United States Patent 11,141,474 (ARTIFICIAL NUCLEIC ACID MOLECULES ENCODING A NOROVIRUS ANTIGEN AND USES THEREOF) - sequence listing, part 15

SEQ ID NO: 32360 - RNA, 1623 nt, Artificial Sequence
  derived and/or modified sequence opt6 from capsid_protein__Norovirus__AAS86780
augaugauggcaucaaaagaugcacccacuucaccugacggagcaucaggagcuggacaacuaguaccagaagcaaauacagcagaacaaauaucuauggacccaguagcuggcgcuucaacagcugucgcuacagcaggacaaguuaauaugauugacccauggauauuuaauaauuuuguacaagcaccacaaggagaauuuacaauauccccaaacaacacaccaggugauauucuauucgaucuacaauuaggcccacauuuaaauccauucuuagcacaucuaagccaaauguauaaugguuggguaggaaauaugagaguuagaauucucuuagccggaaaugcuuuuacagccggcaaaauaauaauuuguugcguaccacccggauuugacgcacguauacuaacaauagcacaagcuacauuauuuccccacuuaauagcugacguucgaacucuagaaccaguugaacuuccucuagaagacguuagaaacguacucuaucacaauucuucacaaccacaaccaacaaugcgacuuguagcaauguuauauacuccacuacgaacaggcgguggaucaggaggaacugaugcauucguugucgcuggaagaguacuaacaugcccagcuccagauuuuucuuucuuauuucuuguaccuccuucaguugaacaaaaaaccagaguauuuucuguuccuaacauaccuuuaaaagaccuaucuaauaguagaguacccguaccuauacaaggaauguuuaugucacccgacgucaaucaaucuguucaauuccaaaacggaagaugucaaaucgauggacaguuacaagguacuacacccguaucauuaucucaauuaugcaaaauaagaggaaaaacaaguaguaaugcaagagucuuaaaucuuucagaaguagauggcacucccuuugucccauuagaaucaccagcaccaguuggcuuuccagaucuuggaggcugugauuggcacguaaauuuuacauuucaagcucaaaaucaagauccaucucaaucuguaacauucgcaacuaaugaugcaaguuucguuccauaucuaggaucuauauccccucauaauggaggagauuuccaugcaggagauaucauuggcucccuaggauggaucucagcaccaagcgauaacacccaacuuaauguguggacaauuccuaaauauggcucaucucuuccugauguaacacaccuagccccugcgguauuucccccuggauucggcgaaguaauauuauauuucuauucaacuuuuccagguucaggacaaccaucucaacuacaaguaccuugccuacuaccccaagaauuuauuacacauuucugcaacgaacaagcaccuauagcaggagaagcagccuuacuucauuauguagauccagacacagguagaaaucuaggagaauuuaaauuauaccccgacggauuuaugacaugcgucccaaauucaguaucaucaggcccucaaacacuaccaauaaaugguguauuuguauucgucucuuggguaagucgauuuuaucaacuaaaaccaguagguacagccucagcagcacgacgauuaggacuacguagaauauaa

SEQ ID NO: 32361 - RNA, 1623 nt, Artificial Sequence
  derived and/or modified sequence opt6 from capsid_protein__Norovirus__AAS86783
augaugauggcaagcaaagaugcacccaccucuccugacggagcaucaggagcuggacaauuaguuccugaagcuaauacagcagaacaaauaucaauggauccaguagcaggagcuucaacagcagucgcuacagcaggucaagucaacaugauagacccauggauuuuuaauaauuucguucaagcaccacaaggugaauuuacaauaucaccaaauaauacaccaggagacauuuuauuugaccuucaacuagguccccaucuaaauccauuucuagcacauuuaucacaaauguauaacggauggguaggaaacaugagaguaagaauuuuacucgcaggcaaugcuuucacugccggcaaaauaauuauauguuguguaccaccuggcuuugaugcacgaauuuuaacaauugcacaagccacuuuauucccacauuuaauagcagauguaagaacccuugaaccaguagaauuaccuuuagaagauguuagaaauguauuauuucacaauuccucccaaccacaaccaacaaugagauuaguagcaauguuauacacaccacucagaacuggugguggaucaggagguacugacgcauuuguaguugcaggaagaguauuaacaugcccugcuccagauuucucauuucuauuucuaguaccaccuucugucgaacaaaaaacacgaguauucucuguuccuaacguaccacuaaaagauuuaucaaacucucgaguucccguaccaauccaaggaauguucaugucaccugacguaaaucaaucaguacaauuucaaaacggcagaugucaaauagauggacaauuacaaggaaccacaccuguuuccuuaucccaacucuguaaaauaagaggaaaaacaucaucaaaugcacgagucuuaaaucuaucagaaguagacgguuccccauucauuccuuuagaaucuccugcaccaguaggauuuccagauuuaggcggaugcgauuggcaugucaauuucacauuucaagcacaagaccaagacccaucccaaucuguaacauuugcaacaaaugacgcauccuuugucccauaucuuggaucuaucucuccacauaauggaggagacuuucauucaggagauauaauaggcucauuagguuggauaucagcuccaucagauucaucacaacuaaauguuuggacuauaccuaaauaugguucaucuuuacccgacgucacucaccuagcuccagcaguauuuccaccuggauuuggagaaguuauauuauacuuuuauucuaccuucccuggauccggacaaccuguacaacuccaaguaccaugucuccuaccacaagaauuuauaacacacuucugcaaugaacaagcaccaauagcaggagaagcugcauuacuacauuauguugauccagauacaggacguaaucuaggagaauuuaagcucuauccugauggauuuaugacauguguaccaaauucaguauccucaggaccacaaacacuaccaauaaacggcgucuucguguucguaucuuggguaucaagauuuuaucaacuaaaaccaguaggaacugcuucagucgcacgaagauuaggacuucguagaauauaa

SEQ ID NO: 32362 - RNA, 1623 nt, Artificial Sequence
  derived and/or modified sequence opt6 from capsid_protein__Norovirus__AAS86786
augaaaauggccucuaaugaugcagcaccaucaaaugacggugcaacuggacuaguaccugaaauuaauaacgaaacuuuaccccuagaacccguagcaggugcugcaauugcugccccuguuaccggucaaaacaauaucaucgacccauggauucgaacaaacuuuguacaagcccccaauggagaauuuacagucucaccaagaaauucacccggagaaauacuauuaaaccuagaauuagguccagaucucaauccauauuuagcucaucuaucucgaauguacaauggauacgccggcggaguugaaguacaaguacuucuagcaggaaacgcauuuacagcuggaaaaaucuuauucgcagcaguaccaccaaacuuuccaguagaauuucuuaguccagcucaaauaacaaugcuaccacaucuaauaguagacguaagaacacucgaaccaauuaugauaccauuaccagauguaagaaauaccuuuuuucacuacaacaaucaacccgcaaaucgaaugagacuaguagcuauguuauacacuccauuaagaucaaauggcuccggugaugauguauuuacaguuucuugccgcguuuuaacuagaccaacaccagauuuugaauuuacauaucuuguuccaccaucaguagaaucaaaaacaaaaccauucucauuacccauacuaacaauaucagaauuaacaaauucaagauuuccagcuccaauugacucccuauuuacagcucaaaauaacaaucuaaacguacaaugccaaaacggaagauguacacuagacggagaauuacaaggaacaacacaacuccuuccuucaggaaucugcgcauuuagagguagacuaacggcagauguagacgguucacaugacgaucgauggcauaugcaacuuacaaauuuaaauggaacaccauuugacccaaccgaagacguaccagcaccucuuggaacacccgauuucacaggauuacuauucggaguugcaucacaaagaaauguaggaucaaauccuaauacaacaagagcacacgaagccguaguaagcacaacaucaucucaauuuguaccaaaacuaggcucaguuaacuuuggaucaacaucaacagacuuccaauuacaacaaccaacuaaauucacuccaguaggaauaaaaauagaauccggucacgaauucgaccaaugggcucuuccacgauauucaggucacuuaacacucaacaugaacuuagccccaccaauagcacccaacuuccccggcgaacaacuucuauucuuuagaucaaacguuccaugcgcagguggcguaucagacggcguaauagauugcuuacuaccccaagaauggauacaacacuuuuaccaagaaucagcuccuucucaaucagacguagccuuaaucagauacguaaacccagauacuggccgaacacuauucgaagcaaagcuccauagaacuggauauauaacaguagcucauucaggcgauuauccacuaguuguaccaagcaauggcuauuucagauuugauucaugggucaaucaauuuuacucacucgcaccaaugggaacuggcaauggaagaagacgaguccaauaa

SEQ ID NO: 32363 - RNA, 1623 nt, Artificial Sequence
  derived and/or modified sequence opt6 from capsid_protein__Norovirus__AAS86792
augaaaauggcaucaaacgaugccgcucccucaaaugacggagcagcaggucuaguccccgaagucaacaacgaaacaauggcuuuagaacccguagcaggagcaucuaucgcagcaccauuaacuggacaaaacaauguaauagaccccuggaucagauuaaauuuuguacaagccccaaacggagaauucacuguaucaccacgaaacucaccaggugaaauccuacuuaaccuugaauuaggucccgaacuaaaucccuauuuagcucaucucgcucgaauguauaauggauaugcaggaggaguugaaguacaaguauuauuagcuggcaacgcauucacugcaggaaaauuaguuuuugcagcuauaccaccacacuucccaguagacaaccuaucaccaggacaaauaaccauguucccccaugucauaauagauguaagaacucuagaacccguauuauuaccccuaccugacgugcgaaauaacuuuuuccauuauaaccaacaaucagaucaacgaaugagacucauugcuaugcuuuacacaccacuccgaucaaacggaucuggugaugacguauucacaguaucaugccgaguacuaacaagaccaucaccugacuucgauuuuaauuacuuaguaccaccaacaguagaaucaaaaacaaaacccuucucaguaccuguacuaacacuaaacgaauuaacaaauaguagauuuccaguaccaauugaugcaauguacacaucaccuaacgauucaauaguaguacaaccacaaaauggaagagcuacuauagacggcgaacuccuaggaacaacacaacucauacccuccggaauauguucauuccguggaaaaaucacaacccauuuaucagacgaucgacaccucuggaacguucaaguaucuaaucucaacggaacuccauuugauccaacugacgacguaccagccccauuaggaaugccagacuuuuccggucaaauauuugguguaguaucacaacgcgacacaggaacuaacccagccaaccgagcacaugaugcaguacuagcaacauauucugcaaaauauacacccaaacuaggauccguacaaauaggaaccugggacacugaagaucuacucgaaagacaaccaguaaaauuuacacccguaggacuaaacgaaauaggacaagauaaacauuucgaucaauggguauuacccaauuauucaggcgcccuaggauuaaacaugcaucuagcucccgcaguaucaccucuuuucccuggugaaagacuauuauuuuucagaucuuauauaccacuaaaaggaggacacggagauccauucauugacugccuaguaccccaagaauggauacaacauuuuuaccaagaaucagcaccagcacaaucaucugucgcucuacuuagauaugucaaccccgacaccggaagaacccucuuugaagcuaaacuacauaaagaaggauuuauaacuguaucaucaacagaaaaccgaccaguuauaguucccccaaaugguuauuuuagauuugauucguggguaaaucaauuuuacucacuagcaccaauggguaccgguaacggaagaagaagaaugcaauaa

SEQ ID NO: 32364 - RNA, 1623 nt, Artificial Sequence
  derived and/or modified sequence opt6 from capsid_protein__Norovirus__AAS86795
augaaaauggcaucaaaugaugcugcaccaagcaaugauggagcagcaggacuaguaccagaaguaaacaaugaaacaauggccuuagaaccaguagcaggcgcaucaaucgcagcuccacuuacaggacagaacaacguaauagacccuuggauacgucuuaauuuuguucaagcaccaaacggcgaauuuacaguaucaccucgaaauucacccggugaaauacuuuuaaaccuugaacuaggaccagaauuaaacccuuaucuagcacaucuugcaagaauguauaauggcuaugcaggaggaguggagguacaaguccuauuagcaggaaaugcauuuacagccggcaaacuaguauuugcugccauuccuccucauuucccaguagauaacuuauccccaggacaaauuaccauguucccacauguaauuaucgacguacgaacacuagaaccuguacuacuaccuuuaccagauguacgaaauaauuuuuuccauuauaaucaacaaucagaccaacgaaugcgucuaguagcuauguuauacacaccuuuaagaucuaaugguuccggagaugauguuuuuacaguauccugcagaguuuuaacacgcccaucaccagauuucgacuuuaauuaccuuguaccucccacaguugaaucgaaaacaaaaccauuuucaguacccguauuaacacuaaaugaacuaaccaauucaagauucccagucccaauugacgcuauguauacaucaccuaacgauucaauagucguacagccacaaaauggaagagcaacaauagacggugagcucuuaggaacaacacaacuuauaccaucaggaauauguucauuuagagguaaaauuacaacacaucuaucagacgauagacaccuuuggaacauacaaguuucaaaucuaaauggaacaccauucgauccaacagaugacguuccagcuccauuagguaugccagacuuuucuggacaaauauuuggaguaguaucacaaagagauacuggaaccaauccagcaaacagagcacaugaugcaguacuagcaacauacucagcuaaauauacucccaaauuaggcucaguacaaauaggaacaugggauacugaggaucuacuagaacgacaaccaguaaaauucacuccaguagguuugaaugaaauuggacaagauaaacauuuugaccaauggguauuaccuaauuauucuggugcacuaggacuuaauaugcauuuagcuccagcaguauccccucuauuuccuggagaaagacuacuauuuuuuagaucauacaucccuuuaaaaggcggccacggagaccccuuuauagacugccuaguaccacaagaauggauucaacacuuuuaucaagaaucagcuccagcacaaagcucuguagcucuauuacguuacgucaauccagacacaggucgaacauuauuugaagccaaacugcauaaagaaggcuuuauaaccguaucaucaaccgaaaaucgacccgucauuguaccuccaaauggauauuuucgcuuugauucuuggguuaaucaauuuuacucauuagcaccaaugggaacaggaaacgguagacgaagaaugcaauaa

SEQ ID NO: 32365 - RNA, 1623 nt, Artificial Sequence
  derived and/or modified sequence opt6 from capsid_protein__Norovirus__AAS86798
augaaaauggcaucaaaugaugcagcaccaucuaacgauggcgccgcaggacuuguaccagaaguaaauaacgaaacuauggcauuagaaccaguagcaggagcaaguauagcugcaccauuaaccggacaaaauaacgucaucgauccauggauaagauuaaauuuuguacaagcuccaaauggagaauucacaguaucaccacgaaauucaccaggagaaauauuacuaaaucucgaacuagggcccgaauuaaauccauacuuagcacaucuagcaagaauguauaaugguuaugcaggcggagucgaaguacaaguacuauuagcuggaaacgcauucaccgcagguaaacuaguuuuugcagcaauaccaccacauuuuccaguagauaaccuuucaccaggacaaauaacaauguuuccacacgucauaauagacgucagaacccuugaacccguucuauuaccauuaccagacguacgaaauaauuucuuucacuacucucaacaaagcgaucaaagaaugagauuagucgcaauguuauauacaccauuaagaucaaauggaucuggcgacgacguuuuuacaguuucauguagaguauuaacuagacccucaccagauuucgauuucaauuauuuaguacccccaacuguagaaucaaaaacaaaaccauuuucagucccaguacuuacucucaaugaauuaacaaauucaagauucccaguuccuauagaugccauguauacaucacccaacgauuccauaguaguacaaccacaaaauggaagagcaacaauugauggcgaacuauuaggcaccacccaacucauacccucaggaaucugcucuuuuagaggcaaaauaacuacacaccucucagacgaucgucauuuauggaauauacaaguauccaaccuaaauggcaccccauucgacccuaccgaugacgucccagccccccuaggaaugccagauuucucaggccaaauauuuggagugguuucucaacgagauacaggaacaaacccagcaaauagagcccacgaugcaguauuagcuacauacucagccaaauacacaccaaaacuaggaucuguacaaauaggcacaugggauacagaagacuuauuagaaagacaaccaguaaaauucacucccguaggauuaaacgaaauaggacaagauaaacacuucgaucaauggguucuaccaaacuacuccggagcacuaggauuaaauaugcaucuagcaccagcaguuaguccauuauucccuggagaaagauuauuauuuuuuagaucauauauaccacuaaaaggaggacauggagacccauuuauagacugccuugugccacaagaauggauccaacacuuuuaucaagaaucugcaccugcccaaucaucgguagcucuauuaagauauguaaauccagacaccgguagaacauuauuugaagcaaaauuacauaaagaaggauuuauaacaguaucaucaacagaaaaccgccccguuauagucccaccaaacggauauuuuagauucgauucauggguaaaccaauuuuacucacuugcaccaaugggcacagguaaugguagacguagaaugcaauaa

SEQ ID NO: 32366 - RNA, 1623 nt, Artificial Sequence
  derived and/or modified sequence opt6 from capsid_protein__Norovirus__AAS86801
augaaaauggcaucaaaugacgcagcuccaucuaaugauggagcagcuggacuagucccagaaguaaauaacgaaacaauggcacuagaaccuguagcaggagcaucuauagcagcaccauuaacaggacaaaauaauguaauugaucccuggauacgauuaaauuuuguucaagcaccaaauggcgaauucacuguuuccccucgaaacucaccuggcgaaauauuauuaaaccuagaacuaggaccagaauuaaaccccuaccuagcacauuuagccagaauguauaauggauaugcaggaggcguagaaguucaaguucuauuagcaggaaacgcuuuuacagcaggaaaacuaguuuuugcagcuaucccuccacacuuucccguagauaaucuauccccaggacaaauaacuauguuuccacauguuauaauagacgucagaacauuagaacccguacuauuaccuuuaccugaugucagaaacaacuuuuuucauuauaaucaacaaucugaccaacgaaugcgauuaguagccauguuauauacuccuuuaagaucuaacggauccggagaugacguuuucacaguauccugccgaguucuaacuagaccaucaccagauuuugauuucaacuacuuaguaccaccuacaguagaauccaaaacuaaaccauucuccguccccguuuuaacauuaaaugaauuaacaaacuccagauuccccguaccaauagacgcaauguacacaucaccaaaugauucuauugucguacaaccacaaaauggacgagcaaccauugauggugaauuacuaggcaccacacaauuaauaccauccggaauauguucuuucagaggaaaaaucacuacccaucuaucagaugauagacacuuauggaauauacaaguaucuaaucuaaauggcacaccauuugauccaacagaugacguacccgcuccuuuagguaugcccgacuuuucuggccaaaucuuuggaguaguaucacaacgugauacaggaacaaacccagcaaaucgcgcccaugaugcaguacuagcaacauauuccgccaaauacacaccuaaacuaggaucaguucaaauaggaaccugggacacugaagaccuauuagaacgacaaccaguaaaauuuacaccagucggauuaaacgaaauaggacaagacaaacauuucgaucaaugggugcuuccaaacuacucaggagcccuaggauuaaacaugcaucuagcaccugcaguaaguccauuauucccuggagaaagauuacuauuuuuucgaucauauauaccauuaaaaggaggacauggugauccuuucauagacugccuuguaccacaagaauggauacaacacuuuuaucaagaaucugccccagcccaaucaucagucgcucuauuaagauauguaaauccagauacaggccgaacccuauuugaggcuaaauuacacaaagaaggauucauuacaguauccucaacugaaaaucgaccaguuauaguacccccuaaugguuauuuuagauuugauucauggguaaaccaauuuuauucccuagcaccaauggguacaggcaacggaagaagacgaaugcaauaa

SEQ ID NO: 32367 - RNA, 1623 nt, Artificial Sequence
  derived and/or modified sequence opt6 from capsid_protein__Norovirus__AAS86804
augaaaauggcaucuaaugacgcagcaccaucaaacgauggagcagccgguuuaguuccagaaguuaauaacgaaacaauggccuuagaaccuguagcuggagcauccauugcagcaccauuaacaggacaaaauaacguaauagaucccuggauuagacucaauuucguucaagcuccaaauggagaauucacuguaagccccagaaacuccccaggagaaguacuacuaaauuuagaacuuggaccagaacucaauccauauuuagcacacuuaucacgaauguacaaugguuaugccggaggaguugaaguacaaguacuauuagcuggaaacgccuucacugcaggaaaauuaguauucgcagcaauucccccacauuucccuguagacaaucuaucccccggacaaauaaccauguuuccacauguaauuauagauguacgcacacuagaacccgucuuacucccucuaccagacguaagaaauaauuuuuuccacuauaaucaacaaucagaccaacguaugagacuaauagcaaugcuauauacaccauuaagaucaaacgggucuggugaugauguauucacagucucuugucguguuuuaacaagacccucaccagauuuugacuuuaacuaucuagucccaccuacuguagaaucaaaaacaaagccauuuucaguucccguccuaacacuaaaugaauuaaccaauaguagauucccaguaccaauugaugcaauguacacuucaccuaacgacuccguaguaguucaaccucaaaauggaagagcaacuauagacggagaacuacuaggaacaacacaacuaauaccaucuggaauauguucuuuccgcgguaaaauaaccacacauuuauccgacgauaggcacuuauggaacauacaaguaagcaaucuaaauggaaccccauucgacccaacagacgauguaccagcaccccuaggcaugccugauuuuucuggccaaauauucggaguaauaucccaacgagacacuggaacaaacccagcaaauagagcacaugaugcaguuuuagcaacuuacucagccaaauauacacccaaauuaggaucuguucaaauugguacaugggacacagaagaucuacuagaaagacaaccuguaaaauuuacaccaguuggauuaaacgaaauaggacaagauaaacacuuugaucaauggguauuaccaaauuauuccggagcacuaggucuaaauaugcauuuagcuccugcuguaucuccacuauuucccggagaaagacuauuauucuuucgauccuauauaccacuaaaaggaggacaugggaauccuuucauagacuguuuaguaccucaagaauggauacaacauuuuuaucaagaaucagcaccagcacaaucaucaguagcauuacuuagauauguaaauccagauacaggcagaacauuauuugaagcaaaacuacacaaagaagguuucauaacaguaucuucaacagaaaauagaccagucauagugccaccaaaugguuacuucagauuugauuccugggucaaccaauucuacucacuagcaccaaugggaacaggaaaugguagaagaagaaugcaauaa

SEQ ID NO: 32368 - RNA, 1593 nt, Artificial Sequence
  derived and/or modified sequence opt6 from capsid_protein__Norovirus__AAS86807
augaugauggcaucaaaagaugcaacaucuaauguagacggagcaucuggagcaggacaauuaguacccgaagcuaauacaucagauccauuagcaauggacccaguagcuggaucaucaacagcaguagccaccgcuggacaaguaaaucccaucgaccccuggauaaucaauaauuuuguccaagcaccacaaggcgaauuuacuauaucaccaaacaauacuccaggagacguacuauuugaccuuucauuaggaccccaccucaacccauucuuauuacaccuuucacaaauguacaacggauggguaggcaauaugagaguaagaauaauguuagcagggaaugccuuuacagcaggaaaaauuauagucucaugcauacccccaggauucggcucucauaaucuaacaauagcacaauccacccuauucccacacguaauagcugauguccgaacucuagauccaauagaaguaccacuagaagauguaagaaacguauuauuccauaauaaugaucgaaaucaacaaacaaugcguuuaguauguauguuauacacaccuuuacgaacgggaggaggcacaggagacagcuucguuguugcagguagaguaaugacuugcccaucaccagacuuuaacuuucuauuucuuguaccaccuacaguagaacaaaaaacacgaccauucacuuuaccaaacuuaccuuuauccucauuaaguaauucucgagcaccuuuaccaauaucaaguaugggaauaucuccagauaauguucaaucuguacaauuccaaaacgggagaugcacacuugaugguagauuaguaggaaccacaccaguaucacuaucacaaguagcuaaaauaagaggaacaucuaacgguacugucauaaauuuaacugaauuagacgguacuccauuccauccauuugaaggaccagcuccaaucggauuuccagauuuaggaggcugcgauuggcacgucaauaugacacaauucggucauucaagucaaacccaauucgacgucgacacaacaccagaaacauuuguaccacaucuaggcucaauucaagcuaauggaguuggaucaggaaauuacauaggaguccuaucauggauaaguccaccaucacaccccucagguucucaaguagaucuauggaaaauaccaaacuacggaucaucaauaacugaagcaacacaucuugcaccuucuguauuuccaccaggauucggagaaguauuaguuuuuuucaugucaaaaauaccaggacccggugcauauaauuuaccaugucuccuuccacaagaauacauaucucacuucgccagcgaacaagcacccacagucggagaagcagcauuacuucauuauguugauccagacacaggaagaaaucuaggagaauucaaagcauauccagacggauuccucaccuguguaccaaauggagcaucaucuggaccacaacaacuaccaauaaauggaguauuugucuucguauccuggguaucacgauucuaccaauuaaaaccaguaggaacagcaucuuccgcuagaggaagauuaggauuacgcagauaa

SEQ ID NO: 32369 - RNA, 1623 nt, Artificial Sequence
  derived and/or modified sequence opt6 from capsid_protein__Norovirus__AAT00237
augaaaauggcaucaaaugacgccaacccuagcgacggauccacagccaaccuuguaccugaaguaaauaaugaaguaauggcccuagaaccaguagucggagcugcuauagcugcaccagucgcaggccaacaaaauguaauugauccauggauacguaauaauuucguucaagccccaggaggagaauuuacaguauccccaagaaaugcucccggagaaauauuauggagugcaccacuagguccagaucuuaacccauaccuaucucacuuagccagaauguacaauggauaugcaggaggauucgaaguccaaguuauacuugcuggcaaugccuuuacagcaggaaaaauaauauucgccgcaguaccuccuaacuuuccaacagaaggauuaucaccaucacaaguaacaauguuuccacauauaaucguagauguuagacaacuagaaccaguauuaauacccuuaccagacguaagaaacaauuuuuaucacuacaaucaaucaaaugaccccacaauaaaacuuauagcaauguuauacacgccuuuacgagccaauaaugccggagaagacguuuuuacaguauccugcagaguauuaaccagacccuccccagacuucgauuuuauauuucuaguaccaccuacaguugaaucaagaacuaagcccuucacuguaccaauacuuacaguagaagaaaugaccaacucaagauucccaauacccuuagaaaaauuauuuacaggcccaucaggagcauucguaguucaaccccaaaacggaagauguacuaccgacggaguuuuacuagguaccacacaacuaucacccgucaauaucugugcauuuagaggagauguuacucauauagcuggaacacauaacuacacaaugaaccuagcuagccaaaauuggaacaacuacgauccaacagaagaaauaccagcaccucuugguaccccagacuucguagguagaauacaaggaaugcuuacacaaacaacaagaggagauggauccacaagaggucacaaagcuacaguaucuaccggagauguucacuuuacuccuaaacuaggcuccauacaauuuaacacagauacaaacaacgauuuugaaacaggacaaaauacaaaauucacacccguugguguaguacaagacggaaacggcacacaccaaaacgaaccacaacaauggguacucccuucauacucaggaagaaccggacacaacguacacuuagcucccgcaguagccccaacuuuuccaggugaacaacucuuauucuuuagaaguacaaugccaggaugcucaggauauccaaauaugaaccuagauuguuuacuaccacaagaauggguacaacacuucuaucaagaagcagcaccugcucaaucagaugucgcauuauuacguuuuguaaacccagauaccggacgaguauuauucgaaugcaaauuacauaaaucagguuauguaacaguagcucauacuggacaacacgaccuaguaauuccuccaaauggauauuucagauuugacucauggguuaaccaauucuauacacuagccccaaugggaaauggaacaggaagaagaagagcacuauaa

SEQ ID NO: 32370 - RNA, 1623 nt, Artificial Sequence
  derived and/or modified sequence opt6 from capsid_protein__Norovirus__AAT00240
augaaaauggccucaaaugaugcuaauccuucugacgguucuaccgcaaaucuaguaccugaaguaaauaaugaaguaauggcauuagaaccuguaguaggagcugcuauagcagcaccaguagcaggccaacaaaauguaauagacccuuggauacguaacaacuuuguucaagcuccuggaggcgaauucacuguuaguccaagaaacgccccaggagaaaucuuaugguccgcaccauuaggaccagauuuaaacccauauuuaucacaucuagcacguauguauaaugguuaugcaggaggcuuugaaguccaaguaauacuagcagguaacgccuuuacugccggcaaaauuauauuugcugcuguuccuccgaauuuuccaacagaaggacuaucaccuucacaaguaacuauguuuccucauauaauaguagauguccgccaacucgaaccaguauuaauaccauuaccugauguacgaaauaacuuuuaucauuauaaucaaucaaacgauccuacaauaaaauuaaucgcaauguuauauacaccacuaagagcaaauaacgcuggagaagauguauucacuguaaguuguagaguauuaacucgaccaucuccugacuucgacuuuaucuuucuaguaccaccaacaguagaaucaagaacaaaaccauucacuguaccaauauuaacuguagaagaaaugacaaacuccagauuucccauaccacuagaaaaauuauucacugguccaucaggcgcuuuuguaguacaaccacaaaauggaagauguacuacagauggaguguuauuagguacuacacaacuuucaccaguuaauauaugugcauuuagaggagauguaacacauauagcaggaacacauaauuauacuaugaaucuugcaucccaaaauuggaauaauuaugacccaacagaagaaaucccagcuccacuaggaacuccagauuucguaggaagaauacaaggaauguuaacacaaacaacacgaggagauggaucuacaagaggccauaaagccacaguuucgacaggagauguucauuuuacaccaaaguuaggcucaauacaauuuaacacagauacaaacaaugacuuugaaacaggucaaaauacaaaauuuaccccugucggcguaguacaagacggaaaugguacacaccaaaacgaaccucaacaguggguauuacccucauauucugguagaacaggacauaauguacauuuagcuccugcuguagccccaacuuuuccuggugaacaacuauuauuuuuucgauccacuaugccaggauguuccggauauccuaacaugaauuuagacuguuuauuaccucaagaauggguacaacacuuuuaucaagaagcggcaccugcccaaucagacguagcacuauuaagauucguaaauccagacacugguagaguauuauucgaaugcaaacuacauaaguccggauacguaacaguagcucauacaggacaacacgaucuaguaauaccuccaaacggauauuuuagauuugauucauggguuaaccaauuuuauacuuuagcaccuauggguaaugguaccggacgacguagagcucuauaa

SEQ ID NO: 32371 - RNA, 1623 nt, Artificial Sequence
  derived and/or modified sequence opt6 from capsid_protein__Norovirus__AAT00243
augaaaauggcuucaaaugacgcuaaccccucagauggaucaacagcaaaucuaguaccugaaguaaacaaugaaguaauggcccuagaacccguuguaggugcagccauagcagcaccaguagcuggucaacaaaauguaauagauccauggauacgaaacaauuuuguacaagcaccaggaggagaauuuacaguaucuccaagaaacgcaccaggcgaaauauuaugguccgcaccucuaggaccagaccuuaauccauaccuaucacacuuagcuagaauguauaauggcuacgcaggcggcuucgaaguacaagucauauuagcaggaaacgcauuuaccgcugguaaaauaaucuucgccgcuguacccccaaacuuuccaacagaaggauuaucucccucacaaguaaccauguuuccacacauaauaguugauguaagacaacuugaaccaguuuuaauaccuuuaccugauguaagaaauaacuucuaucacuacaaccaaucaaaugaucccacaauaaaauuaauagcuaugcuauacacaccucuaagagcaaauaaugcuggagaagacguauuuacuguaucaugucgaguacucacaagaccuucaccagauuucgauuuuauauuuuuaguuccaccuacuguggaaucaagaacaaaaccauuuacuguaccaauauuaacagucgaagaaaugacuaacucaagauuuccaauaccacuugaaaaacuauuuacagguccaucaggagcauucguuguacaaccacaaaacggaagauguaccaccgacggagucuuacucgguacaacucaauuaucaccaguaaacauaugugcuuucagaggugacguaacacauauagcaggaacacauaauuacacuaugaaucuagcaucacaaaacuggaauaacuacgauccaacugaagaaauaccugccccacuaggaaccccagacuuuguaggacgcauucaaggaauguuaacccaaacaaccagaggcgacggaucgacucgcggacacaaagcaacugucucuacaggagauguacacuuuacaccuaaauuaggaucaauacaauucaauacagauaccaauaaugauuuugaaacaggacaaaauacuaaauucacaccggucggcguaguccaagauggcaacggcacucaucaaaaugaaccacaacaauggguauuaccaucauauucaggacgaacugggcauaauguacaccuagcaccugcuguagcaccuacauuuccaggagaacaauuacuuuucuuuagauccacaaugccaggcuguucaggauauccaaauaugaauuuagauugccuacuaccacaagaauggguacaacauuuuuaucaagaagcugcaccagcacaaucagauguagcacuuuuaagauuuguaaauccagauacuggaagaguacuuuuugaauguaaauugcauaaaucaggauacguaacaguagcacauacaggacaacacgaucuaguuauaccaccaaauggauauuuccgauucgacucuuggguaaaucaauucuacacccucgcaccaaugggaaacgguacaggacgacgucgugcauuauaa

SEQ ID NO: 32372 - RNA, 1623 nt, Artificial Sequence
  derived and/or modified sequence opt6 from capsid_protein__Norovirus__AAT00246
augaaaauggcuuccaacgacgcaaauccaucagacgguucaacagcaaaccuagucccugaaguaaacaacgaaguuauggcacuugaaccaguuguaggagcagcaaucgcagcaccaguagcaggccaacaaaaugucaucgacccauggauacgcaauaacuucguccaagccccaggaggagaauucacaguaucaccaagaaacgcaccaggagaaauuuuauggucagcuccauuaggcccagaucuuaaucccuacuuaucacauuuagcuagaauguauaauggcuacgcaggaggauuugaaguucaaguaauacucgcaggcaacgcuuuuacagccggaaaaauaauauuugcugcagucccaccaaauuucccaacugaaggguuaucacccucacaaguaacaauguucccacacauaauaguagacguacgucaacuagaacccguauuaauaccacuaccagauguaagaaauaauuucuaccacuauaaccaaucuaaugacccaaccaucaaacucauagcaauguuauauacaccuuuaagagcuaauaaugcaggugaagauguauuuacaguauccugccgaguauuaacucgaccuucaccagauuuugauuucauauuucuaguaccacccacaguagaaucacgaacuaaacccuuuacuguaccaauauuaacugucgaagaaaugacaaacucuagauuuccaauaccauuagaaaaauuauuuaccggaccaucaggcgcauuuguaguacaaccacaaaauggaagauguacuacugauggagucuuacuugguacaacucaacuaucaccaguaaacaucugcgccuucagaggagauguaacacauauugcaggaacucacaacuauacuaugaaucuagccucacaaaacuggaacaauuacgauccuacagaagaaaucccugcaccacucgguacuccagauuuuguaggacgaauacaaggaauguuaacucaaacuaccagaggagaugguucaacacgaggacacaaagcaacaguaucaacaggugauguacauuucacaccaaaauuaggaucuauacaauucaauacagauaccaauaacgacuuugaaacaggacaaaauaccaaauuuacaccaguuggcguaguacaagacggcaacggaacacaucaaaaugaaccucaacaauggguacuaccaucuuauuccggaagaacaggccauaauguacacuuagcacccgcaguagcaccuaccuuccccggugaacaacuacuuuucuuucgaucaacaaugccagguugcucaggauacccaaauaugaaucuugauugccuuuuaccucaagaauggguucaacauuuuuaucaagaagcagcaccagcacaauccgauguagccuuauuaagauucguaaauccagauacaggaagaguacuauucgaauguaaacuacauaaaucaggcuauguuacaguagcacacacaggacaacaugacuuaguaaucccaccaaauggcuauuuccgcuuugauucauggguaaaucaauuuuacacacucgcaccaaugggaaaugguacuggcagaagaagagcacuuuaa

SEQ ID NO: 32373 - RNA, 1623 nt, Artificial Sequence
  derived and/or modified sequence opt6 from capsid_protein__Norovirus__AAT00249
augaaaauggcaucaaacgaugcaaaucccagugauggaaguacagcuaaccuaguaccagaaguuaacaacgaagucauggccuuagaaccaguaguaggagcagcaauagcagcaccaguagcaggucaacaaaaugucauagauccuuggauaagaaauaacuuuguacaagcccccggaggagaauucaccguaucaccaagaaacgcaccaggcgaaauacuauggucagcaccauuaggacccgauuuaaauccauaucuaucucauuuagcacgaauguauaaugguuaugcuggcggauucgaaguccaaguaauucuagcaggaaacgcauucacagccgguaaaauaauauucgcagcaguaccaccaaacuuucccacagaaggacuaucucccucucaaguuacaauguucccucauauaauaguagacguacgucaacuagaaccaguacuuauaccacuaccagacguuagaaacaauuucuaucauuacaaccaaucaaaugaucccaccauaaaacuaauagcaaugcuauauacaccacucagagccaauaaugcuggagaagauguuuuuacaguaucauguagaguacuuacaagaccaucaccagauuuugauuuuauauuccuaguaccaccuaccguugaaucaagaacaaaaccauuuaccguaccaauauuaacaguagaagaaaugacaaacucuagauuccccauaccacuagaaaaacucuuuacaggaccaucaggagcauuuguaguacaaccccaaaauggacgauguacaacugauggaguacuucuaggaacaacucaauuaucacccguaaauaucugugccuuuagaggagacguaacgcacauagcaggaacccacaacuacacaaugaaccuugcaucacaaaacuggaacaauuaugaccccacugaagaaaucccagcaccccuagguacacccgauuuugucgguagaauacaagguaugcucacacaaacaacacgaggagacggcuccacacgaggacacaaagcaacaguuuccacaggcgacguacacuuuacaccaaaacuaggaucuauacaauucaauacagauacaaauaacgauuucgaaaccggucaaaauacgaaauuuacaccuguuggcguaguacaagauggaaacggaacacaucaaaaugaaccccaacaauggguauugccaucauauucaggaagaacaggucauaauguacaucuagcacccgcaguagcuccuacauucccuggagaacaacuauuauucuuccgaucaacaaugccaggaugcucagguuauccaaauaugaaucuagauugcuuacucccucaagaauggguacaacacuucuaccaagaagcugcaccagcccaauccgacguagcacuacuaagauucguaaauccagauaccggaagaguccuauuugaauguaaacuacacaaaacugguuacguaacagucgcacacaccggacaacacgaucuaguaauacccccaaauggauacuucagauuugauucauggguaaaucaauuuuauacauuagcuccaaugggaaauggaacugguagacgucgagcauuauaa

SEQ ID NO: 32374 - RNA, 1623 nt, Artificial Sequence
  derived and/or modified sequence opt6 from capsid_protein__Norovirus__AAT00255
augaaaauggcaagcaaugaugcaaauccaucugauggauccacagcuaaccucguaccugaaguaaacaacgaaguuauggcccuugagccaguugucggcgccgccauugcagcaccaguugcaggacaacaaaauguaauagauccuuggauucguaacaacuucguccaagccccagguggagaauuuaccguaucaccaagaaaugcuccaggagaaauacuauggucagcaccuuuagggccugaucuaaacccauaccuaucucacuuagcuagaauguauaacggauaugcaggugguuuugaaguacaagucauacuagcuggaaaugcauuuacagcagguaaaaucauauuugcagcuguaccucccaauuuuccaacagaaggacuauccccaucacaaguaacaauguuuccacacauuauaguagacguacgacaauuagaaccugucuuaauuccacuaccagauguaagaaacaauuuuuaucacuauaaccaauccaacgauccaacaauuaaauuaauagcuaugcuuuauacaccuuuaagagccaauaacgccggagaagauguauucacuguaucaugcagaguacuuacaagaccaucuccagauuuugacuuuauauuucucguucccccuacaguagaaucaagaacaaaaccuuucacugucccaauucuuacaguagaagaaaugacaaauucaagauucccaauuccuuuagaaaaacuauuuacuggaccaucaggagcauucguaguacaaccacaaaacggcagaugcacaacagacgguguauuauuaggaacaacacaauuaagcccaguaaauauaugcacauucagaggagauguaacacauauagcuggaacacauaacuacaccaugaaucuagcaucccaaaacuggaauaauuacgacccaacugaagaaauacccgcaccauuagguacaccugacuuuguaggaagaauacaaggaaugcuaacucaaacaacacgaggcgauggaucaacgcguggccacaaagcaaccgucucaacaggagauguacacuucacaccaaaacucggaucaauucaauucaacacugauacuaacaacgacuuugaaacaggccaaaacacaagauucacaccaguaggaguaguacaagauggaaacgguacacaucaaaacgaaccacaacaauggguuuuaccuucuuauucaggaagaacaggacauaacguacaucuagcaccagcaguagcaccaacauuuccaggagaacaacuuuuauuuuuccguucaacaaugccaggauguuccggauaucccaauaugaaccuugauugucuauuaccccaagaauggguucaacauuucuaccaagaagcugcuccagcacaaagugacguugcguuacuuagguuugucaacccagacacaggaagaguauuguucgaaugcaaacugcauaaaagcggauacgucacaguugcccacacaggacaacaugacuuaguaauuccuccuaauggauauuucagauucgacucaugggucaaucaauucuacaccuuagcaccuaugggcaauggaacaggaagacgaagagcacuuuaa

SEQ ID NO: 32375 - RNA, 1623 nt, Artificial Sequence
  derived and/or modified sequence opt6 from capsid_protein__Norovirus__AAT00258
augaaaauggcuagcaaugaugcaaaccccuccgacggcucaaccgccaaccuaguaccagaaguuaacaacgaaguaauggcucuagaaccagucgucggcgcagcaauagcagcaccaguagccggacaacaaaaugucauagauccuuggauuagaaacaauuuuguucaggcaccaggcggagaauuuacaguaucaccaagaaaugcaccaggugaaauccucuggucugcaccuuuaggaccugaccuaaauccauaucuaucacacuuagcccgcauguauaacggauacgcaggagguuucgaaguacaaguaauauuagcaggaaaugcauuuacugcaggaaaaauaaucuucgcugcaguuccuccaaauuuuccaacagaaggacuaucuccaucacaaguuacaauguucccucacauaauaguagauguaagacaacuagaaccaguacuaauuccauuaccagacgucagaaacaacuucuaccacuauaaucaaucuaaugaccccacaauaaaauuaauagcaauguuauacacaccccuaagagcuaacaacgccggagaagauguauuuacaguaucauguagaguuuuaacaagaccuucuccagauuuugauuuuauauuuuugguccccccaacaguagaaucaagaacaaaaccauucacuguaccaaucuuaaccguugaagaaaugacaaauucacgcuuuccaauaccacuugaaaaacuauuuacugguccaucuggagcauuuguuguacaaccacaaaacggcagauguacaacagacgguguacuauuagguacaacacaauuaucaccaguuaauauauguacauuuagaggagacguuacacacauugcuggaacacacaauuacacaaugaaucuagcaucacagaacuggaauaauuacgaccccacagaagaaauacccgcaccacuagguacccccgacuuuguagguagaauacaaggaaugcuaacccaaacaacacggggagauggcuccacacguggucacaaagcuacaguauccacaggagacguucauuuuacuccuaaacuaggaucaauacaauucaacacugauacaaacaaugauuucgaaaccggacaaaauacuagauucacacccguaggagucguccaagacggaaacggaacacaccagaacgaaccacaacaauggguacuaccaucauauucaggacgcaccggacauaacguacaucuagcaccugcaguagcuccuacuuuuccaggagaacaacuauuauuuuuccgauccaccaugccaggaugcucaggauauccaaauaugaaucuugacuguuuacuaccacaagaauggguacaacacuuuuaucaagaagcagcaccagcacaaucagaugucgcacuacucagauucguuaauccagauacaggaagaguauuauucgaaugcaaauuacauaaaucaggauauguuacaguagcucauacuggccaacacgaucuagucauaccacccaacggauauuucagauucgauucauggguaaaucaauuuuacacuuuagcaccaaugggaaauggaacaggcagaagacgagcauuauaa

SEQ ID NO: 32376 - RNA, 1623 nt, Artificial Sequence
  derived and/or modified sequence opt6 from capsid_protein__Norovirus__AAT00261
augaaaauggccucaaaugaugccaacccuucagauggcucaacagcaaacuuaguaccagaaguaaacaacgaaguuauggcacuagaaccaguagucggugcugcuauagcagcaccaguagcaggacaacaaaauguaauugacccauggauacguaauaauuuuguacaagccccaggaggagaauuuacugucagcccucgaaaugcccccggagaaauacuauggucagcaccacuaggaccagaucuaaacccauaccuaucacacuuagccagaauguauaaugguuacgccggaggauucgaaguacaaguaauauuagccgguaaugcuuuuacagcaggcaaaauaauauucgcagcaguaccaccuaacuucccuaccgaaggauuaucuccaucacaaguuacgauguucccacacauaauuguagacguacgccaacuagaaccaguacuuauaccuuugccagauguccguaacaacuuuuaccauuauaaccaaucaaaugauccaacaauaaaauuaauagcaaugcuguacacacccuuaagagcaaacaacgcaggagaagacguauucaccguaucaugcagggucuuaacaagaccaucaccagauuuugacuuuauauucuuaguuccaccaacaguugaaucaagaacuaaaccuuuuacaguaccaauuuuaacaguagaagaaaugacaaauucaagauuuccaauacccuuagaaaaauuauucacuggaccaucuggagcauuuguuguacaaccacaaaacggaagauguacaacagacggaguacuucuaggaacaacacaacucucaccaguaaauauuugcacuuuuagaggagacgucacccauauagccggaacucacaauuacacaaugaaccucgcaucucaaaauuggaacaauuacgacccaacagaagaaaucccagcacccuuagguacaccugacuuuguaggaagaauccaaggaaugcuaacccaaaccacaagaggagauggauccacaagaggccauaaagcaacaguaucuacuggagacguucacuuuacuccaaaauuaggcucuauacaauuuaacaccgauacaaauaaugauuucgaaacaggccaaaauacuagauucacaccuguuggaguaguccaagauggaaacggaacacaucaaaaugaaccacaacaauggguauuaccuucuuauuccggaagaacaggacacaauguccaucuagcacccgcagucgcaccaacauuuccaggugaacaacuauuauucuucagaucaacaaugccaggaugcucaggauauccaaacaugaaucuagauugcuuauuaccacaagaauggguacaacauuucuaucaagaagccgcucccgcacaauccgaugucgcuuuacuacguuuugucaauccagauacugguagaguucuuuucgaaugcaaacuacacaaaucagguuauguaacuguugcacacacaggacaacaugauuuaguaauuccaccaaauggauacuucagauucgauucauggguaaaucaauucuauacauuagcaccaaugggaaacggaacuggaagaagaagagcauuauaa

SEQ ID NO: 32377 - RNA, 1623 nt, Artificial Sequence
  derived and/or modified sequence opt6 from capsid_protein__Norovirus__AAT00264
augaaaauggcaucuaaugacgccaauccaucugauggaucuacagcaaaccuaguaccugaaguuaauaaugaaguaauggcccuugaacccguagucggagccgcuauugcagcaccaguagcaggacaacaaaauguaauagauccauggauaagaaauaacuuuguacaagcaccuggcggagaauucaccguauccccuagaaaugcaccaggagaaauauuauggucagccccacuaggacccgauuuaaacccauaucuaucucaccuagcucgaauguauaacggauacgcaggaggauucgaaguacaaguuauacuugcagguaacgccuucacagcugguaaaauaaucuucgcagcaguaccucccaacuuuccaacagaagguuuaucuccaucacaaguaacuauguuuccacacauuauuguugacguaagacaacuugaacccguauuaauaccccuaccagacguucgaaacaauuucuaccacuacaaccaaucaaaugacccaacaauaaaauuaauagcaauguuauauacaccacuaagagcaaacaaugcaggugaggauguauucaccguuuccuguagaguucucacaagacccucaccagacuucgacuuuauauuuuuaguaccaccgacaguugaaucuagaacaaaaccauuuaccguaccaauacucacaguugaagaaaugacaaauucucgauuuccaauaccuuuagaaaaacucuuuacaggucccucuggggccuucguuguacaaccacaaaacggccgauguacaaccgauggaguauuacuaggaacuacucaauuaaguccuguaaacauaugcacauuuagaggagacguaacacauauagcaggaacacauaauuacacaaugaaucuagcaagccaaaacuggaauaauuacgauccaaccgaagaaauaccugcaccacuagguacaccagacuuugucggaagaauucaagguaugcuaacacaaaccacuagaggagaugguucaacacgcggacacaaagcaaccguaucaacuggagauguacacuucaccccaaaauuaggaucaauucaauucaauacagacaccaauaacgauuucgaaacaggacaaaauacacgauucacaccugucgguguaguucaagauggcaacggcacucaucaaaacgaaccacaacaauggguauuaccauccuauucaggaagaacuggacauaacguacaccuagcaccagccgucgcacccacauuuccaggagaacagcuauuauuuuuuagaucuacaaugccaggaugcuccggauaucccaacaugaaucuagacugucuacuaccacaagaauggguacaacacuucuaccaagaagcugcacccgcacaaucugacguagcauuacuaagauucguaaauccagacaccggaaggguacuauuugaaugcaaauuacauaaaucaggauauguaacaguagcacauacuggacaacacgaucuaguaauuccucccaauggauacuuuagauucgauagcuggguaaaccaauuuuacacauuagcaccaaugggaaauggaacaggcagaagaagagcauuauaa

SEQ ID NO: 32378 - RNA, 1623 nt, Artificial Sequence
  derived and/or modified sequence opt6 from capsid_protein__Norovirus__AAT00267
augaaaauggcuucuaacgacgcaaauccaucagacggcucuacagcaaaucuaguaccagaagucaauaaugaagucauggcccuagaaccaguuguaggagcagccauagcugcucccguugccggacaacaaaauguaauagacccauggauuagaaacaauuuuguccaagcaccagggggagaauuuacuguaucuccacguaaugcaccuggagaaauacucuggucagcaccauuaggaccagaucuaaauccauaucucucacaucuugcaagaauguacaacggauacgcagguggauuugaaguacaaguaauauuagcuggaaaugcauucacagcuggcaaaauaauuuucgcagcuguuccaccaaauuuuccuacagaaggacuaucacccucacaaguuacaauguucccacauauaauaguagacguaagacaacuagaaccaguacucaucccacuaccugaugucaggaacaauuuuuaucacuauaaccaauccaaugacccuacaauaaaacuaaucgcaauguuauacacaccccuacgagcaaauaaugcuggcgaagacguauuuacaguaagcugucgaguauuaacacgcccaucaccagacuuugacuuuauauuuuuaguacccccaacagucgaaucaagaacaaaaccauuuacuguaccaauacuaacaguagaagaaaugacaaauucaagauuuccaauaccccucgaaaaacuauuuacaggaccuuccggugcuuucguaguacaaccacaaaauggaagauguacaacagacggaguauuauuagguaccacucaacuaucaccaguaaauauaugcacauucagaggagaugucacacauauugcaggaacacacaauuauaccaugaauuuagcaucccaaaacuggaacaauuacgauccaacagaagaaaucccagcaccuuuaggcacaccagacuucguuggaagaauacaaggaauguuaacucaaaccacaagaggagauggaucaacuagaggucacaaagccacaguuucaacaggugacguacacuucacaccaaaacuuggaucaauacaauucaacacagauacaaauaaugauuucgaaacaggccaaaauacaagguucaccccaguuggcguaguucaagacggaaacggaacccaucaaaaugagccccaacaauggguucuaccaucuuauucagguagaacaggucauaauguccauuuagcuccagcaguugcuccaacauucccaggagaacaauuauuauucuuccgaucaacaaugccaggauguuccggauauccaaauaugaaccuugauugucucuuaccacaagaauggguacaacacuuuuaucaagaagcagcaccagcucaaucagauguagccuuacuaagauuuguaaacccagauacaggaagaguccuauucgaauguaaauuacauaaaucaggauacguaaccguagcacacacaggacaacaugauuuaguaauaccaccaaauggauauuuuagauucgacagcuggguaaaucaauuuuacacccuagccccaaugggaaauggaacaggacggagaagagcauuauaa

SEQ ID NO: 32379 - RNA, 1623 nt, Artificial Sequence
  derived and/or modified sequence opt6 from capsid_protein__Norovirus__AAT00270
augaaaauggcaucaaacgacgcaaacccaucagauggcucaaccgcaaacuuaguaccagaaguaaacaacgaaguuauggcacuugaaccaguaguaggagcagcaauagcugcaccaguagcaggacaacaaaacguaauagaccccuggauacguaauaacuuuguccaagccccuggaggugaauuuacuguaucaccaagaaacgcaccuggugaaauucuaugguccgcaccauuaggucccgauuuaaacccauaucuaucccacuuagcaagaauguauaacgguuaugcagguggauuugaaguacaaguaauacuagcaggaaaugccuuuacugcaggaaaaauaauuuucgcagccguacccccuaacuuuccaacugaaggucuaucuccaucacaagucacaauguucccacauauaauuguagacguacgacaauuagaaccaguccuuauuccacuuccagauguaagaaauaauuucuaucacuauaaucaauccaaugauccaacaauaaaauuaauagcaauguuauacacaccauuacgcgcaaacaaugcaggagaagauguauuuacaguauccugcagaguauuaacaagaccaucccccgauuucgauuuuauauuuuuaguaccaccaacuguugaaucacgaacaaaacccuucacagucccgauacuaacaguagaagaaaugacaaauuccagauuucccauaccccuagaaaaacuauuuacaggcccaucuggcgcuuucguaguacaaccucaaaacggucgcugcacuaccgacgguguauuacuuggaacaacucaacuaucaccaguuaauaucuguacauuucguggagacguaacacacauagcagguacacacaauuauaccaugaaucuagcaagccaaaauuggaauaauuaugauccuacagaagagauacccgccccacuagguacaccagacuuuguuggaagaauacaaggaauguuaacacaaacuacucgaggagauggcagcacaagaggacauaaagcuacaguauccacaggagauguacacuucacaccaaaacuaggcucuauacaauucaauacagacacaaacaacgauuuugaaacuggucaaaauacacgauuuacaccaguuggaguaguacaagauggaaacggaacacaucaaaacgaaccucaacaauggguacuaccauccuauuccggacgaacuggacauaacguucaucuagcaccagcagucgccccaacauuuccaggagaacaauuauuauucuuucgaucaaccaugcccgguugcucuggauacccaaacaugaacuuagacuguuuauuaccacaagaauggguccaacauuuuuaccaagaagcagcaccagcacaaagugauguagcauuacuaagauucguaaacccagauacaggucgaguauuauuugaaugcaaauuacauaaauccggauauguaaccguugcccacaccggccaacacgaccuaguaauaccaccaaacggauauuucagauuugauucuugggucaaccaauuuuacacacuagcuccaaugggcaauggaacuggacgaagaagagcauuauaa

SEQ ID NO: 32380 - RNA, 1623 nt, Artificial Sequence
  derived and/or modified sequence opt6 from capsid_protein__Norovirus__AAT00273
augaaaauggcaucaaacgacgcaaacccaucagacggcucaacugcaaaucuuguaccugaagucaacaaugaaguaauggcacuagaaccaguaguaggagcagcaauagcagcaccaguagccgggcaacaaaauguaauagacccauggauacgaaauaacuucguucaagcaccaggcggagaauuuacuguauccccgagaaaugccccaggagaaauauuauggucagcaccccuaggaccagauuuaaauccauaucuaagucauuuagcucgaauguacaacggauaugcgggaggauucgaaguacaaguaauacuagcaggaaaugcauucaccgccggcaaaaucauauucgcagcaguaccaccaaacuuuccaacagaaggacucucacccucacaaguaacaauguuuccccauauaauaguagacguuagacaauuagaacccguuuuaauaccauuaccagauguaagaaacaauuucuaucauuauaaucaaagcaaugauccuacaauaaaauuaauugcaaugcucuauacaccucucagagcaaacaaugcaggagaagaugucuucacugucuccuguagaguuuuaacacgaccaagcccugacuuugacuucauauuuuuagucccacccacagucgaaucaagaacuaaaccauucacaguaccaauauuaacaguugaagaaaugacuaauucacgauuuccaauaccauuagaaaaauuauuuacaggaccuucuggagcuuuuguaguacaaccccaaaauggccgauguaccacugacggaguauuauuaggaacaacacaacuaucaccuguaaauauuugcacuuuuagaggagacguaacacacauagccggcacacacaacuacacaaugaauuuagcuucacaaaauuggaauaauuacgauccaacagaagaaauaccagcaccacuaggcacaccagacuuuguagguagaauacaaggaaugcuaacacaaacaacaagaggagaugguucaacaagaggacacaaagcuacaguaucaacaggagacguacauuuuacaccaaaauuaggaagcauacaauucaauaccgauacaaacaaugauuuugaaacaggccaaaauacuagauucacucccguaggaguuguacaagacggaaauggaacacaucaaaacgaaccacaacaauggguucucccaaguuauucaggacgaaccggucacaauguacacuuagcaccugccguagccccaacauuuccaggugaacaacuauuauucuuuagaaguacuaugccaggaugcucgggauacccaaauaugaaccuagauugccuauuaccacaagaauggguacaacauuucuaccaagaagcagcaccugcucaaucugauguagcacuauuaagauucguaaauccagauacaggcagaguacuauucgaauguaaauuacacaaaucaggauacguaaccguagcacauacuggucaacacgaucuaguuauaccuccuaauggcuauuuccgauuugauucauggguaaaucaauuuuacacauuagcaccaaugggaaauggaacaggaagacgacgagcacuauaa

SEQ ID NO: 32381 - RNA, 1623 nt, Artificial Sequence
  derived and/or modified sequence opt6 from capsid_protein__Norovirus__AAT00276
augaaaauggccucaaaugaugcuaacccaucagacggaucuacagcuaacuuaguaccagaaguaaacaaugaaguaauggcuuuagaaccagucguaggugccgcuauagcagccccaguugcaggacagcaaaauguuaucgacccuuggauaagaaauaacuuuguacaagcaccaggaggagaauuuacaguuucaccaagaaaugcaccaggagaaauauuauggucugcaccucucggaccagauuuaaaccccuaucucucacacuuagcacgaauguacaauggauaugcaggcggcuucgaaguacaaguaaucuuagccgguaaugccuucaccgcaggaaaaauaauauucgccgcaguuccaccaaauuuuccaacagaaggucuaucuccaucacaaguuacaauguucccacacaucauaguagacguaagacaacuagaaccaguacucauaccauuaccagauguacgaaacaauuucuaucacuauaaccaauccaaugauccaacaauaaaacuaauugccauguuauacacacccuuacgagcuaacaaugcaggugaagacguauuuacaguaucaugcagaguauuaacaagaccauccccagacuucgauuuuauauuucuagucccacccacuguagaaucaagaacuaaaccauucaccguaccaaucuuaacagucgaagaaaugacuaauuccagauuuccuauaccucuagaaaaauuauuuacaggaccaucaggagcauucguaguacaaccccaaaauggacgaugcaccacagacgguguauuauuagguacaacacagcuaucacccgucaacauauguacauuucgaggcgacguaacacauauagcaggcacucauaauuacacuaugaaucuagcaucacaaaacuggaauaauuacgacccaacagaagaaauaccagcuccacuuggaacaccugacuucguaggucgcauacaaggaauguuaacacaaacuaccagaggagauggaucaacaagaggacacaaagcaacugucucaacaggagauguucacuuuacaccuaaauuaggaucaauacaauucaauaccgauacaaauaaugauuuugaaacuggccaaaacacaagauuuaccccuguaggcguaguacaagacgguaacgguacucaucaaaaugaaccccaacaauggguauugccaucauacucaggccgaacaggacauaacguacauuuagcaccagcagucgcaccaacauuuccaggagaacaauuacuauuuuuuagaagcacaaugccaggaugcucaggauauccaaacaugaaucuagacugcuuauuaccacaagaauggguacaacauuuuuaccaagaagccgccccagcucaaucugacguagccuuacuacgauucguaaacccagacacaggacguguauuauucgaauguaaacuacauaaaucaggauauguaacaguagcacacacaggccaacaugacuuaguaaucccacccaauggauauuucagauucgacucauggguaaaucaguucuacacauuggcuccaauggguaacggaacaggaagaaggagagcauuauaa

SEQ ID NO: 32382 - RNA, 1623 nt, Artificial Sequence
  derived and/or modified sequence opt6 from capsid_protein__Norovirus__AAT00279
augaaaauggcaaguaaugaugcaaacccaucagacgguuccacugcuaacuuaguaccagaaguuaauaaugaagucauggcuuuagaaccaguuguaggagccgcaauagcagcaccuguugcaggacaacaaaauguaauagacccauggauacgcaauaauuuuguacaagccccaggaggugaauuuacaguaucaccucgaaacgcaccaggagaaauacuaugguccgcaccuuuagguccugauuuaaauccauaccucagucaucuagcaagaauguauaaugguuacgccggaggauuugaaguucaagucauacuagcaggaaaugcuuucacagcaggaaaaauuauuuucgcagccguaccacccaacuucccaaccgaaggacucagucccucccaaguaacuauguucccucauauaauaguagauguacgacaacuagaacccguacuaauaccacuucccgauguccgaaacaauuucuaccacuauaaucaauccaaugacccaacaauaaaacuuauagcuaugcucuauacaccauuaagagccaacaaugcaggugaagauguauuuacaguaucaugcagaguacuaacaagaccuucaccagacuuugacuuuauauuuuuaguaccaccaacaguagaaucucgaacgaaaccauuuacagucccuauacuaacaguagaagaaaugacaaauucucgauuuccaauaccuuuagaaaaauuauuuacaggacccuccggcgcauucgucguacaaccacaaaacggcagaugcacaacagauggaguucuauuaggcacaacacaauuaucucccguaaauauauguacauuccgaggugacguaacacauauagccggaacacacaauuacacaaugaaucuagcaucacaaaauuggaauaauuaugacccaacagaagaaauaccggcaccucuaggaacaccagacuuugucgguagaauacaaggaauguuaacacaaaccacuagaggagacggaucaacacguggacacaaagccacuguaucaacuggagauguacauuuuacacccaaacucggcucaauucaauuuaauaccgauaccaauaaugauuuugaaacaggacaaaauacaagauucacaccaguuggaguaguacaagacggaaaugguacacaccaaaaugaaccacaacaauggguacuaccaucauacucuggccgaacaggccacaacguucaucuagcacccgcuguagcaccaacuuuuccaggugaacaauuacuuuuuuuuagaucaacaaugccugguugcucaggauacccaaacaugaaucuugacuguuuauuaccacaagaauggguccaacauuuuuaucaagaagcagcuccagcccaaucagacguagcuuuacuaagauucguuaauccagacaccgguagaguacuauuugaauguaaauuacauaaaucaggauauguaacaguagcacacaccggacaacaugaucuaguuauaccaccaaacggauauuucagauuugacucaugggucaaccaauuuuacacauuagcaccaaugggaaauggaacuggacgacgaagagcacuauaa

SEQ ID NO: 32383 - RNA, 1623 nt, Artificial Sequence
  derived and/or modified sequence opt6 from capsid_protein__Norovirus__AAT00282
augaaaauggcaucaaacgacgccaacccuucagauggauccacugccaaccuuguacccgaaguuaacaacgaaguaauggcacuagaacccguaguuggugcugcuauugcagcaccaguagcuggacaacaaaaugucauagauccuuggauaagaaauaacuucguacaagcaccaggaggagaauucacaguaucuccacgaaacgcuccaggcgaaaucuuauggucagcccccuuaggaccagaucuaaauccauaccuuucacaucuugcuagaauguacaacgguuacgcaggagguuucgaaguacaaguaauacucgcuggaaaugcauuuacagcaggaaaaaucaucuuugcagcaguaccaccaaacuuuccuacugaaggauuaucaccaucacaaguuacaauguuuccucacauaaucguugacguccgucaacuagaaccaguccucauaccucuacccgauguacguaacaauuuuuaucauuauaaccaaucaaaugauccaacaauaaaauuaauagccauguuauauacuccucuucgcgcuaacaaugccggagaagauguuuuuacaguauccugcagaguacuaacuagaccaucuccagacuuugacuuuaucuuucuaguaccccccacaguugaaucuagaacuaaaccauucacaguaccuauacuuaccguagaagaaaugacaaacucccgauuuccaauaccccuagaaaaacuauuuacugguccauccggagcauuuguaguacaaccacaaaauggacgaugcacaaccgacggagucuuauuagggacaacucaacuaucaccaguaaacauuugcaccuuucguggugauguuacacauaucgcaggaacucauaauuauacaaugaacuuagcaucucaaaauuggaacaauuacgacccaacugaagaaauaccugcuccuuuaggaacaccagacuucguagguagaauacaaggaauguuaacgcaaacaacaagaggagacggaagcacuagaggacacaaagcaaccguuuccaccggagauguacacuucaccccuaaauuaggaucaauacaauuuaauacagacacaaauaacgauuuugaaaccggacaaaauacaagauucacacccgucggaguaguacaagauggaaacggaacacaucaaaaugaaccacaacaauggguacuaccaaguuacaguggaagaacaggacauaauguacaucuugcaccugcaguagccccuacauuuccaggagaacaacuacuauucuuucguucaaccaugcccggauguucaggauaccccaauaugaaccuugauugcuuacuaccucaagaauggguucaacacuucuaucaagaagcagcucccgcccaaucagauguagcucuacuucgcuucguaaacccagacacaggaagagucuuauucgaaugcaaacuucauaaaucuggauaugucacaguugcacauacuggacaacaugaucuaguaauaccucccaauggauauuucagauucgauucauggguaaaucaauucuauacacuagccccaauggguaauggaacuggaagaagaagagcauuauaa

SEQ ID NO: 32384 - RNA, 1623 nt, Artificial Sequence
  derived and/or modified sequence opt6 from capsid_protein__Norovirus__AAT00285
augaaaauggccucuaacgaugcaaauccaucagauggaagcacagcaaaccuuguaccugaaguaaauaacgaaguuauggccuuagaaccagucguaggugcagcaauagcagcaccaguugcaggacaacaaaauguaauagacccauggauaagaaauaauuucguacaagcaccuggaggagaauuuacaguaucaccaagaaaugcacccggcgaaauauuauggucagcaccauuagguccagauuuaaacccauaucuaucucaccuugccagaauguacaaugguuaugcaggaggauucgaaguucaaguaauucuugccggaaaugcuuuuacagcaggaaaaaucauuuuugccgcaguaccacccaacuucccaacugaaggucuaaguccuucacaaguaacuauguuuccacacauaauaguagacguuagacaacuagaaccaguacuaauacccuuaccagacguaagaaacaauuuuuaucauuacaaccaaucaaacgacccaacgaucaaauuaauagcaaugcuuuacacaccauuaagagcgaacaaugcaggcgaagacguauuuacuguaagcugcagaguacuaacaagaccaucuccagauuuugacuuuaucuuccuuguuccuccuacuguagaaucccguacaaaaccuuuuacuguuccaauacuaacaguagaagaaaugacaaauucaagauuuccaauaccauuagaaaaauuauuuacaggaccaucaggagcuuuuguaguacaaccacaaaacggaagauguaccacugacggaguucuauuaggcacaacacaauuaaguccaguaaacauauguacuuuuagaggagaugucacacauauagcaggcacacacaauuacacaaugaaucuagcaucacaaaauuggaauaauuaugauccgaccgaagaaauuccagcaccauuaggaacaccugacuuuguaggaagaauucaagguaugcuaacacaaacaacaaggggagacggaaguacaagaggucauaaagccacaguaagcaccggugauguacauuucacaccaaaacuaggcucaauacaauucaauacagauacaaauaaugacuucgaaaccggccaaaauaccagauucacaccuguaggaguuguacaagauggaaacgguacacaucaaaacgaaccccaacaauggguucuaccauccuacucaggccguacaggacauaacgugcaucuugcccccgcaguagccccaacauuuccaggcgaacaacuacuauuuuuuagaucuacaaugcccggauguucaggauauccaaauaugaaucucgacugcuuacuaccacaagaauggguccaacauuucuaucaagaagccgcaccagcacaaagugauguugcgcuauuacgauuuguuaacccugauacugguaggguacuguucgaaugcaaauuacauaaauccggauauguaacaguagcacacacuggucaacacgaucuaguaauaccaccaaaugguuauuuuagauuugauuccuggguaaaucaauuuuacacuuuagcaccaaugggaaacggaacaggccgaagaagagcacuauaa

SEQ ID NO: 32385 - RNA, 1623 nt, Artificial Sequence
  derived and/or modified sequence opt6 from capsid_protein__Norovirus__AAT00288
augaaaauggcaucaaaugacgcaaacccuucagauggauccacggcaaaucuaguaccugaaguaaauaaugaaguuauggccuuagaacccguaguaggugcagccauagcagcaccuguugcaggucaacaaaauguaauagacccauggauuagaaacaacuucguacaagcaccaggaggugaauuuacagugucaccaagaaaugcacccggagaaauacuauggucagcaccucucggacccgauuuaaaucccuaucucucccauuuagcuagaauguauaacggauacgcuggaggauucgaaguucaaguaauacuagccggaaaugcauuuacagcagguaaaauaauauucgcugcaguucccccaaacuucccaacagagggccucucccccucucaagucacaauguucccucauauaauaguagacguaagacaacuagaacccguauuaauaccuuuaccagauguaagaaauaacuuuuaccacuacaaccaauccaaugauccaaccauaaaauuaauagcaauguuauauacccccuuacgagcuaacaaugcaggagaagacguuuuuacaguaucuuguagaguacucacaagaccaucaccagauuucgacuuuauauuuuuaguuccaccaacaguagaaucaagaacaaaaccauuuacuguccccauauuaacaguugaagaaaugacuaauucuagguuuccaauaccauuagaaaaauuauucacaggaccuuccggcgcuuuuguaguacaaccucaaaauggacguugcacaacagacggcguacuauuaggaacuacucaacuaucacccguaaacauauguacuuucagaggagacguaacacauauagcuggaacucauaauuauacgaugaaucuugcaucacaaaacuggaacaauuaugauccaacagaagaaauaccagccccacuaggaacaccagacuuugucggccguauucaaggaauguuaacccaaacaacaagaggagauggaucaacaagaggucauaaagccacagucaguacaggagacguacauuuuacaccaaaauuaggcucaauucaauuuaacacagauacaaauaaugacuucgaaaccggacaaaacaccagauuuacucccguaggcgucguacaagauggaaauggcacacaucaaaaugaaccacaacaauggguucuaccaagcuauucuggucgaacuggucauaauguacacuuagcacccgcaguagcaccaacauuuccaggugaacaauuauuauucuuuagaaguacaaugccugguugcucuggauaucccaacaugaauuuagauugcuuacugccacaagaauggguacaacauuuuuaucaagaagcagcaccagcacaaucagacguagcacuauuaagauuuguaaacccagacacaggacgaguauuauucgaauguaaacuucauaaaucaggcuacguuacuguagcccacacaggacaacaugacuuaguaaucccuccaaacggauauuucagauuugauucauggguaaaccaauucuauacacucgccccuaugggcaacggaacuggaagaagaagagcacuauaa

SEQ ID NO: 32386 - RNA, 1623 nt, Artificial Sequence
  derived and/or modified sequence opt6 from capsid_protein__Norovirus__AAT00291
augaaaauggcuucaaaugacgccaaucccucugaugggucaacagcaaaccuaguuccugaaguuaacaaugaaguuauggcucuagaaccaguaguaggagccgcaauagcagcucccguagcaggacaacaaaauguaauagacccuuggauacgaaauaacuucguccaagccccaggcggcgaauuuacaguauccccuagaaaugcaccuggagaaauuuuauggucagccccauuagguccagaucuaaauccauaucuaucacaccuagcaagaauguauaauggauacgcaggcggauucgaaguacaaguuauacuagcaggaaacgcauuuacagcaggaaaaaucauuuuugcagccguaccaccaaauuucccaacagaaggucuuuccccuucacaagucaccauguucccccacauaauuguugacguaagacaauuagaacccguauuaauaccacuucccgacguaagaaacaauuucuaccacuauaaccaaucuaaugacccaacaauaaaauuaauugcuauguuauacacaccacucagagcaaauaaugcuggcgaagacgucuuuacaguaucauguagaguccuaacuagaccauccccagauuucgacuuuauuuuucuaguacccccuacaguagaaucaagaacaaaaccauucaccguaccaauacuuacagucgaagaaaugacaaauucacgauuuccaauaccauuagaaaaauuauucacagguccaucaggagcauucguaguccaaccucaaaauggaagaugcacaacagaugguguucuauuaggaacuacucaauuaucaccuguaaauauuugcacauuuagaggugacgucacacauauagccggaacacacaauuacacuaugaaucuagccucacaaaacuggaacaauuaugauccaacagaagaaauuccagcaccauuaggcacaccagauuucguaggccgaauacaagguauguuaacacaaacaacaagaggcgacggaagcacacguggucacaaagcaacaguauccacaggagauguacacuucacccccaaacuaggaucaauacaauucaauacagacacaaauaaugauuuugaaaccggucaaaacacaagauucacaccaguaggaguaguccaagacggaaacgguacacaucaaaaugaaccacaacaauggguacucccaucauauucaggaagaacaggccacaauguacaucuagcaccugcaguagccccaacuuuuccaggagaacaacucuuauucuuuagaucaacuaugccuggauguucaggauauccaaacaugaaucuagauugccugcuaccacaagaauggguucaacauuucuaucaagaagcagcaccagcacaaucugacguagcccuucugcgauucguaaauccagauacuggaagaguacuuuucgaauguaaacuacauaaaucaggcuacguaacaguagcacacacaggacaacacgaccuaguaauaccaccaaacgguuacuuuagauucgauaguuggguuaaucaauuuuauacacuagcaccuaugggaaacgguacaggaagaagacgagcacuuuaa

SEQ ID NO: 32387 - RNA, 1623 nt, Artificial Sequence
  derived and/or modified sequence opt6 from capsid_protein__Norovirus__AAT00294
augaaaauggcuucaaacgacgccaacccaucugacggaucuacugcaaaccuugucccugaaguaaacaaugaagucauggcacuagaaccaguaguuggagcagcaauagcagccccaguagcaggacaacaaaauguaauagacccauggaucagaaacaacuucguacaagcaccgggaggugaauucacaguuucaccacgaaaugcaccaggugaaaucuuauggagugcaccuuuaggaccagaucuaaacccauaucuaucacaucuagccagaauguauaaugguuaugcagguggauucgaaguacaaguaauucuagcaggaaaugccuuuacugcaggaaaaauaauauucgccgccguaccacccaauuuucccaccgaaggacuaucuccaucgcaaguaaccauguuuccacacauuauaguagacgucagacaacuagaacccguucucaucccauuaccagacguacgaaacaauuucuaccacuacaaccaaucaaaugauccaaccauaaaacuaaucgcuaugcuauauacaccauuaagagcaaauaaugcaggcgaagauguauucacaguauccuguagaguacuaaccagaccaucaccagacuuugacuuuauuuuucuaguuccaccaacgguugaaucaagaacuaaaccauuuacuguaccaauuuuaacaguagaagaaaugacaaauucacgcuucccaauaccacuugaaaaauuauucaccggaccaucaggagcauucguaguucaaccucaaaacggaagauguacaacagauggaguacuacuaggaacaacacaauuaucaccugucaauauauguacauuuagaggagacguaacccauauagcaggaacccacaacuacacuaugaaucuagcaagucaaaauuggaauaauuaugaucccacugaagaaaucccagcaccacuuggaacuccagauuucguaggacgaauucaaggaauguuaacacaaacaacaagaggugacggcucaacuagaggacauaaagcaacaguuucaaccggagacguacacuuuacaccaaaacuaggaucaauacaauuuaauacagauacaaauaaugacuucgaaacaggacaaaauacaagauuuaccccagucggaguaguacaagaugguaauggaacccaucaaaaugaaccucaacaaugggucuugccaucauacagcggacgaacaggacauaauguacaccuagccccagcaguagcacccacuuuucccggagaacaacuauuauucuuuagaucaacaaugccaggaugcuccggauauccaaacaugaacuuagacuguuuacuaccccaagaauggguacaacauuucuaucaagaagcagcccccgcacaaucagauguagccuuauuacguuucguaaacccagauaccggaagaguauuauuugaaugcaaauuacauaaaucuggauacguaacuguagcucacaccggacaacacgaucuaguaauuccuccaaacggauauuucagauucgauaguuggguaaaccaauuuuauacccuagcuccuaugggcaacgguacaggcagacgacgagcccuauaa

SEQ ID NO: 32388 - RNA, 1623 nt, Artificial Sequence
  derived and/or modified sequence opt6 from capsid_protein__Norovirus__AAT00297
augaaaauggcaucaaacgacgccaauccaucugauggaucaacagcaaacuuaguaccagaaguaaacaacgaaguaauggcacuagaaccaguaguaggagcagccauagcagccccaguugcuggucaacaaaauguaauagauccauggauccgaaauaauuuuguucaagccccagguggagaauuuacaguaucaccaagaaacgcuccuggagaaauauuauggucugccccacuaggaccagaucucaacccauauuuaucccaucuagcacgaauguacaacggauacgcaggcggcuuugaaguacaaguaauauuagccggaaaugcauuuacagcuggaaaaauaauauucgcagcaguaccaccaaauuucccuacagaagguuuaucaccaucucaaguaacaauguucccucauauaauagucgauguccgacaacucgaaccaguacucauaccccuacccgauguaagaaacaacuuuuaucacuauaaucaaucaaaugaucccacaauaaaauuaauugcuaugcuuuauacacccuuaagagcaaauaaugccggagaagauguauuuacaguaucauguagaguuuuaaccagacccucacccgacuuugacuuuauauucuuaguuccaccaacaguagaaucaagaacaaaaccauuuacaguaccaauuuuaacaguugaagaaaugacaaacucaagauuuccaaucccguuagaaaaacucuuuacaggccccucaggcgccuuuguaguacaaccacaaaauggaagauguacaacagacggaguccuacuaggaaccacacaacuaaguccagucaacauauguacauuucgcggagauguaacccauauagcaggaacccauaauuauacuaugaaccuagccucacaaaauuggaacaauuacgauccaacagaagaaauuccagccccauuaggaacaccagacuuuguaggacgaauucaaggaaugcugacacaaacaacaaggggagacgguucaaccagaggacacaaagcaacaguuucaacaggagauguucauuuuacaccaaaacuaggaucaauacaauucaacacagauacaaauaacgauuucgaaacaggacaaaauacaagauuuacuccaguaggaguaguacaagacgguaacggaacucaucaaaacgaaccacaacaauggguacuaccuucauacuccggaagaacaggacauaauguccaucuagcaccagcaguugcaccaaccuuuccaggagaacaauuauuauuuuuucgaucaacaaugccaggaugcucaggcuauccuaauaugaaucuagacugucuacuaccacaagaauggguucaacauuucuaccaagaagccgcuccagcccaaagugacguagcauuacuaagauuuguaaauccagacacaggaagaguucuauucgaaugcaaauuacauaaaucaggcuauguaacaguagcacacacaggucaacacgaucucguaauuccucccaauggauauuuuagauucgauaguuggguuaaucaguuuuacacacuagcaccuauggguaauggaacagguagaagaagagcauuauaa

SEQ ID NO: 32389 - RNA, 1623 nt, Artificial Sequence
  derived and/or modified sequence opt6 from capsid_protein__Norovirus__AAT00300
augaaaauggcaucuaaugacgccaacccaucagauggaucaacagcaaacuuagucccagaaguaaacaaugaaguuauggcacuagaaccgguaguaggugccgcuauagcagcuccugucgcuggacaacaaaauguaauagauccauggaucagaaauaauuuuguucaagcgccaggaggagaauucacagucucaccaagaaacgcaccaggagaaauacuauggagugcaccauuaggaccagaucuaaauccauacuuaagucauuuagcaagaauguacaauggcuaugcuggagguuuugaaguccaaguaauacuagcaggaaacgcauuuacagcugggaaaauaauauucgcagcaguaccaccaaacuucccaaccgaaggucucucuccaucacaagugacaauguuuccucauauaauaguagacguuagacaacuagaaccaguccugauaccauuacccgauguaagaaauaauuuuuaucauuauaaccaaucaaacgacccaacaauaaaacucauagcaauguuauacacuccauuaagggcaaauaaugcaggagaagacguauucaccguaucuuguagaguauuaacaagaccaucaccagacuuugacuuuauuuuccuaguucccccaacaguugaaucuagaacaaagccuuuuaccguaccaauccuaacaguugaagaaaugaccaauucaagauuccccauaccacuagaaaaacuuuuuacagguccaucuggagcauucguuguccaaccacaaaacggaagauguacaacagauggaguccuacuuggaacuacacaacuuucaccuguaaacaucuguacauucagaggagacguaacucauauagcaggaacacacaauuauacaaugaaccuagcaucucaaaauuggaacaauuacgauccaacagaagaaauaccagcaccacucggaacaccagauuucguaggaagaauacaaggaaugcuuacacaaacaacaagaggggauggaucaacaaggggacacaaagccacaguaucaacuggagauguucauuucacacccaaacuaggaucuauacaauucaauacugauacaaacaacgacuuugaaacaggacaaaauacuagauuuacuccaguaggaguuguacaagauggaaacggaacacaucaaaacgaaccucaacaauggguauuaccaucuuacucaggaagaacuggacacaacguccacuuagcaccagcuguagcaccaacauuuccaggagaacaacuucuauuuuuuagaucaacaaugccaggcuguuccggauacccuaauaugaacuuagauuguuuauuaccacaagaauggguucaacacuucuaucaagaagcagcaccagcccaaucugaugucgcucuucuaagauucguaaauccagauacuggacgaguacuauucgaauguaaacuacacaaaucaggauauguaacagucgcacauacaggacaacaugaucuaguaauaccuccaaacgguuauuucagauucgauucauggguuaaucaauucuauacacuugcaccaaugggaaauggaacaggcagaagacgagcacuuuaa

SEQ ID NO: 32390 - RNA, 1623 nt, Artificial Sequence
  derived and/or modified sequence opt6 from capsid_protein__Norovirus__AAT00303
augaaaauggccucaaaugaugcuaauccaagcgaugguucaacagcaaaccuagucccugaaguaaauaaugaaguaauggcucuagaaccagucguaggagcugcaaucgcagccccugucgcaggacaacaaaaugucauagauccuuggauaagaaacaauuuuguccaagcucccggaggagaauucacaguuucuccucgaaacgcaccuggagaaauauuauggucagccccacuaggcccagauuuaaauccauaucuaucucaucuagcaagaauguauaacggauaugcaggaggauucgaaguacaaguaauacuagccggcaacgcauuuacagcaggaaaaauaauuuucgcagcuguuccaccgaauuuuccuacugaaggacuaucuccaucacaagucaccauguucccucacauuauaguagaugucagacaacuagaacccguauugauuccauuaccagauguacgaaacaauuucuaucauuauaaucaaucaaaugacccuacaauaaaacuaauagccaugcuuuauaccccuuuaagagcaaacaacgcaggagaagauguauuuacaguuucuugucgaguacucacaagaccaaguccagacuuugacuuuauauuccuaguaccaccuacuguagaaucaagaacaaaacccuucacaguaccuauacucacaguagaagaaaugacaaacuccagauucccaauaccauuagaaaaacuauucaccgguccaagcggagcauucgucguccaaccacaaaauggacgaugcacaacagacggcguauuauuaggaacuacucaauuaucacccguaaauauauguacauuucgaggagauguaacccauauugccggaacacacaauuacacuaugaacuuagcaucacaaaacuggaauaauuaugacccaacagaagaaaucccagcaccucuaggcacaccagacuucguaggaagaauacaaggaaugcucacccaaacaacaagaggugacggaucaacacguggacacaaagcaacugucucaacaggagacguacauuuuacacccaaacuaggaucaauucaauuuaauaccgauacaaauaaugauuuugaaacaggucaaaauacacgauucacuccaguaggaguaguccaagacgguaacggcacacaucaaaacgaaccucaacaauggguucuaccaucauacuccggaagaacaggacauaauguacauuuagccccagcaguagcaccaacauuuccaggagaacaacuauuauucuuucgaucuaccaugccagguugcucaggauauccaaauaugaauuuagauugcuuacuaccucaagaauggguucaacauuuuuaccaagaagccgcccccgcacaaucagauguagcucuauuacgauuuguaaacccagauacaggaagaguauuauucgaauguaaauuacauaaaagugguuacguaacaguagcacauaccggacaacaugauuuaguuauaccaccaaacggauauuuuagauucgauagcuggguuaaccaauucuacacauuagcuccaaugggaaacggaacaggaaggcgaagagcauuauaa

SEQ ID NO: 32391 - RNA, 1623 nt, Artificial Sequence
  derived and/or modified sequence opt6 from capsid_protein__Norovirus__AAT00306
augaaaauggcaucaaacgacgcuaacccauccgauggaucaacagcaaauuuaguaccugaaguaaacaaugaaguaauggcacuagaaccaguaguaggagcagcuauugcagcuccaguagcaggacaacaaaauguaauagauccauggauaagaaauaacuucguccaagcaccaggcggugaauucacaguaucaccuagaaacgccccuggagaaauacuuuggagugcuccacuaggaccagauuuaaauccauaucuaucucacuuagcacgaauguauaacggauacgcaggcggauucgaaguacaaguuauucucgccggaaaugcauuuacagcuggaaaaauaauauuugccgcaguaccaccaaauuuucccacagaagguuuaucaccaucucaaguuacaauguucccacauauaauagucgauguucgucaauuagaaccaguacuaauaccccuacccgauguaagaaauaauuuuuaucacuauaaccaaucaaaugacccaacaaucaaauuaaucgcaaugcuauacaccccauuaagagcaaacaaugccggcgaagacguauucacaguuucaugcagaguauuaacucgaccgagcccugacuuugacuuuauauuccuaguccccccaacaguagaaucuagaacaaaaccauucacuguaccaauacuaacaguugaagaaaugacaaauucgcgauuuccaauuccacucgaaaaauuauuuaccgguccauccggagccuuuguaguccaaccucaaaacggacgcuguacaacagacgguguacuacuaggaacuacacaacuaucaccaguaaauauuugcacuuuuaggggugacguuacacacauagccggaacacauaacuauacaaugaacuuagcaucacaaaauuggaauaacuacgauccaacagaagaaauaccagcaccccuuggaacaccagauuuuguaggacgaauacaaggaaugcuaacucaaacaacuagaggugauggaucuacuagaggacacaaagccacaguaucaacaggugacguacacuuuacaccaaaacucggaucaauacaauucaacacagacacuaauaaugauuuugaaaccggacaaaauacacgauucacaccuguaggaguaguacaagacggaaacggaacacaucaaaacgaaccccaacaauggguucuacccucauauucaggaagaacaggccacaauguacacuuagcaccagcagucgcaccaacuuuuccaggagaacaauuacuauuuuuuagaucaacaaugccaggaugcuccggauaccccaacaugaaucuagacugccucuuaccucaagaauggguccaacauuucuaucaagaagcagcacccgcacaaucugacguugcacuauuacgauucguaaacccagacacaggacgaguauuauucgaaugcaaauuacauaaaucaggauauguuacuguagcacacacaggccaacaugaccuagucaucccacccaacggauauuucagauuugacucaugggucaaccaauucuacacacuugcaccaaugggaaacggaacaggaagaagaagagcauuauaa

SEQ ID NO: 32392 - RNA, 1623 nt, Artificial Sequence
  derived and/or modified sequence opt6 from capsid_protein__Norovirus__AAT00309
augaaaauggcuucaaaugacgcaaaucccucagaugguuccacagcaaacuuaguaccagaagugaauaacgaaguaauggccuuagaaccaguaguaggagcagccauagcagcuccagucgcaggacaacaaaaugucauagauccauggauaagaaauaacuucguacaagcucccgguggagaauucaccguaagcccacgcaacgcacccggugaaauacuauggagcgcuccacuuggaccagauuuaaauccauauuuaucucacuuagcacgaauguauaacgguuaugcaggcggauuugaaguccaaguaauccuagcaggaaaugcauuuacagcaggaaaaauuauauucgccgcaguacccccuaauuucccaacagaaggauuaucaccaucucaaguaacuauguuuccucacauuauaguagacguucgacaacuagaaccaguacuaauaccacuacccgacguucguaacaacuuuuaccacuauaaucaaucaaacgacccuacaauaaaacuaauagcuauguuauacacaccauuacgugcaaacaacgcaggagaagauguauuuacaguaaguugucgaguacuaacaagaccaaguccagauuuugacuucauauucuuaguuccaccuacaguagaaucaagaacaaaaccauuuacaguuccgaucuuaacuguugaagaaaugacuaauucaagauuuccaauuccucuugaaaaauuauuuacaggaccuucaggagcauuuguaguacaaccacaaaauggaagauguacaacagauggaguacuacuaggaacaacacaacuauccccaguaaacauauguacauuccgcggagacguaacacauauagcugguacacacaauuauacaaugaaucucgccucacaaaacuggaacaauuacgacccaacagaagaaaucccagcaccacuaggaacacccgauuuuguaggaagaauacaaggcauguuaacacaaacaacacgaggagauggaucgacucgaggucacaaagcaacaguaucuacaggagacguucacuuuaccccuaaacuuggaagcauacaauucaauacagacacaaacaaugacuucgaaacaggacaaaacacaagauucacaccaguaggcguaguacaagauggaaaugguacacaccaaaaugaaccacaacaauggguauuacccucuuacucaggaagaacaggacauaacguucaccuugcaccagcaguugcaccuacauuuccuggagaacaacuauuauuuuucagaucaaccaugccgggaugcucuggcuauccaaacaugaacuuagacugccuuuuaccccaagaauggguacaacauuucuaucaagaagcagcaccagcucaaucagauguagcauuauuaagauucguaaauccagacacaggaagaguauuauuugaaugcaaauuacauaaaucaggauacguaacaguagcacauacaggacaacacgauuuaguuauaccucccaauggcuauuuuagauucgauucuuggguaaaucaauuuuacacauuagcaccaaugggcaaugguacaggaagaagacgagccuuauaa

SEQ ID NO: 32393 - RNA, 1623 nt, Artificial Sequence
  derived and/or modified sequence opt6 from capsid_protein__Norovirus__AAT00312
augaaaauggcaucuaaugacgcaaacccaucagauggcuccaccgcaaauuuaguacccgaaguuaauaaugaaguaauggcuuuagaaccuguaguaggagcugcaauagccgcaccagucgcaggacaacaaaauguaauagauccuuggauacgaaauaacuuuguacaagcuccagguggagaauucacaguuucaccuagaaaugcaccaggugaaauacuauggucugccccccucggcccagaucuaaauccauauuuaagccauuuagcacguauguacaacgguuaugcaggaggauuugaaguacaaguaauuuuagcaggcaacgcauuuacugcaggaaaaauaauauuugcagcaguaccaccuaauuuuccaacagaagguuuaucaccaucacaaguaacaauguucccacauauuauaguagauguuagacaauuagaaccuguauuaauaccauuacccgacguaagaaacaauuucuaucacuacaaucaaucaaacgacccaacaauaaaauuaaucgcaaugcuauacacacccuuaagagccaacaaugcaggagaagauguuuucacuguuucgugcagaguacuuaccagaccaucuccagacuuugacuuuauauucuuagucccaccaacaguagaaagucgaacaaaaccauucacaguacccauauuaacaguagaagaaaugacaaacaguagauuucccauucccuuagaaaaauuauuuacagguccaucuggagccuucguaguccaaccucaaaacggccgauguaccacagauggaguuuuacuaggaacuacccaauuaucaccaguaaacauauguacuuucagaggagacguaacucauauagcaggaacacauaauuacaccaugaacuuagcaucacaaaauuggaauaauuacgauccuacagaagaaauaccagcaccacuaggaacaccagauuucguaggacggauacaaggaaugcuuacccaaacaacacgaggagauggauccacaagaggucacaaagccacagucucaacaggagacguacauuucacaccaaaacucgguaguauucaauucaauacagacacaaauaaugauuucgaaaccggucaaaacacaagauucacaccaguaggagucguacaagacggaaacggaacacaucaaaaugaaccccaacaauggguacuuccauccuauucagguagaacaggacacaauguucaucuugcaccagcaguugcaccaacauuuccaggagaacaacuacuuuuuuucagaucuacaaugcccggaugcuccggauauccaaauaugaaccuagauuguuuauuaccacaagaauggguacaacauuuuuaucaagaagcugcuccagcucaauccgacguagcccuauuaagauucguuaauccagauaccgguagaguacuauucgaaugcaaauuacauaaaucgggauacguaacaguagcacacaccggacaacaugacuuaguaaucccucccaauggauauuuuagauuugauucauggguaaaucaauucuauacacucgccccaaugggaaauggaacuggucgaagaagagcauuauaa

SEQ ID NO: 32394 - RNA, 1623 nt, Artificial Sequence
  derived and/or modified sequence opt6 from capsid_protein__Norovirus__AAT00315
augaaaauggcaucaaaugaugcaaauccaucagauggaucaacagcaaauuuaguaccagaaguaaacaaugaaguaauggcucuagaacccguaguaggcgcugcaauagcagcaccaguagcgggacaacaaaacguaauugacccuuggaucagaaauaacuuuguacaagcaccaggaggugaauuuaccguaucaccacgaaaugcaccaggagaaaucuuauggagugcaccacuaggaccagaucuaaauccuuaucuaucucacuuagcacguauguauaacggcuaugcaggaggcuuugaaguacaaguaauacuagcaggaaacgcauucaccgcaggaaaaauaauauucgcugcagugccaccaaauuuucccacagaaggacuaaguccaucacaaguaacaauguuuccacacauaauaguugacguaagacaacuagaaccaguacucauaccauuaccagauguaagaaacaauuucuaucacuacaaccaaucaaaugaccccacaauaaaacuaauagcaaugcuuuauacaccuuuaagagcaaacaaugcuggagaagacguauuuacaguuucauguagagucuuaacaagaccauccccagacuuugacuucauauuccucguaccucccacaguugaauccagaacaaaacccuucacaguaccaauacuaacagucgaagaaaugacaaacucuagauuuccaauaccucuagaaaaacuauucacgggaccaucaggagccuuuguaguacaaccacaaaacgguagauguacaacagacggaguacuacuaggaacaacacaacuaucaccuguuaauauaugcacauucagaggugacguaacacauauagcuggaacucacaauuacacuaugaaucuagcuucacaaaacuggaacaauuacgauccaacagaagaaauaccagcuccauuaggaaccccugacuuuguaggaagaauacaagggaugcuaacacaaacaacgcgaggagaugguaguacccgaggacacaaagcuacugucucaacaggcgauguacauuucacaccaaaauuagguuccauucaauucaauacagauacaaauaaugacuuugaaacuggucaaaacacccgauucacaccaguaggaguuguacaagacgguaauggaacacaucaaaacgaaccacaacaaugggucuuaccauccuauucuggaagaacaggacauaacguacacuuagcaccagcuguagcuccaacauuuccuggagaacaacuuuuauucuuucgcaguacaaugccaggaugcucaggauaccccaauaugaauuuagauuguuuacuaccacaagaauggguacaacauuucuaucaagaagccgcaccagcgcaaucugacguagcauuacuaagauucguaaacccagauacaggaagaguuuuauuugaauguaaauuacacaaaucaggauaugucaccguagcccacacaggacaacacgacuuaguuaucccaccaaacgguuauuucagauucgauucauggguaaaucaauuuuauacacuagcaccaaugggaaacggaacaggacgaagaagagcacuauaa

SEQ ID NO: 32395 - RNA, 1623 nt, Artificial Sequence
  derived and/or modified sequence opt6 from capsid_protein__Norovirus__AAT00318
augaaaauggccucuaaugacgcuaauccaagugacggaucaacugccaacuuaguaccagaaguuaauaaugaagucauggcauuagaaccaguuguuggagcagcuauugcagcaccaguagcuggucaacaaaaugucauagacccuuggauaaggaauaacuuuguccaagcucccggaggugaauuuacaguuuccccacgcaacgcaccuggagaaauauuauggucagcaccucuaggcccagaccuaaauccauaucuaucacacuuagcacgaauguacaacgguuacgcuggaggauucgaaguacaaguaauauuagcaggcaacgccuuuaccgcaggaaaaauuauuuucgccgcaguaccaccaaacuucccaacagagggacuaucaccaucacaaguaaccauguucccacacauaauaguagacguuagacaacuugaaccaguacuaauaccauuaccugauguucguaacaauuuuuaccacuauaaccaaucaaaugaucccacaauaaaacuaaucgcaaugcuuuacacuccauuaagagcaaauaacgcaggagaagauguauuuacagucuccugcagaguacuaacacgaccuucaccagacuucgacuuuauuuuuuuaguaccacccacugucgaaucacguacuaaaccuuuuacaguaccaauacucacaguugaagaaaugacaaacucuagauuuccaauaccuuuagaaaaacuauuuaccggacccagcggagcauucguaguacaaccacaaaacggacgauguacaacagauggaguauuacuaggaacaacccaauuauccccaguaaauauaugcacuuuuagaggugauguaacacacauagcaggcacacauaacuacacuaugaacuuagcaucacaaaauuggaauaacuacgauccaacagaagaaaucccggcaccauuaggaacaccagacuuuguaggcagaauucaagguaugcuaacacaaacuacacgaggagacggaucuacaagaggacauaaagcuacaguaucaacuggagacguccacuuuacaccaaaacuaggaucaauucaauuuaauacagauacaaacaacgacuucgaaacaggacaaaacacaagauucacuccaguuggaguaguccaagauggaaacggaacacaccaaaaugaaccacagcaauggguauuaccaaguuauucaggaagaacaggacauaauguacaccuagccccagcaguagcaccaacauucccaggugaacaacuauuauucuucagauccacuaugccagguuguucagguuauccaaauaugaaccucgauuguuuacuaccacaagaauggguacaacauuucuaccaagaagcagcuccagcacaauccgauguagcacuucuucguuuuguuaacccugacacuggaagaguauuauucgaaugcaaacuacacaaaucuggauauguaacaguagcacacacaggccaacacgacuuaguaaucccuccuaauggauacuucagauucgauucaugggucaaccaauuuuacacucuagcaccaaugggaaaugguacaggcagaagaagagcauuauaa

SEQ ID NO: 32396 - RNA, 1623 nt, Artificial Sequence
  derived and/or modified sequence opt6 from capsid_protein__Norovirus__AAT00321
augaaaauggcauccaacgaugcaaacccauccgacggaucaacagcaaaucuaguacccgaaguaaauaaugaaguuauggcauuagaaccaguaguaggugcagcaauagcagccccaguagcaggacaacaaaauguuauugacccauggauaagaaacaacuuuguacaagcaccaggcggcgaauuuacaguaucuccacgaaacgcaccaggcgaaauauuauggucagcaccacuaggaccagaucuaaacccuuaucuaucacauuuagcaagaauguauaauggauaugcaggaggcuucgagguacaaguaauacuagccggaaaugcauuuaccgcaggaaaaauaauuuucgcugcaguaccuccuaacuuccccacugaaggacuuuccccaucacagguaacaauguuuccucacauaauaguagauguaagacaauuagaaccaguucuaauuccacuuccugacguaagaaauaacuucuaucacuacaaccaauccaaugaccccacaauaaaacucauagcuauguuauauacuccauuaagagcaaacaacgcaggagaagacguauuuacaguuucaugcagaguuuuaacgaggccaaguccagauuuugacuucauauuccuaguuccuccaacaguugaaagucgaacaaaaccauucaccguaccaauccuaaccguagaagaaaugacaaauucacgauuuccuauaccauuagaaaaauuauuuacagguccaucuggagcuuucguaguacaaccccaaaacggaagaugcacaacagacggaguacucuuagguacaacacaacugucuccaguuaacauaugcacuuuccgaggagacguuacccacaucgccggaacacauaauuacacgaugaaucuagcaucucaaaacuggaacaauuacgauccaacagaagaaauacccgcaccucuaggaacaccagacuucguuggaagaauacaaggcauguuaacccaaaccacuagaggagacggaagcacaagaggucacaaagcaaccguaucuacaggagauguacacuucacaccaaaauuaggaucaauucaauucaauacagacacaaauaacgacuucgaaacaggccaaaacacaagauuuacaccaguagguguuguacaagacggaaacggaacacaucaaaaugaaccucaacaaugggucuuaccaucauauucugguagaaccggacauaacguacauuuagcaccagcagucgcaccuacauuuccaggagaacaauuauuauucuuucgaucaaccaugccaggaugcucuggcuauccaaacaugaacuuagauuguuuauuaccacaagaauggguacaacauuucuaucaagaagcugcaccagcacaaucagacguugcucuacuaagauucgucaauccagacacuggacgaguccuauuugaaugcaaauuacauaaaucuggauacgucacaguagcucacacaggacaacacgaucuaguaauaccuccaaauggauauuuucguuucgauuccuggguuaaccaauuuuacacacuagcaccaaugggaaaugguacaggccguagaagagcacuuuaa

SEQ ID NO: 32397 - RNA, 1623 nt, Artificial Sequence
  derived and/or modified sequence opt6 from capsid_protein__Norovirus__AAT00324
augaaaauggccucaaacgacgcaaauccauccgauggaucaacugcuaacuuaguuccagaaguaaacaaugaaguaauggcauuagaaccaguagucggagccgcaauagcagcaccaguagcaggccaacaaaauguaauagacccauggauaagaaacaacuucguacaagcaccaggaggagaauuuacaguaucuccaagaaacgcaccaggugaaauacucuggucugccccacuaggaccagaucuaaaucccuauuuaucacacuuagcacgaauguauaacggauacgccggcggauuugagguucaaguaauacuagcaggaaaugcauuuacagcuggaaaaauaauauucgcagcaguuccaccuaauuucccaacagaaggacuaagcccaucucaagucacaauguuuccacacauaaucguagauguacgacaacuagaaccuguucuaauaccccuaccagauguacgaaacaauuucuaucauuacaaccaaaguaaugauccaaccauaaaacuuauagcaauguuauauacaccacuacgagcaaauaaugcuggagaagauguauucacaguaucaugucgaguacuuacaagaccuucaccagacuucgauuucauauuccucguuccacccacuguagaaucaagaacuaaaccuuucaccguacccauacuaacaguagaagaaaugaccaauucccgauuucccauaccauuagagaaacucuuuacagguccaucaggcgcauucguaguccaaccucaaaacgguagaugcacuaccgacggaguucuacuaggcacaacacaacuaucaccaguuaacauaugugcauuuagaggagacguaacacauauagcuggaacccauaauuacaccaugaaccuagcuucacaaaacuggaauaauuacgauccuacugaagaaauaccagcaccauuaggaacaccagauuuuguagguagaauacaaggaaugcuaacacaaacaacucgcggagacggaucaacuagaggucacaaagcuacuguauccacaggugauguccacuucacuccaaaauuaggaucuauccaauuuaauacagacacaaauaaugauuucgaaacaggucaaaauacaaaauucacuccaguaggaguaguucaagacggaaacggcacucaccaaaaugaaccacaacaauggguacuaccaucauauaguggcagaacuggccauaauguucacuuagcuccagcaguagcgccaaccuuuccaggagaacaacucuuauucuucagaucaacaaugcccggcuguucaggauacccaaauaugaacuuagauugucuauuaccacaagaauggguacaacauuucuaccaagaagcagccccagcacaaucagacguagcccuauuacguuuuguaaacccagauacaggaagaguauuauuugaauguaaacuacauaaaucaggauacgucaccguagcccacacaggacaacacgaucuaguaauacccccaaauggauauuuucgcuucgacucauggguaaaucaauuuuacacauuagcaccaaugggaaauggaacuggacguagaagagcccuauaa

SEQ ID NO: 32398 - RNA, 1623 nt, Artificial Sequence
  derived and/or modified sequence opt6 from capsid_protein__Norovirus__AAT00330
augaagauggcuucaaacgaugcaaauccuucagacggaucaacagcaaacuuaguaccugaaguaaacaaugaaguaauggcauuagaaccaguaguaggagcagcaauagcagcucccguagcaggacaacaaaacgucaucgauccauggauaagaaauaacuuuguacaagcaccaggcggcgaauuuaccguaucacccagaaacgcgccaggagaaauccuuuggucagcaccacucggaccugaccucaacccauacuuaucucaucucgcacgaauguauaacggcuacgcugguggauucgaaguacaaguaauacuagcaggaaacgcuuucacagcaggcaaaauaauauuugcagcuguaccaccaaacuuuccuaccgaaggacuuaguccaucucaaguaacaauguuuccacauauaauaguagauguaagacaacucgaaccaguacuaauaccucuaccagauguaagaaauaauuuuuaccacuacaaccaaucaaaugacccuacaauuaaauugauagcaaugcuauauaccccauuaagagcaaacaaugcaggagaagacguauuuacagucuccugucgaguuuuaacuagaccaucuccagacuuugacuuuauauuuuuaguaccaccaacaguagaaucaagaaccaaaccauucacaguuccaaucuuaaccguagaagaaaugaccaauucuagauucccaauacccuuagaaaaauuauuuacagguccaucaggcgcauucguaguacaaccucaaaacggacguuguacaacugauggaguacuacuaggcaccacucaacuaucucccguaaacauauguacuuuuagaggagacgucacacauauagcaggaacacacaauuacacaaugaaucuagcaucacaaaacuggaauaauuaugacccaacagaagaaauaccagcaccacuagguaccccugacuucguaggaagaauacaaggaauguuaacccaaacaacaagaggagaugguuccacaagaggacauaaagcaacuguaucaacaggagacguccacuucacaccaaaauuaggaucuauucaauucaacacagauacaaauaaugauuuugaaacaggucaaaauacaaaauuuacaccaguuggaguuguacaagaugguaacggaacacaucaaaaugaaccucaacaauggguacuaccuuccuauucaggaaggaccggucacaacguucaccuagcaccagcagucgcgccaaccuucccaggagaacaauuauuauuuuucagaucagcaaugccaggcuguucaggauauccaaauaugaacuuagauugcuuacugccacaagaauggguucaacauuucuaucaagaagcagcacccgcacaauccgacguagcacuauuaagauucguaaauccagacacaggaagaguuuuauucgaaugcaaacuacacaaaucaggauauguaacuguagcacacacaggacaacacgaucuaguaauccccccaaacggauacuuccguuuugauucauggguuaaucaauucuauacacuagcaccaauggguaauggaacaggacgaagaagagcuuuauaa

SEQ ID NO: 32399 - RNA, 1623 nt, Artificial Sequence
  derived and/or modified sequence opt6 from capsid_protein__Norovirus__AAT00333
augaaaauggcaagcaacgacgcaaauccaucagaugguucaaccgcuaacuuagucccagaaguaaauaaugaaguaauggcacuagaaccaguaguaggugcagcuauagcagcaccaguagcaggucaacaaaacgucauugaccccuggauacgaaacaacuucguacaagcaccaggaggcgaauuuacaguaucaccaagaaacgcaccaggagaaauacuauggucagccccauuaggaccagauuuaaauccauauuuaucucaccuugcuagaauguauaauggauaugcaggagguuuugaaguacaaguuauauuagcaggaaacgcauucaccgcaggaaaaauaauauuugcagccguaccaccaaauuuuccaacagaaggauuaucaccaucacaaguuacaauguucccucacauaauaguagacgucagacaacuagaaccuguauuaauacccuuaccagauguuagaaauaauuucuaucauuauaaucaaucuaaugaccccacaauaaaacuaauagcaauguuauacaccccccucagagcaaacaaugccggagaagacguauucacaguaaguuguagaguauuaaccagaccaucuccagacuuugauuuuauauuucucgucccaccaacaguagaauccagaacaaaaccauuuacaguaccaauccuuaccguagaagagaugacaaacucucguuucccaauaccccucgaaaaauuauucaccggcccaucaggagcguucguaguccaaccacaaaacggaagauguacaacugauggaguauuacuuggaacaacacaacuaucaccuguuaacauauguacguucagaggagauguuacucauauagcuggcacacauaacuauaccaugaaucuagcaagucaaaacuggaauaauuacgauccaacagaagaaaucccagccccauuagguacacccgauuuuguaggucgaauacaaggaaugcuuacucaaacaacuagaggcgauggauccacaagaggacacaaggcaaccguaagcacaggcgacguccacuuuacaccaaaguuaggauccauccaauucaauacugauacaaauaacgauuucgaaaccggacaaaauacaaaauuuacaccuguaggagucguacaagauggaaauggaacacaucaaaaugaaccacaacaauggguucuuccuucauauucuggaagaacaggacauaacguacacuuagcaccagccguugcaccuacauucccuggagaacaacuacuauuuuuucgaucagcaaugccaggaugcucaggauacccaaauaugaaucuagauugucuacuaccacaagaauggguacaacauuucuaucaagaagccgcaccagcucaaucagauguagcauuauuaagauuuguuaacccagacacaggcagaguucucuucgaaugcaaacuacauaaaucaggauaugugacuguugcacauacaggacaacaugaucuaguaauacccccaaaugguuauuuccgauuugacucauggguaaaucaauuuuacacucuagcaccaauggguaauggaaccggucgaagaagagcauuauaa

SEQ ID NO: 32400 - RNA, 1623 nt, Artificial Sequence
  derived and/or modified sequence opt6 from capsid_protein__Norovirus__AAT00336
augaaaauggcuucaaaugaugccaaucccucagacggaagcacagcaaaucuagucccagaaguaaacaacgaagucauggcauuagaaccaguuguaggagcagcaaucgcagcacccguagcaggucaacaaaacguaauagacccauggauaagaaauaacuucguacaagcaccuggaggagaauuuacgguaucaccuagaaacgcaccaggcgaaauauuauggucagcuccucuaggaccagauuuaaaucccuauuuaucacacuuagcacgaauguacaaugguuaugcaggagguuucgaaguacaaguuauauuagcuggaaaugcauuuacugcagguaaaauuauuuuugccgcaguaccaccuaacuucccuacugaaggucuaucuccaucacaaguuacaauguuuccucacauaauuguagacgucagacaauuagaaccaguucuaauaccauuacccgacguaagaaacaauuucuaccauuauaaucagucuaaugauccaacaauuaaacuaauagcaaugcuuuacacaccuuuaagagcaaauaaugcaggagaagauguguuuacagucucuugcagagucuuaacuagaccuaguccagacuuugauuucaucuuuuuaguaccaccaacagucgagagucgaacuaaaccuuuuaccguaccaauacuaacuguugaagaaaugacaaauagcagauuuccaauacccuuagaaaaauuauuuacaggaccaucaggugcuuucguaguucaaccacaaaauggaagguguacaacugauggaguacuccuaggaacuacacaauuaucacccguuaauauauguacauucagaggcgacgucacucacauagcagguacacacaacuacacaaugaaccucgcaucacaaaacuggaauaauuacgauccuacagaagaaauaccagcaccauuaggcaccccugauuucguuggaagaauacaaggcaugcuaacacaaacaacccgaggagaugguuccacuagaggacauaaagccacagucucaacuggugauguacauuucacaccaaaacucggcuccauacaauucaauacagauacaaacaaugauuucgaaacaggucaaaacaccaaauucacacccguaggaguaguacaagacggaaacggaacucaucaaaaugaaccacaacaauggguacuaccaucauauucaggaagaacaggacauaacguacauuuagcucccgcuguagcaccaacauuuccaggagaacaacuacuauucuuucgaagugccaugcccggauguucaggauauccaaauaugaaucuugacugcuuauuaccacaagaauggguacaacacuucuaucaagaagcagcaccggcucaaucagacguagcacuacuacgcuucguaaacccagauaccggacgaguauuauucgaaugcaaacuacacaaauccggauauguaacagucgcacauacuggacaacacgaccuaguaauuccuccaaauggauacuuccgguucgacagcuggguaaaucaauuuuacacucuagcaccaaugggaaauggaacagguagaagaagagcauuauaa

SEQ ID NO: 32401 - RNA, 1623 nt, Artificial Sequence
  derived and/or modified sequence opt6 from capsid_protein__Norovirus__AAT00342
augaaaauggcaucuaaugaugccaauccauccgauggaucaacggcaaaccuaguaccagaaguaaauaaugaaguaauggcacuagaaccaguaguaggagccgcaaucgcagcaccaguagcaggacaacaaaaugucauagauccauggauacgaaauaacuuuguacaagcaccuggaggagaauucacuguaucaccacgaaaugcaccuggagaaauauuauggucagcaccacuaggaccagauuuaaauccauaucuuucacacuuggcaagaauguacaacggauaugcaggagguuucgaaguacaaguaauucuagcaggaaaugcauucaccgcaggaaaaauaauauuugcugcaguaccaccaaacuucccaacagaaggacuaucgcccagccaaguaacuauguuuccacauauuauaguagacguuagacaacuagaaccaguauuaauaccacuaccagacguuagaaauaauuucuaucacuauaaccaauccaaugacccaacuauaaaauugaucgcaaugcuuuacacuccauuaagagcuaacaaugcaggcgaagauguauuuacagucucaugucgaguucuaacuagaccuucaccagacuuugacuucauauuucuaguuccaccaacaguugaaucaagaaccaaacccuuuacaguuccuauauuaacaguugaagaaaugacaaauucaagauucccaauaccauuagaaaaauuauucacaggcccaucaggcgcauuuguuguucaaccacaaaacggaagauguacuacagacggaguacuguuaggaacaacccaauuaucacccguaaacauauguaccuucagaggugauguaacacacauagcaggaacacacaacuauaccaugaaucuagcaucccaaaauuggaauaauuacgacccuacagaagaaauaccagcaccacuaggaacaccagauuuuguaggacgaauucaaggaaugcuaacucaaacaacacgaggagauggaucuacccgcggacauaaagcaacaguuuccacaggcgauguacacuucaccccuaaauugggaucaguucaauucaauacagauacaaacaacgacuucgaaacuggccaaaauacaaaauucacaccuguuggaguaguacaagacggaaacggagcacaucaaaacgaaccacaacaaugggucuuaccuucauauucaggucgaacaggacauaauguucaccuagcaccugcaguagcaccaacauuuccaggcgaacaauuacuauucuuuagaucaacaaugccaggcuguucaggcuauccaaauaugaaucuagacugucuacuuccucaagaauggguacaacacuuuuaccaagaagcugcaccagcucaaucagacguagcauuacuaagauuuguaaaccccgauacaggaaggguauuauucgaaugcaaauuacacaaaucugguuacguaacggucgcacauacaggacaacaugaucuaguuaucccucccaauggcuauuucagauucgauucauggguaaaucaauuuuauacacuagcaccaaugggaaauggaacuggucgaagacgagcuuuauaa

SEQ ID NO: 32402 - RNA, 1623 nt, Artificial Sequence
  derived and/or modified sequence opt6 from capsid_protein__Norovirus__AAT00345
augaaaauggcaaguaacgaugcaaacccaucagaugguucaacugcaaaucuaguaccugaaguaaacaacgagguaauggcuuuagaaccagucguaggagccgcuaucgcagcaccaguagcaggccaacaaaacgucaucgauccauggauacguaacaacuuuguucaagcaccagguggagaauucacaguaucaccacgaaacgccccaggagaaauucuauggucagcuccucuuggcccagauuuaaaucccuacuuaucucacuuagcacguauguauaacggauaugcaggcggauucgaaguacaaguaauacuagcaggaaaugcauucaccgccgguaaaauuauauuugcagcaguaccaccaaacuuuccuacagaaggacucagcccaucccaagucacaauguucccccauauaauaguagauguacgacaacuagaaccaguacuaauuccacuaccugacguucgcaauaacuucuaucauuacaaccaaagcaaugauccuacaauuaaauuaauagcaaugcuauauaccccauuaagagcaaacaacgcaggagaagauguauuuacugucaguuguagaguauuaacaagaccauccccugacuucgauuuuaucuuccuaguaccaccaacaguagaaucaagaacaaaaccuuucacagucccaauacuaacagucgaagaaaugacaaacucaagauuuccaauaccuuuagaaaaacuauucacaggaccauccggagcauucguaguucaaccacaaaaugguagauguacaacagauggaguuuuauuagguaccacacaacuaucacccguuaauauaugcacauuuagaggagacguaacacauauagccggaacacacaacuacacuaugaaucuagccagccaaaauuggaauaacuacgacccuacagaagaaauaccagcaccacuugguacaccagacuuuguaggacguauacagggcaugcucacucaaacaacacguggagacggaucaacaagaggucacaaagcaacagucucaacaggagacguacauuucacaccaaaacuaggcucaauacaauucaauacagauacaaauaacgauuucgaaaccggacaaaauacaagauucaccccaguaggcgucguacaagacgguaauggaacacaucaaaaugaaccacaacaauggguuuuaccuucauacucuggacgaacaggacauaauguacaucuagcaccagcaguugcaccaacauuuccaggugaacaacucuuauuuuuuagaucaacaaugccagguugcucagguuacccgaauaugaaccuagauugcuuacucccacaggaauggguacaacauuucuaccaagaagcagcaccugcacaaucugauguagcauuacuaagauuuguaaacccagacacaggaagaguauuauuugaaugcaaauuacauaaauccggcuauguaacaguagcucauacaggacaacaugaucuaguaauaccucccaacggauacuuuagauuugauucuuggguuaaucaauuuuacacucuugcaccuaugggaaauggaacaggaagacgaagagcauuauaa

SEQ ID NO: 32403 - RNA, 1623 nt, Artificial Sequence
  derived and/or modified sequence opt6 from capsid_protein__Norovirus__AAT00348
augaaaauggcauccaacgacgccaacccuagugauggaucaacagcaaacuuaguacccgaaguuaacaaugaaguaauggcacuagaaccaguaguaggcgcagcaaucgcggcaccagucgcuggacaacaaaauguuauagacccauggauacgaaauaacuuuguccaagcaccuggaggagaauuuacaguaucaccuagaaaugccccuggagaaauacuauggucagcaccucuaggaccagaucuuaauccauaccucucgcauuuagcaagaauguauaacgguuacgccggcgguuuugaaguacaaguuauauuagcaggcaaugcauucacagcugguaaaauaauauuugccgcuguucccccuaacuuuccaacagaaggauuauccccaucacaaguuacaauguucccacacauaauuguagacguaagacaacucgaaccaguccucauccccuuaccagauguacgcaauaauuucuaucacuacaaccaaucaaaugauccaaccauaaaauuaaucgcuaugcuauauacaccauuaagagcaaacaaugcaggagaagacguauuuaccguaucauguagaguccuaacaagacccucaccagacuucgacuuuauauuucuaguacccccaacaguagaaagccgaacaaaaccauuuacugucccaauauuaacaguugaagaaaugacuaacucaagauucccaauaccacuagaaaaacuuuucacuggacccucaggagcauucgucguacaaccacaaaauggaagaugcacaacagacggaguauuauuagguacaacucaacuuuccccaguaaauauauguaccuuuagaggugacguaacacauauagcaggaacucauaacuacacaaugaacuuagccucacaaaacuggaacaauuacgauccaacugaagaaaucccagcaccacucgguacaccagauuucguaggaagaauucaaggaaugcucacccaaacuaccagaggggacggaucaacaagaggacacaaagcuacaguaucaacuggagauguucauuucacaccaaaacucggcucaauacaauucaauacagacacaaauaacgauuucgaaacaggacagaacacacgauucacuccuguuggaguaguacaagacggaaacggaacacaucaaaaugaaccucaacaauggguacuaccuucuuauucaggaagaacaggacacaacguccaucuugcaccagcaguagcuccaaccuucccaggagaacaauuacuauuuuuuagaucaaccacccccggaugcucuggauacccaaauaugaaucuagacuguuuacuaccacaagaauggguucaacauuucuaucaagaagcagcaccagcacaaucagauguagcccuacuaagauucguaaacccugacacaggcagaguuuuauucgaauguaaauuacauaaauccggcuauguaaccgucgcacacacaggacaacaugaccuaguaauacccccuaaugguuacuuccgauuugauucauggguuaaucaauuuuauacuuuagcaccaaugggaaauggaaccggaagaagacgagcucuauag

SEQ ID NO: 32404 - RNA, 1623 nt, Artificial Sequence
  derived and/or modified sequence opt6 from capsid_protein__Norovirus__AAT00351
augaaaauggccucaaaugacgcuaacccaucagauggaucaacagcuaaucuaguaccugaaguaaacaaugaaguaauggcacuagaaccaguaguuggagccgcaaucgcagccccuguagcaggacaacaaaauguaauagauccauggauaagaaauaacuuuguacaagcaccuggaggcgaauucacaguaucaccucgaaaugcaccaggagaaauacuauggucagcaccacuaggucccgaccuuaauccauaucuaucacaucuagcuagaauguauaacggauaugcaggaggauuugaaguacaaguaauucuagcaggcaaugcuuuuacagcagggaaaaucauauucgcagcaguaccacccaacuuuccaacugaaggucuaucaccuucacaagucaccauguucccacauauaaucguagacguuagacaacucgaaccagucuuaauccccuuaccagauguuagaaauaauuuuuaucauuacaaucaaucaaacgacccaacaauaaaauuaauagcuaugcuauacaccccauuacgagcaaacaacgccggcgaagauguauuuacuguuagcugucgaguacuuaccagacccucaccagauuuugauuuuauauuucuuguaccaccuacuguugaaucacgaacaaaaccauuuacaguccccauauuaaccguagaagaaaugacaaacucacgauuuccuauaccacucgaaaaauuauuuacuggacccuccggagcauuuguuguacaaccacaaaacggaagauguacaaccgacggaguacuucuaggaacaacacaauuaucacccguaaacauauguacauuuaggggagacgucacacauauagcuggaacucacaauuauacaaugaaucuagccucacaaaacuggaacaauuaugacccaacagaagaaauaccugcaccauuagguacuccugacuucguagguagaauacaaggaaugcuuacccaaaccacaagaggagacgguucaacacgaggacacaaagcaacuguuucaacuggagauguacacuuuaccccaaaauuaggcucaauacaauucaauaccgauacaaacaacgauuuugaaacaggacaaaacacuagauucaccccaguaggaguaguccaagacggaaacggaacacaucaaaacgaaccccaacaauggguucuaccaucauauucaggacgaacaggacacaacguccacuuagccccagcaguagcacccacauucccaggagaacaacucuuauuuuuuagaucaacaaugcccgguuguaguggauaucccaacaugaaccuagauugcuuacuaccacaagaauggguacaacauuuuuaccaagaagcugcaccagcccaauccgaugucgcauuacuaagauuuguaaaucccgacacuggcagaguacuauuugaauguaagcuacacaaaucaggauacgucacaguagcucacacuggucaacaugaucuaguaauaccaccaaauggcuauuuuagauuugauucaugggucaaucaauuuuauacucucgcaccaauggggaacggaacaggacgaagaagagcuuuauaa

SEQ ID NO: 32405 - RNA, 1623 nt, Artificial Sequence
  derived and/or modified sequence opt6 from capsid_protein__Norovirus__AAT00354
augaaaauggccagcaaugacgcuaacccuucagacggcuccacagcaaaccuaguaccagaaguaaacaaugaaguaauggccuuagaaccuguaguaggagcugcaaucgcagcaccuguugcuggacaacaaaauguaauagauccauggauaagaaauaauuuuguacaagcuccaggaggugaauucaccguaucaccgagaaaugcuccuggagaaauacuuuggucugcaccacuaggaccagauuuaaaucccuacuuaucacaucuagcaagaauguauaauggauacgcagguggauucgaaguacagguaauauuagcgggaaaugcauuuaccgcaggaaaaauaauauuugcagcaguacccccaaacuuuccaaccgaaggacuauccccaucacaaguaacaauguuuccacacauaauaguugacguuagacaauuagaaccaguacuaauuccauuacccgauguaagaaauaauuuuuaucacuauaaucaaaguaaugacccaacaauaaaacuaauagcaauguuguacacaccauuaagagcaaacaaugcaggagaagauguuuucacaguaucauguagaguccugacuagaccaucaccagacuuugacuuuauuuuucuaguaccaccaacuguagaaucuagaacaaaaccauuuacaguaccaauauuaacaguagaagaaaugacuaacucucguuucccaauaccauuagaaaaacuauuuacuggaccuuccggcgcauucguaguccaaccacaaaauggaagauguacaacugacggaguauuauuaggaacaacacaacucucuccuguaaauauuugcaccuuuagaggagacguaacacauauagcuggaacacacaauuacacaaugaaccuagcaucacaaaacuggaauaacuaugacccaaccgaagaaaucccagcaccacucgguacuccagacuucguaggaagaauucaaggaaugcuuacacaaacuacacgaggagacggcucaacuagaggacacaaagcaacaguaucaacuggagauguacacuuuacaccuaaauuaggaucaauccaauucaacacagauacaaacaacgauuuugaaacaggacaaaacacucguuuuacaccaguagguguaguacaagacgguaaugguacacaccaaaaugaaccacaacaauggguacuaccuucauacucaggacgaacaggccauaauguacaccuagccccagcaguugcuccuacauuuccaggugaacaauuauuauucuuucgauccacaaugccaggaugcucaggauaucccaauaugaaucuagauugucuauuaccacaagaauggguccaacauuuuuaccaagaagccgccccagcccaauccgacguugcauuauuaagauucgugaauccugauacaggucgcguauuauuugaaugcaaauuacauaaauccggcuauguaaccgucgcacauacuggacaacaugaucuuguuauaccaccaaauggcuacuuuagauucgauucauggguuaaucaauucuacacacuagcuccuaugggaaacggaacaggacgaagaagagccuuauaa

SEQ ID NO: 32406 - RNA, 1623 nt, Artificial Sequence
  derived and/or modified sequence opt6 from capsid_protein__Norovirus__AAT00357
augaaaauggcauccaacgacgcuaacccuucugacggaucaacagcaaaucuaguaccugaaguaaacaaugaaguaauggcucuagaacccguuguaggagcagcaauagcagcacccgucgcaggacaacaaaauguuauagaccccuggauacgaaauaauuucguucaagccccaggaggagaauucacaguaucaccuagaaaugcaccaggagaaauuuuauggucagcaccacuaggaccagaccuaaauccauaucuaagucacuuagcucgaauguauaauggauacgcaggaggauuugaaguucaaguaauacuagcagguaaugcauucacagcgggaaaaauaauauucgcagcaguuccaccaaauuucccuacagaaggacuaucuccaucucaaguaacaauguuuccacauauaauaguagacguaaggcaacuagaaccggucuuaauaccuuuaccagauguaaggaacaauuuuuaucauuauaaucaaucaaacgauccaacuauaaaacuaauagcaaugcuauauacaccccuacgagcaaacaaugcaggagaggauguuuuuacaguaucaugcagaguauugacaagaccauccccagacuuugauuuuauauucuuaguaccaccaacuguagaauccagaaccaaaccuuuuacaguaccaauucugacaguagaagaaaugacaaauucaagauuuccuauuccacucgaaaaacuauucacaggaccaucuggagccuucguaguacaaccacaaaacggacguuguacaaccgacgguguccuucuaggaacaacacaacuauccccagucaauauaugcaccuuuagaggagaugucacacauauagccggaacucauaacuacacuaugaaucuagcaucacagaauuggaauaauuaugauccuacagaagaaauaccugcaccauuaggcacaccagauuuuguaggccgaauacaaggaaugcuuacacaaacaacaagaggugacggaucaacuagaggacauaaagcaacaguuagcacuggagacguacacuuuacaccuaaauuaggaucaauacaauuuaauaccgacacaaauaaugauuucgaaacaggacaaaauacaagauuuacaccaguagggguaguacaagauggaaacggcacacaucaaaaugaaccacaacaauggguacucccaucauauucaggccgcacaggacauaacguacacuuagcuccagcaguugcaccaaccuuucccggugaacaauuacucuuuuuuagaucaacuaugccaggauguagcggauauccaaauaugaaucuagauugucuauuaccucaagaauggguacaacacuuuuaccaagaagcagcaccagcacaaucagacgucgcauuauuaagauucguaaacccagacacaggacgaguauuauuugaaugcaaacuacauaaaucuggauacgucacuguagcacauacaggucaacaugaccuaguuauaccaccuaacggauauuucagauuugacucauggguaaaccaauucuauaccuuagcuccaaugggaaauggaacagguagaagacgagcccuauaa

SEQ ID NO: 32407 - RNA, 1623 nt, Artificial Sequence
  derived and/or modified sequence opt6 from capsid_protein__Norovirus__AAT00360
augaaaauggcauccaaugaugcaaauccuagugauggaaguaccgcaaacuuaguaccagaaguaaauaaugaaguaauggcacuagaaccaguaguaggagcagcaaucgcagcacccguagcaggccaacaaaauguaauagacccauggauuagaaauaauuuuguacaagcaccaggaggugaauuuacaguaucaccuagaaacgcaccaggagaaauauuauggucagcaccauuagguccagaccuaaacccauaucuaucacauuuagcacgaauguauaaugguuacgcaggaggauucgaaguucaagucauacuagcaggaaaugcauuuaccgcaggcaaaauaauauucgcugcaguaccaccuaauuucccuacagaaggucuaucaccaucacaaguaacaauguucccacacauaauaguugaugucagacaacuagaaccaguacuaauaccuuuaccagacguaagaaacaauuucuaccacuacaaccaaucuaaugacccaacaauuaaauuaauagccauguuauacacaccacuacgagcuaacaaugcaggugaagauguauuuacaguuucaugucgaguacuaacaagaccaucaccagacuuugacuuuaucuuuuuaguaccaccuacaguagaauccagaacaaaaccauuuaccguaccuauacucacaguagaagaaaugacaaacucaagauucccaauuccacuagaaaaauuauuuacaggaccaucuggagcauucguaguacaaccacaaaacggcagauguacuacagacggaguauuacuagguacaacacaacuaaguccaguuaauauauguacauuccgaggugacguaacacauaucgccggaacgcauaauuauacaaugaauuuagccagccaaaauuggaauaauuacgauccuacagaagaaauaccagcuccauuaggaacucccgacuuuguaggacgcauacaaggaaugcuaacacaaaccacaagaggugauggaucaacaagaggacauaaagcaacuguaucaacaggcgauguacauuuuacaccaaaacuugguucaauacaauucaauacagacacaaauaaugacuucgaaacuggacaaaacacaagauucacuccuguaggagucguacaagauggaaauggaacccaccaaaaugaaccacaacaauggguacucccauccuauucaggaagaacuggacacaauguacaccuugcaccagcuguagcaccuacuuuucccggcgaacagcuucuuuucuuuagaucaaccaugccaggauguucaggauacccaaauaugaacuuagacuguuuauuaccccaagaauggguccaacauuucuaucaagaagccgcaccagcccaaucugauguagcacuucuaagauuuguaaauccagacacaggcagaguauuauuugaaugcaaauuacauaaaucaggauacguaacaguagcucacacaggacaacaugaucuaguuauaccaccuaauggauacuuuagauuugauucauggguaaaccaauucuacaccuuagcacccaugggaaauggaacugguagaagaagagcauuauaa

SEQ ID NO: 32408 - RNA, 1623 nt, Artificial Sequence
  derived and/or modified sequence opt6 from capsid_protein__Norovirus__AAT00363
augaaaauggcaucuaacgacgcuaacccaucagauggauccacagcaaacuuagucccagaaguaaacaaugaagucauggcauuagaaccaguagucggagcagcaaucgcagcuccugucgcaggccaacaaaacguaauagacccauggauacgaaauaauuuuguacaagcaccaggcggagaauucacagucucaccaagaaacgccccuggagaaaucuuaugguccgcaccacuuggaccagaccuaaauccauauuuaucacaucuagccagaauguauaacggauaugcuggcggauucgaaguacaaguuauacuugcuggcaacgccuuuacagcagguaaaauaaucuucgcagcuguaccaccaaauuuuccaacagaaggacuuucacccagccaaguuaccauguuuccacacaucauagucgauguuagacaacuagaaccaguacuuaucccacuacccgacguaagaaauaauuucuaucauuauaaucaaucaaacgacccaacaauaaaacuuauagccaugcuauauaccccacuuagagcuaacaaugccggagaagauguauucacaguaagcuguagaguacuaacaagaccuucaccagauuucgacuuuauauucuuaguuccuccaacaguagaaucacgaacuaaacccuuuacagucccaauauuaacaguugaagaaaugacaaauucacgauuuccaauaccacucgaaaaauuauuuacaggaccauccggagcauucguuguucaaccacaaaacggaagauguacaacagacggagucuuacuaggaacaacucaacuuucacccgucaauauaugugcauucagaggagacguaacccauauagcaggcacacacaauuauaccaugaauuuagcuucacaaaauuggaacaauuaugauccaacagaagaaauaccagcaccauuaggcacaccagauuuuguaggaagaauacaaggaauguuaacucaaacaacaagaggagacgguucaaccagaggacacaaagcaacugucucaacuggagauguucauuuuacaccaaaacuaggaucaauucaauucaauacugauacaaacaacgacuuugaaacaggccaaaauaccaaauucacaccaguuggaguaguccaagauggaaacggaacacaucaaaacgaaccacaacaauggguacuaccaaguuauucagguagaacaggacauaacguacauuuagccccagcaguggcuccuacauuucccggagaacaacuauuauucuucagaucaacuaugccagguuguucuggauacccaaacaugaauuuagauugucuacuaccacaagaauggguacaacacuuuuaccaagaagcagcaccagcccaaucagacguagccuuauuaagauucguaaacccagacacaggaagaguuuuauucgaauguaaauuacauaaaucuggauacgucacaguagcacauacaggacaacacgaccuaguaauaccaccuaauggauauuucagauuugauucuuggguuaaccaauuuuauacacuagcaccuaugggaaauggcacaggaagaagaagagcauuauaa

SEQ ID NO: 32409 - RNA, 1623 nt, Artificial Sequence
  derived and/or modified sequence opt6 from capsid_protein__Norovirus__AAT00366
augaaaauggcaucuaaugacgcaaacccaucagacggcucuacagcaaacuuaguaccagaaguuaauaaugaagucauggcuuuagaaccuguaguuggagccgcuauagcagcaccuguagcaggacaacaaaauguaauagacccauggauaagaaacaacuuuguacaagcuccaggaggagaauuuacaguaucaccacgaaacgccccaggugaaauacuauggagugcaccauuaggaccagauuuaaauccauaucuuucgcacuuagcacgaauguauaauggcuacgcaggaggauuugaaguacaaguaauauuagcuggcaaugcauuuaccgcaggaaaaauuauauucgcagcaguaccaccuaauuucccaacagaaggucuaucuccuucccaaguuaccauguucccacacaucauaguagacguacgccaacuagaaccuguauuaauacccuuaccggacguucgaaauaacuucuaucauuacaaccaaucuaacgacccaacuauaaaauuaauagcaaugcucuacacaccuuuaagagcaaacaacgcaggagaagacguauuuaccguauccuguagaguauuaacucgcccaagcccagacuuugacuuuaucuuuuuaguaccaccaacaguagaaucuagaacuaaaccauuuacuguaccaauacuuacuguagaagaaaugacaaauucaagauuucccauaccccuagaaaaacuauucacagguccaucaggagcauuuguuguacaaccacaaaauggaagauguacaacagacggaguacuacuuggaacaacacaauuaucaccuguaaauauauguacauucagaggugaugucacacauauagcaggcacucacaacuacaccaugaaucucgcuucucaaaacuggaacaacuacgauccaacagaagaaauuccugccccuuuaggaacaccugacuuugucggaagaauacaagguauguuaacacaaacaacaagaggagaugggucaacacgaggacacaaagccacaguaucgacuggagacguacacuuuacacccaaacuaggaucaauacaauucaauacugauacaaauaacgauuuugaaacuggacaaaacacacgauuuacaccaguuggcgucguacaagacggaaaugguacucaucaaaacgaaccacaacaauggguauuaccaucauauuccggacgcacaggacacaacguucacuuagccccagcaguagcaccaacauuuccuggagaacaacugcuuuucuuccgaucaacaaugccagguuguucaggauauccaaauaugaaucuugauugcuuacucccacaagaauggguucaacauuucuaccaagaagcugcuccagcucaaucagauguagcauuacuaagauuuguaaacccagacacaggucgaguauuauuugaaugcaaauuacauaaaucuggauauguaacuguugcccacacuggacagcaugaucuuguaauuccaccaaacggauauuuccgauucgauucaugggucaaucaauucuacacauuagcaccaaugggaaauggaacaggaagacgaagagcacuauaa

SEQ ID NO: 32410 - RNA, 1623 nt, Artificial Sequence
  derived and/or modified sequence opt6 from capsid_protein__Norovirus__AAT00369
augaaaauggcaucuaacgaugcaaacccauccgacggcuccacagccaauuuaguaccagaaguaaacaacgaaguaauggccuuagaaccgguuguaggcgcugcaauagcagcacccguagcaggacaacaaaacgucauagacccuuggauaagaaauaacuuuguacaagcaccaggaggagaauuuacaguuuccccacgaaaugcaccaggugaaauauuauggucagcaccacucggaccagauuugaauccauaucuaucacaucucgcaagaauguauaauggauaugcaggcggauuugagguccaaguuauacuagcaggaaaugcauuuacagcaggaaaaauaauauuugcugcuguacccccuaacuuuccaacagagggauuauccccaucacaaguaaccauguucccucauauuauuguagauguaagacaauuagaaccaguauuaauaccauuaccugacguaagaaauaauuucuaccacuacaaucaaucaaacgauccaacaauaaaauuaauagcaaugcuauauacaccauuacgagcaaauaacgcaggagaagaugucuucacaguaucaugucgaguuuuaacacgcccaucacccgacuuugacuuuauauuuuugguaccaccuacaguagaaucacgcaccaaaccauuuacagucccaauccuuacuguugaagaaaugacuaacucaagauuuccuauucccuuagaaaaacuauuuacaggcccaucaggagcauuuguaguccaaccucaaaauggacgauguacaaccgaugguguacuacuaggaacaacacaauuauccccaguuaacauaugcacauucagaggugacguaacacauauagcagguacucauaacuacacaaugaaucuagcuucacaaaauuggaauaauuacgacccaacagaagaaauaccugccccacuaggaacacccgacuuuguuggcagaauacaaggaauguuaacacaaacaacaagaggagacggaucaacaagaggacauaaagcaacagucucaacaggugauguacauuucaccccaaaacuaggcucaauacaauucaauacagauacaaauaacgauuuugaaacuggacaaaacacuagauucacaccaguaggagucguacaagauggcaacggaacacaucaaaaugaaccccaacaauggguauuaccaaguuauuccgguagaacaggacauaauguacaccuagccccagcaguagcccccaccuuccccggagaacaacuauuauuuuucagaucaacaaugccuggauguucgggauauccaaauaugaaucuagauuguuuacuuccacaagaauggguacaacauuuuuaccaagaagcugcaccugcacaaucugauguagcucuccucagauuuguuaauccagauacaggcagaguauuauucgaaugcaaauuacacaaaucugguuacguaacaguugcucauaccggucaacaugaucuaguaaucccuccaaauggauauuuccgcuuugauucuuggguaaaccaauuuuauacauuagcaccaaugggaaauggcacaggccgucgaagagcauuauga

SEQ ID NO: 32411 - RNA, 1623 nt, Artificial Sequence
  derived and/or modified sequence opt6 from capsid_protein__Norovirus__AAT00372
augaaaauggcuucaaaugacgccaauccuucagacggaucuacagcuaaucucguaccugaaguaaacaacgaaguuauggcccucgaaccuguaguuggugcagcaaucgcugcaccaguugcuggccaacaaaacguuauagauccuuggauacgaaauaauuuuguccaagcacccggaggagaauuuaccgucucaccucgaaacgcaccaggagaaauuuuaugguccgcaccacuaggaccugaccuaaauccauaucuaucucacuuagccagaauguacaauggauaugcaggaggcuucgaaguccaagucauauuagcaggaaaugcauuuacagccggaaaaauuauauuugcagcaguaccuccaaacuucccaacagaaggucucucaccaucacaaguaacaauguuuccacacauaauugucgacguacgacaauuagaaccuguccuaauaccacuaccagaugugagaaauaacuucuaucacuauaaucaaucaaacgacccaacaauaaaauuaauagccaugcuauacacaccacuaagagcuaacaacgcaggugaagacguauuuaccguuuccuguagaguacuaaccagaccauccccagacuuugacuucauauuuuuaguacccccuacaguugaaucuagaacaaaaccauucacaguaccaauauuaacaguagaagaaaugacaaacucuagauuuccaauucccuuagaaaaauuauucacaggaccaucuggagcauuuguaguccaaccacaaaaugguagauguacuaccgacggcguucuuuuagguaccacacaauuaucaccaguaaauauauguaccuucagaggugacgucacacauauagcaggaacacauaauuacacuaugaaucuagccucacaaaauuggaacaauuaugauccaacagaagaaauuccagcaccuuuaggcaccccugacuuuguagguagaauucaaggcauguuaacacaaacuacucgaggcgacggaucaaccagaggacauaaagcaaccgucucuacaggagauguucauuuuacaccuaaauuaggaucaauacaauucaauacagacacaaacaaugacuucgaaacaggccaaaacacaagauuuacaccaguaggagucguccaagauggaaacggaacacaucaaaaugaaccacaacaauggguauuaccaucauacucaggacgaacaggacacaauguacaccuugccccugccgucgcuccaacauuuccaggugaacaacuacuuuucuucagaucaacaaugcccggaugcucuggcuacccaaauaugaaucuugauugcuuacuaccacaagaauggguucaacauuuuuaccaagaagcagcuccagcacaaucagauguagcacuauuaagauucguaaauccagacacuggaagaguacuuuucgaaugcaaauuacauaaauccggauauguaacagucgcacacacaggucaacacgauuuaguaauaccuccaaacggauauuucagauuugauuccuggguaaaucaauucuacaccuuagcuccaaugggaaauggaaccggaagacgaagagcccuuuaa

SEQ ID NO: 32412 - RNA, 1623 nt, Artificial Sequence
  derived and/or modified sequence opt6 from capsid_protein__Norovirus__AAT00375
augaaaauggcuucaaaugaugcaaacccaucagauggaucaacagcuaaucuugugccagaagucaauaaugaaguuauggccuuagaaccuguuguaggugcagccauagcugcuccaguagcuggacaacaaaaugucauagacccuuggauaagaaauaacuucguacaagcaccaggaggugaauuuacuguaucuccaagaaaugcaccaggagaaauauuauggucagcaccauuaggaccagaccuaaauccauauuuaagucaucuagcaagaauguauaacgguuaugcaggaggauuugaaguacaaguaauauuagcaggcaaugcauuuacagcagguaaaaucauuuuugcagccguuccuccaaacuucccaacggaaggcuuaucaccaucacaaguaacaauguuuccacacauaauagucgaugucagacaacuagaaccaguacuaauaccucuaccagacgugagaaacaauuucuaccacuauaaccaaucaaaugacccuacaauaaaauuaaucgcuaugcucuacacucccuuaagagcuaacaacgcaggugaagauguauuuaccgucucauguagaguacuaacuagaccauccccugauuuugacuucauauuucucgucccacccacaguagaaucccgaacaaaaccauucacaguuccaauacuuacaguagaagaaaugacaaauucuagauuuccaaucccauuagaaaaauuauuuaccgguccaucuggcgcauucguaguacaaccacaaaacggcagauguacaacagauggaguacuuuuaggaacaacacaacucucaccaguaaacauauguacauucagaggagaugucacacauauagccggaacacauaauuacacaaugaaccuagcaucacaaaauuggaacaacuacgaccccacagaagaaauaccagccccacuaggaacuccagacuucguaggaagaauacaaggcauguuaacucaaacaacaaggggagacggaucaacuagaggccauaaagcaacaguaucaacaggugauguccacuuuacacccaaacuaggaucaauacaauucaauacugacacaaacaacgauuuugaaacaggucaaaacacacgcuuuacaccagucggaguuguacaagacggaaacgguacacaucaaaaugaaccacaacaauggguacuaccaucuuauuccggaagaacaggacauaauguacaucuugcuccagcaguagcaccaacauucccaggagaacaacuacuuuuuuuuagauccacaaugccaggauguuccggauauccaaauaugaauuuagauugcuuauuaccccaagaauggguacaacauuucuaucaagaagccgcaccagcucaaagcgauguagcccuucuucgauuuguuaaccccgacacaggacgaguacuauucgaauguaaacuacauaaaucagguuacguaaccguagcacacacaggccaacacgaucuagucauaccuccaaauggauauuucagauucgauucaugggucaaccaauuuuacaccuuagcaccaaugggaaacggaacagggcguagacgagcacuuuaa

SEQ ID NO: 32413 - RNA, 1647 nt, Artificial Sequence
  derived and/or modified sequence opt6 from capsid_protein__Norovirus__AAT70110
augaaaauggcaucaaaagaugcaacaccaucaaaugacggagccgccggacuuguaccagaaauaaauaaugaagccauggccuuagauccuguugcaggagccgcuauagcagcaccauuaacuggacaacaaaacauaauagaccccuggaucaugaauaacuuuguacaagccccuggcggugaauuuacuguaucaccaagaaacucaccaggagaaguacuauuaaaucuagaacuaggucccgaaauaaauccauaucuugcacaccuagcaagaauguauaauggauaugcuggcggauuugagguccaaguaguacuagcagguaaugcauuuacagcaggaaaaauaauauuugcugcuauuccaccaaauuuuccaauagacaauuuaagugcagcucaaaucacaaugugcccucacguaauuguagacguaagacaacuagaacccguuaauuuaccaaugccagauguuagaaauaauuucuuccauuacaaccaaggaucagauuccagauuaagacuaauagcaauguuauacacuccacuacgagcgaacaauucaggcgaugaugucuucacaguaucuugucgaguauuaaccagaccaucaccagacuuuagcuuuaacuuucuaguaccaccuacugucgaaucaaaaacaaaaccauucacuuuaccuauccuaacaauuuccgaaaugucaaauucaagauucccagucccaauagauucucuacauacaucaccaacagaaaauauaguaguacaaugccaaaacggucgaguaacacuagacggagaacuaaugggaacaacucaacuccuaccaucacaaauaugugcuuuuagaggaguauuaacaagaucaacaucaagagcaucagaccaagcagacacugcuaccccaagauuauuuaacuacuauuggcauauacaacucgauaaccucaauggaacacccuacgacccagcagaagauauaccuggaccucuaggaacuccagauuuucgaggcaaaguauucggaguagcaagucaacgaaaucccgauucaacaacacgugcacacgaagcuaaaguugacacaacagcaggucgauuuacaccuaaacuaggaucauuagaaauaucaacagaaucaggcgauuuugaucaaaaucaaccaaccagauucacaccaguugguauagguguagauaaugaagcagacuuccaacaauggagucucccagauuauucaggacaauucacacauaacaugaauuuagcaccagcagucgccccuaacuuuccaggugaacaauuauuauucuuuagaagucaauuaccaucaaguggaggcagaucaaauggaauauuagacuguuuaguuccacaagaguggguacaacauuucuaccaagaaucagccccuagucaaacacaagucgccuuaguaagauacguaaacccugacacuggaagaguccuauucgaagcaaaauuacauaaacucggcuuuaugacaauugccaaaaauggagacucaccuauuacuguaccuccaaaugguuauuucagauucgaaucauggguaaauccauucuauacucuugcuccaaugggcacuggcaauggaagaagaagaauacaauaa

SEQ ID NO: 32414 - RNA, 1623 nt, Artificial Sequence
  derived and/or modified sequence opt6 from capsid_protein__Norovirus__AAT73592
auggcuuccaaagacgcagcaccaucuacagacggcgcugcaggacuaguaccagaaucaaacaaugaaguaauggcuuuggaacccguagccggagcagcauuagccgcaccaguaacuggucaaaccaauauaauagacccuuggauucgaacuaacuuuguacaagcaccuaacggugaauuuacagucucaccaagaaaugcacccggagaaguucuacucaauuuagaacuaggucccgaauuaaauccauaucuagcacaccucgcaagaauguacaacggauaugcaggcgguauggaaguacaaguuauguuagcaggaaaugcuuuuacugcuggaaaacuaguauucgcugcagucccaccccacuucccaguugaaaauuuauccccccaacaaauaaccauguucccucacgucauaauugacgucagaacccuugaaccagucuuacucccacuaccagaugucagaaacaacuucuuucacuauaaucaaaaagaugacccaaaaaugcgaaucguagccauguuauacacaccuuuaagauccaacggaucaggagacgauguauuuacugucucaugcagaguacuaacuagaccaaguccagauuuugacuuuacauaucuagucccaccaacaguugaaucaaaaacaaaaccauuuacauuaccaauauuaacauuaggagaaacauccaauucaagauucccaguacccauugaccaaauguauacaucaccaaacgaaguaaucucaguccaaugucaaaauggcagauguacacuagauggugaauuacaagguacuacacaauuacaaguuucuggaaucugugcuuuuaaaggccaaguaacagcacacuuacaagauaacgaacaccuauacaaugucacaauaacuaaccuaaauggaucaccauucgacccgucagaagauauaccagccccuuuaggcguuccugacuucgaaggccgaguauucggaguaaucucacaaagagacaacuacaauucaggcggacaaaaccaaccagcaaauagaucucaugaugcuguagucccaacauauacagcacaauacacaccgaaacuaggacaaauacaaauaggaacauggcaaacugaugauauaacuguugaucaacccgcuaaauucacuccaguaggacucucugacacagaccacuuuaaccaaugggucguaccucgauacgcaggagcacuuaaccucaacacuaauuuagcaccaucaguugcaccaguauucccaggagaaagacuacuuuuuuuuagaucauauauaccauuaaaagguggauuuggaaauccugccauagauugucuuguaccacaagaauggauacaacauuuuuaucaagaagcaacacccuccuuaucagaaguagcacuaguaagauacauaaacccagauacuggacgugcccuuuucgaagcaaaacuacaccgagcaggauuuaugacaguaucuucuaacacaagcgcaccagucguaguuccagcaaauggauauuuuagauucgauucauggguaaaucaauuuuauucauuagcuccuaugggaacaggaaacggacgaagaaggauacaauaa

SEQ ID NO: 32415 - RNA, 1614 nt, Artificial Sequence
  derived and/or modified sequence opt6 from capsid_protein__Norovirus__AAT78480
auggcaucaaaagacgcugcaccaagcaacgacggagcaacuggccuaguaccagaaauaaauacagaaacauuaccauuagaaccuguagcaggagcagcaauagcagcuccaguuacaggucaaaauaacauuauugauccauggauuagaaauaacuuuguacaagcuccaaauggagaauuuacagucucccccagaaauucaccaggagaaauauuaaugaaucuugaauuaggcccugaucuaaauccauaccuagcacacuuaucaagaauguacaauggauacgcuggcgguguagaaguccaaguacuccuagcaggaaaugccuuuacagcuggaaaaauauuauuugcugcaguaccuccaaacuuuccaguagauaugcuaucuccugcacaaauaacaaugcuaccacacuuaauaguagauguaagaacuuuagaaccaaucaugauuccucuaccagauguaagaaaugucuucuaccacuucaauaaucaaccggcaccacgaaugagauuaguagcuauguuguacacaccccuucguucaaacgguucuggagacgauguuuuuacaguauccugcagaguucuaacacgaccaacccccgauuuugaauucacauaucuaguaccacccucaguagaaaguaaaacaaaaccuuuuacauuaccaauauuaacaauaggagaauuaacaaauucacgauuuccagcaccaauagaccaauuauauacuucaccaaacgcagauguaguaguacaaccacaaaacggaagaugcucauuagacggagaacuucaaggaacaacccaacuccucaccaccgccauauguaguuaucgcggaaugacaucaaacccaacuagagauuacugggacggucaucuacuccaucuaguacauccaaauggagcaacauaugauccaacagaagacguaccugcaccauucggaacucaagacuuuagggguauauuauaugguguccuaacccaaaauccaagagcaucaggugacgaagcagcuaauucacaagguguauauaucucaaguacuagcgaaaaauuuaccccaaaauuaggaacaaucggauuacaccaaguacaaggacaucauucccaacaucaacaaagcaaauucacaccucuaggcguagccgucaacgguaauacaccauuuagacaaugggaauuaccaaacuacucaggagcauuaacucuaaacacaaauuuagccccugcuguaggaccaaauuucccaggugaacaaauacuauuuuuucgcucaaaugucccaucuguucaaggaggacaaccaauagaaauagacugccuaaucccucaagaauggguaucacauuuuuaccaagaaucugcacccucacaaucagaugucgcacuaguuagauacgucaauccagacacaggaagaacuauauuugaagcaaaauuacaucgacaaggauucauaacaauugcugcaacaggaucaaauccaguuguagucccucccaacggauacuucagauuugauucauggguuaaucaauuuuaugcacuagcgccaaugggaacaggaaacggcagaagaagaauacaauaa

SEQ ID NO: 32416 - RNA, 1635 nt, Artificial Sequence
  derived and/or modified sequence opt6 from capsid_protein__Norovirus__AAT78481
auggcaucaaaagaugcuccaucuaauauggauggaacaucaggagcaggucaacuaguuccugaagcuaacacugcugacccaauaccacuagaaccaguaguaggcgcagcuacagcagcagcuacagcuggucaaguuaauaugauagauccauggauaaugaauaauuuuguacaauccccagaaggagaauucacuaucucaccaaacaacacucccggcgauauacuauucgaccuacaauuaggaccacaucuuaauccauucuuacaacaucuuagucaaauguacaauggauggguaggaaauaugagaguuagaauacuuuuagcaggaaaugcauuuucagcugguaaaauaauuauuuguugcguccccccaggauucacagcucaaaauauaucuauugcacaagcaacaauguucccacacguuauugcagacguaagaguauuagaaccaauagaaaucccauuagaugacguacgaaacguucuauuucauacaaaugaaaauagaccuacaaugcgacuauuaugcaugcuuuauacaccacuucgugcaggaggugcaucugccggaaccgauccauuuguaauagcaggucgcguauuaacaugucccaguccagacuucaacuuucuauucuuaguuccaccauccguugaacaaaaaacacgacaauuaaccguaccaaacauuccucucaacaacuuauccaauucaucagucccagcuaugauaaauaaaauggcaauuagcagugacgccaaucaaguaguacaauuucaaaauggaagauguacaacagauggacaauuacuaggaacuacaccuauaucagcaucacaaguagccagaauaagaggcaaagucuuuucuacaucaucuggaaaagguuuaaaucuuucugaauuagauggaucaccauaucacgcauuugaaucaccagcuccuguaggauucccagacuuaggacauugugauuggcauguaucuagcuucaaagcagaucaaaauucaucaggagacccaauuuccagauuagauauaaaacaaggagcaucauuugcuccacaccuuggaucaauugaauauacaacaucucaaaauccagauggaggucaacuaggaaccuuaacauggauaucaucccccucagaugacacaccaggacacgguacaauaaaucucuggaaaauacccucauacggaucaacaguuacagaaucaguacaccucgcuccaccaauauacccaccaggauucggugaaacacucguuaaucuaaugucgaauuucccaaucggacauaccaauagcaacauggcacaaguaccuuguacacuaccucaagaauucguagcacacuuuguaaaugaacaagcuccuguucgaggagaugccgcccuauuacauuauguagacccugauacacaccgcaaccuaggagaauuuaaauuauauccugagggcuacauaacauguguacccaauacaggaggaggaggaccccaauccuuaccuacaaaugguguauuuaucuuuucuucauggguaucacgauauuaucaacuagaaccagucggaaccgcaggacccgcuagaagacuaggagucagacgcgucuaa

SEQ ID NO: 32417 - RNA, 1620 nt, Artificial Sequence
  derived and/or modified sequence opt6 from capsid_protein__Norovirus__AAU95776
augaaaauggcaucaaaugaugcgaacccuucagauggaucaacagcaaacuuaguuccugaaguaaacaaugaaguuauggcucuagaaccaguaguuggugccgcaauagcugcaccugucgcaggucaacaaaauguaauugacccauggauaagaaauaauuuuguccaagcaccagguggagaauuuacaguaucaccaagaaaugcaccaggagaaauacuaugguccgcgccacuaggaccagauuuaaauccauaucuaucacaccuagcaagaauguacaauggauaugccggaggauucgaaguccaaguaauuuuagcaggcaacgcauuuacugcagguaaaguaauauuugcugcagucccaccaaacuuuccaacagaaggacuauccccaucacaaguuacaauguucccucacauaauaguagacguaagacaauuagaaccuguccuaauaccauuaccagauguaagaaauaauuucuaucacuauaaccaaucaaaugauucaacuauuaaacuaauagcaauguuauacacaccacuuaaagcaaauaacgcaggugacgauguauuuacagucucauguagaguacuaacaagaccaucuccugauuuugauuuuauauuccuagucccaccaacaguagaaucaagaacuaaaccuuuuacaguuccaauauuaacaguugaagaaaugucuaauuccagauuuccaaucccacuagaaaaacuauauacagguccaucaucugccuucguaguccaaccacaaaacggccgauguacaacagauggaguccuacuaggcacaacucaauuaucugcaguuaauauauguacauuuagaggagauguaacacauaucgcaggaucacacgacuacacaaugaaucuagcaucacaaaauuggaauaauuacgacccaacugaagaaaucccagcaccauuaggcacacccgauuuuguaggcaaaauucaaggaaugcuaacccaaacuacacgagaagacgguucuacaagagcacacaaagcaacagucucaaccgguucaguucacuuuaccccuaaauuagguucaguccaauacacuacagauacaaauaacgacuuccaaaccggacaaaacacaaaauuuacacccguaggagucauacaagacggaaauaaccaccaaaacgaaccacaacaauggguauuaccaaauuacucaggacgaacaggacauaauguacauuuagcuccagccguagcaccaaccuucccuggugaacaacuauuauuuuucagaucaacaaugccaggaugcucagguuauccaaacaugaacuuagauugcuuacuaccccaagaauggguccaacacuuuuaccaagaagcugcaccugcacaaucagacguugcacuucuaagauuuguaaacccagacacaggaagaguccuauuugaauguaaacuucacaaaaguggcuauguuacaguagcacacaccggcccacacgaccuaguaauaccaccaaauggauacuucagauuugacucauggguaaaccaauucuacaccuuagcaccaaugggaaacggggccggcagacgccgagcacuauaa

SEQ ID NO: 32418 - RNA, 1644 nt, Artificial Sequence
  derived and/or modified sequence opt6 from capsid_protein__Norovirus__AAX32874
augaaaauggcuucaaaugaugcagcaccaucaacagauggaagugcaggccuaguaccagaaguaaacaaugaaacaauggcauuagaaccaguaguaggugcuccauuagcugcuccaguagcaggacaacacaauauuauagauccauggauaaaaaugaauuuuguacaagcaccaaauggugaauuuacaguaucaccuagaaaugcaccaggcgaaauauuauuagaccuagaauuaggaccagauuuaaacccauauuuaagucacuuagcaagaauguauaacggauaugcaggaggaauggaagugcaaguaguacuagcaggaaaugcauucacagcaggaaaaauuauuuuugcagcaguaccaccaaacuuuccagcagaaaacuuauccgccgcacaaguaaccauguguccacauguaauaguagauguccgacaauuagaaccaguaauguuaccaaugcccgauauuagaaauaaauuauuccauuauaaucaaguagaugauccaaaacuuagauuauuagcauacuuauauacuccauuaagagcaaauaaugcaggugaugacguauuuaccguuucauguagaguauuaaccagaccuacuccagauuuugaauuuauguuuuuaguuccacccacaguagaaucuaaaacaaaaccauucucguuaccaagccuaaccuuagaugaacuaucaaauucaagauuuccagcaccaauaguacaauuauacacaaauccacaugacaauuuaguaguccaaccacaaaauggacguuguaccauagauggacuuuuacaagguacaacccaauuaguaucauguaacguauguucauucagaggaacuauaggugaugggcaaccagcaagucacuccgaagaagaaauaaugccaauggcauuuaacauccagagagaaauaaugcuagaaaauuuagauggaucaccauaugacccagcagacgauauaccagcaguauuaggcucaccagauuuucaaggaauaguauuuggaguucucucacaaagaaacgcagauggucaaacccgagcccacgaagcaaaaguagauacaagagcugcuagauuugcuccaaaacuaggauuuguuguugcaacaguugagucaacagauuuccaugcaaaucaaccuucccgauuuacaccaguagguuuaggaggugauggcaaucaagauuucaaccaaugggcucuaccagcuuauggaggugcucuaacuaauaauacaaaccuagcaccacccguaaugccuguauauccaggagaacaaauccuauauuuuagaucccaacucccaucaucaggaggaguagugggagguugguuagacugccuccuaccacaagaguggguacaacauuuuuuucaagaaagcgcuacaucucaaagugacguugcuuuaguaagauacauaaauccuacaacuggucguguacuuuuugaagcuaaauuacauaaacaaggauucuuaacuguagcagcaucaggaucauauccacucgucguaccagcagauggauacuuuagauuugaaucauggguuaaccaauuuuauacuuuagccccuaugggaaauggcucaggaagaagaagaacaagauaa

SEQ ID NO: 32419 - RNA, 1674 nt, Artificial Sequence
  derived and/or modified sequence opt6 from capsid_protein__Norovirus__AAX32877
augaugauggcuaguaaugacgcaacagcaccaacugacggagcagcaggacuaguaccagagguaacaaacgaaacaauggcauuagaaccaguagcaggagcagcacuagcagcaccaguaguaggacaacacaauguaauagauccauggauuagagguaauuuuguacaagccccaaacggagaauuuaccguuucaccaagaaauucuccuggagaaguacuuuuaaacuuagagcuugguccagaauuaaaucccuauuuagcacaucuagcacgcauguauaauggauacgcuggaggaauggaaguacaagucguacuagcuggaaaugcauuugcagcugguaaaauaaucuucgcagcuguucccccaucauuuccaguagaugccuuaucagccccaacgaucacuaugugcccccacguaaucguagacguacgucagcuagaacccguauuacuccccaugccagauguaagaaauaauuuuuuucacuacaaccaauccucugacccaaaacuaagauuaguugcuaugcuauauacaccauuaagagcaaacucuccaacugacgacguuuucacuguuucauguagaguacuuacacgccccucaccagauuuugaauuuacauuucuaauaccaccaacugucgaaucuaaauccaagccauuuacuaucccccaacucacauuaucugaacuaucaaauucaagauuuccagcaccuauagauauguuauauacaucaccaaaugacaacaucguuguacaaccacaaaacggaagauguacauuagauggagaacuacaaggaacaacucaacuacaaccaucucuuauauguucauucagaggagucacguuaaaugaaacaucaagaaugcuaguagaucaagaagaagaagaagaaggagaaguacaacgaccacaagcacgagcauuuaaucaugaauaccacuuacaacuccaaaacuuggauggcacagauuaugaccccgcaggcgaucuacccgcaacacuaggagcaccagauuuuaucggaaccgucuauggagucgucucacaaagaacuacaagagauagcgcagcuagagcacacgaagccaaaauuacaacaagugauccucgcuacgcaccaaaacuuggauccguagaauuugucaccgaaucaacagauauaguauuaaacgaccaaacaaaauuuacaccuguaggacuagcacacaauagagcaguugauuacaaacaaugggaacuaccacauuaugcaggugaacucacugcaaauacaaaucuagcaccacccguugcacccguuuauccaggugaacaacuauuguuuuuuagaucaaacuuaccacuagcaggagguacugcagcauccguauuagauugccuuuuaccucaagaauggauccaacacuuuuaccaagaaucauucgcaccacaaucugauauagcauuauuaagauacguaaaccccgacaccggacgaguacuauucgaagcaaaacuucacagacaaggauacauaacuguugccggugcuggaacaucuccaguagcaguaccaccuaauggauauuucagauuugaaucauggguuucacaauucuauacacuagcaccuaugggaucaggaacaggacgccgacguaaucaauaa

SEQ ID NO: 32420 - RNA, 1674 nt, Artificial Sequence
  derived and/or modified sequence opt6 from capsid_protein__Norovirus__AAX32880
augaugauggcuagcaacgaugcaacagcacccacagacggugcagcaggacuaguuccggaaguaacaaacgaaaccauggcauuagaaccaguagcaggagcugcauuagccgcuccaguaguaggccaacacaauguaauugaccccuggauaagaggaaacuuuguccaagcaccaaacggagaauucacaguaucaccaagaaacagcccaggagaaguauuacucaaucuagaacuagguccagaauuaaacccauauuuagcgcauuuagccagaauguacaauggauacgcaggcggaauggaaguacaaguuguacuugcaggcaaugccuuugcagcuggcaaaauaaucuucgcagcuguuccuccaucuuuuccgguagacgcauuaucagcaccaaccauaacaaugugcccucauguaaucguagacguuagacaacuagagccaguuuuauuaccaaugccugaugucagaaacaauuuuuuucacuacaaccaauccucagaucccaaacuaagacuagucgcaauguuauauacaccauuaagagcuaauucaccaacagaugauguauuuaccguuucuuguagaguacuaacaagaccuucaccugauuucgaauuuacauuuuuaauaccaccuacaguagaaucaaaaucuaaaccuuuuacaauuccacaauugacacuaucugaacuaucaaacucgagauuuccagcuccaauugauaugcucuacaccucuccuaaugacaauauaguaguccaaccacaaaacggacgauguacacuaggaggagaauuacaaggaacaacacaauugcaaccaagccuaauauguucauuuagagguguaacacuaaacgaaacaucccgaauguuagucgaccaagaagaagaagaagaaggagaaguccaaagaccucaagcaagagcauucaaucaugaauaccauuuacaacuccaaaaucuagauggcacagauuaugacccagcaggagauuuaccagcaacacuaggagcaccugacuuuauuggaacaguauacggcguaguaucacaaagaacaacaagagacucagcagcacgcgcacaugaagcgaaaaucaccacaucagaccccagauaugcaccaaaauugggcucaguagaauucguaacagaauccacagacauaguacuaaaugaucaaacaaaauuuacaccaguagggcuugcucacaauagagcuguagacuacaaacaaugggaacuaccacauuaugcaggagaacucacagccaacacaaaucuagcaccaccaguagcuccaguuuauccaggagaacaauuauuauuuuucagaagcaaucuaccauuagcaggaggaacagcugcaucagucuuagauugucucuuaccucaggaauggauccaacacuucuaccaagaaucauuugcaccacaauccgauaucgcacuuuuacguuacgucaauccagauaccggaagaguauuauuugaagcaaaauuacauagacaaggauacauaacuguugcaggugcaggcaccucaccaguugcugugccaccaaaugguuauuuucgauuugaaucauggguaagccaauuuuauacacuugcaccaaugggaucaggaacaggacgacgaagaaaucaauaa

SEQ ID NO: 32421 - RNA, 1647 nt, Artificial Sequence
  derived and/or modified sequence opt6 from capsid_protein__Norovirus__AAX32886
augaaaauggcauccucagacgcagcaccuuccucagacggcuccgcuggauuaguaccagaaguaaauucagaaacaauggcacuagaacccguuguuggugcaccacucgcagcucccgucgcaggucaacauaauaucauugacccauggauaaaauuaaauuucguacaagccccaaauggugaauuuacaguauccccucgcaacgcaccaggagaaauacuucuugauuuagaauuaggaccagaccuuaacccauacuuagcucaccuaucaagaauguauaaugcuuacgcagguggaauggaaguacaaguuauauuagccggaaacgcuuucaccgcagguaaaauaauauucgcagcaguaccuccaaacuucccacuagaaaaccuaagcgcagcacaaauaacaauguguccucauauuauaguagauguaagacaacuagaaccaguaaugcuaccuaugccagauguuagaaauagacuauuccauuauaaucaaguacgugaacccagauuaagauuaguagcauaucuauauacaccacuaagagcaaauaaugcuggagacgauguauucacaguaucaugccgaguauuaacaagaccaucacaagauuucgaauuuauguucuuaguaccuccauccguugaaucaaaaacuaaaccauuuucauuaccuaauuuaaccuuagcagaacuaucuaacagcagauuuccacuaccuauagaacaauuauacacaaauccauuagauaaccuuguaguacaaccucaaaauggacgauguaccaucgauggaauacucuuaggaacaacccaauuaguaccaucucuaauauguucaaugagaggaacacuugaagcagaucaagcuucaggacauaccgacgacgaaucaguacaaucucgagcuuuuaauagacaacgaagucuuaugcuagaaaacccagauggcucagcauuugacccaucagaugaaguacccgcaguuuuagguguaccagauuuucgaggcguuguauuuggcguauuaucacaacgaaauaacggugauaccacaagaagccaugaagccaaaauugauaccagaagaccaagauacgcaccaaaacuaggauuugucgaaguacuaaccgaauccgacgacuuccaaaauggaccacccacuaaauucacaccaguagguuuaggaggagacgguaauccagauuuccaacaaugggcacuacccgauuauggaggagcucuaacgaauaauacaaacuuagcuccaccgguuguaccagucuauccaggagaacaaauauuauucuuccgaucacaauuaccaucaucugguggaacaguagcaggauggcuagacuguuuacuaccucaagaauggauacaacauuuuuaccaagacucagcugcugcacaaucugauguagcuuuaguaagauacauaaauccugcaacuggacggguauuauuugaagcuaaauuacacagacagggauuuuuaaccguaucggcugcaggcccacacccuguaguugcacccgcagauggauauuuuagauuugaauccuggguaaaccaauuuuauacacuugccccaaugggaaaugguucuggaagaagaagaguauacuaa

SEQ ID NO: 32422 - RNA, 1623 nt, Artificial Sequence
  derived and/or modified sequence opt6 from capsid_protein__Norovirus__AAZ31376
augaaaauggcuucaaaugaugcaacaccaucagauggaucaacagcaaacuuaguuccagaaguaaauaaugaagucauggcacuagaaccuguaguaggagcagcuauagcagcaccagucgccggacaacaaaauguaauugauccauggauacgaaacaacuuuguccaagcaccaggaggagaauucacagucuccccaagaaacgcaccaggugaaauacuauggucagcaccccucggaccagaucuaaacccauacuuaucacaccuagcacgaauguauaacgguuaugcuggagguuuugaaguacaaguaauuuuagccggaaacgcguuuacagcuggaaaaaucauauuugcagcagucccaccaaauuuuccuacagaaguacucucuccuucacaaguaaccauguuuccacacauaauaguagacguaagacaacuagaaccaguauuaauaccauuaccagauguaagaaauaacuuauaucauuauaaccaauccaaugauccaaccauaagauuaauagcuauguuauacacacccuuaagagcaaauaaugcaggugacgacguuuucacaguaaguuguagaguacuuacaagaccaaguccagauuuugacuucauguuucuaguaccaccaacaguagaaucacgaacaaaacccuucucaguucccauacuuacaguagaagaaaugacaaauucccgauuucccauaccucuagaaaaacucuuuacaggaccaucaucagcauuuguaguccaaccacaaaauggaagauguacuaccgacggaguacuucuaggaacaacacaauuaucuccgguaaacauauguacauuucgaggagacgucacacacauagcuggugcucaaaauuauacuaugaaucuagcaagucaaaacuggaauaauuaugauccuacagaagaaauaccagcuccauuaggaacaccagauuucguaggaaaaauacaaggaguuuuaacacaaaccacucguagagaugguucaacaagaggucauaaagcaaccguuucuacaggauccguacauuuuacaccaaaauuaggcucaguucaauuuaguacagauaccucaaacgauuucgaaacaggacaaaauacaagauuuacaccagucggaguaguacaagacggauccacaacccaccaaaaugaaccacaacaauggguauuacccgacuauucaggcagagauagccauaauguucaccuagcaccggcuguagccccuacuuuuccaggcgaacaacuauuauucuucagaucaacaaugccagguuguagcgguuacccaaauaugaauuuagauugucuauuaccacaagaauggguucaacacuuuuaccaagaaucugcaccagcacaaucugacguagcacuacuacgauucguaaauccagauacaggcagaguccuuuuugaaugcaaauuacauaaaucggguuauguaacuguagcccacacaggacaacaugaccuuguaaucccacccaauggauauuuccgauuugauucuuggauaaaucaauucuauacauuagcaccuaugggaaacggagcaggcagaagaagagcacuauaa

SEQ ID NO: 32423 - RNA, 1623 nt, Artificial Sequence
  derived and/or modified sequence opt6 from capsid_protein__Norovirus__AAZ31396
augaaaauggcuaguaaugacgccacaccaucagauggaucaacagcaaauuuaguaccagaaguuaauaaugaaguaauggcucuugagcccguaguaggagcagccauugcagcaccaguagccggacaacaaaauguaauagaucccuggauuagaaauaauuuuguacaagccccaggaggugaauuuacaguaagcccucgcaacgcacccggugaaauacuaugguccgcgccauuaggaccagauuuaaauccauacuuaucccauuuagcacgaauguauaacgguuaugcaggcggauuugaaguacaaguuaucuuagcaggaaacgcauuuaccgcagguaaaauaaucuuugcugcaguaccacccaacuuuccuacagaaguacuaaguccuucccaaguuacaauguuuccacacauaauuguagacguuagacaauuagaaccuguauuaaucccacuuccagauguaagaaauaaucucuaccauuacaaccaaucaaaugacccaacaauacgacucauugcaauguuauacacacccuuacgagcuaacaaugcaggcgacgacguauuuacaguaucauguagaguucuaacacgaccaaguccugauuuugauuucauauuuuuaguaccuccaacaguagaaucacgcacaaaacccuuuucagucccuauauuaacuguagaagaaaugacaaauucccgauuuccaauaccacuagaaaaacuauuuacuggaccaucuucagccuucguaguucaaccacaaaauggaagaugcacaacugacggaguccucuuagguacuacacaauuaucuccaguaaauauauguacauuuaggggagacguaacacauauagcagguacacaaaauuacacaaugaaccuagcaucacaaaauuggaauaauuacgacccaacagaagaaauaccagccccauuaggaacaccagauuuuguaggaagaauacaagguguauuaacacaaacaacaagacgagacgguuccacaagaggacauaaagcaacugucaguacagguucaguacauuuuacaccaaaauuaggaucaguucaauucucuacagauacuucaaacgauuucgaaacuggacaaaauacaagauucacaccugucggaguaguucaagacggcucaacaacccaccaaaaugaaccacaacaauggguuuuaccagauuauucaggaagagauucucauaacguacaccuagcaccagcaguugcaccuacauucccuggugaacaauuacuauucuucagaucuacaaugcccggauguucaggauauccuaauaugaauuuagauugccuacuaccacaagaauggguccaacauuuuuaccaagaaucugcacccgcacaaucugacguugccuuauuacgauuuguaaacccagacacaggucguguccuauucgaaugcaaacuucauaaaucaggcuaugucacaguugcacacaccggacaacacgaccuaguaauaccaccaaauggauauuuucgauuugauuccuggguaaaccaauuuuacacacuagcaccuaugggaaacggugcaggaaggagaagagcauuauaa

SEQ ID NO: 32424 - RNA, 1623 nt, Artificial Sequence
  derived and/or modified sequence opt6 from capsid_protein__Norovirus__AAZ31402
augaaaauggcaucuaaugacgcaucaccaucagacggcucaacagcaaaccuugucccagaaguaaacaaugaaguaauggcacuagaaccagucguaggagccgcaauugcugccccaguugcuggccaacaaaaugucauagacccuuggauaagaaauaacuuuguucaagcaccagguggugaauuuacaguaucaccaagaaaugcuccuggugaaauauuauggucagcuccucuaggucccgauuuaaauccauacuuaucacaccuugcacgaauguacaacggauaugcaggaggauucgaaguacaaguaauacuagcaggaaaugcauuuacugcuggaaaaauaauauucgcagcaguacccccaaauuuuccuacagaaggauuaggaccuucacaaguaaccauguuuccacacauaaucguugacguuagacaacucgaaccuguauuaauaccacuucuagacgucagaaacaauuuauaucauuauaaccaauccaacgauccaaccauaaaacuuauagcaauguuauauacaccauuaagagcaaauaaugccggagaagucguuuucacaguuucauguagaguacuaacacguccaucaccagauuuugacuuuauauuuuuaguuccaccaacaguagaaucaagaacaaaaccauucacaguaccuauauuaaccgcagaagaaaugacaaacucaagauuccccacaccacucgguaaacuauuuaccggacccuccagugcuuuuguuguccaaccccaaaauggaagaugcgcaacagacgguguccuauuaggaacaacacaacuaucaccaguaaacauuuguacuuuuagaggagacguaacacauauugcaggaacccacgauuacacaaugaacuuagcuucacaaaacuggaacaacuacgauccaacagaagaaauaccagcaccucuaggcacaccagacuuuguuggaaaaauccaagguguccuaacacaaaccaccagaggagacggaucaacaagaggucacaaagccacagucucaacuggaucuguucacuuuacuccaaaacuaggcggaguacaauucacaacugacaccaacaacgacuucgaaaccggacaaaauacaaaauuuacucccguaggaguaauccaagauggcaauucaacacaccaaaaugaaccacaacaaugggucuuaccaaacuacucaggacgaacaggacacaacguacaccuagcaccagcaguagcaccaaccuuuccaggagaacaacuacuauucuuuagaucaacaaugccaggaugcucgggauauccaaauaugaauuuagauugcuuacuaccccaagaauggguccaacauuuuuaccaagaagcugccccagcucaaucagacguagcuuuauuaagauuuguaaacccagacgcaggacguguauuauuugaaugcaaaccacacaaaucaggauacguaacagucgcacacaccggacaacaugaucuaguaauaccaccaaacgguuauuuucgauucgauuccuggguaaaucaauuuuguacauuagcacccauggguaauggaacaggaagacgacgagcacuauaa

SEQ ID NO: 32425 - RNA, 1620 nt, Artificial Sequence
  derived and/or modified sequence opt6 from capsid_protein__Norovirus__AAZ31411
augaaaauggcaucaaaugaugcaaacccaucagauggcucagcagcuaauuuaguaccagaaguaaacaaugaaguuauggcacuagaaccgguaguaggagccgccauagcagccccaguagcuggacaacaaaacguaauagauccauggauaagaaacaacuuuguacaagcacccggcggugaauuuaccguaucaccacgaaaugccccuggcgaaauacuauggucagcaccauuagguccagaucuaaacccauauccuucucaucuugcaagaauguauaacggcuaugcaggaggauucgaagugcaaguaauacucgcugguaaugcguuuaccgcaggaaaaaucauauucgcugccguuccaccuaauuuuccuacagaaggauuaucacccucacaaguaaccauguucccacauauaaucguggacguaagacaacuagauccaguccuaauaccaucaccagauguacgcaacaacuucuaucauuacaaucaaucuaacgacucuacaauuaaacuaaucgccaugcuauacacaccacuaagagcaaauaaugcaggagacgacguauuuacagucucaugcagagucuuaacaagaccuucaccagacuucgacuucauuuuuuuaguaccaccaaccgucgaauccagaacuaaaccauuuaccguaccaauacuaacuguagaagaaaugucaaacucaagauuuccaauaccauuagaaaaauuauauaccggaccauccucagcauuuguaguacaaccacaaaacggaagauguacaacagauggaguacuauuaggaacaacucaacucucagcagucaacauuuguacauucagaggagaugugacccacauugcugguucacaugacuauacaaugaaccuugcaucccaaaacuggauaaauuaugacccaacagaagaaauaccagcaccacuaggaaccccagacuuugucggaaaaauacaaggaaugcuaacacaaaccacuagagaagauggauccacaagagcacauaaagcaaccguaucuacaggaucaguacauuuuacaccuaaacuaggaucaguacaauacacaacagauacaaauaaugauuuucaaacaggacaagauacaaaauuuacaccaguuggaguuauacaagacggaaacaaccaccaaaaugaaccacaacaauggguauuaccaaauuacucaggcagaaccggacauaauguacauuuagcaccagcaguagcacccacuuuuccaggagaacaacuauuauucuucagaucaacuaugccaggaugcucuggauauccaaacaugaacuuagacugccuccucccacaagaauggguacaacacuucuaucaagaagcugcaccugcacaaccagauguagcucuauuaagauuuguaaacccagacacgggaagaguauuauucgaauguaaacuacauaaaagcggauauguaaccguagcccauacaggcccacaugauuuaguaauaccaccaaauggauauuuccgauucgauucauggguaaaucaauucuauacauuagcaccaauggguaacggugcaggacguagaagagcacuauaa

SEQ ID NO: 32426 - RNA, 1647 nt, Artificial Sequence
  derived and/or modified sequence opt6 from capsid_protein__Norovirus__AAZ31423
augaaaauggcaucaagcgacgcuacucccuccaaugauggcgcagcaggauuaguacccgaaauagauaaugaagccauggcacuugauccaguagcaggagcagcaauagcagcaccacucaccggacaacaaaacauaauagacuuauggauuaugaacaauuuuguccaagcaccuggaggcgaauucacuguaucaccaagaaacuccccaggagaaguacuauuaaaccucgaacuaggcccugaaauaaacccuuaucuugcacaccuugcaagaaugcacaauggcuaugccggaggauucgaaguacaagucguauuagccggaaaugcauucacagcaggaaaaauaauauuugcagcaauucccccaaacuuuccaauagacaauuuauccgccgcucaaauaaccaugugcccccacguuauaguagacguucgacaauuagaaccuguaaauuuaccaaugccagacguuagaaauaacuucuuccauuauaaccaaggaucagauucuagauuaagacuaauagcuaugcucuacacaccacuuagagcuaauaacuccggugaugaugucuuuacaguaaguuguagaguauuaacaagaccaagcccagacuucuccuucaauuuucuaguaccaccuacaguagaaucaaaaacaaaaccuuucacauuaccaauccuaacuauauccgaaaugucaaauucaagauuucccguuccaaucgauucacuauuaacauccccaacagaaaauauaguuguccaaugccaaaauggacgaguuacauuagauggugaacuaaugggaaccacccaacuccuccccucacaaauaugcgcuuuuagagguguauuaacuagaucuacaucucgugcaucagaccaagcagauacggcaacaccucguuuauuuaacuauuacuggcauauacaacucgacaauuuaaacggaacaccauacgauccagcagaagacauaccaggaccacucggcacaccagacuuuagagguaaaguauuuggcguagcuucccaaagaaauccugauucaacaacuagagcccaugaagccaaaguugauacaacagcaggaagauuuaccccaaaacuagguucacuugaaauaucaacagaaagcgacgauuucgaucaaaaucaaccaacccgauuuacacccgucggaauaggcguugaucgagaagcagacuuucaacaauggaguuuaccugacuauucaggacaauuuacacauaacaugaaccuagcaccagcuguugcuccaaaccuaccaggagaacaauuauuauuuuucagaucucaacuaccuucaucaggagguagaucaacaggaauccuagacugccuagucccacaagaauggguacaacauuucuaucaagaaucagcaccagcacaaacucaaguagccuuaguacgauauauaaacccugauacaggaagaguacuuuuugaagccaaauuacauaaauuaggauuuaugacaauagcgaaaaauggcgacaguccaauaacuguaccacccaaugguuauuucagauucgaaucauggguaaauccauucuacacacuugccccaauggguacaggaucagguagaagaagaauacaauaa

SEQ ID NO: 32427 - RNA, 1623 nt, Artificial Sequence
  derived and/or modified sequence opt6 from capsid_protein__Norovirus__AAZ31428
augaaaauggcaucaaaugacgcagcaccaucgaacgacggugcagcaggauuagucccagaaauuaauaaugaaguaaugccuuuagaaccuguagcaggugcuucacuagcuaccccaguuguaggucaacaaaacauaauagaccccuggauaagaaauaacuuuguacaagcuccugccggagaauuuacagucucaccacgaaacagcccuggagaaaucuuacuugauuuagaacuuggccccgaacuaaauccauacuuagcacacuuagcaagaauguauaacggacauccuucaggaauggaagaacaaauaguacucgcaggcaacgcauuuacagcaggaaaaaucauauuugcugccauaccaccagguuucccauacgaaaauuuaucacccucacacaugacaaugugcccacauguaauaauauauguuauacaacuagaaccaguauuaauguuaaugccagaaauacaaaauaauuucuuucacuauaaccaaggaaaugacccaaaacuacguuuaguagcaauguuauauacaccauuaagagcuaacaacagcggagacgauguauuuacagucucauguagaguauuaacaaaaccauccccagacuuugaauuuacauuccuaguaccaccaacaguagaaaguaaaacuaaagaauuuacacuaccaauauuaagaaucucagagaugacaaacucuagauuuccaguucccguagaaaugauguauacagccagaaaugaaaaucagguaguacaaccacaaaaugguagagucacauuagacggugaauuauuagguacaacaccacuacuagcaguaaauauauguaaauuuaaaggcgaaguaauagccaagaauggugacguuagaaguuacagaauggacauggaaauaacaaacacugacggaacacccauagauccuacagaagacacaccaggaccaauagguucacccgauuuccaaggaauacucuuuggaguagcaucucaaagaaacaaaaacgaacaaaauccagccaccagagcccaugaaguaaacauaaauacaggaggagaccaauacgcuccaaaauuagcacaaguaaaauuuuucucagaaucacaagauuucgaaguccaucaaccaacaguauucacuccaguaggaguugcaggagauacaucacauccauuuagacaguggguauuaccaagauauggaggacacuuaacaaacaacacacaccuggcaccugcaguagcaccucuauuuccaggagaacagauauuauucuuucgaucacaaauaccaucaucaggaggccaugaauuaggauacauggauugccuagucccacaagaauggguacaacauuucuaucaagaagcagccacagcccaaucugaaguagcauuaauacgauuuauaaaucccgauacaggaaggguacuauucgaagcaaaauuacauaaacaaggauuuauaacaguagcacauacaggagauaaucccauugucaugccuccaaacgguuacuuccgauucgaagccugggucaaucaauuuuacucacucgcaccaguaggaacaggaaauggcagaagaagaguacaguaa

SEQ ID NO: 32428 - RNA, 1626 nt, Artificial Sequence
  derived and/or modified sequence opt6 from capsid_protein__Norovirus__ABB02420
augagaauguccgauggugccgcaccaaaagcaaauggcucagaagcaaguggucaggacuuaguaccaacagcagucgaacaagcaguacccauacaacccguagcuggcgcugcccuggcagcuccagcagcuggucaaauuaaucaaauagauccauggauuuuucaaaauuucguacaauguccguuaggagaauuuaguauuucuccaagaaacacaccaggagaaauucuauuugauuuagcucuaggaccuggccuuaauccauaucuagcccauuuaucagcaauguauacaggauggguuggaaauauggaaguccaacuaguauuagcagguaaugcuuuuacagcaggaaaaguaguagucgcauuaguaccaccuuauuuuccaaaagguucacuuacaaccgcacaaauuacuuguuucccucacguaaugugcgaugucagaacauuagaaccaauacaauuaccccuccuugauguuagacgaguauuauggcaugccacucaagaucaagaagaaucaaugagauuaguauguaugcuuuacacuccccucagaacaaacaguccuggagacgaaucauucgucguaucaggucgacuacuaucaaaaccagcagcagauuuuaauuuuguauauuuaacaccaccaauagaaagaacaaucuacagaaugguagaccuaccaguauuacaaccacgauuauguacacacgcacgauggccugccccaguauacgguuuauuaguagauccaucucuaccuucuaacccacaauggcaaaacggacgaguucauguagauggaacauuacuaggaacuacaccuguaaguggaucaugggucucaugcuuugcugcggaagcagcauaugaauuucaaagcgguaccggacaaguagcaacauuuacaaugauagaacaagauggaucugcauauguuccuggugauagagcagcaccauuaggauaucccgauuauucaggacaacuugaaauagaaguacaaacagaaacaacaaaagcuggagauaaacuaaaaguaacaacuuucgaaaugauuuuaggucccacaacaaauguagaucaagcaccauaucaagguagagcauacgcuagucuaaccgcaguagcuucauuggaucuaguagauggucgugucagagcaguaccaagaucaauauauucauuccaagauguccucccagaauauaaugacggacuauuaguuccucuugcaccaccauuaggaccauuuuuaccuggagaaguacuauuaagauuccgaacuuacaugagacaauuagauacagcagacgcugcagcacaacccauagauugcgcuuuaccacaagaauucauuucaugguucgcuucaaauucauucacaguacaaucagacgcccuauuaguacgcuauagaaacacuuuaacaggacaauuacuauucgaagcuaaacuauauucagaaggauauauagcaguaucauauucaggaucuggaccucucacauucccaacagauggauucuuugaagucguaaguuggguaccaagauuauuucaacuagcaucaguagguagccuagcaaccggaagaacauuaaaacaauaa

SEQ ID NO: 32429 - RNA, 1626 nt, Artificial Sequence
  derived and/or modified sequence opt6 from capsid_protein__Norovirus__ABB02423
augagaaugucugauggagcagcaccuaaagcaaauggauccgaagcuaguggacaagauuuaguuccuacugcaguagaacaagcuguaccaauacaaccaguagcuggagcagcauuagcugcuccagcagcaggacaaauuaaccaaauagaucccuggauauuucaaaacuuuguacaauguccauuaggagaauuuuccauaucaccaagaaauacaccuggagaaauacuauuugaucuagcauuaggaccagguuuaaauccauauuuagcucauuuauccgcaauguauacuggauggguaggaaauauggaaguacaauuaguacuagcuggaaaugcuuuuacagcgggaaaaguuguaguagcacucguuccacccuacuucccaaaagguucccuuacaacugcacaaauaacauguuucccccacguuaugugugacguuaggacacuagaaccaauacaacuacccuuauuagauguacgacgaguuuuauggcaugcaacccaagaccaagaagaaaguaugaggcuagugugcauguuauauacaccuuuaagaacaaacucaccaggcgaugaauccuuugucgucucaggacgauuacuaucaaaacccgcaucagauuuuaauuuuguauaccuaacaccaccuauagaaagaacaauauacagaaugguugaucuaccaguguuacaaccacguuuauguacccaugcuagauggccagcaccuguuuacggauuauuaguagacccaucacuacccucaaauccucaauggcaaaauggaagaguacauguugauggaacacuacuaggaacuacaccagucucaggaucauggguaaguuguuucgcagcagaagcugcauaugaauuucaaucaggaacaggagaagucgcuacauucaccaugauagaacaagauggaucagccuauguaccuggcgauagagcagccccauuaggauauccagacuuuaguggacaauuagagauagaaguacaaacagaaaccacuaaaacuggugauaaacuaaaaguaacaacauuugaaaugauauuaggaccuacuacaaacgucgaucaagcaccuuaccaaggacgagcauaugcaucauuaacagcagcagcaucuuuagaucuuguagauggucguguaagagcaguacccagauccguauauucuuuucaagaugaauuaccagaauauaacgacggccuacuuguaccucuugcaccacccuuaggaccauuucuaccaggcgaaguccuauuaagauucagaacuuauaugagacaauuagauacagcagacgcaucugcacaaccaaucgauugcgcacuaccacaagaauuuauaucuugguucgcaaguaauaauuuuaccguacaaucugacgcacuauuaguuagauacagaaauaccuuaaccgggcaacuuuuauuugaagcuaaacuauauucagaaggauacauagcaguuucauacucagguucagguccacuuacuuucccaacagauggauuuuuugaaguagucaguuggguaccaagacuauuucaacucgcuuccgucggauccuuaguaacaggacgaaccuugaaacaauaa

SEQ ID NO: 32430 - RNA, 1623 nt, Artificial Sequence
  derived and/or modified sequence opt6 from capsid_protein__Norovirus__ABC96746
augaaaauggcaucuaaugaugcauccucaucagauggcucaacagcaaaucuaguaccagaaguaaacaacgaaguaauggcauuagaaccaguaguuggagcugcaauagcagcaccagucgcuggacaacaaaaugucauagacccauggaucagaaauaauuuuguacaagcaccaggcggagaauuuacaguuucaccaagaaaugcaccaggugaaauuuuauggucagcaccccuaggaccagauuuaaauccauaccuaucccacuuagcacgaauguauaacgguuacgcaggaggauuugaaguucaagucauucuagcaggaaaugcauuuaccgcuggaaaaauaauauuugcagcuguuccaccaaacuuuccaacagaaggacuuucaccuucacaaguuacgauguuuccucauauuaucguugauguacgacaacuugaaccaguauuaauaccuuuacccgacguaagaaacaauuuuuaucacuauaaucaaucaaacgacccaacaauuaaacuaauagcgaugcuauauacaccuuuaagagcaaacaaugccggagacgauguauucacaguuuccugcagagucuuaacacguccaucacccgauuuugacuuuauauuucuaguaccaccaacaguugaauccagaacuaaacccuucacaguaccaauacuaaccguagaagaaaugacaaauucacgauuuccuaucccucuagaaaaauuauuuacaggaccaucaucugcuuucguaguccaaccccaaaauggacgcuguacaacugacggaguccuacuagguaccacccaacuaucaccagucaacauauguaccuuucgaggagauguuacacauaucgcagggacacaugauuauacaaugaaucuagcaucacaaaacuggaacaauuaugauccuacagaagaaauaccugcaccucuaggaacaccagauuucguaggaaagauacaaggugucuuaacucaaacaacaagaggagauggguccacacguggacauaaagccacaguaucuacaggaucaguucacuucacuccuaaauuaggaaguguccaauuuacaacagauacaaauaacgacuucgaaacaggacaaaauaccaaauucacaccaguuggcguaguccaagauggaaacucaacacaucaaaaugaaccacaacaauggguauuaccaaauuauagugguagaacuggacauaauguccauuuagcuccagcaguagccccaaccuuuccaggagaacaacuauuauucuuuagaucaacuaugcccggaugcucaggauacccaaauaugaaucuagauugucuauuaccacaagaauggguucaacauuucuaccaagaagcagcaccagcucaaucagauguugcauuauuaagauuuguaaaucccgacacaggaagaguauuauuugaauguaaacuccauaaaucaggauacguaacaguagcacauaccggacaacacgaccucgucauaccuccaaauggauauuucagauuugauuccuggguuaaccaauucuauacacuugccccuaugggaaauggagcaggaagacgaagagcauuauaa

SEQ ID NO: 32431 - RNA, 1620 nt, Artificial Sequence
  derived and/or modified sequence opt6 from capsid_protein__Norovirus__ABD77588
augaaaauggcauccaaugaugcgucaccaucugauggaagcacugccaauuuaguaccagaaguaaauaacgaagucauggcacuagaaccaguuguuggagcugcaauugcagcuccaguugcaggacaacaaaauguaauagauccuuggauaagaaacuccucaguacaagcacccggcggagaauuuacaguaucuccaagagaugcaccaggagaaauauuauggagcgcuccuuuaggaccagauuuaaauccauaucucagucauuuagccagaauguacaauggcuaugcaggaggauucgaaguccaaguuauauuagcaggaaaugcauucacagcaggaaaaauaauauuugcagcagcaccaccaaauuuuccuacagaaggacucucuccaucacaaguaacuauguuuccucacauuauaguagguguuagacaauuagaaccaguacuaauaccacuaccagauguacgcaacaacuucuaccauuacaaucaaucuaaugauucaacaauaaaauuaauagcaauguuauacacaccucuaagagcaaacaaugcaggagaugauguauuuacaguaucuugcagaguucucacacgaccauccccagauuuugauuucauuuuuuuaguaccgccuacuguagaaucuagaaccaaaccauuuacagucccaauccuaacaguagaagaaaugacaaauuccagauucccuauaccuuuagaaaacugcucgagaguaccagcuguaccauuaucaucuaaucauaaaaugcaaugcacaacugauggaguacuccuugggacaacacaacuaucuccagucaauauauguacauuuaggggagauguaacccauauaccaggaacuagaacauauagaaugaaucuagcaucacaaaauuggaauaauuaugauccaacagaagaaauacccgcaccucuagguacaccagacuucguaggaaaaauacaaggaaugcuaacacaaacaacaaaaggagauggaucuacuagaggacacaaagcaacaguaaguacagguucaguagauuucaccccuaaauuaggaaguguccaauucgcaacagauacugauaacgauuuugaaacuggacaaaauacaagauuuacuccagucggaguaauucaagauggaaguucaacucauagaaaugaaccacaacaauggguuuugccagauuauuccggacgcacaguacauaacguacacuuagcaccagcuguagcaccaacauuuccaggagaacaauuauuauuuuuuagaaguacaaugccuggauguucuggauauccaaauauggaucuagacugucuuuuaccacaagaauggguacaacacuucuaucaagaagcagcaccaucucaaucugacguagcuuuacucagauucgucaacccagacacuggaagaguauuauucgaaugcaaacuacauaaagcuggauacguaacaguagcacauacuggacaacacgauuuaguuauacccccaaacggauauuuccgcuucgacucaugggucaaucaauucuacacacuugccccaaugggaaauggagcuggaagaaggagagcauuauaa

SEQ ID NO: 32432 - RNA, 1623 nt, Artificial Sequence
  derived and/or modified sequence opt6 from capsid_protein__Norovirus__ABD77589
augaaaauggccucaaaugacgcaucaccaucagauggaucaacagcaaaccucguacccgaaguuaauaaugaaguaauggcacuagaaccaguuguaggugcugcuauagcagcuccaguagccggacaacaaaacguaauagacccauggauaagaaacaacuuuguccaagccccuggaggagaauuuacaguuuccccaagaaaugccccuggagaaauauuauggagugcaccuuuaggaccagaucuaaauccauaucuaucacauuuagcaagaauguacaacggcuaugcaggcggcuuugaaguucaaguaauacuagcaggaaaugcauuuacagcaggaaaaauaauauuugcagcuguaccaccaaacuucccaaccgaaggacuuagcccaucucaagucacaauguucccccauaucauaguagacguaagacaacuugaacccguacuaauaccauuaccagaugugcgaaacaauuuuuaucauuauaaucaaucaaacgauuccacuauaaaauuaauagcaaugcuuuauacaccacuucgagccaauaaugcaggagaugaugucuuuacaguaucauguagaguacuuacaagaccuuccccugacuuugacuuuauauuuuuagucccaccaacaguagaaagucgaacaaaaccguucacaguaccuauuuuaacaguagaagaaaugacuaauucaagauuuccaauuccacuugaaaaacuauuuacaggaccaaguucagcauuuguaguacaaccacaaaauggaagauguacaacagauggcguccuacuaggaacaacacaacuauccccaguaaauauauguacauuuagaggagauguaacacauaucccaggcacacgcacuuauagaaugaacuuagccucucaaaauuggaacaauuacgauccaacagaagaaauaccagcaccacuaggaacaccugacuucguaggaaaaauacaaggcaugcuaacacaaacuacaaaaggugacggaucaacaagaggacauaaagccacaguaaguaccgggucagucgacuuuacaccuaaauuagacaguguacaauucgcuaccgacacagacaaugauuuugaaacaggacaaaacacacguuuuacuccuguaggagucauacaagaugguucaagcgcacauagaaacgaaccucaacaauggguuuuaccagacuauucaggcagaacaguacauaacguccaccuagcaccagcaguagcaccaacuuuuccuggugaacaauuauuauuuuuccgcucaacaaugccaggaugcucuggauacccaaacauggauuuagauugccuauuaccacaggaauggguccaacauuuuuaucaagaagcugcuccaucucaaucagacgucgccuuacuaagauuugucaacccagauaccggaagaguucucuucgaauguaaauuacauaaagcagguuaugucacaguagcacauacaggucaacaugaucuagucauaccacccaauggauauuucagauucgacucuugggucaaucaauuuuauacauuagcacccaugggaaauggagcaggucgaagaagagcuuuauaa

SEQ ID NO: 32433 - RNA, 1647 nt, Artificial Sequence
  derived and/or modified sequence opt6 from capsid_protein__Norovirus__ABD77590
augaaaauggcaucaaaugacgcuacaccaucaaaugauggagcagccggacuaguaccagaaauaaauaacgaagcaauggcacuagacccaguagcaggagcugcaauagcagcaccacuuaccggacaacaaaauauaauagauccauggauaaugaauaauuuuguucaagccccaggcggugaauucacaguaucaccccguaauucuccaggagaaguacuauuaaauuuagaacuaggaccagaaauaaauccuuacuuagcccauuuagccagaauguacaaugguuaugcaggcgguuucgaaguacaagucguacucgcaggaaacgcauuuacagcagguaaaauaauauuugcagcaauaccccccaauuuuccaauagauaaccuaagcgcggcucaaauaaccauguguccacacguaauagucgauguaagacaauuagaaccuguaaacuuaccaaugccagacguuagaaacaacuuuuuccacuauaaccaaggaagugauucuaaauuaagacuaguagcaaugcuauacacuccacuaagagcaaauaauucaggcgacgauguuuuuacaguaucuugcagaguacuaacaagaccaucacccgacuucucauucaauuuuuuaguaccaccaacugucgaaaguaagacaaaaccuuuuacacuaccaauacuaacaaucagugaaaugucaaauagucgauucccuguacccauagauuccuuacacacuucacccaccgaaaauauuucaguccaaugucaaaauggucgaguaacacuagacggagaauuaauggguacuacacaacuauuaccuucacaaauaugugccuuuagagguguucucacaagaucaacaucaagagcauccgaccaagcagauaccgcaacucccagauuauuuaauuacuauuggcacauacaacuagacaauuuaaauggaacaccauaugaccccgcagaagacauaccaggcccauuaggaaccccugauuuuagaggaaaaguauucggaguagcaucccaacgcaacccagacucaacaacacgcgcccacgaagcaaaaguagauacuacagcaggaagauucacaccaaaauuaggaucauuagaaauauccacagaaucaggagacuucgaccaaaaccaaccuacucgauuuacaccaguaggaauaggaguagaucaugaagaaaacuuucaacaauggucauuaccagauuacucuggucaauucacccacaauaugaaucuagcaccagcaguagcaccuaacuucccaggagaacaacuucuauuuuucaggucacaauuaccaucauccgguggucgaagcaacgguauacucgacugucuaguaccacaagaauggguacaacauuuuuaucaagagucugcuccugcacaaacacaaguagcauuaguuagguacguaaauccagauacaggacgaguauuauucgaagcaaaacuucacaaguuaggauuuaugacaauagcuaaaaacggagacucucccauuaccguaccaccaaauggauauuuuagauucgaaucauggguuaauccuuuuuacacauuagcuccaaugggaacaggcaauggacgacgacgaauacaauaa

SEQ ID NO: 32434 - RNA, 1626 nt, Artificial Sequence
  derived and/or modified sequence opt6 from capsid_protein__Norovirus__ABG45845
augcgaaugucugauggagcugcuccuaaagcuaaugguucugaagcaucaggacaagacuuaguaccaacagcuguugaacaagcugucccaauccaaccaguagcaggagcaagccucgcagcaccagccgcuggucaaauaaaucaaauagauccauggauauuucaaaauuuuguacaaugcccucucggagaauuuucaauaucuccuagaaacacaccuggugaaauucuauuugauuuagccuuaggacccggauuaaacccauauuuagcacaucucagcgcaauguauacaggcugggucggaaauauggaaguacaacuaguauuagcaggaaaugcuuuuacugcaggaaaaguaguuguagcacuaguaccaccauauuuuccaaaaggaucacuaaccaccgcccaaauuacaugcuucccacauguaaugugcgauguuagaaccuuagaacccauacaauuaccacuauuagacguaagacguguucuauggcaugccacgcaagaucaagaagaaucaaugcgauuaguuuguaugcuauauaccccauuaagaacaaauuccccaggagacgaaucauucguuguaagcggaagacuacucucaaaaccagcagcugauuuuaauuuuguauauuuaacuccuccuauagaacgaaccauauaucgaauggucgauuuaccaguucuucaacccagauuauguacacaugcuagguggccagcaccaauuuacggauuguuaguagauccuucucuaccagcaaauccacaauggcaaaacggaagaguacauguagaugguacacuacuaggcacaaccccaguuucaggaucauggguaucauguuuugcggcagaagcagcauaugaauuucaaucaggcaccggagaaguagcaacauuuacacuaauagaacaagauggaucagccuaugucccuggagauagggcagcaccauuaggauacccugauuuuucaggacaauuagaaaucgaaguacaaacugaaacaacuaaaacaggagauaaauuaacugucacaacauuugaaaugauauuaggaccaacaaccaauguagaucaagcaccauuccaaggucgugcauacgccucauuaacagcagcagcaucacuggauuuaguugauggaaggguacgagcaguaccuagaucuauuuacuccuuucaagauguaauuccagaauauaaugacggucucuuaguaccacuagcgccacccauagguccauuuuuaccaggagaaguacuacuacgcuuuagaacuuacaugcgacaaauagauucaagcgaugcugcugcagaagcaauagacugugcacuaccccaagaauuuauuucaugguucgcaucaaaugcuuuuacgguacaaucugaagcauuacucuuaagauacagaaacacauuaacaggucaauuauuauuugaaugcaaauuauacucagaaggauauauagcauuaucuuacucaggauccggaccacuaacuuucccaacagacggauuuuuugaaguaguauccuggguaccaagauuauaccaauuagcuucaguaggaucauuagccacaggacguacauuaaaacaauaa

SEQ ID NO: 32435 - RNA, 1626 nt, Artificial Sequence
  derived and/or modified sequence opt6 from capsid_protein__Norovirus__ABG45847
augcguaugucagacggagcugcaccuaaagccaauggaucagaagcauccggacaagacuuaguaccaaccgcauuagaacaagcugucccaauacaaccuguagcaggagcuucauuagcagcacccgcagcuggccaaauuaaccaaaucgacccuuggauauuucaaaauuuuguacaauguccacugggagaauuuucaauaucuccaagaaacacaccaggagaaauauuauucgaucuugcauuaggaccaggacuuaacccuuauuuagcacauuuaucagcaauguauacaggaugggugggaaauauggaaguacaacuaguauuagccggaaaugcauuuacagcaggaaaaguaguuguagcacuaguaccuccauauuuuccaaaaggaucucuuacaacagcucaaauaacuuguuuuccacauguaaugugcgacguucgaacauuagaaccaauacaacuuccccuucuagacguaagaagaguuuuauggcaugcaacacaagaccaagaagagucaaugcgauuaguauguaugcuauacaccccauuacgaacaaauuccccaggagaugaaucauucguagucucaggaagauuacuauccaaaccagcagcugauuuuaauuuuguauacuuaacaccacccauagaaagaacaaucuacagaaugguagauuuacccguuuuacaaccacgacucuguacacaugcuagauggccagcaccuauauaugguuuacuaguugauccauccuuaccugcaaauccucaauggcaaaaugguagaguacauguagauggaacucuacuaggaacaaccccaguaucagguuccuggguaaguugcuuugcugcagaagcagcuuaugaauuucaaucaggaacuggagaaguagcagcauuuacucucaucgaacaagaugguucagcauacguaccaggugacagagcagcgccuuuaggauauccugauuuuucgggccaauuagaaauagaaguucaaacagaaacuacaaagacaggagacaaacuaacuguaacaacauucgaaaugauacuaggaccaacaacaaacguugaucaagcaccuuuucaaggaagaguauaugcaucauuaacagcagcagccucauuagaucuagucgauggcagaguacgcgcaguaccccgauccauauauggauuucaagauguuauuccagaauacaaugauggauuacuagucccguuagcaccuccaauagguccuuucuuaccuggagaaguauuacuaagauuucguacuuacaugagacaaauagacuccucugacgcagcugcagaagcuauagacugugcuuuaccucaagaauuuaucucaugguuugcuucuaacgcauuuacuguucaaagugaagcacuauuauuaagauacagaaauacacucacaggucaauuauuauuugaauguaaacuuuauucagaagguuacauugcauuaucauauucagggucagguccauuaacauuuccaacagacggauuuuuugaaguagucucauggguaccucgauuauaucaacuugcaucuguaggauccuuagcuacaggaagaacauuaaaacaauag

SEQ ID NO: 32436 - RNA, 1626 nt, Artificial Sequence
  derived and/or modified sequence opt6 from capsid_protein__Norovirus__ABG45849
augcgaaugucugauggagcggcacccaaagccaacgguucagaagcuucaggacaagacuuaguaccaacagcaguagaacaagccguucccauacaaccagucgcuggcgcaucacuagcugcgccugcagcaggacaaauaaaucaaauagauccauggauauuucagaacuucguacaauguccauuaggagaauuuucaauuucaccaagaaauacacccggugaaauuuuauucgauuuagcauuaggaccaggcuuaaacccauacuuagcacauuuauccgcaauguauacagguuggguaggaaauauggaaguacaauuaguacuagcuggaaaugcauucacagcaggaaaaguuguaguagcauuagugccaccuuacuuucccagagguucauuaacaacugcucaaauuacuuguuuuccacacguaaugugugauguccgaacauuagaaccaauacaacuaccucuauuagacguuagaagaguauuauggcacgcaacacaagaccaagaagaaucuaugagauuaguaugcauguuauauacuccauuaagaacuaauucaccuggagaugaaucauucgucguaagcggaagacuacuaucaaaaccagcagcagacuuuaauuuuguauauuuaacuccaccaauugaaagaacaauauauagaaugguagauuuaccaguccuacaaccaagauuauguacccaugcacguuggccagcaccaauauacggcuuauuaguagguccaucacuuccugcuaauccccaauggcaaaauggacgaguucacguugaugguacacuucuuggcacaacaccaguaucagguucuuggguuaguuguuuugcagcagaggcagcuuaugaauuccaaucaggaacaggagaaguagcagcauuuacacuaauagaacaagaugguagugcauauguaccaggagacagagcggcaccuuuaggcuauccagacuucucaggacaauuagaaauagaaguacagaccgaaacaacaaaaacaggagauaaacuuacuguaacuacuuuugaaaugauucuuggucccaccacaaauguagaucaagccccauuucaaggaagaguauacgcuaguuuaacugcugcagcuucacuagaucuuguugacggaagaguaagagcaguuccucgcagcauauauggauuccaagacguuauaccugaauacaaugauggcuuacucgucccccuagcucccccuauaggcccauuuuuaccaggagaaguucuauuaagauuuagaacauacaugagacaaaucgauaguucagaugcagcagcagaagcaaucgacugcgcucuaccacaagaauucauuaguugguuugcaucaaacgccuuuacaguacaauccgaagcccuacuacuccgauauagaaauacucuuacagaacaauuauuauucgaauguaaauuauauucagaaggauauauagcacucucauauucuggaucaggaccacuaacauuucccacugacggauucuuugaagcuguuucauggguaccuagacuuuaucaauuagcaucaguagguaguuuagcaacaggaagaacauuaaaacaauaa

SEQ ID NO: 32437 - RNA, 1626 nt, Artificial Sequence
  derived and/or modified sequence opt6 from capsid_protein__Norovirus__ABG45851
augcgaaugagugauggugcagcaccuaaagcaaacggaucagaagcuucuggucaagauuuaguaccaacagcaguagaacaggcaguuccaauacaaccuguugcaggugcaagucuagcagcaccugcugcaggacaaauaaaucaaauugaucccuggauuuuucaaaacuuuguacaauguccacuuggugaauuuucuauuucaccaagaaauacacccggagaaauauuauucgauuuagcccuagguccaggacuaaauccauacuuagcacacuuauccgcaauguauacaggauggguuggaaacauggaaguucaauuaguauuagcaggcaaugcauuuacagcaggaaaaguagcaguagcucucguaccaccauauuuuccaaagggaucauuaacuacagcacaaauuacuugcuuuccacauguuaugugcgauguacgaacccuagaaccuauacaauuaccauuauuagauguacgaagaguucuuuggcaugcuacacaagaccaagaggaaucaaugagacuuguauguauguuauacacuccccuaagaacuaauucuccuggugacgaaucauucguaguuagcgguagacuucuaucaaaaccugcagcugauuuuaauuuuguauauuuaaccccaccaauagaaagaacaaucuauagaaugguugacuuaccuguauuacaaccuagacuauguacacacgcacgauggccugccccaauauacggacuacuaguagaccccucauuaccggcaaauccucaauggcaaaacggaagagugcauguagauggaacauuauuagguacaacuccaguaucuggaagcagaguaucauguuuugcagcugaagcagcauacgaauuucaaucuggcacaggcgaaguagcuacuuucacacuaauagaacaagauggaagcgcauacgucccaggagacagggcagcaccacuaggauauccagauuuuucaggacaacuagaaauugaaguacaaacagaaacuacaaaaacaggagauaaauuaacaguaacaacuuucgaaaugauuuuaggacccacuaccaauguagaccaagcaccauuucaaggaagagcuuacgcuucauuaacugcagccgcuucauuagaucucguagauggaagaguaagggcaguuccuagaucuauuuacucauuucaagauguaauacccgaauauaaugauggcuuauuaguaccucuagccccaccuauaggaccauuucuaccuggugagguauuacuacguuucagaacauacaugcgacaaauagauagcagugaugcagcugcggaagcaaucgacugugcacuaccccaagaauuuauaucaugguuugcaucuaacgcuuuuaccguacagucagaagcacuuuuauuacguuauagaaauacuuuaacaggucaauuacuuuuugaauguaaacuauacagugaagguuauauugcacugucauauucuggaaguggaccuuugacauuuccuacagauggauuuuuugaaguaguaucauggguaccacgcuuauaucaauuagccucaguaggaucauuagcaacaggaagaaccuuaaaacaauaa

SEQ ID NO: 32438 - RNA, 1626 nt, Artificial Sequence
  derived and/or modified sequence opt6 from capsid_protein__Norovirus__ABI95835
augagaaugucagauggagcagcuccuaaagccaaugguucugaagcaucaggucaagauuuaguacccacugcaguagaacaagcaguuccuauucaaccaguagcuggagccucucuagcagcaccugcagcaggacaaauaaaucaaauagauccauggauauuucaaaauuuuguacaauguccuuuaggagaauuuucuauauccccacgaaauacuccuggagaaauauuauucgauuuagcauuaggaccaggccuaaacccauacuuagcccacuuaucugcuauguacaccgguugggucggaaacauggaaguacaacuaguacuagccgguaaugcauuuacugcaggaaaaguaguuguagcucuaguaccaccauauuuuccaaaaggcuccuuaacaacagcacaaauaacauguuuuccucaugugaugugugacguaagaacuuuagagccaauacaacuaccuuuacucgauguuagaagaguacucuggcaugccacacaagaccaagaagaaucaaugcgauuaguuugcaugcuauauacuccacuacgaacaaauucaccaggagacgaaucauuuguaguuucaggaagacuuuuaucuaagcccgcagcugauuucaauuucguauaucuuacccccccaauagaacgaacaauuuauagaaugguugauuuaccaguauuacaacccagacuauguacacaugcuagauggcccgcacccauauauggacuacucguagauccaaguuuacccgcaaauccacaauggcaaaauggacgaguacacguugacggcacucuauuagguacaacaccaguaucugguucuuggguaucuugcuuugcagcagaagcagcauaugaauuucaaaguggaacuggagaaguagcaacauuuacucuaauagaacaagacggaucugcauaugucccuggagaucgagcugcaccauuagguuacccagauuuuucuggacaguuagaaaucgaaguacaaacugaaacaacgaaaacaggagauaaauuaacaguaacaacguuugaaaugauauuaggaccaacaacuaauguggaucaagcaccauuccaaggaagagcauaugcaucacuaacagccgcugcaucacuagaucuaguagauggaagaguacgagccguacccagauccauauauucauuucaagauguuauaccugaauauaaugacggacuuuuaguuccauuagcaccaccaauaggaccauucuuacccggugaaguacucuuaagauuuagaacauacaugagacaaauugauuccucagacgcagcagcugaagcaauagauugugcauuaccucaagaauucaucucaugguucgccucaaaugcauuuacaguacaaucggaagcauuacuccuaagauacagaaauacacuuacaggacaauuauuauucgaauguaaauuauauucagaagguuauauagcucuuuccuauucuggaucaggaccccuaauauucccaacugauggcuuuuucgaaguaguaagcuggguaccucguuuauaucaacuagcuucaguagguucauuagcuacaggucgaacucuaaaacaauaa

SEQ ID NO: 32439 - RNA, 1620 nt, Artificial Sequence
  derived and/or modified sequence opt6 from capsid_protein__Norovirus__ABI97981
augaaaauggcaucaaaugaugccaauccaucagacggauccacagcuaaccuagucccugaaguaaauaacgaaguaauggcuuuagaaccaguaguaggagcagcaauagcagcaccuguagcaggacaacaaaacguaauagaccccuggauaagaaauaauuucguacaagcuccagggggagaauuuacagucaguccccguaacgcaccaggagaaauacuauggucagccccacuagguccagauuugaauccauauuuaucacaccuagcaagaaccuacaauggauacgcuggcggauucgaaguccaaguaauucuagcaggaaaugcauuuacugccgguaaaaucauuuuugcugcaguaccaccaaauuucccuacagaaggccuaucacccucccaaguuacaauguuuccucacauaauuguagauguaagacaauuagaaccaguccucauaccacuaccagacgucagaaacaacuuuuaucauuacaaccaaucaaacgauucaaccauaaaacuaauagccauguuauacacuccacuacgagcuaauaaugcuggagacgacguauuuaccguaucuuguagaguucuaacacgaccaucaccagauuuugauuucauuuucuuaguacccccaacaguagaaucaagaacaaaaccuuuuacagucccaauacuaacuguagaagaaaugucaaauucaagauuuccuauuccauuagaaaaauuauacacaggaccauccuccgcauuuguaguucaaccacaaaacggcagauguacaacagacgguguauuacucggaacaacucaacuauccgcaguaaauauaugcacauuuagaggagacgucacacacauagcaggaucacaugacuacacaaugaaucuugcaucccaaaacuggaacaacuaugauccaacagaagaaauuccagcaccacuaggaacaccagacuuuguaggcaaaauacagggaauguuaacacaaacaacccgcgaagauggaucaaccagagcacauaaagccacuguaucaacaggaucuguccacuucacaccaaaauuaggaucaguacaauacacaacugacacuaauaaugacuuccaaaccggacaaaauacaaaauucacacccguaggaguaauucaagacgguaacaaucaucagaaugaaccucaacaauggguucucccuaauuauuccggccgaacaggacauaauguacacuuagccccagcuguugcacccacauucccaggagaacaacuauuauuuuuuagaucaacuaugccaggaugcucagguuacccaaacaugaacuuagauugucuacuaccucaagaauggguccaacauuucuaccaagaagcagcacccgcacaaucagauguugcauuacuaagauuuguaaaucccgacaccggaagaguacuauucgagugcaaauugcauaaauccggauacguuacagucgcacauacagguccacacgaucuagucauaccaccuaaugguuacuuccgauuugauucuuggguaaaccaauucuauacucuagcaccaaugggcaauggagccggccgaagaagggcuuuauaa

SEQ ID NO: 32440 - RNA, 1626 nt, Artificial Sequence
  derived and/or modified sequence opt6 from capsid_protein__Norovirus__ABP99038
augagaaugucagacggagcugcaccaaaagcaaacgguagugaagcaucaggccaagacuuaguaccaacugcuguagaacaagcuguaccuauacaaccaguagcaggagccucauuagccgcaccagcagcaggacaaauaaaucaaauugauccauggauauuucaaaauuucguacaaugucccuugggagaauucucuauaucaccaagaaacacaccaggagaaauuuuauuugauuuagcauuagguccaggacucaauccauaucuagcucacuuaucagcaauguauacaggaugggucggaaauauggaaguacaauuaguacuagcaggaaaugcauuuacagcaggaaaagucguaguagccuuaguaccucccuauuuuccaaaaggaagcuuaacuacagcacaaauuacaugcuuuccacaugucaugugcgauguacguacuuuagaaccaauucaauuaccucuauuagauguaagaagaguauuauggcaugcaacacaagaccaagaagaaucaaugagacuaguuuguauguuauauacaccauuaagaacuaacucgccaggugaugaaucauuuguugucucagguagacuacuaucaaaaccggcagcugacuuuaacuuuguauacuuaacaccaccaauugaaagaacaauauaucggaugguagauuuaccugccuuacaaccuagauuaugcacacaugcaagauggccagccccuguauauggauuguuagucgaucccucucuaccauccuccccacaauggcaaaauggcagaguacauguugacggcacuuuauuaggaacaacaccagucucugguucauggguuucauguuuugcagccgaagccgcauaugaauuucaaucaggaacaggagaaguagccacaaguaccuuaauagaacaagacggaucugcauaugucccuggcgaaagagcagcaccuuuaggauacccagauuuuucaggacaacuagaaauugaaguccaaaccgaaacaacuaaagcaggagauaaauuaagaguaacaacauuugaaaugauauuagguccuacuacaaauguagaccaagcaccauaucaaggaagaguauaugcaucacuuacagcagcagcaucauuagauuuaguugacggacgaguacgagcaguuccaagaagcauauauggauuucaagacguaauaccagaauauaacgauggccuauuaguuccccuugcuccuccaauagguccuuucuuaccuggugaaguucuacuuagauuucgaacauacaugagacaaauagauucaucagaugcagcugcagaagcuaucgauugugcuuuaccucaagaauuuauuaguugguucgcauccaacgcuuucacaguucaaucagaagcauuacuccucagauaucgaaauacuuuaaccggacaauuauuauuugaauguaaauuauauagcgaaggauacauagcacuaucauauucuggaucaggaccacuagcauuuccaacugauggauucuuugaaguaguaucauggguaccuagauuauaucaacuugcgucaguuggaucauuagccacaggaagaacauuaaaacaauaa

SEQ ID NO: 32441 - RNA, 1626 nt, Artificial Sequence
  derived and/or modified sequence opt6 from capsid_protein__Norovirus__ABP99041
augcgaauguccgauggugcagcaccaaaagcuaauggaucagaagcauccggacaagacuuaguaccaacagcaguagaacaagcaguuccaauacaaccaguugcaggagcugcacuugcagcaccagcagcaggacaaauuaaucaaauagauccauggauuuuucaaaauuuuguccaaugucccuuaggugaauucucaauaucaccacgaaauacaccaggagaaauacucuuugauuuagcauuaggaccaggucuaaauccuuauuuggcacacuuaagugcgauguacacaggauggguaggaaauauggaaguacaauuaguucuagccggaaaugcuuuuaccgcagguaaaguaguuguagcauuaguuccuccuuauuuuccaaaaggcucucucacaacugcccaaauaacauguuuuccgcacguaaugugcgacguaagaacucucgaaccaauucaauuaccacuuuuagauguaagacgaguauuauggcaugcaacacaagaucaagaagaaaguaugagauuaguauguaugcucuacacaccacuuagaacaaacucaccaggugacgaauccuuuguaguuucaggaagacuacuaucaaaaccugcugcggauuuuaauuuuguauauuuaacaccacccauagagagaacuaucuacagaaugguagaucuaccaguacuacaaccuagacuauguacacaugcacgauggcccgcaccaguauaugguuuauuaguagacccuucauuaccaucuaacccacaauggcaaaauggaagaguacauguagaugguaccuuauuaggcacuacaccaguaucaggcucauggguaucauguuuugcagcagaagcugcauaugaauuccaaucagguacaggagaaguagcuacuuuuacuaugauugaacaagauggaucagcauacguuccuggugauagagcagcaccauuaggcuacccugauuuuucaggccaacuagaaauagaaguacaaacagaaacaacaaaagcaggcgauaaacuaaaaguuacaacauuugacaugauacuuggacccacaacuaauguagaccaggcuccauaucaaggucgagccuaugcuaguuuaacagcagcugcaucuuuagauuuaguugauggaagaguaagagcaguuccaagauccauauauucauuccaagaugaacuaccagaauacaaugacggcuuauuagucccauuagcuccaccacuaggaccauuuuuaccaggcgaaguauuauuacguuuuagaacuuauaugagacaacuugauacagcagaugcaucagcacaaccaauagauugugcauuaccacaagaauucauuucaugguuugcuucaaauaauuuuacaguacaaucagacgcacuauuaguaagauauagaaauacccuaacaggacaacuauuauuugaagcuaaacuauauucagaaggauacauagcaguaucauauuccggaaguggacccuuaacauuucccacagacgguuucuucgaaguaguaucaugggucccacgacuauuccaauuagcaucuguaggaucauuagcaacaggcagaacacuaaaacaauaa

SEQ ID NO: 32442 - RNA, 1623 nt, Artificial Sequence
  derived and/or modified sequence opt6 from capsid_protein__Norovirus__ABQ12784
augaaaauggcaucaaacgacgccacaccaucagaugguuccgcagcaaaucuaguuccugaaguaaauaacgaaguaauggcacuagaaccagucguaggagcagcaauugccgcaccaguagcaggacaacaaaacguaauagauccuuggauacgaaauaauuuuguucaagcaccaggcggagaauuuacugucucaccaagaaaugcaccuggugaaaucuuauggucugcacccuuagguccagauuuaaaucccuaccuaucucaccuagccaggauguacaauggauaugcaggcggauuugaaguacaggucauacuagcagguaaugcauucacagcaggaaaaauuaucuucgcagcaguuccaccuaacuucccaacagaaggauuauccccuucccaaguuacuauguuuccacacauaauaguugauguccgacaacuagaaccuguauuaauuccccuaccugacguacgaaauaauuucuaucauuauaaccaaucaaaugauccaacaauuaaacuaauagcuaugcuuuacaccccacuacgugcaaacaacgcaggcgacgauguauuuacaguuucaugcagagucuuaacuagaccaucuccagacuuugacuuuauauuucuaguacccccaacaguugaaucucgcaccaaaccuuucagcguaccuaucuuaacaguagaagaaaugacaaauucacgauuuccaaucccacuagaaaaacuauuuacaggcccaucaucuucauucguaguacaaccacaaaauggcagaugcacaacagacggaguccuacuaggaacaacccaauuaucaccaguaaauauauguacauuuagaggagacguaacccacauagcaggaacucaaaacuacacuaugaaucucgcuucacaaaauuggaacaauuacgauccaacagaagaaauaccugcaccuuuaggcacaccagacuuuguaggaaaaauacaaggcguacuaacacaaacaacaaggagagacggaucaacccgaggacauaaagcaaccguuaguacaggaucaguacacuuuacaccaaaauuaggaucuguccaauucucuaccgauacaucaaacgauuuugagacaggacaaaauacaagauuuacacccguaggaguaguucaagauggaucuaccaccccacaaaacgaaccccaacaauggguauuaccagacuauucuggcagagauucacacaauguacaucuagcaccagcuguagcaccaaccuuuccaggagaacaacucuuauuuuuuagguccacaaugccagguuguuccggauacccaaauaugaaucuugauugccuacuuccacaagaauggguucaacauuucuaucaagaaucagcaccagcacaaucugacgucgcucuacuaagauucguaaacccagacacaggucgcguacuauucgaaugcaaacuccauaaaucagguuacguaacagucgcacacacaggacaacacgaccuaguaauaccaccaaauggcuauuucagauuugauucauggguaaaccaauuuuauacacucgcaccaaugggcaacggagccggaagaagacgugcacuauaa

SEQ ID NO: 32443 - RNA, 1737 nt, Artificial Sequence
  derived and/or modified sequence opt6 from capsid_protein__Norovirus__ABR15783
augaaaauggccaguucagaugcaacuccuucaucagauggagcuggaaaccuaguaccugaaucccaacaagaaguauuaccacucgcaccaguagcuggagcagcccucgcagcacccguaguaggacaacaaaauauuauugauccauggauaaaagaaaauuuuguccaagcaccacaaggcgaauucacaguaucgccaaaaaauucaccaggagaaguauuaguaaauuuagaauuaaguccaagauuaaacccauauuuacaucaccuuaguaaaauguacaaugcuuaugcaggaggaauggaaguagaaauuauacuagcagguaacgcauucacagcuggaaaaguacuaauagcagcaguaccaccuaauuuuccaauagaaaauguuagcgcaagucaagccucucaauuuccacauguaauaguagauguaaggacacuagaaccaauaagauuaccacucccagaugugagaacuaauuuuuuucauuauacaacacaagaagagccaagaaugagaauuguagccugguuguacaccccuuuaagaacaaacggaaguggagacgauucauucacaguuucgggaagaauauuaacacgaccaucaccugacuucgaauucaguuuuuuaguaccuccaacaguagagaccaaaacaguaaguuucucugucccagguuuaguaguacaagauaugucaaacucaagauggccagcacaaauaucuggcuuaguaguacgaggcaaugaagcacaaguuguucacuuccaaaauggaagauguacuacagaaggaaugcuuuuaggaacaacaacuuuaaauauaaauucaauauguggacucagaggacuaaguguuucacaagcgagcguaagaggugcuccagcauuaacagaagaaaugccaccauuagaagaugaaguagcagauggagccgcagcuacauauacuuuaacaagggccgcagauacagcacuuugguuaagaguugaagaacccgacgggcgaccauaugacauauucggcgaucaaccagcaccauuaggcacaccagauuucacagcagucauaguaggaacugcaauaaggccuagaacaacaucaggugcauauuuacacgacgcuuauguagauacaaccccaggagaugcugacuuuacacccucaacaggaaauacaaaaauaguauuaagaggaggagguuccggucauguaggucaaggucauuauuggcaauuuaaaccaauagcagucgaaggaggaggaagcagaccacaauaucaagaauauaaucuaccagauuaugcuggaccuacugcaaguaaucaugaccuagcaccaccugucgcaccccgaaugccuggcgaacuauuauuacuuuuugaaagugauaugccaguaugggauaauggugcaggagcagcaccagcacaaaaaauacauuguuuauuaccaaaugaauucauaacacaucuuuuugaucuccaggcaccagcucucgcagaagcagcccuauuaagauacguacauccagacaguggcagaacucuauuugaauguaaauuauacagagaagguuauaugguagucgcagcuccuguaggacguuuaaauuucccacuugacggcuauuucagauuugauuccuggguaucagcauuuuauguccuaucaccagucggaucaggucaagguagaagaggcagaaguaaagcagcuuaa

SEQ ID NO: 32444 - RNA, 807 nt, Artificial Sequence
  derived and/or modified sequence opt6 from capsid_protein__Norovirus__ABR24136
auggcaggugcauucuuugcaggacuagcaagugauguauuaggaucaggauuaggaucauuaauaaacgcaggagcaggagcaauuaaucaaaaaguagaguucgaaaacaacagaaaauuacaacaagcaucauucgaauuuucaucaaauuuacaacaagcaucauuucaacacgauaaagaaauguuacaagcacaaauagaagcaacaaaaaaauuacaacaaggcaugaugaaaguaaaacaagcaauguuauuagaaggcggauucagugaaacagacgcagcaagaggagcaauaaaugcaccaaugacaaaagcacuugauuggucaggaacacgauauugggcaccagaugcaagaacaacgacauauaacgcaggaagauucucgacaccacaaccaagcggagcauugccaggaagaacaaacccaagagcgaccguacccgcaagagggagcccaaguacaccaucaaacacaaguacaguaacaagcguuuacucagaucaaacaguaaguacaagauuaggaucaacagcaggaucaggaacacgaguaagcucauuaccaucaacagcaaggacaagaucauggguagaagaccaaaacagaaacuuaaguccauucaugagaggagcacauaacauaagcuucguaacaccaccagcaucacgaucaagcucgcaaggaacaguaaguacaguaccaaaagagguacuggacucauggacaggagcauuuaauacaagaagacaaccauuauucgcacacauaagaaaaagaggugaaucgagagcauaa

SEQ ID NO: 32445 - RNA, 1647 nt, Artificial Sequence
  derived and/or modified sequence opt6 from capsid_protein__Norovirus__ABS12173
augaaaauggccuccaaugacgcuacaccaucaaaugauggcgcagcaggauuaguaccagaaauuaauaacgaagcaauggcacuagacccuguugcaggugcagcuauagcugcaccauuaacaggccaacaaaacauaauugaucccuggauaaugaauaacuuuguucaagcaccaggaggagaauuuacagucaguccccgcaauucacccggagaaguauuacuaaaucuagaacuuggaccagaaauaaauccauaccuagcucauuuagcaagaauguauaauggauaugcuggcggauuugaaguacaagucguacuagcaggaaacgcauuuacagcaggaaaaauaauauuugcagcaauacccccaaauuucccaauagacaaucuaucugcagcucaaauuaccauguguccacauguuauuguagacguaagacaacuagaaccaguuaacuuaccuaugccagaugucagaaacaauuuuuuucauuauaaccagggaucugacucuagacuucgcuuaauagcuaugcucuacacaccauuaagagcuaauaacaguggagacgacguauuuacaguuucauguaggguucucaccagaccuucaccugauuuuucauuuaauuucuuaguuccuccaacaguugaaucaaaaacaaaaccauuuacacuaccaauccuuacaauauccgaaauguccaauuccagauucccuguaccaauagacucacuucauaccucuccaacagaaaauaucguuguacaaugucaaaacggacgaguaacccuagauggagaauuaaugggaacaacacaacuauuacccucacaaauaugcgccuuucgcggaguauuaacaagaucaacaucacgaccaagcgaccaagcagauaccgcuacaccaagacuauucaauuacuauuggcauauccaauuagauaacuuaaauggaacaccauacgauccugcugaagauaucccagguccacuagguacaccagacuuuagagguaaaguuuucggaguagcaucacaaagaaacccagauucuacuacacgagcacaugaagcaaaaguagauacaacagcagguagauuuacacccaaacuaggaucacuagaaauauccacagaaucaggagauuuugaucaaaaucaaccaacaagauuuacuccaguaggaauaggaguagaccaugaagcagauuuccaacaauggucacucccagauuauucuggucaauuuacacauaauaugaauuuagcaccagcaguagcaccuaauuuuccaggagaacaacuacuauuuuuuagaucacaauuaccaucaagcggcggcagaucaaauggaauacuugauuguuuaguaccacaagaauggguccaacauuucuaucaagaaucagcaccagcucaaacacaaguugcacucguaagauauguaaauccagacacaggaagaguuuuauuugaagccaaacuacauaaauuaggguucaugacaauagcaaaaaacggagauaguccaauaacaguuccaccaaacggauauuucagauucgaaucauggguaaauccauuuuacacacuagcaccaaugggaacaggcaauggccgacgaagaauucaauaa

SEQ ID NO: 32446 - RNA, 1611 nt, Artificial Sequence
  derived and/or modified sequence opt6 from capsid_protein__Norovirus__ABS12175
augaaaauggcuucaaacgacgcuaccccuucugaugacggagcagcuggacuaguacccgaaauaaacucugaaguaauggcacuagaaccagucgcaggagcaucacuagcagcaccaguaguuggccaacaaaauauaauagacccauggauaagaaacaauuuuguacaagcacccgccggagaauuuaccguaucuccacgaaauucaccaggagaacuauuacuagauuuagaauuagguccagaacuaaauccauauuuagcacacuuagcccgaauguauaacggacacgccggaggaauggaaguucaaaucguacucgcaggcaaugcauuuacagcaggcaaaauauuauucgcagcaauaccaccaucauuuccauacgaaaaucuaucacccgcacaacuuaccaugugcccacauguaauaguugacguaagacaacuagaaccaguacuacuaccuaugcccgacauaagaaacguauuuuaucauuacaaccaaaauaacucuccuaaacuacgauuaguagcaaugcuauacacaccacuaagagccaauaauucaggagacgauguuuucacaguaucaugucguguccuaacaagaccaucaccagacuuucaauuuaccuuuuuaguuccuccaacaguagaaucuaaaaccaaaaacuucacauuaccaguccuuagagucucagaaaugacaaauucaagauuuccaguaguacuagaucaaauguacacaucuagaaaugaaaacauaauaguacaaccucaaaauggacgauguacaacagauggagaauuacuaggaacaacaauauuacaaucuguaucuauauguaacuuuaaaggaacaaugcaagcaaaauuaaacgaagaaccacgauaucaacuccaauuaaccaaucuugauggaucaccaauagauccaacagacgacaugccagcaccacuaggaacaccagauuuccaagcaaugcuauacggagucgcuagucaaagaucaucaagagacaacgcaaccagagcacacgacgcucaaauugacacagcuggugacacuuucgcaccaaaaaucggccaaguaagauuuaaaucuucuucgaacgauuucgauuugcaugauccaaccaaauucacuccaauaggugucaacguagaugaucaacacccauucagacaaugguuucucccaaacuauggaggacaucuagcauuaaacaaucaccuagcaccagccgucacaccacuauuuccaggcgaacaaauauuauucuuuagaucuuacauaccauccgccggaggacacacagacggagcaauggauugcuuauuaccucaagaauggguugaacauuuuuaucaagaagcagcaccaucacaaucugacaucgccuuaguacguuuuaucaacccugacacaggcagaguacuuuucgaagcuaaacuccauaaacaagguuuucuaacaauagccgcaucuggagaucauccaauagucaugcccacuaauggauauuucagauucgaagcuuggguaaacccauuuuacacacuagcacccguaggaacuggaucuggaagacgcagaauucaauaa

SEQ ID NO: 32447 - RNA, 1626 nt, Artificial Sequence
  derived and/or modified sequence opt6 from capsid_protein__Norovirus__ABS29273
augagaauguccgauggagcagcaccaaaagcaaacggaagugaagcaucuggacaagauuuagucccaaccgcaguugaacaagcaguccccauacaaccaguagcuggagcagcacucgccgcucccgcagcaggacaaauaaaucaaauagacccauggauuuuucaaaauuuuguacaauguccauuaggcgaauucucaauuaguccuagaaauacuccaggugaaauccuauuugauuuagcauuaggaccaggacuaaacccauaccuagcucaucuuucagcaauguacacagguuggguuggaaauauggaaguacaauuaguccuagcagguaaugccuuuacagcagguaaaguaguaguagcuuuaguaccuccuuauuuucccaaaggaucucuaacaacagcacaaaucacuuguuuuccacauguuaugugugauguaagaacacuugaaccuauacaauuaccuuuacuugauguaagaagaguauuauggcacgcuacucaagaccaagaagaaucaaugcgacucguuuguauguuauauacaccauuaagaacuaacucaccuggagaugaauccuucguaguuuccggacgauuauuauccaaaccugcagcagacuuuaauuucgucuauuuaacaccaccaauagaaagaacuaucuauagaaugguagauuuaccaguaauccaaccaagacucuguacacaugcacguuggccugcucccauauacggacuauuaguugauccaucacuuccaucaaauccacaauggcaaaaugguagaguacacguagacgguacacuuuuaggaaccacuccuauaucaggcucauggguuucuuguuuugcagcagaagcugcauaugaauuucaaucaggaauaggagaaguagcaacauucacacuuaucgaacaagaugguucugcauacguacccggagaucgugcggccccacuuggauauccugauuuuucaggucaauuagaaauagaaguucaaaccgaaacuacaaaaacaggagauaaauuaaaaguaacaacauucgaaaugauauuaggcccaaccaccaaugcagaucaagccccuuaucaaggacgaguauuugcauccguaacagcagcagcaucuuuagauuuaguugauggccgagucagagcuguaccacgaucaguauacuccuuuugugauacaauaccagaauauaaugauggucuacuugugcccuuagcaccaccgauagguccuuuucucccaggagaaguucuccuaagauuccgaacauauaugcgucaauuagauacugcagaugcggccgccgaagcaauagauugugcacuaccacaagaauucgucucaugguuugcauccaacgccuuuacaguacaaagcgaagcuuuauuacuuagauaucgaaacacucuuacaggacaauuacuauucgaauguaaacuuuacucugaaggauauauagcacuauccuacucaggaucaggaccauuaacauucccuacagaugguuuuuucgaagucguaucauggguaccaagauuauaccaauuagcaucaguagguucucucgcuacaggaagaacacuaaaacaauaa

SEQ ID NO: 32448 - RNA, 1626 nt, Artificial Sequence
  derived and/or modified sequence opt6 from capsid_protein__Norovirus__ABS29275
augcgcaugucagauggagcagcaccaaaagccaauggauccgaagcaucaggacaagaucuuguuccaacugcuguugaacaagcuguaccaauacaacccgucgcuggugcagcauuagcagcaccagcugcaggccaaauaaaucaaaucgacccauggauauuccaaaauuuuguucaauguccauuaggcgaauucucaauaucaccaagaaacacaccuggagaaauccuauucgaccuagcauuaggaccagguuuaaauccauaccuagcacauuuaucugcuauguauacuggauggguaggaaauauggaaguacaguuaguauuagcaggaaacgcauucacugcuggaaaaguugucguagcuuuagucccaccauauuuuccaaaagguucucuaacuacugcacaaauaacauguuuuccacacguuaugugugauguacggacuuuagaacccauacaacuuccacuauuagauguaagaagaguacuuuggcaugcuacacaagaccaagaagaaucaaugcguuuaguguguauguuauauaccccacuuagaacaaauucacccggagaugaaaguuuuguaguuucaggaagacuauuaaguaaacccgcagcugauuuuaacuucgucuauuuaacaccuccaauugaacgaacuauauauagaaugguugaucuaccaguaauucaacccagauuauguacucaugccagauggccagcucccguauauggcuuauuaguagacccaucauuaccaaguaauccucaauggcaaaacggucguguacauguagacggaacauuacuaggaacaacaccaauaucuggcucuuggguuucuuguuucgccgcagaagcagcauaugaauuccaaucaggaaucggcgaaguugccacauuuacacuuauagaacaagauggaucagcauacaucccuggagaucgagcagccccacuagguuauccagacuucaguggacaacuugaaauagaaguacaaacagaaacaacaaaaacaggugacaaauuaaaaguuacaacauuugaaaugguacucggaccaacuacaaauguugaucaagcaccauaucaaggcaggguuuaugccaguguaacugcagcugcaucuuuagauuuagucgauggacgaguaagagcuguaccucgaucaauuuauucauuucaagacacaauucccgaauacaaugauggucuacuuguaccauuagcaccacccauugguccauuuuuaccaggcgaaguacuucucagauuucguacauauaugagacaacuagauacagcagaugcagcugcagaagcaauagauugcgcacuuccacaagaauuuguuucaugguuugccucaaaugcauuuacuguucaaucagaagccuuauuacuaagauacagaaauacucuaacaggacaacuuuuauucgaauguaaacucuacucagaaggauauauugcuuuaucauacucugguucagguccacucacuuucccaacagacggcuuuuucgaaguuguaucauggguaccacgucuauaccaauuagcaucuguaggaucccucgcuacagguagaacacuuaaacaguaa

SEQ ID NO: 32449 - RNA, 1626 nt, Artificial Sequence
  derived and/or modified sequence opt6 from capsid_protein__Norovirus__ABU55541
augagaaugucagauggagcugcaccuaaagcaaaugguucagaagcaucuggacaggacuuaguuccagccgcugucgaacaagcaguaccaauacaaccagucgcuggagccgcacuggcagcaccugcugcaggacaaauaaaucaaauagaccccuggauauuucaaaauuuuguacaauguccauuaggagaauucucaauauccccaagaaauacaccaggagaaauacuauuugauuuagcucuaggacccggauuaaauccauacuuagcucauuuaucugcuauguauacuggcuggguaggaaauauggaaguacaguuaguauuagccggaaaugcauuuacagcaggaaaaguuguugucgcauuaguaccucccuauuuuccaaaaggaaguuuaacaacagcccaaauaacauguuucccacauguaaugugugauguaagaacauuagaaccaauacaauuaccucuauuagauguuagaagagugcuauggcaugcaacacaagaucaagaagaauccaugcgccuaguauguauguuauauacuccauuaaggacaaacucuccaggagaugaaucuuuuguuguuucaggacgauuacuauccaaaccagcagcagauuuuaauuuugucuauuuaacuccaccuauagaaagaacuauauaucgaaugguugauuuaccaguaauacaaccaagacuauguacacaugcaagauggccagcgcccguuuauggauuauuaguagaucccucuuuaccaucaaauccacaauggcaaaauggaagaguucacguugauggaacacuuuuaggcacaacccccauuucaggaagcuggguaagcuguuucgcagcagaagcagcauacaaauuucaaucagguacaggagaaguugcaacauuuacacuaauagaacaagacgguucugcauauguacccggggacagagcugcuccacuaggauacccagauuucucaggucaauuagaaauagaaguucaaacagaaacaacaaaaacuggggauaaauuaaaagucacaacuuuugaaaugauauuaggaccaacuacuaaugcugaucaagcccccuaucaaggucgcguuuucgcaucuguaacagcagcagcaucauuagauuuaguggacggucgaguaagagcaguaccucgaucaauauauggauuccaagacacuauucccgaauauaaugacgguuuacuuguaccucuagcaccaccaauaggcccauuucuaccuggagaaguacuacugagauuuagaacauacaugagacaaauugauacugcagacgcggcagcagaagcaauagacugugccuuaccucaagaauucguaucaugguucgcuucaaacgcuuuuaccguucaaucagaagcucuauuacugagauauaggaauacccuuacaggacaacuuuuauuugaauguaaacuauauaaugaaggguacauagcauuauccuauucagguucaggaccccuuacauuuccaacagauggaauuuuugaaguuguaucauggguaccuagauuauaucaauuagcuagcgucggaaguuuagcaacaggaagaauguuaaaacaauaa

SEQ ID NO: 32450 - RNA, 1626 nt, Artificial Sequence
  derived and/or modified sequence opt6 from capsid_protein__Norovirus__ABU55544
augcgaaugucagacggagcagcuccuaaagcuaauggaucugaagcaucugggcaagaucuaguucccgcagcaguagaacaagcaguaccuauacaacccguugcaggugcagcauuagcagcaccugcagcaggacaaaucaaucaaauagaucccuggauauuccaaaauuuuguacaauguccauuaggugaauuuucuauaucaccaagaaauacaccaggagaaauucuauuugaccuugcauuaggacccggacuaaauccuuauuuagcacaucuuucagcgauguauacaggauggguaggcaauauggaaguacaauuaguauuagcuggaaaugcauuuaccgcaggaaaaguaguaguagcccuaguacccccuuauuuucccaaaggaucucucacuacagcucaaauaacauguuucccucauguaaugugcgacguaagaacauuagaaccaauucaacuaccacuauuagauguaagaagaguauuauggcaugcaacacaagaucaagaagaaucaaugagacugguauguauguuauauaccccucuacgaacaaauucaccaggugaugaaucauuuguugucucaggaagauuauuaucaaaacccgcagcagacuucaauuuuguauauuuaacuccuccaauugaaagaacaauauauagaaugguagauuuaccagugauccaacccagacuauguacucaugccagguggccagccccaguauauggauuacucguagaucccucucuaccaucaaacccacaauggcaaaacggcagaguacauguugaugguacauuacucggaacaacaccaauaucuggauccugggucucaugcuuugcagcagaagcagcauauaaauuccaaucaggaacaggugaaguagcaacauucacauuaauagaacaagacggaagugcauauguuccaggagauagggcugcaccuuuaggguaccccgauuuuucaggacaauuagaaauugaaguacaaacagaaaccaccaaaacaggagauaaauuaaaaguuacuaccuucgaaaugauuuuaggaccuacuacaaacgcugaccaagcacccuaucaaggaagaguauucgccagcguaacagccgcagcaucuuuagauuuaguagauggucgagucagagcaguaccccguucaauauacgguuuccaagauacaaucccagaauauaaugauggacuacuuguaccacuagcaccuccaauaggaccauucuuaccaggugaaguacuauuaagguuuagaacuuauaugagacagauagacacagcagaugcagcagcagaagcaauagauugugcacuaccacaagaauuuguuucuugguuugcaaguaaugcuuuuacaguacaaucugaggcacuauuauuaagauauagaaauaccuuaacaggacaacuuuuauuugaaugcaaauuauauaaugaaggauauauugcacucucauauucuggaucaggaccauuaacauuuccaacggacggaauauuugaaguaguaucuuggguacccagacucuaucaacuagcuuccguagguucucuugcaacuggcagaauguuaaaacaauaa

SEQ ID NO: 32451 - RNA, 1626 nt, Artificial Sequence
  derived and/or modified sequence opt6 from capsid_protein__Norovirus__ABU55547
augagaaugucagauggagcagccccaaaagccaauggaucagaagcaagcggacaagauuuaguaccagcagcaguugaacaggcaguaccaauacaaccaguagcaggagcagcacuagcagcuccugcagcaggacaaauaaaucaaaucgauccauggauauuucaaaauuuuguucaauguccauuaggagaauuuucaauaucuccaagaaauacaccaggagaaauuuuauucgauuuagcacuaggaccaggacuaaauccauacuuagcccaucuauccgcaauguacacuggauggguagguaacauggaaguacaauuaguacucgcaggaaaugcauuuacugcagguaaaguaguaguagcauuaguaccaccauacuucccaaaaggaucacuaacaacagcacaaaucacauguuuuccacauguaaugugugauguacgaacucuagaaccaauacaguuaccacuuuuagauguacgacgaguacucuggcaugcaacacaagaucaagaagaaucaaugagauuaguuuguaugcuauauacaccuuuaagaacaaacucgccaggugaugaauccuuuguuguauccggaagauuacuaaguaaaccagcagcugauuuuaacuucguauacuuaacacccccaauagaaagaacaauauauagaaugguagauuuaccaguaauacaaccuagacuauguacucacgccagauggccagcaccgguauauggacuauuaguagacccaucauuaccuucaaauccacaauggcaaaauggaaggguacacguagacggaacauuacuagguacaacuccaauaucaggcucauggguaaguuguuuugcagcagaagcugcauauaaauuucaaucaggaacaggugaaguugcaacauuuacauuaauagaacaagauggcucagcauauguaccaggcgacagagcagcaccuuuagguuauccagauuuuaguggacagcuagaaauagaaguucaaacagaaaccaccaaaacaggagauaaauuaaaaguaacaacauucgaaaugauauuaggcccaacaacaaaugcggaucaagccccauaucaagggagaguauuugcaaguguaacugcagcagccagucuagaccuagucgacucaaggguaagagcaguaccaagaaguauauauggguuucaagauacaauaccagaauacaaugauggucuauuaguuccauuagcaccaccuauuggaccauucuuaccaggagagguacuacuaagauuuagaacauauaugagacaaauagauacugcagacgccgcugcugaagcaauagauugcgcuuuaccccaggaauuugucucgugguuugcaaguaaugcauuuacuguacaaucagaagcauuauuauuaagauauagaaauacacuaacaggacaauuauuauuugaaugcaaauuauauaacgaaggauauaucgcuuuaaguuauucaggaaguggaccccuaacauucccaaccgauggaauuuuugaaguaguuaguuggguaccacgacucuaucaacuugcaucaguagguucacuagcaaccggaagaaugcuaaaacaauaa

SEQ ID NO: 32452 - RNA, 1626 nt, Artificial Sequence
  derived and/or modified sequence opt6 from capsid_protein__Norovirus__ABU55550
augagaauguccgauggagcggcgccaaaagcgaaugguucagaagcaaguggacaagauuuaguaccagcugcaguagaacaagcaguaccaauacaaccaguagcaggagcugcacuagcagcucccgcagcuggacaaauaaaucaaauagauccuuggauauuccaaaauuucguacaauguccuuuaggcgaauuuagcauaucaccuagaaauacaccaggagaaauacuauucgauuuagcauuaggaccaggauuaaauccauaucuagcgcauuuaucagcuauguauacuggcuggguagguaauauggaaguacaauuaguacuugcaggaaaugcauuuacagcagguaaaguuguuguagcacuaguaccaccauauuuuccaaaaggaagucuaacaacagcacaaauaacaugcuucccacacguaaugugugaugucagaacuuuagaaccuauacaauuaccccuauuagacguaagaagaguacucuggcaugcaacccaagaucaagaagaaucaaugagacuaguuuguauguuauauacacccuuaagaaccaauucaccaggagacgaaucauuuguaguaucaggcagauugcuuucaaaaccagcagcugacuucaauuuuguuuaucucacuccaccaauagaaaggacaauauacagaaugguagaucuuccuguaauacaacccagacucuguacacaugcaagauggccugcuccuguauauggacuauuaguagacccuaguuuaccaagcaauccccaauggcaaaauggaagaguacacguggauggcacacuucuagguacaacaccuauaucaggcaguuggguuucaugcuuugcagccgaagcagcuuauaaauuucaaaguggaacuggagaaguagcuacauuuacauuaauagaacaagauggcucagcauauguacccggagauagagcagcuccacuaggauaccccgauuucucaggacaacuagaaauagaaguccaaacagaaacuacaaaaacaggagauaaacuaaaaguaacuacuuuugaaaugauauuagguccaacaaccaaugcugaccaagcuccauaucaaggucguguuuuugcauccguaacagcugcagcaucauuagauuuaguagauggaagaguaagagcagucccaagaucaauauauggcuuucaagauacaauccccgaauauaaugauggauuauuaguaccacuagcaccaccaauaggaccuuuccuaccaggagaaguauuauuaagauucagaacauacaugagacaaauagacacagcagaugcagcagcagaagcuauagacugugcuuuaccacaagaauuuguaucuugguuugcgucaaacgcauuuaccguucaaucagaagcauuauuauuacgauacagaaauacauuaacuggacaauuacuguucgagugcaaacuauacaacgaaggcuauauagcacucucauacaguggaucaggaccucucacauucccuacugauggaauauuugaaguuguuagcuggguaccaagacucuaucaacuagcuucuguaggaucacuagcaacaggaagaauguuaaaacaauaa

SEQ ID NO: 32453 - RNA, 1626 nt, Artificial Sequence
  derived and/or modified sequence opt6 from capsid_protein__Norovirus__ABU55553
augcgaaugagcgauggagcugcaccuaaagcaaauggaagugaagcaucuggucaagacuuaguaccagcagcaguagaacaagcaguaccaauacaaccaguugcgggagcugcuuuagcagcaccagcugcaggacaaauaaaucaaauagauccuuggauauuucaaaauuuuguacaauguccccuaggagaauucucaauuucuccaagaaacacaccaggagaaauacucuuugaucuagcccuaggaccaggauuaaacccauaucuagcacacuuaucagcuauguauacaggauggguuggaaauauggaaguucaauuaguucuagcaggcaaugcuuucacagcaggaaaaguaguuguagcgcuuguaccuccauauuuuccaaaaggaucccuaacaacugcacaaauaacauguuucccacauguaaugugugauguuagaacauuagaaccaauccaacucccacuauuagauguucgaagaguacuauggcaugcaacacaagaccaagaagaaucaaugagacuuguauguaugcuauauacaccccuaagaacaaauucaccaggagacgaaucauuuguaguaucaggcagacuauuaucaaaaccagcagcagacuuuaauuucguauaccuaacuccaccaauagaaagaacaauuuauagaaugguagauuuaccaguaauccaaccaagauuauguacacacgcaagauggccugcaccaguuuauggauuacucgucgacccuucacuuccaucaaauccccaauggcaaaacggaagaguucauguugacgguacucuauuaggcaccacacccauuucuggauccuggguaucauguuucgcagcagaagccgcauauaaauuccaaucaggaacaggagaaguagccacauucacauuaauagaacaagacggaagcgcauauguaccuggugacagagcagccccacuaggauacccagauuuuucaggacaacuagaaauagaaguacaaacagaaacuacaaaaacaggugauaaauuaaaaguaacuacauuugaaaugauucuaggaccaaccacaaaugcagaucaagccccauaucaaggacgcguauucgcaucaguaaccgcagcagcaucacuagauuuaguagaugguagaguuagagccguuccaagaucaauauacggauuucaagauacuauuccagaauauaacgauggacuacuugucccauuagcaccaccuauaggacccuuuuugcccggagaaguuuuacucagauucagaacauauaugagacaaauugacacugcagaugcugccgcagaagcaauagauugugcacuuccacaagaauuuguaucaugguuugcaucaaaugcauuuacaguucaaucagaagcauuacuacuucgauaucgaaauacacuuacaggacaauuauuauucgaaugcaaacuauauaaugaaggauacaucgcacuaucuuauucagguuccgggccguuaacuuuuccaacugacggaauauucgaaguaguaagcuggguaccaagauuauaccaauuagcaucaguuggaucauuagccacaggaagaauguuaaaacaauaa

SEQ ID NO: 32454 - RNA, 1626 nt, Artificial Sequence
  derived and/or modified sequence opt6 from capsid_protein__Norovirus__ABU55556
augagaaugucagacggagcagcaccaaaagcaaacggaucugacgcaagcggucaagauuuaguucccgcagcaguagaacaagcaguuccuauucagcccguagcaggagcagcauuagcagcaccugcagcuggacaaauaaaucaaauagacccauggauauuucaaaauuuuguacaauguccauuaggagaauuuaguauaagccccagaaauacuccgggagaaauucuauuugaccuagcacucggacccggacuaaaucccuaucucgcacacuuaucagcaauguauacuggauggguaggaaacauggaaguacagcucguacuagcaggaaaugcuuucacagccggaaagguuguaguagcccuaguuccaccauauuucccaaaaggaucacucacaacagcacaaauuacuuguuuuccacauguuaugugugauguaagaacucuagaaccaauacaauuaccacuacucgacguaagaagaguacuauggcacgcaacacaagaccaagaagaaucaaugagauuaguauguaugcuauauacuccauuaaggacaaauucaccaggagaugaaucauucgugguaucuggaagguuauuaucaaaaccagcugcugauuuuaauuucguauaucuaacaccaccaauagaaagaacaauuuauagaaugguagauuuaccaguuauacaaccaagacucugcacacaugcacgauggccagcaccaguauacggacucuuaguugacccaucuuuaccaaguaauccucaauggcaaaauggccguguacauguagauggaacacuacuagguacaacuccaauauccggaaguuggguuucuugcuuugccgcagaagcagcauauaaauuucaaucuggaacaggagaaguagcaacuuuuacacuaauagaacaagacggaucagcuuacguaccuggagauagagcagcaccuuuagguuacccagacuuuucaggacaacuagaaauugaaguacaaaccgaaacaacaaaaacuggugauaaacuuaaaguaacuacauuugaaaugauacucggaccaacaacaaaugcagaccaagcacccuaccaaggaagaguauuugcuucuguaacagcagcagccucccuugaccucguagauggaagaguucgagcaguaccuagaucuauauacggcuuccaagacacaauaccagaauacaacgauggauuauuaguuccccuugcaccuccuaucggcccauuucucccuggagaaguacucuuacgcuucagaaccuauaugcgucaaauagacacugcagacgcagcagcggaagcaauagauugugcacuuccacaagaauuuguaucuugguuugcaucaaaugccuucacaguccaaucagaagcacuuuuauuaagauauaggaauaccuuaacaggccaacuauuauucgaaugcaaacuguauaaugaaggcuauauagccuuaucauauuccggcucaggaccacuaacuuuuccaacagauggaauauucgaaguuguuuccuggguaccacgcuuauaucaauuagcuucaguuggaucauuagccacaggucgcauguuaaaacaauaa

SEQ ID NO: 32455 - RNA, 1626 nt, Artificial Sequence
  derived and/or modified sequence opt6 from capsid_protein__Norovirus__ABU55559
augagaaugucagauggagcagcacccaaagcuaauggaagugaagcaucaggucaagauuuaguaccagcagcaguagaacaagcaguaccaauacaaccuguagccggagcagcauuagcagcuccugccgcaggucaaauaaaucaaaucgaccccuggaucuuucaaaauuuuguccaauguccuuuaggcgaauucucaauaucuccuagaaauacaccaggagaaaucuuauucgaccuagcacuagguccaggauuaaauccauauuuggcccauuugagcgcaauguauacaggauggguaggaaauauggaaguacaauuaguauuagcaggaaaugcauuuacugcaggaaaaguuguaguagcauuagucccuccuuacuuuccuaaaggaucuuuaacaacagcacaaauaacuugcuuuccacaugucaugugugacguaagaacauuagaaccaauucaacuuccauuacuugauguaagaagaguacuuuggcaugccacacaagaucaagaagaaucaaugagauuaguuuguaugcuauauacuccucuaagaacaaacucccccggagacgaaucauuuguaguaucuggaagauuauuaucaaaaccagcagccgauuucaauuuuguauauuuaacaccaccaauagaaaggacaauauaccgaaugguagauuuaccagucauccaaccaagauuauguacacaugcaagauggccagcaccaguauauggucuauuagucgauccaucguuaccaucaaauccacaauggcaaaacggaagaguacauguagacggcacuuuauuagguacaacaccaauaucaggaucauggguaaguuguuucgcugcagaagcagcauaugaauuucaaucugguacuggagaaguugcaacauucacuuuaauagaacaagacggaagcgcauauguaccaggagaucgagcagcaccauuaggauauccugauuuuuccggccaauuagaaauugaaguacaaacugaaacaacaaaaacaggggacaaauuaaaaguaacaacauuugaaaugauucuaggaccaacaaccaaugcagaucaagcuccuuaucaagguagaguauuugcuucugucacagcagccgcuuccuuagaccucguugacgguagaguaagagccguuccaagaucaauauauggauuucaagauacaauuccagaauauaaugacggacuacuaguaccacuagcaccaccaauaggaccuuucuugcccggagaaguucuauuaagauuuagaacuuauaugagacaaauugauacagccgacgcagcagcugaagcaauugacugugcuuuaccucaagaauuuguaaguugguuugccucaaaugcauucacaguccaaucugaagcucuacuacuaagauauagaaauacacuaacaggacaacuauuauucgaauguaaauuauauaaugaaggauacauugcucucaguuauucugguucagguccucuaacauuuccaacagauggaauuuuugaaguuguuucuuggguaccaaggcuauaucaacuagcaucaguuggaucuuuagcuacaggaagaauguuaaaacaauaa

SEQ ID NO: 32456 - RNA, 1626 nt, Artificial Sequence
  derived and/or modified sequence opt6 from capsid_protein__Norovirus__ABU55562
augagaauguccgauggagcagcacccaaagcaaaugguuccgaagcaucaggacaagauuuaguaccugcagcuguagaacaagcugugccaauccaaccaguagcuggcgcagcccucgcugcuccagcagcuggacaaauaaaucaaauagauccauggauauuccaaaacuucguacaauguccucuuggagaauuuucaauuuccccuagaaauacacccggagaaauacuauucgauuuagcuuuaggacccggauuaaauccauaucucgcgcauuuaagugccauguacacaggauggguaggaaauauggaaguacaauuaguucuagcaggaaacgcuuuuacugcaggaaaaguaguaguagcucuaguuccaccauauuuucccaaaggaaguuuaacaacagcacaaauaaccuguuucccacauguaaugugugacguccgaacacuagaaccaauacaauuaccauuacucgauguacguagaguauuauggcacgcaacacaagaucaagaagaaucuaugagauugguauguauguuauauacaccacuacguacaaacucaccaggagaugaaucuuuuguuguuaguggacgauuauugucaaaaccugcagcugauuuuaacuuuguauauuuaacaccaccaauagaaagaacgauauauagaaugguagaucuaccaguaauccaaccaagacuauguacacacgcaagauggccugccccagucuauggucuauuagucgacccaucucucccuucaaauccacaauggcaaaaugguagaguacauguugauggaacacuauuagguaccacaccaaucucuggauccuggguuucuuguuuugcagcugaagccgcauauaaauuucaaucagguacaggcgaaguagcaacauuuacacuaauagaacaagauggaucagcuuauguaccuggcgauagagcugcuccacucggauauccagauuuuucgggacaacuagaaauugaaguacaaacugaaacaacaaaaacuggagauaaauuaaaaguuacaaccuucgaaaugauacuugguccuacaaccaaugccgaucaggcacccuaucaaggacgcguauucgccaguguaacagcagcugcaucauuagauuuaguagacggaagaguacgagcagucccaagauccauauauggauuucaagauacaaucccugaauauaaugauggacuccuaguaccccuagcaccaccaauaggaccauuccuuccaggagaaguacuacuccgauuuagaacauauaugcgacaaauugacaccgcagaugcagcagcagaagcaauagauugcgcacuaccucaagaauucguuagcugguucgcuuccaacgcauucaccguacaauccgaagcauuauuauuaagguauagaaauacacuaacaggacaauuauuauuugaauguaaauuauauaaugaaggauauauagcucuuucauauucaggcucaggaccauuaacauuucccacagacggaaucuuugaagucguaucauggguaccacguuuauaccaacucgcaaguguaggaucuuuagcaacaggacguaugcucaaacaauaa

SEQ ID NO: 32457 - RNA, 1626 nt, Artificial Sequence
  derived and/or modified sequence opt6 from capsid_protein__Norovirus__ABU55565
augagaaugucugauggugcagcaccuaaagcaaauggaagcgaagcuucuggccaagaucuaguaccagcggcaguagaacaagcaguaccuauucaacccguagcaggagcugcacuagcugcaccagcagcaggacaaauaaaucaaauagacccauggauauuccaaaacuuuguucaaugcccacuaggagaauucucaauuucaccaagaaacacaccuggagaaauauuauuugaucuggcuuuaggaccaggauuaaacccauaccuagcacauuuaucagcaauguauaccggauggguugguaauauggaaguacaauuaguacuagcuggaaaugcauuuacugccgguaaaguaguaguagcacuuguaccaccuuauuucccaaaaggaucauuaacaacagcucaaauuacuuguuuuccacauguaaugugugauguucgcacacuugaacccauacaauuaccacuccucgacguccgaagagucuuauggcacgcaacucaagaucaagaagaaucaaugcguuuagucuguauguuauauacuccacuacgaacaaauucaccaggagaugaaucuuuuguuguaucuggacgauuauuaaguaaaccagcugcagauuuuaauuuuguauaucuaacaccaccaauagaaagaacuauauauagaaugguagacuuaccaguaauacaaccaagacuauguacacaugcuagauggcccgccccaguuuauggauuacucguagauccaucuuuaccaucuaacccacaauggcaaaacggacguguacacguagacggaacacuucuugguacaaccccaauaucaggaucuugggucucauguuucgcugcugaagcagcuuauaaauuucaauccggaacaggagaaguugcuacauucacucuaaucgaacaagaugguucagcauauguaccaggcgaucgagcagcaccauuaggauacccagacuuuuccggucaauuggaaauagagguucaaacugaaacaacaaaaacuggagacaaacucaaaguaaccacauuugaaaugauauuaggaccaacaacaaaugcagaccaagcaccauaucaaggaagaguauuugcaucuguaacggcagcugcaucauuagauuuaguagauggaagaguacgcgcaguuccucgaucaauuuaugguuuccaagauacaauaccagaauauaacgacggauuacuaguaccauuagcacccccaauaggacccuuuuuaccaggugaaguuuuguuaagauuuagaacauauaugagacaaauagacaccgcugaugccgcagcugaagccauagacugugcacuaccacaagaauuuguuucaugguucgcuucaaaugcguucacaguucaaucagaggcacuucuucuacgauacagaaauacacuuacaggacaauuauuauucgaauguaaauuauauaaugaaggauacauugcucuaucguauagugguucaggaccacucacauucccaacagacggcauauucgaagugguaucauggguaccaagacuauaucaauuagcuucaguuggaucucuugcaacaggacggauguuaaaacaauaa

SEQ ID NO: 32458 - RNA, 1626 nt, Artificial Sequence
  derived and/or modified sequence opt6 from capsid_protein__Norovirus__ABU55568
augagaaugucagauggagcagccccaaaagcaaaugguagcgaagcauccggccaagauuuuguuccagcagcuguagaacaagcuguaccaauucaaccaguugcaggagcagcacuagcugcgccagcagcaggccaaauuaaccaaauugacccauggauauuucaaaauuuuguacaaugcccauuaggagaauuuagcauuaguccaagaaauacaccuggagaaauucuauucgaucuagccuuaggaccagguuuaaaccccuacuuagcucaccuaagugcaauguauacagguuggguugguaauauggaaguacaacuuguauuagcugguaaugcauuuacagccggaaaagugguuguagcauuaguuccuccauauuuuccaaaaggaucccuaacaacagcucaaauaaccugcuucccacauguaaugugugacguaagaacacuagaaccaauucaacuuccauuauuagauguaagaagaguucuauggcaugcgacacaagaccaagaagaaucuaugagacuaguauguaugcuauauacuccacuaagaacaaacucaccaggagaugaaucuuuugucguaucaggucgacucuuaucaaaacccgcagcugauuuuaauuuuguauaucuaacgccaccuauagaaagaacaguuuauagaaugguagacuuaccaguacuucaacccagacuauguacacacgcuagauggccagcaccuguuuacggguuauuaauagaucccaguuuaccuucaaauccgcaauggcaaaacggaagaguacauguuaauggaacucucuuaggaacaacaccaguuucuggaucauggguauccugcuuugcugcagaagcugcuuacgaauuucaaucugguauuggagaaguagccacauuuaccaugauagaacaagaugguucagccuacguaccaggagauagagcugccccacuuggauauccagacuuuucaggucaauuagaaauagaaguacaaacugaaacuacaaaaucaggcgauaaacuaaaaguaacaacauuugaaaugaucuuaggaccaacuacaaaugcugaccaaacaccuuaucaaggaaagguauaugcuucaauagcagcugcugccucacuugauuuaguagauggaagaguaagagccguuccaagaucuguauacgcauuucaggauguauuaccugaauauaaugauggauuauuaguuccuuuagcaccaccuuuaggaccuuuucuaccaggagaaguuuuacuuagauucagaacauauguuagacaacuagauacugcagaugccgccgcccaaccaauagacugcgcauuaccacaagaauucauuaguugguucgcauccaauaauuuuacaguucaaucagaugcuuuacuaauaagauauagaaauacauuaacaggacaacuuuuauucgaagcaaaacuuuacucagaagguuauauagcagugucauauucaggaucaggaccauuaacauuuccuacagaugguuucuucgaaguagucucauggguaccucgauuauuucaacuagccucaguagguucuuuagcaacaggccgaacacuuaaacaauaa

SEQ ID NO: 32459 - RNA, 1626 nt, Artificial Sequence
  derived and/or modified sequence opt6 from capsid_protein__Norovirus__ABU55571
augagaaugucagauggagcagcaccgaaagccaacggauccgaagcuucaggacaagaucuaguaccuacagccguagaacaagcuguaccaauacaaccaguagcaggagcagcacuagcagcuccugcagcuggacaaaucaaucaaauagauccuuggauauuucaaaauuucguacaauguccuuuaggugaauuuucaauuucaccacgaaauacaccaggagaaauacuauucgauuuagccuuagggccaggucuuaauccuuaucuagcacauuuaucugcuauguacacaggguggguaggaaacauggaaguacaauuaguacucgcugguaaugcauuuacagcuggaaaaguaguaguugcacuaguucccccuuauuuuccaaaaggaucuuuaacaacagcucaaaucacaugcuuuccucauguaaugugugacguaagaaccuuagaaccaauacaacuacccuuacuagauguaagaagaguauuauggcaugcaacacaagaucaagaagaaucaaugcgcuuagucuguauguuauauacaccauuacgaacaaauuccccaggagaugaaucauucguaguuucuggucgacuacuaucaaaaccugccgcagauuuuaauuuuguauaccuaaccccaccaauagaaagaaccguauacagaauggucgacuuaccgguauuacaaccaagauuauguacacaugcaagauggccagcaccaauuuauggccuauuaauagauccuucuuuacccucaaauccucaauggcaaaacggaagaguacaugucaacggaacauuacuaggcacaacaccaguaucaggaucauggguaucauguuucgccgcagaagcagcauaugaauuccaaucaggaacuggagaaguagcuacauuuacaaugauugaacaagacggaucagcauauguuccaggugauagagccgccccauuaggauauccugacuucucaggacaacuugaaauagaaguucaaacagaaacaacaaaaacaggagacaaauuaaaaguuacaacauuugaaaugguacuagguccaacuacaaacguagaucaagccccuuaucaaggaagaacauaugcaagcuuaacagcagcugcuucucuagauuuaguagauggacgaguacgagcaguaccuagaucaauauauucauuccaagacguauuaccagaauauaacgauggauuauuaguaccacuagcaccaccacuugguccauuuuuaccuggagaaguacuauuaagauuuagaaccuauaugagacaauuagauaccgcugaugccgcggcacaaccuauagauugugcgcuaccccaagaauuuaucucaugguuugccucuaauaauuuuaccguacaaucugaugcauuacuaauucguuacagaaauacacuaacaggccaguuauuauuugaagcaaaacuauauucagaaggauauauugcgguuucauauucagguucaggaccuuuaacauucccuacagacgguuucuucgaaguaguaucauggguaccaagauuauuucaacuagcuucaguaggcucccuugcaacaggacgaacacucaaacaauaa

SEQ ID NO: 32460 - RNA, 1626 nt, Artificial Sequence
  derived and/or modified sequence opt6 from capsid_protein__Norovirus__ABU55577
augagaaugagugauggagcagcaccgaaagcuaaugguucagaagccauaggccaagaucucguacccacagcaguagaacaagcaguuccaauacaaccaguagcaggagccgcauuagcagcaccagcagcaggacaaauaaaucaaauagauccauggauauuucaaaacuuuguacaauguccucuaggagaauuuucaauaucaccaagaaauacacccggagaaauacucuucgaucucgcauuaggaccaggauuaaauccauauuuagcacaucuaucugcaauguauacaggcuggguugguaacauggaaguacaauuaguauuagccggaaaugcauuuacugcuggaaaaguuguaguggcacucguaccaccauauuuuccaaaagguucucuaacaacagcucaaauaacauguuucccucauguaaugugcgauguacgugcacuagaaccaauucaauuaccacuauuagaugucagaagaguauuauggcaugcuacacaagaccaagaagaaucaaugagacuaguauguauguuauauacacccuuaagaacaaacucuccuggagacgaaucauuugucguaucugguagauuauuaucaaaaccagcagccgauuuuaacuuuguauaccucacaccccccauagaaaggacaguuuaucguaugguugaucuaccaguacuccaaccaagauuauguacacaugcuagguggccagcacccguuuacggucuauuaguugauccaucacuaccaucaaauccccaauggcaaaacggaagaguacaugucaacgguacuuuauuagguacaacuccuguuagcggaucauggguauccugcuuugcagcugaagcagcauacgaauuucaaucaggaacuggugaaguagcuacauuuacuaugauagagcaagaugguucugcauauguaccaggugacagagcugcuccacuuggauacccugauuuuuccggucaauuagaaauagaaguacaaacugagacaacaaaaaguggagauaaacuaaaagucacaacauuugaaaugauacuaggaccuacaacaaacgcugaucaaacucccuaucaaggaagaguuuaugcuucuauagcugcagcagccccauuagaccucguagauggaagaguaagagcuguaccaagaucuguauauuuuuuccaagauguucuaccugaauauaacgauggacuucucguuccgcuagcucccccacuagggccauucuuaccaggagaaguacuauuacgauuuagaacauauguuagacaauuagauacagcagaugcagcugcacaaccaauagauugugcauuaccacaagaauuuauaucaugguuugcuucaaauucuuuuacaguccaaucugaagcacuacucauaagauacagaaacacccuaacaggacaacuccuuuuugaagcuaaacuguacucagaagguuauauagcaguuucguauagugguucaggaccuuuaacauuuccaacagaugguuuuuuugaaguaguuaguuggguaccucgucuauuucaauuagcauccguagguucuuuagcaacaggaaggacacuaaaacaauaa

SEQ ID NO: 32461 - RNA, 1626 nt, Artificial Sequence
  derived and/or modified sequence opt6 from capsid_protein__Norovirus__ABU55580
augaggaugucagauggugcagcaccuaaagcaaauggaucagaagcaauaggacaagacuuaguacccacagcaguagaacaagcuguaccuauucaaccaguagccggagcugcucuagcugcaccagccgcaggacaaauaaaucaaauagauccuuggauuuuucaaaacuuuguacaaugcccauuaggugaauuuucaaucuccccaagaaacacuccaggugaaauauuauuugaucuagcacuaggaccagguuuaaacccauauuuggcccaccugucagcaauguauacaggauggguaggaaacauggaaguucaacucguauuagcagguaacgcauuuacugcuggaaaaguaguagucgcgcuaguaccaccuuauuucccuaaaggaucauuaacaacagcacaaauaacauguuuuccacauguuaugugugacguaagagcucuagaaccuauucaauuaccauuauuagacguaagacggguacuauggcacgccacacaagaucaagaagaaucaaugcgcuuaguauguauguuauauacaccuuuacguacaaacucaccuggagacgaauccuuuguaguaucugguagguuacuaucaaaaccugcagcugacuuuaauuuuguauaccuaacccccccaauagaaagaacgguauaccgaaugguagaucuaccaguucuacaaccaagauuaugcacucaugcacguuggccagcaccaguuuauggacuauuaguagauccaagcuuaccuaguaauccacaauggcaaaauggaagaguccauguaaauggaacacuauuagguacaaccccaguuucaggaucauggguaagcuguuuugcagcugaagcagcuuacgaauuccaaucaggaaccggagaaguugcaacuuuuacaaugauagaacaagauggaucagccuauguuccaggagaccgugcagcuccauuaggauaucccgauuucucaggacaauuagaaaucgaaguacaaacagagacaacuaaaucaggagauaaguuaaaaguuacaacauuugaaaugauauuaggaccaacaaccaacgcugaccaagcaccauaccaaggcagagucuaugccucuuuagcagcagcagcaccucuagaccuaguagacggaagaguaagagcaguaccuagaucaguguauuuuuuucaagauguacuaccagaauacaaugacggucuacuaguaccccuagcaccuccauuaggaccauuucuucccggagagguacuacuaagauuuagaaccuauguuagacaacuugacacagccgacgcugcugcucaaccaauagauugcgcacuaccacaagaauucauuucuugguuugcaucaaacucauuuaccguccaaagcgaagcauuauuaauaagauauagaaauacucuuacaggucaauuacuauucgaagcaaaacuauauucagaagguuacauagcugucucuuauuccgguucagggccacuaacauuuccaacagacgguuuuuuugaaguaguauccuggguaccacgacuauuucaacuagcauccgucgguucauuagcaacugguagaacauuaaaacaauaa

SEQ ID NO: 32462 - RNA, 1626 nt, Artificial Sequence
  derived and/or modified sequence opt6 from capsid_protein__Norovirus__ABU55586
augagaaugagugauggagcagcuccuaaagcaaauggaucagaagcaauaggacaagaucuaguuccaacagcaguagaacaagcaguuccaauacaaccuguugcaggcgcagcucucgcagcaccagccgcgggacaaaucaaucagauugacccauggaucuuucaaaacuucguacaaugcccauuaggagaauuuucuauaagcccaagaaauacaccaggagaaauacuauuugaucuagcauuaggcccgggacuaaacccauaucuagcccacuuaucggcaauguauaccggaugggucgguaauauggaaguacaacuaguguuagccggaaaugcauucacugcaggcaaaguuguuguagcauuaguaccaccauauuucccaaaagguuccuuaacaaccgcacaaauaacaugcuuuccucacguaaugugugauguaagagccuuagaaccaauacaacuccccuuauuagauguaagaagaguucuauggcacgcaacacaagaucaagaagaaucaaugcgauuaguauguauguuauauaccccacuaagaacaaauucuccaggcgacgaaucuuuuguuguaaguggcagauuacuaaguaaaccagcagcagauuucaauuuuguuuaccuaacaccaccuauagaaagaacaguuuauagaaugguagaucuaccaguauuacaaccacgcuuauguacacaugcuagauggccugcacccguuuauggacuacuuguagauccauccuuaccaucuaauccacaauggcaaaacgggagaguacaugucaacggaacacuucuaggaacaacacccguaucaggauccugggucucaugcuucgcagccgaagcugcauacgaauuucaaucaggaacaggagaaguagcaacauucacaaugauagaacaagaugguuccgccuacguaccaggagauagagcagccccacuaggcuacccagacuucucaggacaauuagaaauagaaguacaaacagaaacaacaaaaucaggagacaagcuaaaaguaacuacauuugaaaugaucuuaggaccaacaacuaacgcugaucaagcaccauaucagggaaaaguauaugcuucacuagcugcugcugccccuuuagauuuaguagauggacguguaagagcuguaccaagaucaguauauuuuuuucaagacguacuuccagaauacaaugaugguuuacuuguacccuuagcuccaccucuaggaccauucuuaccaggcgaaguauuauuaagauuuagaacauauguaagacaauuagacacugcagacgcagcagcacaaccuauagacugugcuuuaccucaagaauuuauaucaugguuugcaucaaacucuuuuaccguacaaucugaugcucuauuaauaagauaucgaaauacuuuaacaggucaauuacucuucgaagcuaaauuauauucagaaggauauauugcuguuaguuauuccggauccggaccacucacuuuucccaccgauggauuuuucgaaguaguaucauggguuccuagacuauuccaacuagcaucaguagguucacuagcaaccggaagaacuuuaaaacaauaa

SEQ ID NO: 32463 - RNA, 1626 nt, Artificial Sequence
  derived and/or modified sequence opt6 from capsid_protein__Norovirus__ABU55589
augcgcaugucagauggugcugcaccaaaagcaaacggaucugaagcaucuggacaagaucuaguaccaaccgccguagaacaagcuguaccuauacaaccaguagcaggugcagcacuugcagcacccgcagcuggccaaauuaaccaaauagaucccuggauuuuucaaaauuucguacaaugcccuuuaggcgaauuuucaauaucuccaagaaacacaccaggugaaauacuauuugaucucgcacuaggaccuggucucaauccuuaucuagcacacuugagcgccauguauacaggauggguaggaaauauggaaguacaauuaguauuagcagguaaugcauuuacagcggguaaagucguaguagcauuaguaccuccauacuucccaaaagguucacuaacaacugcacaaauaacauguuucccacauguaaugugugacguuagaacacuagaaccuauacaacuaccacuacuagauguaagacguguuuuauggcaugccacccaagaucaagaagaaucuaugcgacuaguuuguauguuauacacacccuuaagaacaaacaguccaggugaugaaagcuucguaguaucuggacgacuacuauccaaaccagcugcagauuuuaacuuuguauacuuaacuccaccaauagaacgaaccguauauagaaugguagauuuaccagugcuucaaccaagauuauguacacacgcuagauggcccgcaccaguauauggauuacuaauagaucccucauuaccuucuaauccucaauggcaaaacggacgaguacaugucaacgguacacuauuaggaacaaccccaguaucuggaucauggguaucuuguuuugcugcggaagcugcauaugaauuucaaaguggcacaggagaaguagcaacauuuacaaugauagaacaagacggauccgcuuauguaccuggugacagagcagcaccuuuaggcuacccagauuucucaggacaauuagaaauugaaguucaaacugaaacuacaaaaucaggagacaaacuaagagucacaacauuugaaaugauauuaggaccaacaacaaauguagaccaggcaccuuaucaaggaagaguauacgcauccuuagcagcugcagcaucauuagaucuugucgauggacgagucagagcaguaccaagaucgguauauucauuucaagauguccuaccagaauauaaugauggacuauuagucccccuagcaccuccacuaggcccauuccuaccaggagaaguauuauuaagauucagaacauauaugagacaacuagacacagcagaugccgcagcacaaccaauugacugugcauuaccacaagaauucauaucaugguuugcaucuaauaauuuuaccguacaaagcgacgcauuacucauucgcuaucguaauacguuaacuggucaacuauuauucgaagccaaacuauacucagaaggauauaucgcaguaucauauucagguucuggcccauuaacuuuucccacagacggauucuuugaaguaguaucauggguaccuagacuauuccaacuagcaucagucggaaguuuagcaacaggucgcacauuaaaacaauaa

SEQ ID NO: 32464 - RNA, 1626 nt, Artificial Sequence
  derived and/or modified sequence opt6 from capsid_protein__Norovirus__ABU55598
augagaaugucagauggagcugcaccaaaagcaucagguucagaagccucaggacaagauuuaguaccaacagccguugaacaagccguaccaauacaaccgguagcaggcgcugcacuagcagccccagcagcaggccaaauaaaccaaauugacccauggauuuuccaaaauuuuguacaaugcccacuaggagaauuuagcauuucaccacgaaacacucccggagaaauacuuuuugaucuagcauuagguccaggauuaaauccuuauuuagcacauuuaucagcaauguauacagguugggucggaaacauggaaguacaauuaguuuuagcagguaacgcauuuacagcagguaaaguaguaguagcuuuaguaccacccuauuuuccuaaaggaucauugacaacggcucaaauaacguguuuuccucauguaaugugugacguaagaacacuagaacccauucaacuacccuuauuagauguaagacguguauuguggcaugcaacacaagaucaagaagaaucaaugagacuaguaugcaugcuauauacucccuuacgaaccaauaguccaggcgacgaaucuuucguaguuucaggaagauuauuaagcaaaccagcagcugauuuuaauuuuguauauuuaacacccccaauagaaagaacaauauauagaaugguagacuuacccguacuacaacccagacucugcacucaugcccgauggccagcaccaguauauggacuauuaguagauccaagcuuaccaucaaauccacaauggcaaaacggaagaguacauauagauggaacauuguuaggaacuacaccaguaucagguucauggguauccuguuuugcagccgaagcagcauaugaauuccaaucagguacuggagaaguagcaacauuuacauuaaucgaacaagauggaucagcauacguaccaggugauagggcagcuccauuaggauauccagacuuuaguggucaacuagaaauagaaguacaaacugaaaccaccagagcaggagauaaacuaaaaguaaccacauucgaaaugauauuaggcccaacuacuaauguagaccaagccccguaccaaggaagaguauacgcuaguuuaacagcagcagcaucacucgauuuaguagauggaagaguacgagcagucccaagaucaauauauucauuucaagacguuuuaccagaauacaaugauggauuauuaguaccucuagcaccuccaauaggaccauucuuacccggagaaguguuauuacgauuucgaacauauaugagacaaguugacaguuccgacgcagcagcagaagcaauugauugcgcacuaccacaagaauuuguaucuugguucgcaucaaauggauuuaccguacaaucagaagcauuauuacuaagauaucgaaauacacucacaggacaauuauuauucgaauguaaauuauauucagaaggauauaucgcuuuaagcuauucaggaaguggaccauuaacauuuccaacagauggauuuuucgaagucguaucaugggucccaagauuauuucaacuugcaucaguaggaagucuaguuacaggaagaacacuuaaacaguaa

SEQ ID NO: 32465 - RNA, 1626 nt, Artificial Sequence
  derived and/or modified sequence opt6 from capsid_protein__Norovirus__ABU55601
augagaaugucugauggugcagccccaaaagcuaauggaucagaagcaucaggccaagauuuaguaccaacagcaguagaacaagcaguuccaauacaacccguugcaggagcagcauuagcagcaccggcugccggacaaauuaaccaaauagacccauggauauuucaaaauuuuguacaauguccauuaggcgaauuuucaauaaguccuagaaacacaccgggcgaaauauuauucgauuuagcacuaggaccaggacuaaauccauaccuagcacacuuaagugcaauguacacaggaugggucggaaauauggaaguacaauuaguuuuagcaggcaaugcauucacggcaggaaaaguuguaguagcuuuaguaccacccuauuuucccaaggguucauuaacaacugcucaaauaacaugcuuuccacaugucaugugugacguacgaacauuagaacccauacaauuaccucuauuagauguuagaagaguacuauggcaugcaacccaagaucaagaagaauccaugagacuuguaugcaugcuauauaccccauuaagaacaaauucacccggagaugaaucauuuguaguaagcggaaggcuauuaucaaaacccgcugcagauuucaacuuuguauauuuaacaccuccuaucgaaagaacuauauauagaauggccgacuuaccaguccuacaaccaagauuauguacccaugcaagauggccagccccugucuacggauuauuaguugauccuucacuuccuaguaacccacaauggcaaaacggccguguacauguagauggaacccuacuagguacuacacccauuucaggaucuuggguaucuugcuuugcagcugaagcugcuuaugaauuucaaucaggaacuggagagguagcaacucuaacacucauagaacaagacggaucugcauauguaccaggugacagagcagcaccauuaggguacccagacuuuucuggacaauuagaaauagagguacaaaccgaaacaacaaaagcuggugauaaauuaaaaguuacaacauuugacaugauauuaggaccuacaacaaauguagaucaagccccauaucaaggcagaguauaugcaucaguuucaaccgcagcaucacuuggauuaguugauggaagaguuagagcaguaccaagaucaauauauggauuccaagacacaauaccugaauauaacgauggauuauuaguaccauuagcaccaccaaucggaccuuuuuuaccuggagaaguacuuuuaagauuuagaacauauaugagacaaauagauacagcagaugcagccgcagaagcaauagauugugcucuaccacaagaauucauaucaugguuugcauccaacgcauuuacuguacaaucagaagcauuguuauuaagauauagaaacaccuugacuggucaauuacuauucgaaugcaaauuauauucagaaggauacauagcacuaucauacucagguaguggaccccuaacauucccaacugaugguuuuuuugaagcuguuucauggguacccagacuauaccaauuagccaguguugguucucuagcaacuggaagaacauuaaaacaauaa

SEQ ID NO: 32466 - RNA, 1626 nt, Artificial Sequence
  derived and/or modified sequence opt6 from capsid_protein__Norovirus__ABU55604
augcgaaugucagauggugcugcaccaagagcaaacgguucagaagcauccggacaagaucucguaccaacagcuguagaacaagcaguaccuauucaaccaguagcaggagcugcuuuagcagcuccagcugcaggacaaauaaaucaaauagauccauggauauuccaaaauuuuguacaauguccgcucggagaauuuagcauuaguccaagaaauacaccuggagaaauauuauuugaucuagcauuaggaccaggauuaaauccuuacuuagcucaucuaucugcaauguauacagguuggguaggaaacauggaaguacaacuaguacuugcagguaacgcuuuuacugcagguaaaguaguaguagcacuuguaccaccuuauuuuccuaaaggauccuuaacaacagcacaaauuacuuguuuuccacacguaaugugugauguccgaacauuagaaccaauacaacugccauuacuagauguaagaagaguacuuuggcaugcaacacaagaucaagaagaaucuaugaggcuaguauguaugcuauacacaccauuaagaacaaauucaccaggagacgaaucauucguuguaucaggcagauuacuaucaaaaccugcagcagacuuuaauuucguuuauuuaacaccaccgauagaaagaacaauauaucgaaugguagauuuaccaguaauucaaccaagacucuguacacacgcaagauggccagcuccaauauauggcuuacuuguugauccaucauuaccaucaaauccacaauggcaaaaugguagaguacauguagaugguacacuacuaggaacuacucccauaucaggcucauggguaucuugcuuugcagcagaagcagcauaugaauuucagucuggaacuggagaaguagccacauuuacauuaauagaacaagacggaucagcauacguuccaggagauagagcagcuccacuagguuauccagacuucucuggucaauuagaaauagaaguacaaacagaaacaacaaaaacuggugauaaacuaaaaguaacuacauucgaaaugauccuuggcccaacuacgaauguagaucaagcaccauaucaaggaagaguauaugcaucaguagcugcagcugcaucauuagauuuaguagauggcagaguacgugcaguaccaagaucaaucuacggauuucaagauguaauaccagaauauaaugauggccuuuuaguaccauuagcaccaccaauaggacccuucuuaccuggagaaguacuauuacguuuuagaacauauaugcgacaacucgauacagcugaugccgcugcagaagcaauagacugugcacuaccucaagaauucguaucaugguuugcaucuaaugcuuucacaguacaaucugaagcguuacuacuccgauaucgaaacacacuaacaggacaacuuuuauuugagugcaaauuauauucugagggauauauagcucuaucauacaguggaagcggaccccuuaccuucccagcugacggauuuuucgaaguagucucauggguuccuaggcuuuaucaacuugcaucagucgguagccuugcaacagguagaauguuaaggcaauaa

SEQ ID NO: 32467 - RNA, 1626 nt, Artificial Sequence
  derived and/or modified sequence opt6 from capsid_protein__Norovirus__ABU55607
augagaaugagcgauggagccgcuccaaaagcuaacgguucagaagccucuggacaagauuuagucccuacagccgucgaacaagcaguaccuauucaaccagucgcaggugcagcacuagcagcaccagcagcaggucaaauaaaucaaauugacccuuggauauuucaaaauuuuguucaauguccucuuggagaauuuucaauaucaccaagaaauacuccaggagaaauacuuuuugaucuagcuuuaggaccaggacucaacccauaucuagcacaucuuucagcuauguacaccggauggguagguaauauggaaguacaauuaguuuuagccggaaaugcauucacugcaggaaaaguagucgucgcacuuguaccuccauacuuuccaaaaggaucuuuaacaacagcacaaauaacaugcuuuccacauguaaugugugauguuagaacauuagaaccaauucaacuaccucuucucgauguaagaagaguacuuuggcaugccacccaagaucaagaagaaagcaugagacuaguauguauguuauauacaccccuaagaacaaacagucccggagaugaauccuuuguaguaucaggccguuuauuaucaaagccagcaccagauuucaacuuuguauaucucacuccaccaauugaaagaacaauauaucgcaugguagauuuaccuguucuacaaccucgucuuuguacacacgcaagauggcccgcaccaguauauggacuacuagucgacccaucacuaccaucuaauccccaauggcaaaauggaagaguacaaguagauggaacacuacuagguacuacacccguuagugguucuuggguuucuugcuuugcagcagaagccgcuuacgaauuucaagcuggaacaggagaaguugucacauuuacuaugauugaacaagauggaucagcauauguaccuggagauagagcugcaccucuaggauaucccgauuuuucaggacaacucgaaauagaaguccaaaccgaaacuacaaaaacaggagauaaacuuagaguaacaacauuugaaaugauauuaggaccaaccaccaacguagaccaagcuccauaucaagguagagcuuacgcaucuuuaacagccgcagcaucauuagaucucgucgaugguagaguuagagcaguaccacgaucuauauacucauuucaagaugaacuaccagaauauaaugauggauuacucguaccucuugccccaccacuaggaccauucuuaccaggcgaaguacuacucagauuuagaacauauaugagacaacuagauacagccgaugcugcagcacaaccaaucgauugugcacucccucaagaauuuauauccugguuugcauccaauaacuucacaguacaaagugaugcguuauuaguaagauacagaaauacuuuaaccggucaacuacuauuugaagccaaauuauauucagaagguuauauagcaguuucuuacucuggaagcggaccauuaacauuuccaacagacgguuuuuuugaaguaguaucuuggguccccagacuauuucaauuagccucagucgguucacuuguaacaggaagaacacuaaaacaauaa

SEQ ID NO: 32468 - RNA, 1626 nt, Artificial Sequence
  derived and/or modified sequence opt6 from capsid_protein__Norovirus__ABU55610
augagaaugucagauggugcagcaccaaaagcuaauggaucagaagcuaguggacaagauuuaguaccaacagcaguagaacaagcagucccaauacaaccaguagcaggagcugcauuagcagcaccagcugcaggacaaauaaaccaaauugacccauggauauuucaaaauuucguacaauguccucuuggagaauuuagcguaucaccaagaaacacuccuggcgaaauucuauucgaucuagcacuaggaccaggcuuaaauccuuacuuagcacauuuaucagcaauguauacagguuggguaggaaauauggagguccaauuaguuuuagcaggaaacgcuuuuacagcaggaaaagugguugucgccuuaguaccaccauacuuuccaaaaggaucauuaacuacagcucaaauaacauguuuuccucauguuaugugcgauguucgaacacuagaaccaauucaacuacccuuacucgauguaagaagaguucucuggcaugccacacaagaucaagaagaaucaaugagauuagucugcauguuauauacaccauugagaaccaauucaccuagcgacgaaucauuugucguuucaggaagacuauuaaguaaaccagcagcagauuucaacuuugucuauuuaacuccaccaauagaaagaaccauauacagaaugguagauuuacccguccuacaaccacgucuauguacacaugcuagauggccagcaccaguauauggccuacuaguugauccaucauuaccaagcaauccacaauggcaaaauggcagaguacauguagacggaacacuauuaggaacaacacccauaucaggaucauggguaucaugcuuugcagcagaagcagcauaugaauuucaaucuggaacaggagaaguagcuacauucacauuaguugaacaagauggaucagcauauguuccaggagaucgagcagcaccccucgguuacccagacuucucuggccaacuugaaauagaaguacagacggaaacuaccaaacccggagaaaaacuaaaaguaacaacauuugaaaugauauuaggaccuacaaccaacguagaccaagcuccauacagagguaaagucuuugccucaaucacaacagcagcaucacuaaguuuaguugauggaagaguuagggcuguaccuagaucaauuuauucauuccaagaugucauuccugaauacaaugauggucuauugguaccauuagcuccuccaauuggaccauuuuuaccaggugaaguacuacuaagauuuagaacuuauaugagacaauuagacucagcugaugcugcugcagaagccauagacugugcacuuccacaagaauuuguaucaugguuugcaucaaacgcauuuacgguacaaucagaagcucuacuacuaagauacagaaauacccuaacaggacaacuauuauuugaaugcaaacuauauucugaaggauauaucgccuuaaguuauucuggaucagguccauuaacauuuccaaccgacggauuuuucgaaguaguaucuuggguacccagacuauaucaauuggcaucuguaggaucacucgcaacuggaagaacacuaaagcaauaa

SEQ ID NO: 32469 - RNA, 1626 nt, Artificial Sequence
  derived and/or modified sequence opt6 from capsid_protein__Norovirus__ABU55613
augcgaaugucugauggcgccgcucccaaagccaacggaucugaggcaaguggacaagaucuagucccaacagcuguugaacaagcaguuccaauccaaccaguagccggaucugcucuagcagcaccagcagcaggucaaauaaaucaaauugaucccuggauauuucaaaacuuuguccaaugucccuuaggugaauuuucaaucucucccagaaacacaccaggagaaauauuauuugauuuagcacucggacccggauuaaauccauaucuagcacauuuaucugcuauguauacaggauggguaggcaauauggaaguacaauuaguuuuagcuggaaaugcuuuuacggccggaaaaguuguuguagcccuaguacccccuuacuuccccaaaggaucauuaacaacugcacaaauaacauguuucccucauguuaugugugauguaagaacuuuagaaccaauacaacuaccauuacuagauguaagacgaguucuauggcaugccacacaagaucaagaagaaucaaugcgacuaguuugcauguuauauacaccauuaagaacaaauucucccggagacgaaucauuuguuguaucuggccguuuauuaucuaaaccagcagcagacuuuaauuuuguauaucucacuccaccaauugaaagaacaauauaucgaaugguagauuuaccaguuuuacaaccccgauuauguacucaugccagauggccagcaccuauuuauggacucuuaguagacccaucacuuccuuccaauccacaauggcaaaauggucgaguacauguagacgguacucuacucggcacaacuccaguaaguggaucauggguaucauguuucgcagcagaagcagcauacgaauuccaaucaggcacaggagaaguugcaacuuuuacauuaauugaacaagacggaagcgcuuaugucccaggagauagagcagccccccuaggauauccugacuucaguggucaacucgaaauagaaguccaaacugaaacuacuaaaacaggagauaaacuaaaagucacaacuuucgaaaugauauuaggaccaacaacaaauguagaucaagcuccauaccaagguagaguauaugccucacuaacagcugucgcaucacuagacuuaguagacggacguguacgugccguuccccgcucaauauauggauuccaagauguuauaccagaauauaacgauggauuauuagugccauuagcaccuccuauuggaccuuuucucccaggagaaguacuacuaagauucagaacauauaugagacaguuagauacagcugaugcagcagcagaagcaauagacugugcuuuaccacaagaauucaucucaugguuugcaucaaacgcauuuaccguucaaucagaugcauuacuuuuaagauauagaaauacauuaacaggacaauuacuauuugaauguaaacuauauucugaaggauauauagcacucucauacucuggaucuggaccacuaacauuuccaacagauggauuuuucgaaguuguaucauggguaccuagauuauuucaacuugcaucuguuggcucauuaacuacaggccgaacauuaaaacaauaa

SEQ ID NO: 32470 - RNA, 1626 nt, Artificial Sequence
  derived and/or modified sequence opt6 from capsid_protein__Norovirus__ABU55616
augcgaaugucagauggagcagcaccaaaagcuaacggaucagaagcaucaggacaagauuuaguaccaacagcaauagaacaagcaguaccuauccaaccaguagccggcucagcacucgcugcaccagcagcaggacaaauuaaucaaaucgacccauggauauuucaaaauuuuguacaaugcccucucggagaauuuucuauaagucccagaaauaccccaggagaaauacucuuugauuuagcacuugguccaggauuaaacccauaccuugcacauuuaucugcaauguauacaggauggguagguaacauggaaguccaauuaguauuagcagguaaugcuuuuacugcaggaaaaguaguaguagcacuuguaccaccauauuucccaaaaggaucuuuaacaaccgcacaaauuaccuguuuuccucacguaaugugugaugucagaacauuagaaccaauacaauuacccuuauuagauguaagacgagucuuauggcacgcaacucaagaucaagaagaaucaaugagauuaguuuguauguuauacacuccacuacgaacaaacucacccggagaugaaucauuuguuguaucaggaagauuacuaucuaaaccagcagcugauuucaauuucguuuaccuaacaccaccaauagagcguacaauuuaucgaaugguagauuuacccguauuacaaccucguuuaugcacacaugccagguggccagcaccaauauauggacuacuaguagacccauccuuaccaucaaauccacaauggcaaaauggaagaguacacguagacgguacacuacuaggaacuacaccaguaucaggaucuuggguaucauguuuugccgcagaagcagcauaugaauuucaauccggaacaggagaaguagcuacauuuacauuaauagaacaagacgguucagcauauguaccuggcgaccgagcagcgccauuaggauauccagauuuuucaggacaacuagaaauagaaguacaaacagaaaccacuaaaacuggagacaaauuaaaagucacaacauucgaaaugauuuuaggaccuacaacaaacguagaucaagcaccauaucaagguaaaguauacgcuaguuuagcuguagcagcaucccuagauuuaguagacggacgaguaagagcagucccacgaucgauauauggauuucaagauguaauaccagaauauaaugacgguuuacuaguaccacuugcuccaccaauaggacccuuucuuccaggagaaauauuacuaagauuucgcacauauaugagacaauuagauaccgcagaugcugcugcagaagcaauagauugugcacucccccaagaauuuaucucaugguuugcaucaaaugcuuuuacaguucaagcagacgcuuuacuacuaagauaucgaaauacauuaaccggacaacuacuauuugaauguaaauuauauucagaaggauauauagccuuaucuuacagugguucagccccacuuacuuucccaacagauggauucuuugaaguaguaagcuggguuccacgcuuauuucaauuagcaucuguaggaucccuaaccacaggacgcacucuaaaacaauaa

SEQ ID NO: 32471 - RNA, 1626 nt, Artificial Sequence
  derived and/or modified sequence opt6 from capsid_protein__Norovirus__ABU55619
augagaaugucagauggugcagcaccaaaagcaaauggaucagaagcaucuggacaagaccuaguaccaaccgcagucgaacaagcaguuccgauucaacccguugcgggaucagccuuagcggcuccugcugcuggucaaauuaaucaaauagauccauggauuuuucaaaacuucguacaaugucccuuaggagaauuuucaauuucaccacgaaauacaccaggagaaauacuauucgaucuagcucuagguccgggacuaaauccauaucuagcucauuuaucagcuauguauacaggaugggucgguaauauggaaguacaacuaguauuagcagguaaugcauuuacugcugguaaaguaguuguugcucuaguaccuccauauuuuccuaaagguucucuaaccacagcacaaauaacauguuucccacacguaaugugcgauguaagaacuuuagaacccauacaacucccauuauuagauguaagacgaguauuauggcaugcuacacaagaccaagaagaaucaaugagauuaguuuguaugcucuauacaccucuaagaacaaauucaccaggagacgaaaguuuuguaguaucaggaagauuauuaaguaaaccugcagcugauuucaacuuuguuuaccucacaccaccuauagaaagaacaauuuauagaaugguagaucuaccaguacuacaaccaagacucuguacacacgcuagauggccagcaccuauauauggauuauuagucgauccaucuuuaccaucaaauccccaauggcaaaauggaagaguacauguugacggaacucuucuggguacaacuccuguaucuggaucauggguaucauguuuugcagcugaagcagccuacgaauuccaaucugggacuggucaaguugcaacauuuacucuaauagaacaagauggaagugcauauguaccaggagauagagcagcuccuuuaggauauccagacuucucuggccaacuugaaauugaaguacaaacagaaacaacaaaagccggagacaaacuaaaaguaacaaccuuugaaaugauucuagguccuacaacaaauguagaucaagcaccauaucaaggaagaguauaugcgucacuagcaguagcagcaucauuagaccucguagacggaagaguuagagcuguuccaagaaguauccacggauuucaagacguuauaccugaauacaaugauggauuauuaguaccauuagcacccccuauuggaccauuuuuaccaggagaaguucuauuacgauuuagaacauacaugcgccaacuugacaccgcggaugcugcugcagaagcaauagauugugcacuaccgcaagaauuuauaucaugguucgcaucaaacgccuucacaguacaaucugaugcucuauuacucagauacagaaauacauuaacaggucaauuacuauuugaauguaaauuauacucagaaggauauauagcauuaucauauucagguucugguccacucaccuuuccaacagaugguuucuucgaaguaguuucauggguaccacgauuauuucaauuagcaucaguaggcaguuuagccacaggaagaacuuuaaaacaauaa

SEQ ID NO: 32472 - RNA, 1626 nt, Artificial Sequence
  derived and/or modified sequence opt6 from capsid_protein__Norovirus__ABU55622
augcgaaugucagauggagcaacaccaaaagcaaauggaucggaagcaaguggacaagaccuugucccaacagcuguugaacaagccguaccaauacagccuguagcaggagcagcacucgcagcaccagccgcaggacaaauaaaucaaauagacccuuggauauuucagaacuuuguccaauguccacuuggagaauuuucuauuucaccaagaaacacacccggcgaaauacucuuugaccuggcacuagguccaggccuaaacccauaucuagcucaucucucagcaauguauacugguuggguaggaaauauggaaguccaauuaguuuuagcaggaaaugcauuuacagcaggaaaaguaguaguugcucuaguaccucccuacuuuccaaaagggucacuuaccacugcacaaauaacaugcuucccucacguaaugugugacguaagaacauuagaaccaauucaauuaccauuauuagacguaagaagaguauuauggcacgcaacacaagaucaagaagaaucaaugagauuaguaugcauguuauauacuccauuacgcacaaauucaccaggagaugaaaguuuuguaguaucuggcagauuauuaucuaaaccugcagcugacuuuaacuucguauauuuaacccccccaauagaaagaacuauauauagaaugguugaucuaccaguuauacaaccaagauuauguacacaugcaagauggccagcaccuguauauggacuauuaguagacccauccuuaccuuccaacccacaauggcaaaacggaagaguacaugucgacggaacauugcuaggaacaacuccaauaucagguucauggguaucauguuuugcagccgaagcugcuuaugaauuucaaucuggaaccggagaaguagcaaccuucacucuuaucgaacaagauggaucggcauauguuccaggugaucgcgcagcuccucucggauacccagauuuuucaggacaacuugaaauugaaguacaaacagaaacuacaaaaacaggugauaaauuaaaaguaacaaccuuugaaaugauauuaggaccuacaacaaauguugaucaagcuccauaccaagguagaguauuugccucaguuacugcagcugcaucauuagaucuagucgauggaagaguaagagcaguaccucgaucuauauauggauuccaagauacuauaccugaauauaaugauggauuauuaguaccacuagcaccaccuauaggaccauuuuuaccuggagaaguacuccuaagauuuagaaccuauaugagacaauuagauacugcugacgcagcagccgaggcuauagacugugcacucccacaagaauuuguaucuugguucgcaaguaaugcauuuacaguccaaagugaagcacucuuauuaagauaucgaaauacacuaacuggacaauuacuauuugaauguaaacuuuauucagaagguuauauagcacuaucauacagcggaucaggaucccuaacuuuuccaaccgauggauucuuugaaguuguaucauggguaccccgauuauaccagcuugccucaguaggauccuuagcuacuggaagaacauugaaacaauaa

SEQ ID NO: 32473 - RNA, 1623 nt, Artificial Sequence
  derived and/or modified sequence opt6 from capsid_protein__Norovirus__ABU55628
augagaaugucagauggagcaguaccuaaagcaaauggaagugaagcuucaggacaagacuuaguacccacagcaguagaacaagcaguaccaauucaaccaguugcaggagcuucaauagcagcuccagcagcaggacaaauuaaucaaauagacccauggauauuucaaaacuuuguacaaugucccuuaggagaauuuaguauaucacccagaaauacaccaggagaaauuuuauuugaucuggcauuagggccaggacuaaauccauaucuagcccaucuuucagcuauguauaccggauggguaggcaacauggaaguucaacuaguacuugccggaaaugcuuuuacagcuggaaaaguaguaguugcacugguaccaccauauuucccuaaaggcucucuaaccacugcacaaauuacaugcuuuccacauguuaugugugaugucagaacauuagaacccauccaacuaccuuuauuagacgucagaagaguuuuauggcaugcaacacaagaucaagaagaaucaaugcgucuuguaugcaugcuuuauacccccuugcguacaaacucaccaggagaugaaucguucguaguaucaggaagacuucuuucuaaaccugcagcugauuuuaacuuuguauacuuaaccccaccuauagaacgaacaauuuaucgaauggucgaucuuccaguacuacaaccucgacuaugcacacacgcaagauggccugcaccaauauauggacucuuaguagauccaucauuacccucaaacccacaauggcaaaacggaagaguucauguagauggaacuuuacuagguacuacaccaguaucaggaucauggguaaguuguuuugcagcagaagccgcauaugaauuucagucaggaacaggagaagucgcaacauuuacccucauugaacaagauggaucagcauacguaccaggagauagagcagcuccucuagguuauccugauuucucaggacaacuagaaauagaaguucaaacagaaacaacaaaaacaggagaaaaacuaaaagucacaacuuuugaaaugauccucggacccgcaaccaaugucgaucaagccccauuccaaggaagaguauaugcaagucuaaccgcaguugccucacuugaccuagucgaugggagaguuagagcuguaccaagaagcauauacgcauuucaagauguaauaccugaauauaaugauggauuacuuguaccacuagcuccacccauaggacccuuuuuacccggagaacuauuacuaagauuuagaacuuauaugagacagauugacucaucagaugcggcagccgaagcaauagacugugcacuaccacaagaauuuauaucaugguuugcaucuaacgccuuuacuguacaaucugaagcauuacuauuaagauaccgaaauacacuuacaggacaauuauuauuugaauguaaacuuuauucagaaggauauauagcucuuaguuauucuggaagugguccauuaacuuuuccagcugauggauuuuucgaaguugucucauggguaccaagauuauuucaauuagcaucaguaggaucaucagcaaccggaagaacacuaaaauaa

SEQ ID NO: 32474 - RNA, 1593 nt, Artificial Sequence
  derived and/or modified sequence opt6 from capsid_protein__Norovirus__ABW74121
augaugauggcaucaaaagacgcaacaucauccguagacggagcaucaggcgcaggacaauuaguaccugaaguaaacgcuuccgacccacucgcaauggauccaguagcagguucuucaacagcaguagcaacagcuggacaaguuaaucccauagauccauggauaauaaauaacuuuguacaagcaccacaaggagaauuuacaauuucuccaaauaauacucccggagacguccuauucgauuuaucauuaggaccacaucuaaauccauuucuuuuacacuuaucacaaauguacaacgguuggguuggaaauaugcgcguuagaauaaugcuagcagguaaugcuuuuacagccgguaaaauaauagucucauguauucccccaggauuugguucucacaaucuaacaauagcacaagcuacauuauucccacauguaaucgcugauguacgcacacuugauccuauugaaguaccuuuagaagauguacgcaacguucuauuccauaacaaugauagaaaucaacaaacaaugagacucguauguaugcuauauacuccauuacgaacaggaucuggaacaggagauucuuuuguaguagcaggacgagucaugacuugcccuucuccagauuuuaacuuccuuuuuuuaguuccaccaacuguagaacaaaaaacuagaccauuuacacuaccuaacuuaccacuaucaucuuuaucaaauucccgagcaccacuaccuaucuccggaauggguauuuccccugauaacguacaaucaguacaauuccagaauggaagauguacacuagacggacgacuaguaggaacaacuccuguaucucucucccaugucgcaaaaauacgaggaacaucuaacggcacaguuauaaaucuuacagaauuagacggaaccccauuucauccuuuugaaggaccagcacccauuggauuuccugaucuaggagguugugacuggcacauaaacaugacacaauuuggacauucaagucaaacccaauaugauguagauacuacaccagauacauucguaccucacuuagguuccauacaagcaaacggaauuaacuccggaaauuauauaggaguauuaucuuggguaaguccacccucccacccaucuggcucacaaguagauuuauggaaaauaccaaauuauggauccucuauaacagaagcaacucaucuagcaccaucaguauuccccccaggauuuggugaaguacuaguuuuuuucaugucaaaaauucccggaccaggagccuacucacuaccaugucuacuaccacaagaauacauaucucacuuagcaucagaacaagcuccaacaguaggagaagccgcauuauuacauuacguugacccagauacugguagaaacuuaggagaguucaaagccuacccagaugguuuucucacuugcguuccaaauggagcaucaucagguccucaacaacucccaauaaacggaguauucguauuuguaaguugggucucaagauucuaucaauuaaaaccaguaggaacugcaucuacagcaagaggaagauuagguuuacgcagauaa

SEQ ID NO: 32475 - RNA, 1593 nt, Artificial Sequence
  derived and/or modified sequence opt6 from capsid_protein__Norovirus__ABW74123
augaugauggccucaaaagacgcuacaucaucaguagacggagcaucaggagcuggucaacuaguuccagaagucaaugcaucagacccuuuagccauggauccaguugcagguucaucaacagcaguagcaacagcaggccaaguaaacccaauagauccauggauaauaaauaacuuuguacaagcaccacaaggagaauuuacaauaucuccaaacaauacaccuggagauguacuauucgauuuaucauuaggaccucaucuaaacccuuuccuauuacaucuaucacaaauguacaacgguuggguaggaaauaugagaguuagaauaaugcucgcuggaaaugcauucacugcuggaaaaauaauaguaucauguauuccuccuggauucggcucacacaaucuaacuauugcccaagcaacauuauuuccacaugucauagcagauguuagaacauuagauccaaucgaaguaccacuagaagacguaagaaacguauuauuucauaauaacgaccgaaaccaacaaacaaugagacuaguauguauguuauauacacccuuaagaacaggaggugguacuggcgacucauucguaguagcaggaagaguaaugacauguccaucucccgacuucaacuuccucuuuuuagucccaccaacaguagaacaaaaaacucgaccauucacacuuccaaauuuaccauuaagcucucuaucaaauucacgagcaccacuaccaaucucuggaaugggcaucucaccugacaaugugcaaucaguccaauuucaaaauggaagauguacauuagacggaagauuaguaggaacaacccccguuagccuuucucauguagcaaaaauacgaggaacaagcaacggaacaguaauuaauuuaaccgaauuagacgguacaccauuucauccauuugaaggaccagcuccaaucggauuuccagaucucggaggaugugauuggcacauaaacaugacacaauuuggccacucaucucaaacacaauacgacguagauacaacacccgauacauucguuccacauuuaggaucaauacaagcaaauggaauuaacucuggaaacuauauuggaguacuuucauggguuucuccacccucucacccaagcggaucacaaguugaccuauggaaaauuccuaauuacggaucaucuaucacugaagcaacucauuuagccccaaguguauuuccaccaggauucggagaaguacuaguuuuuuucaugaguaaaauaccaggaccaggagcauauucauuaccaugccuccuaccucaagaguauauuucccaccuugcuucagaacaagcuccaacaguaggagaagcagcacuacuucauuauguagacccagauacaggaagaaauuuaggugaauucaaagcuuacccagauggauuucuaacaugcguaccaaauggcgcuaguuccgguccacaacaacucccaauaaauggaguuuuuguauucguaucauggguaucucgauuuuaccaacuuaaaccaguugguacagccucuacagcaagagguagacuaggucuucguagauaa

SEQ ID NO: 32476 - RNA, 1593 nt, Artificial Sequence
  derived and/or modified sequence opt6 from capsid_protein__Norovirus__ABW74124
augaugauggcaucaaaagaugcaacaucaucaguagacggugcaucuggagcaggacaacucgucccagaaguaaaugccucugacccccuagcaauggaucccguagcaggcaguucuaccgcaguagcaacugcuggacaaguaaacccaauagacccauggauaauaaauaacuuuguacaagcaccccaaggagaauuuaccauaucaccaaauaauacuccaggagauguauuauuugauuuaucacuaggaccacauuuaaacccauuucuacuacacuuaucacaaauguauaacggcuggguaggcaauaugagaguaagaauaaugcuagcaggaaaugcauuuacugcuggaaaaaucauagucuccugcauuccaccuggcuuuggaucacacaaucuaacaaucgcucaggcaacuuuauucccacauguaauagcugacgucagaacacuugaucccauagaaguaccacucgaagauguacgaaauguauuauuucauaauaacgaucgaaaucaacaaacuaugagauuagucugcauguuauauacuccacuaagaacuggcggaggaacaggagacucauucguaguagcagguagaguaaugacaugcccaucaccagacuucaauuuucuauuucucguaccuccaacuguagaacaaaaaacaagaccuuuuacucuaccaaaccuuccuuuaucaucccuaucaaauucacgagcaccauuaccaauuucaggaauggguauaaguccagauaacguucaaucgguccaauuucaaaauggacguuguacucuagacgguagauugguaggaaccacaccaguaucauuaagccauguugccaaaauaagaggaacuucaaacggaacuguuauaaauuuaacagaauuagacggcacaccuuuccacccauuugaaggacccgcaccaauaggauucccagaccuagguggaugugacuggcacauuaacaugacacaauuuggacacucaucacaaacacaauacgauguagacacaacuccagauacauuuguuccucacuuaggaucaauacaagcaaauggaauuaacucgggaaauuauauaggaguauuaucauggguuagucccccaucacacccuaguggcucucaaguugaucuauggaaaaucccuaauuauggaucuuccauuacagaagcaacccauuuagcaccaucuguuuuuccuccagguuucggagaaguacuaguauucuucaugucaaaaaucccaggcccaggagcauacucuuuaccuuguuuacuaccacaagaauauaucucucaucuagcauccgaacaagcaccaacaguaggcgaagcagcauuauuacauuauguagacccagacacaggcagaaauuuaggcgaauucaaagcauauccagauggauucuuaaccugcguaccaaauggcgcuucuucaggcccacaacaacuaccuaucaauggaguauucguauucguaucauggguaucaagauuuuaucagcugaaacccguaggaacagcaucaaccgcaagaggacgacuaggucuaagacgauaa

SEQ ID NO: 32477 - RNA, 1593 nt, Artificial Sequence
  derived and/or modified sequence opt6 from capsid_protein__Norovirus__ABW74125
augaugauggcaucuaaagacgcaacaucauccgucgauggugcuucaggagcaggacaauuagucccagaaguaaacgcaucugauccacuagcaauggauccaguugcaggaucauccacagcaguagcuacugcaggacaaguuaauccuauagacccauggauaauuaauaauuucguacaagccccacaaggagaauuuacaaucucuccuaauaauacuccaggagauguauuauuugacuuaucacuuggaccacauuuaaauccauuucuacuccaucuaucucaaauguauaacgguugggucggaaauaugcgaguaagaauaaugcuagcugguaacgcauuuacagcaggaaaaaucauaguaucauguauaccuccagguuuugguucacacaauuuaacaauagcucaagcaacauuauucccucaugucauagcagacgucagaacauuagauccuauagaaguaccacuagaagauguaagaaauguacuauuucauaauaaugaccgaaaccaacaaacaaugcgauuaguuuguauguuauacacacccuuaagaacagguggaggaacuggcgauucauucguaguagcuggccgcguaaugacaugccccuccccagacuuuaauuuuuuauucuuaguucccccuaccguagaacaaaaaaccagaccauucacgcuaccuaaucuaccauuauccucccuuucaaauucaagagcgccauuaccuauaucaggaaugggcaucucaccugauaauguacaauccguucaauuccaaaacggacgauguacauuagauggacgacuagucggaacuacuccuguuucacuaagucauguagccaaaauacgaggaacaucaaacggaacaguaauaaauuuaacagaauuagacggaacaccauuucauccauuugaaggaccagcaccuauuggauuuccugaucucggcggcugugacuggcauauaaauaugacccaauucggacacucuucacaaacacaauacgaugucgauacuacacccgacacauuuguaccacauuuaggaucaauacaagcaaauggcauaaauucagguaauuacauagguguacuaucauggguaucaccucccucacauccauccggaucucaaguugaccuauggaaaauaccaaauuauggcagcaguauaacagaagcaacacacuuagcaccaaguguauucccaccaggauuuggagaaguauuaguauuuuuuauguccaaaauuccagguccaggugcauauucucuaccaugccuuuuaccacaagaauacauaucacauuuagcaucagaacaagcacccacaguuggcgaagcagcuuuauuacauuaugucgaucccgauacaggacgaaacuuaggagaauucaaagcauauccagauggcuuucuaacauguguuccaaauggagcauccucagguccacaacaauuacccauaaaugguguauuuguuuucgugucuuggguaucuagauuuuaccaacuaaaaccaguagguacugcauccaccgcuagaggacgacuagguuuaagaagauaa

SEQ ID NO: 32478 - RNA, 1593 nt, Artificial Sequence
  derived and/or modified sequence opt6 from capsid_protein__Norovirus__ABW74126
augaugauggcauccaaagaugcaaccucaagcguugauggugcaucuggugcaggucaauuaguaccagaagucaacgcaucugacccacuugcaauggauccaguagccggaucaucaacugcaguagcaaccgcaggacaaguuaauccaaucgauccuuggaucaucaacaauuuuguccaagcaccccaaggagaauuuacaauuaguccaaauaauacacccggagacguucuuuucgaccuaucauuaggaccccaucuaaaccccuuucuauuacacuugucccaaauguauaauggauggguuggcaacaugcguguaagaauaauguuagcugguaaugcauuuacagcaggaaaaauaauaguaucuuguauacccccagguuuuggaucucacaacuuaacaauagcacaagcuacucuauuuccacacgucauagcugacguuagaacauuagauccaauagaaguaccucuagaagacguucgaaauguacuuuuucacaacaacgacagaaaucaacaaacaaugcgcuuaguaugcaugcuauacacaccccuacgaacuggaggagguacaggagauuccuucguuguagcuggcagaguaaugacuugcccuucaccagacuucaauuuuuuauuucuaguaccaccaacaguagaacaaaaaacacgaccauucacuuuacccaaucuaccauuaucuucacuaucaaacucaagagcaccuuuaccaauaucagguaugggaauaucaccugauaauguccaaaguguacaauuucaaaacggaagauguacauuagauggacguuuaguuggaacaacaccaguaucucuuucacacguugcaaaaauaagaggaacaucaaauggaacaguaauaaaucuuacagaauuagauggaacaccuuuucauccauucgaaggaccagcaccaauaggcuuuccagaccucgguggaugugacuggcacauaaacaugacacaauucggacauucuucccaaacacaauaugauguagacacaacaccagauacauuuguaccacaucuaggaucaauacaagcaaauggaauaaauucaggaaacuauauaggcguuuuaucauggguaucuccucccucacacccuucagguucucaaguagauuuauggaaaauaccaaauuauggaucaucaauaacagaagcaacccaucucgcuccaucaguauucccuccaggauuuggcgaaguucucgucuuuuuuaugucuaaaauaccaggaccaggagcauauucacuaccaugucugcuaccacaagaauacauaucccauuuagcaagcgaacaagcucccacuguuggugaagcagcauuauuacauuacguugauccagacacaggaagaaaucuaggagaauucaaagccuacccagauggcuuuuuaacuugcguaccuaauggcgcaucaucuggaccacaacaauuaccuauaaauggaguauucguauuuguaucauggguaucaagauuuuaccaacuaaaacccguugguacagcauccaccgcaagaggccgauuaggauuaagacgguaa

SEQ ID NO: 32479 - RNA, 1593 nt, Artificial Sequence
  derived and/or modified sequence opt6 from capsid_protein__Norovirus__ABW74127
augaugauggccucuaaagaugcaacaucaucaguugacggcgcuuccggagcuggacaauuaguuccagaaguuaaugcaucagacccauuagcaauggauccaguugcagguuccucaaccgcaguagcaacagccggacaaguaaauccaauagauccauggaucauaaauaauuuuguacaagcaccacagggugaauuuacaauaucaccaaauaauaccccuggagauguauuauucgaucuaucacuaggaccacaccuaaaccccuuuuuauuacacuuaagucaaauguauaacgguuggguagggaacaugagaguacgaauaauguuagcagguaaugcauuuacagcaggaaaaauaauaguauccugcauaccaccuggauucggaucacacaaccuuacaauagcacaagcuacauuauucccacacguaauugccgacguaagaacacuagauccaauagaaguaccucuagaagauguaagaaacguacucuuucauaauaacgacagaaaucaacaaacaaugcgauuaguuuguauguuauauacuccacuuagaacaggugguggaacaggagauuccuuuguaguugcaggaagaguuaugacaugcccaucuccagauuucaauuuucucuuucuaguuccacccacaguagaacaaaaaacaagaccauuuacauuaccaaaucuaccuuuaucaucacuaucaaacucaagagcaccauuacccaucucagguaugggaauaucaccugacaauguucaaucaguacaauuucaaaacgguagauguacauuagacgguagauuagucggaacaacaccaguuucacuaucacauguagcuaaaauacguggaacuucaaacggaacaguaauaaacuuaacagaauuagaugguacaccauuucauccauuugaaggaccagcuccaauaggauuuccagaucuaggaggaugugacuggcauauaaauaugacacaauucggacauucaucacaaacacaauaugacguagauacuacuccagauacauuuguuccacauuugggaucuauucaagcaaaugguauaaauucagguaauuauauagguguauuaucuugggucucaccaccaucacacccaaguggaucacaaguagaucuauggaaaaucccuaauuacggauccucaauaacugaagcaacacaucuugcuccuuccguauucccuccuggauuuggagaaguucuuguauuuuucaugucaaaaauaccaggcccuggugcuuacucccuaccauguuuacucccgcaagaauauauuucacacuuagcaucugaacaagcaccaacaguaggagaagcugcacuucuacauuacguagauccugauacaggccgaaauuuaggagaauuuaaagcauauccugacggauuucuaacaugcguaccaaauggagcuucaucugguccacaacaacucccaauuaauggaguauucguauucguaaguuggguaucaagauuuuaccaacuuaaaccaguagguacugcaucuacugcucgcggacgucucggauuaagaagauga

SEQ ID NO: 32480 - RNA, 1593 nt, Artificial Sequence
  derived and/or modified sequence opt6 from capsid_protein__Norovirus__ABW74128
augaugauggcaucaaaagacgcaacaucaucugucgacggagccucuggugccggacaguuaguuccagaagucaaugccuccgauccuuuagcuauggacccaguugcaggaucuucaacagcggucgcaacagcaggacaagucaauccaauagacccauggauaauaaacaacuuuguacaagcaccucaaggagaauuuacaauaaguccaaauaauacuccuggcgauguauuauucgaccuaucuuuaggaccacaucuaaaucccuucuuauuacaccucucacaaauguauaacggauggguaggaaauaugagaguaagaauaaugcuagcuggcaacgccuuuacagcuggaaaaaucauagucucaugcauuccaccaggauuuggaucacacaaucuaaccauagcccaagcaacauuauuuccacacguaaucgcagauguacgaacacuugauccaauugaaguuccauuagaagacguaagaaauguauuauuucacaauaacgauagaaaucaacaaacaaugagacuuguauguauguuauauaccccacugcgaacaggaggcggcacaggagacucauuugucguagcaggaagaguuaugacuugcccaucaccugauuuuaacuuuuuauuucuaguaccaccaacuguagaacaaaaaacucgucccuucacauuaccuaacuuaccauuaucuucucuaucaaacucaagagcuccacucccaauaucaggaaugggaauuuccccagacaauguacaaucaguacaauuucaaaacgguagaugcacauuagaugguagauuaguaggaaccacuccaguaagccuaagccaugucgcaaaaauaagaggaacaucaaacggaacaguaauaaaucuuacagaauuagacgguacaccauuccauccauucgaaggcccagcacccauaggcuuuccagaucuuggaggaugugauuggcauauaaacaugacacaauucggucauuccucacaaacacaauaugauguagauacaacaccagacaccuuuguaccacaccuaggaucuauacaagcaaauggaauaaauucaggaaauuacauaggaguacuaucauggguaagcccuccaucacacccuucagggucacaagucgaucuauggaaaauaccuaauuauggaucaucaaucacagaagcaacccacuuagcaccaucaguauucccaccaggauuuggagaaguauuggucuuuuucaugucaaaaauaccgggaccaggugcauacucauuaccuugcuuacuaccucaagaauacauaucacaccuugcaucagaacaagcacccacaguaggagaagcugcauuacuacauuacguagauccagacacaggacgaaacuuaggugaauucaaagcauacccagauggcuuuuuaacaugcguuccuaauggugcaaguucuggaccacaacaacuaccaauaaauggaguauuuguuuucguaagcugggucuccagauuuuaucaacuaaaacccguaggaacagcaucaacagcuagaggaagauuaggucuaagaagauga

SEQ ID NO: 32481 - RNA, 1620 nt, Artificial Sequence
  derived and/or modified sequence opt6 from capsid_protein__Norovirus__ABW74532
augaaaauggcuucaucagacgcaaacccauccgauggaucagcagcuaacuuaguaccugaaguaaacaacgagguuauggcauuagaaccaguaguaggagcagcaauugcugcaccuguagcaggacaacaaaauauaauagacccauggauaagaaauaauuuuguccaagccccaggaggagaauucaccguuagcccacgcaaugcuccaggagaaauacuauggucagccccacuaggcccagacuuaaauccauacuuaucucaucuuuccagaauguacaauggauacgcagguggauucgaaguacaaguaauacuagcaggaaacgccuucacagccggcaaaaucauauuugcugccguaccuccaaauuucccaacagaaggacuauccccaucacaaguaacuauguucccccacguaauaguagacguacgacaauuagaaccaguuuuaauaccauuaccagacguaagaaacaauuucuaccacuacaaccaagcccaugauccaacaauaaaacucauagcaauguuauacacaccauuaagagcaaauaaugcaggugaugauguuuuuaccguaagcugccgaguacucacaagaccuuccccagauuuugacuuuauauuucuaguaccaccaacaguagaauccagaacuaaaccauucacagucccaauacucacaguagaagaaaugucuaacucaagauuuccaauaccacucgaaaaacucuauacaggaccaucuucagauuucguaguccaaccacaaaacggaagauguacaacagauggaguacucuuaggaacaacccaacuaagcgcaguaaacauauguaacuuuaaaggagacgucacccauauagcaggcucacgagauuauagaaugaaucuaguuucacaaaacuggaauaauuacgauccaacagaagaaauccccgccccucuagguacaccagacuuucaaggaaaaauucaagguuuauuaacccaaacaacaggagccgauggauccacaagggcacauaaagcaacaguaucaacaggagcugcuaauuuuacaccaaaacuuggaucaguacaauuuacaacagacacagauaacgauuuccagacaggacaaaauaccaaauucaccccaguaggaguuauacaagacggaucacaucaucaaaacgaaccccaacaauggguacuaccuaauuacagcggaagaacaguucauaauguucaucuagcaccagcaguagcaccaacauuucccggugaacaauuacuauucuuucgauccacuaugccaggauguucaggauauccaaauaugaaccuagauuguuuauuaccacaagaaugggucaugcauuuuuaucaagaagccgcaccugcacaaucagaugucgcacuauuaagauucgucaauccagacacaggaagaguccuauuugaauguaaauuacacaaagcuggauacaucacaguugcucauacuggacaacacgaccuaguaauaccaccuaacgguuauuuucgauuugacucuugggucaaccaauuuuacacacuagcaccaaugggaaauggugcuggaagacgaagagcacuauaa

SEQ ID NO: 32482 - RNA, 1620 nt, Artificial Sequence
  derived and/or modified sequence opt6 from capsid_protein__Norovirus__ABW74533
augaaaauggcaucuaacgaugcaaauccaucagauggaucuacagcuaaucuuguaccugaaguaaacaaugaaguaauggcauuagaacccguaguuggagcugcaauagcugcaccaguagcuggacaacaaaacguuauagauccuuggauacgaaauaacuuuguacaagcaccaggaggcgaauucacaguaucaccacgcaacgccccaggagaaauccucuggucagcaccauuagggccagacuuaaaccccuauuuaagucaccuugcaagaauguauaacggauacgcuggcggauucgaaguacaaguaauccuugcagguaacgcuuuuacagcuggcaaaauaauauuugcugcaguaccccccaacuuuccaacugaaggauuaucuccaucucaaguaacaauguucccacacauaauaguugauguaagacaauuagaacccguauuaauacccuuaccagauguaagaaacaacuuuuaccauuauaaccaaucaaacgauucaacuauaaaauuaauagcaauguuauauacuccauuaagagcaaacaacgcuggagacgacguauuuaccguaucaugucgugucuuaacacgacccaguccugacuuugauuuuauauuucuaguaccaccuacaguagaaucaagaacuaaaccauuuacuguaccaauacucacaguagaagaaaugucaaacucaagauuuccaauaccauuagagaaauuauauacuggaccaucaucagcauucguaguccaaccacaaaacggacgauguaccacagaugguguacuuuuaggaaccacccaauuaucagcaguuaauauaugcacauuuagaggagauguaacccacaucgcugguucccaugauuauacuaugaaucuagcaagccaaaacuggaacaacuacgacccgacagaagaaauaccugcaccacuaggcacaccugauuuuguaggaaaaauacaagguaugcuaacccaaaccacaagaggagauggcucaacacgagcacacaaagcaacaguaagcaccgguucaguacacuuuacaccaaaauuaggaucaguccaauucacaaccgauacaaacaacgauuuucaaacaggacaaaauacuaaauucacaccuguaggaguaauacaagauggagacaaccaucaaaaugaaccacaacaaugggucuuaccaaacuauuccggcagaacagggcacaacguacauuuagcaccagcaguagccccaacauuuccaggagaacaacuauuauucuuccgcuccacaaugccuggauguucaggauaccccaacaugaaccuagacuguuuacuaccacaagaauggguacaacauuuuuaucaagaagcagcaccagcacaaucagauguagcgcuauuaagauucguaaauccagauacagggagaguauuauuugaauguaaacuacauaaaagcggauacguaacagucgcccauacaggcccacaugauuuaguaauaccaccaaauggauauuucagauucgauucauggguuaaucaauuuuauacauuagcuccuaugggaaacgguacaggacgaagaagagcacuauaa

SEQ ID NO: 32483 - RNA, 1623 nt, Artificial Sequence
  derived and/or modified sequence opt6 from capsid_protein__Norovirus__ABW74534
augaaaauggcauccaaugaugcaucucccucagacggaucaacagcuaauuuagucccagaaguuaacaaugaaguaauggcacuagaacccguaguaggagcagcgaucgcagcacccguagcuggucaacaaaauguaauugauccauggauucgaaacaauuuuguacaagcccccggaggagaauuuaccguuucaccacgaaaugcuccaggcgaaauccuuuggagcgcaccauuaggaccagacuuaaacccauauuuaucacacuuagcacggauguauaacggauacgcaggaggcuucgaaguacaaguaauuuuagcuggaaaugcauuuacagcugguaaaauuauauucgcagcagucccuccaaacuucccaacugaaggacuaucaccuucucaaguuacaauguucccacacauaauaguagacguaagacaauuagaaccaguauuaauucccuuaccugauguaagaaauaauuuuuaucauuauaaccaauccaaugacccuacaauaaaacuaauagcaaugcuauacacaccauuacgagcaaacaaugcaggagacgauguuuucacaguaagcuguagaguacuuacaagaccuucaccagacuuugauuuuauauuucuaguuccaccuacaguugaaucacgcacaagaccauucacaguaccaauacuaacuguugaagaaaugacaaauucacgauuuccaauacccuuagaaaaacuauuuacaggcccaucuggagcuuucguuguucaaccccaaaauggacgauguacaacugacgguguucuacuaggaacaacacaacuaucaccuguuaauauaugcaccuuucguggagacguuacacacauagcaggaacacaugauuauacaaugaauuuagcaucucaaaauuggaacaauuacgauccuaccgaagaaauaccagcaccauuaggaacaccagacuuuguaggaaaaauacaaggaguacuaucccaaaccacacguggagacggcucaacuagaggucacaaggccacgguaucaacagguaguguacacuuuacaccaaaauuaggaucaguacaauuuaccacagauaccaauaacgacuuagaaacaggacaaaauacaaaauuuaccccaguaggagucguacaagauggaaauucaacccaccaaaaugaaccacaacaauggguacucccaaauuauucaggucgcacaggacacaauguccaucucgcaccugcaguagcaccaacuuuuccaggagaacaacuucuauucuucagaucaacaaugcccggcugcucaggauauccuaauaugaaucuugauugcuuauuaccucaagaauggguucaacacuuuuaucaagaagcagcuccagcacaauccgacguagcauuacucagauuuguuaauccagauacaggaagaguuuuauuugaaugcaaauuacauaaaucaggcuauguuaccguagcacauaccggacaacaugaccuaguuauaccaccaaacgguuauuuucgauuugauuccuggguaaaucaauucuauacacuagcaccaaugggaaauggagcuggacgacgacgagccuuauaa

SEQ ID NO: 32484 - RNA, 1623 nt, Artificial Sequence
  derived and/or modified sequence opt6 from capsid_protein__Norovirus__ABW74535
augaaaauggcuucaaaugacgcaaacccauccgacggaucaacagccaauuuaguuccagaaguaaacaacgaaguaauggcauuagaaccaguaguuggagccgcaauagcagccccaguagcaggacaacaaaauguaauugaucccuggauaagaaacaauuucguacaagcaccaggaggcgaauucacaguaaguccuagaaacgcaccaggagaaauauuaugguccgcaccacuagguccagaucuuaacccauauuuaagccacuuagcucguauguacaauggauaugccggagguuucgaaguacaaguaauuuuagcaggaaaugcauucaccgcaggaaaaauaaucuucgcagcaguuccaccaaauuucccaacugaaggacuaagucccucacaaguaacaauguuuccacauauaauaguugacguaagacaacuagaaccaguacuaauaccacuucccgauguacgcaacaauuucuaccacuauaaucaaucaaaugaccccacaauaaaacuaauagcaaugcuauauacaccacuacgugcaaacaaugccggagaagacguauuuacaguaucauguagaguacuuaccagaccauccccagacuucgauuuuaucuuucuaguaccaccuaccguagaaaguagaacaaaaccauuuacuguucccauacuaaccguagaagaaaugacuaauuccagauuuccaauacccuuagaaaaacuauucacaggaccauccggagcuuucguaguacaaccacaaaacggaagaugcacaacagauggagucuuacucggaacuacacaauuaucaccuguuaacaucuguacauuuagaggugacguaacacauauagccggaacacauaauuacacuaugaaucuagcaucacaaaauuggaacaacuaugauccaacagaagaaaucccugcaccauuaggaacacccgacuucguaggcagaauacaaggaaugcuaacacaaacuacaagaggugaugguucuacaagaggccacaaagcaacaguaaguacaggagacguacacuuuacuccaaaauuaggaucuauacaauucaacacagacacaaauaaugauuucgaaacaggacaaaauacccgauuuacaccaguagguguaguacaagacggcaauggaacacaccaaaaugaaccccaacaauggguacuacccucauauucaggacgaacaggacauaacguacauuuagcacccgcaguugcaccuacauuuccaggugaacaauuauuauucuuccgauccacaaugccaggaugcucaggauauccaaauaugaaucuagacugucuacuaccucaagaauggguacaacauuuuuaccaagaagcagcacccgcucaaucagacguagcauuacuucgauucguaaacccagauaccggaaggguguuauucgaaugcaaacuacauaaaucaggauauguaacaguagcacacacuggacaacacgacuuaguaauaccaccaaauggauauuuccgguuugauuccuggguaaaucaauuuuacacucuagcaccuauggguaauggaaccggaagacguagagcacucuaa

SEQ ID NO: 32485 - RNA, 1620 nt, Artificial Sequence
  derived and/or modified sequence opt6 from capsid_protein__Norovirus__ABW74536
augaaaauggccucauccgacgcuaauccuuccgacggauccacagcuaacuuaguaccugaagucaacaaugaaguuauggcuuuagaaccaguaguaggcgcagcuauagcagcaccaguagcaggucaacaaaauguaauagacccauggauuagaaacaacuuuguacaagcaccaggaggagaauuuacagugucaccacgaaaugcaccaggugaaauacuuuggucugcaccauuagguccugauuuaaacccauacuuaucacauuuagcaagaauguauaacgguuacgcaggaggauuugaaguacaaacaaucuuagcaggaaaugcauuuacagcuggcaaaauaauauucgcugcaguacccccaaauuuuccuacagaaggauuaucaccgucucaaguaacaauguucccacacauaaucguugacguacgccaauuagaaccaguacucaucccucuaccagacguucgaaauaauuucuaccacuauaaccaaucaaaugacccaacuauaaaauuaauagcaauguuauauacaccauuaagagcaaacaaugccggagacgauguauuuaccguaucuuguagaguucuaacaagacccuccccugauuuugacuuuauauuccuaguaccaccaacugucgaaucuagaacaaaaccauucacagucccaauauuaacaguagaagaaaugaguaacucaagauuuccaauaccauuagaaaaacuauauacaggcccauccagugcauucguuguucaaccacaaaacgggcgauguacaacagacggaguauuacuaggaacaacacaauuaagugcaguuaacauauguacauuuagaggugacguuacccauauagcuggaucacacgauuauacuaugaacuuagcuucacaaaacuggaauaauuaugauccaacagaagaaauaccagccccauuaggaacacccgacuuuguaggaaaaauacaaggaaugcuaacacaaacaacaagagaggauggaaguacuagagcccauaaagcuaccguaucaacagguucuguccacuucaccccaaaauuaggaucaguacaauacacuaccgauacaaauaacgauuuccaagcaggacaaaauacaaaauucacccccguaggaguaauacaagacgguaauaaucaucaaaacgaaccacaacaauggguauuaccuaacuauucuggacgaacaggacauaauguacacuuagccccagcaguagcuccaacauuuccaggcgaacaauuauuauuuuucagaucaacaaugccaggaugcagcggauauccaaauaugaaucuugacugcuuauuaccacaagaauggguacaacacuuuuaccaagaagcugcaccagcucaaucagaugucgcgcuuuuacgauuuguaaauccagacaccggacgaguacucuuugaauguaaauuacacaaaucaggauacguuacuguagcacacacaggaccccacgauuuaguuaucccaccaaacggauacuuucgauucgauucauggguuaaccaauucuauacauuagcaccaaugggaaacggaacaggaagacgaagagcauuauaa

SEQ ID NO: 32486 - RNA, 1623 nt, Artificial Sequence
  derived and/or modified sequence opt6 from capsid_protein__Norovirus__ABW74537
augaaaauggcuucaaacgacgcauccccuagcgauggaucaaccgcaaacuuaguuccagaaguaaacaacgaagucauggcacucgaaccaguaguuggagcugcaaucgccgcacccguagcaggucaacaaaauguuauagacccauggauccgaaauaauuuuguucaagccccagguggagaauuuacaguuucaccccgaaaugccccaggagaaauacuaugguccgcuccauuaggacccgauuuaaacccauaucuaucacaucuagccaggauguauaacggauacgcaggaggcuucgaaguacaagucauacuagccggaaaugcuuuuacugcaggcaaaauuauuuuugcagcuguacccccaaacuuccccacagaaggauuaucaccaucacaaguaacaauguucccccacauaauaguugacguaagacaauuagaaccuguuuuaauaccauuacccgaugucagaaauaacuuuuaccauuacaaucaaucaaaugauccaacaauaaaacuuauagcuauguuauacacaccacuaagagcaaauaacgcaggagaugauguauuuaccgucucaugcagaguucuaacaagaccaucaccagauuucgauuucauuuuucuugucccaccuacuguagaaucaagaacaaaacccuuuacuguuccaauuuuaacuguagaagaaaugacuaauucaagauucccaauaccacuagaaaagcuauuuacuggaccaucuucagcauucguaguacaaccacaaaauggaagauguacaacugacggcguauuauuaggaacaacacaauuaucaccagucaacauauguacauuccgaggagacgucacccauauaccaggaacacgcacauauagaaugaaccuagcaucacaaaauuggaauaauuaugaucccaccgaagaaauacccgccccacuagguacaccugacuuuguaggaaaaauacaaggaauguuaacccaaacaacgaaaggagaugguucaacaagaggucauaaagccacaguaucaacaggaucuguugauuucacaccaaaacuaggaucaguccaauucgcaaccgacacagacaacgauuucgaaaccggacaaaauacacgguuuacuccuguaggaguaauacaagacggaucaagugcacauagaaaugaaccacaacaauggguucuaccagauuauaguggacguacaguucauaauguacaucuagcaccagcaguagcuccaacauuuccaggagaacaacuuuuauuuuucagaucaacaaugccaggaugcucaggauauccaaacauggacuuagauugucuauuaccucaagaauggguacaacauuucuaucaagaagccgcaccagcacaaucagacguugcauuacuaagauucguaaauccugauacugguagaguacuuuucgaauguaaacuucacaaaacuggauauguaacaguagcucacaccggacaacacgaccuaguuauaccaccaaacgguuauuucagauucgacucaugggucaaucaauuuuacacacuagcaccuaugggaaacggagcgggacgcagaagagcuuuauaa

SEQ ID NO: 32487 - RNA, 1623 nt, Artificial Sequence
  derived and/or modified sequence opt6 from capsid_protein__Norovirus__ABW74538
augaaaauggccucuaaugacgcaucacccucagauggaucaacagcaaacuuaguaccagaaguaaauaaugaaguaauggccuuagaacccguuguaggagcagcaauagcugcccccguagcaggacaacaaaauguaauugacccuuggauaagaucaaacuucguccaagccccaggaggcgaauuuacaguuucaccacgaaacgcaccaggcgaaauauuauggucagcaccacuaggaccagauuuaaauccuuaucuaucacaccuagcccguauguauaauggauacgcaggaggauucgaaguacaaguuauacuagcaggaaaugccuucacagcuggaaaaauuauauucgccgcuguacccccaaacuuuccuacagaaggacuauccccaucacaaguaacaauguucccacauauuaucguugacguaagacaacuagaaccaguacuaauucccuuaccagauguaagaaauaauuucuaucacuacaaucaauuaaaugauccaacuauuaaacuuauagcaaugcuauacacuccacuaagagcuaacaaugcaggcgacgaugucuuuacaguauccugcagaguccucacacguccaucuccagacuuugacuuuauauuccucguuccaccuacaguagaaucaagaacaaaaccauucacuguaccaauacucaccgucgaagaaaugacaaauucaagauucccaauaccauuagaaaaauuauuuaccgguccaucaggagcauuuguuguacaaccucaaaacggaagaugcaccacagauggcguccuacuagguacaacacaauuaucuccaguaaauauaugcacauuuagaggagacguaacucauauagcuggaacacaugauuacacaaugaaucuugcaucacaaaacuggaacaauuacgacccaacugaagaaaucccagcaccacuaggaaccccagacuuuguaggaaaaauucaaggaguccuaacucaaacaaccagaggagacggcucaacaagaggacacaaagcaacagucucaacaggcucuguucacuuuacaccuaaacuaggaucaguccaauucacuacugauacaaauaacgacuuagaaaccggacaaaauacacgcuuuacaccaguagguguaguucaagacggaaauucaacucaucaaaacgaaccacaacaauggguuuuaccaaacuacucaggacgugcaggccacaacguacacuuagcaccagcaguagcaccaacauuucccggagaacaacucuuauuuuuuagaucaacaaugccaggauguucagguuacccaaauaugaauuuagacugcuuacuaccccaagaauggguacaacauuucuaucaagaagcagcccccgcacaaucagacgucgcccuccucagauucguaaauccagacacuggaaggguauuauucgaauguaaauuacauaaaagugguuauguuacuguagcacacaccggacaacacgauuuaguuauaccaccuaauggauauuucagauucgacaguuggguaaaccaauuuuauacacuagcaccaauggguaauggugcuggaagacgacgagcauuauaa

SEQ ID NO: 32488 - RNA, 1623 nt, Artificial Sequence
  derived and/or modified sequence opt6 from capsid_protein__Norovirus__ABW74539
augaaaauggcaucaaacgacgcuaauccaucagauggaucaacagcaaacuugguuccagaaguaaacaaugaagucauggcacuugaacccguaguuggagcagcaauagcugcaccuguugccggacaacaaaauguaaucgacccauggauaagaaauaacuuuguacaagccccaggaggugaauuuacaguaucaccacgaaacgcaccaggagaaauccuaugguccgcuccauuaggaccagaucuaaacccauauuuaucacaccuugcacgaauguauaacggauacgcuggaggauucgaaguacaagucauauuagcuggaaaugcauuuacagccggcaaaauuaucuucgccgcaguaccaccuaacuucccuaccgaaggccucucaccaucucaaguuacaauguuuccacacauaauuguagacguacgacaacuagaaccuguauuaauaccacuaccagauguaagaaauaacuucuaccacuauaaccaauccaaugauucuacaauaaaacuaauagcaaugcuauauaccccauuaagagcaaauaaugcaggugacgacgucuucacuguaucuuguagaguucuaacaagaccuucaccugacuuugauuuuauauuuuuaguaccccccacaguugaaucaagaacaaaaccauucacaguaccaauccuuacaguagaagaaaugacaaacagucgcuuuccaauaccacuagaaaaacuauuuacaggcccaucaggagcuuucgugguacaaccacagaacggacgaugcacaacugacggcguacuauuagguacaacucaacuaucuccaguaaauauauguacauuuagaggugacgucacccauauagcaggaacaagaaacuauacaaugaaccuagcaucucaaaauuggaauaauuacgauccuacagaagaaauaccagcaccccuaggaaccccagacuucguaggucguauacaaggaauguuaacccaaaccacaagaagagacggaucaacaagaggucauaaagcaacuguaucaacaggagacgcacauuucacaccaaaauuaggaagcauaauguuuucaacagacacugauaacgauuucgaaaccggacaaaacacaaaauucacaccugucggagucguacaagacggaaacggaacacaucaaaaugaaccacaacaauggguacuaccaaguuauucagguagaacaggacauaacguucauuuagcacccgcaguagcaccaacauuuccaggagaacaacuauuauucuuuagaucaacaaugccagguugcuccggauauccaaacaugaaucucgauugcuuacucccucaagaauggguacaacauuucuaucaagaagccgcuccagcccaaucugacguugcacuauuaagauuuguaaacccagacacuggaagaguuuuauuugaaugcaaauuacauaaaucaggcuacguaaccguagcacacacaggacaacacgaccucguaaucccaccaaauggauauuucagauuugauagcugggucaaucaauuuuacacacuagcaccaaugggcaacgguacuggaagacgacgagcauuauaa

SEQ ID NO: 32489 - RNA, 1623 nt, Artificial Sequence
  derived and/or modified sequence opt6 from capsid_protein__Norovirus__ABW74540
augaaaauggcaucaaaugaugcuacccccucagauggaucaacagcaaauuuaguacccgaagucaacaaugaaguaauggcccuagaacccguaguaggagcagcgauagcagcaccaguagcuggacaacaaaacguaauagacccauggauaagaaauaacuuuguacaagcaccuggaggagaauuuacaguaagcccaagaaaugcaccaggcgaaauauuaugguccgcuccacuaggaccagaccuaaauccuuaucuaucccauuuagcaagaauguacaacgguuacgccggaggcuucgaaguccaaguuauuuuagcaggaaaugcauucacugcagguaaaauaauauucgcagcaguaccaccaaauuuuccaacagaaggacuaucuccaucacaaguaacaauguucccacauauaaucguagacgucagacaauuagaacccguauuaauaccccuuccagauguaagaaacaauuucuaucacuauaaucaaucaaacgauccaacaauuaaacuuauagcaauguuauacacaccauuaagagccaacaacgcaggagaugacguauuuaccguaucaugucgaguauuaacaaggccuagcccagacuucgacuuuauauuucucguaccaccaacaguugaaucacguacaaagccauuuaguguaccaauccuaacagucgaagaaaugacaaauucuagauucccaauaccauuagaaaaacuauuuacaggacccucauccgcauuuguaguacagccccaaaauggcagaugcaccaccgacgguguacuacuaggaacaacacaacuaucaccuguaaauauaugcacuuuucgaggugauguaacacauauagcaggaacucaaaauuacaccaugaaccuagcaucucaaaacuggaacaacuacgauccaacagaagaaauacccgccccacuaggcacaccagauuuugugggaaaaauacaagguguacuaacacaaacaacuagacgcgacggauccacaaggggacacaaagcaacaguaaguacaggaucuguacauuuuacaccaaaauuaggaucaguacaauucucuacagauacaucaaaugacuucgaaacaggucaaaacacaagauuuacaccagucggaguuguacaagacggaucaacuacacaucaaaaugaaccccaacaauggguacuaccagacuauucaggucgagauucacauaauguacaccuagcacccgccguagcuccaacauuuccaggagaacagcuccuuuuuuuuagaucaacaaugccaggaugcaguggauauccuaacaugaauuuagacugccuauuaccucaagaauggguacaacacuuuuaccaagaaucugccccggcacaaucugacguagcauuacuaagauucguaaacccagacacaggcagagucuuauucgaauguaaacuacauaaauccggauauguaacaguagcacacacaggacaacaugaccuaguaauaccacccaaugguuacuuuagauucgauucauggguuaaucaauucuacacccuagcaccaauggguaauggagcaggucgaagacgcgcccuauga

SEQ ID NO: 32490 - RNA, 1623 nt, Artificial Sequence
  derived and/or modified sequence opt6 from capsid_protein__Norovirus__ABW74541
augaaaauggcauccaacgaugcaacaccaucagacgguucaacugccaaucuaguuccagaaguaaauaaugaaguaauggcauuagaacccguaguaggagccgcaauugcagccccaguagcaggacaacaaaacguaaucgaccccuggauuagaaacaauuuuguacaagcaccagguggagaauucacuguaucuccaagaaacgcaccaggugaaauauuauggagugcaccauuaggaccagacuuaaacccauaccuaucacauuuagccagaauguacaacggauaugcaggcggauuugaaguacaaguaauacucgcagguaaugcauucaccgcaggaaaaauaauauucgccgcaguaccccccaauuuuccaacagaagguuuauccccaucccaaguaacaauguuuccacacauuaucguugaugucagacaauuagaaccaguauuaauuccacuaccagacguaagaaacaacuuuuaccacuauaaucaaucaaaugauccaacaauaaaacuaaucgcaaugcuguacacaccauuacgagcaaacaacgcaggagacgacguauucacuguaucuugcagaguccuaacaagaccaucaccagauuuugacuucauauuucuaguaccaccaacaguugaaucacguacaaaaccauucuccguaccaauccucacagucgaagaaaugacaaacucaagauuuccaauaccauuagaaaaacucuucacaggaccuucuucaucauucguaguucaaccacaaaauggucgcugcacaacugacggaguacuuuuaggcacaacacaauuaucaccaguaaauauauguacauucagaggcgacguaacacacauagcagguacacaaaacuauacaaugaacuuagcaucacaaaauuggaacaacuaugauccaacugaagaaauaccagcaccauuaggaacccccgauuuugucgguaaaauacaagguguucuaacacaaacaacaagaggagacgguucaacaagaggacauaaagcaacagucucaacuggaucaguacauuuuaccccaaaauuaggaucaguacaauucucaacagacacgaguaaugauuuugaaacaggacaaaauacaagauucacgccaguaggaguaguacaagauggaucaacuacacaccaaaacgaaccccaacaauggguauuaccagauuacuccggaagaaacucacauaacguacacuuagcuccagcaguagcaccaacauuuccaggagaacaacuacuauucuuucgaucaacuaugccagguuguuccggauauccaaacaugaauuuagacugccucuuaccucaagaauggguacaacacuucuaucaagaaagcgcaccagcacaauccgacguugcucucuuaagauuuguaaauccagacacaggaagagucuuauucgaaugcaaauuacacaaaucaggauacguaacaguagcacacacaggacaacacgaucuaguaauaccaccuaauggauacuuccgauuugacucauggguuaaucaauuuuacacacuagcaccaaugggcaacggagccggacgacgccgagcauuauag

SEQ ID NO: 32491 - RNA, 1623 nt, Artificial Sequence
  derived and/or modified sequence opt6 from capsid_protein__Norovirus__ABW74542
augaaaauggcaucuaacgacgcaaauccaucagacggaucugcagcuaaucuagucccagaaguaaauaaugaaguaauggcacuagaaccuguaguaggagcugcaauagccgcccccguugcaggacaacaaaacguaauagauccuuggauucgaaauaauuuuguacaagcaccaggaggcgaauucacgguaucaccaagaaaugcuccaggagaaauucuauggucugcuccuuuaggaccagaucuaaauccauaucuaucacaucuagcaagaauguauaauggauaugcagguggcuucgaaguacaaguaauauuagcugguaacgccuuuacagcaggaaaaauaauauuugcagccguaccaccaaacuuccccacagaaggauuaagcccgucacaagucacaauguuuccacauaucauaguugacguacgacaacuagaaccaguacuaauaccccuaccagacguaagaaauaacuucuaccauuauaaccaaucuaaugauucaacaaucaaauuaauagcuaugcuauacacaccacuuagggcaaacaaugcuggugaagauguauuuacuguaucuugcagaguuuuaacaagaccaucgcccgacuucgacuuuauauuucuaguaccaccaacaguagaaucaaggacaaaacccuuuucagucccaauacuaacuguagaagaaaugacaaauucccgauuuccuauaccccuagaaaaacucuuuacaggaccuucaagugccuuugugguucaaccacaaaauggaagaugcacaacagacggcguacuacuaggaacaacacaauuaucaccaguaaacauauguacauuuagaggagacguaacacacauagcuggaacucaagaguacacuaugaacuuagcaucacaaaauuggaauaacuacgauccaacagaagaaauacccgcaccacuaggaacaccagauuuuguaggaaaaauacaaggcguccuaacucaaacaacucguagagauggauccacaagaggccauaaagcaacuguuucuacaggcaguguccauuuuacaccaaaguuaggaagaauacaauuuucaacagauacauccaacgauuuugaaacaggacaaaacacacgauuuacuccaguaggcguaguacaagauggcucaaccacacaucaaaaugaaccacaacaauggguucucccuaauuauucagguagagauucacauaacguacaucuagcuccugccguagcaccuagcuucccaggagaacaauuauuauuuuuuagaucuacaaugccaggaugcucaggauauccuaauauggaucuagacugcuuacuaccacaagaauggguacaacauuuuuaccaagaagcagcaccugcacaaagugacguagccuuacuacgauucguaaauccugacacaggaagaguucuauucgaaugcaaauuacauaaaucaggauauguaacaguagcacacacaggacaacacgaccuagucauacccccgaauggauacuuucgauuugauucauggguaaaucaauuuuauacacuagcaccuauggguaauggcacaggaagaagacgagcccuauaa

SEQ ID NO: 32492 - RNA, 1623 nt, Artificial Sequence
  derived and/or modified sequence opt6 from capsid_protein__Norovirus__ABW74544
augaaaauggcaucaaaugaugcaaacccaucagauggcucugcagcaaaccuaguaccagaagucaacaaugaaguaauggcacuagaaccuguuguaggagcagcaauagccgcaccaguagcaggacaacaaaauguuauagacccuuggauacgaaacaacuuuguacaagccccuggcggcgaauuuaccguuucccccagaaaugcaccaggagaaauacuuuggucagccccacuagguccagacuuaaaucccuacuuaagucauuuagcaagaauguacaauggauacgcagguggauucgaaguccaaguaauauuagccgguaaugcauucaccgccggaaaaauuauauucgcggcaguaccuccaaacuucccaacagaaggacuuucaccaagucaaguaacaauguucccacauauaauaguugauguaagacaauuagaacccguauuaauaccacuacccgauguaagaaacaacuucuaucacuauaaccaaucuaaugacucaacuauaaaauuaauugcaaugcuauauacaccacuaagagcuaacaaugccggugaagauguauucacgguauccugcagaguucuaaccagaccaucgccugacuucgauuucauauuucuaguuccuccaacaguugaaucaagaacaaaaccauuuaccguaccaauacuuacaguugaagaaaugacaaacucaagauucccaauaccauuagaaaagcuauuuacuggaccauccggagcauucguaguccaaccacaaaacggcagauguacaacugacggaguacuacuaggaaccacacaauuaucaccagucaauauaugcacauucagaggugauguuacacauauagcaggaucacgaaauuacacaaugaauuuagcaagcuuaaauuggaauaauuacgaucccacugaagaaauaccugccccacucggaacaccagacuuuguugguaaaauacaaggagucuuaacccaaacuacaaaaggagacggaucaacaagaggacacaaagcaacaguauacacaggaucagccccauuuacaccuaaauuaggaucaguacaauuuucaacagauacagaaaacgacuuugaaacucaccaaaacacaaaauuuacaccaguuggaguaauacaagacggaucaacaacacauagaaaugaaccucaacaauggguccuacccucauauucaggacguaacguacacaacguacaucuagcacccgcaguagcaccaacauuuccaggagaacaacuacuauucuuuagaucaacaaugccaggaugcucaggcuauccaaauauggacuuagacuguuuacucccacaagaauggguucaacacuuuuaucaagaagcagcaccugcacaaucugauguagcuuuacuaagauucguaaacccagacacugguagaguuuuauuugaaugcaaacuacauaaaucaggcuauguaacaguagcacauacuggccaacacgauuuaguaaucccuccaaacggcuacuuuagauuugauagcuggguuaaucaauuuuacacucuagcuccaaugggcaauggaacaggaagaagaagagcauuauga

SEQ ID NO: 32493 - RNA, 1623 nt, Artificial Sequence
  derived and/or modified sequence opt6 from capsid_protein__Norovirus__ABW74545
augaaaauggcaaguagcgacgcaaacccuucagacggaaguacagcaaacuuaguaccagaagucaauaaugaaguaauggcucucgaaccaguagucggugcagccauagcugcaccagucgcaggacaacaaaauguuauagaucccuggauuaggaauaacuuuguccaagcaccagguggcgaauuuacaguaucaccuagaaaugcuccaggcgaaauacuauggagcgcuccucucggaccagacuuaaauccauaucuaucccaucuagcaagaauguauaacuccuacgcuggcggcuucgaaguacaaguaauauuagcuggcaaugccuuuacagcuggaaaaauaauauucgcagcaguacccccaaauuuucccaccgaaggauuaucaccaucucaaguaacaauguuuccacacaucauaguagacguaagacaauuagaacccguuuuaauaccacuuccugacguaagaaauaacuucuaucauuauaaucaauccaaugacccaacaauaaaacucauagccaugcuauauacaccauuaagagcuaacaacgcaggcgaugaugucuuuacaguaucguguagaguacuuacuagaccuucacccgauuucgacuucauauuccuaguaccccccacugucgaauccagaacaaaaccuuuuucaguuccaauauuaacaguagaagaaaugacaaauuccagauuuccaauaccauuagaaaaacuauuuacaggacccuccucagcauucguaguacaaccacaaaauggaagauguacuacagacggaguucuacucggaaccacacaauuaucuccgguaaauauaugcacauuuagaggagauguaacucauauagcaggaacacaagaauacacaaugaauuuagcuucacaaaacuggaacaacuaugauccaacagaagaaauaccagcuccauuaggaacaccagacuucguagguaaaauucaagguguauuaacucaaacaacuaggcgagaugguuccacacgaggacacaaagcaacagucucaacaggaucaguacacuuuacaccaaaacuaggcagaauacaauuuuccacagauacaucaaacgauuuugaaacaggccaaaauacaagauuuacaccaguagguguaguacaagacggaucaacaacacaucaaaaugaaccacaacaauggguauuaccaaauuacucuggccgagauucacacaacguacaccuugcaccagcuguagcaccuagcuuuccaggagaacaauuacuauucuuucgaucuacaaugcccggcugcucgggauaccccaauaugaauuuagacugucuacuaccccaagaauggguccagcauuucuaucaagaagcagcucccgcacaaucagauguagcccuauuacgauucguaaacccagacacaggccgaguauuauuugaaugcaaacuucauaaaucagguuacguaaccgucgcucacacaggacaacacgauuuaguaauaccaccaaaugguuacuucagauuugauaguuggguaaaccaauucuacacacuagccccaaugggaaacggaacaggacgacguagagcuuuauaa

SEQ ID NO: 32494 - RNA, 1623 nt, Artificial Sequence
  derived and/or modified sequence opt6 from capsid_protein__Norovirus__ABW74546
augaaaauggcaagcaacgacgcaaacccaagcgauggaagugcagcuaauuuaguacccgaaguuaacaaugaaguaauggcucuagaaccagugguaggagcugcaauagcugcacccgucgcaggacaacaaaauguaauagauccauggauuagaaauaacuucguccaagcaccaggaggagaauuuacuguaucaccaagaaaugcuccaggagaaauauuauggucagcaccauuaggaccagauuuaaauccauauuuaucacaccuugccagaauguauaacggauacgcaggaggauucgaaguacaaguaauacuggcaggaaaugccuuuacagcaggaaaaauaauuuuugcugcaguaccaccuaauuuuccaacugaaggacuaucucccucacaagucacaauguucccucacauaaucguagauguaagacaacuagaaccaguauuaauuccacuaccagauguaagaaauaauuucuaccauuacaaccaaucaaacgacagcacaauaaaacuaaucgcuaugcuauauacuccauuaagagcuaacaacgcaggcgaagauguauucacaguaucaugcagaguacuaacaagaccaucaccagauuuugacuucauauuucuaguuccaccaaccguugaaucaagaacaaaaccguuuaccguaccaauauuaacuguugaagaaaugacuaauucaagauuuccaauaccacuagaaaaacucuuuacaggaccuaguucggccuucguaguacaaccccaaaauggaagauguacaacagauggaguccuccuaggaacaacacaacuaucaccuguaaacauauguacauucagaggugacguaacacauauagcugguucaagaaacuauacaaugaauuuagcaucacuaaauuggaacaauuacgauccaacagaagaaauaccagccccauuaggaaccccagauuucguaggaaaaauacaaggaguauuaacacaaacaacaaaaggcgacggaucaacuagaggacauaaagcaacagucuauacuggaucagcacccuuuaccccaaaacuaggaucaguacaauucucaacugacaccgaaaaugacuuugaaacacaccaaaacacaaaauucacuccuguaggaguaauacaagauggaucaacaacacauagaaaugaaccacaacaauggguacuacccucuuauaguggacgaaauguacacaauguacacuuagcaccggccguugcaccaacauuuccaggcgaacaacuacuuuuuuucagaucaacuaugccaggaugcucuggauauccaaauauggaucuagauugcuuauuaccacaagaauggguucaacacuuccaucaagaagcagcaccagcucaaucagaugucgcacuucuaagauucguaaacccagacacaggccguguauuauucgagugcaaauuacauaaaucaggauacguaaccguagcacauacuggacaacaugauuuagucauucccccaaacggauauuucagauuugauucuuggguaaaucaauuuuauacacuagcaccaauggguaauggcacaggaagacguagagcacuuuaa

SEQ ID NO: 32495 - RNA, 1566 nt, Artificial Sequence
  derived and/or modified sequence opt6 from capsid_protein__Norovirus__ABW75843
augaaaaugucagauaaagaauccgcagaaucaccagcaucauuaggucaaguucuacccccacaaguagauguaguaguuccaguugaaccaacaguaggagcacaaauagcagcaccaacugcuggacaaauaaaucccauugauccauggauauuuucaaauuuuguacaagcuccucaaggagaauucacuaucaguccaaauaacaauccaggugaaauccuauuugaaauggaacuaggaccagauuuaaauccauauuuaggucacuuacguagaauguauaauggauggacaggcucacucagaguacguguaauguuagcagguaaugcauucagugcuggaaaaaucauagucuuuuguauaccaccaggauuugauacaacauuucuaacaccagcucaagcuacacaauuuccacauguaauaauggauguaagagcacccgauccaguagaaguaccucuagaagauguuagaaauguacuauuucaccaaggaccugauaauagaaugcgacuuguaggaauguuauauacuccccuuagagccaacucaggagcagauccauuuguaguaaccgguagaguauuaacauguccuucugaaaacuuuucauuuuucuuccuuguaccaccaacagucgaagaaaaagacguuccauuuacaauacccaacguucccacaaguuccuuaacaaauucaagaaugcuugaaccaguugcagaacuaagaaguucacgcaacuuugcacuaucaguacaauuccaaaauggaagaucaacuauagaaggagaauuauuaggaacaacuccagcaucucuugcagaucuuggaagcuuucuaugcauaagaggaggaacagcuaacuuagcagaauuauuucaaccaaacgaagaugcguuugucgcaggaucccauccagcacccuuuggauucccagauuuuucaaacuguacauuagacuuuuuauuauacgaugccaauggauuauaccauagacaucuugauguaacaucugcuucuaacuucacacccgcacuaggacacauuacuuuagacggauccguuccagaccgacuaacuagagccagauuagaaggaguacaaagagcaucagaaaauacauuuuggaggaugccagauuauagaggugauguccucggugcagaauuugcucccgcaguuucugcaccaggcauaggcgaaacauuauuauucuucauguccaauguaccauaucauaacggaucaaacccaaacccacuaccauguuuacuaccccuagaauggauaaaucauuucguagcagaaagaccagcaaaacaaucagacguagcucuccuuaauuauauaaacccacuuacaggacgaguuuuguuugaaugcaaauuauacucugcgggauuuuuagcuguuaaccuagguucacaaacagaaguaaccuuaccaguagauggaauauucaaauuuguauccuggguaucauacuacuaccaacuaagacccguaggaacagucucuguaggucgaagauuaccaagauuagauggacauuaa

SEQ ID NO: 32496 - RNA, 1737 nt, Artificial Sequence
  derived and/or modified sequence opt6 from capsid_protein__Norovirus__ABX71062
augaaaauggcaagcaaugaugcagcaccaucaucugauggagcagguaacuuaguaccagaaucucaucaagaaguacucccuuuagcaccaguagcaggagccgcaauugcugcuccaguaguaggucaacaaaauauuaucgauccuuggaucaaagaaaauuuuguacaagcaccucaaggagaauuuacuguuucaccaaaaaauucaccaggugaagucuuaguuaauuuagaauuaucuccaaaauuaaacccauauuuagaucauuuaaguaaaauguauaaugccuacgcaggcgguauggaaauagaaauaauuuuagcgggaaaugcauuuacggcaggaaaaguacuaauagcagcaguaccuccaaacuucccaguagaaaacauaucagucagucaagcaagucaauuuccacacguuauaguagacgucagaacuuuagaaccaaucagacuuccauuaccagacguuaggacaaacuuuuuucauuauacaacgagagaugaacccaaaaugagaauugucgccuggcuauauacaccacuaagaacaaaugguaguggagaugauuccuuuacuguuucuggaagaauacuaacuagaccaagugcggacuuugaguuuuccuuccuaguacccccaacuguagaaacaaaaacagucucuuucucuguacccggauuaacaguagaagaaaugucuaauucuagauggccagcacaaauuaacggacuaguaguacguggaaaugaagcucaaguaguacacuuccaaaauggaagaugcacaacagaagguaugcuacucggaacaacaacauuaaacguaaauucaauauguggacuaagagguacaucaauaucacaugcuucuguaagagaagcacccgcauuaucagaagaaaugccaccacuugaagacgaaguagcccauggugccgcagcaacauaugcuguaggacgcgcagcagauacaacauuguggauccgaguagaagaaccaaauggccaaccuuaugauauauucggugaacaaccagcacccuuaggaacuccagacuuuaccgcgguaauaauaggcacagcaauaagaccgcgaacagcuagcggugcuuaccuucacgacgcauauguagacacaagaccaggagaugcagauuucacaccaucaaccggaaacacaaaaauagucuuaagaggaggcggcagcggucauguaggugaaggacacuauuggcaauuuaaaccaauagcaguagaaggaggaccaaacagaccaguauaccaagaauacaacuuaccagaauaugccggcccaacagcuucaaaccacaaucuagcuccuccaguagccccuaaaaugccaggugaauuauuauuauuauuugaaucagacaugccaguaugggauaauggaaguggcucagcgccaacacaaaaaauacauuguuuauuaccaaaugauuuuguaacacacuuuuuugacuuacaagcaccagcauuagcagaagcagcacuucuaagauauguacauccagauucaggaagaacacuauuugaaugcaaauuauacagagaaggauauaugguaguuguagcaccaucaggucgauuagacuuuccacuugacggauauuucagauucgauucauggguaaacgcauuuuacguuuugucaccuguaggaaauggacaaggaagaagaggaagagcaaaaaauauauag

SEQ ID NO: 32497 - RNA, 1605 nt, Artificial Sequence
  derived and/or modified sequence opt6 from capsid_protein__Norovirus__ABY77754
augaaaauggcuucuaaugacgccucaccuucauccgacggaucagcuaacuuaguaccagaaauaaacaacgaaguaauggcacuagaacccguagcaggagcagcaauagcagcacccguugccggucagcaaaauauaauagaccccuggauuagaaacaacuuuguacaagcaccuggaggugaauuuacugucucaccaagaaacgcuccaggcgaagucuuacuaaaccuuccacuaucaccagacauaaaucccuaucuagcacacuuaucccguauguacaacggauacgcaggaggagucgaaguagaagucguucucgcaggaaacgcauucacagcagguaaaauaaucuuugcagcaguaccacccaauuuuccuccagaaaaccuaucuccaucacaaauaaccauguuaccccacaucauaguugauguucgacaauuagaaccuguacgaauaccauuaccagacguaagaaacaacuuuuaucacuauucacgcgaaaaugacucuacacuaagauuaguagcaauguuauacacaccacuaagagcaaacaaugcaggagacgauguuuucaccguuucuuguagaguucuaacucgaccaucaccagauuucgauuuuauauuccucguaccacccacaguagaaucaaaaucaaaaccauucacaauaccaauacuaacaauagaagaaaugacaaacucaagauuccccgcaccauuagaaaugaugacaacaggaccaucacaugauauaguuguucaaccccaaaauggucgcugcacuauagacgguguacuacuaggaacaacacaacuaucaccaguaaacauauguucaaugagaggaguaccaaccaaaagaacaaaugguacagauaacuguuucguacaacuagaaaauccaaacggcucagcauacgaucccacagaagacauaccagcaguauuaggaucaccagacuuugucggcgaauuuuauggaaccauaacacaaagaucaccaaauaauagcacaagagcacaucccuucacacuaaacacaggauccccuagauacacaccuaaaauaggaucuguagacauccacguaacagauguagacgaccuaaaugaccaugaaccaguaaaacuaaccccagucggauuaucaggaucuucuggaucaauacaccaauggcaauuaccaaauuacagcggaguagcuacucacaauaugcauuuagcaccaucagucgcaccacuauucccaggcgaacaaauacucuuuuucagaagcacaguaccaggauguggaggauauccaaacacuaacauugacugccucauaccacaagaauggguccaacacuucuaucaagaaggagcaccagcucguacagauguagcccuauuacgauucauaaauccagauacuggaagaguauuauucgaauguaaauuacacaaacacgguuuuaucacaguugccuauucaggaaaccaugaccucguaaugccaccaaacggauacuuuagauuugaaucauggguaaaccaauuccacacacuagcaccaaugggcacagguagagcagaagaaauacaauaa

SEQ ID NO: 32498 - RNA, 1608 nt, Artificial Sequence
  derived and/or modified sequence opt6 from capsid_protein__Norovirus__ABZ89549
augaaaauggcuucaaaugaugcuucaccaucauccgauggaucagcuaaccuaguccccgaaauaaauaaugaaguaauggcauuagaaccugucgccggagccgccauagccgcaccuguagcaggccaacaaaauauaauagauccauggauacgaaauaacuuuguacaagcuccuggaggagaauucacaguaucacccagaaacgccccaggagaaguacuauuaaacuuacccuuaucaccagauauuaacccauaccuugcacaccuaucaagaauguauaauggauacgcaggaggcguagaaguagaagucguacuagcaggaaacgccuuuacagcagguaaaauaauuuucgccgcagucccaccaaauuuuccaccugaaaauuuaucaccaucacaaauuacaauguuaccacacauaauaguagauguaagacaacuagaaccaguaaggauaccacucccagauguaagaaauaauuucuaccauuauucaagagaaaaugauagcacucuaagacuaauagcaaugcuuuauacaccacuaagagcaaauaacgcaggagaugaugucuuuacaguaucauguagaguacuaacuagaccaucuccugauuucgacuuuauauucuuaguaccaccaacaguagaaucaaaaucaaaaccuuucacaauccccauucuaacaauagaagaaaugacaaauucacgauucccagcaccacuagaaaugaugaccacugguccuucacaugacauaguaguccaaccacaaaauggaagauguacaauagauggaguauuacuaggaacgacacaacuaucaccagucaacauauguucaaugcgaggcguucccacaaaaagaacaaacggcacagacaacugcuucguacaacuagaaaacccaaaugguucagcauacgacccaacagaagauauaccagcaguccuaggcucaccagacuucguuggagaauucuacggaaccauaacacaacgguccccaaauaauucuacccgagcccacccauuuacacuaaauacuggaucaccaagauacacuccaaaaaucggaucuguagacauacacgucacagacguagaagacuuaaaugaccacgaaccgguaaaacuaacaccaguuggacucucuggaucuucaggaucuauacaccaauggcaauuaccaaacuauuccgguguagcaacacauaauaugcaccuugcaccauccguagcccccuuauuucccggugaacaaauacucuucuuuagaucaacugucccaggaugcggcgguuacccuaacacuaacauagacuguuuaauaccccaagaauggguucaacauuuuuaccaagaaggagcuccagcaagaacagauguagcacuacuucgauuuguuaacccagauaccggacgaguauuauuugaaugcaaacuacauaaacacggauucauuacaguagcauacucugguaaucaugaccuagucaugccucccaacggauacuuuagauucgaaucauggguaaaucaauuucauacuuuagcaccaaugggaacaggauccggaagaagaagaauacaguaa

SEQ ID NO: 32499 - RNA, 1644 nt, Artificial Sequence
  derived and/or modified sequence opt6 from capsid_protein__Norovirus__ACC69023
augaaaauggcaucaaaugacgcaccaccaucuacagacggaucagcuggcuuaguuccagaaguuaauaaugaaacaauggcuuuagaaccuguaguaggugcaccacuagcugcaccaguagcaggacaacauaauauaauagaccccuggauaaaaaugaauuuuguucaagcaccaaacggagaauuuacaguuucaccaagaaacgccccaggcgaaauuuuauuagauuuagaacuaggcccagauuuaaacccauauuuaucacauuuagcaagaauguauaacggauacgcuggaggaauggaagcacaaguuguauuagcaggaaacgcauucacugcaggaaaaaucauauuugcagcuguaccaccaaauuuuccagcugaaaacuuaucagcugcacaaguuaccaugugcccccauguaaucguugauguaagacaguuagaaccugucauguuaccaaugccagauauaagaaauaaacuauuucacuauaaccaaguagaugauccaaaauuaagauuauuagcuuaucuauauacaccucuaagagcuaauaacgccggagacgacguuuuuaccguuucuuguagaguacucacacgaccaacaccugauuucgaauuuauguuucuagucccuccaacaguagaaucaaaaacaaaaccauucucauuaccggguuuaacacuagaugaauuaucaaacucccgauuuccagcacccauaguacaauuauacacaaauccacaugauaauuuaguaguacaaccacaaaacggucgaugcacaauugacggccuccuacaaggaacaacucaauuaguaucaugcaauguaugcucuuacagaggaacaauaggaggaggucaaccagcaucucauacagaagaagaaauuaugcccauggcauuuaacauucaaagagaaauaauguuagaaaaucuagacggauccccauaugauccaguagaugauauaccagcaguacuaggaucaccagacuuucaaggaguaguauuuggaauacuaucccaacgaaaugcaaacggucagaccagagcacaugaagcaaaaguagauacaagagcagcaagauuugcaccaaaacuaggauucguuguagccacagucgaaucaacagauuuucaugacaaucaaccaucacguuuugcaccaguaggauuagguggaaauggcaaccaagauuucaaucaaugggcucucccagcauacggcggagcacucacaaauaacacaaaucuugcaccaccaguaaugccuguauauccaggggaacaauuauuauuuuuucgaucucaacuaccaucaucaggaggaguaguuggagguugguuagacuguuuacuaccucaagaauggguacaacauuuuuuucaagaauccgcuacaucacaaagugacguagcucuaguaagauauauuaauccaacaacaggcagaguauuauuugaagcuaaauuacauaaacaaggauucuuaaccguagccgcaucaggaaguuacccacuugucguaccagccgauggcuauuuccgauuugaaucuuggguaaaucaauuuuacacacuagcacccaugggaaacgguuccggaagaagaagagcaagauaa

SEQ ID NO: 32500 - RNA, 1644 nt, Artificial Sequence
  derived and/or modified sequence opt6 from capsid_protein__Norovirus__ACC69026
augaaaauggcuucuaaugaugcaccgccaucaacagauggaucagcaggacuuguaccagaaguaaauaaugaaacuauggcucuagaaccaguagucggcgcuccccuugcagcaccaguugcaggacaacauaauauuauugacccuuggauuaaaaugaacuuuguccaagcuccaaacggugaauuuaccguaucaccucgaaaugcaccuggagaaauauuacucgauuuagaauuagguccugauuuaaauccuuauuuaucacacuuagcaagaauguauaacggauacgccggaggaauggaaguacaagucguauuagccggaaaugcuuucacagcagggaaaaucauauuugccgcaguacccccaaauuuuccagcagagaauuuaucagcagcucaaguuacaauguguccacacguuauaguagauguuagacaauuagaaccaguuauguuaccaaugccugauaucagaaauaaacuuuuccauuauaaccaaguagacgauccaaaauuacgccuacuagcauacuuauauacaccucuaagagcaaauaacgcaggugacgaugucuucacagucucauguagaguuuuaacaagaccuacaccagauuuugaauucauguuuuuaguaccuccaacaguugaaagcaaaacaaaaccauucagcuuacccggcuuaaccuuagaugaacucucaaacucuagauuuccugcaccaauaguacaauuauacaccaauccacaugauaauuuaguaguucaaccacaaaacgggcgauguacaauagauggauuauuacaaggaacaacacaacuuguaucuuguaacguauguaguuucagaggaacaauaggaggaggucaaccagcaucacauuccgaagaagaaauuaugccuauggcuuuuaauauacaaagagaaaucauguuagaaaaccucgacggaucaccauaugacccagcagaugauauaccagcaguccuaggaucaccagacuuucaaggaguuguauuugguauacuaucccaaagaaaugccucaggacaaacacgugcacacgaagcuaaaguagauacuagagcagcaagauuugcuccuaaacuuggauucguuguagcaaccguagaaucaacagacuuccaugacaaucaaccaucaagauuuaccccaguuggacuuggaggaaauggaaaccaagauuucaaucaaugggcccuaccagcauacggcggagcacuaacuaauaacacaaaucuagcuccaccaguaaugccaguauauccaggagaacaguuacuauuuuuucgaagucaacuuccaucaucaggagguguagucggagguugguuagauugcuuacuaccccaagaauggguccaacauuuuuuccaagaaucagccacaucacaaucagauguugcauuaguuagauacauaaauccaaccacuggaagaguauuauuugaagcaaaacuucauaaacaagguuuucuaacaguugcugcuucugguucauacccccuaguaguaccagcagauggauauuucagauuugaaucauggguaaaucaauuuuauacacuugcaccaaugggcaauggaaguggaagacgaagagcucgauaa

SEQ ID NO: 32501 - RNA, 1671 nt, Artificial Sequence
  derived and/or modified sequence opt6 from capsid_protein__Norovirus__ACC69028
augaaaauggcuucuaacgauguagcugcaccaaguacagauggauccgcuggcuuaguaccugaaguaaauaaugaaacuauggcauuagaaccaguagccggagccgcucuagcugcaccgguaguaggacaacacaaugucauugauccauggauaagagguaacuuuguucaagcaccaaacggugaauuuacaguaucaccaagaaauagcccaggagaaguauuauuaaauuuagaacuuggcccugaauuaaacccauauuuagcucaucuugcuagaauguacaacggauacgcaggaggaauggaaguacaaguaguauuagcaggaaaugcauucgccgcaggaaaaauaauauuugcugcaguaccaccaucauucccuguagaugcucuaucugcaccaacaauaaccauguguccccacguaauagucgacguacgccaauuagaaccuguccuacuacccaugccagaugucagaaauaauuucuuucauuauaaucaaaguagugacccaaagcuaagacugguugcaaugcuauacaccccauuaagagcuaauagucccacugacgaugucuucaccguaucauguagaguuuuaacaagaccaaguccagacuucgaauuuacauuuuuaauaccuccuacaguggaaucaaaauccaaaccauuaacaauaccacaacuaacauuauccgaauuaucaaauagccgauuucccgcaccaauagauaugcuaaauacaucacccaaugacaacauuguaguccaaccucaaaauggucgauguacccuagacggagaauuacaagguacaacucaauuacaaccaucauuaauuugcucuuuuagaggaguuguacuaaaugaaacaucaagaauggcuguagacuaugaagaagaagaagaaguccaacgaccacaagcuagagcauuuaaucaugaauaccaucuacaauuacaaaacuuagacggaacugauuacgacccagcuggagauuuaccagccacuuuaggagcaccggacuuuguaggaacaguuuaugguguaguaucacaaagaacaacucgagauucggcagcccgugcucacgaagcuaaaaucauuacgaaugauccacgauacgcaccgaaacuaggaucaguagaauucguuacagaaucaacagacauaguaauaaacgaccaaacuaaauuuacaccagucggacuugcucauaaccgagcuguagauuauaaacaaugggaauuaccacauuacgcuggugaacuaacagcaaauacaaaccuagcuccaccaguagcuccaguauauccgggagaacaacuccuauuuuuuagaucaaaccuaccauuagcuggagguacagcagcaucaguacuagacuaucuccuuccacaagaauggauacaacacuucuaucaagaaucuuucacaccacaaagcgacauagcacuacuaagauauguaaauccagacacaggaagaguauuauuugaagcaaaauuacauagacaaggcuauauaacaguagcaggcgcaggaacaucaccaguagcaguuccaccaaacggauauuuuagauuugaaucuuggguaucacaauuuuaugcacuagcaccaauggguucaggaaccggacgaagaagaaaucaauag

SEQ ID NO: 32502 - RNA, 1626 nt, Artificial Sequence
  derived and/or modified sequence opt6 from capsid_protein__Norovirus__ACC96732
augggaaugucugacggagcagcacccaaagcaaauggaucggaagcaucaggucaagacuuaguaccuacagcugucgaacaagcaguuccuauacaaccaguagcaggagcugcacuugcagcaccagcagcaggacaaaucaaucaaauagauccauggauauuccaaaacuuuguucaauguccacuaggagaauuuaguauaagcccuagaaauacuccuggugaaauauuauuugaccucgcuuuaggaccaggacuuaacccauacuuagcacacuuauccgcaauguacacagguuggguuggcaacauggaaguucaauuaguacuagcuggcaacgcuuuuacagcuggaaaaguagucguagcuuuaguaccaccauacuuccccaaaggaucucuaacuacagcacaaauaaccuguuuuccucacguaaugugugacguaagaacccuagaaccuauacaacuuccacuauuagauguaagaagaguacuauggcaugcaacacaagaccaagaagaaucaaugcguuuaguuugcaugcuauauacaccauuaagaacaaacucaccaggagaugaaaguuucguaguaucaggucgucuacuaucgaaaccagcagccgacuucaacuuuguuuauuuaacaccaccaauagaaagaacaauauauagaaugguagaucuaccaguaauacaaccuagauuauguacuagagcacgguggccagcaccaguauacggacuauuaguagauccaucauuaccaucaaauccucaauggcaaaauggaagaguucacguagauggaacacuacuaggaacaacacccauaagcgguucguggguaaguuguuuugcagcugaagcagcauaugaauucagaucaggaacaggagaagaaguaacauuuacuuuaauagaacaagacggauccgcauauguaccuggugaucgagccgcaccccucggauacccagacuuuaguggacaauuagaaauugaaguacaaacagaaacaaccaaaacaggagauaaacucaaaguuaccacauucgagaugauacuaggaccacguacaaacguagaccaagccccauaucaaggaagagcauacgcaagcguuaacgcaacugcaucauuaaauuuagucgauggaagaguuagagcuguaccaagauccauacauucauuucaagauguuauuccagaauauaaugauggacuacuuguuccacuugcaccaccaauaggaccauuucuaccaagugaaguccuucuacgauuuagaacuuauaugagacagauagauacagcagaugccgcagcagaagcaauagacugugcacuaccucaagaauuuguauccugguucgcaucaaaugccuuuacuguacaaucagaagcuuugcuauuaagauauagaaauacacuaacaggacaacuucuauuugaauguaaacuauacuccgaaggauauauagcacuaucuuauuccgggucaggaccauuaaccuucccuaccgacgguuuuuuugaaguaguaucauggguaccaagacuuuaucaacuggcuagcguaggaucauuagcaaccgguagaacucuuaaacaauaa

SEQ ID NO: 32503 - RNA, 1626 nt, Artificial Sequence
  derived and/or modified sequence opt6 from capsid_protein__Norovirus__ACC96735
augagaaugagugacggagcugccccaaaagcaaacggaucagaagcaucaggacaagaccuuguacccacugcaguagaacaagcaguaccuauacaacccguagcaggagcagcuuuagcagcaccugcugcgggucaaauaaaccaaauagacccauggauauuucaaaacuuuguacaaugcccucuaggugaauuuucuauaucccccagaaauacaccaggagaaauacuauuugaccuagcacuaggaccaggacuuaauccauauuuagcucaucucucagccauguacacaggauggguaggaaacauggaaguacaauuaguucuagcaggcaaugcauucacagcaggaaaagucguaguagcauuaguaccuccauauuucccaagagguucauuaacuacuacccaaauaacuuguuuuccacacguaaugugcgacguaaggacuuuagaaccaauacaacuuccacuauuagauguacguagagucuuauggcaugcaacacaagaucaagaagaaucaaugagacuugucuguaugcucuauacaccucuucgaacaaauucuccaggagaugaaucauucguaguaucuggacgauuauuaucuaaaccagccgcagauuucaauuuuguuuaucuaacuccucccaucgaaagaacaauauacagaaugguugaucuaccaguuguucaaccaagauuauguacacaugccagauggccagcaccaauauauggccuacuuguugauccaagcuuacccucaaauccccaauggcaaaauggaagaguacauguugauggaacacuauuaggcacaacaccaauaucgggaucuuggguaucuugcuuugcagcagaagcugcuuaugaauuucaaucuggaaccggagaaguggcaacauuuacguuaauagaacaagauggaucugcauaugucccaggugacagagcagccccuuuaggcuacccagacuucucaggacaacuagaaauagaaguucaaacugaaacuacaaaaacaggagauaaacuaaaagucacaacauuugaaaugauucucggaccagaaacuaaugaagaccaagccccauaucaagggcgaguauucgcuaguauaucagcagcagcuucacuagauuuaguugauggaagagucagagcuguaccuagaucaauauauggauuucaagacguaauaccagaauauaaugacggacuccuaguuccuuuagcuccaccaauaggaccauuuuuaccaggagaaguauuacuaagauuuagaacauacaugcgucaaguagauacucaagaugcugcagcagaagcaauugauugcgcacuaccacaagaauuuguuucaugguuugcaaguaaugcuuucacuguacaaucagaagcccuauuauuacgauauagaaacacacuaacaggacaauuacuauuugaaugcaaauuauauagcgaagguuauauagcauuaucauauucaggaccaggaccacuaacauuucccaguaauggauucuucgaaguaguauccuggguaccaagauuauaccaauuagcaucaguaggaaguuuagcaacuggacgaacauuaaaacaauaa

SEQ ID NO: 32504 - RNA, 1623 nt, Artificial Sequence
  derived and/or modified sequence opt6 from capsid_protein__Norovirus__ACF41177
augaaaauggcauccaaugaugcaaacccuucagauggaucaaccgcuaauuuaguacccgaaguaaacaaugaaguaauggcauuagaaccaguaguaggagcagcaauagcagcaccaguagcuggacaacagaauguaauagacccuuggauaaggaauaacuuuguacaagcaccaggcggagaauuuacagucuccccacgaaaugcuccaggagaaauacuuuggucagcaccauuaggaccagaucuaaauccauacuuaucacauuuagccagaauguauaauggauaugcaggagguuucgaaguacaaguaauacucgcaggaaacgcauuuacagcaggaaaaauaauauucgcagcaguaccaccaaauuuuccaacugaaggacuaucaccaagccaaguaaccauguuuccacacauaauaguagacguaagacaacuagaaccagucuuaauuccacuacccgauguacguaauaauuuuuaucacuauaaucaaaguaacgacucuacuauaaaguuaauagcaaugcuuuauacuccauuaagagcaaauaaugcuggcgacgauguauuuacaguauccuguagaguccuaacaagaccaucaccagacuuugauuuuauauuucuuguaccaccaacaguagaaucuagaacaaaaccauucacagucccaauauuaacaguagaagagaugacaaacucaagauuuccaauuccucucgaaaaacuauucacuggaccuucaucagcauucguaguacaaccacaaaacgguagauguacuaccgacggcguauuacuaggaaccacacaauuaucaccagucaacauaugcucauucagaggagauguuacacauauaccaggaacacgaacauacagaaugaauuuagcaucucaaaacuggaacaauuacgauccaacagaagaaauucccgcaccauuagguacaccagacuuuguuggaaaaauccaaggaaugcuaacacaaacaacaaaaggagacggaucaacucgaggacauaaagcaacaguauccacuggauccguugauuuuaccccuaaauuaggcucaguacaauucgcgacagacacagauaaugauuucgaaacaggccaaaacacaagauuuacaccagucgguguaauacaagacggaucaucaacccaccgaaacgaaccacaacaguggguacucccugacuauuccggucgaacaguacacaacguacaucuagcaccagcaguagcaccaacauuuccuggagaacaacuacuuuuuuuucguucaacaaugcccgguuguaguggauacccaaacauggaucuugauugucuccucccucaagaauggguacaacauuucuaucaagaagcagccccaucacaaucugauguagcucuacuaagauuuguaaaccccgauacaggaagaguacuauuugaauguaaauuacauaaagcaggauacguaacaguagcccacacaggacaacacgaccuaguaauuccaccuaacggauacuuccgauucgacagcugggucaaccaauuuuacacacuagcgccaaugggaaauggagcaggaagaagaagggcaucauaa

SEQ ID NO: 32505 - RNA, 1623 nt, Artificial Sequence
  derived and/or modified sequence opt6 from capsid_protein__Norovirus__ACF41180
augaaaauggcuucaaaugacgcaaccccauccgauggcucaacagcaaaucuuguaccugaaguaaacaaugaagucauggcacuagaaccagucguaggagcagcaauugcagcaccgguagcaggacaacaaaauguaauagacccauggauacgaaauaauuucguacaagcaccaggcggagaauuuacaguaucaccacgaaaugcacccggagaaauauuauggucagcaccacuaggaccagaucuaaauccauauuuaucucauuuagcuagaauguauaaugguuaugcaggcgguuuugaaguccaagucauacuagcuggaaaugcauuuacagcaggaaaaauaauauuugccgcaguuccaccuaacuuccccacagaaggauuaucaccaucacaaguuacuauguuuccacauauaauaguagacgucagacaacuagaaccaguauuaauaccauuaccagauguaagaaacaauuucuaucauuauaaucaaucaaaugauccuacaauaaaguugauagcuaugcucuacacaccacuacgugcaaacaacgcaggagaugacguuuuuaccguuagcuguagaguauuaacaagaccaucaccugacuucgacuuuauauuucuaguaccaccaacagucgaaucaagaacaaagccuuuuucaguccccauauuaacaguagaagaaaugacaaauucaagauuuccaauaccuuuagaaaaauuauuuacaggaccuucuucugcauuuguaguacaaccgcaaaauggaagauguaccacagacggaguccucuuaggaacaacacaacuuuccccaguaaauauuugcacuuuucgaggcgacguuacacauauagcuggaacucaaaauuauacaaugaaucuagcuagccaaaacuggaauaauuacgaccccacagaagaaaucccggcaccccuagggacacccgacuuuguaggaaaaauacaagguguauuaacacaaacaacaaaaagagacggaagcacuagaggccacaaagcaacaguaucaacaggaucaguacauuucacaccaaaacuaggauccguacaauucucuacagauacauccaacgauuucgaaauaggccaaaauacaagauucacacccguuggaguaguacaagacggaagcacaacacaucaaaaugaaccacaacaauggguauuacccaauuauaguggacgcgacggacauaacguccauuuagcaccagcaguagcaccaacauuuccaggcgagcaacuacuuuuuuuuagaucaaccaugccaggaugcuccggauauccuaauaugaauuuagauugcuuacuaccacaagaauggguacaacauuucuaucaagaaucagcaccagcacaaagugacguugcauuacuaagauuuguuaacccugacacuggaagagcucucuuugaaugcaaauuacauaaaucuggauacguaacaguagcccacacaggccaacacgauuuaguaauuccuccaaacggauauuucagauuugauucuuggguaaaccaauuuuacacauuagcaccaaugggaaauggagcuggaagaagaagagcacuauaa

SEQ ID NO: 32506 - RNA, 1623 nt, Artificial Sequence
  derived and/or modified sequence opt6 from capsid_protein__Norovirus__ACF41181
augaaaauggcuucuaacgaugcaaauccaucagauggaucgacagcaaaccuaguaccagaaguaaauaaugaaguaauggcauuagaaccuguaguaggagcagcaauugcagcaccagucgcuggucaacaaaaugucauagacccauggauaagaaacaauuuuguacaagcuccgggcggcgaauuuacaguaucuccuagaaacgccccaggagaaauacuauggucugcaccacuugguccagacuuaaauccauaucucucacaccuagccagaauguauaacggauacgcaggcggcuucgaaguucaaguaauauuagcaggaaaugcuuucacugcuggaaaaauaauauucgccgcaguaccaccaaauuuuccaacagaaggcuuaucacccucccaaguuacaauguuuccucauauaauaguagauguuagacaacuagaaccaguacuaauaccauuaccagauguaagaaauaauuucuaucacuacaaucaaucaaaugacucaacaauuaaacuaauagcaauguuauauacaccccuuagagcuaacaaugcaggagacgauguauuuacaguaucaugccgaguauuaacccgaccuucaccagacuuugacuucauauuucuaguuccaccaacaguagaaucacgcacaaaaccuuuuacaguucccauacugacuguagaagaaaugacaaacucuagauuuccaauaccauuagaaaaauuauuuacaggcccauccuccgcauuuguaguacaaccucaaaacggacgauguacaaccgacggaguacuauuaggaacaacucaacuaucaccaguaaauaucuguaccuuccgaggagacguaacacauauaccaggaacuagaaccuaccgaaugaacuuagcaucacaaaauuggaacaauuaugauccuacagaagaaauaccagcaccucuaggaaccccagacuuuguagguaaaauacaaggaauguuaccacaaacuacaaaaggagauggcucaacacgaggacacaaagcaacuguuucaacaggaucaguagauuuuacuccuaaacucggaucuguucaauucgcaaccgauacugauaaugauuucgaaacaggccaaaauacaagauucacccccguagguguuauacaagacggaucaucuacucaccgaaaugaaccacaacaauggguacuaccugacuauucaggccgcacagucuacaacguacacuuagcaccagccgucgcaccaacuuucccaggagaacaacuacuauucuuccgaucaacuaugccagguuguucuggcuauccaaacauggaucuagauugcuuauuaccucaagaauggguacaacauuuuuaccaagaagcagccccaucucaaucagacguagcccuacucagauuuguaaauccagauacagguagaguccuuuuugaauguaaacuacacaaagcuggcuaugucacuguagcacacacuggccaacaugauuuaguaauaccuccaaauggauauuucagauucgauucauggguaaaucaauuuuacacuuuagcacccaugggcaauggagcaggucgaagaagagcauuauaa

SEQ ID NO: 32507 - RNA, 1623 nt, Artificial Sequence
  derived and/or modified sequence opt6 from capsid_protein__Norovirus__ACF41182
augaaaauggccucaaaugacgcaucaccaucagauggaucuaccgcuaaccucgucccagaaguuaacaaugagguuauggcauuagaaccaguaguaggcgccgcuauagcagcaccagucacaggccaacaaaacguuauagaccccuggauuagaaauaauuuuguacaagcaccaggcggagaauuuacagucaguccacgaaacgcaccaggagaaauacuauggucagccccauuagguccugauuuaaauccauacuuaucccacuuagcaaggauguauaacgguuaugccggaggcuucgaaguucaaguuauacuugcaggaaaugcauucacagcaggaaaaauaauuuucgcagcaguaccuccuaacuuucccacagaaggauuaucaccaucccaaguaacaauguucccacauauaauaguagacguuagacaacuagaaccuguucucauaccuuuacccgaugucagaaacaauuuuuaucacuauaaucaaucaaaugacucaacaauaaaauuaauagcaauguuauauaccccauuaagagcuaacaaugcaggugaugauguauuuaccguaucuuguagaguauuaacaagaccauccccggacuuugauuuuauauuccuaguaccaccuaccguagaaaguagaacuaaaccauuuacuguaccaauucuuacagucgaagaaaugacaaauucuagauuuccaauuccacuagaaaaauuauuuacaggcccaaguucugcauuuguaguacaaccacaaaacggaagauguacaacagacggaguacuacuaggaacuacucaauuaucaccugucaauaucugcacauuuagaggagacgucacacacauacccggaaccagaacauacagaaugaaucuagccucacaaaacuggaauaacuaugauccaaccgaagaaaucccugcaccauuaggaacaccagauuuugucggaaaaauacaaggcauguuaacacaaacaacaaaaggagauggaucaacaagaggucacaaggcaacugucucaacaggauccguagauuucacaccaaaauuaggaucagugcaauucgcaacagauaccgauaaugauuucgaaacaggacaaaauaccagauucacaccaguaggaguaauacaagauggaucaucaacacauagaaaugaaccacaacaauggguuuuacccgauuacuccggaagaacagcacauaacguacauuuagcaccagcaguagcaccaacauuuccaggagaacaacuacuauucuuuagauccacaaugccuggaugcucagguuauccaaacauggaucuagauugccuauuaccucaagaauggguacaacacuuuuaucaagaagcagcacccucccaaucagauguagcguuauuacguuucguuaacccagauacuggaagaguauuauuugaauguaaacuacacaaagcaggauauguaacuguugcccauaccggccaacacgauuuagucaucccuccaaauggauauuuccgcuuugauuccuggguuaaucaauuuuauacauuagcaccuaugggaaauggagccggaagaagaagagcauuauaa

SEQ ID NO: 32508 - RNA, 1623 nt, Artificial Sequence
  derived and/or modified sequence opt6 from capsid_protein__Norovirus__ACF41183
augaaaauggcaucaaaugaugcaucaccaucagauggauccacagcaaaucuaguaccugaaguaaacaaugaaguaauggcacucgaaccagucguuggugcugcaaucgcagcuccaguagcaggacaacaaaacguuaucgacccuuggauaagaaauaauuucguacaagcaccuggaggcgaauucacuguaucaccacgcaaugcaccuggagaaaucuuaugguccgcaccacuuggaccagacuuaaacccauaucuuucacaucuagcuagaauguacaacggauacgcaggaggauucgaaguacaaguaauauuagcugguaacgcauuuacagcuggcaaaauuauauucgcugccguaccaccaaacuuuccaacugaaggacuaucaccaucucaaguaacaauguuuccacacauaauaguagauguaagacaauuagaacccguacuuauaccauuaccugauguacgaaacaauuucuaucacuacaaccaaucuaacgauucaacaauaaaacuaauagcuaugcuauacacuccacuuagagcaaacaacgcuggagaugauguauucacaguuucauguagagucuuaacucgcccaaguccugauuucgacuucauauuucucgucccaccaacaguagaaucuagaacaaagcccuucacaguaccuauacuaacugucgaagaaaugacaaauucucgauuccccauaccccuagaaaaauuauuuacagguccuuccucagcauuuguaguccaaccacaaaacggacgauguacaacagacggcguacuuuuaggaacaacucaauuaucacccguaaauauauguacauuucgaggugacguuacacauauaccugggaccagagcauaucgaaugaaucuagcaucacaaaacuggaauaauuaugauccaacagaagaaauaccagcaccacucgguacaccugauuuuguaggaaaaauacaaggaaugcuaacccaaacaaccaaaggggacggaucaacacgcggacauaaagcaacaguaucaacuggaucaguagauuucacaccaaaacuuggcucaguacaauucgccaccgauacagacaacgauuuugaaacaggccaaaauacaagauucacaccaguaggaguaauccaagacgguaguucaacacauagaaaugaaccccaacaauggguauuaccagacuauucaggaagaacaguacauaacguucacuuagcccccgccguagcacccaccuuuccaggagaacaauuacuauucuuuagaucuacaaugccagguugcucaggauauccuaauauggaucucgauugcuuacucccccaagaauggguacaacacuucuaucaagaagcagccccaucccaaucagauguugcccuauuaagauucguaaacccagacacagguagaguauuauucgaaugcaaacuacauaaagcuggauacguaacuguagcacacaccggucaacacgaucucguaauuccuccuaaugguuacuucagauucgacuccugggucaaucaauuuuacacacucgcuccaaugggaaauggagcagguagaagacgagcauuauaa

SEQ ID NO: 32509 - RNA, 1623 nt, Artificial Sequence
  derived and/or modified sequence opt6 from capsid_protein__Norovirus__ACF41184
augaaaauggcuucaaaugaugcuaacccaucagauggaucagcagcaaacuuaguaccagaaguaaauaaugaaguaauggcauuagaacccguaguuggagcagcaauugcggccccaguagcaggacaacaaaacguuauagauccauggauaagaaauaauuuuguacaagcgccuggaggugaauuuacaguaaguccacgaaacgcaccaggugaaaucuuaugguccgcuccucuuggcccggauuuaaauccauauuuaucacaucuagcaagaauguacaauggauacgcaggaggauucgaaguccaaguaauacuugcaggaaaugcauuuacugcuggcaaaauaauauucgcagcaguuccaccaaauuuuccaacagaaggauuaucuccaucacaaguuacaauguuuccacauauuauuguagacguaagacaauuagaaccaguacuaaucccccucccagauguccgaaacaacuucuaucacuauaaucaaucaaaugauuccacuauaaaacuaauagcaauguuauacacaccacucagagccaacaaugcaggugaagauguauuuacaguaucaugcagaguacuaacucgaccuucaccagacuuugacuuuauauuucuaguacccccaacaguagaaucaagaacgaaaccuuucacaguuccaauacuagcaguagaagaaaugacaaauucacgauucccaauuccauuagaaaaacuauuuacaggaccgucuucagcauuaguuguacaaccacagaacggaagauguacuacagaugguguauuacuaggaaccacacaacuaucaccaguaaauauauguacauuuagaggagacguaacacacauagcaggaucaagaaauuacacuaugaaucuagccucacuaaacuggaauaauuaugauccaacugaagaaaucccagccccauuagguacuccagauuucguaggaaaaauacaagguguauuaacucaaaccacaaaaggugacgguucaacaagaggacauaaagccacaguauauacaggaucugcaccuuuuacaccaaaacucgguucuguacaauucggaacagauaccgaaaaugauuucgaaacacaucaaaacacaaaauuuacaccaguugguguaauccaagacgguucuacaacacacagaaacgaaccacaacaauggguucuaccaagcuacuccggaagaaauguucauaaugugcacuuagcaccagcaguagcuccaacauuuccaggagaacaauuacucuucuuucgcucuacaaugccagguuguucaggauauccaaauauggauuuagacugucuauuaccccaagaauggguacaacauuucuaucaagaagccgcuccugcacaaucagacguugcacuucucagauucguaaauccagauacagggagagucuuauuugaaugcaaauuacauaaaucaggauauguuacaguugcucacacaggacaacacgaccuaguaauuccaccaaacggauacuuucgcuucgacucaugggucaaucaauuuuauaccuuagcaccaauggguaauggaacuggcagaagacgugccuuauaa

SEQ ID NO: 32510 - RNA, 1623 nt, Artificial Sequence
  derived and/or modified sequence opt6 from capsid_protein__Norovirus__ACF41185
augaaaauggcaucuaacgaugcaaauccaucugauggaagcgcugcaaaccuagucccugaaguaaacaaugaaguaauggcauuagaaccaguaguaggagcugcaauagccgcaccagucgcaggacaacaaaauguuauagaccccuggauacgaaacaacuucguacaagcaccuggcggagaauuuacaguaucaccaagaaaugcaccaggagaaauacuuuggucugcaccuuuaggaccagacuuaaacccauaccuaucccauuuagccagaauguauaacgguuacgcaggcggauucgaaguacaaguaauucuugcuggaaacgcauuuaccgcuggaaaaaucauauucgcagccguaccaccaaacuuucccacagaaggacuaucacccucacaaguaacaauguuuccacacaucauaguugauguaagacaauuagaaccaguucucauaccauuacccgacguucgaaauaauuucuaucauuauaaccaaucaaacgauucaacaauaaaauuaauagcaaugcuauauacaccauuaagagcaaacaaugcaggagaugaugucuucacagucagcugcagaguucuaacaagacccucccccgauuuugauuuuauauuccuaguacccccaacaguugaaucaagaaccaaaccauucacaguaccaauauuaacuguagaagaaaugaccaauucuagauuuccaauacccuuagaaaaacuauucacaggaccaucaggagcuuucguaguucaaccacaaaauggucguugcacaacagacgguguauuauuagguacaacacaacuauccccaguuaauaucuguaccuuuagaggagacguaacacacauagcuggaucaagagauuacacaaugaaucucgcaagccuaaacuggaacaacuacgauccaacagaagaaauuccagcaccuuuaggaacaccugacuuugucggaaaaauacaaggaguacuuacacaaacaacuaaaggagauggaucaacaagaggacacaaagcaacagucuauacaggaucagccccauuuacaccaaaauuaggaucuguacaauuucgcacugauacagaaaacgauuucgaaacacaucaaaauacaaaauuuacaccuguaggaguaauacaagacggaucaacaacacauaggaacgaaccacaacaauggguacuacccucauacucaggaagaaacguacauaauguucaucuagcacccgccguagcaccuacauuuccaggcgaacaacuauuauuuuucagaucaacaaugcccggauguucaggauauccaaauauggaucuagauuguuuacuaccucaagaauggguacaacauuuuuaucaagaagcagccccagcacaaucagauguugcacuucuaagauucguuaacccugauacaggaagaguucuuuuugaauguaaauuacacaaaucagguuauguaacaguagcacacacaggccaacacgaucugguaauacccccuaauggauauuuccgcuuugacucaugggucaaccaauucuauacuuuagcaccuaugggaaaugguacaggaagaagaagagcacuuuaa

SEQ ID NO: 32511 - RNA, 1623 nt, Artificial Sequence
  derived and/or modified sequence opt6 from capsid_protein__Norovirus__ACF41186
augaaaauggcuucuaacgaugcaaacccaucaggcggaagugcggcaaauuuaguuccagaaguaaauaaugaaguuauggcuuuagaaccaguaguaggagccgcuauagcugcuccagucgcuggccaacaaaauguaauagaucccuggauaagaaauaauuuuguacaagccccaggaggagaauuuacaguaucaccuagaaacgccccaggcgaaauauuauggucagccccauuagguccagaucucaauccauaucucucucaccuugcuagaauguauaacggauacgcuggaggcuucgaaguacaaguaauacuugcaggaaaugcauuuacagcaggcaaaauaauauucgcagcaguuccaccuaacuuuccaacagaaggauuaucucccucacaagucacaauguucccacauauaauaguagauguaagacaacuagaaccuguacuaauuccacuacccgacguccgaaacaauuucuaucacuauaaucaaucuaaugauucaacaauuaaguuaauagcuauguuauauacaccacuaagagcgaauaacgcaggagaagacguauuuacaguaucaugccguguauuaacacgaccuucaccggauuuugauuuuauauuuuuaguuccaccuacaguagaaucucgaacuaaaccauucacaguuccuauauugaccguugaagaaaugacuaacucaagauuccccauacccuuagaaaaauuauuuacaggaccauccucagcauuuguaguacaaccacaaaacggacgauguacaacagaugguguacuccuaggaacaacucaauuaucaccaguaaauauauguacauuucgaggagacguaacucauauagcaggaagucgaaacuacacaaugaaucuagccucacuaaauuggaacaauuacgacccaacugaagaaauaccagcuccacuuggaacaccugacuuuguaggaaaaauccaaggaguacuaacccaaacaaccaaaggcgauggauccacaagaggacauaaagcuaccguuuauacaggcucugcaccuuuuacaccaaaacuaggaucaguccaauucaguacagauacagaaaacgauuuugaaacacaucaagauacaaaauuuacaccagucggagucauccaagacggcgggacaacacauagaaaugaaccacaacaauggguacuaccaucauauuccgguaggaauguacaaaacguacaccuugccccugcaguagcaccuacauuuccaggagaacaacuacuuuuuuuucgauccacaaugcccggauguagcggauauccaaacauggacuuagauugucuuuuaccacaagaauggguccagcauuuuuaccaagaagcagcccccgcacagucagauguagcucuacuacgauuuguuaacccagacacuggucgaguccuauucgaaugcaaacuacauaaaucaggauacguaacaguagcucauacaggacaacaugauuuaguuauaccaccaaacggauacuucagauuugauucauggguaaaccaauuuuauacauuagcaccuaugggaaauggcaccggacguagaagagcacuauga

SEQ ID NO: 32512 - RNA, 1623 nt, Artificial Sequence
  derived and/or modified sequence opt6 from capsid_protein__Norovirus__ACF41187
augaaaauggcaucuaaugaugcaaauccaagcgaugggucagcagccaacuuaguaccagaaguaaacaaugaaguaauggcucuagagcccguaguuggugcagcaaucgcagcaccaguagcuggccaacaaaauguaauagacccuuggauuagaaauaacuuuguacaagcaccaggaggagaauuuacaguauccccacggaacgccccaggugaaauacuauggucagcaccacuaggaccugaccuaaacccauaucuaucucacuuagcaagaauguauaacggauaugcagguggcuucgaaguccaaguaauauuagcaggaaaugcauuuacagcuggaaaaauuauuuucgcagcaguaccaccuaacuuuccaacagaaggacuaucaccaucccaagucaccauguuuccucacauaauaguagacguuagacaauuagaaccaguccuaauaccacuuccagauguaagaaauaauuucuaucauuauaaucaaucuaaugauucaacuauaaaauuaauagcaauguuauacacuccauuacgagcaaacaaugcaggagaagauguauuuacaguaucauguagaguucuaacuagaccaucaccagauuuugacuucauauuuuuaguaccaccuacaguagaaagucgaacuaaaccauucacaguaccuauacucacaguagaagaaaugacaaauucaagauucccaaucccacuugaaaagcuauuuacaggaccaucuucagcuuucguaguucaaccucaaaacggaagaugcacaaccgacggaguauuacuaggcacaacacaauuaucaccaguaaauauauguacauuuagaggagacgucacacauauugcaggaucuagaaacuacacaaugaauuuagcaucauuaaauuggaacaacuaugacccaacagaagaaaucccugcaccucucggaaccccugacuuuguaggaaaaauucgaggaguauuaacucaaaccacuaaaggagacggaucaaccagaggucacaaagcuacaguauauaccggcucagcucccuuuacuccaaaacuaggaucaguacaauucucaacugauacagaaaacgauuucgaaacacaccaaaauacuaaauuuacuccaguaggaguuauacaagacggaggaacaacacaucgaaaugaaccccaacaauggguacuaccuucuuacuccggaagaaacguaccaaacguacaccuugccccagccguugcaccaacauuuccuggcgaacaauuacuauuuuuucgaucuacaaugccaggauguucuggauacccaaacauggacuuagacugcuuacuaccucaagaauggguacaacacuuuuaccaagaagcugcaccugcucaaucagauguagcuuuauuaagauuugucaauccagacacaggaagaguauuauuugaauguaaacuacauaaauccggcuacguaacagucgcucacacuggucaacacgacuuaguaauaccaccaaaugguuacuucagauucgacucguggguaaaucaauucuacacacuagcacccaugggaaacggaacaggcagaagaagagcccuauga

SEQ ID NO: 32513 - RNA, 1623 nt, Artificial Sequence
  derived and/or modified sequence opt6 from capsid_protein__Norovirus__ACF41188
augaaaauggcaucaaacgaugcaaacccuucagauggaucugcagcaaaccuaguuccagaaguaaauaaugaaguaauggcucuagaaccaguaguaggugcagcaauagccgcaccuguugcaggacaacaaaaugucaucgauccuuggauuagaaauaauuuuguacaagccccuggaggcgaauuuacaguauccccaagaaacgcaccaggagaaauacuguggucagcuccauuaggaccagaucuuaauccauaucuaucccacuuagcuagaauguacaacggauacgcugguggauucgaaguacaaguaauucuugcagguaaugcauuuacagccggaaaaauaauuuucgcagcaguucccccuaauuuuccaacugaaggccuaucaccuucucaggucacaauguucccacauauaaucgucgauguaagacaacuagaaccuguacuaauuccauuaccagacguaagaaauaauuuuuaccauuauaaccaaucaaacgacucuacaauuaaauuaauagcaauguuauacacuccauuaagagcaaacaaugcaggagaagauguauucacaguauccuguagaguacuaacaagaccaucuccagauuuugauuucauauuuuuaguaccaccaacaguagaaucaagaacaaaacccuuuacaguaccaauacuaacaguagaagaaaugacaaacaguagauuucccauaccacuagaaaaauuauuuaccgguccaucauccgcuuucguuguacaaccacaaaacggacgaugcacaacagauggaguuuuauuaggaacaacucaauuaucaccaguaaauauauguacauucagaggugacguaacacauauagcuggaucucggaauuauacuaugaauuuagccucauuaaauuggaauaauuacgauccuacagaagaaauaccagcaccacuagguacacccgauuuuguaggaaaaauacaaggaguacuuacccaaaccacuaaaggugacggaucuacaagaggacacaaagcaacugccuauaccgguucugcacccuuuacaccaaaauuaggaucuguacaauucucaacagauacagaaaaugauuucgaaacacaccaaaacaccaaauuugcacccguaggaguaauacaagauggaggaacuacacaucgaaaugaaccucaacaauggguacuuccaagcuacucaggaagaaaugucccuaauguacacuuagcaccugcagucgcacccacuuuuccaggagaacaacuacucuucuuuagaucuacaaugccaggcugcucaggauaccccaacauggauuuagauuguuuacuaccacaagaauggguacaacauuuuuaucaagaagcagcaccagcucaaucagaugucgcacucuuaagauuugucaauccugauacaggccguguccucuuugaauguaaacuacauaaaucaggauacguaacuguugcacacacaggccaacacgaucucguaauaccacccaacggauauuucagauucgacucauggguaaaucaauuuuauacuuuagcaccaaugggaaauggcacuggaagaagaagagcacuauaa

SEQ ID NO: 32514 - RNA, 1623 nt, Artificial Sequence
  derived and/or modified sequence opt6 from capsid_protein__Norovirus__ACF41190
augaaaauggcaucaaaugaugcuaauccaagcgacggaucagccgcaaaucuuguaccagaaguuaauaaugaaguuauggcacucgaaccaguaguaggagcagcaauagcugcaccaguagcuggucaacaaaaugucauagacccuuggauaagaaauaacuuuguacaagcaccaggaggcgaauuuacaguuucacccagaaaugcuccaggagaaauauuauggucagcaccauuaggaccagaucucaaucccuauuuaucacauuuagcuagaauguacaauggauacgcaggcggauucgaaguacaaguaauacuagcaggcaaugcuuucacagccggaaaaauaauauuugcagcagucccaccaaacuucccaacugaaggauuaucaccaucacaaguaacuauguuuccucauauaauaguagacguacgucaacuagaaccuguacucauuccucuuccugauguaagaaacaacuucuaucauuauaaccaaagcaacgacucaacaauuaaacuaauagcaauguuauacacaccauuaagagcuaauaaugcaggagaagauguauuuacaguuuccugcagaguucuaaccagaccaucaccagauuucgauuuuaucuuucuaguaccaccuacaguagaaucaagaacaaaacccuucaccguaccaauucuaacaguagaagaaaugacaaauuccagauuuccuauuccauuagaaaaacuauuuacaggaccaaguucagcauucguaguacaaccccaaaacggacgcuguacuacugacggcguacuacuaggaaccacucaauuaucuccaguaaauauaugcaccuuuagaggagacguaacacauaucgcuggaucacgaaauuauacaaugaaucuugcaucacuaaacuggaacaauuaugacccaacugaagaaauaccagccccauuagguacccccgacuucguagguaaaauccaaggaguauuaacacaaaccacaaaaggagauggaucaacuagaggucacaaagcaacuguauacacaggaucagcacccuuuacaccaaaauuaggaucaguacaauucucaacagauacagaaaacgauuucgaaacucaucaaaauaccaaauucacucccguaggaguaauccaagacggaggaacuacacauagaaaugaaccucaacaauggguacucccuucauauucaggucgcaauguaccaaauguacaucucgcuccagcaguagcaccuacauuuccaggagaacaacuacuauucuuucgaucuacaaugccagguuguucagguuauccuaauauggaucuagacugucuuuuaccacaagaauggguacaacauuucuaucaagaagcagcaccugcacaaucagacguugccuuacuacgauuuguaaaucccgauacuggacguguacuauucgaauguaaacuacacaaaucaggauauguaacaguagcacacacuggucaacacgaucuaguaauaccaccaaacggauauuucagguucgacucaugggucaaucaauuuuauaccuuagcaccaaugggaaaugguacaggaagaagacgugcuuuauaa

SEQ ID NO: 32515 - RNA, 1623 nt, Artificial Sequence
  derived and/or modified sequence opt6 from capsid_protein__Norovirus__ACF41191
augaaaauggcaucaaacgaugcaaacccaucagauggauccgcagcaaaccuaguaccagaaguaaauaaugaaguaauggcacuagaacccguaguaggagcagcaaucgcagccccaguagcaggacaacaaaacguaauagauccuuggauaagaaacaauuucguacaagcuccuggaggagaauuuacagucucaccaagaaacgccccaggagaaauccuauggucagcaccacuagguccugaucuaaacccauaucuuucacaccucgcaagaauguauaacgguuacgcaggaggauuugaaguacaaguaauauuagcggguaacgcuuuuacagcagguaaaauaauauucgcagcaguaccaccuaacuuuccaacagaaggauuaucacccucucaagucacaauguucccacauauuauaguagacguuagacaacuugaaccaguacuaauuccacuaccagacguaagaaauaauuucuaccauuauaaccaaucaaaugacucuacaauaaaacucaucgcaauguuauauacaccacucagagcaaauaacgcaggagaagauguauuuaccguaucauguagaguacuuacaagaccaucacccggauuugauuuuauauuccuaguuccgcccacaguagagucacgaacaaaaccuuuuacaguaccaaucuuaacuguagaagaaaugaccaacagcagauuuccgauuccacucgaaaaacuguuuacaggaccauccucagcauucguaguacaaccacaaaaugguagauguacaacagacggcguuuuacuugguaccacacaauuaucaccaguaaacauauguacuuuucgaggagauguaacacacaucgcuggaucucgaaacuauaccaugaaucuagcuucucuuaacuggaauaauuaugauccaacugaagaaauaccagcaccacucggaacaccagacuucguaggaaaaauacaaggaguccuaacacaaacaacuaaaggugacgguucaacaagaggucacaaagccacaguauauacaggaagcgcaccauucacaccaaagcuaggaucuguacaauucuccacagauacugaaaacgauuucgaaacucaucaaaacacaaaauucacaccaguaggcguaauccaagacggaggaacaacacauagaaaugaaccccaacaauggguauuacccucauacucuggaagaaauguaccaaacguacacuuagcaccagccgucgcaccaacauucccaggagaacaacuucuauuuuuucgcucaacaaugccaggcugcucaggauacccaaacauggaccuagacugucuacucccacaagaauggguacaacauuucuaccaagaagcagcacccgcacaaucagauguagcccuauuacgauucguaaauccugacacuggaagaguacucuucgaaugcaaacuacacaaaucaggauauguuacaguagcacacacaggucaacaugaucuagucauaccaccaaauggauacuuccguuucgauucauggguuaaccaauuuuauacacuagcuccaaugggaaauggaacgggaagaagaagagcccuauag

SEQ ID NO: 32516 - RNA, 1647 nt, Artificial Sequence
  derived and/or modified sequence opt6 from capsid_protein__Norovirus__ACF60293
augaaaauggccuccaaugaugccacuccuucaaaugauggugcagcaggauuaguuccagaaauaaauaacgaagcaauggcauuagacccaguagcaggagcagcaaucgcagcaccucuuacaggucaacaaaauauaauagauccauggauaaugaacaauuucguccaagcaccggguggugaauuuacaguaucuccaagaaacucaccaggagaaguacuauuaaaucuugaacuaggaccagaaauaaauccauauuuagcucacuuagcaagaauguauaacggauaugcaggaggcuucgaaguacaaguaguauuagcuggaaaugcauuuacagcaggaaaaauuaucuuugcagcuauaccaccaaauuuuccuauagaaaaccuaucugcagcacaaauaacuaugugcccacacguaauugucgacguuagacaacuagaaccaguaaacuuaccuaugccugauguaagaaauaacuucuuucauuauaaucaaggcagugacucaaaacuacgacuugucgcaauguuauauacaccauugcgugcaaacaauucaggagaugauguauuuacagucuccugucgagugcuaacucgaccuucaccagauuuuucauucaacuuuuuaguaccuccaaccguagaaucaaaaacaaaaccauuuacacuuccaauacuaacaauaucagaaaugucaaauucucgauuuccuguaccuauagacucccuacauacaucaccaacagaaaauauagucguacaaugucaaaauggaagaguaacucuagauggcgaauuaaugggaacaacccaacuacuaccuucacaaauuugugcauuuagaggaguccuaacacgaucaaccuccagagcuucagaccaagcugauaccgcaacacccagacuauuuaacuauuacuggcacauacagcuagauaaccucaacggaacaccuuacgauccugcagaagacauaccaggaccacuuggaaccccagacuuucgcggcaaaguauuuggaguagcaagucaacgaaauccugauuccacaaccagagcacaugaagcaaaaguagacacaacugcuggaagauucacaccaaaauuaggauccuuagaaauaucaacagaaucaggugauuucgaucaaaaccaaccuacaagauucacccccguaggaauuggcgucgaccacgaagcagacuuucaacaauggucacucccagauuauagcggacaauuuacacacaauaugaauuuagcaccggccguagcaccaaauuuuccaggagaacaacuucuauucuucagaucucaauuaccuucaucagguggaagaucaaacggcauacuagacugucgaguaccucaagaauggguacaacauuucuaucaagaaucagcuccagcucaaacacaaguugccuuagucagauauguaaauccugacacaggcagaguauuauucgaagccaaauuacauaaauuaggauuuaugacaauagcaaaaaauggagauucaccaauuacagucccaccaaacgguuauuuuagauuugaaagcuggguaaauccauuuuauacauuagcaccaaugggaacuggcaauggacgaagacgcauacaauaa

SEQ ID NO: 32517 - RNA, 1647 nt, Artificial Sequence
  derived and/or modified sequence opt6 from capsid_protein__Norovirus__ACF60294
augaaaauggcaucuaaugacgcaacuccaucaaaugacggcgcugcaggcuuaguuccagaaauaaacaaugaagcaauggcauuagaccccguugcaggagcagcaauagcagcaccccuaacuggucaacagaauauaaucgauccauggauaaugaauaauuucguucaagcaccagguggagaauuuacuguaucaccaagaaacucaccaggagaaguauuacucaacuuagaacuuggaccagaaauaaauccauauuuagcacaccuagcaagaauguauaauggauacgcaggaggauucgaaguacaaguaguacuagcuggaaaugcauucacagcaggaaaaauaauuuuugcagcuauuccaccaaacuucccaauugacaaccuuucagcugcacaaauuacaaugugcccacacguuauuguagauguaagacaauuagaaccaguaaaccuaccuaugccagauguacguaauaauuucuuccacuauaaucaaggcagugauucaagauuacgucuuguagcaaugcuauacaccccucuacgagccaacaauucuggagaugaugucuuuacaguaucauguagaguucugacuagaccaucuccagacuuuuccuucaacuuucuaguaccaccuaccguagaaucaaaaaccaaaccauuuacccuaccuauauuaacaaucucagaaaugucaaauucacgauucccaguaccaauagacucacugcauacaucuccuacugaaaauauaguaguacaaugucaaaacggacgaguaacacuagauggagaauuaauggguacaacacaauuacuaccaucacaaauaugugcuuucagagguguucucacaagaaguacuucacgagccucagaucaagcagauaccgcaaccccaagacucuucaauuauuacuggcauauacaauuagauaaccucaauggaacaccauacgaccccgcugaagacauaccaggaccauuaggaaccccugacuuuagaggaaaaguauucggaguagcaucacagagaaacccugacucaaccacacgcgcacaugaagcaaaaguagauaccacugcuggaagauucacaccaaaauuagguucucuagaaauuucuacugaaucaggugacuucgaucaaaaucaaccaacacguuuuacaccagucggaaucggaguugaucaugaagcagacuuccaacaauggucauuaccugauuacuccggacaauucacacacaacaugaaucuagcaccagcuguagcacccaacuuuccuggugaacaauuauuauucuuuagaucacaacuaccaucaucaggcggacgauccaacggaauacuugacugccuaguaccacaagaauggguacaacauuucuaccaagaaucugcaccagcacaaacucaaguagccuuaguaagauaugucaacccagauacagguagaguauuauuugaagcaaaacuacauaaacuaggauuuaugacaauagccaaaaacggagacucacccauaacaguaccuccaaaugguuauuucagauuugaaucuuggguaaaucccuucuauacacuagccccuaugggcacuggaaauggaagaagacgaauccaauaa

SEQ ID NO: 32518 - RNA, 1647 nt, Artificial Sequence
  derived and/or modified sequence opt6 from capsid_protein__Norovirus__ACF60295
augaaaauggcaucaaaugaugcaacaccaaguaaugacggagcagcaggacuagucccagaaauuaauaaugaagcaauggcgcuagauccaguagcaggagcggcaauagcagcaccucuuacuggacaacaaaauauaauagauccuuggauaaugaauaacuuuguacaagccccuggaggagaauuuacagucucaccaagaaauucuccaggugaaguaccucuaaaucucgaauuaggaccagaaauaaaccccuaucucgcccacuuagcacgaauguacaacggauacgcagguggcuucgaaguucaaguaguacuagcuggcaaugcauuuacagcaggaaaaauaauauuugcagcaauaccaccaaauuucccaacagacaaucuuucagcagcccaaauuacaauguguccgcacguaauaguagacguucgacaacuagaaccaguaaaccuaccaaugccagacguaagaaacaauuucuuucacuacaaccaagguucagacucaagauuaagacuuguugcaaugcuauacacaccccuaagagcaaacaacucaggugacgacguauuuacaguuucaugucguguauuaacuagaccaucaccagauuuuucauuuaacuuucuaguaccuccuacuguagaaucaaaaacaaaaccuuucacacuaccaauauuaacaauaucagaaaugucaaauucaagguucccaguaccaaucgacucauuacauacaucucccacagaaaauauaguaguucagugucaaaacggaagaguaacauuagauggcgaacuaauggguacuacacaauuacuaccaucacaaauaugugccuuucgaggaguccuuacccgaucaacaucaagagcaucagaucaagcagauacagcaacaccuagauuauuuaauuacuacuggcacauacaacucgacaauuuaaauggaacaccauacgacccugcagaagacauaccaggaccccuaggaacucccgacuucagaggaaaaguauucgguguagcaucacaacgaaauccugauucaacuacacgcgcccaugaagcaaaaguagauacuaccgcaggaagauuuacaccaaaacuaggcucccuugaaauuuccacagaaucagacgauuucgaucaaaaccaaccaacacguuucacuccugucggaauugguguagaucacgaagcagauuuucaacaauggucauuaccugacuauucaggccaauuuacacacaauaugaacuuagcaccagcaguagcaccaaauuucccuggugaacaauuacuauucuuucgaucacaacuaccaucuucaggaggaaggucaaaugguauacuagauuguuuaguaccacaagaauggguacagcacuuuuaccaagaaagcgcaccagcacaaacccaaguagcauuaguaagauauguaaaccccgacacuggaagagucuuauucgaagccaaacugcauaaacuagguuuuaugacaauagcaaaaaauggugacaguccaauaacaguaccaccaaauggauacuuuagauuugaaucauggguaaacccauuuuacacacuagcaccaaugggaacaggaaaugguagaagaagaauacaauaa

SEQ ID NO: 32519 - RNA, 1647 nt, Artificial Sequence
  derived and/or modified sequence opt6 from capsid_protein__Norovirus__ACF60296
augaaaauggcaucaaaugaugcuaccccaucaaacgauggagcagcaggccucguaccagaaauaaauaaugaagcaauggccuuagacccuguagcuggagcagcaauagcagcaccauuaacaggucaacaaaacaucauagaccccuggauaaugaacaacuuuguacaagcacccggaggagaauuuacuguaucuccaagaaacucaccaggagaaguauuauuaaaccucgaacuuggccccgaaauuaaucccuauuuagcacaucuagcaagaauguacaaugguuaugcaggggguuuugaaguucaaguaguccuagcaggaaacgcauucacugcuggaaaaauaauauucgcagcaauacccccaaacuucccuauagauaauuuaucagcagcacaaauaacuaugugcccacauguaaucguagauguccgccaacuagaaccaguaaacuuaccuaugccagacguaagaaauaacuucuuucauuacaaccaagguucagacucacgauuacgauuaguagcaaugcuauacacccccuuaagagcuaacaacaguggagaugauguauuuaccguaucuuguagaguuuuaacaagaccaucaccugacuuuucuuucaauuuucuagucccaccuacuguagaaucaaaaaccaaaccuuuuaccuuaccaauauuaaccauaucugaaaugucuaauucuagauucccaguaccuauagauucacuacauacuucucccacugaaaacauaguaguccaaugccaaaauggacgcguaacauuagacggagaacuaaugggcacuacccaauuauuaccaucacaaauaugugccuuuagaggaguacuaacacgauccacaucaagagcaucagaucaagcagacacagcuacaccccgauuauucaauuacuacuggcacauucaacuagacaacuuaaaugguacuccuuaugacccagcagaagauauaccuggaccauuaggaacuccagauuuuagaggaaaaguauuuggaguagcaucgcaaagaaacccagauucaacaacacgagcacaugaagcaaaaguagauacaacagcaggaagauucacaccaaaacucggaucacuggaaauaucaacagaaucagaugacuucgaccaaaaccaaccuacuagauucacaccaguaggaauaggcgucgaucacgaagcagacuuucaacaguggucauuaccagacuacucaggacaauucacucauaauaugaauuuagcgccagcggucgcaccaaauuuuccaggcgaacaauuauuguuuuuuagaucacaacuaccaucaaguggaggaagaucuaauggaauacuagacuguuuaguuccacaagaauggguacaacacuuuuaccaagaaucagcacccgcacaaacacaagucgcuuuaguaagauauguuaauccagauacaggaagaguacuuuuugaagcaaaacuacauaaacuuggauuuaugaccaucgcaaaaaauggagauucaccaauuaccguuccaccaaaugguuauuuccgauucgaaagcuggguaaacccauuuuauacacuagcuccaaugggaaccggcaacgguagacgaagaauacaauaa

SEQ ID NO: 32520 - RNA, 1647 nt, Artificial Sequence
  derived and/or modified sequence opt6 from capsid_protein__Norovirus__ACF60297
augaaaauggcaucaaaugacgcaacaccaucaaacgauggcgccgccggacuuguuccagaaauaaauaacgaagcaauggcauuagacccaguugccggagccgcaauugcagcaccucucaccggacaacaaaauauaauagauccauggauaaugaauaauuuuguacaagcaccagguggagaauuuacaguuuccccaagaaauucccccggagaaguauuauuaaauuuagaacuuggcccagaaaucaacccuuacuuagcacacuuagcaagaauguacaacggcuacgcuggaggauucgaaguucaaguagucuuagcuggaaaugcauuuacagcagguaaaauuauauucgcagcuauaccaccaaacuuuccuaucgauaauuuaucugcagcacaaauaacaauguguccacauguaauaguagacguaagacaacuagaaccaguaaaucuacccaugccugauguaagaaacaacuuuuuucauuacaaucaaggaucagacucaagacuaagauuaguagcaaugcuauacacaccccuaagagcaaacaacuccggagaugauguauuuacaguuucaugucgaguccuuacaagaccaucaccugacuuuucauucaauuuucuuguaccaccuacuguagaaucuaaaacaaaaccauuuacauuaccaauacuuacuauauccgaaaugucaaacucaagauucccagucccaauagacucauuauauacaucaccaacagaaaauauaguaguccaaugucaaaacgguagagucacucuugauggagaauuaguaggcacuacucaauuauuacccucacaaauaugugcauuccgaggaguauuaaccagaucaacuucucgcgcaucagaucaagcagauacagcaacaccacgucuauucaacuacuauuggcacauacaacuagacaauuugaacggaacaccauaugauccugcugaggauauaccuggaccucuuggaacaccugauuuccgaggaaaaguauuuggcguugcuucacaacgaaauccugacuccacuacacgugcccaugaagcaaaagucgauaccacagcaggcagauucacccccaaacuuggaagucuagaaauaucuacagaguccggagauuuugaucaaaaccaaccaacaagauuuacaccuguaggaauuggaguugaucaugaagcagauuuucaacaauggucauuacccgacuauucaggucaauuuacacacaauaugaauuuagcacccgcagucgcaccuaauuuuccaggcgaacaauuauuauuuuuccgaagucaauuaccaucuucaggaggacguuccaauggaauauuagacugcuuaguaccacaagaauggguacaacauuucuaucaagaaucagcaccagcucaaacacaagucgcauuagucagauacguaaauccugauacagguagagucuuauucgaagccaaacuccauaaacuagguuuuaugacaauugcaaaaaauggagacuccccaaucaccgucccuccuaacggcuauuuuagauucgaaagcugggugaacccauuuuacacauuagcucccaugggcacaggaaauggaagaagacguauacaauaa

SEQ ID NO: 32521 - RNA, 1626 nt, Artificial Sequence
  derived and/or modified sequence opt6 from capsid_protein__Norovirus__ACF72688
augagaaugagugauggagcagcaccuaaagcaaauggaucagaagcaucuggccaagacuuaguaccaacagcuguagaacaagcaguaccuauucaaccaguagccggagcagcauuagcagcuccagccgcaggucaaauaaaccaaauagauccauggauauuccaaaacuucguucaauguccucuuggugaauuuucuauaucaccaagaaauaccccuggugaaauuuuauuugacuuagcacucggaccuggacucaauccuuacuuagcacacuuauccgcuauguauacaggguggguaggcaacauggaaguucagcuaguccuagcugguaaugcauuuacagcaggaaaaguuguaguagcacuagucccuccauauuuuucaaaaggaagucuaacuacagcacagauuacauguuuuccacaugucaugugcgauguacguacacuugaaccaauacaauuaccacuauuagauguaagaagaguauuauggcaugcaacucaagaucaagaagaaucuaugagacugguuugcaugcuuuauacuccauuaagaacaaacagcccaggagacgaauccuuuguugucucaggaagacuauuaucuaaaccagcuccugauuuuaauuuuguuuaucuuacaccaccaauugaaagaacaauuuauagaaugguagaucuaccacuauuacaaccucgacuauguacacaugcaagauggccagcaccaguauauggcuuauuaguagauccaucauuaccaucuaacccacaauggcaaaacggucguguacacgucgauggcacauuauuaggaacaacuccaguaucagguucaugggucucuuguuuugcugcagaagcagcauacgaauuccaaucugguauaggagaaguuguaacauuuacaaugauagaacaagauggaucagcauacguaccaggagacagagcugcaccacuaggauauccagauuucucaggacaauuagaaauugaaguacaaacagaaacaacaaaaacaggagauaaacuuaaaguuacaacauuugagaugauucuagguccaacaacaaauguagaucaagcaccauaucaagguagagcuuacgcgucacuaacagcuauggcuucacuagauuugguugauggaagaguuagagcaguaccccgaucaauauauucuuuucaagaugaauuaccagaauauaaugaugguuuauuaguaccacuagcaccaccccucggaccauuucuaccaggagaaguauuacuaagauuuagaacauauaugcgacaauuagacaccgcagaugcagcagcacaaccaaucgauugcgcacuaccacaagaauuuaucucaugguuugcuucuaauaauuuuacaguacaaucagaugcauuacuaguucgauauagaaacacauuaacaggccaauuauuguucgaagcuaaauuauauucugaaggauacauagcagucucuuauucaggaucaggaccacuaacauuuccuacagauggauuuuuugaagucgucucuuggguaccaagauuauuucaacuagcaucuguagguucccuagcaacaggaagaacacuaaaacaauaa

SEQ ID NO: 32522 - RNA, 1623 nt, Artificial Sequence
  derived and/or modified sequence opt6 from capsid_protein__Norovirus__ACH42093
augaaaauggcauccaaugacgcaacccccucagauggcucaacagccaaucuaguaccagaaguaaauaaugaaguuauggcacuagaaccgguagucggcgccgccauagcagcaccaguagcuggccaacaaaauguaauagacccauggauaagaaacaauuucguacaagcaccaggaggagaauucacaguaaguccacgaaaugccccuggagaaauauuauggucagcaccacuaggaccagaucucaauccauaccuaucacauuuagccagaauguacaacggauaugcuggagguuuugaaguacaaguuauacuagcaggcaaugcuuuuacagcaggaaaaauaauauuugcagcaguaccaccuaauuuccccacagaaggccuaucaccaucacaagucaccauguucccacauauaaucguagacguaagacaacuagaaccuguacuaauaccuuuaccagauguucgaaauaauuucuaccacuauaaccaaucuaacgauccaacaaucaaauuaauagcuauguuauacacaccucuuagagcuaacaaugcaggagaugaugucuucaccguuucauguagagucuuaacaagaccaucaccagauuuugacuuuaucuuccuuguaccaccaacaguagaaucaagaacaaaaccauucucuguaccaauacucaccguagaagaaaugacuaauucucgauucccaauuccacuagaaaaacuuuuuacaggaccaucaucagcauucguuguccaaccacaaaacggaagauguacaacugauggcguacuacuaggaaccacacaacucucaccuguaaacauaugcaccuucagaggcgacguaacacauauagcaggaacacaaaauuacacuaugaaucucgcuucacaaaacuggaacaauuacgauccaacagaagaaauaccugccccauuaggaacaccugauuuuguaggaaaaauacaaggagucuuaacacaaacaacuagaagagaugguucuacgcgaggucauaaagcaaccguaucuacaggaucaguccauuucaccccaaaauuaggaucuguacaauucucaacagauaccucuaacgacuuugaaacaggacaaaacacaaaauucacaccagucggaguuguacaagauggaucaacaacacaucaaaacgaaccccaacaauggguauuacccgauuauucaggacgagacucucacaauguccaucuagcuccugcaguagcaccaacauucccaggagaacaacuauuauucuuuagaucuacuaugccaggauguucaggauauccaaacaugaaucuugauugccuacuaccacaagaauggguacaacauuucuaccaagaaagcgccccugcucaaucagacgucgcacuacuacguuuuguaaaccccgacacugguagaguacuuuucgaauguaaacuucacaaaucaggauacguaacaguagcccacacaggacaacaugaucuugucauaccacccaacggauauuuccguuuugauucauggguaaaccaauuuuacacucuagcaccaaugggaaauggagcaggcagacgaagagcauuauaa

SEQ ID NO: 32523 - RNA, 1623 nt, Artificial Sequence
  derived and/or modified sequence opt6 from capsid_protein__Norovirus__ACH42094
augaaaauggcuaguaacgaugcuacaccaucugacggauccacagcaaauuuaguaccagaaguaaauaacgaagucauggcucucgaaccuguaguaggugcagcaauagcagcaccugucgcuggacaacaaaauguaauagaucccuggauucguaauaacuuuguacaagccccaggcggagaauuuacaguuuccccccgaaaugcuccaggcgaaaucuuauggucagcaccacuagguccugaccuaaauccauaucuaucacauuuagcaagaauguauaauggauacgcuggagguuucgaaguacaagucauauuagcaggcaaugcauuuacagcaggaaaaauaauuuucgcugccguaccaccuaauuuuccaacagaaggucuuucaccaucucaaguuacaauguucccacacauaauaguugauguuagacaacuagaaccaguacuuauaccccuaccagauguaagaaacaauuucuaucacuauaaucaauccaaugacccuacaauaaaauuaauagcgaugcuauacacaccauuaagagcaaacaaugcaggugaugauguauuuacaguaucaugucgaguauuaacaagaccaaguccagacuucgauuuuauauuucuagucccaccaacaguagaaucucguacaaaaccauucucuguaccaauauuaacagucgaagaaaugacaaacucuagauuuccaauaccccuagaaaaacuauuuacagguccaucaucagcauucguaguacaaccacaaaauggaagauguaccacagacggcguacuucucggaacaacacaauuaucaccagucaacaucugcacuuuccguggagacguaacacauauagcaggaacacaaaauuacacaaugaaucuagcaucccaaaacuggaauaauuacgauccaacagaagaaauaccagcaccuuuagguacuccagauuucguaggaaaaauacaaggaguucucacacaaacuacuagaagggauggaucuacuagaggacacaaagcaacuguaucaacaggcagcguucacuuuaccccuaaauuaggaucuguacaauuuucaacagauacaucgaacgauuucgaaacaggucaaaacacacgcuuuacaccaguaggagucguacaagacggaucaaccacacaucaaaacgaaccccaacaauggguuuuaccagacuacucaggucgugacucacacaacgugcaccuagcaccugcaguagcucccacuuucccaggagaacaacuacuauucuuuagaucaaccaugccaggauguucaggauauccuaauaugaaucuagacugucuucuaccacaagaauggguacaacauuuuuaccaagaaucugcucccgcacaaucugacguagcauuauuacguuucguaaacccagacaccggacgaguacuauucgaaugcaaauuacacaaaucuggauacguaaccguagcacauacuggacaacacgacuuaguaauaccccccaacggauacuucagauuugacagcugggucaaucaauuuuacacucuagcuccaaugggaaauggcgcaggaagaagaagagcacuuuaa

SEQ ID NO: 32524 - RNA, 1623 nt, Artificial Sequence
  derived and/or modified sequence opt6 from capsid_protein__Norovirus__ACH42096
augaaaauggcaucaaaugacgccacaccaucagauggaucuacagcuaacuuaguaccugaaguuaacaaugaaguuauggcacuagaaccaguaguaggagcagcaauagcagcaccaguugcuggucaacaaaauguaauagacccauggauaagaaauaauuuuguacaagcuccaggaggagaauuuacaguaucuccaagaaaugcaccuggugaaauacucuggucagcaccccuaggaccagacuuaaauccauaccuaagucaccuggcaagaauguauaacggauacgcaggaggauuugaaguacaaguaauuuuagcaggcaaugcauuuacagcaggaaaaauaauuuucgcagcagucccuccaaauuuuccaacugaaggcuuaucaccaagucaaguuacaauguucccacacauaauaguagauguacgacaauuagaaccaguauuaauuccacuaccggauguacgcaacaacuucuaucacuauaaucaaucuaaugauccaacuauaaaacuaauagcaaugcuuuacacccccuuaagagcuaauaaugcaggugaugacguauucacggucucauguagaguacucacaagaccaucaccugacuuugacuuuauauuuuuaguaccaccaacaguagaaucacgcacuaaacccuuuucaguaccaauacuuacuguagaagaaaugacaaacucaagauucccuauaccacuagaaaaacuauuuacuggcccaaguucagcauucguaguacaaccacaaaacggaagauguaccaccgauggaguacuucuaggaacaacacaauuauccccuguaaauaucuguacauuuagaggagauguaacacauauagcaggaacucaaaauuacacaaugaaccuagcuucacaaaacuggaauaauuacgauccaacagaagaaauacccgcuccccuaggaacaccugacuuuguagguaaaauacaagguguccuaacacaaaccacaagaagagauggcucaacaagaggacauaaagcaaccguaucuacugguucuguucauuuuaccccaaaauuaggcucaguucaauuuucaacugacacaucaaacgauuucgaaacaggucaaaauaccagauuuacaccagucggaguaguucaagacggaucaacuacccaucaaaaugaaccacaacaauggguuuuaccagacuauucaggaagagauucacacaacguacauuuagccccugcaguagccccaaccuuccccggagaacaauuauuauuuuuccgaucaaccaugccagguuguuccgguuauccaaacaugaauuuagauuguuuauuaccacaagaauggguucaacauuucuaucaagaaucugccccugcacaaucugauguagcacuauuaagauuuguaaacccagacacaggaaggguacuauucgaaugcaaauuacauaaaucagguuacgucacaguagcacauacuggacaacacgauuuaguuauaccaccuaauggguauuuucguuucgauucaugggucaaucaauuuuauacauuagcacccaugggcaacggcgcaggaagaagaagagcauuauaa

SEQ ID NO: 32525 - RNA, 1623 nt, Artificial Sequence
  derived and/or modified sequence opt6 from capsid_protein__Norovirus__ACH42097
augaaaauggcaucaaaugacgcaacaccaucugauggcucaacugcuaaucuugugcccgaaguaaauaacgaaguuauggcacucgaaccaguaguaggagcugcaauagccgcaccugucgcuggacaacaaaauguaauugacccuuggauaagaaauaauuucguucaagcuccuggaggagaauuuacaguuucaccuagaaaugcaccuggagaaauauuauggucagcuccacucggaccagaucuuaacccauaucuuucacaccuagcaagaauguauaacggcuacgcaggaggauuugaaguacaaguaauacuagccggcaaugcauuuacagcagguaaaaucauauuugcugcaguaccuccaaacuuuccaaccgaagguuuaagucccucacaaguaacuauguucccucauauaauaguugacguuagacaacuagaaccuguauuaauuccauuaccagacguaagaaacaacuuuuaccacuauaaucaaagcaacgacccaacaauaaaauuaauagcuauguuauauacaccauuaagagcaaacaaugcaggagacgacguauuuacagucucuugccgaguauuaacaagaccaucaccagacuucgauuuuauuuuucuaguaccaccaacagucgaaucaagaaccaaaccauuuucuguaccuauauuaacaguugaagaaaugacaaacagcagguuucccauaccacuugaaaaauuauucacaggaccaucaucggcauuuguaguccaaccacaaaacggaagauguaccacagacggaguacuauuaggaacaacacaacuuucuccagucaauauauguacauucagaggugacguaacacauauagcuggaacucaaaauuauacaaugaauuuagcaucucaaaacuggaacaauuacgacccaacagaagaaauaccagcuccuuuaggaacucccgauuuugucggaaaaauacaaggaguacucacucaaacaacaagacgugacggauccacaagaggccacaaagcaacuguuucuacaggaucaguacacuuuacucccaaauuaggaucagugcaauucucaacagauacuagcaacgauuuugaaaccggacaaaacacaagauucacaccaguuggagucguucaagauggaucaacuacacaccaaaaugaaccacaacaauggguacuaccagauuauucuggcagagauucucacaacguacacuuagcaccagcgguagcaccaacauuuccaggagaacaacuacuauuuuucagaucuacaaugccaggaugcucaggauauccaaauaugaaccucgauugccucuuaccacaagaauggguccaacacuucuaucaagaaucagcuccugcucaaucugacguagcacuuuuacgcuucguaaacccugauacaggcagaguauuauuugaaugcaaacuucauaaaucuggauauguuacaguugcacacacaggccaacaugaccuaguaauaccaccaaaugguuauuuccgguuugauucauggguuaaucaauuuuacacauuagcaccaaugggaaauggagccggaagacgucgagcauuauaa

SEQ ID NO: 32526 - RNA, 1623 nt, Artificial Sequence
  derived and/or modified sequence opt6 from capsid_protein__Norovirus__ACH42098
augaaaauggcaucuaaugacgccacuccauccgacggaucuaccgcaaaccuaguuccagaagucaacaaugaagucauggcacuagaacccguagucggugcagcuauagcagcaccuguagcaggucaacaaaauguaauagacccauggauaagaaauaacuucguccaagcaccuggaggcgaauuuacuguaucuccuagaaaugcuccaggagaaauauuaugguccgccccucuaggaccagaccuaaauccauauuuaucccacuuagcacgaauguacaauggauaugcaggaggcuucgaaguacaaguuauacuagcaggaaaugccuuuacagcagguaaaauaauauucgcugcuguccccccuaacuuuccaacugaaggauuaucucccucucaaguaaccauguucccacauaucauaguugacguuagacaauuagaaccagucuuaauaccccuaccagauguacgaaauaauuuuuaucauuauaaucaaucaaacgaccccacaauaaaacuaauagcaauguuauauacuccacuucgugccaauaacgcaggagaugacguuuuuacaguaucaugucguguauuaacaagaccaucuccagauuuugacuuuaucuuucuagugccuccaacagucgaaucuagaacaaaacccuucucaguuccaauauuaacaguagaagaaaugacaaauuccagauuucccauaccacuagaaaaauuauuuaccggaccuucuucugcauuuguaguacaaccucaaaauggacgauguacaacagacggaguauuauuaggaacaacucaacuaucaccuguuaauauauguacauuccgaggagacguaacucauaucgcaggaacacaaaacuauacuaugaauuuagcaucacaaaauuggaauaauuacgauccaacagaagaaaucccagccccuuuaggaacaccagacuuuguagguaaaauucaaggaguuuuaacacaaacaacacgacgagacggaucaacaagaggacauaaagcaaccguaucaacaggauccguacacuuuacaccaaaauuaggcucaguacaauucuccacagauacaucuaacgauuucgaaacaggacaaaauaccagauucacaccaguuggaguaguacaagauggauccacaacacaucaaaaugaaccacaacaauggguacuccccgauuacucuggaagagauucccauaauguacaccuagccccagcaguagccccuacuuuuccuggagaacaauuacucuuuuuuagaucaacuaugcccggaugcucaggauauccaaacaugaacuuagauugccuacuaccacaggaauggguccaacauuucuaccaagaaucggcaccagcacaauccgacguagcuuuacuacguuuugucaauccugacacaggaagaguccuauucgaaugcaaauuacacaaaucuggauacguaacaguagcacacacuggacaacaugauuuaguuauaccaccaaauggauauuuuagguuugacucauggguaaaccaauuuuacacucuagcaccaaugggaaauggagcaggacgaagacgagcauuauag

SEQ ID NO: 32527 - RNA, 1623 nt, Artificial Sequence
  derived and/or modified sequence opt6 from capsid_protein__Norovirus__ACJ66263
augaaaauggcuucuaaugacgcuaacccaucagacggaucaacagcaaaccuuguucccgaaguaaauaaugaaguaauggcauuagaaccaguuguuggagcagcaauagcugcaccaguagcuggucaacaaaaugucauagauccauggauaagaaauaacuuuguacaagcaccaggcggagaauuuaccguaucaccaagaaacgcaccaggugaaauacuauggucagcaccauuaggaccagaucuaaaucccuaucuuucacacuuagcccgaauguauaacggauacgccggagguuuugaaguccaaguaauacuagccggaaaugcuuuuacugcaggcaaaaucauauucgcugcaguaccaccaaacuuuccuacagaaggauuauccccaucacaagucacaauguuuccucauauaaucguagacguuagacaauuagaaccaguacuaauuccuuuaccagacguacguaacaauuucuaucacuauaaccaauccaaugacccaacaauuaaacuaauagcgaugcuauauacaccacuaagagcuaacaacgcaggugaugacguauuuacaguaucauguagaguacucacuagaccaucaccugauuuugacuucauuuuuuuaguuccaccaaccguagaaucacgaacuaaaccauucacaguaccaauauuaacaguagaagaaaugacaaauucaagauuucccauaccccuagaaagacuuuauaccgguccaucaucagcuuucguuguacaaccacagaacggacgauguacaacagacggaguauuacuaggaaccacacaauuaucagcaguaaauauauguaccuucagaggcgacguaacccauauagcaggaucacgaaacuauacaaugaaucuugcaucacaaaacuggaacaacuacgauccaacugaagaaaucccagcaccucuuggaacaccugacuucguagguaaaauucaaggaauguuaacacaaacaacuagaucagauggaagcacacgaggacacaaagccacaguauuaaccggaucagcugacuuugcacccaaacuaggcagaguucaauuugcaacagauacagacaacgacuuugaaucaggacagaacacaaaauuuaccccaguuggagucauacaagacgguucaacuacacaucgaaaugaaccacaacaguggguacuaccuaauuauucagguagaacaggacacaacguacaccuugcaccagccguagccccuacuuacccaggugaacaacuauuauucuuccguuccacaaugcccggcugcucaggauaucccaauauggauuuagacugccuacuuccacaagaauggguccaacauuucuaucaagaagcugcacccgcccaauccgacgucgcauuauuacgauuugucaaccccgacacaggaagaguauuauucgaaugcaaauuacacaaaucuggcuauguaacaguagcacacacuggacaacacgaucuaguuauaccaccuaauggauauuucagauuugauuccuggguaaaucaauucuauacccuagcaccaaugggaaauggagcuggaagaagaagagcacuauaa

SEQ ID NO: 32528 - RNA, 1623 nt, Artificial Sequence
  derived and/or modified sequence opt6 from capsid_protein__Norovirus__ACJ66265
augaaaauggccucaucagacgcaaacccuucagauggcagcacagcaaaucuuguaccagaaguuaauaaugaagucauggcgcuagaacccguaguaggagcagcaauagcagcaccaguagcaggccaacaaaacguuauugacccauggaucagaaauaacuuuguacaagcaccuggaggagaauuuacaguaucaccaagaaaugcaccaggagaaauacuuuggagcgcaccauuaggaccugaucucaauccauaucuaucacaccuugcuagaauguacaauggauaugcugguggauuugaaguacaaguaauauuagcugguaacgcauuuacagcaggcaaaauaauauuugcagcaguaccaccuaauuuuccuacagaaggacuaagcccaucacaagucacaaugagcccacacauuauaguagacguaagacaacuugaaccaguacuaauaccacuaccagauguccgaaacaauuucuaccacuauaaucaaagcaacgauccaacaauaaaacuaauagcaaugcuauauacaccucuuagagcaaauaacgcaggugaugauguauucacuguaucaugucgaguucucacaagaccaucaccagauuucgauuucauauuuuuaguaccuccaacaguagaauccagaacaaaaccauuuaguguaccaauacuaacagucgaagaaaugacaaacucuagauuccccauaccacuugaaagauuauuuacaggacccucaucagcauucgucguacaaccacaaaacggacgauguacaacugacgguguucucuuaggaacuacucaacuuagccccgucaauauaugcacuuucagaggugauguaacucacauagcuggaacacaagaauauaccaugaacuuagcaucacaaaacuggaauaauuaugacccaacugaagaaauaccagcuccacucggaacaccagauuucgucggaaaaauacaagguguauuaacucaaaccacuagaagagauggaucaacaagaggacauaaagcaacaguuuccacaggaucaguacacuuuaccccuaaauuaggaagaauacaauuuucaaccgacacaaguaaugauuuugaaacaggacaaaauacacgcuucacaccaguaggaguaguucaagacggaggaacaacacaccaaaaugaaccacaacaauggguacuaccuaacuauucaggcagagauggacauaauguacaucuugcaccagcagucgcuccaucuuucccaggcgaacaacuuuuauucuuuagaucuacaaugccaggaugcucuggauaccccaacaugaaucucgauugcuuauuaccacaagaauggguacaacauuuuuaucaagaagcugcuccagcccaaucagauguagcacuauuaagauucguaaauccugauacaggaagaguccuauucgagugcaaacuucacaaauccgguuauguuaccguagcacauacaggacaacaugauuuaguuauaccaccaaacggauauuucagauucgacucuuggguaaaucaauuuuacacacuagccccaaugggaaauggaaccggaagaagacgagcauuauag

SEQ ID NO: 32529 - RNA, 1623 nt, Artificial Sequence
  derived and/or modified sequence opt6 from capsid_protein__Norovirus__ACJ66267
augaaaauggcuuccaacgacgcaaacccaucagauggauccacugcuaacuuagucccagaaguaaacucagaaguaauggcuuuagaaccaguaguaggagcagcuauagcagcaccaguagccggacaacaaaauguaauagacccauggauaagaaauaauuuuguacaagcuccaggaggugaauuuacaguaaguccaagaaaugcacccggagaaauauuauggucggcaccccuagguccagacuuaaauccauauuuaucacaccuagcccgaauguacaacgguuacgcuggaggauuugaaguacaaguaauauuagcaggaaaugcuuuuacagcaggaaaaauuauauuugcggcaguaccuccaaacuuuccaacagaaggacuauccccaucacaaguaacaauguuuccacacauuauaguagauguaagacaacuugagccaguuuuaauaccacuaccagauguaagaaauaauuuuuaucauuauaaucaaucaaaugauccaaccauaaaauuaauagcaauguuauauacaccauuacgagcaaacaaugccggagaugauguauuuacagucuccugcagaguucuaacuagacccucaccagauuucgauuucauauuucuaguuccacccacaguagaaucaaggaccaaaccauuuacaguuccaauauuaacagucgaagaaaugacaaacaguagauuucccauuccucuagaaagauuauauacagguccgucuucagccuucguaguacaaccacaaaacggaagauguaccacagaugguguauuacuuggaacaacacaacuaagcgcuguaaauauauguacauuuagaggagacguaacacacauagccggcagccgaaauuacacuaugaauuuagcaucacaaaacuggaauaacuaugacccaacagaagaaauaccagcaccacuaggaacaccagacuuugucggcaaaauccaaggaauguuaacacaaacaacaagaucugaugguucaacucgcggucacaaagcaacuguauuaacuggaucagcagauuuugcacccaaacuugggagaguacaauuugcaacugauacagacaaugauuuugaaucaggucaaaauacaaaauuuacaccagucggaguuauacaagacgguucaaccacacauagaaacgaaccucaacaauggguacuaccuuccuauucaggacgaacaggacacaacguacaccuugcaccagcaguagcccccacauacccaggagaacaacuauuauucuuuagaucaacaaugccaggaugcucuggauauccuaauauggauuuagauugcuuacuaccacaagaauggguacaacacuuuuaucaagaagcagcccccgcacaaucagacguagcacuccucagauucguaaacccagauacagguagaguacucuuugaauguaaacuccauaaaucaggauauguaacaguagcacauacaggucaacacgaucucguaauaccaccaaauggcuauuuuagauucgauuccugggucaaucaauucuacacauuagcaccaauggguaauggagcagguagaagacgggcucucuaa

SEQ ID NO: 32530 - RNA, 1623 nt, Artificial Sequence
  derived and/or modified sequence opt6 from capsid_protein__Norovirus__ACJ66269
augaaaauggcuucauccgaugcaaacccaucugauggaucaacagcuaaccuuguaccggaaguaaacaaugaaguaauggcccucgaaccaguuguuggagcagcuauagcagcaccaguugcuggacaacaaaauguaauagauccauggauacgaaauaauuucguacaagcuccaggcggagaauuuacaguuucaccaagaaaugcaccuggggaaauauuauggucugccccccuaggacccgaucuaaaucccuaucuaucucaucuugcacgaauguauaauggauaugcaggaggauucgaaguacaaguaauacuagcaggaaacgcauuuacugcaggcaaaauaauauucgcugcuguaccaccaaauuuuccuacugaaggucuauccccuucacaaguaacaauguuuccacauauaauaguagacguaagacaauuagaaccaguauuaauaccacuaccagauguaagaaacaauuucuaucacuacaaucaaagcaaugacccaacaauaaaauuaaucgcuauguuauauacaccauuacgugcuaauaacgcaggagacgaugucuuuacaguauccugucgaguauuaacaagaccuucaccagauuuugacuucauauuuuuaguacccccuacuguagaaucaagaacaaaaccuuucucaguaccaauacuaacuguagaagaaaugacaaacucaagauuuccaaucccacucgaaagauuauuuacaggaccaaguucugcauucguuguucaaccacagaaugguagauguacaacagauggaguccuauuaggaacaacacaacuaagcccagcaaauauuuguacauuucgaggagauguaacccauauugcagguacacaagaauauacaaugaacuuagccucccaaaacuggaacaacuacgaucccacagaagaaauaccagcaccacuugguacaccagacuuuguaggaaaaauucaaggugucuuaacacaaacaacaagaagagauggauccacucgaggacacaaagcaacuguauccacaggaucuguacauuuuaccccaaaauuaggcagaauacaauucucuacagacacuucaaacgauuuugaaacaggacaaaauacucgauucacacccguuggaguaguacaagacggaggaacgacacaucaaaaugaaccacaacaaugggucuuaccaaacuauuccggaagagauggacauaauguucaccucgcaccagcaguagcaccuuccuucccaggagaacaacuucuauucuuucgaucaacaaugccagguuguuccggauaucccaauaugaaccuagacugccuauuaccacaagaauggguacaacauuuuuaucaagaagcagcuccagcacaaucagacguagcauuacuacgcuucguuaacccagacacaggaagaguacuauuugaaugcaaacuacauaaaucaggauauguuacaguugcacacacaggacaacacgaucuaguaauaccaccaaauggauauuuucgcuuugauucauggguaaaccaauuuuacacucuugcaccaaugggaaauggaacagguagaagaagagcauuauaa

SEQ ID NO: 32531 - RNA, 1623 nt, Artificial Sequence
  derived and/or modified sequence opt6 from capsid_protein__Norovirus__ACJ66271
augaaaauggcauccucagaugcaaauccauccgauggaucaacagcaaaucucguuccagaaguaaacaaugaaguaauggcauuagaaccaguaguaggagcagcaaucgcagccccaguagcaggacaacaaaauguaaucgacccauggauacgcaauaacuucguacaagccccaggcggagaauuuacaguaucuccaagaaaugcaccuggagaaauauuauggucagcaccucucggacccgacuuaaauccauaucuaucacacuuagcaagaauguauaacggauacgcaggaggauucgaaguacaaguaauauuagcaggcaaugcauuuacagcuggaaaaauaaucuucgcugcuguuccaccaaacuuuccaacagaaggucucucaccaucacaaguuacaauguucccucacauaauaguagauguacgacaacucgaaccaguacuaaucccucuuccagacguacgaaacaauuuuuaucauuacaaccaaucuaacgacccaacaauaaaacuaauagcaaugcuauacacuccauuaagagcaaauaaugcuggagaugauguauuuacaguuucauguagaguucuaacucgaccaucaccagauuuugacuuuauuuuuuuaguacccccaacaguugaaucuagaacaaaaccauuuucaguacccauauuaaccguagaagaaaugacgaauucaagauucccaauaccacuagaaagacucuuuacagguccuucaucagcuuucguaguccaaccacaaaacggaagaugcacuacagauggcguacuacuaggaacaacacaacuuucaucaguaaauaucugcacauucagaggagauguaacccauauagcuggaacucaagaauacaccaugaauuuagcuucccaaaauuggaacaacuaugacccaacagaagaaaucccugcaccacuaggaaccccagacuuuguaggaaaaauccaaggaguauuaacacaaaccacuagaagagauggaucuacaagaggucauaaagcaacaguaaguacagguucuguacauuuuacaccaaaacuuggaagaauucaauucucuacagauacaucuaacgauuuugaaacagggcaaaauacccgcuuuaccccuguaggcguuguacaagacgguaguacaacacaucaaaaugaaccacaacaauggguuuuaccaaauuauuccggcagagacggacacaacguacaccuagcuccagcaguagcuccuaguuucccaggugaacaauuauuguucuucagaucaacaaugccaggauguuccggauacccaaacaugaacuuagacugccuauuaccacaagaauggguacaacacuuuuaccaagaagcagcuccagcacaaucagauguugcacuacuaagauucguuaauccugauaccggacgaguacuauucgaaugcaaacuccauaaaucuggguacgucacaguagcccauacaggacaacacgaccuaguuauaccaccaaacgguuauuuccgauucgauuccuggguaaaucaauuuuauacauuagcaccuauggguaauggaacaggacgucguagagcccuauaa

SEQ ID NO: 32532 - RNA, 1623 nt, Artificial Sequence
  derived and/or modified sequence opt6 from capsid_protein__Norovirus__ACJ66273
augaaaauggcuaguucugacgcaaauccaucagauggaucuacugcaaaccuaguaccagaaguuaacaaugaaguaauggcucuugaaccaguagucggugcagcaauagcagcaccaguagcuggacaacaaaacguaauagaucccuggaucagaaauaauuuuguccaagcgccaggcggagaauuuacagucucaccaagaaaugcuccaggagagauauuauggagugcaccauuaggaccagauuuaaacccauaucuaucacacuuagcuagaauguauaauucuuacgcuggcgguuucgagguccaaguuauauuagcaggaaaugcauuuaccgcuggcaaaaucauuuucgcagcaguacccccaaacuucccuacugaagguuuaucacccucacaaguaacaauguuuccacacauuauuguagauguaagacaauuagaaccuguuuuaauaccccuccccgaugucagaaacaauuucuaucauuacaaccaaucaaacgacccaacaauaaaacuaauagcaaugcuauauacaccuuuacgagcaaacaaugcaggagaugauguauuuacaguaucaugucguguauuaacaagacccucaccagacuucgauuuuauauuucuaguacccccaacuguagaaucacgaacaaaaccauuuaguguuccaauauuaacaguagaagaaaugaccaacuccagauuuccaaucccuuuagaaaaauuauuuacuggaccaucuucagcauuuguaguacaaccacaaaauggcagauguacuaccgauggaguacuauuagguacaacccaacucucaccuguuaauauuuguaccuuccguggagacguuacacauauagcaggaacucaagaauauacaaugaaucuagccucacaaaacuggaauaauuaugacccuacagaagaaauuccagcaccacuagguacuccugacuuuguagguaaaauacaagguguauuaacacaaacaacucgaagagacggaucaacaagaggacacaaagcaacaguaucaacaggauccguacacuuuacacccaaauuaggcagaauacaauuuuccacugauaccuccaaugacuuugaaacaggacaaaauacacgcuucacaccuguaggagucguacaagauggcaguacaacacaucaaaaugaaccacaacaauggguacuaccaucauacucaggucgagauucucacaauguccacuuagcaccugcaguagcaccaaguuuucccggagagcaauuacuuuucuuucgcaguacaaugcccggaugcucaggauaccccaauaugaaucucgacugucuuuuaccacaagaauggguccaacauuucuaucaagaggcagcaccagcacaaagcgacguagcucuauuaagauucguuaauccugauacaggaagaguauuauuugaaugcaaauuacauaaaucaggauauguuacugucgcacacacaggacaacacgaucuaguaauacccccaaacgguuauuuuagauucgauucaugggucaaucaauuuuauacacuagcaccaaugggaaauggagccgguagaagaagagcccuuuaa

SEQ ID NO: 32533 - RNA, 1623 nt, Artificial Sequence
  derived and/or modified sequence opt6 from capsid_protein__Norovirus__ACJ66275
augaaaauggcaucaucugacgcaucacccucagaugguucagcagcaaaccuuguacccgaaguaaauaaugaaguaauggcacuagaaccaguuguaggugcugcuauagcugcaccaguagcaggacaacaaaauauaaucgaccccuggauccgaaauaacuucguccaagcaccaggaggcgaauuuacaguaaguccccgaaacgcaccaggagaaauauuauggucugccccauuaggaccagaucuaaauccuuauuuaucacaucuaucaagaauguauaacggauacgcaggaggauucgaaguacaaguuauauuagcuggaaaugcauuuaccgcagguaaaguaauauuugcagcaguaccaccaaacuuuccaacugaaggauuaucuccaucccaaguaaccauguuuccacacauuauaguagauguaagacaacucgaaccaguauuaauacccuuaccagacguaagaaacaauuucuaucacuauaaucaaacaaaugaccccacaauaaaauuaauagcaaugcuauacacaccacuuagagcaaauaaugcaggagaugacguauuuacaguaucauguagaguucuaacacgaccaaguccugauuucgauuuuauuuuucuaguaccaccuacuguagaauccagaacaaaaccauucacuguaccaauacuaacaguagaagaaaugacaaacuccagauucccaauacccuuagaacgauuauacacagguccaaguucagcuuucguaguacaaccacaaaacggacgauguacaacagauggaguauuacucggaaccacacaauuaucagcagucaauaucugcacauuuagaggugacgucacacauaucgccgguucacgcaauuacacuaugaaccuagcaucccaaaauuggaauaauuacgauccaacagaagaaauaccagcaccacuaggaacaccugacuucguagguaaaauacaaggaaugcuaacccaaacuacaagaggagacgguucuacaagaggacacaaggcaacaguauacaccggauccgcagauuuugcuccuaaauuaggaagaguacaauucgcuacagauacagauaacgacuuugaaucaaaucaaaacacaaaauuuaccccuguaggcguuauacaagacggcaauacaacacauagaaaugaaccucaacaauggguacucccaggauauuccgguagagauggccauaauguacaccucgccccagccguagccccaaccuaucccggugaacaauuauuauuuuuccgaucaacaaugccaggauguucaggauauccaaauauggaucucgauugccucuuaccccaagaauggguacaacauuucuaucaagaagcagcaccagcucaaucagaaguagcacuuuuaagauuuguuaacccagacaccgguagaguauuauucgaauguaaacuacauaaaucaggauauguaacagucgcucauaccggucaacacgauuuagucauaccaccaaacggauauuuuagauuugauucauggguaaaccaauucuacacccuagcuccaaugggcaauggagcuggacguagacgugccuuauaa

SEQ ID NO: 32534 - RNA, 1623 nt, Artificial Sequence
  derived and/or modified sequence opt6 from capsid_protein__Norovirus__ACJ66279
augaaaauggcaaguaaugacgccacaccaucagauggaucuaccgcgaaccucgucccagaaguaaauaacgaaguaauggcauuagaaccaguaguaggagccgccauagcagcuccuguagcaggccaacaaaacguaauugauccauggauaagaaacaauuuuguacaagcaccagguggugaauuuacuguaucuccaagaaaugcacccggagaaauccucuggucagcaccacuugguccagaucuuaaucccuaccuuucacaccuagcacguauguauaaugguuacgcaggaggauuugaaguacaaguaauacuugcaggaaaugcuuucacugcuggaaaaaucauuuucgcagcaguaccuccaaauuucccaacagaagggcuaucaccaagucaaguaacaauguucccacacauuauaguagacguaagacaacuagaaccaguucuuauaccacuacccgacguaagaaauaauuucuaccauuauaaccaaucuaaugacccaacaauaaaauuaaucgcaaugcuauacacuccccuaagagcaaauaacgccggagacgauguauuuacaguuaguuguagaguauuaacuagaccauccccugauuuugacuuuaucuuccuaguaccacccacaguugaaucacgaaccaaaccauucucuguaccaauacuaacaguagaagaaaugacaaacucaagauuuccaauaccuuuagaaaaacuauuuacaggaccaucuagugcuuucguaguucaaccacaaaaugguagauguacaacagacggaguauuacuaggaacaacacaauuaucaccugucaauauauguacuuuuagaggugacguaacacauauagcugguacacaaaauuacacaaugaaccuagcaucacaaaacuggaacaauuacgauccuacagaagaaauacccgcaccuuuagguacuccagacuucguaggaaaaauacaaggcguucuaacacaaaccacacguagagacggcucuacaagaggacacaaagcaacaguuucaacugguuccguacacuucacaccaaaauuaggaaguguacaauucucaacagauacauccaaugacuucgaaacaggccaaaauacaagauucacucccguugguguaguacaagacggaucaacaacucaccaaaacgaaccacaacaauggguauuaccagacuauucaggucgagauucacacaacguacaucucgcaccugcaguagcaccaaacuuuccaggagaacaacuacuauucuuuagaucuacaaugccuggaugcucaggauaucccaacaugaauuuagauugccuauuaccacaagaauggguacaacauuuuuaucaagaaagugcaccugcacaaucagacguagcacuacuaagauuuguaaacccagacacuggacgaguacuguucgaauguaaauuacauaaaucaggauaugucacaguagcacauacaggacaacaugacuuaguuauacccccuaauggauauuucagauucgacucauggguuaaucaauuuuacacacuugcuccaaugggaaauggagcaggccgacgaagagcucuauaa

SEQ ID NO: 32535 - RNA, 1623 nt, Artificial Sequence
  derived and/or modified sequence opt6 from capsid_protein__Norovirus__ACJ66281
augaaaauggcaucuaaugaugcuaacccuucagauggcucagcugcaaaccucguucccgaaguuucuaacgaaguaauggcauuagaaccuguaguaggagcugcuaucgcugcaccaguagcaggacaacaaaacgucauagauccauggauaagaaauaauuuuguacaagcuccuggaggagaauucacaguaucaccuagaaaugcccccggugaaauacuauggucagcuccacuaggaccagaucuuaauccauauuuaucacaucucgcuagaauguauaacggcuacgccggaggauuugaaguacaaguaauuuuagcaggcaacgcauuuacugcaggcaaaauaauuuucgcagccguuccaccaaacuuuccaacugaaggcuuaaguccuucacaagucacaauguucccucacauaauaguugacguaagacaauuagaaccaguacuuauaccauuaccagaugucagaaacaauuuuuaucauuacaaccaaucaaacgacucuacaauaaaacuuauagcuauguuauacacuccacuuagagcuaauaacgcaggagaagacgucuucacaguuucauguagaguacuuacuagaccaucaccugacuucgacuucaucuuuuuaguaccuccuacaguagaaucaaggacuaaaccauucacuguuccuauauuaacaguagaaaaaaugacaaacagcagauuuccaauuccacuagaaaaacucuuuacaggaccuucaggagcauucguuguacaaccacaaaauggacggugcacaacugauggaguauuacuaggaaccacacaauuaaguccagucaauauaugcacauuucgaggagauguaacacauaucgcuggaucaagaaauuauacaaugaaucuagcuaguuuaaacuggaauaauuaugauccuacagaagaaauaccugcaccacuaggcacaccagauuucguaggaaaaauacaagguguacuaacacaaacaaccaaaggagacggaucaacacguggacacaaagcgacugucuauacaggaucagcaccauuuacaccuaaauuagguucuguacaauucaguaccgacacagaaaaugauuuugaaacccaucaaaauacaaaauucacaccaguaggcguaauucaagacggaucaacaacacaucguaaugaaccucaacaauggguauuaccaaguuauaguggcagaaauguacauaauguacaucuagcaccggccguagcaccuacauuuccuggagaacaacucuuauucuuuagaucaacaaugccaggaugcuccggauacccuaauauggauuuagacuguuuacuaccacaagaauggguucaacauuucuaucaagaagcagcaccagcacaaucagacguagccuuacucagauucguaaauccugacacaggacgagucuuauucgaauguaaacuacauaaaucuggauauguaacaguagcucacacaggacaacacgaucuaguaaucccaccaaauggauauuucagauucgauucauggguuaaucaauucuacacacuagcaccuaugggaaacggaacaggaagacgaagagcccuauaa

SEQ ID NO: 32536 - RNA, 1623 nt, Artificial Sequence
  derived and/or modified sequence opt6 from capsid_protein__Norovirus__ACJ66283
augaaaauggcaucuaaugacgcaaacccaagcgauggaucugcagcaaaccuaguauuagaaguaaacaaugaaguaauggcucucgaaccuguagugggagcagcuauagccgcaccaguagcaggacaacaaaacguaauagauccuuggauaagaaacaauuuuguacaagcaccuggaggagaauuuaccguuucaccucgaaaugccccuggagaaaucuuauggucagcccccuuaggaccugaccuaaauccauaccuaucacaccuagcaagaauguauaacggcuacgcaggaggauuugaaguacaagucauucucgcuggaaaugcauucacugcaggaaaaauaauuuucgcagccgucccuccuaacuucccaacugaaggccuaucaccaucccaagucacaauguucccacauauaauuguagacguuagacaacuugaaccaguucuaauaccacuaccagauguacgaaauaauuucuaucacuauaaucaaucaaacgacuccacaauuaaauuaauugcaaugcucuacacaccauuaagagcaaacaaugcaggagaagacguauuuacaguuagcuguagaguccuaacacgaccaucaccagauuuugacuuuaucuucuuaguaccaccaacaguagaaucaagaacaaaaccuuucacaguaccaauccuaacaguugaagaaaugacuaauucuagauuuccaaucccauuagaaaaacuauucacaggaccaucuggagcauuuguaguacaaccccaaaacggaagauguacaacagacgguguauuacuaggaacaacacaauuauccccaguaaauauauguacauuuagaggcgauguuacucauauugcuggcucaagaaauuauacaaugaaucuugcaucauuaaacuggaauaauuaugacccgacagaagaaauaccagcaccauuaggaacacccgauuuugucggaaaaauacaagguguuuuaacccaaacaacaaaaggugacggauccacucgaggacauaaagcaacagucuauaccggaucagcaccauuuacaccaaaacuaggcuccguacaauucucaacagacacagaaaacgacuucgaaacccaccaaaauacaaaauuuaccccagucggaguaauacaagauggaucuaccacacauagaaacgaaccucaacaauggguacuuccaucauacucuggaagaaauguacauaauguucacuuagcuccagcaguugccccaacauucccaggagaacaacuccuauuuuuuaggucuacaaugccaggauguucagguuauccaaauauggaucuugauugccuuuuaccucaagaauggguccaacauuucuaucaagaagcugcuccugcacaaucagacguugcacucuuacgauucguaaauccagauacuggccguguacuauucgaaugcaaacuacauaaauccggcuauguaacaguagcacacaccggacaacacgaucuaguuauuccaccaaacgguuacuuccguuuugauucauggguaaaucaauuuuacacauuagcaccaaugggaaaugguacaggcagaagaagagcacucuaa

SEQ ID NO: 32537 - RNA, 1623 nt, Artificial Sequence
  derived and/or modified sequence opt6 from capsid_protein__Norovirus__ACJ66285
augaaaauggccucaucagacgcaaaccccucagauggaagcacagccaaccuugucccagaaguuaauaaugaaguaauggcauuagaacccguaguaggagcagcaauagcagcacccguugcgggacaacaaaauguaauagacccaagaauucgaaauaacuuuguucaagcaccaggaggugaauuuaccguaucaccacguaacgcaccaggagaaauauuauggucugcaccauuaggcccugaccuaaauccauauuuaucccacuuagcaagaauguauaacucuuaugcaggcggauucgaaguccaaguaauacuagcaggcaacgcauuuacagccggaaaaauaauauucgcugcaguaccacccaauuucccuacagaagguuuaucaccaucccaaguaacaauguuuccucacaucaucguagacguaagacaacuugaaccuguauuaauaccauuaccagacgucagaaacaauuuuuaucacuauaaucaaucuaaugacccaacaaucaaacuaauagcaaugcuauauacaccauuacgagcaaacaaugcaggagaugauguauuuacaguauccuguuggguccuaacacgaccgucaccugacuuugauuuuauuuuuuuaguaccaccaacaguagaaucaagaacaaaaccuuucucagucccaauacuaacaguagaagaaaugacuaacucaagauuuccaauaccauuagaaaaauuauuuacaggaccaucauccgcguuuguaguacaaccacaaaauggaagauguacaacagacggagucuuacuuggaacaacacaacuaucacccguaaauauauguacauuuagaggagauguuacacauauagcaggaacacaagaauacacuaugaaucuugcaagccaaaauuggaacaauuacgacccuaccgaagaaauaccagcaccacuaggaacaccggacuuuguaggaaaaauacaaggaguucuaacacaaacaacuagaucagaugguucaacacguggacauaaagcaacaguaucuacaggaucaguacauuuuacaccaaaauuaggaagaauccaauucucaacagacacaucuaacgauuucgaaacaggucaaaauacaagauucaccccaguugguguuguacaagacggaucaacaacacaccaaaaugaaccacaacaauggguauuaccaaauuacuccggaagagacucccauaacgugcacuuagcaccagcagucgcaccaucauuuccaggagaacaacuacuauucuuuagaucaacaaugccuggauguaguggauacccuaacaugaaucucgauugcuuacuaccucaagaauggguacaacauuuuuaucaagaagcagcuccagcucaaucagacguugcacuauuaagauucguuaacccugacacaggaagaguauuauucgaaugcaaacuacauaaaucuggauacguaacugucgcacacaccggacaacacgaccuaguaauaccuccaaauggcuacuucagauucgacucaugggucaaccaauuuuacacccuagcacccaugggaaauggcaccggaagaagaagagcccuauaa

SEQ ID NO: 32538 - RNA, 1623 nt, Artificial Sequence
  derived and/or modified sequence opt6 from capsid_protein__Norovirus__ACJ66286
augaaaauggcauccaaugaugcaaacccauccgaugguucagcagccaauuuaguaccagaaguaaacaacgaaguaauggcacuagaaccuguaguaggagcagcaaucgcagcaccgguugcaggccaacaaaauguuauugauccuuggauucgaaauaacuuuguccaagcgccaggaggugaauucacagucucaccacgaaaugccccuggcgaaauccuauggucagcaccacuagguccagaccuaaauccuuauuuaucacacuuagcacgaauguauaacggauacgcaggcggauucgaaguccaaguaauauuagccgguaaugccuucaccgcagguaaaauuauauucgcagcaguaccaccuaacuuuccaacagaaggacuaucuccaucacaaguuacuauguuuccacauauaauaguugauguacgacaacuagaaccaguuuuaauuccacuacccgauguacguaauaauuuuuaucacuacaaccaaucaaacgauagcacaauuaaacuaauagcaauguuauacacaccauuaagagcaaacaaugcuggagaagauguauucacaguaucauguagaguccuuacaagaccaucccccgauuuugacuuuauauuucuaguaccuccaacaguagaaucucgaacaaaaccauuuacuguuccaauacuuacagucgaagaaaugacuaacucaagauucccaauaccauuagaaaaacuauuuacagguccuucaggagcauucguuguacaaccacaaaacggucgauguacaacagauggaguauuauuaggaacaacacaauuaucaccaguaaauauaugcacauuuagaggagacguuacacauauagcuggcucuagaaauuacacaaugaauuuagcaucacuaaauuggaauaacuaugauccuaccgaggaaauuccagcaccauuagguaccccagacuuuguaggaaaaauacaagguguacuaacacaaacaacuaaaggagacggaucuacucgaggccacaaagccacaguuuauacaggaucagcaccauuuacaccuaaauuagguucaguacaauucuccacagacacagaaaacgauuuugaaacacaucaaaauaccaaauucacaccagucgguguaauacaagauggaucaacaacacaucguaaugaaccacaacaauggguacuaccuucauauucaggcagaaauguccacaauguacauuuagcaccggcaguagcaccaacuuuuccaggcgaacaacucuuauuuuuuagaucuacaaugccaggaugcaguggauaucccaauauggaucuugauugcuuacuuccacaagaauggguucaacacuucuaucaagaagcagcuccagcucaaucagacgucgcacuucucagauucguaaacccagacacagguagaguauuauucgaaugcaaauuacauaaaucuggauacguaacuguagcacauacaggacaacacgauuuaguuauuccacccaauggauauuucagguucgauucauggguaaaucaauucuacacucuugcaccaaugggcaacggcacaggacgccgacgagcacuauaa

SEQ ID NO: 32539 - RNA, 1626 nt, Artificial Sequence
  derived and/or modified sequence opt6 from capsid_protein__Norovirus__ACJ72216
augagaaugagcgacggugcagccccaaaagcaaacgggucagaagcaucaggacaagacuuaguaccaacagcaguagaacaagcaguacccauacaaccaguagcaggagcugcacuagccgcacccgccgcaggccaaauuaaccaaaucgacccuuggauuuuucaaaauuuuguucaauguccacuaggagaauucucaauaucaccuagaaauaccccaggcgaaauccuuuucgaucuagcauuaggaccaggacuuaacccuuaucuugcccaucuaucagcgauguauacaggauggguaggaaauauggaaguacaauuaguuuuagccggaaaugccuucacagcaggaaaaguaguaguagcauuaguaccaccauauuuucccaaagguucccuuacaacagcacaaaucacauguuucccgcauguuaugugcgauguaagaacauuagaaccaauacaauuaccacucuuagacguucgccggguauuauggcaugcaacucaagaucaagaagaaucaaugagacuagugugcauguuauauacaccuuuaagaacaaauucaccuggagaugaauccuuuguaguaagcggaagauuacuaucaaaaccugcagccgauuuuaauuuuguauauuuaacaccaccaauagaacgaacuauauauagaaugguagauuuaccaguauuacaaccucgacuauguacucaugcacguuggccagcacccauuuauggacuacuaguugauccaucacuaccaucuaacccacaauggcaaaacgguagaguucauguagauggaacgcuacuggguacaacaccaauaaguggaucuuggguuucuugcuucgcagcagaagcagcauaugaauuucaaagugguacaggagaaguaguaacuuuuagcaugauagaacaagauggaucagcuuauguaccaggugauagagccgccccuuuaggcuacccagauuauucagggcaauuagaaauagaaguccaaaccgaaacaacaaaagccggagacaaacuuaaagucacaacuuucgaaaugauacuaggaccaaccacaaauguagaccaagcaccauaccaaggaaaagcuuaugcaucacuaucaacaaccgcuucucuugauuuaguagauggucgaguacgagcaguacccagaucuguauauagcuuccaagauguacucccagaauauaaugacgguuuacuuguuccccucgccccaccccuaggaccauauuuaccuggagaaguacuauuaagauucagaacauauaugagacaauuagauacagcagaugcugcagcacaaccaauagauugugcauuaccucaagaauuuauaucuugguuugcaucaucaaauuuuacaguacaaucagaagcacuucuaguuagauauagaaauacucuaacuggacaacuuuuauuugaagcaaaauuauacucagaaggauauauagccguaucuuauucaggcucaggaccauuaacauuuccaacagacgguuucuuugaaguaguaagcuggguaccaagauuauuucaacuugcaagcguaggaucacuagcaacuggaagaaccuuaaaacaauaa

SEQ ID NO: 32540 - RNA, 1620 nt, Artificial Sequence
  derived and/or modified sequence opt6 from capsid_protein__Norovirus__ACL27297
augaaaauggcuucaaacgacgcaaauccuagcgauggaucaacagcaaacuuaguaccagaaguaaacaacgaaguaauggcucuagaaccagucguaggugcagccauagcugcaccaguagcaggacaacaaaauguaauagauccauggauaagaaauaauuuuguacaagcaccaggaggagaauuuacaguaucaccaagaaaugcucccggcgaaauucuauggucagcaccccuuggaccagacuuaaacccauaccuuucacacuuagcaagaauguacaauggauaugcaggagguuuugaaguucaaguaauacuagcuggaaacgccuucacagcagguaaaaucauauuugcagcaguaccacccaacuuccccacugaaggucuaucuccaagccaaguuaccauguuuccacauauuauaguagacguaagacaacuagaacccguuuuaauuccauuaccagacguuagaaacaauuucuaccacuacaaucaaucaaaugacuccacaauuaaauuaauagcaaugcuauauacaccacuacgcgcuaacaaugcaggagcagauguauuuacugucucaagaagaguacuaacaagaccaucaccagauuucgauuuuauauucagcguaccaccaacaguugaaucaagaacaaaaccuuucaccguaccaauacuaacagucgaagaaauguccaacuccagauucccgauuccacuagaaaaauuauauacaggucccuccucugcauuuguuguacaaccacaaaacggacgauguacaacggacggaguacuacuaggaacaacacaauuaucagcuguaaacauuuguacauuuagaggagacguuacccauaucgcuggaagucacgauuacacaaugaauuuagcaucacaaaacuggaacaauuaugaucccaccgaagaaauacccgcaccauuaggcacaccagacuuugucgguaaaauccaaggaaugcuaacccaaacaacucgagaagacggaucaacuagagcacacaaagccacaguauccacaggaucuguucacuuuacacccaaacucggcuccguacaauacacaacugacaccaauaaugauuuucaaacuggacaaaacacuaaguucacaccaguugguguaauacaagacgguaacaaucaccaaaaugaaccccaacaauggguucucccaaauuacucuggcagaacuggacauaauguacaucuagcacccgcuguugcaccaacauucccuggagaacaauuacuuuuuuuuagaucuacaaugccuggaugcuccggauacccuaacaugaaccuagauuguuuacugccacaagaauggguccaacauuuuuaccaagaagcugcuccugcucaaucagauguagcucucuuaagauucgucaauccagauacaggaagaguucuauuugaaugcaaauuacacaaauccggcuauguaacaguagcacacacaggaccacaugacuuaguaauaccaccaaauggauauuuuagauucgacaguuggguaaaccaauucuauacucuggcaccaaugggcaacggcgcuggacgaagacgagccuuauaa

SEQ ID NO: 32541 - RNA, 1623 nt, Artificial Sequence
  derived and/or modified sequence opt6 from capsid_protein__Norovirus__ACL27298
augaaaauggcaucaaaugacgcaucuccaucagauggaucaacagcuaacuuaguaccagaagucaauaaugaaguuauggcacuagaaccaguuguaggagcagcaauagcagcaccaguagcaggacaacaaaauguaauagaucccuggauacguaacaacuuuguacaggcaccaggaggagaauuuacaguaucaccaagaaaugccccaggagaaauccuuuggucagccccacuaggaccagaucuuaauccauaucuaucacauuuagcaagaauguauaacgguuacgcaggugguuuugaaguacaagucauacuagcaggcaaugccuucacagcaggcaaaauaaucuuugcagcagucccaccuaauuuucccacagaaggacuaucacccucucaaguuacaauguuuccacacauaauaguagacguaagacaauuagaaccuguauuaauuccauuaccagauguaagaaauaauuucuaccacuauaaucaaucaaacgacccaacuaucaaauuaauagcaauguuauacacaccauuacgagcaaacaacgcaggugaagauguauuuacagucagcugucgaguucuaacacgaccaucaccugacuucgacuuuauauuucuuguuccaccuacuguagaaucacgaacaaaaccauucacuguacccauucuuacaguagaagaaaugacuaauagucgcuuuccaauaccacuagaaaaacuauuuacuggaccaucaggagcauuuguaguacaaccacaaaauggaagauguaccacagauggagucuuacuaggaacaacucaacuuucuccaguaaauauauguacauuucgaggagaugucacccauaucgcaggaacucacgauuauacuaugaacuuagcaucacaaaauuggaacaacuacgauccaacagaagaaauuccugcuccauuaggaacaccagacuucgucgguaaaauacaaggaguauugacccaaaccaccagaggagaugguucaaccagaggacauaaagcuaccguaucaacagguucaguacacuuuacaccaaaauuaggaaguguacaauucaccacugauacaaauaaugacuuugaaacaggucaaaauacuaaauucacacccguugguguaguacaagacggaaacucaacacaccaaaaugaaccucaacaauggguacuaccaaacuacucaggaagaacaggacauaacguucauuuagcaccugcaguagcuccaacauuuccaggagaacaacuacuauucuuucgcucaacuaugccaggaugcucaggcuauccaaacaugaaccuagacugcuuacuuccacaagaauggguacaacauuucuaucaagaagcagcacccgcucaaucugacgucgcacuauuaagauuugugaaucccgacacuggacgcguauuauuugaaugcaaacuacauaaauccggauauguaacaguagcccacacaggacaacaugauuuagugaucccaccaaauggauacuucagguucgauucauggguaaaucaauucuauacauuagccccaaugggaaauggcgccggucgaagacgggcauuauaa

SEQ ID NO: 32542 - RNA, 1623 nt, Artificial Sequence
  derived and/or modified sequence opt6 from capsid_protein__Norovirus__ACL27299
augaaaauggcaucaaaugacgcaaauccaucagauggaucaacagcaaauuuaguaccagaagucaauaaugaaguaauggcucucgaaccaguaguaggagcagccauagcagcaccaguagcaggccaacaaaauguaauagacccauggauaagaaauaauuuuguacaagcaccaggaggagaauuuaccguaucaccuagaaaugcuccaggagaaauauuauggucagcaccguuaggaccagaucuuaacccuuaucuaucacaccuagcaagaauguacaauggauacgccggaggauucgaaguacaaguuauacuagccgguaaugccuuuacagccggaaaaauuaucuuugccgcaguaccaccaaauuucccaacagaagguuuaucuccaucacaaguaacaauguuuccacauaugauagucgauguacgccaauuagaaccaguacuaauaccacucccagauguaagaaacaauuuuuaccauuauaaccaaucuaaugauccaacaaucaaacuaaucgccaugcuuuauacaccacuuagagccaacaaugccggagaugaugucuuuacaguaaguuguagagucuuaacacgcccaucaccggauuuugacuuuauauuuuuaguaccuccuacaguagaaucaagaacaaaaccauuuacaguuccaauauuaacaguagaagaaaugacaaauagccgauuuccaauaccauuagaacgacuauacacaggaccauccucagcauucguagugcaaccucaaaauggacgauguacaacagacggaguauuacucggaacaacacaacuaucagcagucaacauaugcacauuucggggagauguaacucauauagcagguagcagaaauuauacaaugaaucuagcgucacaaaauuggucaaauuaugauccaacagaagaaauaccggcuccacucggaacaccagacuucgucggaaaaauacaagguaugcuaacucaaacgacaagaagagaugguucuacaagaggacauaaagcaacaguauuaacagguucagcugauuuugcaccaaaauuaggcagaguacaauuugcaacugauaccgauaaugauuuugaaaguggagaaaauacaaaauucacaccaguagggguaauacaagauggaucuaccacacauagaaaugaaccacaacaauggguacuaccaaauuacucaggaagaacuggacauaacguccaucuugcaccagcuguagcaccaacuuauccuggugaacaauuauuauuuuuuagaaguacaaugccaggcugcucaggauauccuaacauggacuuggacuguuuauuaccccaagaauggguucgccacuuuuaucaagaagcagcuccagcacaaucagacguagcauuacuccgauucguuaauccagauacugggcgaguauuauuugaaugcaaauuacauaaaucagguuacguuacaguagcucauacaggccaacaugaccuaguaaucccucccaauggauauuuuagguuugacucauggguaaaucaauuuuauacccucgcaccaaugggcaauggagcuggaagaagaagagcacuauaa

SEQ ID NO: 32543 - RNA, 1623 nt, Artificial Sequence
  derived and/or modified sequence opt6 from capsid_protein__Norovirus__ACL27300
augaaaauggcaaguaacgaugcuaacccaucagauggaucaaccgcaaaccuuguacccgaaguaaauaaugaaguuauggcacuagaaccaguuguaggagcagcaauagcugcaccaguagcaggacaacaaaacguaauagacccauggauuagaaauaacuuuguacaagcaccuggaggagaauuuacuguaagcccaagaaaugcaccaggagaaauacuauggucagcaccauuaggaccagaucuaaauccauaccuuucacacuuagcacguauguauaacgguuacgcaggcgguuucgaaguucaaguuauacucgcaggcaacgccuuuacagcuggaaaaaucaucuucgcugccguaccaccaaauuuccccacugaaggacuaucuccuucccaaguaaccauguucccucauauuauaguugacguaagacaauuagaaccuguacuaauuccauuacccgauguacguaauaacuucuaucacuauaaucaauccaaugaccccacaauaaaauuaauagcaauguuauacacaccacuucgagcaaauaacgcaggugacgauguauuuacaguaaguugucgaguacuaacucgcccgucaccagauuuugauuuuaucuuccuagucccaccuaccguagaaucaagaaccaaaccauucacaguaccaauacuaacaguagaagaaaugacaaauucaagauuuccaauaccucuagaaagacuauauacaggaccaucaagcgcauucguaguacaaccacaaaauggccgaugcacaacagacggaguauuacucggaaccacacaacuaagugcaguuaauaucuguacauuucguggugauguaacucauauagcaggaagucgcaacuauacaaugaaccuagcaucacaaaauuggaguaauuaugacccaacagaagaaauaccagcaccuuuaggaacacccgauuuuguagggaaaauacaaggaaugcuaacacaaaccacucgaagagacggaucaacaagaggacacaaagcaacuguauuaacaggcagugcagauuuugcaccaaaauuaggaagaguacaauucgcaacagauacagacaacgacuuugaauccggagaaaacacaaaauucacacccguaggaguaauacaagaugguucaaccacacaccgaaaugaaccacaacaauggguauuaccaaauuauagcggacgaacaggacauaacguacaccuagccccugcuguagcaccgacauauccaggagaacagcuacuauucuuuagaucaacaaugccuggauguucagguuaucccaacauggaucuagacuguuuauuaccacaagaguggguucgucacuuuuaucaagaagcagcacccgcacaaucagauguagcauuauuacgauucguaaauccugauacaggaagaguguuauucgaauguaaacuccacaaaagcggauauguaaccgucgcacacacaggccaacacgauuuaguaauaccaccuaacggcuauuucagauucgacucaugggucaaccaauuuuauacucuagcaccaaugggaaacggcgcaggcagaagaagagcauuauag

SEQ ID NO: 32544 - RNA, 1623 nt, Artificial Sequence
  derived and/or modified sequence opt6 from capsid_protein__Norovirus__ACL31312
augaaaauggcaucuucugacgcaaauccaucugauggaucaacagcaaacuuaguaccagaaguaaacaaugaaguuauggccuuagaaccuguaguaggagcagcaauagccgcaccaguagccggacaacaaaacgucauugauccuuggauuagaaacaauuucguacaagccccuggaggagaauuuacaguaucaccucgaaaugcuccaggugaaauauuauggucagcaccuuuaggccccgacuuaaauccauauuuaucccaccuagccagaauguauaacggauaugcaggaggauuugaaguucaaguaauuuuagcugguaacgcauucaccgcaggaaaaauuauuuucgcugcaguaccaccaaacuuuccaacagaaggauuaucuccuucacaaguuacaauguuuccacauauuauaguugacguaagacaacucgaaccaguuuuaauaccacuaccagauguccguaacaauuuuuaccauuacaaccaaucaaaugacccaacaauaaaauuaauugccaugcuauacacacccuuaagagcaaauaaugccggcgacgacguauuuacagucucuugucgaguauuaacacgaccaaguccugacuucgacuuuaucuuucucguaccaccaacuguugaaucuagaaccaaaccauuuucaguaccaauauuaacuguagaagaaaugaccaacucaagauuuccaauaccacuugaaaaauuauucacaggaccuucaucagcauucgugguccaaccacaaaacggaagaugcacaacagauggaguauuacucggcaccacacaauuaucacccguaaacaucuguacuuuucgaggggacguaacacauauagccggcacacaagaauauacaaugaauuuagcaucucaaaacuggaacaauuaugauccaaccgaagaaauaccugcccccuuaggaacuccugacuuugucggcaaaauacaaggagucuuaacacaaacaacuagacgagacgguucuacaaggggucauaaagcuacuguuucaacuggcucuguacauuucacaccaaaacuaggaagaauacaauucucuacagauaccuccaaugauuucgaaacaggucaaaauacaagauuuacaccaguaggaguuguacaagaugguuccacaacucaucaaaacgaaccacaacaaugggucuuaccugacuacucaggucgcgauucccauaauguacaccuagcaccugcuguagcaccaucauuuccaggagaacaauuauuauuuuuuagaucaacaaugccugguugcucaggauauccaaacaugaacuuagacugccuucuaccacaagaauggguucaacauuuuuaucaagaagcagcaccagcucaauccgacguugcauuacuaagauucguuaaucccgacacuggacgagucuuauuugaaugcaaguuacacaaaucuggcuauguaacuguugcacauacuggacaacacgaccucguuauaccaccaaacggcuauuuuagauuugauucauggguuaaucaauuuuacacucuggcaccaaugggaaauggcacugguagaagacgugccuuauaa

SEQ ID NO: 32545 - RNA, 1623 nt, Artificial Sequence
  derived and/or modified sequence opt6 from capsid_protein__Norovirus__ACL31313
augaaaauggcaucaaaugacgcaacaccuucagacggaucaacagcaaacuuaguaccagaaguuaauaaugaaguuauggcuuuagaaccaguaguaggagcggcgauagccgcaccaguagcaggacaacaaaacguaauugacccauggauaagaaacaacuuuguacaagccccaggaggagaauucaccguuucaccacgaaacgcaccaggagagauauuauggagugcaccucugggaccagacuuaaauccuuaucuaucacauuuagcucgaauguauaacggguacgcaggaggcuucgaaguacaaguaauucuugccggaaaugcauuuacagcuggaaaaauuauauuugccgcaguaccacccaacuuuccaacugaaggucuaucaccaucacaaguuacaauguucccacacauaauaguagacguaagacaacuagaaccuguacucauuccauuaccagauguacgaaacaauuucuaucacuauaaccaaaguaaugacccuacaauaaaacuuauagcaauguuauauacuccauuacgagcaaacaaugcaggagaugauguauuuacaguaucuugccgaguacucacaagaccaucaccagauuucgacuucauauuccuaguuccaccuacaguagaaagcagaacaaaaccauuuagcguaccaauacucacuguagaagaaaugacuaacuccagauuuccaauaccacuagaaaaacuuuuuacaggcccaucaucagcauucguaguucaaccacaaaauggaagaugcacaacagauggaguucuuuuaggaacaacacaacuaucaccuguaaacauauguaccuuccguggcgacguaacacacauagcaggcacacaaaauuacacuaugaaucuugcaucacaaaacuggaacaauuaugaucccacagaagaaauaccugcaccauuaggaacaccagauuuuguaggaaaaauacaaggaguauuaacacaaacaacuagaggagacggaucaacaagaggacacaaagccacaguaucaacaggaucaguucauuucaccccaaaacuaggcucaguacaauuuucaacagacaccuccaaugauuucgaaaccggacaaaauacaagauuuacaccaguuggcguaguccaagacggaucaacaacacaucaaaaugaaccucaacaauggguucuuccagcauauucagguagagacaaucauaauguacacuuagcaccagcaguugcaccuacauuuccaggagaacaacuauuauuuuuucgaucaacaaugcccggaugcucagguuacccuaauaugaaucuagauugcuuacuaccacaagaauggguucagcauuuuuaucaagaaucagcaccugcacaaucagauguugcucuucuaagauucguaaaucccgauacaggacgaguauuauucgaauguaaacuacacaaaucugguuauguaaccguagcacauacaggccaacaugaccuaguaauaccaccaaacggauacuucagauuugacucuuggguaaaccaauucuauacuuuagcuccaaugggaaauggcgccggaagaagacgcgcucuauaa

SEQ ID NO: 32546 - RNA, 1623 nt, Artificial Sequence
  derived and/or modified sequence opt6 from capsid_protein__Norovirus__ACL31316
augaaaauggcuucuucagacgcaacaccaucagauggcucaacagcuaacuuaguaccagaagucaacaaugaaguaauggcauuagaaccuguugucggagcagcaauagcagccccagucgcaggacaacaaaauguaauugauccauggauaagaaacaacuuuguacaagccccuggcggugaauucacaguaucuccaagaaaugcacccggagaaauacucugguccgcaccacuagggccagaucuaaauccuuaucuaucacaucuggcaagaauguauaacggcuacgcaggagguuucgaaguacaaguaaucuuagcaggaaaugcuuuuacugcaggaaaaauaauuuuugcugcaguuccaccaaauuuuccaacagaaggucuaucaccuucucaaguuaccauguucccacacauaauaguagauguaagacaacuagaaccaguacuuauaccuuuacccgauguacgaaacaauuucuaucauuauaaccaaucaaaugacccuacuauaaaauuaauagcaauguuauauacuccacuucgugcaaacaaugccggagacgauguauuuacuguaucaugcagaguauuaaccagaccauccccggacuuugacuuuauauuuuuaguaccaccaacugucgaauccagaacaaaaccauucucaguaccgauauuaacaguggaagaaaugacuaacucaagauuucccauaccacuugaaaaauuauucacagguccaucaucagcauucguaguacaaccacaaaacggcagauguacaacagacggaguauuacucgguacaacacaauuaucaccagucaauauauguacauuucgaggugauguaacacauauagcgggaacucaaaauuacacaaugaauuuagcuucacaaaacuggaauaauuacgauccuacugaagaaauaccagcaccauuaggaacacccgacuuuguagguaaaauccaaggaaugccaacacaaacaacacgaggagacgguucaacaagaggacauaaagcaacuguaucaacugguucuguucacuuuacaccuaaauuagguuccguucaauuuuccacagauaccuccaacgacuuugaaacaggacaaaacacacgauucacuccaguagguguaguucaagacgguuccacaacacaucaaaaugaaccacaacaauggguauuaccaaacuauucagguagagauucacauaacguucaucuagcgccugcaguugccccaacuuuuccaggagaacaacuauuauucuuuagaucaacaaugcccggaugcuccggcuauccaaacaugaaccuagauugccuacuuccacaagaauggguucaacacuucuaccaagaaucugcuccugcccaaucagacguagcauuauuaagauucguuaacccugacacaggcagaguucuauuugaaugcaaacuacacaaauccggauacguaacaguagcacacacuggacaacaugauuuaguaauaccaccaaacggcuauuuccgauucgacuccuggguaaaucaauuuuacacucuagcaccaaugggaaauggagcaggaagacgaagagcauuauaa

SEQ ID NO: 32547 - RNA, 1623 nt, Artificial Sequence
  derived and/or modified sequence opt6 from capsid_protein__Norovirus__ACL31317
augaaaauggcuagcucugacgcaaauccaucagacgguucaaccgcaaaucuuguuccugaaguaaacaacgaaguuauggcacuagaaccaguaguaggagcagcuauugccgcaccuguagcaggacaacaaaacguaauagauccauggauacgaaacaacuuuguucaagcaccuggaggagaauuuacaguaucaccccgaaaugcaccuggagaaauauuauggucagcaccacuaggacccgaccucaaucccuaccuaucccaccuagccagaauguauaacggauacgcuggcggauuugaaguacagguuauucucgcaggaaaugcauuuacagcaggaaaaaucauauucgcagcagucccaccuaauuucccaacagaaggauuaucuccaucacaagucaccauguucccacacaucauaguagauguaagacaguuagaacccguacuuauuccauuaccagauguacgaaauaacuucuaccacuauaaucaaucaaaugacccaacaauaaaauuaauagcuauguuauacacaccacuaagagcaaacaaugcaggugacgacguauucacaguaucaugcagaguacuaacaagaccauccccagacuuugacuuuauauuccuaguaccaccaacaguagaaucucgcacaaaaccauuuuccguuccaauacuaacaguugaagaaaugacaaauucacguuucccaauaccacuagaaagacuauuuacuggaccaucaucagcuuuuguuguucaaccccaaaacggaagguguacaacugaugguguuuuacuaggaacaacacaauuaagucccguaaauauaugcacauucagaggagaugucacacacauugcagguacacaagaauacacaaugaauuuagcaucccaaaacuggaacaauuacgauccaacagaagaaauacccgcaccacuagguacaccagauuucgucgguaaaauacaagguguauuaacacaaacaacaagaagagauggcucaacaagaggacacaaagcaacaguaucaaccggaucuguccauuuuacaccaaaacuaggaagaauacaauucucaaccgauacaucuaaugauuuugaaacaggacaaaauacucgauucacaccaguagguguuguacaagacggaucaacuacucaucaaaaugaaccacaacaauggguacuuccagacuauucagguagagauggacauaacguucacuuagcuccugcaguagcaccaucuuuuccaggugaacaacugcuuuucuuucgcuccacaaugccaggauguucuggauauccaaauaugaaccuagauugccucuuaccucaagaauggguacaacauuuuuaucaagaagcagcuccagcacaaagcgacgucgcauuauuacgauucguaaauccugauacaggacgaguauuauuugaauguaaauuacacaaaucaggauauguaacaguugcacauaccggccaacacgauuuaguaauacccccaaauggauacuuucgauuugauucaugggucaaucaauucuauacauuagcaccaaugggcaauggaacaggcagaagaagagcauuauaa

SEQ ID NO: 32548 - RNA, 1623 nt, Artificial Sequence
  derived and/or modified sequence opt6 from capsid_protein__Norovirus__ACL31319
augaaaauggcaucaucagaugccaauccaucagauggcucaacagcaaauuuaguaccugaaguaaauaacgagguaauggcauuagaaccaguaguuggagcagcaauugcagcaccaguagcuggacaacaaaauguuaucgacccauggauaagaaacaacuucguacaagcaccagguggagaauuuaccguaagcccacgaaacgcuccaggugaaauacuuuggucugcaccauuaggcccagaucuaaauccauacuuaucacauuuagcaagaauguauaaugguuacgcagguggauuugaaguacaaguuuuauuagcaggcaaugcauuuaccgcaggaaaaauaauauucgcagcaguaccaccaaauuucccaacugaaggacuauccccaucacaaguaacaauguucccgcacauaauuguagacguaagacaacuagaaccaguauuaauaccauuaccagacguucguaauaauuuuuaucauuauaaccaaaguaacgauccaacaauaaaacuaauagcuauguuauauacaccauuaagagcuaacaaugcaggugacgauguauucacaguaucauguaggguacuaacuagaccaucaccugauuuugacuuuauauucuuaguaccuccaacuguggaaucacgaacaaaaccuuuuucagucccaauucuaaccguagaagaaaugacaaauucaagguuuccaauaccacucgaaagauuauuuaccggacccucuucagcauucguaguccaaccacaaaauggucgauguacaacagacggaguauuacucggaacaacacaauuaucaccaguaaacauauguacauuuagaggagacguaacccauauagccggaacucaagaauauacaaugaaucuagcaucccaaaauuggaacaacuaugaccccacagaagaaaucccagcaccauuaggaaccccagacuuuguaggcaaaauacaaggaguacuuacucaaacaacucgcagagacggaucuacuagaggucacaaagcaacagucagcacaggaucuguccacuuuacaccuaaauuaggucgaauccaauuuucuacagauacaucaaacgauuucgaaacaggucaaaauacaagauuuacaccaguaggaguuguacaagaugguggaacaacacaucaaaaugaaccucaacaauggguucuaccagacuacucaggaagagauagccauaauguucacuuagcaccagcaguagcaccaucauuuccaggagaacaacuucuauuuuuuagaucaacaaugccaggaugcucagguuaucccaacaugaaucuagauugcuuacuaccacaagaauggguacaacauuucuaccaagaagcugcacccgcacaaagcgauguagcuuuacuuagauuuguaaaccccgacacaggacgaguacuauuugaauguaaacugcauaaaucuggauacguuacuguagcucacacaggacaacaugauuuagucaucccacccaauggauauuucagauuugacagcuggguaaaucaauuuuacacacuugcaccaaugggaaauggaacaggaagacgccgagcacucuaa

SEQ ID NO: 32549 - RNA, 1623 nt, Artificial Sequence
  derived and/or modified sequence opt6 from capsid_protein__Norovirus__ACL31320
augaaaauggcgucaucagaugcuaauccuuccgacggaucuacugcaaaccuuguaccagaagucaacaacgaaguaauggcucuagaaccaguaguaggugcagcuauagcugcaccugucgccggccaacaaaacguaauagauccauggauucguaauaacuucguacaagccccaggcggcgaauucaccguaucgccaagaaacgcaccaggagaaauacucuggagcgcaccauuaggucccgaccuaaacccuuaccuuucacauuuagcaagaauguauaacggcuaugcaggcggauuugaaguucaaguaauauuagcaggaaaugcauuuacagcaggaaaaauaauauucgccgcaguaccaccuaauuucccaacagaaggcuuauccccaucacaaguaacaauguucccccauauaauaguagacguacgacaauuagaaccaguacuaauaccauuaccagauguaagaaacaacuucuaucauuacaaccaaaguaaugaccccacaauaaaauuaaucgcaauguuauacacuccacucagagcaaacaaugcaggagaugaugucuuuacaguuuccuguagaguauuaacaagaccaucacccgauuuugacuuuauauuuuuaguacccccuacaguagaaucacgcacaaaaccauucucuguaccuauauuaacaguagaagaaaugacaaacagcagauuuccaaucccauuagaaagauuauuuacaggaccaucaucugccuuugucguacaaccacaaaauggaagaugcaccacagacggaguccuacucggaacaacucaauuaucaccaguaaauauaugcacauucagaggagauguaacacacauagcaggaacacaagaauacacaaugaauuuagcaagccaaaacuggaacaacuacgacccaacagaagaaaucccugcuccuuuaggaacacccgacuucguaggaaaaauacaaggagucuuaacacaaacaacacgcagagacggaucaacaagaggacacaaagcaacaguauccacaggaaguguaaacuucacaccaaaacuaggcagaauacaauucucuacagauacaucaaaugauuuugaaaccggccaaaauaccagauucacaccaguaggaguaguccaagacggaucaacaacacaccaaaacgaaccacaacaauggguuuuaccagacuauucuggaagagauucacacaacguccaccuagcaccugcaguagcaccaagcuuuccaggagaacaauuacuauucuuuagaucaacaaugccaggaugcucaggauacccaaauaugaauuuagauugccuucuuccacaagaauggguacaacauuucuaucaagaagcugccccagcccaaucugauguagcacuccuaagauuuguuaacccagacacuggacgaguauuauuugaaugcaaacuacacaaauccggcuauguaacagucgcacacacaggacaacaugaucuagucauuccaccaaacggcuauuuccgauucgacucuuggguaaaccaauuuuacacauuagcacccaugggaaauggaacaggaagacgcagagcauuauaa

SEQ ID NO: 32550 - RNA, 1623 nt, Artificial Sequence
  derived and/or modified sequence opt6 from capsid_protein__Norovirus__ACL31322
augaaaauggcauccucagaugcuaaucccucagauggcucaacagcaaauuuaguacccgaaguuaauaaugaaguaauggcacuagaaccuguaguaggagcagccauagcagcaccagucgccggacaacaaaauguaauagacccauggauaagaaauaacuucguacaagcuccugguggagaauuuaccguauccccaagaaacgcaccaggagaaauucuauggucagcuccacuaggaccagaucucaacccuuaucuaucucauuuagcucgaauguacaacgguuaugcuggaggauucgaaguacaaguaauacuagcagguaacgcauucacagcaggaaaaauaauauuugccgcuguucccccaaauuucccaacagaaggacuaucaccaucccaaguaacuauguucccacauauuauugucgauguuagacaauuagaaccuguacucauaccacuaccagacguacgaaacaacuuuuaccacuacaaucaaucaaacgacccaacaauaaaacuaauagcuaugcuauacaccccauuacgagcaaauaaugcaggagaugacguauuuacagucucuugcagaguacuaacacgcccuucuccagacuucgauuucauuuuucuaguaccaccaaccguugaaucaagaacaaaaccuuuuucaguaccaauacuaacaguagaagaaaugacuaauucuagauuucccauaccacuagaaaaauuauuuacugguccaucaucugcuuucguuguucaaccccaaaauggacguuguacaacagauggcguacuacuaggaacuacucaauuaucuccuguuaauauaugcacauucagaggagauguaacacauauagcugguacacaagaauacacaaugaauuuagccucacaaaacuggaacaacuaugacccaacagaagaaauaccagcaccacuagguacuccagauuucgucggaaaaauacaaggaguucuaacucaaacuacaagaagagauggaucaaccagaggacauaaagcgaccguuucaacugguucaguccacuucacaccuaaauuaggucguauucaauuuucaacagauacuuccaaugacuuugaaacaggccaaaauacccguuuuacucccguaggaguaguacaagacggauccacaacucaccaaaaugaaccccaacaaugggcacuaccagauuauuccggacgugauucacauaacguccaucuagcaccagccguagcaccaucauucccuggagaacaauuauuauuuuuuagaaguacaaugccuggauguucagguuauccuaauaugaacuuagacugucuccuaccacaagaauggguacaacauuuuuaucaagaagcagccccagcccaauccgauguugcacuacuaagauucguuaaccccgauacuggacgaguacuauucgaauguaaacuacauaaaucugguuacguaacugucgcccacacaggucaacacgauuuaguaauaccaccuaacggauacuuuagauuugauucuugggucaaccaauuuuauacauuagcaccaauggguaacggcaccggacgaagaagagcucuuuaa

SEQ ID NO: 32551 - RNA, 1623 nt, Artificial Sequence
  derived and/or modified sequence opt6 from capsid_protein__Norovirus__ACL31324
augaaaauggccucaucagaugccaauccaucugauggaucaacagccaaucuuguaccagaagucaauaaugaaguuauggcuuuagaacccguuguaggagcagcaauagccgccccaguagcaggacaacaaaacguaauagacccauggauaagaaauaacuucguucaagcuccaggaggagaauuuacaguaucuccuagaaaugcaccuggagaaauauuauggucagcuccauuaggaccagauuuaaauccauauuugucccaccuugcaagaauguauaaugguuaugcaggagguuucgaaguacaaguaauacuagcaggaaaugccuuuacagcaggaaaaauaauuuucgcagcaguaccaccaaacuuuccaacagaaggacuaucuccaucacaaguuacuauguucccacauauaaucguagacguuagacaauuagaaccaguacuaauaccccuaccagacguacguaauaauuuuuaccauuauaaccaaagcaaugacagcacuauuaaauuaauagcaaugcuauacacaccauuacgugcaaacaaugcaggagacgauguauuuacagucucaugccgcguccuuacacgaccauccccagacuuugacuucaucuuucuaguaccacccacuguagaaaguagaacuaaaccauuuucagucccaauacuaacaguagaagaaaugacaaauucacgauuucccauaccauuagaacgacuuuuuacaggcccaucauccgcauuugucguccaaccccaaaauggccgcugcacuacagacggcguauuacuaggaacaacucaacuaucaccaguaaauauauguacauuccgaggugauguaacccauauagcaggaacacaagaauauacaaugaaucuagcaucacaaaauuggaacaacuacgacccaacugaagaaauaccagcaccucuagguacacccgacuucgucgguaaaauacaaggaguauuaacacaaacaacuagaagagacggaucaacccgaggacacaaagcaacaguaucuacaggaucaguacauuucacuccaaaauuaggaagaauacaauucucuacugauacaucaaacgauuuugaaacaggacaaaacacaagauucacaccaguaggcguaguucaagacggaggaaccacccaucaaaaugaaccccaacaauggguuuuaccagauuacucagguagagacggucauaauguacacuuagcuccagcaguagcacccucuuuccccggagaacaacuucuauucuuucgauccacuaugccaggaugcucaggauauccaaacaugaaccuugacugucuuuuaccccaagaauggguccaacacuuuuaccaagaagccgcucccgcacaaucagacguagcauuacuaagauuuguuaaccccgacacuggacgaguucucuucgaaugcaaauuacacaaaucaggauauguaacuguagcacacacaggacaacacgaccuaguaauaccaccaaauggauauuuccgauuugauuccugggucaaccaauuuuacacacuugcaccaauggguaacggaacuggaagaagaagagcauuauga

SEQ ID NO: 32552 - RNA, 1608 nt, Artificial Sequence
  derived and/or modified sequence opt6 from capsid_protein__Norovirus__ACL31325
augaaaauggcaucaaaugaugcugcucccucaaacgauggcgcagcaggacuaguaccagaaguaaauaacgaaacaauggcauuagaaccaguuguaggcgcuuccauagcagcaccacuuacuggacaaaauaacguaauagacccauggauaagacuaaauuuuguacaagcuccaaauggagaauuuacaguuaguccaagaaacucaccuggugaaguauuacuuaaccuggaacuagguccugaauuaaacccauauuuagcacauuuaucacgaauguacaauggcuaugcuggaggaguagaaguacaaguauuauuagcaggaacagcauucacagccggaaaacuaguauuugcagcaguuccaccccauuuuccauuagaaaauauaucaccaggucaaauaaccauguuuccccauguaauaauagauguacgcacauuagaaccuguuuuacuaccacuaccagauguucgaaauaauuuuuuucauuauaaucaacaaaacgaaccacgaaugagacuaguagcaauguuauauacuccacuccgaucaaacggcuccggugaugaugucuucacaguaucauguagaguauuaacaagaccaucuccagauuucgauuucaauuacuuagugccaccaacaguagaaaguaaaaccaaaccuuuuacucuuccuauacuaaccauaggugaauuaacaaauucaagauucccuguaccaauagaugaauuauauacaucacccaaugaaucuuuaguaguacaaccucaaaauggaagaugcgcacuugacggugaacuccaaggaacaacacaauuacuuccaaccgccauauguucauucagaggacgaauaaaucaaaaaguaucaggagaaaaucauguauggaauaugcaaguuaccaauauaaaugguacaccauuugacccaacagaagaugucccugcuccauuaggaacuccagacuucuccggcaaauuauuugguguuuuaucucaacgugaucacgcaaaugcauguagaucacaugacgcagucauugcuacuaauucagcuaaauuuacucccaaacuuggagcuauacaaauaggaacaugggaacaagacgacguacauauuaaucaaccuaccaaauucacaccuguaggauuauucgaaaaugaagguuuuaaucaauggacccuaccuaacuauucaggagcuuuaaccuuaaauaugggacuugccccuccaguagcuccaacuuuccccggagaacaaauacuuuuuuuucguucacauaucccccucaaaggcggaguagcagauccuguaauagauugucuucuuccacaagaauggauacaacauuuauaccaagaaucagcaccaucacaaacagacguugcacuuauaagauucacuaauccagacacaggcagagucuuauuugaagcaaaacuucaucgauccggauauauaaccguagcaaacacaggaucaagaccaauaguuguaccugcuaauggguauuuccguuucgauucauggguaaaccaauuuuacucacuagccccaauggguacuggaaacggaagaagaagaguacaauaa

SEQ ID NO: 32553 - RNA, 1629 nt, Artificial Sequence
  derived and/or modified sequence opt6 from capsid_protein__Norovirus__ACL31326
augaaaauggccagcaacgaugcagcaccaucaaacgauggcgcagcaucauuagucccagagggaguaaacgaaacaaugccauuagaaccuguagccggagcaucuauagcagcuccagucgcaggucaaaccaacauaauagacccauggauacguaccaacuuuguacaagcacccaauggugaauucacaguauccccacguaauagucccggcgaaauacuauuaaacuuagaacuaggaccagaccuaaaccccuaucuagcccaccuaucacguauguauaauggauaugcaggugguguugaaguacaaguauuauuagcaggaaaugcauucacugcagguaaaauccuauuugcagcaauaccacccaauuucccaguagauaugauaucuccugcucaaauaacaaugcuuccccaccuaauaguagauguaagaacucuugaaccaauuaugauaccucuaccugacguccgaaacguauuuuaucauuucaauaaccaaccccaaccaagaaugagauuaguagcaauguuauauaccccauuaagaucuaauggaucaggagaugauguauuuacaguaucuuguagagucuuaaccagaccaacuccagauuucgaauuuaucuaccuaguaccaccuucaguagaaucaaaaacaaaaccauuuacauuaccaaucuuaacaauuagugaacuaacaaauaguagauuuccaauacccauagaacaauuauacacagcaccaaaugaaacaaacguaguucaaugucaaaauggacgaugcacacucgauggagaauuacaaggaacaacacaauuacuaucuucagcaguaugcuccuacagaggcagaaccguagcaaacuccggugacaauugggaucaaaauuuauuacaauuaacauacccuaacggcgcuucuuacgauccuacagaugaaguaccagcaccauuaggaacacaagacuuuucaggaaugcuuuauggaguucuaacucaagauaauguuaacguauccacaggugaagcuaaaaaugcuaaaggaauauauauaucaacuacaagcggcaaauuuacaccaaaaauuggaucuauuggacuccacucaauaaccgaacacguucaccccaaccaacaauccagauucaccccagucgguguagccguaaacgaaaauacaccuuuucaacaauggguauuaccucacuaugccgguucuuuagcauuaaacacaaaccuagcaccagcugucgcaccaacauuuccuggagaacaacuacuauucuucagaucaagaguaccaugcguccaaggacuacaaggacaagacgcauuuauagauugucuauuaccucaagaauggguaaaucauuuuuaccaagaagcagcaccaucacaagcugacguagcacuuauucgauauguuaauccugauacaggacgaacauuauuugaagcaaaauuacaccgaaguggauucauaacuguaucucauacaggagccuauccauuaguaguaccaccaaauggacacuuuagauuugacuccuggguaaaccaauuuuauucauuagcaccuauggguacaggaaacgguagaagaagaguacaauaa

SEQ ID NO: 32554 - RNA, 1623 nt, Artificial Sequence
  derived and/or modified sequence opt6 from capsid_protein__Norovirus__ACL31340
augaaaauggcaaguaaugacgcaacaccaucagacggaucaacagcuaaccuaguaccagaaguaaacaacgaaguaauggcauuagaaccagucgucggagcagcaauugcagcaccaguagcuggacaacaaaaugucauugauccauggauaagaaauaacuuuguacaagcuccaggaggagaauuuacaguaucaccacgcaacgcaccaggagaaauacuauggucugccccucuaggccccgacuuaaacccauaucuuucacauuuaaguagaauguauaacggauacgcugggggauucgaaguucaagucauauuagcaggcaacgcauuuacagcaggaaaaauaauauucgcagccguuccaccaaacuuuccaacagaaggcuuaucaccaucucaaguaacaauguucccccacauaauaguagacguacgacagcuugaaccaguacuaauaccacuaccagacguaagaaauaauuucuaucacuauaaccaaucaaaugacccuacaaucaaauuaauagcaauguuauacacuccacuacgugcaaacaaugccggagacgacguguuuacaguuagcugucgcguacuuacacgaccaucuccugacuuugauuuuauauuucuagucccaccgacaguagaaucaagaacaaaaccauuuucuguacccauauuaacaguagaagaaaugacaaauucaagauuucccauaccacucgaaaaacuauucaccggaccuucaucagcauucguaguacaaccacaaaacggacgauguacaacugauggaguuuuacuaggaaccacacaauuaucacccguaaauauuuguacauuucgagguaacguaacaaauaucgcaggaucucaaacauacacaaugaacuuagcuucacaaaauuggaauaauuacgaccccacagaagaaauaccugcaccacuaggaacaccugauuucguuggaaaaauacaaggaguauuaacacaaacaacaaaaggagacggcucaaccagaggacacaaagcaacaguaucaacaggaucagcucaauuuacuccaaaauuaggaucuguacaauuuucaacagauacaucaacagauuuugaaacaggacaaaauacuagauuuacaccagucggaguuauacaagauggcucuacuacucauaaaaaugaaccucaacaauggguacuaccauccuauaguggacgagauucacauaacguccaucuagccccagcaguagcaccaaccuuuccaggugaacaaauauuauucuuuagaucaaccaugcccggauguucggguuaccccaauauggaucuagacugucucuuaccacaagaauggguccaacauuuuuaccaagaaagugcaccagcacaaucugauguagcacuauuaagauuuguaaacccagauacaggacgaguucuuuucgaaugcaaauuacacaaaucuggauacguaacaguagcccacacuggucaacacgaucuugucauaccaccaaauggauauuucagauucgacuccugggucaaucaauuuuauacacuagcaccuaugggaaacggagcaggaagacgaagagcauuauaa

SEQ ID NO: 32555 - RNA, 1623 nt, Artificial Sequence
  derived and/or modified sequence opt6 from capsid_protein__Norovirus__ACL31354
augaaaauggcauccaaugacgcaaacccaucagacggcagugcagcuaaccuaguaccagaaguaucaaaugaagucauggcuuuagaaccaguuguaggagcugcaauagcugcaccaguugcaggacaacaaaauguaauagacccuuggauaagaaauaacuuuguccaagccccaggaggcgaauuuacaguuuccccaagaaaugcuccgggugaaauccuauggucagcaccacucgguccagaucuaaauccauaucucucacacuuagcaagaauguauaauggauacgccggaggauuugaaguacaagucauacuagcaggaaaugcuuuuacagcaggcaaaauaauauuugcagcaguaccuccuaacuuuccaacggaaggccucucaccaucucaaguaacuauguucccccacauaauuguagauguacgacaacuagaaccaguacuaauuccucuaccagauguaagaaacaauuuuuaucacuauaaccaauuaaaugacucaacuauuaaacuuauagccaugcuauacacaccauuaagagcaaacaaugcaggcgaagacguauuuaccguaucuugcagaguucuaacaagaccuucaccagauuuugauuuuauauuucuaguacccccuacaguagaaagucgaacuaaaccauucacuguaccuauauuaaccguagaagaaaugacuaacucaagauuccccauaccauuagaaaaacuauuuacaggaccaucaggagcauuuguuguacaaccccaaaacggaagaugcacaaccgacgguguacuucuaggaacaacacaacuaucaccaguaaauauauguacauuuagaggugacguaacccacauagcaggaucaagagacuauacaaugaaccuagcaagcuuaaauuggaacaauuaugauccaacagaagaaaucccagcaccucuagguacuccagauuuuguaggcaaaauacagggaguacucacacaaacaacuaaaggcgauggauccacaagaggacacaaagcaacaguauacacaggaucugcaccauuuacaccuaaauuaggaucaguacaauucucaacagauacagaaaacgauuucgaaacucaucaaaauacaaaauucacaccaguaggaguaauacaagacggaucaacaacacaucgaaaugaaccucaacaauggguacuaccuagcuauucuggccgcaauguacauaacguacacuuagcaccagcaguagcccccacauuucccggagaacaauuauuauucuuucgcucaaccaugccaggauguucaggauauccaaauauggauuuagauugccuacuaccacaagaauggguacaacauuucuaucaagaagcagcuccagcucaaucagauguagccuuauuaagauuuguaaacccagauacaggcagaguacuuuuugaauguaaacuacauaaaucaggauacguaacagucgcacauaccggacaacaugauuuaguuauaccaccaaauggauauuuucgauuugacagcuggguaaaucaauucuauaccuuagcacccaugggaaauggaacaggucggagaagagcuuuauaa

SEQ ID NO: 32556 - RNA, 1623 nt, Artificial Sequence
  derived and/or modified sequence opt6 from capsid_protein__Norovirus__ACL31355
augaaaauggcuaguaacgacgcaaacccgucugauggaagugcagcuaaccuaguaccugaaguaucaaaugaaguaauggcauuagagccaguaguaggugcagcaauugcagcuccagucgcaggccaacaaaaugucauugauccauggauacgcaauaauuuuguacaagcaccaggaggggaauuuacaguaaguccaagaaaugcaccuggugaaauacugugguccgcuccauuaggaccagacuuaaauccauaucuaucacaucuagcaagaauguauaaugguuaugcaggaggauucgaaguacaaguaauauuagccggcaaugccuuuacugcaggaaaaauaauauuugcagcaguaccaccuaacuuuccuacagaaggauuaaguccaucccaaguaacaauguucccccauauaauaguugaugucagacaacuagaaccaguauuaauuccauuaccagauguuagaaacaauuucuaucacuauaaucaaucaaacgacucuacaauuaaacuaauagcaaugcuauauacaccauuaagagcaaauaaugcaggagaagacguauuuacaguauccuguagaguacuaacacgaccauccccugacuuugauuuuauauuccuuguaccacccacaguagaaucaagaacaaaaccauuuacaguucccauauuaacaguggaagaaaugacaaacucaagauuuccaauucccuuagaaaaacuauucacuggaccaucaggugcauucguaguacaaccccaaaacggaagauguacaacugacggaguauuacuaggaacaacacaauuaucaccaguuaauauauguacauuuagaggcgauguuacacauauagccggaucccguaacuauacaaugaaucuagcaucauuaaauuggaacaauuacgauccaacagaagaaaucccagccccauuaggaacuccagacuucguaggaaaaauacaagguguacuaacacaaacaacaaaaggugacggaucaacccgaggucacaaagcaacaguauauacaggaagugcuccauucaccccaaaauuagguucaguccaauucaguacagauacagaaaacgauuuugaagcucaucaaaauacuaaauuuacaccaguaggaguuauccaagacggaggaacaacucacagaaaugaaccacaacaaugggucuuaccaagcuacaguggaagaaauguacacaacguccaucuagcucccgcaguugcaccuacauuuccaggugaacaacuuuuauucuuucgaucaacaaugcccggauguucuggauacccaaauauggaucuagauugccuacuuccacaagaauggguacaacauuucuaucaagaagcagcacccgcacaauccgacgucgcauuacuucgauuuguaaacccugauacaggaagaguauuauucgaaugcaaauuacauaaaaguggcuacguaacuguagcacauacuggacaacacgaccuaguaauaccuccaaauggauauuuccgcuuugauuccuggguuaaucaauucuacacauuagccccaaugggaaauggaacuggaagaagaagagccuuauaa

SEQ ID NO: 32557 - RNA, 1623 nt, Artificial Sequence
  derived and/or modified sequence opt6 from capsid_protein__Norovirus__ACL31356
augaaaauggcaucaaaugacgcaaaccccucagauggaucagcagcaaaucucguaccagaaguaucaaacgaaguaauggcacuugaacccguuguaggugcagcaaucgcagccccggucgcaggccaacaaaaugucauagacccauggauaagaaauaauuucguccaagcaccaggcggagaauuuacaguaucaccaagaaacgcaccaggagaaauauuaugguccgcaccauuaggaccagaucuaaauccauaucuaucacaccucgcccgaauguacaacgguuaugcuggcggauucgaaguucaaguaauacuugcuggaaaugcauucacugcaggcaaaauaauauucgcagcaguacccccaaauuuuccaacagaaggccuuucuccaucccaaguaacaauguucccacauaucaucguagauguccgucaauuggaacccguacuuauacccuuaccagauguaagaaauaacuuuuaucauuauaaccaaucaaaugacucuacaauaaaacuaauagcaauguuauauacaccucuccgagcaaacaaugcaggagaagauguauucacaguaucaugcagaguccuaacccgaccaucaccugauuuugacuuuaucuuucucguccccccuacaguagaaucuagaacaaaacccuuuacugucccuauauuaacuguagaagaaaugacaaacucaagauuccccauaccucuagaaaaauuauuuacaggaccaucuggagcauuuguaguacaaccucaaaacgguagaugcacaacugacggagucuuauuagguacgacacaauuaucaccaguaaauauuuguacuuuccgaggagacguuacucauauagcaggaucaagaaauuauacaaugaacuuagcaucauuaaauuggaacaauuacgauccuacugaagaaauaccugcaccacuaggaacaccagacuuuguaggaaaaauacaaggaguauuaacacaaacaaccaaaggggacggcucaacaagaggacacaaagcaacagucuauacaggauccgcaccuuucacaccaaaauuaggaucaguacaauucucaacagauaccgaaaaugauuuugaaacccaucagaacacaaaauucacuccagucggaguaauacaagacgggucaacaacacauagaaaugaaccacaacaauggguacuaccuuccuauucaggacgaaauguccauaacguacacuuagcaccagcuguagccccuaccuucccaggagaacaauuauuauuuuuuagaucuacaaugccagguuguucaggauaucccaacauggaucuagauugcuuacuaccacaagaauggguacaacauuucuaucaagaagccgcaccugcacaaucugauguugcauuacuaagauuuguuaacccagacacaggaagaguauuauuugaaugcaaacuacauaaaucuggauauguuaccguagcacauacuggacaacacgauuuaguaauaccucccaacggauacuuuagauuugauuccuggguaaaucaauuuuacacucucgcuccaaugggaaauggaaccggcagacgucgcgcucucuaa

SEQ ID NO: 32558 - RNA, 1623 nt, Artificial Sequence
  derived and/or modified sequence opt6 from capsid_protein__Norovirus__ACL31358
augaaaauggccaguaaugacgcaaacccaagcgaugguuccgcagcgaauuuaguaccugaaguaucaaaugaaguaauggcccucgaaccuguaguaggagcagccauagcagcucccguagccggacaacaaaacguaauagauccauggauuagaaauaacuuuguacaagcaccaggaggagaauuuacaguaaguccaagaaaugcaccaggagaaauacuauggagugcaccauuaggaccagauuuaaauccuuaucuaucucauuuagcuagaauguauaacgguuacgcaggcggcuucgaaguacaagucauauuagcagguaaugcuuuuacagcaggaaaaauaauauuugcagcagugccuccaaacuuuccaacagaaggacuauccccaucccaaguaaccauguucccacacauaaucguagauguacgacaauuagaaccaguauuaauaccccuaccagauguuagaaacaauuucuaccauuauaaccaaucaaacgauucaacuauuaaauugauagcuaugcucuacacaccacuacgagcuaauaaugcuggagaagacguauuuacaguaucauguagaguacucacacgaccaucacccgacuuugauuuuaucuuuuuaguacccccaaccguugaaucuagaacaaaaccauucacaguaccaauauuaaccguagaagaaaugacaaauucuagauuuccaauucccuuagaaaaacuauucacaggaccaucaggagcuuucguaguucaaccacaaaacggaagaugcacaacagacggaguacucuuaggaacuacacaauuaucaccaguaaacauauguaccuuuagaggcgacguaauacacauagcaggaagucgaaacuauacaaugaauuuggcuucauuaaacuggaauaauuacgaucccacugaagaaaucccagcaccauuaggaacaccagauuuuguaggaaaaauacaagguguauuaacacaaacaacaaaaggagacggauccacucguggacacaaagcuaccguauauacaggaucagcaccauuuacuccaaaacuaggcucaguacaauucucuacagacacagaaaacgauuucgaagcccaucaaaauacaaaauucacuccaguaggaguaauccaagacggaggaacaacacacagaaacgaaccacaacaauggguacuuccaucauauucaggaagaaacguacacaauguacacuuagcgccugcaguagcaccaaccuuuccaggagaacaacuuuuauucuuucgaucaacaaugccagguugcuccgguuacccaaauauggacuuagauugcuuauuaccacaagaauggguacaacauuuuuaccaagaagcagcgccagcccaaagcgacguugcauuauuaagauucgucaacccagauacugguagaguacuauucgaaugcaaacuacacaaaucaggauauguaacugucgcacauacuggccaacaugacuuaguaauaccaccuaauggcuauuucagauuugacucauggguuaaucaauuuuacacacuagcaccaaugggcaaugguaccggacgaagaagagcauuauaa

SEQ ID NO: 32559 - RNA, 1647 nt, Artificial Sequence
  derived and/or modified sequence opt6 from capsid_protein__Norovirus__ACL31361
augaaaauggcuucaaacgacgcagcaccaucuaacgacggagcagcaggacuagucccagaaauuaauaaugaagcaauggccuuagaacccguugcaggugcagcuauagcagcaccccuuacaggacaacaaaauauaauagauccauggauaaugaacaacuucguacaagcaccuggaggagaauucacaguaaguccuagaaacucaccaggugaaguccuauuaaauuuagaauuaggaccagaaauaaauccauacuuagcccaccuugcaagaauguauaacggcuaugcagguggauuugaaguacaaguaguacuagcaggaaacgccuuuacagcagggaaaauaauuuuugccgccauuccaccaaauuuucccauagacaacuugucagcugcgcaaauaacaauguguccacacgucauaguugacgucagacaacucgaaccaguaaacuuaccaaugccagacguacgaaacaacuucuuucacuauaaccaaggaucagacaguagacuacgauuaauagcaauguuauauacaccacuacgagccaacaacucaggagacgacgucuucacuguuucaugccgaguucucacuagaccauccccagacuucucauucaauuuccucguacccccaacuguagaaucaaaaacaaaaccuuuuuccuuaccuauacuaacaaucucagaaauguccaauucaagauucccaguuccaauagacaguuuacacacaucuccaaccgagaauauagucguacaaugucaaaauggaagaguuacacuagauggagaacuaaugggaaccacacaauuauuaccaucacaaauaugugccuuccgaggaguacuaacaaggucaacaucaagagcuucugaccaagcagacacagcaaccccacgacuauuuaauuacuauuggcauauacaacuagauaaccuuaacgguacaccauaugacccagcagaagauauccccgguccccuuggcacaccagacuuuagaggcaaaguauuuggagucgcaucucaaagaaacccagacuccacaacaagagcucaugaagcuaaaauagauacaaccucaggaagauucacaccaaaauuaggaagucuagaaaucuccacagaaucugacgauuucgaccaaaauaaaccaacaagauuuacuccaguuggaauaggaguagaccaugaagcugauuuucaacaaugggcccuaccagauuaugcuggacaauucacacauaauaugaacuuagcaccagcaguagcaccuaacuuuccaggagaacaacuacuauucuuucgaucucaauuacccucaucaggaggccgcuccaauggaauuuuagauugcuuaguaccucaagaauggguucaacauuuuuaucaagaaucagcuccaucacaaucacaaguagcacugguaagauacauaaacccugauacaggacguguacuauucgaagcuaaauuacauaaacuuggauuuauaacuauagcaaaaaacggagauucaccaaucacaguaccaccaaacggauacuuuagauuugaaucauggguaaacccuuucuacacauuagcacccaugggcacuggaaauggaagaagaagaauacaauaa

SEQ ID NO: 32560 - RNA, 1623 nt, Artificial Sequence
  derived and/or modified sequence opt6 from capsid_protein__Norovirus__ACL31365
augaaaauggcaucaaaugacgcaaaucccucagacggaucagcugcuaaccuaguacccgaaguaucaaaugaaguuauggccuuagaaccaguaguaggagcagcaauagcagcaccaguagcaggacaacaaaaugucaucgauccauggauacgcaauaacuucguacaagcaccaggaggagaauuuacaguaucacccagaaaugccccaggagaaauacuauggucugcaccauuagguccagacuuaaauccauaccugagucacuuagcaagaauguacaacgguuacgcuggaggauuugaaguacaaguaauauuagcuggaaacgcuuuuacagcagguaaaaucauuuuugcagccgucccaccaaauuuuccuacagaaggacuuucacccucccaaguaacuauguuuccacauauuaucguagacguaagacaacucgaaccaguccuaauuccacuccccgauguuagaaauaauuucuaucacuauaaccaaucuaacgauucuacaauaaaauuaaucgcaauguuauacacuccuuuacgagcaaauaaugcaggagaagauguauuuacaguaagcugcagaguacuaacuagacccuccccagauuucgauuuuauauuuuuaguacccccuacagucgagucuagaacuaagccauuuacaguaccaauucucacaguagaagaaaugaccaauucuagauuuccaauaccacuagaaaaacuauuuacaggaccaucaggagcauuuguuguacaaccacaaaauggccgauguacaacugacggcguacuacuaggaacuacacaacuuagcccagucaacaucuguacguuuagaggagacguuacacauauagcaggaagucauaauuauacaaugaaucuagccuccuuaaacuggaauaacuacgauccaacagaagaaauaccugcaccuuuggguacaccagauuuuguaggcaaaauacaagguguacuaacacaaacuacuaaaggagauggaucaacacgcggucacaaagccacaguauauacuggaucagcacccuucacaccaaaacucggaucuguacaauucucuacagacacugaaaaugauuucgaaacucaucaaaauacuaaauucaccccaguagguguuauacaagaugguucaaccacacacagaaaugaaccacagcaauggguacuaccaaguuauucaggaucuaacguucacaauguccauuuagccccagcaguagcaccaacguuuccaggugaacaauuauuauuuuuuagaucuacaaugccaggaugcucaggcuacccaaauauggacuuagacugucuacucccccaagaauggguacaacacuucuaucaagaagcagcaccugcacaaucagacguagcacuucuacgauuuguuaacccagacacuggccgaguacuauucgaauguaaauuacacaaauccggauauguaacaguagcacauaccggacaacaugaccuuguuauaccccccaauggauacuucagauuugacucaugggucaaucaauucuauacacucgcaccuaugggaaacgguacaggaagaagaagagcuuuauaa

SEQ ID NO: 32561 - RNA, 1623 nt, Artificial Sequence
  derived and/or modified sequence opt6 from capsid_protein__Norovirus__ACL36375
augaaaauggcauccaaugacgcaaauccaucagacgguucagcagcuaaucuaguaccagaaguuaauaaugaaguaauggcauuagaacccgucguuggagcagcaauugcagcaccaguagcaggacaacaaaauguaauagacccauggauacgaaauaacuuuguacaagcucccggcggugaauuuacagucucacccagaaacgcaccaggagaaauacuauggucagcuccacuaggacccgacuuaaacccauaucucucacaccuagcaagaauguauaacggauacgcagguggauucgaaguacaaguaauacuagcaggaaacgcauuuaccgcaggcaaaaucauauucgcagcaguaccccccaacuucccaacagaaggauuaucuccuucccaaguuacaauguuuccacacauaauaguagacguaagacaauuagaaccaguauuaauaccuuuaccagacguuagaaacaauuucuaccacuauaaccaaucaaaugacccuaccauaaaauuaauagcaauguuauauacaccacuaagagccaacaaugcaggagaagauguauuuacaguuucuuguagaguacuaacacguccaucacccgauuuugauuuuauauuuuuagucccaccaaccguagaaucacgaaccaaaccuuucacaguaccaauauuaacuguagaagaaaugacaaauucaagguucccaaucccuuuagaaaaauuauucacaggaccaagcagcgcauucguaguacaaccucaaaacggaagauguacuacugauggugucuuauuaggaaccacacaauuauccccugucaauauuugcacauuccgaggagacgucacacacauagcagguucacgaaauuauacaaugaauuuagcuucauuaaacuggaacaauuacgauccaacagaagaaguuccagcaccucuugguacaccugacuuuguaggaaaaauucaaggaguauuaacacaaacaaccaaaggugacggaucuacuagaggacacaaagcaacaguauacacaggaagcgcucccuucacaccaaaacuaggcucaguacaauuuucaacagacaccgaaaacgauuucgaaacacaucaaaauaccaaauuuaccccaguaggaguaauacaagacggcucaacaacacaucgcaacgaaccacaacaauggguacuaccaaguuacucaggcagaaauguacaaaauguacaccuagcucccgcaguagcuccaacauuuccaggcgaacaauuauuauuuuuucguucaacuaugccaggauguuccggauacccaaauauggaccuugauuguuuacuaccucaagaauggguacaacacuucuaucaagaagcagcacccgcucaaucagacguagcauuauuaagauucgucaauccagacacuggacgcguucuauuugaauguaaauuacauaaaucaggauaugucaccguugcgcauacaggacaacaugauuuaguaauaccacccaauggcuauuucagauucgacucuugggucaaccaauucuacacauuagcaccaaugggaaauggaacaggcagacgaagagcauuauaa

SEQ ID NO: 32562 - RNA, 1593 nt, Artificial Sequence
  derived and/or modified sequence opt6 from capsid_protein__Norovirus__ACN32270
augaugauggcuaguaaagaugcaacaucaucaguagauggugcaucaggagcaggacaacuuguaccugaaguaaaugcaucagauccacuagcuauggacccaguagcuggaucauccacagcaguagcaaccgcuggucaaguaaacccuauagauccuuggauaauaaauaauuuuguacaagcaccacaaggagaauuuacaauaucaccaaacaauacaccaggcgacguauuauucgauuuaucacuaggcccacauuuaaaucccuuuuuauuacauuuaucccagauguauaaugguuggguaggaaauaugagaguuagaauaaugcuugcaggaaaugcauucacugcagguaaaauaauaguaaguuguauaccacccgguuuuggaucacacaauuuaacaaucgcacaagcaacauuauuuccucacguaauagcagauguaagaacauuagauccuauugaaguaccucuagaagacguuagaaacguucucuuucacaauaacgauagaaaccaacagacaaugcgacuaguauguaugcuauacacaccauuaagaacaggaggaggaacuggugacucuuuuguagucgcagguagaguuaugacauguccuucaccagacuuuaacuuucuauuucuagugcccccaacuguugaacagaaaacaagaccuuucacacuuccuaacuuacccuuauccucauuaucaaauagucgagcucccuuaccaauuucugggauggguauaucacccgacaauguacaaucgguacaauuucaaaauggaagaugcacacuugauggacgauuaguuggcacuacaccaguaucacuaucccacguugcgaaaauaagaggaacuucaaacggaacaguaaucaaucucaccgaacuugaugguacacccuuucauccauuugaaggaccugcaccaauaggauuccccgaccuuggaggaugugacuggcauauaaauaugacacaauucggccauuccucacaaacccaauaugauguagacaccacaccagauacauuugucccacacuuaggaucaauucaagcaaaugguauaaauucaggaaauuacauaggaguauuaucauggguaucaccaccaucacauccaucaggaucucaaguagauuuauggaaaauaccuaauuauggcucuucuauaacagaagccacucaucuugcaccaucaguauuucccccaggauuuggagaaguauuaguuuuuuuuaugaguaaaauaccaggcccaggagcauacucauuaccaugucuacuaccacaagaauauauaucacaccuagcaucugaacaagcuccuacaguaggagaagcagcauuacuacauuacguagacccagauaccggaagaaacuuaggugaauucaaagcauauccagacggauuuuuaacuuguguaccaaauggagcuucaucuggcccucaacaauuaccuaucaacggaguauuuguauuuguuucauggguaucaagauuuuaucaacuaaaaccaguuggaacagcauccacagcaagaggacgauuaggacuuagacgauaa

SEQ ID NO: 32563 - RNA, 1608 nt, Artificial Sequence
  derived and/or modified sequence opt6 from capsid_protein__Norovirus__ACT52403
augaaaauggccucaaaugaugcuucaccaucaucugauggaucagcaaacuuaguaccagaaauuaacaaugaaguaauggcacuugaaccaguagcaggcgcagcaaucgcagcaccagucgccggucaacaaaauauuauagacccuuggauaagaaacaauuucguacaagcccccggaggagaauucacagucucuccacgauccgcaccaggagaaguacuacucaauuuaccacucucuccagauauaaauccuuaucuagcacaccuauccagaauguauaacggauacgcuggcggaguagaaguagaagucguacuagcaggcaacgccuuuacagccggaaaaauuauuuuugcagcagucccgccaaauuuuccaccagaaaaucuuucaccuucacaaauuacaaugcuaccacauauaauuguagauguuagacaacuagaaccagucagaauuccauuaccagacguaagaaacaauuucuaccacuauagucgugaaaacgacucuacauuaagacucauagccaugcuauauacacccuuacgagcaaacaaugcaggcgacgacguauuuacaguaucuugccgaguuuuaacaagaccaucaccagacuuugauuuuauauuucuaguuccccccacaguagaaucaaaauccaaaccauucacuauacccauacuuacaauagaagaaaugacuaauucucgauucccagcaccccuugaaaugaugacaacagguccaucacacgauaucguaguacaaccacaaaauggacgauguacaauagauggaguauuauuagguaccacacaacuaucaccaguaaauauauguucaaugagagguguaccaacaaaacgaacaaauggaacagacaauuguuuuguacaacucgaaaauccaaauggaucagcauaugacccaacagaagacauuccagccguucuaggaucgccagauuuuguaggagaauuuuauggcaccauaacacaacgaucuccaaauaauucaacaagagcacaccccuuuacauuaaacacagguucaccuagauauaccccaaaaauaggaucaguagacauacacguaacagacguugaagauuuaaacgaccaugaaccaguuaaacuaaccccaguaggauugucagguucaucuggaucaauacaucaauggcaacuuccaaacuauaguggaguagcaacacauaacaugcaccuagcuccauccguugccccccucuuuccaggagaacaaauacuauuuuuucguucaacaguaccaggauguggaggcuauccaaauacuaacauagacugccuaaucccacaagaauggguucaacacuucuaccaagaaggcgcacccgcucguacugauguagcuuuacuaagauucauaaauccagauacaggcagaguauuauuugaaugcaaauuacacaaacacggauuuauaacagucgcauauucaggaaaccacgauuuaguuaugccaccaaacggcuacuuucgauuugaaucaugggucaaccaauuccauacauuagcaccaaugggaacagguucaggaagacgucgaauccaauaa

SEQ ID NO: 32564 - RNA, 1647 nt, Artificial Sequence
  derived and/or modified sequence opt6 from capsid_protein__Norovirus__ACT52405
augaaaauggcaucaaaugaugcuaccccauccaacgauggagcagcuggucuaguacccgaaauuaacaaugaagcuauggcucuagauccaguugcaggagcagcaauagcugcaccacuaacaggucaacaaaauauaauugauccuuggaucauggauaauuuuguacaagcaccuggaggugaauucacaguaaguccucgaaauucuccaggagaaguauuauuaaaccuagaacucggaccagaaauuaacccauaccuagcccaucuugccagaauguacaacggauacgcaggcggcuucgaaguacaaguaguacuagcaggaaaugcuuuuaccgccgguaaaaucauauucgcugcaauaccaccuaacuuuccaauagauaauuuaucagcagcucaaauaacaaugugcccucauguuauaguagacguccgucaacuagaacccgucaaucuaccaaugccagacguaagaaacaauuucuuucauuauaaccaaggaagugauagcagacuuagacuaauagcaaugcuauacacaccacuacgugccaacaauagcggagacgauguauucacaguuuccugucgaguacuuacaagaccgucaccagauuuuucauucaauuuuuuaguaccaccaacaguagaaucaaaaacuaaaccuuucacuuuaccaauauuaacaauaucagaaaugucaaauucacgauuucccguacccauagauucucuacauacaucuccaacagacaauaucguaguacaaugccaaaacggccgcguaacauuagauggagaauuaaugggcacaacacaacuacuuccaucacaaauaugcgcauuuagaggaguacuuacucgcuccacaucccgagcaucugaucaagcagacacagcaacaccuagauuauucaauuacuauuggcauauacaacuugauaauuuaaacgguaccccuuaugauccagcagaagacauaccaggaccacuaggaacaccagauuucagaggaaaagucuucgguguagcuucacaaagaaauccagauucaacaaccagagcacacgaagcuaaaguagacacaacagcaggaagauucacuccaaaacuaggaucacucgaaauaucaacugaaucaaacgauuuugaucaaaaucaaccaacaagauuuacaccaguagguauaggcguugaucaugaagccgacuuucaacaauggaguuuaccagacuacuccggacaauuuacccauaacaugaauuuaguucccgcagucgcaccuaacuuuccuggagaacaauuauuauucuuuagaucacaauuaccuucaucaggcggaagaaguaauggcauacuagacugcuuaguaccacaagaauggguucaacauuucuaucaagaaucagcuccagcacaaacacaaguugcucuuguccgauauguuaacccagauacaggcagaguucuauuugaagcaaaacuucacaaauuaggcuuuaugacaauagcuaaaaauggagauucaccaaucacaguuccacccaacggcuacuuuagauucgaaucaugggucaaccccuucuacacuuuagcuccaaugggaacaggaaauggcagacguagaaaucaauaa

SEQ ID NO: 32565 - RNA, 1647 nt, Artificial Sequence
  derived and/or modified sequence opt6 from capsid_protein__Norovirus__ACT52407
augaaaauggcaucaaacgacgcaaccccaucaaacgauggugcagcaggacuaguacccgaaauaaacaaugaagcaauggcacucgacccugucgcuggagcagcaauagcagccccacuaacuggacaacaaaacauaauugauccauggauuaugaauaacuucguacaagccccagguggugaauuuaccgucucuccucguaacucaccaggugaaguacucuuaaacuuagaauuaggaccagaaauaaauccauaucuuucucacuuagcaagaauguacaacggauaugcaggaggcuucgaaguacaaguaguacucgccgguaacgccuuuacagccggaaaaauaauauuugcagcaauacccccuaacuuuccaaucgauaaucuuucugcagcacaaauaacaauguguccucauguaauuguagauguaagacaauuagaaccaguaaaccuuccuaugccagauguaagaaauaacuuuuuccacuauaaucaaggcucugauucaagacuacgauuaaucgcaauguuauauaccccacuacgagcaaacaauucaggagaugaugucuuuacaguuucaugccgaguauuaacacgcccaucaccagauuucucauuuaauuucuuaguaccaccaaccgucgaaucuaaaaccaaacccuuuacacugccaaucuuaacaauaucagaaaugucuaauucaagauucccuguaccaauagacucauuacauacaucaccaacagaaaacauaguaguacaaugccaaaacggaagagucaccuuagacggugaauuaaugggaacaacucaacuauuaccaucacaaauuugcgcauuucgaggagucuuaacaagaagcacaaguagagcaucagaucaagccgauacugcaacacccagacuauuuaacuauuauuggcacauacaacuagauaaucuaaacggaacuccauaugacccagcagaagauauaccuggaccauuaggaacuccagacuucagaggaaaagucuucggagucgcaucacaacguaauccagauucaacuacacgcgcacacgaagcaaaaguagacacuacggcagguagauucaccccaaaacuagguucucuagaaauaucaaccgaaucugaugacuucgaccaaaaccaaccaacuagauucacuccagucggaauagggguagaucacgaagccgauuuucaacaauggucucuaccugauuacucuggacaguuuacacauaacaugaaucuagcacccgcaguagcaccaaacuuuccaggugaacaauuauuauuuuuuagaucacaacuacccagcucaggugguagaucaaauggcauacuagauugccucguaccacaagaauggguacaacauuucuaucaagaaucagcaccagcucaaacccaaguagccuuaguucgauauguaaauccggauacagguagaguacuauucgaagccaaacuacacaaacuaggauuuaugacaaucgcuaaaaauggugauagcccaauaacaguuccaccaaauggauauuucagauuugaauccuggguaaacccauucuacacacuagccccaaugggaacaggaaacggacgucgaagaaaucaauaa

SEQ ID NO: 32566 - RNA, 1608 nt, Artificial Sequence
  derived and/or modified sequence opt6 from capsid_protein__Norovirus__ACT52409
augaaaauggcaucuaacgacgccgcuccaucaaacgauggugcagcugguuuaguuccagaaguaaacaacgaaacaauggcacuagaacccgucgcaggcgcaucaauagcagcuccauuaacgggacaaaauaacguaaucgauccauggauuagaaugaacuucguacaagcuccaaauggugaauucacaguaucaccaagaaacucaccaggagaaauauuauuaaauuuagaacuaggcccugaauuaaauccuuucuuagcucauuuaucacgcauguauaauggcuaugcaggaggaguagaaguacaaguauuacucgcagguaacgcauucacugcuggaaaauuagucuucgccgcaauaccaccacauuuucccaucgaaaacuuaucaccaggucaaauaacaauguuuccacacgucauuauagauguucgaaccuuagaaccaguauuauuaccauuaccagacguuaggaacucauuuuuucauuacaaccaagaaccugaacccagaaugagauuaguagcaaugcucuauacacccuuaagaagcaacggcucaggagacgacguauucaccguaucaugucgaguacuaacaagaccaucuccagacuucgauuuuaauuaucuugucccaccuacagucgaaucaaaaacuaaaccauuuacacuacccauacuuacaaucggagaacuaucaaauucacguuuuccugcaccuauagacgaacuauauaccucaccaaaugaaggacuaguaguacaaccacaaaacggcagaagcacuuuagauggagaacuauuaggaacaacacaacucguccccucaaacauaugcucacuaagaggaagaacuaacgcacaucucccagauaaucaacauagauggaacaugcaaguuaccaacccuaauggaacaccauuugacccuacagaagacguuccagcaccuuuaggaacgcccgacuuuuuagccaauaucuauggcguaacaucucaacgaaauccuaauaacacaugccgagcacacgacggcauauuagcaacuuggucaccaaaauuuacaccaaaacuaggaucuguaguacuaggaaccugggaagaccgugauuucgacauuaaccaaccaacuagauucaccccagucggauuauaugacacagaucacuuuaaccaaugggcacuaccuaauuauucaggcgccuuaaccuuaaauaugaaucuagccccuuccguagcaccacuauuuccaggagaacaauuacuuuucuuuagaucacacauaccacuaaaagguggaacuucuaauggcgcaauagauugccuucuuccucaagaauggguacaacauuucuaucaagaaucagcaccaucaucuacugacgucgcauuaauucguuauacaaauccagauacaggaagaguauuauuugaagcaaaauuacacagacaaggauucauaacaguaucaaacucugguucaagaccaauaguaguacccccuaacggauauuuuagauucgacucauggguuaaccaauucuacucccuagcaccaaugggcacaggaaauggccgaagaagaguacaauaa

SEQ ID NO: 32567 - RNA, 1623 nt, Artificial Sequence
  derived and/or modified sequence opt6 from capsid_protein__Norovirus__ACT78459
augaaaauggcaucaucagaugcaaaccccucagauggaucaacugcaaacuuaguaccagaaguaaacaaugaaguaauggcauuagaaccaguugucggagcagccauugccgcacccguagcuggacaacaaaauguaaucgauccauggaucaggaauaauuucguccaagcacccggcggugaauucacagucucaccaagaaacgcaccuggagaaauccuuuggucagcuccucuagguccagaucucaauccuuaccuuucucacuuagcaagaauguauaaugguuaugcugguggauuugagguacaagucauauuagcaggaaaugcauuuacagcaggaaaaauaauuuucgccgcaguaccaccuaacuuuccaacugaaggacucucaccaucucaaguaacaauguucccucauauaaucguugaugucagacaauuagaaccaguauuaauuccacuaccagauguaagaaacaauuuuuaucacuacaaccaaucaaaugacccaacaaucaaauuaaucgcuauguuauacacaccuuuacgcgccaacaaugcaggcgacgacguauuuaccguaucauguagaguacuaacucguccaucaccagauuucgacuuuauauuucuaguuccaccaacaguagaaucuagaacaaaaccauucucagucccaauacuaacaguugaagaaaugaccaacucccgauucccaaucccccuagaaaaacuauuuacaggaccaucuagcgccuuuguaguacaaccucaaaacggaagauguacaacugaugguguauuauuaggaacaacacaacucucaccaguaaacauaugcaccuuuagaggagauguaacacauauaacuggaucaagaaauuauacaaugaaucuagcaacacaaaacuggaacucauacgauccgacagaagaaauaccagcaccauuaggaacaccagauuuugucggaaaaauacaaggaguauuaacacaaacaacaagagcagauggauccaccagaggacauaaagcaacaguuuauacaggaucagcagauuuugcaccaaaauuaggcagaguucaauucgcaacagauacagaucacgauuucgaugcaaaccaaaauacaaaauuuacaccaguuggaguaauacaagacggugacaccgcacauagaaaugaaccacaacaauggguacuaccuuccuauucagguagaaacucacacaauguacacuuagcaccugcaguugcaccuacauuucccggugaacaauuauuauucuuuagaucaacaaugccuggaugcucuggauacccaaacauggaucuagauugucuuuuaccacaagaauggguacaauauuucuaucaagaagccgcaccagcucaaucagauguugcacucuuaagauucguaaauccagacacaggucgaguauuauuugaauguaaacuacacaaaucaggauauguaacuguagcacacaccggacaacaugauuuaguuaucccacccaauggauacuuccgauucgauuccuggguaaaucaauuuuacacauuagcucccaugggaaauggaaccggaagaagacgagcacucuga

SEQ ID NO: 32568 - RNA, 1641 nt, Artificial Sequence
  derived and/or modified sequence opt6 from capsid_protein__Norovirus__ACU56258
augaugauggcuucaaaagacgcuccacaaucagccgauggagcaucuggcgcuggacaauugguaccugaaguaaauacagccgacccucuaccaauggaaccaguugcaggaccaacaacagcaguagcaacagcaggacaaguuaauaugauagauccauggauuguaaauaauuucguacaaucuccucaaggagaauucacaaucucaccaaacaauacuccuggugauauacuauucgacuuacaauuaggaccacaccuaaacccauuuuuaucacacuuaucacaaauguauaacggauggguaggcaauaugagagucagaauacuacuagcuggaaaugccuuuucagcuggaaaaaucauaguauguuguguaccuccaggauuuacaucuuccagcuuaaccauugcucaagcuacacuauuuccacacguaauagcugaugucagaacacuagaaccaauagaaaugccauuagaagauguucgaaauguacuauaccacacuaacgauaaccaaccaacuaugagacuaguauguauguuauauacaccauuaagaacaggcggagguucaggcaauucugauucuuucguagucgccggaagaguacuuacugcuccaucaucagacuucucauucuuauuuuuaguaccaccaacuauugaacaaaaaacaagagcauucacuguuccaaauauaccacuacaaacuuuaucuaauucaagauuuccaucacuaauacaaggcaugauacucucaccagaugcuagucaaguaguacaauuccaaaauggacgaugucuuauagacggacaacuauuaggaacuacuccagcaaccucaggacaauuauuuaggguuagaggaaaaauaaaucaaggcgcacgcacacuaaaccuaacagaaguagacggaaaaccauuuauggcauuugauucaccagcaccuguuggcuuuccagauuuuggcaaaugcgauuggcauaugcgaauaaguaaaacuccaaauaauacuuccucaggugacccaaugagaucaguugauguacaaacagacguacaagguuuuguaccacacuuagguucuauacaauuugaugaaguuuuuaaucauccuacaggagacuauauaggcacaauugaauggauaucacaaccaucaacuccaccuggaacagauauaaacuuaugggaaauaccugauuauggaucuucccuaucacaagcugcaaauuuagcuccaccaguauucccaccugguuuuggagaagcacuagucuacuuuguuagugcauuuccuggaccaaauaaucgaucugcaccaaacgaugucccaugccuacuaccacaagaauauguuacacauuuuguaucagaacaagcaccaacaaugggagacgcagcuuuauuacacuauguagauccagauacaaauagaaaccuaggagaauuuaaacucuauccuggaggauaucuuacauguguacccaacggagucggcgcaggaccacaacaacuaccucuaaacggugucuuuuuauuugucucauggguuagcagauucuaucaacuaaaaccaguaggaacagccucaacagcgcgagguagauuaggagucagaagaauauaa

SEQ ID NO: 32569 - RNA, 1638 nt, Artificial Sequence
  derived and/or modified sequence opt6 from capsid_protein__Norovirus__ACX33982
augaugauggcuucaaaagaugcaccuacaaauauggauggaacuaguggagcaggucaacuuguaccagaagcaaauacagcugaacccauaucaauggaaccaguagcaggagcagcaacagcugcagcuacagcaggacaagucaacaugauagaucccuggauaaugaauaauuacguacaagcuccacaaggagaauucacaauaucaccaaauaacacaccaggagauguacuauuugacuuacaacuagguccccaccuaaacccauuucuaucucaccuagcacaaauguauaaugguuggguagguaauaugaaaguaaaaguuuuacuugcagguaaugcuuucacagcuggaaaaauuauaauaucauguaucccgccaggauuugcugcccaaaauuuuucgauagcucaagcaacaauguucccucauguaauagcagacguaagaguacuagaaccaauagaaguaccccuagaagauguacguaacguacuguuucacaauaaugacaauacaccuacaaugagauuaguauguauguuauacacuccauuacgagcaucaggcucaucaagugguacagauccauucguuauagcaggacgaguauuaacauguccaucaccagauuuuagcuucuuauuuuuagucccaccaaauguagaacaaaaaaccaaaccauucucaguuccaaaucuaccucucaacacacuaucaaacucacgaguaccaucauuaaucaaaucaaugaugauuucuagagaccauggacaaaugguccaauuucaaaauggacgaguaacauuagacggacaauuacaaggaacgacaccaacaucagcaucacaacuuuguaaaauaagaggcuccguauuccaugccaauggagguaauggcuacaaucuaacagaauuagauggaaguccauaccaugcauuugaaucaccagcacccauugguuuuccagauuuaggagaaugugauuggcacauggaagcaucaccuauaacucaauucgauacuggagacguaaucaaacaaauaaacguuaaacaagaaagcgcauuugcaccacaucuuggaacuguacaagcagauggauuaucagaugucucagcaaacaccaauaugauagcuaaacuagguugggugucaccaguaucugauggacauagaucugauguugauccauggguuauuccacgauacggaucaacuuuaacagaagcagcacaacuagccccaccaauauacccaccaggauucggcgaagcaauuguauuuuuuauguccgauuucccaauagcucauggaacaaauggauuauccguaccauguacaauaccacaagaauuuguaacacauuuuguuaaugaacaagcuccaacaagaggagaagcagcacuauuacauuaucuugauccagacacacauaggaauuuaggagaauucaaauuauaucccgacggauucaugacauguguuccaaauucuaguggaacaggaccacaaacccuuccuauuaaugguguuuucguuuucguaucauggguuagcagauuuuaucaacuaaaaccaguuggaacagcagguccugcaagaagauuagguauaagaagaucauaa

SEQ ID NO: 32570 - RNA, 1638 nt, Artificial Sequence
  derived and/or modified sequence opt6 from capsid_protein__Norovirus__ACX33983
augaugauggcaucuaaagacgcuccaaccaauauggauggaacaucaggagcaggacaauuaguaccugaagcaaauaccgcugagccuauaucuauggaacccgucgccggagcagcaacugcagcagcuacugcuggacaaguuaauaugauagaccccuggauaaugaauaacuauguacaagcaccacaaggagaauuuacaaucucuccuaauaauacaccaggagacguauuauuugauuuacaauuaggaccucaccuaaauccauuucuaucccacuuagcacaaauguauaauggcuggguagguaauaugaaaguaaaaguucuauuagcagguaacgcuuuuacagcaggaaaaauaauaauaucauguauaccaccuggauuuguagcccaaaauuuuucaauagcacaagcaacaauguuuccucaugucauagcagauguaagaguacuagaaccaauagaaguaccacucgaagauguucgcaauguacucuuucauaacaacgauaauacucccacaaugagauuaguuugcaugcucuauacaccauuacgagccggaggaucaucaucagguaccgauccauuuguaauugcaggaagaguacuaacaugucccucuccugacuuuaguuuucuuuuucuuguaccaccaaauguagaacaaaaaacaaaaccuuuuucaguaccaaaucuaccucucaacacuuuaucuaauuccagaguaccaucauuaauaaaaucaaugaugauaucucgagaucacggacaaaugguccaauuccaaaauggaagaguuacacuagauggucaacuccaaggaacaaccccaacaucagcaucacaauuauguaaaauaagaggaucaguauuucacgcaaacggaggaaacggauauaauuuaacagaacuagacggcucuccauaccacgccuuugaaagccccgcuccaauaggauuuccagaccuaggcgaaugugauuggcauauggaagcaucuccaacaacacaauucgauacaggugauguaauaaaacaaauaaauguaaaacaagaaucagccuuugcaccacacuuaggcacaguacaagcagauggcuuaucagauguaucugcuaauacaaauaugauugcaaaauuaggauggguaucaccuguaucagauggucaucguucagacguagauccuuggguaauuccaagauauggaagcacucuaaccgaagcagcacaacuagcaccgccaauuuacccacccggauucggugaagcaauaguauuuuuuaugucagacuucccaauagcacauggaacaaacggauuaucaguaccuuguacuauaccacaagaauucguaacucauuuuguaaaugaacaagcaccaacacgcggagaagcagcuuuguuacauuauuuggauccagauacacaccgaaaccuaggagaauuuaaauuauauccugauggauuuaugacaugcguaccaaauucaucagguacaggaccacaaacucuaccaauaaauggaguauuuguauuuguaucaugggucucaagauuuuaucaauuaaaaccaguagguacagcagguccugcccgaagacuagguauaagaagaucguaa

SEQ ID NO: 32571 - RNA, 1611 nt, Artificial Sequence
  derived and/or modified sequence opt6 from capsid_protein__Norovirus__ACX81341
augaaaauggcuucuaaugaugcaacaccaagcgaugacggagcagccggauuaguacccgaaauaaauaaugaaguaauggcacucgaaccagucgcaggugcuucaauagcagcaccaguaguuggacaacaaaacaucauagauccuuggauaagaaauaacuuuguacaagcccccgcaggagaauuuacagucucaccuagaaauucuccuggcgaacuauuauuagaucuagaacuuggcccagaauuaaauccauaucuagcacaccucgcaagaauguauaacggacacgcaggcggaauggaaguacaaauaguucuagcaggaaaugccuuuaccgcaggaaaaauacuauucgcagcaauaccaccauccuuuccauaugaaaaucuaucacccgcacaauuaacaaugugcccacauguuauaguagacguaagacaacuagaaccuguacuauuaccaaugcccgauauaagaaacguauuuuaucacuacaaucaaaacaacucacccaaacuaagacuagucgccauguuauacacaccauuaagagcaaacaauuccggagaugauguauuuacaguaaguugccgaguauuaaccagacccucaccagauuuucaauucacuuucuuaguaccaccaaccguagaaucaaaaaccaaaaauuucacucuaccaguauuaagaguaucagaaaugaccaacucuagauuuccugucguccuagaucaaauguauacauccagaaaugaaaacauaaucguccaaccacaaaacggaagauguacaacugauggagaacuuuuaggaacaacaauauuacaaucaguaucaauauguaacuucaaaggaaccaugcaagcuaaacuaaacgaagaaccaagauaccaacuacaauuaacaaaucuugauggaucaccaauagaccccacagacgacaugccagcaccccuagguacuccugacuuccaagcaauguuauauggaguagccucccaaagauccucuauagacaacgcuaccagagcccaugacgcucaaauagacacugcaggagauaccuuugcaccaaaaauaggacaaguacgauuuaaaucauccucaaacgacuuugaccuacaugaccccaccaaauucacaccaaucggaguuaacguugaugaucaacaccccuuucgucaauggucauuaccaaacuacggaggucaucuagcacucaacaaucacuuagcaccagcagugacuccucuauucccuggcgaacaaauacuauucuuucgaaguuacauaccauccgcuggaggacauaccgauggcgccauggacugcuuacucccacaagaaugggucgaacacuucuaucaagaagcagccccaucucaaucagauauugcucugguuagauucauaaauccagauacaggaagaguacuauucgaagcaaaacuccauaaacaaggauucuuaacaauagcagcaucaggagaucacccuauaguaaugccaaccaacgguuacuucagauuugaagcauggguaaauccuuuuuauacacuagcaccaguuggaacaggcucggguagacgaagaauacaauaa

SEQ ID NO: 32572 - RNA, 1611 nt, Artificial Sequence
  derived and/or modified sequence opt6 from capsid_protein__Norovirus__ACX81343
augaaaauggcuucaaaugacgcuacaccaucagacgauggagcugcaggauuaguaccagaaaucaacaaugaaguaauggcuuuagaacccguagccggugccucaauugcagcacccguuguaggccaacaaaacauaauagauccauggauaagaaacaacuuuguacaagcaccagcaggagaauuuacaguguccccaagaaauuccccaggagaacuacuucuagauuuagaacuaggaccagaacuaaauccauacuuagcccacuuagcacgaauguauaauggucacgcaggagguauggaaguccaaauuguauuagcaggaaacgcuuuuacagcaggaaaaauacuauuugcagcaauaccaccaucauuucccuaugaaaauuuaucuccagcacaauuaacuauguguccacauguaauaguagauguaagacaacuagaaccaguacucuuaccaaugccagauaucagaaacguauucuaucacuauaaccaaaacaacucucccaaacuuagacuuguugccaugcuauacacaccccuccgagcuaacaacucaggagacgacguauuuacaguauccuguagaguccucacaagaccaucaccagacuuucaauuuaccuuuuuaguuccaccaacaguugaaucaaagaccaaaaacuuuacucuaccaguauuacgcguaucagaaaugacaaauucaagauuucccguaguacuagaccaaauguacacuucccgaaaugaaaauauaauaguccaaccucaaaauggucgauguaccacagacggagaacuacuaggaacaacaauccuucaaucaguaucaauaugcaauuuuaaaggaacuaugcaagcaaaacuaaaugaagaaccacgcuaucaauuacaauuaacaaaucuugauggcucaccaaucgacccaacagaugacaugccagcaccacucggaaccccagauuuccaagcuauguuauauggagucgcuucucaaagaucaucuauagauaacgcaacaagagcacaugacgcacaaauagacacugccggagauacauucgcacccaaaaucggacaaguucgauuuaaauccucaucaaacgacuucgauuuacaugacccaacaaaauucacaccaauaggaguaaacgucgaugaccagcauccauucagacaauggucacucccaaacuauggaggacacuuagcauuaaacaaucaucucgcuccggcaguaacaccccuauucccaggugaacaaauacuauuuuuuagaucuuacauaccaucugcugguggacauacagauggagcaauggauugcuuacuaccacaagaauggguagaacauuucuaucaagaagcugcaccaucacaauccgacauagcucucguacgauucauuaacccugauacuggcagaguacucuucgaagcaaaacuacauaaacaaggauucuuaacaaucgcagccucuggagaucacccuauagucaugccaacaaacggauauuuccgauucgaagcauggguuaaccccuuuuacacacuagcaccgguagguacuggaucaggaagacgacguauccaauaa

SEQ ID NO: 32573 - RNA, 1611 nt, Artificial Sequence
  derived and/or modified sequence opt6 from capsid_protein__Norovirus__ACX81345
augaaaauggcaucaaaugaugcaaccccuucagaugacggagcagcaggauuaguaccagaaauuaauucugaaguaauggcauuagaaccaguagcaggagccucauuagcagcaccaguagucggacaacaaaacauaauagaccccuggauacgaaauaacuuuguucaagcuccagcaggagaauucacaguaucaccaagaaacucacccggcgaauuauuacuagaccuagaacuaggacccgaauuaaauccuuaccucgcccacuuagcaagaauguauaacggccacgcaggcggaauggaaguacaaauaguacuugcaggcaaugcauucacagccggaaaaauauuauucgcagcuauaccacccucauuuccuuacgaaaaccuuuccccagcccaauuaacuaugucaccacauguaauaguagauguacgacaauuaaaaccuguacuauuaccaaugccagacauaaaaaaugauuucaaccacuauaaccaaaaaaauaacacaaaauuaagauuaguugccauguuauauacaccacuaagagcuaacaauucaggagacgacguaugcaccgaaucaugcagaguacuaacgagaccaucaccagauuuccaauucacuuuucuaguacccccaacagucgaaucaaaaacaaaaaacuuuacacuaccuguacuaagaguuagcgaaaugacaaauuccagauuucccguaguauuagaccaaauguacacuagccguaaugaaaauauaauaguacaaccacaaaauggcagauguacaacagacggagaacuacuagguacaacaauacuccaaucuguaucaauauguaacuucaaaggaacaaugcaagccaaacuaaaugaagaaccacguuaccaauuacaacucacaaaucuagauggcucaccaauagacccaacugaugacaugccagcaccauuagguacaccagauuuccaagcaauguuauacggagucgcaucacaaagaucaucgauagacaacgcuacaagagcacacgacgcucaaaucgauaccgccggagacacauucgcacccaaaaucggacaaguaagauuuaaauccagcagcaacgauuuugacuuacaugauccuaccaaauucacacccauaggagucaacgucgacgaccaacacccauucagacaauggucauuaccaaauuacggaggucaucuagcauuaaacaaucaccucgccccagccguaaccccauuauuucccggagaacaaauccuauucuucagaagcuauauucccucagccggaggccauaccgauggagcaauggauugcuuauuaccacaagaauggguagaacacuucuaucaagaagcagcuccaucccaauccgacauagcacuagugagauucauaaaucccgacacaggaagaguacuauucgaagcaaaauuacacaaacaaggauuucucaccaucgcagcuuccggagaccacccaauaguaaugcccacaaauggauacuucagauuugaagcaugggucaaccccuuuuacacucuagcacccguaggaacaggaucaggaagaagacgaauccaauaa

SEQ ID NO: 32574 - RNA, 1611 nt, Artificial Sequence
  derived and/or modified sequence opt6 from capsid_protein__Norovirus__ACX81347
augaaaauggcauccaacgaugccacaccaucugaugacggagcagccggacuaguacccgaaauaaauaaugaaguuauggcacuagaaccuguugcaggagcaucuaucgcagcaccaguaguaggccaacaaaauauaauugaccccuggauaagaaauaauuuuguacaagcaccagcaggugaauucaccguaucaccacgaaauaguccaggagaacucuuauuagauuuagaacuuggcccugaacuaaauccauauuuagcacaccucgccagaauguacaacggacaugcaggcgguauggaaguucaaaucguuuuagccggaaaugccuuuaccgcaggaaaaaucuuauuugcugccauucccccauccuuuccauacgaaaacuuaucaccugcacaacuaacaaugugcccacaugucaucguagacgucagacaacuagaaccaguccuauuaccuaugccagacauacgaaaugucuuuuaucacuacaaccaaaauaauucaccaaaauuaagauuaguagcaauguuauacaccccacuaagagcaaacaauucaggagacgauguauuuaccguaaguuguagaguucuuacaagaccaucccccgacuuccaauuuacuuuucuaguaccaccaacugucgaaucuaaaacaaaaaauuucacacuuccuguauuacgaguuagcgaaaugacaaauucaagauucccaguagucuuagaucaaauguauacaaguagaaaugaaaauauuauaguucaaccacaaaaugguagauguaccacagacggagaauuacuaggaaccacaauauuacaaucuguauccaucuguaauuucaaagguaccaugcaagcaaaauuaaacgaagaaccccgauaccaacuacaacuaacaaaccuugauggcucaccaauagacccaacagaugauaugccugcaccccuagguacaccagauuuccaagcaauguuauauggaguagcaucacagagauccucaauagauaacgcuacaagagcacaugacgcgcaaauugauacagccggugauaccuucgcaccaaaaauaggacaaguaagguuuaaaucuucaagcaaugacuucgaucuucaugacccaacaaaauuuacaccaauaggaguuaacguagacgaccaacauccauucagacaauggucauuaccaaacuacggcggucacuuagcccuaaacaaucacuuagcuccugccguaacaccauuauuuccaggugagcaaauacuuuucuuuagaucauacauuccaucagccggcggacauacagauggagcaauggauuguuuauuaccacaagaauggguagaacauuucuaucaagaagcagcuccaucacaaucagacauagcccuaguuagauucauaaaucccgauacaggacguguauuauucgaagcaaaauuacauaaacaaggauuucuaacaauagcagcaucaggagaccauccaauaguuaugccaacaaauggauauuucagauuugaagcaugggucaauccauuuuacacacuagcaccaguagguacuggaucgggaagaagaagaauacaauaa

SEQ ID NO: 32575 - RNA, 1611 nt, Artificial Sequence
  derived and/or modified sequence opt6 from capsid_protein__Norovirus__ACX81349
augaaaauggcaucaaaugaugcaacuccuuccgaugacggcgccgcaggacuaguaccagaaauuaacaaugaagucauggcucuagaacccguagcaggagcuucaaucgcagcacccgucguaggccaacaaaauauaauugacccauggauaagaaauaacuuuguucaagcacccgcaggugaauuuacaguaucaccaagaaauucaccaggagaauuacuauuagaucuagaauuagguccagaacuaaauccauaccuagcccacuuagccagaauguauaacggacacgcaggaggaauggaaguacaaauaguacucgcaggaaaugcauuuacagcuggcaaaauacuauucgcugcaaucccacccuccuucccauacgaaaaucuaucaccugcacaacuuacaaugugcccacacguuauaguagacguaagacaauuagaacccguucuacuaccaaugcccgacauacgaaauguauucuaccacuauaaucaaaacaacucaccaaaauuacgcuuaguagccauguuauacacaccacuuagagccaauaauucuggagacgauguauuuacagucuccugcagaguacuaacaagaccaucaccagacuuccaauucacauuccuugucccaccaacaguugaaucuaaaacaaaaaauuucacccuaccaguacuuagaguuucagaaaugacaaacucaagauucccugucguauuagaccaaauguauacauccagaaaugaaaacauaauaguucaaccacagaacggacgauguacaacagauggugaacuucuaggaacuacaauucuacaaucaguaucuauauguaacuuuaaaggcacaaugcaagcuaaacuaaacgaagaaccaagauaccaacuacaauuaacaaauuuagauggaucacccauagacccaacugaugacaugccagccccauuaggaacaccagacuuccaagcaauguuauaugguguagccucccaacgaucaucuauagauaaugcaacacgugcccaugacgcacaaaucgacacagcaggagauacuuuugcaccaaaaauaggacaaguacguuuuaaaucuagcucaaacgauuuugaucuacaugauccuacaaaguucaccccaauaggaguaaauguagacgaucaacauccauuuagacaauggucacucccaaacuauggcggacacuuagccuuaaacaaccaccuagccccagcaguaaccccacuauuuccaggcgaacaaauauuauucuucagauccuacauaccaucugccggaggacauaccgauggagcaauggacugcuuacuaccacaagaauggguagaacauuucuaucaagaagcugcacccagccaaucagacauagcacuuguaagauucaucaauccugacacagguagaguccuauucgaagccaaauuacauaaacaaggauucuuaacuauagcugcaucuggagaucacccaauagucaugccaacaaauggauauuuccgauuugaagcauggguaaacccauuuuauacacucgcaccagucggaaccggcucaggacgacgucguauacaauaa

SEQ ID NO: 32576 - RNA, 1611 nt, Artificial Sequence
  derived and/or modified sequence opt6 from capsid_protein__Norovirus__ACX81351
augaaaauggcauccaaugaugcuacaccaucagacgacggagcagcaggacuuguuccagaaauuaacaaugaaguaauggcacuagaaccaguagcaggcgcuucaauagcagcuccaguaguaggacaacaaaauauaauagacccauggauaagaaauaacuuuguccaagcuccagccggagaauuuacagucucaccaagaaauuccccaggagaacucuuacuagaucuugaacuaggaccagaauuaaaucccuauuuagcacauuuagcacgcauguauaauggucacgcaggaggaauggaaguacaaauuguacuugcuggaaacgcauucacagcaggaaaaauauuauuugcagcaauaccaccaucauuuccauaugaaaaucuaucuccagcccaacuaacaaugugcccucauguuauaguagauguacgucaacuagaacccguauuauuaccaaugccagauauuagaaacguuuucuaccacuacaaucaaaacaauucaccaaaauuacguuuagucgcaauguuauacacacccuuaagagcaaauaauuccggagaugacguauuuacuguaucuugcagaguuuuaacacgaccauccccagacuuccaauuuacauuucuaguuccuccuacaguagaaucaaaaacaaaaaacuuuacacuuccaguauuaagagucucagaaaugaccaacucaagauuucccguuguucucgaucaaauguauacaucaagaaaugaaaacauaauaguccaaccgcaaaacggacgauguacaacagacggagaauuauuagguacaacaauacuacaaucaguaaguauauguaacuuuaaaggaacaaugcaagcaaaauuaaaugaagaaccaagauaucaauuacaauuaaccaaccuagacggaucaccaauagaccccaccgaugacaugccagcacccuuaggcacaccagacuuccaagcaaugcuauauggaguagccucucaaagaucaucaauagacaaugcuacuagagcccacgacgcacaaauagacaccgcaggcgacacauucgcuccuaaaauaggacaaguuagauuuaaaucaagcucuaacgacuucgaucuacaugacccaacaaaauuuacuccuauaggaguuaacguugacgaucaacacccauuuagacaauggucauuaccuaacuauggaggccaccuagcauuaaacaaucaccucgcuccugcaguuaccccauuauuuccuggagaacaaauacuauucuuccgcucauacauaccaucagcagguggccauaccgacggcgcaauggacugucuacuaccucaagaauggguagaacacuucuaccaagaagcagcacccucacaaagcgauauagcccuaguucguuucauaaacccugauacuggacgcguccucuucgaagcaaaacuacacaaacaaggauuucuaacuauagcagcauccggagaucacccaauagugaugcccacaaaugguuauuuccguuucgaagccuggguaaauccauuuuacacgcuagcccccguaggaacaggaagcggcagacgaagaauccaauaa

SEQ ID NO: 32577 - RNA, 1611 nt, Artificial Sequence
  derived and/or modified sequence opt6 from capsid_protein__Norovirus__ACX81353
augaaaauggcauccaacgaugcaacaccauccgacgauggagcagcaggauuaguaccugaaauaaacaaugaaguaauggcacuugaaccaguagccggagcaucaauagcagcaccaguaguaggccaacaaaacauaauagauccauggauucguaauaacuuuguccaagcaccagcuggagaauucacuguaaguccuagaaauucaccaggagaacuauuacuagacuuagaacuaggaccagaauuaaaucccuaucucgcacaccuggccagaauguauaacggacacgcaggcggaauggaaguccaaauaguauuagcaggaaacgcauuuacagcaggaaaaauacucuuugcagcaauaccuccaucauuuccauaugaaaacuuaucaccagcacaacuaacuaugugcccucauguuauugucgacguccgacaauuagaaccaguacuacuaccaaugccagacauucgaaacguuuucuaccacuauaaccaaaacaauucaccaaaacuaagauuaguugcaauguuauacacaccauuaagagcuaacaauucaggagacgauguauucacaguaucaugcagaguuuuaacaagaccaagcccagacuuucaauucacuuuucuagucccaccaaccguagaaucuaaaacuaaaaauuucacauuaccaguacuucgaguaucagaaaugacaaauucaagauucccaguaguccuagaccaaauguauaccucaagaaaugaaaacauaauaguucaaccacaaaauggaagauguacaacagacggagaauuacuaggaacaacaauacuacaaucaguaaguaucugcaacuucaaagguacaaugcaagcuaaacuaaacgaagaaccuagauaucaacuacaacuaacaaauuuagauggaucaccaauagaccccacagaugacaugcccgcaccacuagguacaccagauuuccaagcuaugcuauauggaguagcaucacaaagaagcucaagagauaacgcaacaagagcacaugaugcccaaauagauacagcuggagacacauucgcucccaaaauaggccaaguacguuucaaaucaucaagcaaugauuucgaccuacaugauccaaccaaauuuacaccaauaggaguaaacguagacgaucaacauccguuucgucaauggaguuuaccaaacuacggaggacacuuagcuuuaaacaaucaccuagcuccugcaguaacuccucuauucccaggagaacaaauacuauuuuuccgaucauacauuccaucagcaggaggacauacagacggagcaauggauugucuauuaccucaagaauggguagaacauuucuaccaagaagcagcuccuucucaauccgacauagcauuaguacgcuucaucaacccagauacuggaagaguauuauucgaagccaaauuacacaaacaaggauuccuaacuauagcagccucaggagaccacccaauagucaugccaacaaauggauauuucagauuugaagcauggguuaaucccuucuacacacuugcacccguaggaacuggaucaggaagaagaagaauacaauaa

SEQ ID NO: 32578 - RNA, 1611 nt, Artificial Sequence
  derived and/or modified sequence opt6 from capsid_protein__Norovirus__ACX81355
augaaaauggcauccaaugacgccacaccuucugaugacggugcagcaggacuaguaccagaaauaaacaaugaaguaauggcauuagaaccaguugcuggugcuucaauagcugcacccguaguuggucaacaaaacauaauagacccauggauaagaaauaacuuuguacaagccccugcaggcgaauuuacaguaucaccuagaaauucaccaggagaauuauuacuugauuuagaacuaggaccagaacuaaaccccuauuuagcacacuuagccagaauguauaacggacacgcuggaggaauggaaguacaaauaguccucgcagguaaugcauuuaccgcagguaaaauacuauucgcagcaauaccaccaucauuucccuaugagaauuugucaccagcacaacuaaccauguguccucacguaauagucgacguucgacaacucgaaccuguacuauuaccuaugccagacauaagaaaugucuucuaucacuauaaucaaaacaauucaccaaaacuaagacuaguugcuauguuauacacaccacuacgagcaaacaauaguggcgaugaugucuucacagucuccugucgaguauuaacaagaccauccccagacuuccaauuuacauuucuagucccaccaaccguagaaucaaaaacuaaaaacuucacucuacccguacuaagaguaucagaaaugacaaacuccagauuucccguaguacucgaucaaauguauacuagucgaaaugaaaacaucauuguacaaccacaaaauggaagauguacuacugauggagaauuauuaggaacuacaaucuuacaaucagucaguauuugcaauuucaaagguacuaugcaagcaaaacuaaacgaagaacccagauaccaacuacaacucaccaaucucgauggcucaccaauagaccccaccgaugacaugccugcacccuuaggaaccccagauuuucaagcuaugcuuuauggaguagcaucacaaagaucuucuaucgauaaugcuacaagagcccaugacgcacaaauugacacagcaggagacacauuugccccaaaaauaggacaaguccgauucaaaucaucuucuaacgauuucgacuuacaugaccccacaaaauucacaccuauaggaguaaacguagaugaccaacacccauuuagacaauggucccuacccaauuauggaggacaccuagcauuaaacaaucaccuagcaccagcaguuacaccucuauucccaggugaacaaauauuauucuucagaucauauauaccaucagcugguggacauacagauggcgccauggauugcuuacucccacaagaauggguagaacauuucuaucaagaagcagccccaucucaaucagacauagccuugguaagauuuauaaaccccgacacaggaagaguauuauucgaagcaaaauuacauaaacaaggauuucucacaauagcagcaucaggagaucacccaaucguaaugccaacaaacggcuauuuuagguucgaagcauggguaaauccauuuuauacccuagcccccguuggcacaggaucaggaagacgaagaauccaauaa

SEQ ID NO: 32579 - RNA, 1623 nt, Artificial Sequence
  derived and/or modified sequence opt6 from capsid_protein__Norovirus__ACX85806
augaaaauggcaucaucagacgcaaacccuucagaugguucaacagcuaaccuuguaccagaaguaaacaaugaaguaauggcuuuagaacccguaguaggugcagcuauagcagcucccguagcuggccaacaaaauguaaucgacccauggauaagaaauaacuuuguacaagcaccaggaggagaauuuacaguaagcccaagaaaugcacccggagaaauauuauggucugcuccucuugguccagacuuaaauccuuaccuaucucacuuagcaagaauguauaauucauacgcaggaggcuuugaaguacaagucauuuuagcaggaaacgcauuuacugccggcaaaauuauauuugcagcuguucccccuaacuucccaacagaaggucucucaccaucacaaguaacaauguucccacacauuguaguagacguucgacaacuugaaccuguacucauaccacuuccagacgucagaaauaacuucuaccauuauaaccaaucaaacgauccuacuauuaaauuaauugcaaugcuuuacacaccacuaagagcaaacaaugcaggagacgacguauuuacugucuccuguagaguacuaacaagaccaucaccagacuuugacuucaucuuuuuaguaccaccaaccguugaaucacgcacuaaacccuucucagucccaauauuaacuguagaagaaaugaccaauuccagauuuccuauuccuuuagaaaaacuauucacugguccuucaucagcauucguaguacaaccacaaaacggacgcuguacaacagauggaguacuauuagguacuacacaauuaucaccaguaaauauuuguacauuuagagguaacguuacccacauugcuggaacacaagaauauacuaugaauuuagcaucacaaaacuggaauaauuacgauccaacugaagaaauaccagcaccacuaggaacaccugauuuugucggaaaaauucaaggaguauuaacacaaaccacacgacgagacggaucaacaagaggacauaaagcaacagucucaacaggcucaguucacuucacacccaaacuuggaagaauacaauucucuacugauacauccaaugacuucgaaacaggacaaaauacaagauuuacaccuguaggaguaguacaagacggaucaacaacacaucaaaaugaaccacaacaaugggucuuaccaaauuauuccggaagagacucacauaauguucacuuagcaccugcaguugcaccuucauuucccggagaacaacuauuauucuuuagaucuaccaugccaggauguucaggauaccccaacaugaacuuagacugucuuuuaccucaagaauggguucaacauuuuuaucaagaagcagcaccugcucaaucagauguagcauuauuaagauucguaaacccagauacaggcagaguauuauuugaaugcaaauuacacaaaucaggcuauguaacaguagcacacacaggacaacacgaucucguaauaccuccaaauggguauuucagauucgacucauggguaaaucaauucuauacacuagcacccaugggaaacggcacugguagaagaagggcauuauaa

SEQ ID NO: 32580 - RNA, 1647 nt, Artificial Sequence
  derived and/or modified sequence opt6 from capsid_protein__Norovirus__ACX85807
augaaaauggcaucuaaugaugccgcgccaucaaaugauggagcagcaggacuaguaccagaaauaaacucagaagcaauggcacuagaaccaguagcaggagcagcaaucgcugcaccauuaacaggacaacaaaauauaaucgacccauggaucaugaacaauuuuguacaagcaccagguggagaauuuacaguaucaccaagaaauuccccaggugaaguuuuauuaaaccuugaacuaggaccagaaauuaacccauaccuagcucacuuagcacgaauguauaacggcuaugcaggcggauuugaaguccaagucgucuuagccggaaaugcacuaacagcaggcaaaauaauauucgccgcaauacccccuaauuucccaauagacaaccuaucugcagcacaaauaacuauguguccacacguaauaguugauguaagacaacuugaaccaguaaaucuaccaaugccugauguaagaaacaacuucuuccauuauaaccaaggguccgauucaagacucagacuaauagcaauguuauauacuccccuuagagccaauaacucaggagacgauguauuuacaguaucaugccgaguccuaacaagaccuaguccugacuuuucuuucaauuucuuaguaccuccaacaguagaaucaaaaacaaaacccuuuucuuuaccaauauuaacaauauccgaaaugucaaacucccgcuucccagucccaauagauuccuuacacacaucaccuacagaaaacauaguaguacaaugccaaaauggaagaguaacacuagacggugaacuaaugggaacuacacaacuccuacccagccaaaucugcgcuuuucguggagucuuaacaagaucuacuucaagagcaucagaucaagcugauacagcaacaccaagguuauucaacuacuacuggcacauucaauuagauaacuuaaacgguaccccauaugacccugcagaagauaucccaggaccucucgguacuccugacuucagaggaaaaguauucggagucgcaucacaacgaaacccugaugcaacaacaagagcacacgaagcaaaaauagauacaaccaguggcagauucacuccaaaauuaggaaguuuagaaauaucaacagaaucagaugauuucgaucaaaacaaacccacacgauuuacuccaguugguauaggaguagaccaugaagaagacuuccaacaauggacacucccagauuacgcuggacaauuuacucacaauaugaauuuagcaccagcaguagcaccaaauuuuccaggagaacaacuauuauucuuuagaucacaacuaccaucaucaggaggaagaucaaacggcauacuagauugcuuaguuccucaagaauggguacaacauuuuuaccaagaaucagccccuagucaaacacaagucgcacuaguacgguauauaaauccagauacaggcagaguacuauuugaagccaaacuucauaaauuaggauuuaugaccaucgcaaaaaauggugauucaccaauaaccguaccaccaaacggauauuuucgauuugaaucauggguaaauccauucuacacacuagccccaauggguacaggaaaugguagacgaagaauacaauaa

SEQ ID NO: 32581 - RNA, 1623 nt, Artificial Sequence
  derived and/or modified sequence opt6 from capsid_protein__Norovirus__ACX85809
augaaaauggcauccaacgacgcagcgccaaguaacgacggagcagcaggauuaguuccugaaauaaacaaugaaguaaugccauuagaaccaguugcuggagccucacuagccaccccaguaguaggucaacaaaauaucauugauccauggauacgaaacaacuuuguucaagccccagcaggugaauucaccguaucuccaagaaauucaccaggugaaaucuuauuagaucuagaauuagguccugaacuaaaccccuaucuagcucaccuagcaagaauguacaauggacaugcaggaggaauggaaguccaaauaguucucgccggaaaugcauuuacagcuggaaaaauaauauucgccgcaauaccaccuggcuuucccuacgaaaaucuuucacccucacaaauaacuaugugcccacacguaauuauagauguaagacaacuagaaccagucuuauuaccuaugccagacaucagaaauaauuuuuuucacuauaaccaaggaaacgacccaaaauuaagacuaaucgcaaugcuauacaccccauuaagagcaaacaacucuggagaugauguauucacuguaagcuggagaggauuaaccaaaacaucaccagacuuugaauuuacauuucuaguaccaccaacaguagaaucaaaaacaaaacaauuuacacuaccaauuuuaaaaauuagcgaaaugacuaacagcagauucccaguaccaguagaaaugauguacaccgcaagaaacgaaaaucaaguuguucaaccucaaaauggaagaguaacauuagacggugaacuccuaggaaccacaccuuuauuagcaguuaauauauguaaauuuaaaggugaaguaauagcaaaaaauggagacguaagaaguuaucgaauggauauggaaauaacaaauacagacggcacaccaauagauccaacagaagacacaccuggaccaauaggaucuccugacuuucaaggcauauuauuuggaguagcaucacaaagaaauaaaaaugaacaaaaucccgcaacaagagcucacgaagcaaacauaaauaccggaggagaccaauaugcacccaaauuagcucaaguaaaauuuuucuccgaaucacaagauuuugaaguacaucaaccaacaguauuuacacccgucgguguagcaggugauacaagucauccauuuagacaauggguacucccaagauacggaggacacuuaacuaauaacacgcauuuagccccugcuguagcaccuuuauuuccaggugaacaaauacuauucuuuagaucacaaauaccaucaagcggcggacacgaacucggauacauggauugucuaguaccucaagaauggguucaacauuucuaucaagaagcagcaacagcacaaucagaaguagcuuuaauaagauucauaaacccagauacaggacgaguauuauucgaagcaaagcuccacaaacaagguuuuauaacaguugcucauacuggcgauaauccaauuguaaugccaccaaacggauauuuucguuucgaagcauggguaaaucaauucuacucacuagcaccaguaggaacaggaaacggcagaagaagaauacaauaa

SEQ ID NO: 32582 - RNA, 1623 nt, Artificial Sequence
  derived and/or modified sequence opt6 from capsid_protein__Norovirus__ACX85810
augaaaauggcaucaaacgaugcagcaccaucaaacgacggugcagcaggauuaguaccggaaauaaacaaugaaguaaugccuuuagaaccagucgcaggagcuucacuugcaaccccagucguuggccaacaaaauauaauugauccauggauuagaaacaauuuugugcaagccccagcaggagaauuuacaguaucaccaagaaauucucccggagaaauauuacuagauuuagaacuaggaccugaacugaauccauauuuagcacacuuagcaagaauguacaauggacaugccggagguauggaaguacaaauuguauuagcaggaaaugcauuuaccgcagggaaaauuauuuuugcagcaauacccccaggcuuuccauacgaaaauuuaucuccaucacaaauaacaaugugcccucacguaauuauagauguaagacaacuagaaccaguacuuuuacccaugccagauauaagaaauaauuucuuucauuauaaccaaggcaaugauccaaaauugagacucauagccauguuauauacaccacuuagagcuaacaauagcggagaugacguauuuacaguuucaugcagaguacuaacaaaaccaucaccugauuucgaauucacauuucuuguuccuccaacaguagaaucuaaaacuaaacaauuuacacuaccaauacuaaaaauauccgaaaugacuaacucuagauuuccaguaccaguagaaaugauguauacagcaagaaaugaaaaucaaguaguacaaccacaaaacggcagaguuacccucgauggagaauuacuaggaacaaccccauuacuugcaguaaauauaugcaaauuuaaaggagaaguaauagccaaaaacggugauguaagaucauauagaauggacauggaaauaacuaacacugacggaacacccauagauccuacagaagacacaccugguccaaucggaucucccgauuuccaaggaauacuuuucggcguugcaagucaaagaaacaaaaaugaacaaaauccugcaacacgcgcccaugaagcaaacauaaauacuggaggugaccaauacgcacccaaacuagcacaaguaaaauuuuucucagaaucacaagacuucgaaguacaucaaccaacaguauuuacccccgucggaguagccggugacaccucacauccauuuagacaauggguacuaccacgauauggcggucacuuaacaaacaauacacacuuagcaccugccguagcaccacucuuuccaggcgaacaaauacuauuuuuccgaucacaaauaccaaguucuggcggacacgaauuaggcuauauggauugccuagucccacaagaauggguacagcauuucuaucaagaagccgcugcagcacaaucagaaguagcacucauaagauucauaaauccagacaccggcagaguucuuuucgaagcaaaacuucacaaacaaggauuuauaaccguagcacacacaggagacaacccaauaguaaugccaccuaauggauauuuccgauuugaagcauggguaaaucaauuuuauucccuagcuccaguaggaacagguaacggaagaagaagaauacaauaa

SEQ ID NO: 32583 - RNA, 1569 nt, Artificial Sequence
  derived and/or modified sequence opt6 from capsid_protein__Norovirus__ACY41155
augaaaaugaccgauagagauacaacagauccagcacccgcauuaggacaaguauuaccacccgaagucgaagcuucaguaccgguagaaccaaccgcuggugcacccguagcagcagcaacagcuggacaaguaaauccaauagauccauggauuuucgcaaauuuuguucaagcaccgcaaggagaauuuacaauaucaccuaauaauaauccaggagaaauauuauuugaauuagaacucggaccugaauuaaacccuuaucuagcacaccuaagaagaauguacaacgguuggacaggauccaugagaguaagaguauuauuagcaggcaaugcauuuucagcuggaaaaguagucguauuuuguguaccaccaggauuugaugcaucauaucuaacaccuucacaagcuacacaauucccacacguacuaauagacguacgugcaccagaaccaguugaaaugccauuagaagauguaagaaauauacuauuucaccaaggaccagauucuagaaugagacuuaugggaaugcuuuacacaccacuaagagcaaacucuggugcggaucccuuuguaguaacuggccguguauuaacauguccaucucccaauuuuucauuuuucuuucuuguaccaccaaccgucgaagaacgagaaguacccuuuacuuuacccaaccuaccaguuaauaaccuaucucauucaagaguuauggaacccauagcacaaaugaugucuucaagaaaucuaccagcaucaguacaauuucaaaacggaagauguacacuagcaggugaccuacucggcaccacaccaucuucaccugcugacuuagguacauucgugggacuaauugccgaaccagguucuagaguagucgaacuauuucaaccaaaucaagaagacuuccacgcaggaucagcaccagcaccccuaggauucccagauuuuucagauugcucauuaacauuuguagucgcuucaucaacuacuguaggagaaagaacaguuaauucaagaucaccacaaaacuucacuccugcacuuggacauguaacuuuagacgaagaagcaccagcugaucuauuucgagcuagauuaagaaaucuaugggacccaacagaacauucuuuuuggagaauaccugauuacagagcagauguacuaggauccgaauuugcaccaucaguaucugcaccugguguaggagaaacucuauuauuuuuuauguguaacguacccagauuaaauggagccaauccuaauccauguccuuguuuauuaccacaagaauggauuacacauuucguaucagaacgugcugcauuacaaggugacguagcauuauuaaauuauguuaacccuaauacagguagagugcuauucgaauguaaauuauaugccaauggauuucuuacagucaaccuaggcgcuucagaucaagcaacacuaccuguagaugguauuuuuaaauucguaucauggguuucauuuuacuaucaauuaaggccuguaggcaaugcaucaguagguagaagauuaccacguuuaaaugguuuuuaa

SEQ ID NO: 32584 - RNA, 1623 nt, Artificial Sequence
  derived and/or modified sequence opt6 from capsid_protein__Norovirus__ADA77528
augaaaauggcaucuaaugaugcuucaccauccgauggaucaacagcuaaccuaguuccagaaguaaacaaugaaguuauggcauuagaaccaguuguuggagcagcaauagcagcaccaguugcaggacaacaaaacgucauagaccccuggauaagaaauaacuuuguacaagcaccuggcggagaauuuacaguaucuccaagaaacgcaccuggagaaauucuauggucagccccauuaggaccagaucuuaaccccuaucuaucucaccuagccagaauguauaauggcuacgcaggcgguuuugaaguucaaguaauuuuagcaggaaaugccuuuacagccggcaaaauuauauuugcagcuguuccaccaaauuucccaacagaaggacuaucucccucucaaguaacaauguuuccucauauaauaguugauguaagacaacuagaaccaguuuuaaucccauuaccagauguacgaaauaauuuuuaucauuauaaucaaucaaaugacucuaccauaaaauuaauagcuaugcuuuauacaccauuacgugcaaauaacgcaggugacgauguauuuacuguauccuguaggguccuaacaagacccucaccagacuucgauuuuauauuucuaguaccuccaacaguugaaucaagaacaaaaccuuucacaguuccaauccucacaguagaagaaaugaccaacucacgauuuccaauaccccuagaaaaacucuucacagguccaucuucagcauuuguaguacaaccacaaaauggaagaugcacaacugacggaguauuacuaggaaccacacaauuaucaccagucaauauauguacauuucgaggagauguaacacacauaccagguacaagaacuuacagaaugaauuuagcaucacaaaacuggaauaauuacgauccaacugaagaaauaccagccccauuaggaacacccgauuuuguaggaaaaauucaaggaaugcuaacacaaacaacaaaaggugaugguucuacaagaggucacaaagcaacaguuucaaccggaucagucgacuucacaccuaaacuaggaucaguucaauucgcaacagacacagacaacgauuuugaaacgggacaaaauacacguuuuacacccguuggcguaauacaagauggaaguagcacccacagaaacgaaccacaacaauggguauuaccagauuacucuggaagaacagcacacaauguucaucucgcaccagcaguagcaccuacauuuccaggcgaacaacuauuauucuuccgcucaacaaugccagguuguucaggcuacccaaauauggaucuagacugccucuuaccccaagaauggguacaacauuuuuaucaagaagcugcuccaagucaaucugacguagcacuacuuagauuuguaaauccagauacaggaagaguuuuauuugaaugcaaacuucauaaagcuggauauguaacaguagcccacacaggacaacaugaccuaguaauaccuccaaacggauauuuuagauucgacucaugggucaaccaauucuauacauuagcaccuaugggaaauggugcuggaagacgaagagcauuauaa

SEQ ID NO: 32585 - RNA, 1620 nt, Artificial Sequence
  derived and/or modified sequence opt6 from capsid_protein__Norovirus__ADB22512
augaaaauggcaucaaacgacgccgcaccaucaaaugauggcgcuacaggacuaguuccagaagucaauacugaaacacucccuuuagaaccugucgcaggagcagcaauagcagcaccaguaacaggacaaaacaacauaauagacccauggauaagaucaaacuuuguucaagccccaaauggcgaauuuacagucucaccucgaaacucaccaggagaaauauuaaugaaccuugaacucggucccgacuuaaacccuuacuuagcacaucucucuagaauguauaauggauacgccgguggaguagaaguacaaguacuacuagccgguaaugcauucacagcuggaaaaauccuauucgcagcaguaccaccaaauuuuccuguagauaugcuuucaccagcccaaaucacaauguuaccacacuugauaguagauguucgaacacuagaaccaaucaugauaccacuaccagaugucagaaauguauuuuaucacuuuaauaaccaaccagcuccaagaaugagauuaguagcuauguuauauacaccacuuagaucaaacggauccggagacgauguauuuacaguaaguuguagaguacuaacaagaccuacaccagauuuugaauuuacauaucuuguuccaccauccguagaaucuaaaacuaaaccauucacccuccccauauuaacaauuggagagcuaacaaauucuagauucccagcacccauagaccaacuauauaccucaccuaaugcagauguuguaguucaaccucaaaauggucgauguacuuuagacggagagcuacaaggaacaacacaauuacucacaacugcaauauguucauacagaggaaugacauccaauccaacaucagacuacugggauggacaccucuuacauuuaguacacccaaacggagcaacauaugacccaacagaagauguuccagcaccauuuggaacacaagacuuccgagguauauuauaugguauguuaacacaaaacccaagaacuucuggagaugaagcagccaauucucauggaguauacauaucuucaacaucagaaaaauucacaccaaaauuaggaacaauaggauuacaucaaguucaaggagaccacucacaacaacaacaaucaaaauuuaccccuguaggaauugccguaaauggaaacacacccuuucgacaaugggaauuaccaaauuacucuggagcauuaacacuaaauaccaaucuagcacccgcuguaggaccuaacuuuccaggugaacaaaucuuauuuuuuagaaguaauguucccucaguccaaggaggacaacccauagaaauugauugccuaauaccacaagaauggguaucacacuuuuaucaagagagugcaccaucacaaucagacgucgcuuuaguaagauacguuaaucccgacacuggccgcacaaucuuugaagccaaacuccaccgacaagguuuuauaacaauagcggccacagguucaaauccugucgucguaccccccaauggauauuucagauucgauucauggguaaaccaauuuuacgcacucgcucccaugggaacaggcaauggaagacgaagaauucaauaa

SEQ ID NO: 32586 - RNA, 1623 nt, Artificial Sequence
  derived and/or modified sequence opt6 from capsid_protein__Norovirus__ADC91993
augaaaauggcaagcaaugacgcaaacccaucugacggaucagcagcaaaccuaguccccgaaguaaacaacgaaguaauggcacuugaaccuguaguaggagcagcaauagccgcacccguagcaggucaacaaaaugucauagauccauggauacgaaacaauuuuguccaagcaccaggaggugaguuuacaguaucuccacgaaaugcacccggcgaaauccuuuggucagcaccuuuaggaccugauuuaaacccauaccuaucacaccuagcaagaauguauaacggauacgcaggaggauucgaaguucaaguaauucuagccggaaaugcuuuuaccgcuggaaaaauaauauuugcugcaguccccccaaacuuuccaaccgaaggacuauccccaucucaaguaacaauguuuccacauaucaucguagacguuagacaauuagaacccguccucauuccucuaccggacguccgcaauaauuucuaccacuauaaucaaucaagcgacucaacaauuaaauuaauagcaaugcuauacacaccacuaagagccaauaacgccggagaagaugucuuuacaguuucauguagaguacuaacucguccaucucccgauuuugacuuuaucuuccuaguaccccccacaguagaaucuagaacaaaaccauuuacuguaccaauacuuacaguagaagaaaugacaaauucaagauuucccauaccauuagaaaaacuauuuaccggcccaucaucagcauucguuguacaaccacaaaauggaagauguacaacagacggugucuuauuagguacaacacaauuaucaccuguaaauauauguacauuucgaggcgauguuacacauauagcuggaucaagaaauuacacuaugaaccuugcuucauuaaacuggaauaauuaugauccaacagaagaaauaccagcuccacuaggaacaccagacuucguugguaaaauucaaggaguauuaacacaaacaacaaaaggcgacggaucaaccagaggacauaaagcuaccguauacacaggaagcgcuccuuuuaccccaaaacuaggaucaguccaauucucuaccgauaccgaaaacgacuuugaaacccaccaaaacacaaaauuuacaccaguaggcguaauacaagaugguggaacaacucaccgaaaugaaccacaacaauggguauuacccucauacagugguagaaauguucaaaacguacaucuagcuccagcaguugcaccuacauuucccggagaacaacuccuauuuuuucgaucaacuaugccaggaugcucaggcuauccaaauauggaccuagacuguuuauuaccacaagaauggguacaacauuuuuaucaagaagcagcuccagcacaaucugauguagcacuuuuaagauuuguaaauccugacacaggcaggguacuauucgaauguaaauuacauaaaucaggauacguaacaguagcacauacaggacaacaugaccuaguuauucccccgaaugguuacuuuagauuugauucauggguaaaucaauucuacacacuagcacccaugggaaacggaacaggacgacguagagcauuauaa

SEQ ID NO: 32587 - RNA, 1623 nt, Artificial Sequence
  derived and/or modified sequence opt6 from capsid_protein__Norovirus__ADC91994
augaaaauggcuaguaaugacgccacaccauccgacggaagcacagccaaucuaguaccagaaguaaauaaugaaguaauggcucuagaaccaguaguaggagcagcaauagcagcaccaguagcaggccaacaaaauguuauagaccccuggauaagaaauaacuucguccaagcacccggaggugaauucacaguuucaccaagaaaugcucccggagaaauccucuggucagcaccauuaggaccagauuugaauccauaucuaagucauuuagcaagaauguauaauggauacgcugguggauucgaaguacaaguaauucuagccggaaacgcauuuacagccggaaaaaucauauucgcagcaguccccccaaauuuuccaacagaaggauuaagcccaucucaaguaaccauguucccccacauaaucguugacguaagacaauuagaaccaguuuuaauaccuuuacccgauguaagaaacaacuuuuaucauuauaaccaaucaaaugaccccacuauaaaacugauagccauguuauacacaccauuaagagcaaacaaugcaggagacgacguauucacaguuagcugcagaguacuaacaagaccaucaccagauuuugauuuuauauuuuuaguuccaccuacuguagaaucuagaacuaaacccuuuuccguaccaauauuaacaguagaagaaaugacaaauucuagauuuccuauaccacuagaaaaauuauuuacuggaccaagcucugcuuuugucguacaaccucaaaauggaagauguacaacagacggcguauuauuaggaacaacacaauuaucaccugucaauauauguacauuucgaggagauguaacacauauaacaggaucucgcaacuacacaaugaaucuagcaacacaaaauuggaacucuuaugauccaacagaagaaauaccugcaccauuagggacaccagacuuugucggaaaaauacaagguguauuaacacaaaccacgagagcagauggaucuacuagaggacacaaagcaacagucuacaccggaucugcugacuucucaccaaaauuaggacgaguccaauucgcaacagauacugacaaugacuucgacgcaaaucaaaauacuaaauuuacuccaguaggaguaauacaagacggagacacagcucauagaaaugaaccucaacaauggguacuaccuuccuauucuggaagaaauucucacaauguucaucuugcaccagccgucgcaccaacauuuccaggagaacaauuauuauuuuuuagaucaacaaugccaggauguaguggauauccaaacauggauuuagacugcuuauuaccacaagaauggguucaauauuuuuaucaagaagcagcaccagcacaaucugauguagccuuauuacgauucguaaacccagacacuggacgaguguuauuugaauguaaauuacauaaaucaggcuacguaacagucgcacauacgggacaacacgauuuaguaauaccuccaaaugguuacuucagauuugacucauggguuaaucaauucuacacccucgcaccaauggguaauggaacuggaagaagaagagcauuauaa

SEQ ID NO: 32588 - RNA, 1611 nt, Artificial Sequence
  derived and/or modified sequence opt6 from capsid_protein__Norovirus__ADE28701
augaaaauggcaagcaacgaugcuacuccuucagaugauggugccgcaggacuaguaccugaaauaaauaacgaaguaauggcacuagaacccguagcaggagccuccaucgccgcaccaguaguuggccaacaaaauauuauagaccccuggauaagaaauaauuuuguacaagcaccugccggagaauucacaguuucuccccgaaacucuccaggagaauuacuacuagaucuagaauuaggacccgaacuuaacccauauuuagcacaccuagcaagaauguacaacggacaugcaggaggaauggaaguccaaauaguacuagcaggcaacgcauuuaccgcaggaaaaauacuauucgcagccauaccaccaucguuuccuuaugaaaaucuaucacccgcacaauuaacuaugugcccucauguaaucguugacguaagacaacuagaacccguucucuuaccaaugccagacauaagaaauguauuuuaucacuacaaccaaaacaauucaccaaaauuaagacucgucgcuaugcuuuauacaccauuaagagcuaauaauuccggugacgacguuuuuaccguuucuuguagaguauuaacuagaccuucaccagacuuucaauuuacuuuucucguaccacccacaguagaaagcaaaacaaaaaauuucacauuaccagucuuaagaguaucagaaaugacaaauucaagauucccaguaguauuagaucaaauguacacaucccgaaaugaaaacauaauaguacaaccacaaaaugguagaugcacuacagauggugaacucuuagguacaacaaucuuacaaagugucucuauauguaacuuuaaaggaacaaugcaagcaaaauuaaaugaagaaccaagauaucaauuacaacuaaccaacuuagauggaucuccaauugacccaacagaugacaugccagccccauuaggaacacccgauuuccaagcaaugcucuauggaguagcaucacaacguaguucaauagacaacgcaacaagagcacaugaugcacaaaucgauacagcuggagacacauucgcaccaaaaauuggacaaguaagauuuaaaucauccucuaaugacuucgauuuacacgauccaacaaaauucacuccaaucggaguaaauguagaugaucaacauccauuucgccaauggucauuaccaaauuauggaggccaccuugcauuaaacaaucaucuagcaccagcaguuaccccccuauuuccuggugaacaaauccuauucuuuagaucauacauucccuccgcggguggacauacagacggcgcaauggacugccuucuaccucaagaauggguagaacauuucuaccaagaagcagcaccaucccaaucugauaucgcauuaguaagauuuauaaauccagacacaggaagaguccuauucgaagcaaaacuacauaaacaaggauuuuuaacuaucgcugcaucaggggaucacccuauuguaaugccaacaaauggcuacuuuagauuugaggccuggguuaacccauuuuauacauuagccccagucggaaccggaucuggacgucgcagaauacaauaa

SEQ ID NO: 32589 - RNA, 1644 nt, Artificial Sequence
  derived and/or modified sequence opt6 from capsid_protein__Norovirus__ADE28721
augaaaauggcaaguaaugaugcagcuccaucuaaugauggagcugcaaaccuaguuccagaagccaauaaugaaguaauggcccuagaaccaguaguaggagcaucaauagcugcaccaguaguaggucaacaaaauauuauagacccauggauaagagaaaacuuuguacaagcaccacaaggagaauuuacuguaucuccaagaaauucuccaggugaaaugcuacuaaaccuagaauuaggccccgaauuaaauccauaccuaucacauuuaucacguauguauaacggauaugcagguggaaugcaaguacaaguuguuuuagcaggaaaugcauucacagcugguaaaauaauauucgcugcuguaccaccacauuuuccuguggaaaauauaucagcagcucaaauaacaauguguccucauguaauaguagauguaagacaauuagaaccaguauuacuuccucuacccgacauacguaacagauuuuuccauuacaaucaagaaaauacaccacgaaugagauuaguagcaauguuguacacaccauuaagagcaaauucuggagaagacguauuuacagucucgugcagaguguuaacuagaccugcacccgacuuugaauuuacuuuucuaguaccuccaaccguagaaagcaaaacuaaaccauuuacuuuacccauauuaacauuaggagaacuaucaaauucaagauuuccugcaccaauagacauguuauauccagauccaaaugaaggaauaguaguacaaccucaaaacggaagauguacuuuagaugguacauuacaaggaaccacacaauuaguaccaacccaaaucugugcuuucaggggaacccuaauaggacaaacaucacgaucuagugauucuacugauucagcaccacgaagacgagaucauccacuucauguacaacuuaaaaaccuugauggaacacaauaugauccaacugaugaagucccagcaguguuaggagcuauagacuuuaaaggaacaguauuuggcguagcaucacaaagagacguaucaggacaacaaguaggcgcaacaagagcccaugaaguacauauaaauacgacugacccaagguauacaccaaaacucggauccauacuuaugcauuccgaaucagaugauuucguaacuggccaaccaguacgauuuacaccaauaggaaugggagauaacgacuggcaccaaugggaauuaccagacuauucuggucauuuaacauuaaauaugucacuugcaccugcaguugcaccugcauucccaggagaaagaauacuauuuuuuagauccauaguuccaagcgcuggaggauauggaucaggauauauugauugccuuauaccucaagaauggguucaacacuuuuaucaagaagcagcaccaucccaaagugcaguagcccuaauaagauauguaaauccugauaccggacgaaauauauuugaagcuaaacuccacagagaaggauuuauaacaguagcuaauucuggaaauaauccaauaguaguaccuccaaacggauauuuuagauuugaagcauggguaaaucaguucuacacacuaacaccaauggguacgggacaaggaagaagaagaaaucaauaa

SEQ ID NO: 32590 - RNA, 1644 nt, Artificial Sequence
  derived and/or modified sequence opt6 from capsid_protein__Norovirus__ADE28722
augaaaauggcaaguaaugacgcagcuccaaguaacgacggagcagcuaaucuuguuccagaagccaauaacgaaguaauggcccuagaaccugucguuggugcaucaauagcugcaccuguaguaggacaacaaaauaucauagauccauggauuagagaaaauuuuguucaagcaccucaaggugaauuuacuguaaguccuagaaauucaccaggagaaauguuacuaaaccuugaauuaggcccugaauuaaaucccuacuuaagucaucuaucucguauguacaacggauaugcaggcggaaugcagguacaaguaguacuugcaggaaaugcauuuacagcaggaaaaauaauuuucgcagccguaccaccacauuuuccaguagaaaauauuagugccgcucaaauaacaauguguccacauguaauaguagauguuagacaauuagaaccaguauuacuaccacuaccugauauaagaaauagauuuuuccauuauaaucaagaaaauacacccagaaugagacuaguagcuauguuauauacucccuuaagagcaaauucuggagaagacguuuuuacggucaguuguagaguacucacaagaccagcaccagauuuugaauuuacuuuucucgucccaccaacuguagaaucaaaaacaaaaccuuuuacauuaccaauacuaaccuuaggagaauuaucaaacucaagauuuccagcaccaauugacauguuuuacacugaccccaaugaaggaauaguaguucauccccaaaauggcagauguacacuugacggaacuuuacaaggaacuacacaauuaguuccaacacaaauuugcgcuuucagagggacucuaauaggacaaacuucuagauccucugauucaacagacucagcaccacguagacgugaucauccacuucauguacaacucaaaaaucucgauggcacacaauaugauccaacagacgaagucccagccguacuaggagccaucgacuuuaaaggaacaguauucggaguagcaucacaaagagauguaucuggacaacaaguuggagcaacaagagcacacgaaguccauauuaacacaacagauccccgauauaccccaaaauuaggaucuauauuaaugcacucagaaucagaugauuuuguaaccggucaaccagucagauuuacaccaauaggaaugggcgacaaugacuggcaucaaugggaacuacccgauuacucaggacaccuaacucuaaauaugaaucuugcacccgcaguagcaccagcauuuccuggagaacgaauuuuauuuuuuagaucaauuguaccaucugcgggcgguuacggaucuggauacauugauugucucauaccacaagaauggguccaacacuuuuaucaagaagcagccccuucacaaucagcaguagcuuuaauuagauacguuaaucccgauacaggucggaacauauucgaagcuaaauuacaccgagaagguuucauuacaguagcuaauucaggaaacaauccaauuguaguuccaccaaauggcuacuuuagauuugaagcauggguuaaccaauucuauacuuuaacaccaaugggaaccggacaaggacgccgaagaaaucaauaa

SEQ ID NO: 32591 - RNA, 1644 nt, Artificial Sequence
  derived and/or modified sequence opt6 from capsid_protein__Norovirus__ADE28723
augaaaauggcuuccaacgacgcugcaccaucuaacgacggagcagcuaaucuaguuccagaagcuaacaaugaaguaauggcacucgaaccaguuguuggagcaucaauagcagcacccguuguaggacaacaaaauauuauagauccauggaucagagaaaauuucguacaagcaccucaaggagaauuuacuguaucaccaagaaauucacccggagaaauguuacuaaauuuagaauuaggaccagaacuaaauccauaucuaucucacuuaucacgaauguacaaugguuaugcaggaggaaugcaaguacaaguaguucuagcaggaaacgcauuuacagcaggaaaaauuauauuugcugcaguaccaccucauuuuccaguagaaaauauaagcgcagcccaaauaacaaugugcccucacguaaucguagauguucgacaauuagaaccaguuuuacuuccuuuaccugauauaagaaacagauuuuuucacuauaaccaagaaaauaccccaagaaugagauuagucgcaaugcuauacaccccauuaagagcaaacucgggagaagaugucuuuaccguuucaugccguguauuaacucgaccugcaccagauuuugaauuuacauuucugguaccaccuacuguagagucaaaaacaaaaccauuuacuuuaccaauauuaacacuuggugaacuuucaaacucuagauuuccugcaccaauugauaugcuauauacagauccaaacgaagggauagucguucaaccacaaaauggaagauguacauuagacggaacucuucaagguacaacccaacugguuccuacacaaauaugugcauucagaggaacauuaauaggucaaaucucacgaucuucugauucaacagauucagcaccacgaagacgagaccauccauuacauguucaauuaaaaaaccuagauggaacacaauaugauccaacagacgaaguaccagcaguuuuaggagcuauagauuuuaaaggaaccguauucggaguagcaagucaaagagauguuucaggccaacaaguaggugcaacaagagcucaugaaguacauauaaauacaacagacccaagauacacaccaaagcuaggcaguauacuaaugcauucagaaucagaugacuuuguaaccggccaaccaguuagauuuacaccaauuggaaugggagacaaugacuggcaccaaugggaauuaccugauuauagcggacauuuaacauuaaacaugaaucuugcuccagcaguugcaccagcuuuuccuggagaacgaauauuauucuuucguucuauaguaccaucagcaggagguuaugguucagguuacauugauugcuuaauaccacaagaauggguacaacauuuuuaucaagaagcagcaccaucacaaucugcuguagcacuaauuagauacguaaauccugacacaggaagaaauaucuucgaagcaaagcuucacagagaaggauucauaacaguagcaaauucaggaaauaacccuauaguaguaccaccuaauggauacuucagauuugaagcauggguaaaucaauucuauacauuaacaccaaugggaacaggucaaggacgaagacgaaaucaauaa

SEQ ID NO: 32592 - RNA, 1644 nt, Artificial Sequence
  derived and/or modified sequence opt6 from capsid_protein__Norovirus__ADE28724
augaaaauggcauccaaugaugcagcaccaagcaacgacggagcagcaaaccuagugccagaagcaaauaaugaaguaauggcacuugaaccaguuguuggagcaucaauagcagcaccaguaguaggucagcaaaauauaauagaucccuggauccgagaaaauuucguacaagccccucaaggugaauucaccguaucaccacgaaauuccccaggagaaaugcuucuuaauuuagaauuaggaccugaacuaaaccccuauuuaucacauuuaucuagaauguauaacgguuaugcaggcggaaugcaaguccaaguaguauuagcaggaaacgcauucacugccggaaaaauuauauuugcggcaguaccuccucauuuuccuguugaaaacauuucagccgcucaaauaacuaugugcccacacgugauuguagacgucagacaauuagaaccaguauuacuuccauugccagacauaagaaauagauucuuucacuauaaucaagaaaauacaccaaggaugcgauuagucgcuaugcuauacacaccacuccgagcaaauagcggugaagacguauucacagucuccugcagaguauuaacccgaccugcaccagauuuugaauuuaccuuucuaguaccuccaacaguagaaucaaaaacaaaaccauucacacuaccaauauuaacucuaggagaguuaagcaauucccgauucccugcaccaauagacaugcuauacacagaucccaacgaagguauaguuguacaaccacaaaauggaagauguacacucgacggaacauuacaaggaacaacucaacuagugcccacacaaauaugcgcauucagaggaacuuuaauaggccaaacuuccagaaguagugacucaacagacucagcaccucgaagaagagaccauccacuacauguacaauuaaaaaaucuagacgguacucaauacgaccccacagacgaaguaccagccguacuaggagcuauagauuucaaagguacuguauuuggcguagcuucucagcgugacgucucaggccaacaaguaggugcuacaagagcacaugaaguacauauuaauacuacagauccaagauauacaccuaaauuaggauccauauuaaugcauagugaaucagaugauuuuguaacaggacaaccuguuagauuuacaccaauaggaaugggagauaaugauuggcaucaaugggaacuuccagacuauucuggucauuuaacuuuaaauaugaauuuagcucccgcaguagcaccagcauuuccaggcgaacgaauauuauuuuucagaucuaucgucccauccgcuggcggauauggaucggauuauauagacugucuaauuccacaagaauggguacaacacuuuuaucaagaagcagcaccaucucaaucugcaguugcacucauucguuauguuaauccagauacaggaagaaauauauuugaagcaaaacuacaucgagaagguuuuauaacuguagcaaauagcggaaauaacccaauaguaguaccaccaaacggauauuucagauuugaagcauggguaaaucaauucuauacccuagcaccaaugggcacaggucaaggacguagacgaaaucaauaa

SEQ ID NO: 32593 - RNA, 1647 nt, Artificial Sequence
  derived and/or modified sequence opt6 from capsid_protein__Norovirus__ADK23787
augaaaauggcaaguaaugacgcaacaccuucuaaugacggagcagcaggacucguuccagaaauaucuaaugaagcgauggcacuugauccaguggcaggagcagcaauagcggccccacuuacaggacaacaaaauaucauagacccguggauaaugaauaacuucguucaggcaccuggaggagaauuuacaguaucaccaagaaacucaccaggagaaguacuauuaaaucuugaacuaggaccugaaauaaauccauaucuagcacauuuagcaagaauguacaacgguuacgcaggaggauuugaaguacaaguuguucuagcaggaaaugccuucacagcaggaaaaauaauauucgccgcuauacccccaaacuucccaauagacaauuuauccgcugcucaaauaacuauguguccacauguaauuguagauguacgacaacuugaaccaguaaauuuacccaugccagauguaagaaauaacuucuuccacuauaaucaaggcagugacucucgcuuacgacuaguugcaauguuauauacaccacuaagagcaaauaauucaggagacgacguauuuacaguaaguugucgaguccuaacacgaccaucaccagauuucucauucaauuuucuaguaccaccaacaguagaaucaaaaacuaaacccuucacacuccccaucuuaacaaucucagaaaugucaaauucaagauucccaguacccauagacucuuuacacacuucuccuacagaaaacguaguaguacaaugccaaaacggacgcgucacuuuagauggugaacuaaugggaacaacccaauuacuaccaagucaaauaugcgcauucagagguguacuaacaagauccaccuccagagcuucugaucaagcugacacagcaacaccaagauuauuuaauuauuacuggcacauucaauuagacaaucucaacgggacucccuaugacccagcagaagacauaccaggaccacuuggaaccccagacuuuagaggaaaaguauuuggaguugcuucucaaagaaaucccgacucaacaacaagagcacaugaagcaaaaauagauaccacagccggacgauucacaccaaaauuagguucucuagaaauaucaacagaaucaggagacuucgaucaaaaucaaccaacaagauucaccccgguaggaauaggaguagaucaugaagcagacuuccaacaauggucacucccagacuauucaggucaauuuacacauaauaugaauuuagccccagcaguagcuccuaauuucccuggagaacaacuauuauuuuuuagaagccaacuucccucuuccgguggaagaucaaacggaauacuagauugccuaguaccacaagaauggguucaacacuucuaucaagaaucagcacccgcacaaacacaaguagccuuaguaagauauguaaauccugauacagguagaguacuauuugaagcuaaacuacauaaacuuggauuuaugacaaucgcaaaaaacggugacucaccaaucacaguuccaccaaauggauacuuccgcuuugaaucuuggguaaauccauuuuauacauuagcaccaaugggcacaggcaauggaagaagaagaauacaauaa

SEQ ID NO: 32594 - RNA, 1623 nt, Artificial Sequence
  derived and/or modified sequence opt6 from capsid_protein__Norovirus__ADM52743
augaaaauggccucaaaugacgccaacccaucagacggcucuacugcuaacuuaguaccagaaguaaacaaugaaguaauggcacuugaaccuguaguaggugcagcaauagcagcaccaguugccggacagcaaaacguaauagauccauggauacgaaauaacuuuguacaagcaccaggcggagaauuuacaguauccccuagaaaugcucccggcgaaauacuauggucagcaccacuaggcccagaucucaauccauaucuaucacaucuagccagaauguauaauggauacgcaggagguuuugagguacaagucauuuuagccggaaaugcauuuacagcaggcaaaauaauauuugcagcaguuccaccaaacuuucccacagaagguuuauccccaucacaaguuacaauguuuccucauauaauaguugacgugagacaauuagaaccaguuuuaauuccauuaccugaugucagaaacaacuuuuaucauuauaaccaaucaaaugacccaacaauaaaacuuauagcaauguuauacacuccauuacgagcaaacaaugcaggagacgauguauuuaccguuuccuguagaguacucacuagaccuucaccagacuucgacuuuaucuuuuuaguaccacccacagucgaaucaaggacaaaaccauuuucuguaccaauauuaacaguagaagaaaugacaaacucaagauucccaauuccucucgaaaaacuauuuaccgguccaucauccgccuucguaguucaaccucaaaacggcagauguaccaccgacgggguuuuacuagguacaacccaauuaagcccagucaacauauguacuuuuagaggagauguaacacauaucacaggaucacguaauuacacuaugaauuuagcgacacaaaacuggaacagcuacgaccccacagaagaaauaccagcaccauuaggaacaccagacuuuguaggaaaaauucaaggaguauuaacacaaacaacaagagcagaugguuccacaagaggacauaaagcaacaguauauacaggaagcgcagacuuugcuccaaaauuaggaagaguacaauuugcaacugauacagauaaugauuucgaugcaaaucaaaauacaaaauucacaccaguuggcgucauacaagacggaaacacagcacaucgaaacgaaccacaacaauggguccuaccaucauacucagguagaaacucccauaauguccaucuagcaccagcaguagcaccaacauuuccaggcgaacaacuucuuuucuuucgaucaacaaugcccggaugcucuggauauccaaauauggaucucgacugcuuacuaccacaagaauggguacaauauuucuaucaagaagcagcaccugcacaaucugacguagcauuauuaagauucguaaauccagacacaggaagaguauuauucgaaugcaaacuacauaaaucaggauauguaaccguugcacacacaggacaacaugacuuagucauaccaccaaauggauauuuccgauucgacucauggguaaaucaauuuuauacacuagcaccaaugggaaauggcacaggacgaagaagagcucuauaa

SEQ ID NO: 32595 - RNA, 1623 nt, Artificial Sequence
  derived and/or modified sequence opt6 from capsid_protein__Norovirus__ADR57234
augaaaauggcaucaucagacgcaaauccaucagacggaaguacagcuaaucuaguaccagaaguaaauaaugaaguuauggcucuugaaccaguaguaggugccgcaauagccgcaccuguagcaggacaacaaaauguaauagaccccuggauaagaaauaacuucguacaagcaccaggcggugaauuuaccguauccccuagaaacgccccaggagaaauacuuugguccgcaccauuaggacccgacuuaaaucccuauuuaucgcacuuagcacguauguauaacggcuacgcaggcgguuucgaaguacaaguaauccuagcaggaaaugcauuuacagcuggaaaaaucauauucgcagcuguaccuccaaacuucccuacagaaggauuaucaccaucucaaguaacaauguucccucauauaauuguagauguaagacaacuagaacccguucuaauuccuuuaccagauguaagaaacaauuucuaccacuauaaucagcuaaacgaccccacaauaaaauuaauagccauguuauacacuccacuaagagcaaauaaugcaggagacgacguauuuacaguaaguuguagaguuuuaacuagacccucuccagauuuugacuuuauauuuuuagucccaccaacaguagaaucucgcacaaaaccuuucuccguaccuauacucacuguugaagaaaugacaaacucaagauuuccaauuccauuagaaaaacuauuuacaggaccauccucagccuucguaguccaaccacaaaacggaagauguacaacagacggaguccuuuuaggcaccacucaacuaucaccaguaaacauaugcacauuuagaggcgauguuacacauauaaccggaucacacaauuauacaaugaaucuagcaucccaaaauuggaacucauaugauccaacagaagaaauaccagcaccacuagguacaccagacuucgucggaaaaauccaaggaguacuaacgcaaaccacaagagcagauggaucuacaagaggacauagagcaacaguuuacacaggaucagcugaauuugcaccaaaacucggaagaguacaauucgccacagauacugaaaacgacuucgacacaaaccaaaacacaaaauuuacaccuguuggcguaauacaagacggaaauacuacacauagaaaugaaccucaacaauggguccucccaucauauucuggacgaaauucucauaacguacaccuagcaccugcaguagcaccaacauuuccaggagaacaauuacuauuuuuucgcucuacaaugccaggaugcucuggauauccaaauuuagacuuagacugucuacucccacaagaauggguacaacacuucuaucaagaagcagcccccgcacaaucagacguagcauuauuacgauucguuaauccagauacuggacgaguacuauuugaauguaaauuacacaaaucuggauauguaacaguagcacacacaggucaacaugauuuaguaauaccucccaaugguuauuuucgauuugacuccuggguaaaucaauuuuacacacuagcaccaaugggaaauggaacaggaagacgucgugcauuauaa

SEQ ID NO: 32596 - RNA, 1626 nt, Artificial Sequence
  derived and/or modified sequence opt6 from capsid_protein__Norovirus__AEA07712
augcgaaugagugauggagcggcuccaaaagcaucuggaucugaagcaucuggucaagaccuaguaccuuccgcaguagaacaagcaguuccaauacaaccaguagucggagcaacauuggccgcaccagcagcaggacaaauaaaccaaauagauccuuggauauuucaaaacuuuguacaaugcccacuuggcgaauuuucaauaucacccagaaauacaccaggcgaaauauuauucgauuuagcacuaggaccuggauuaaauccauauuuagcacauuuaucagcaauguacacaggauggguagguaauauggaaguccaauuaguauuagcuggaaaugcauuuacagcaggaaaaguaguaguugcucuuguaccuccauacuuuccaaaaggauccauaacaacagcacaaauaacauguuuuccucacguuaugugugauguacgaaccuuggaaccaauacaauuaccacucuuagacgucagacgaguucuauggcaugcuacacaagaucaagaagagucaaugagacuuguuuguauguuauauaccccacuaagaacaaauucuccuggagaugaaucuuuugucguuucaggaagauuacuuucaaagccagcagcagauuuuaauuuuguuuaucuaacaccaccaauagaacgaacaauauauagaauggucgacuuaccaguacuucaaccaagauuaugcacacaugcaagauggcccgcuccaguauacggauuacuuguagauccuagucuuccuagcaauccucaauggcaaaauggacgaguacauguagauggaacauuauuggguacaacaccaguaaguggaucuuggguauccuguuuugcagcagaagcagcuuaugaauuucaaucaggaauaggugaaguugcaacauuuacauuaauagaacaagauggaagcgcauacuuacccggagauagagcugcaccuuuaggauauccagauuuuucaggacaauuagaaauagaaguacaaacagaaaccacuaaagcuggcgauaaauuaaaaguuaccacauuugaaauggcauuaggaccaacaacuaacgucgaucaagcuccuuaucaaggaagaguauucgcuucauuuaccgcuagugcuucuuuagaucuaguagauggucgaguuagagcaguaccaagaucaauauucgguuuucaagauguaguaccugaauauaaugauggauuacucguacccuuagcaccaccaauaggaccuuuucuaccaggugaaguauuacuaagauuuagaacauacaugcgacaaauugauagcuccgacgcagcagcagaagcaauagauugugcauuaccacaagaauuuguaucuugguucgcaucuaaugguuucacaguccaaucagaugcauuacuacucagauacagaaauacgcuaacaggacaauuauuauuugaauguaaacuauacucagacggauauauagcauuaucauauucaggaucaggaccucuaacuuuuccuacugauggauuuuuugaaguaguaucuugggucccacgauuauaucaauuagcaucaguuggaucacuagcaacuggaagaacauuaaaacaauaa

SEQ ID NO: 32597 - RNA, 1623 nt, Artificial Sequence
  derived and/or modified sequence opt6 from capsid_protein__Norovirus__AEK05311
augaagauggcaucaaaugacgcaaauccauccgacggaucagcagcuaaccuaguaccagaaguaaauaaugaaguaauggcauuagaaccaguaguaggagcugccauagcagccccuguagcaggacaacaaaauguuauagacccuuggauaagaaauaacuuuguacaagcuccaggcggagaauuugcaguuucaccaagaaaugcaccaggugaaauauuauggucugcaccauuaggaccugaccuaaacccauaccuaucacaccuugcaagaauguauaacgguuacgcuggcggauucgaaguacaaguaauucuagcaggaaaugcauucaccgcugguaaaauaauauuugcagcaguaccaccuaauuucccuacagaaggacuaucaccaucacaagucacaauguucccacauauuauaguagacguuagacaacuggaaccaguguuaauaccuuuaccagacguccgcaauaauuucuaucacuauaaucaaucaaaugauucaaccauaaaauugaucgccaugcuuuacaccccacuaagagcuaacaaugcaggugaagauguauucacagucuccugucgaguacuaacacgacccucaccagacuuugauuucauauuccuaguucccccaaccguugaaagucgaacaaaacccuucacaguccccauauuaacagucgaagaaaugaccaacucuagauuuccaauuccacuagaaaaauuauucacaggaccaucaggagcauuuguuguacaaccccaaaauggucgauguaccaccgacggaguucucuuaggaaccacccaacucucuccaguaaauauauguacauucagaggcgacguaacacauauagccggaucaagaaauuacacaaugaacuuagcaucucuaaacuggaauaauuaugauccaacugaagaaaucccagccccucuaggaacaccagacuuuguaggaaaaauacaaggaguucuaacacaaacaacuaaaggagacggcuccacaagaggacacaaagcaaccguauauacaggaagugcuccuuuuacuccuaaauuaggaucuguacaauuuaguaccgacacagaaaaugacuucgaaacacaucaaaauacaaaauuugcuccagugggcguuauacaagacggaucaacaacacaucgaaacgaaccucaacaauggguauuaccaaguuauucaggaggaaauguccauaacguccaccuagcucccgcaguagcaccaacauuucccggagaacaauuacuuuucuuuagaucuacaaugccaggaugcuccgguuaccccaauauggaccuagauugccuacuaccacaagaauggguacaacauuucuaucaagaagccgcaccagcucaaucugacgucgcauuauuaagauuuguaaauccugauacuggcagagucuuauucgaaugcaaauuacacaaaucaggauacgucaccguagcacauacaggacaacaugaucuaguaauaccaccaaauggcuacuuuagauucgacuccugggucaaccaauuuuacacuuuagcaccaauggguaauggcaccggaagaagacgugcacuauaa

SEQ ID NO: 32598 - RNA, 1608 nt, Artificial Sequence
  derived and/or modified sequence opt6 from capsid_protein__Norovirus__AEP16505
augaaaauggccucaucagacgccgcaccaucaaacgacggagcagcuggauuaguacccgaaguuaacaacgaaacuauggcauuagaaccuguagccggagcaucaauagcagcuccacuaaccggacaaaauaacguaauagauccauggaucagaaugaauuucguacaagcacccaauggagaauucacaguuucucccagaaauucaccuggugaaguucuacucaaccuagaacucggaccagaacuuaacccauucuuagcacaccuuucuagaauguauaauggauaugcaggaggagucgaaguccaaguacuauuagcaggaaacgccuucacagcuggcaaauuagucuuugcagcuauacccccacauuuucccuuagaaaaucuaucaccaggccaaauuacaauguuuccacacgucauuauagauguaagaacacuagaaccaguacuacuaccauuaccagauguuagaaacaauuuuuuccacuacaaucaacaaccagaaccaagaaugcgccuaguagcaauguuauauaccccauuaagaagcaacggaucaggagaugauguuuucacugucagcugcagaguccuaacaaggccaucaccagauuuugacuucaauuauuuaguacccccaacaguagaaucaaaaacaaaaccauuuacauuaccaauauuaacaauaggagaauuaaguaauucaagauucccaguuccaauagacgagcuauacacaucuccaaacgaaggaguagucguacaaccacaaaauggccgaucuacccuugauggcgaauuauuaggaacaacccaauuaguacccucaaauauuugugcacuaagaggacguauaaaugcacaaguccccgacgaccaucaucaauggaaccuacaaguaacuaaugcaaacgguacaucauuugacccaacagaagacguccccgcaccauuagguacaccugauuuucucgcaaacauauacggcguaacuucacaacguaaucccgacaauacauguagagcacaugacggcguacuugcaaccugguccccaaaauucacccccaaauuaggaucaguaguauuaggcacaugggaagaauccgauuuagaccuaaaccaaccaacacgauuuacaccaguaggcuuauaugauaccaaucauuuugaccaauggauacuaccaaauuauagcggacgauuaacccuaaauaugaacuuagcaccaucaguagcuccccuauucccaggagaacaaauauuauuuuuuagaagccacauacccuuaaaaggaggaacaucuaauggagcaauagauugcuuacugccacaagaauggauucaacacuucuaccaagaaucagcaccaucaccuacagacguagcuuuaauaagauacccaaacccagauacaggucgaguacuuuucgaagcaaaacuccuaagaccaggauucauaacaguagcaaauuucgguuuuaaacccauaguuguaccuccuaaaggcuacuuuagauucgauaguugggucaaucaauuuuacucuuuagccccaaugggaacaggaaacggaagacgaagaguccaauaa

SEQ ID NO: 32599 - RNA, 1632 nt, Artificial Sequence
  derived and/or modified sequence opt6 from capsid_protein__Norovirus__AEY77318
augaugauggccucaaaagaugcucccacaaauauggauggcaccucuggagcuggacaauuagucccagaaguaucuacugcagaaccaauaucuauggaacccguagcaggagcagcaacagccgcagccacagcuggucaaguaaauaugauagaucccuggauuaugucaaacuacguacaagccccacaaggagaauuuacaauaucuccaaauaauacaccaggagacauacuuuuugaucuacaacuaggcccacaccuaaacccauuccuuagucacuuagcacaaauguauaaugguuggguuggaaacaugaaaguaagaguucuucuagcuggcaacgcauucacggcuggcaaaauaauaauaucaugcguuccaccuggauuugcagcacaaaacguuucuauagcacaagcaacaauguucccacacguaauagcugauguaagaguucuagaacccauagaaguaccacuagaagaugucagaaauguauuauuucauaauaaugauucaacaccuacaaugagauuaauauguauguuauauacuccucuaagagcuucagguagcagcucuggaacugauccguuuguuauagcaggucgaguauuaacauguccuucuccagauuuuaauuuucuuuuuuuaguuccccccaauguugaacaaaaaacaaaaccauuuucuguaccaaaucuaccucuaaacguacuaucuaacuccagaguaccaucucuuauaaaauccaugaugguaucacaagaccacggacaaaugguacaauuucaaaauggucgaguaacucuugauggacaacuacaaggaacuacuccaacuucagcaucacaacuauguaaaauuagaggaacaguauaucaugcaacagguggucaaggauuaaaccuaacagaaauagacgguacuccauaucaugcauuugaaucaccugcaccuauuggauucccugaucuaggagaaugcgacuggcauauaaaugccucuccagcaaaugcauuuacagaugguucaauaauucauagaauugauguagcacaagacucaaccuuugcaccucauuuaggaacaauacauuauacaaaugcagauuauaacgcaaacguaggacuaauuuguucacuagaaugguuauccccacccagugguggcgcaccaaaaguaaauccaugggcaauaccccgauauggaucaacauuaacugaagcagcucaacuagcuccuccaauuuauccaccuggauuuggcgaagccauaguauuuuucaugagugauuucccaaucgcaaaugguuccgauggcuuaucaguaccuuguacaauaccacaagaauuuguaacccacuuugucaaugaacaagcacccacacgaggcgaagcagcauuauuacacuauguagauccugacacccauagaaauuuaggugaauuuaaauuauacccagaagguuuuaugacuuguguaccuaauucaucaggaucaggcccucaaacauuaccaauaaacggaguuuucacuuuuauaucuugggucucaagauucuaucaauuaaaaccaguaggaacaacaggaccuguaagaagacucggcauuagaagaucuuaa

SEQ ID NO: 32600 - RNA, 1626 nt, Artificial Sequence
  derived and/or modified sequence opt6 from capsid_protein__Norovirus__AEY83583
augagaaugucagauggagcagcaccaaaagcuaauggauccgaagcaaguggucaagauuuaguuccaacagcaguagaacaagccguuccuauacaaccaguagcaggagcagcauuagccgcuccagcagcuggacaaauuaaucaaauagaucccuggauauuucaaaauuucguccaaugcccauuaggagaauucucaauauccccucgaaacaccccaggcgaaauacuauuugauuuagcacuaggaccuggccuaaacccauauuuagcucaucuaucugcaauguauacuggauggguaggcaacauggaaguccaauuaguacuugcagguaaugcauucacugcaggaaaaguaguugucgcacuaguaccaccuuacuuucccaaaggcuccuuaacuacugcacaaauaacuuguuucccacauguuaugugugauguacgaacauuagaaccuauccaacuuccuuuauuagauguaagaagaguauuauggcaugcaacucaagaccaagaagaauccaugcgacuaguauguauguuauauacaccauugcguacaaauaguccaggagaugaaucauucguaguaucagguagauuauuaucaaaaccugcuccagauuuuaauuucguauaucuaacaccaccaauagaacgaacaauauauagaaugguugauuuacccgucuuacaaccacgacuauguacacaugcacguuggccagcuccaguuuacgguuuauuagucgacccaucucuaccaucuaacccucaauggcaaaacggaagaguucaaguagacgguacacuauuagguacaacaccaguaaguggaucauggguaucauguuuugcagcagaagcagcauaugaauuucaagcagggacuggagaaguaguaacuuuuacaaugauugaacaagacggaucagcauauguacccggugacagagcagcaccauuagguuauccggauuuuucaggacaauuagaaauugaaguacaaacagaaaccacaaaaacaggcgauaaauuaagaguaacaacuuuugaaaugauauuaggaccuacaaccaauguugaucaagcaccauaucaaggaagagcauacgcauccuuaacagcagcugcaucccuagaucucguagauggacgaguacgagcuguuccuagaucuauauacucauuccaagaugaauuaccagaauauaaugacggaguucuaguaccccuugcacccccucuaggcccauuuuuaccaggagaaguauuacuucguuuuagaacauauaugagacaauuagauacagcagaugcagcagcucaacccauagacugcgcacuaccacaagaauuuauuucaugguuugcauccaauaacuucacaguacaaucagaugcacuauuaguacgcuauagaaacacuuuaacaggacaauuauuauuugaagcaaaacuauauucagaagguuacauagcaguaucauauucaggaucaggaccguuaacuuuucccacugacggauuuuuugaaguaguuucuuggguaccaagauuauuucaauuagccuccguaggaaguuuaguaacagguagaacuuuaaaacaauaa

SEQ ID NO: 32601 - RNA, 1629 nt, Artificial Sequence
  derived and/or modified sequence opt6 from capsid_protein__Norovirus__AFB18010
augaaaauggcaagcaaugacgcagcuccaucaacagacggagcagcugguuuagucccugaauccaacaacgaaguaauggccuuagaaccaguugcuggagccgcccuagcugcaccggucacaggucaaacaaacauaauugacccauggauaagaacaaauuuuguucaagccccuaacggagaauucaccguaucuccaagaaaugcaccaggcgaaguacuauuaaaccuagaauuaggacccgaauuaaauccuuaucuagcgcaccuagcucguauguauaauggauaugcuggaggaauggaaguacaaguaaugcuugcagguaaugcauucacagcagguaaacuaguauucgcugcaguuccuccccacuucccaguagaaaacuuaucuccacaacaaauuacuauguuuccucaugucauuauugacguaagaacacucgaaccuguauuauuaccacuuccugacgucagaaauaauuucuuucacuacaaucaaaaagacgacccaaaaaugcgaauagucgccaugcucuauacaccacuuagaucaaacggaucaggagaugacguauucacaguaucuugucgaguucuaacacgacccuccccugauuucgacuuuacauauuuaguacccccaacaguugaauuuaaaacuaaaccauuuacuuuaccaauauuaacacuaggagaaaugucaaauucacgcuucccaguuccaauagaucaaauguacacaucaccuaaugaaauaauuucuguucaaugucaaaauggacguuguacuuuagauggagaacuacaaggaacuacacaacuacaagucucaggcauaugcgcauuuaaaggucaaguaacagcucacuuacaagacaacgaacacuuauauaacguaacaaucacuaaccuaaauggaucaccauuugaucccucagaagauauuccugcaccauuaggagucccugauuucgaaggacgaguauucgguguaauaucacaaagagacaacuauaauuccggaggacaaaaucaaccagcaaacagaucucacgaugcaguaguaccaaccuauacugcacaauacacaccuaaauuaggacaaauucaaauaggaacuuggcaaacagacgauauaacaguagaccaaccagcuaaauuuacaccuguaggauuaucagauacagaucauucaaaucaauggguugucccaagauaugcaggagcuuuaaaucuuaauacaaauuuagcacccucaguagcaccugucuuuccaggagaacgacucuuauuuuuuagaaguuauauuccacuaaaaggaggauuuggcaauccagcaauagauugucuaguaccacaagaauggauacaacauuuuuaucaagaagcugcaccuucauuaagugaaguagcacuugcuagauacauaaacccugauacuggaagagcauuauuugaagcaaaacuacauagagcaggauuuaugacaguaucaucuaauacaagcgcaccuguaguuguaccagcaaauggauauuucagauucgauucauggguaaaucaauuuuauucacuagcaccaaugggaacaggaaacggaagaagaagaauucaauaa

SEQ ID NO: 32602 - RNA, 1623 nt, Artificial Sequence
  derived and/or modified sequence opt6 from capsid_protein__Norovirus__AFB18013
augaaaauggccucuaacgaugcaaacccauccgacgguucaacagcaaaucuuguaccagaagucaauaacgaaguaauggcauuagaaccugucguaggcgcagcaauagcagcaccuguagcaggacaacaaaauguaauagauccauggauacgaaauaacuuuguacaagcaccaggaggagaauuuacaguuucuccccgaaacgcaccaggggaaauacuauggucagccccuuuagguccagaucuaaauccuuaccuaagucacuuagcaagaauguacaacgguuacgcaggcggcuuugaaguucaagucauucucgcaggaaaugccuucacagcaggaaaaguaauauuugcagcaguaccaccuaacuuucccaccgaaggauuaucaccuucacaaguaacaauguucccccacauaguaguagacgucagacaauuagaaccuguacuaauaccuuuaccugacguaagaaauaauuuuuaucauuauaaucaauccaacgacccaaccauuaaauuaauagcaauguuauacacuccuuuaagagcaaauaaugcaggcgaagaugucuuuaccguuagcugcagaguacuaacuagaccaucacccgacuuugacuucauuuuucuagucccaccaacagucgaaucuagaacaaaaccauuuacaguaccuauacucacaguugaagaaaugacaaacucaagauuuccaauaccauuagaaaaauuauucacagguccuuccggugcauucguaguucaaccccaaaacggaagaugcaccacagacggaguccucuuaggaacaacacaauuauccccuguuaacauaugcacauuuagaggagacguaacacauaucgcuggaacucauaauuacacaaugaauuuagcaucucaaaauuggaauaacuaugacccaaccgaagaaauaccagcaccccuaggcacaccugacuuuguaggcagaauucaaggaauguuaacucaaacaacaagaggugacggaucaacuagaggccauaaagcaacaguaucaacaggagacguacauuuuacacccaaauuaggaucaauccaauucaauacagauacaaacaacgauuucgaaacaggacaaaacacuaaauuuaccccuguaggaguaguacaagauggaaacggaacacaucaaaaugaaccacagcaauggguucuaccuagcuauucaggaagaacaggucauaauguucacuuagcaccagccguagcaccaaccuuuccuggugaacaauuauuauuuuucagaucaaccaugccaggauguucaggauacccaaacaugaacuuagauugucuacuaccccaagaauggguacaacauuucuaucaagaagcagcaccugcucaaucagauguagcacuacuaagauucguaaacccagacacaggaagaguacuuuucgaaugcaaacuacacaaaucuggauauguaacaguagcccauacaggacaacaugaucuaguaaucccuccaaauggauacuucagauucgacaguuggguaaaucaauucuauacauuagcaccaaugggaaauggcacuggaagacgccgcgcauuauaa

SEQ ID NO: 32603 - RNA, 1743 nt, Artificial Sequence
  derived and/or modified sequence opt6 from capsid_protein__Norovirus__AFJ05624
augaaaauggcaaguaaugaugcuaccgcacccucacaagauggagcugcaaauuuaguaccugaaagucaacacgaaguacuagcuuuagaaccugucgcaggcgcagccuuagcugcaccuguagcuggucaauuuaaugcaauagauccuuggauuaaacaaaauuucguucaagcacccgccggcgaauuuacaguaagcccacguaaugcaccaggagaaauauuaauggauuuagaauuagguccagaacuaaacccauuucuugcacaucuagcucaaauguauaacgcuuacgcaggagguauggaaguacaaauaauccuugccggaaacgcauuuacagcaggaaaaauaauuguaugugcaguaccgccaaauuuuccaccagaccgacuuucagcuagccaagccacaaauuuuccacauguuauuauggacguucgcacccuagaaccaguaauauuaccauuaccagacguaagagcaggauuuuuucacuacaaucaacuaagagaacccagaaugcgauuaauggcacuuuuauacacuccacuuagggccaauggaacgggagacgaugcauuuacaguaucaugcagaguucuaacuagaccaaugcaagauuuugaauucauguuuuuaguaccuccuacaguagaaucaagaguaacaccauuuucaguuccuacuuauccaguuguagaaaugacaaacucaagauggccagccagaauaucugguaugcacguaaacgcaaaucaaaccuuagcaguucaauuccaaaauggcagauguacacucgauggucaauuaaugggaacuacacaacuaugugcagcagauguuugccgaaugagaggaagauacacaucaaccagagcagauuuagcaggaguagaccauacugaccaaggaccaucuuuaggaacuggaccaucagaugauagugucucuguaccugaagcaagagcacaaacaagaacugguguuucugcucacuuacaauuagaagaacucaacggccaaccauaugaaguauauggagaacaaccagcaccacuaggaacaccagacuucagauguagauuaaugggugaauuaguaagauuaccaucaaccucaccagcagcacaaucaagauucagagaugcuuuuuuugacaccuacggugcacucuucgcaccagcagucgguucaacuacuuuuacagucaauaauaguucuacuucagauuucgccaacggucaaccauuugaauuuuuaccaauaggaguugaaauuggcaauagcgcucaauaugaugaauucgcccuaccuucauauaauggcgcaauaggagaaaauagacaccuugcuccugucgccgcuccagguuucccaggugaaaauauaguauucuuuucuucaaauuuaccaguaugggauucaacuuccgcacaaaauaaccgccgaauaaguuguuuauuaccuaacgaauucguacaacauuuuuaugauuuacaagcaccaucacaaagugacguagcauuauuaagauacguucauccagaaaguggaagaguuuuauuugaauguaaauuauauagagacggauucuuaacaguuaacggagcaucacuagcagaauuuccaguuaaugguuauuuuagauuugauucauggguuaaucaauucuucacacuauccccaguaggaacaggcucaggacgacgaggacguucacgaaacgcacaauaa

SEQ ID NO: 32604 - RNA, 1746 nt, Artificial Sequence
  derived and/or modified sequence opt6 from capsid_protein__Norovirus__AFJ05628
augaaaauggccucuaacgaugcagccucaccaucaucagacggagcagcaaaucuaguaccagaaauaaauaaugaaguaauggcacuugaaccuguugccggagcucaauuagcagccccaguagcuggucaauucaacgccauagauccauggauaagacaaaauuuuguccaagcaccagaaggagaauucacaguaucaccacguaacgcaccaggagaaauacuuuuaaacuuagaacuuggaccacacuuaaacccauuccuucaacaucuagcacaaauguacaaugcuuaugcaggaggaauggaaguacaaguuguauuagccgguaacgcuuucacagcaggaaaaauaauauuugcagcuguaccuccacacuucccaccugaacgauuauccgcagcacaagcaacacaauuuccacacguaauagucgauguacggcaauuagaaccaauaauccuacccuuaccugauguaagacauaaucuuuuccauuuuaaccaacaaaaugaugaaagaaugcaucuaguagcauuucuauauacaccauuacgagcuaacucaggaucaggagaugauguauuuacaguaucuuguagaguacugaccagaccaagccaagauuuugaauuuauguuucucguuccccccacagucgaaaaaaaaacaguagcauucagucucccccaacuagcaauaggcgaaaugucuaacucucgcuggccagccagaauaacaggauuaguaguagauccaagacuaccucaaguauuacauauacaaaauggaagauguacauuagauggaacacuuaugggaacaacacaacuaaaucccaaugacauaugcaggauucgaggauauuuuucauccucaagacccgaacuauuaugcgaaaacgaagaaucugcaacugauccaaugccuacagaaacagauacagauaaucaacccccagaaguuagagcacaagcaagggccacacaacgaugguuugcaguaacagaacuuaacggucaagucuaugauccauuuggcgaucaaccugcaccucuaggcguaccagacuucaaagcacguauauuaggagcacuaaugagacuucccgguacaaauccaacaucaaacuccagauuugaagacgcauggguagaaaccaauaaucaaacaacguaugcuccagcagcagguguaguagcuaucacaacuaacgacaacucaucaagcaauuacgcuaacgaucaaacaugugaauuuguuccacuagguauagaaauaacagauucugcacccuaucaugaauucgacuuaccaagcuacggcggagcagcaucaagcggcaaccguaaccuagcaccaacaguugcaccaacauucccaggagaagcaauacucuuauucggaucaaauaugccaguauauaauagaaauacaggcacaucaaauaaagauauaagaugucucuuaccaaaugaauauguacaacacuuauaugauacacaagccccuucauuaucugacguagcucuaguaagauauguaaauagagauacaggaagaguauuauuugaggcuaaauuacauagagaugguuuuaugacagucaacgcaucuucuaccacaguucuaccuguagacggauauuuuagauuugacaguuggguaaaccaauuuuaugcccucucuccaguagguaaugcaucuggaagaagaggcagauccagacaaaccaauuaa

SEQ ID NO: 32605 - RNA, 1623 nt, Artificial Sequence
  derived and/or modified sequence opt6 from capsid_protein__Norovirus__AFJ24945
augaaaauggcuagcaaugaugcaaauccaucagauggauccgcagcaucauuagucccagaaguaaauaaugagguuauggccuuagaaccaguaguaggagcagcuauagcagcaccaguagcuggucaacaaaacguuauagaucccuggauaagaaacaacuuuguccaagcuccaggaggagaauucacaguuucaccaagaaaugcaccaggagaaauccucuggucagcaccauuaggaccagacuuaaauccauaucuaucacauuuagcacgcauguauaacgguuacgcuggggguuucgaaguacaagucauauuagccggaaaugcuuucacagcuggaaaaauaauauuugcagcaguaccaccaaacuuuccaacagaaggauuaucacccucucaaguuacaauguucccacauauaauaguagacguaagacaacuugaaccaguucuaauuccauuaccagacguacgaaauaauuucuaucauuacaaccaaucgaaugacucuacaauaaaauuaauagcaauguuauacacuccccuacgagcaaacaaugcaggagaagacguuuuuacaguuucuuguagaguauuaacaagaccauccccugacuucgauuucauauuucuaguccccccuaccgucgaaucacgaacuaaacccuucacaguaccaauauuaacaguugaagaaaugacaaauucuagauuucccauaccacuagaaaaacuauuuacaggaccaaguucagcuuuuguaguacaaccccaaaacgguagauguacaacugauggagucuuauuaggaacaacacaacuuucaccaguaaauauaugcacauuccgcggagacgucacacacauagcaggaaguagaaauuacacaaugaauuuagcaucauuaaauuggaacaauuacgaucccacugaagaaauaccugcaccccuuggcacuccagauuucguagguaaaauccaaggaguccuaacacaaaccacuaaaggagauggaucaacaagaggacacaaagccacaguauauaccggaucugccccauuuaccccuaaauuaggaucaguacaauucucaaccgauaccgaaaaugauuucgaaacucaucaaaauacaaaauucacaccaguagguguaauacaagaugguucaacuacacacagaaacgaaccccaacaauggguuuuaccaucauauucagguggaaauguucacaacguucaucuagcaccugcuguagcaccaaccuucccaggugaacaacuacuauuuuuuagaucaacaaugccaggaugcucaggauauccaaauauggaucuagauugucuacuaccucaagaauggguacaacauuucuaccaagaagcagcaccugcacaaagcgauguagcacuucuucgauuuguuaauccugacaccggccgaguucuauucgaaugcaaauuacauaaaagugguuauguaacaguagcacauacaggacaacacgacuuaguuauaccaccaaauggauauuuucgauuugacucguggguaaaccaauuuuacacauuagcaccaaugggaaauggcaccgguagaagaagagcccuauaa

SEQ ID NO: 32606 - RNA, 1638 nt, Artificial Sequence
  derived and/or modified sequence opt6 from capsid_protein__Norovirus__AFK75851
augaugauggcuuccaaagaugcaccaccaaacauggacggcacaucuggagcuggacaacuaguuccagaagcaaacaccgccgaaccaaucucaauggagccaguagcaggagcagcuacggcagcagcaacagcaggacaaguuaauaugauagacccauggauaaugaauaauuacguacaagcaccacaaggcgaauuuaccauuucaccaaauaauacaccaggagacauuuuauuugacuuacaauuagguccacauuuaaacccauuucuaucacauuuagcacaaauguauaauggaugggucggaaauaugaaaguaaaaguauuacuagcagguaaugcauuuacagcaggaaaaauaaucauaucaugcauaccuccaggauuugcugcucaaaacaucucaauagcacaagcaacaauguuuccucauguaauagcagacguaagaguucuagaaccaauugaaguaccauuagaagauguaagaaauguauuauuccauaauaacgauaacacuccaacaaugagacuaguauguauguuauauacaccauuacgagcaagcggcucuucaaguggaacagacccauuuguuauagcuggaagaguauuaacuugcccaaguccagacuuuucauuccuauuuuuaguaccuccaaauguagaacaaaaaacaaaaccauucucagucccaaaccuaccacuaaauaccuuaucaaacucgaggguucccucauuaauaagaucuaugaugguuucacgugaucacggacaaaugguacaauuccaaaauggaagaguaacauuagauggacaacuucaaggaacaacaccuacaucugcaagccaauuaugcaaaauaagaggaucuguauuucaugcuaacggaggaaauggauauaacuuaacagaacuagauggaucuccauaucaugcuuucgaaaguccagcuccaauaggcuuuccagaccuaggagaaugugauuggcacauggaagccucaccaacuacucaauuugauacaggcgauguaaucaaacaaauaaaugucaaacaagaggcagcauuugcaccgcauuuaggaacaauacaagccgacggacucucugauguauccguaaauacaaauaugauagcaaaauuagguuggguuucuccugugucagauggacauagaggaucuguagauccauggguaauaccuagauacggaucaacccuaacagaagcagcgcaauuagcaccacccauauauccaccaggauucggugaagcaaucguauuuuuuaugucugacuuuccuauagcacauggagcaaauggauuaucagucccguguacaauaccacaagaguucguaacucauuuuguaaacgaacaagcaccuacaagaggagaagccgcauuacuacacuaucuagauccagauacccauagaaaucuaggagaauuuaaacuauauccugaaggauucaugacauguguaccuaauaguucagguacaggaccucaaacuuuaccaauaaaugguguauucgcauuuguaucauggguauccagauuuuaccaacuaaaaccaguagguacagcaggaccugcucgccgacucggcauacgaagaucauaa

SEQ ID NO: 32607 - RNA, 1635 nt, Artificial Sequence
  derived and/or modified sequence opt6 from capsid_protein__Norovirus__AFK75852
augaugauggcaucuaaagacgccaccccuucugcagacggagcaacaggcgcgggacaauuaguaccagaaguuaauacagcagacccaauaccaauugauccuguugccggcuccuccacagcccuagcaacagcaggacaagucaaccuaauagauccuuggauaauaaauaacuucguacaagcaccacaaggagaauuuacaauaucaccaaauaauacacccggugauguauuauucgaucuccaacucgguccacaccuaaacccauuucucucucaccugucacaaauguacaacggauggguaggaaauaugagagucagaguaguauuagcaggaaacgcauuuacugcuggaaaaguaauaauuuguugcguuccaccuggauuccaaucaagaacacuauccauagcacaagcaacacuauucccacauguuaucgcagauguuagaacauuagauccaguggaaguaccuuuagaagauguaagaaauguuuuauaucauaacaaugauacccaaccaaccaugagauuauuaugcauguuauauacaccucucagaacaggaggagcaucaggaggaacugauucuuuugucguagcaggaagaguucucacaugccccggucccgauuucaauuuuuuauucuuagucccucccaccguagaacaaaaaacacgaccauuuacaguaccuaauauaccuuuaaaauauuuaagcaauucaaggauaccaaacccgauagaaggaaugagccucucaccagaucaaacacaaaacguccaauuucaaaacggucgauguacaaucgauggacaaccauuagguacuaccccaguaucugucucucaauuauguaaauucagaggccgaauaacuuccgggcaaaaagucuuaaaucuaaccgaacuagauggauccccauucauggcuuucgcagcaccugcaccagccggauucccugaccuaggauccugugauuggcauauugaaaugucuaaaauacccaauucaucaacccaaucaaaucccauaguagucaauucuguaaaaccaaauagucaacaauuugucccacaucuuucaucuauaacacuagaugacaaugucuccucaggaggugauuauauaggaacaauacaauggacaucaccuccauccgacagcggaggagccaauacaaacuuuuggaaaauuccugacuacggcagcucccucgcagaagcaucacaauuagcaccugcuguauacccaccagguuuuaaugaagucaucgucuauuuuauggcauccauaccaggcccaaaccaaucaggaaguccaaacuuaguaccauguuuauuaccacaagaauacauaacacauuuuauaagugaacaagcaccaauacaaggagaagcagcacuacuacauuauguagacccagauacaaaccgaaacuuaggagaauuuaaacuuuauccaggaggauaucuaacauguguuccaaauuccucaucaaccggaccacaacaauuaccacuagacggcguauucguuuucgcaucuuggguaucaagauuuuaccaacuuaaaccugucggcacagcaggaccggcacgaggcagauuaggcguuagaagauaa

SEQ ID NO: 32608 - RNA, 1641 nt, Artificial Sequence
  derived and/or modified sequence opt6 from capsid_protein__Norovirus__AFK75853
augaugauggcaucaaaagacgccucccaaucggcagacggagcauccggagcaggacaacuuguuccagaaguuaacaccgcugauccacuccccauggaaccaguagcaggaccaacaacagcuguagcuacagcaggucaaguuaacaugauagauccauggauuguuaauaacuuuguacaaucaccacaaggagaauucacuauaucuccaaauaacacacccggagacauauuauuugauuuacaauuaggaccacacuuaaacccauuucuuucacaucuaucacaaauguauaauggauggguaggaaacaugagagucagaauacuucuagcuggaaacgcauuuucagcaggaaaaauaauaguauguuguguaccaccaggauuuacaagcucaucacuaacuauagcacaagcaacauuauuuccccauguaauagcugauguaagaacucuagaaccaauagaaaugccacuagaagacguuagaaauguauuauaccauacuaacgauaaucaaccuacuaugcgauuagucuguaugcuauacaccccacuacgaacaggaggagguucaggaaacucagacucauuuguaguagcuggacguguacuuacagcaccauccucagauuuuucauuccuauuuuuaguacccccaacuauagaacagaaaacaagagcauuuacaguaccuaauauaccauuacaaacauuauccaacucgagauucccuucacuaauccaaggaaugauauuaucaccagaugcaucacaagugguacaauuucaaaacggaagaugcuuaauugacggucaauuacuaggaacaacuccagcuacaagcggucaacucuuuagaguaagagguaaaauaaaucaaggagcacgaacucucaaucucacagaaguagacggaaaaccauuuauggcauuugacucaccugcaccaguaggauuuccagauuuuggaaaaugugacuggcauaugcguauaucuaaaacaccaaauaacacaucaucaggagacccaaugagaaguguaagcgugcaaacaaacguccaagguuuuguaccacacuuagguucaauacaauucgaugaaguauuuaaccaucccacaggagacuauauaggaacuauagaauggauuucacaaccaucuacuccacccggaacagacauuaaccuaugggaaauaccagauuauggcucuucauuaucucaagccgccaaucucgcaccaccaguauuucccccugguuuuggagaagccuuaguuuauuucguaagcgcuuucccagguccaaauaauagauccgcucccaaugaugucccaugccuacuaccucaagaauauauuacacauuuuguaucagaacaagcuccaacuaugggagaugcagccuuauuacauuacguagaucccgacacuaauagaaacuuaggugaauuuaaauuauauccagguggauaccucaccuguguuccuaauggaguuggagcuggaccacaacaacuaccacucaaugguguuuuuuuauuugucaguugggucucaagauuuuaucaauuaaaaccuguagguacagccucaacagcaagagguagacuagguguaagaagaauauaa

SEQ ID NO: 32609 - RNA, 1647 nt, Artificial Sequence
  derived and/or modified sequence opt6 from capsid_protein__Norovirus__AFK75854
augaaaauggcaucaaacgaugccgccccaucaaacgauggagcagcaggauuaguaccagaaauaaauaaugaagcaauggcauuagacccaguagcaggagcagcaauugcagccccauuaacaggccaacaaaacauaauagacccauggauaaugaauaauuucguacaagcuccaggaggagaauuuacuguuucaccaagaaacuccccaggagaagucuuauuaaacuuagaauuaggaccagaaauaaaccccuaucuagcacauuuagcuagaauguauaacggauaugccggaggauucgaaguccaaguaguguuagcaggaaacgcauuuaccgccggcaaaguaauauuugcugcaauacccccaaauuucccaauagauaacuuaucagcagcacaaauaacaaugugcccucauguaaucguagacguaagacaacuagaaccaauaaaucuaccaaugccugauguuagaaauacauuuuuccauuauaaccaagauucagacucuaggcuuagacuaauagcaaugcuguacacaccacuuagagcaaauaauuccggcgacgauguauucacaguuaguugucguguauuaacaagaccaucuccugauuuuucauuuaauuuuuuaguuccuccaacugucgaaucuaaaacaaaauuauucacccuacccauacuaacaauaucugaaauguccaauucacgauucccaguaccaauagauucauuacacacaucuccuacagaaaacauaguaguacaaugccaaaacggacgaguuacacucgacggagaacuaaugggaacuacacaacuauuaccuucacaaauaugugccuuccguggaacacuaacucguucaacaucaagagcaucagaucaagcagauacaccaacgccacgauuauuuaaucauagauggcauauacaauuggauaauuuaaacggcaccccauacgacccugcugaagacauaccagcccccuuaggaacacccgauuuccgagguaaaguauucggcguagcaucacaaagaaaucccgacucaacaacaagagcacaugaagccaaaguagauacaacaucuggcagauucacaccaaaauuaggaaguuuagaaauaacaaccgaaucagacgacuuugauacaaaucaaucaaccaaauuuacuccgguuggaauagguguagacaacgaagcagaauuucaacaauggucauuaccaaacuacucuggacaauuuacacacaauaugaaucuagccccagcaguagcgcccaauuucccaggcgaacaauugcuauucuuuagaagucaauuaccaaguucaggagguuggucuaacggaguccuugauugucuaguaccacaagaauggguacaacauuuuuaucaagaaucagcuccagcacaaacucaaguugcguuaguaagauauguaaauccagauacaggaagaguccuauucgaagcaaaacuacacaaacuaggauuuaugacuauagcaaaaaauggagacucuccaauaacaguaccaccaaauggauacuuucgguuugaaucauggguaaauccauuuuauacacuagcaccuaugggaaccgguaacgguagaagaagaauacaauaa

SEQ ID NO: 32610 - RNA, 1671 nt, Artificial Sequence
  derived and/or modified sequence opt6 from capsid_protein__Norovirus__AFN61315
augaaaauggcauccucugaugcagcacccucugccgauggcgcaggaaaucuaguaccagagucacaacaagaaguauuaccucucgcaccaguagcuggagcggcuuuagcugcaccuguaguaggucagacaaacauaauugauccauggauuaaggaaaauuuuguacaagccccacaaggugaauuuacaguauccccaaaaaacucaccaggugaaauauuaguaaauuuagaacuaggaccaaaacucaauccauaccuagaccauuuaucuagaauguauaacaguuaugcaggaggcauagauguaaugguaguacuagcaggaaaugcuuuuacagccggaaaaguauuaauagcagcaauuccuccuaauuuuccuguugaaggaguaucagccucacaagcaacgcaauuuccacauguuauaauagauguuagaacauuagacccaguaaggcuaccauuaccagauguaagaucaacuuuuuuccacuacacaaaugauacggaaccaaaaaugaggcucguaauaugguuauauaccccacuucgaaccaacgguucaggagacgacucauucacuguaucaggaagaauacuaacaagaccuucacaagauuuugaauuugcauuuuuaauuccaccaacaguagaaacaaaaacaacacccuucucaguaccaggauuuaguguacaagaaaugagcaacucaagauggccagcagcaauaucagcaaugguagucagagguaacgaaccacaagucgugcaauuucaaaauggaagagcucaucuagacggaaugcuauuaggaacaacaccuguaucaccaaauuacauagcaucauacagaggaauaagcacaggaaauucaagaucggcaucaucugaagcagaugaacgagccguaggaucuuuugacguauggauaagacuacaagaaccugauggucaaccauaugauauauuugggaaacaaccagcacccauagguacaccagacuuuaaagcaguaauagucggauucgcugcacgaccauuaacaucaggaucauacgcuaacgaagcauacguuaauacaacagcaagcgauuacgccccagcuacuggaaacaugcgauuuacuguuagaaauggugguacaggacacauaagugcaaauaaauauugggaauuccgcagcuuuggaguggaaggugaaagacauacagauguacaauaucaagaauacgaacuaccagauuauucaggacaagucgcaagcaaucauaaccuagcuccaccugucgcaccuagaaugccuggagaauccuuacucuuauuucaaagcaauaugccaguaugggaugacggaagaggagaaucaacaccaaaaaaaauacauuguuuauuaccacaagaauucauaggacauuuuuuugauaaacaagcaccaaguuuaggugaugcugcauuacuuagauaugucaaucaagaaacaaauagaguauuauuugaauguaaauuauacagagauggcuauauaacaguagcagcagcuucuggucuacuugauuuuccgcuugauggauuuuuccguuucgauagcuggguaucaucauuuuauauacuaucaccuguuggcucaggccaagguagaagaggaagaguaagauuccaauaa

SEQ ID NO: 32611 - RNA, 1623 nt, Artificial Sequence
  derived and/or modified sequence opt6 from capsid_protein__Norovirus__AFQ00511
augaaaauggcaucaaacgacgcaaaccccucagaugguucagcugcuaauuuagucccagaaguuaacaacgaaguaauggcucuugaacccgucguaggagcagcaauagcugcaccaguugcaggccaacaaaacguuaucgacccauggaucagaaacaacuucguacaagccccaggaggagaauuuacagucucacccagaaaugcaccaggagaaauauuauggucugcuccauuaggaccagaucuuaauccauaccuaucacaccucgcaagaauguauaacggauaugcaggcggauucgaaguccaagucauuuuagcagguaaugccuuuacagcaggaaaaauaaucuucgcagcaguccccccaaauuuuccuacugaaggacuaucaccuucacaaguaacaauguuuccacauauuauagucgacguacgacaacuagaaccaguacuaauaccauuaccagauguaagaaauaauuuuuaucauuauaaccaaucaaaugauucaaccauuaaauuaauagcuauguuauacacuccacuucgugccaacaaugcaggagaagauguuuuuaccguaucauguagaguguuaacacgaccauccccagauuucgacuucaucuuuuuaguuccaccuaccguagaaucucgaacaaaaccuuucacaguaccaauccuaacaguugaagaaaugacaaacaguagauuucccauuccauuagaaaaauuauucacaggaccaucuucugcauucguaguacaaccacaaaaugguagauguacaacagacggagucuuacuaggaaccacccaauuaucacccguaaauauauguacauuuagaggugauguaacacacauagcaggcucuagaaacuauacuaugaauuuagcauccuuaaauuggaauaacuacgaucccacagaagaaauaccagcaccacuggguacaccagacuuugucggaaaaauucaaggaguauuaacccaaacaacuaaaggagauggaucaacaagaggucacaaagcaacaguauauacuggauccgcucccuucacaccaaaauuaggaucgguucaauucucuacagacacagaaaacgacuucgaaacacaucaaaacacaaaauucaccccaguaggcguuauacaagaugguggaacaacacacagaaacgaaccacaacaaugggucuuacccucauauucaggaagaaaugucccaaauguucaccuagcuccagcuguagccccaacauuuccaggagaacaauuacuuuucuuuagaucaacuaugccaggauguucaggauacccaaauauggauuuagacugucuucuaccacaagaauggguacaacauuucuaccaagaagccgcccccgcacaauccgauguagcauuauuaagauuuguuaacccagacacaggaagaguucuauucgaaugcaaacuacauaaaucagguuauguaaccguagcacacacaggccaacacgaucuaguaauaccaccuaauggauauuucagauucgauucauggguuaaucaauuuuacacuuuagcacccauggguaaugguacaggccgaagaagaguauuauaa

SEQ ID NO: 32612 - RNA, 1623 nt, Artificial Sequence
  derived and/or modified sequence opt6 from capsid_protein__Norovirus__AFQ00512
augaaaauggcaucaaacgaugcaaauccauccgacggaucagcagcuaaccuaguacccgaaguaaacaacgaaguaauggcacuagaaccaguaguaggagcugcaauugcugcaccuguugcaggacaacaaaauguaaucgacccuuggauacgaaacaauuucguacaagcuccuggaggugaguucacaguaucuccucgaaaugcacccggcgaaauacucuggucagcaccacuaggaccagaucuaaauccauaucucucucacuuagcacgaauguauaauggauacgcuggaggauuugaaguacaaguaauuuuagcaggaaaugccuuuacagcaggaaaaaucauauucgcagcaguuccaccaaacuuucccaccgaaggacuaucacccucucaaguaaccauguuuccccauauuauaguagacguuagacaauuagaacccgugcuaauaccacuaccagauguaagaaauaacuucuaucacuauaaccaaucuaaugacucaacaauaaaacuuauagccaugcuauacacaccucuacgagcaaacaaugcaggagaagauguauuuaccguaucauguagaguacuaacacgacccucacccgauuuugacuuuauauuccuaguaccaccaacagucgaaucaagaacuaaaccuuucacagucccaauauuaacaguugaagaaaugacuaauucuagauuuccuauaccauuagaaaaacucuucaccggcccuaguagcgcauuuguaguacaaccccaaaacggaagauguacaacugacgguguacuacuagguaccacucaguuaucaccagucaacaucugcaccuuuagaggagauguaacacauauagccggaucacgaaauuacacaaugaaucuagcaagucucaacuggaacaacuacgauccaacagaagaaauaccugcaccacuugggacaccagauuuugucggaaaaauacaagggguuuuaacccaaacuacaaaaggagacggaaguacaagaggacauaaagcuacaguauacacaggaucagcuccguuuacaccaaaacuuggcucaguccaauuuucaacagacacagaaaacgauuucgaaacucaucaaaauaccaaauucacaccaguuggaguuauucaagacggaggaacaacccacagaaaugaaccacaacaauggguacuaccuucauacucaggaagaaauguaccaaacguucaccuugcucccgccguagcaccuacuuucccaggcgaacaacuucuauuuuuuagaucuacaaugccaggaugcucaggauaucccaacauggaucuagauugucuccuaccucaagaauggguucaacauuucuaccaagaagcugcaccagcacaaucagacgucgcauuauuaagauuuguaaacccagacacaggcagaguauuauucgaaugcaaauuacauaaaucaggauauguaacaguagcacauacaggacaacacgauuuaguaauaccaccaaacggauacuuucgauucgacucuuggguaaaucaauuuuacacacuagcaccaaugggaaauggcacagguagaagaagagcacuauaa

SEQ ID NO: 32613 - RNA, 1623 nt, Artificial Sequence
  derived and/or modified sequence opt6 from capsid_protein__Norovirus__AFQ00513
augaaaauggcuucaaaugacgcaaacccuucagauggaucugcagcaaauuuaguucccgaaguaaacaaugaagugauggcacuagaaccaguaguaggagcagcaauugcagcaccaguagcaggacaacaaaauguaauagauccuuggauaagaaauaauuucguacaagcaccuggaggagaauucacaguaucaccacgaaacgcaccaggcgaaauccuauggucagcaccacuaggcccugauuuaaauccuuauuuaucacauuuagcuagaauguauaacggauacgcagguggauucgaaguacaaguaauauuagccggaaaugcauucaccgcuggaaagauaauauuugccgcuguaccuccaaacuuuccuacagaaggccuaucaccaucacaagucaccauguucccacacauuauaguagauguacgucaacuagaaccaguucucauaccacuacccgacguuagaaacaacuucuaccacuauaaccaauccaaugacucuacaauuaaauuaauagccaugcuauacacaccauuaagagcuaacaaugcaggagacgauguauuuacaguguccugcagaguacucacuagacccucaccagauuuugauuuuauauuucucguaccaccuacuguagaaucaagaacaaaaccauuuacaguaccaauacuaacaguugaagaaaugacaaacuccagauuuccaauuccccuugaaaaacuauucacaggaccaucaucagcauucguaguacaaccacaaaacggaagauguaccacagaugguguucuuuuaggaacgacacaauuaucuccaguaaacauauguaccuuuagaggcgacguaacacauauagcuggaucuagaaauuacacaaugaacuuagcaucauuaaauuggaacaauuacgacccaacagaagaaauuccugcccccuuaggaacaccagauuuuguaggaaaaauucaaggaguacucacccaaacaacaaaaggagacggcuccacaagaggacauaaagcaacaguauauacaggaucugcaccauucacaccaaaacuuggauccguacaauucucaaccgacacagaaaaugauuuugaaacacaucaaaacacaaaauuuaccccaguuggugugauucaagauggaucuacaacgcaucgaaaugaaccacaacaauggguucuaccaucuuauucaggccgcaauguacaaaacguacacuuagcaccugccguagcacccacauuuccaggagaacaacuauuauuuuuucgaaguacaaugcccggcugcucaggauacccuaauauggaccucgauugcuuacuaccacaagaauggguacaacacuuuuaucaagaagcugcacccgcacaaucugauguagcacuuuuaagauuuguaaauccagacacaggaagaguacuauuugaaugcaaauuacacaaaagcggauauguaacaguagcacacacuggccaacaugaucuagucauaccaccaaauggauauuucagauuugauucauggguaaaucaauuuuacacacuugcaccuauggggaauggaacuggaagacgcagagcauuauaa

SEQ ID NO: 32614 - RNA, 1623 nt, Artificial Sequence
  derived and/or modified sequence opt6 from capsid_protein__Norovirus__AFQ00516
augaaaauggcaucaaacgaugcuaaucccucagaugguucugcggcaaauuuaguaccagaaguaaacaacgaaguaauggcacuagaaccaguuguaggagcagccauugcagcaccaguagcaggccaacaaaauguaauagacccuuggaucagaucuaauuuuguccaagcccccggaggcgaauuuacaguauccccacguaaugcaccuggagaaauccuuugguccgcaccccuaggacccgaccucaacccauaucuaagccaucucgcaagaauguauaauggauaugcuggagguuuugaaguacaaguaauacuagcaggaaaugcuuuuacagcaggcaaaauaauauucgcagcaguaccaccaaacuuuccaacagaaggacuaucaccaucacaaguaaccauguucccacacauuaucguagacguuagacaacuugaaccaguacuaauuccauuaccagauguucgaaacaacuucuaucauuacaaccaaucaaaugauucuacaauaaaacuaauagcaaugcuuuacacaccuuuaagagcaaacaacgcuggagaagauguauucacaguauccuguagaguucuuaccagaccaucaccagacuuugacuuuauuuuucucguaccaccaaccguagaauccagaaccaaaccauuuacaguaccaauauuaacaguagaggaaaugacuaacucacgauuuccaauaccauuagaaaaacuauucacaggaccaucaucagcauucguaguacaaccacaaaacggccgaugcacaacugacggaguacuacuagguacaacacaauuaaguccaguaaauauuuguaccuucagaggagacguaacacauauagcaggaagucguaacuauacaaugaacuuagcaucacuaaauuggaauaauuaugauccaacugaagaaauaccugcaccacuagguacacccgauuuuguaggaaaaauacaaggaguacuaacacaaacaacaaaaggagacgguuccacaagaggacauaaagcaacaguauacacaggcucagcaccauuuacaccuaaacucggaucaguucaauuuggaacagacacagaaaaugauuucgaaacacaucaaaauacuaaauucacuccaguaggagucauacaagacggaggaacaacacauagaaaugaaccacaacaauggguacuaccuucguauagugguagaaauguaccaaacguucaccucgccccagcaguagcacccacauuuccaggagaacaauuacuauuuuuuagaucuacaaugccaggauguucagguuacccaaacauggauuuagacugcuuacuaccacaagaauggguacaacauuuuuaccaagaagcagccccugcucaaucugacgucgcucuauuaagguucguaaaucccgauacaggacgcguacuauuugaaugcaaacuacauaaaucaggauauguaacaguagcccauacaggacaacacgaccuaguuaucccucccaauggauacuucagauuugauucauggguaaaucaauuuuacacguuagcaccaaugggaaacggaacaggccgccgcagagcauuauaa

SEQ ID NO: 32615 - RNA, 1623 nt, Artificial Sequence
  derived and/or modified sequence opt6 from capsid_protein__Norovirus__AFQ00517
augaaaauggcaucaaaugacgcaaacccuucagacggaucugcagcaaaucuaguacccgaaguuaacaacgaaguaauggcacuagaacccgucguaggagcagcaaucgcagcgccagucgcuggacaacaaaauguaauugacccauggauaagaaauaauuuuguacaagcuccaggaggcgaauuuacagucuccccaagaaacgccccaggagaaauacuauggucugcuccucuaggaccagaccucaauccauaccuaucacaucuagcaagaauguauaauggauaugcaggcggauucgaaguacaagucauacuagccggaaaugcauuuacagcagguaaaauaauuuucgcugcuguaccaccaaacuuuccuacugaaggacuaucaccaagucaaguaacaauguucccacauauaaucguagauguacgacaacuagaaccaguacuaauuccacuccccgauguuagaaacaauuucuaucacuauaaccaaucaaaugauaguaccauuaaacuaauagcuauguuauacacuccccuaagagcaaacaacgcaggagaagauguauuuacaguaucauguagaguuuuaacacgacccucuccagacuuugacuucauauuccucguaccaccuacaguagaaucaagaacuaaacccuuuacaguaccaauccuaaccguagaagaaaugacaaacucccgauuuccaauaccccuagaaaaacuauucacaggaccauccucagccuucguaguucaaccacaaaacggacgaugcacaacagacgguguacuacuaggaaccacacaacuaucaccaguaaauauauguacauucagaggagauguaacacacaucgccggaaguagaaauuauaccaugaaucucgcaucauugaacuggaauaauuacgauccaacagaagaaauaccagcaccuuuaggaacaccagauuucguaggaaaaauacaagguguacuaacacaaacaacaaaaggcgauggaucaacaagaggacacaaagcaacaguauauacaggaucagcaccauuuacaccuaaauuaggaucaguacaauucuccacagauacagaaaacgacuucgaaacacaucaaaauacaaaauuuaccccuguuggaguaauacaagaugguggaacaacacacagaaaugaaccucaacaauggguccucccaucauauuccggaagaaauguuccaaauguacauuuagcaccagcugucgcaccaacauucccaggagaacaacuucucuucuucagauccaccaugccaggaugcucaggauauccaaauauggaucuagacugccuacuaccccaagaauggguacaacacuucuaucaagaagcagcaccagcccaaucagacguugcacuacuacgauucguaaacccagacacaggaagaguauuauuugaauguaaacuacauaaaucuggauacguaacaguagcucauacuggacaacacgaucuaguuauaccuccaaauggauauuuccgauucgauucauggguaaaccaauuuuauacccuagcaccuaugggaaacgguacagguagaagacgugcacuuuaa

SEQ ID NO: 32616 - RNA, 1623 nt, Artificial Sequence
  derived and/or modified sequence opt6 from capsid_protein__Norovirus__AFQ00518
augaaaauggccucaaacgacgcaaauccaucugacggcucagccgccaaucucguacccgaaguaaauaaugaaguaauggcauuagaaccaguaguuggagcggcaauugcugcaccaguagcaggacaacaaaauguaauugacccuuggauuagaaauaacuuuguacaagcacccggaggagaauuuacagucucaccacgcaaugcucccggagaaauacuauggucagccccuuuaggaccagaccuaaauccuuaucuaucacaucuagcccgaauguauaauggauaugcaggaggauuugaaguacaaguaauauuagcaggcaaugcauuuaccgccgguaaaaucauauucgcagcaguaccaccuaauuuuccaacagaaggucuuucaccaucacaaguaacaauguucccccacauaauaguagacguaagacaauuagaacccguacuaauuccacuaccugauguaagaaauaauuucuaucauuacaaccaaucuaacgacucaacaauaaaauuaauagcaauguuauacacucccuuaagagcaaauaaugcaggagaagauguauuuaccguaucaugucgcguauuaacaagaccaucuccagacuuugacuuuauuuucuuagucccaccaacaguagaaucacgaacaaaaccauuuacaguaccaauauuaacuguagaagaaaugacuaacucaagauuuccaauaccacuagaaaaacuauucacaggaccaucaucugcauucguaguucaaccacaaaacggaagaugcacaacagauggaguacuauuaggaacaacacaacuauccccagucaacauaugcacauucagaggugacguaacucauauagcaggaucucgaaacuauacaaugaauuuagcaaguuuaaauuggaacaacuacgauccaacagaagaaauacccgcuccccuagguacaccugauuuugucggcaaaauacaaggaguauuaacacaaacuacaaaaggagacggaucuacacgcggucauaaagcaacuguuuacacggguuccgcuccauuuaccccaaaauuaggaucaguacaauucuccacagauacugaaaacgacuucgaaacacaucaaaauacaaaauuuacaccuguuggaguuauacaagauggaggcacuacacauagaaacgaaccucaacaauggguuuuaccaaguuauaguggacgcgauguaccaaacguccaccuagcaccugccguugcaccaaccuuuccaggagaacaacuauuauucuuccgaagcacaaugccaggaugcucuggauacccaaacauggaucuagacugucuacucccacaagaauggguacaacauuuuuaucaagaagcagcuccagcucaauccgacguagcacuauuaagauuuguuaacccagacacaggaagaguccuauucgaaugcaaacuucauaaaucaggauacgucacaguagcacauacuggacaacaugaucuaguaauaccucccaauggcuacuuccgauucgacucuuggguuaaccaauuuuacaccuuagcaccaaugggcaauggaacaggaagaagacgagcacuauaa

SEQ ID NO: 32617 - RNA, 1623 nt, Artificial Sequence
  derived and/or modified sequence opt6 from capsid_protein__Norovirus__AFQ00519
augaaaauggcuucaaacgacgcaaaucccucagacggauccgcagcuaaucuaguaccugaaguaaauaacgaaguaauggcacucgaacccguuguaggagcagcaauagcagcaccaguagcaggccaacaaaauguaauugauccauggauacgcaauaacuuuguacaagcaccagguggugaauucacaguaaguccaagaaacgcaccaggagaaauacuauggucugcccccuuaggaccagauuuaaauccauauuuaucgcacuuagcccgcauguacaacggcuacgcaggaggauucgaaguacaaguaauacuagcagguaaugcauuuacagcugguaaaauaauauuugcagcaguuccaccuaauuuuccuaccgaaggacuaucaccaucccaaguaacuauguuuccacauauaauaguagacguacgacaauuagaaccaguauuaauaccacuaccagacguacgaaauaacuuuuaccauuauaaccaguccaacgacucgacaaucaaauuaauagcaauguuauacacaccacuaagagcaaauaaugccggagaagacguauuuacugucuccugccgaguacuaacuagaccaucaccagacuuugacuuuauauucuuaguuccaccaacaguugaaucaagaacaaaaccauuuacagucccuauauuaaccguagaagaaaugacaaauucuagauuuccaauuccccucgaaaaacuauuuacaggaccuaguucagcauucguaguacaaccacaaaacggaagauguacaacagacggaguccuccuaggaaccacacaauuaucaccuguuaauauaugcaccuucagaggagacguaacacauauagcaggaucuagaaauuacacuaugaaccuagcgucauuaaauuggaacaauuacgacccaaccgaagaaauaccagcaccacuagguacaccagacuuuguagguaaaauucaaggaguucuuacccagacuacuagaggugacggaucaacaagaggacacaaagcaacuguauacaccggaucugcaccauuuacaccaaaaaugggauccguucaauucucaacagacacugaaaacgauuuugaaacucaucaaaauacuaaauucaccccaguaggaguuauacaagacggaggaacaacgcaccgcaacgaaccccaacaauggguacugccaucguauucaggaagaaacguaccaaauguacacuuagcaccagcaguagcaccaacauuccccggagaacaacucuuauucuuuagaagcaccaugccagguuguaguggauauccuaauauggaucucgacugccuccuaccacaagaauggguacaacacuuuuaccaagaagcagcuccagcccaaucagauguagcuuuacuaagauucguaaauccagacacagggagaguuuuauucgaauguaaacuacauaaaucaggcuauguaacaguagcacauacaggucagcacgaccuuguuauaccaccuaauggcuauuucagauuugacucauggguaaaccaauuuuauacauuagcucccaugggcaauggaacaggaagacgacgagcucuuuaa

SEQ ID NO: 32618 - RNA, 1623 nt, Artificial Sequence
  derived and/or modified sequence opt6 from capsid_protein__Norovirus__AFQ00520
augaaaauggcuuccaacgacgcuaacccaucagauggaucagcugccaauuuaguaccugaaguaaacaaugaaguaauggcacuagagccaguuguaggugcagcaauagcagcaccuguagcaggacaacaaaauguaauagauccauggauacgaaacaacuucguacaagccccaggaggagaauucacaguaagcccaagaaacgcaccaggcgaaaucuuauggucagcuccauuaggacccgaccuaaauccauauuuaucccacuuagcacgaauguauaauggguacgcaggaggauuugaaguucaagucauacuagcuggaaaugcauuuacagccggaaaaauaauuuucgcugcaguaccaccaaauuuuccuacagaaggacuuucaccaucacaaguaaccauguucccacacauuauaguagacguaagacaacucgaaccaguauugauaccuuuaccagauguaagaaacaauuucuaucacuacaaucaaucuaaugauucaacuauaaaacuaauagcaauguuauauacuccacuuagagcaaacaaugccggcgaagauguauuuaccguaucaugcagaguauuaaccagaccaucucccgacuuugauuucauauuuuuaguuccaccaacaguagaaucaagaacaaaacccuuuacugucccaauauuaacaguugaagaaaugacaaacucuagauucccaauaccauuagaaaaauuauucaccggaccaucaucugccuuuguuguacaaccccaaaacggacgauguacaacagacggaguauuacuaggaacaacacaacuauccccagucaauauauguacuuuuaggggugacgucacucauauagcaggaucucgaaauuacacuaugaaucuagcaucauuaaacuggaauaauuacgauccaaccgaagaaauaccugcaccucuuggaacuccugauuucguagguaaaauacaaggcaugcuaacacaaacaacaaaaggggauggcuccacaagaggacacaaagcaacaguauacacagguucagcuccuuucaccccaaaauuaggaucuguccaauucucaacagauacagaaaaugauuuugaaacacaccaaaacacaaaauucacaccaguaggcguaauucaagauggaucuacuacucauagaaaugaaccacaacaauggguuuuaccaucauauucaggaagaaacguaccaaauguacaucuagcaccagccgucgcaccaacauuuccuggagaacaauuacuauuuuuuagaucaacaaugccaggaugcucuggauauccaaauauggaucuagauugucuacucccgcaagaauggguacaacauuucuaucaagaagccgcacccgcacaaucugauguagcccuauuaagauucguaaauccagacacugguagaguacuauuugaaugcaaauuacacaaaccaggauauguuacaguagcucauacuggucaacacgaccuuguaauaccaccaaauggauacuuucgauuugauuccuggguuaaucaauucuacacucuagcuccuaugggcaacgguacaggaaggcgaagagccuuauaa

SEQ ID NO: 32619 - RNA, 1623 nt, Artificial Sequence
  derived and/or modified sequence opt6 from capsid_protein__Norovirus__AFQ00521
augaaaauggcaucaaaugaugcaaauccuucagacggcucugcagcaaauuuaguaccagaaguaaacaacgaaguuauggcauuagaaccaguaguaggugcagccauagcagcaccaguagcaggacaacaaaauguuauagacccuuggauaagaaauaacuucguacaagcccccggaggagaauucacaguuucuccuagaaacgcaccuggagaaauacuauggagugcaccacuaggacccgauuuaaauccauaucuuucacaccuagccagaauguauaacggcuaugcaggugguuucgaaguccaaguuaucuuagcuggaaaugcauuuacagcaggaaaaauuaucuucgcugccguuccaccaaauuuuccaacagaaggauuaucuccaucacaaguaaccauguuuccacacaucauaguagacguaagacaacuugaaccagucuuaauaccauuaccagauguacgaaacaacuucuaccacuauaaucaauccaacgacucaacaauaaaauuaauagccaugcucuauacaccuuuacgagcaaacaaugcuggagaagauguauuuacagucaguuguagaguacuaacuagacccuccccugacuuugauuuuauauucuuaguaccaccaacaguagaaucuagaacaaaaccuuuuacaguacccauauuaacaguugaagaaaugacuaauucgcgauuuccaaucccuuuagaaaaacuauucaccggccccucaucugcuuucguaguacaaccacaaaauggucgaugcacuacagacgguguauuacucgguaccacacaauuaucaccuguaaauauauguacauucagaggagacguaacacauauugcaggaucacgcaauuauacaaugaaucuagcuagucuaaauuggaacaauuacgacccaacugaagaaauaccugcacccuuaggaacaccugacuuuguaggaaaaauacaaggaguuuuaacacaaacaacaaaaggugaugguucaacaagaggacacaaagcaacagucuauacagguucagcuccauuuacaccaaaacuaggaucaguacaauucucaaccgauacagaaaacgauuuugaaacacaucaaaauaccaaauuuacaccagucggaguaauacaagacggaggaacaacacaucgaaaugaaccacaacaguggguacuaccaucauauuccggaagaaauguacaaaacguacacuuagcuccagcaguagcaccuacuuuuccuggugaacaauuacuuuucuucagaucuaccaugccaggaugcucaggauauccuaacauggaccucgauugcuuauuaccacaagaauggguccaacauuucuaucaagaagcagcaccagcucaaucagaugucgcauuacucagauuuguaaacccagacacaggacgaguacuauuugaaugcaaacuacauaaaucaggcuauguuacaguagcacauacaggucaacaugaccuaguuauacccccaaauggauacuuucgauucgauucauggguaaaccaauuuuacacucuagcacccaugggaaauggaacuggaagacgacgaguuuuauaa

SEQ ID NO: 32620 - RNA, 1623 nt, Artificial Sequence
  derived and/or modified sequence opt6 from capsid_protein__Norovirus__AFQ00522
augaaaauggccucaaaugacgcuaacccaucagauggaucagcagcuaacuuggucccugaaguaaacaacgaagucauggcacucgaaccaguaguaggagcagcuauagcagcacccguagcaggucaacaaaacguaauagacccauggauaagaaauaacuucguccaagccccaggaggagaauuuaccguaucgccaagaaaugcaccaggcgaaauacucuggucagcaccucucggaccagauuuaaacccauaucuaucacauuuagccagaauguauaacggauacgcaggaggauuugaaguccaagucauacuagcaggcaacgccuuuacugcaggcaaaauaauauuugcagcagucccaccgaacuuuccaacagaaggauuaucaccuucucaaguaacaauguucccacauauaauaguugacguaagacaacuagaacccguauuaauaccacucccugacguacgaaacaacuuuuaccauuauaaccaauccaacgauucaacaauaaaacucauagcaaugcuauacaccccauuaagagcaaauaaugcaggugaagauguauucacuguuucuugccgaguauuaacaagaccauccccagauuuugacuuuauauucuuaguaccuccaacuguagaaucaagaacaaaaccauucacugucccaauauuaacaguagaagaaaugacaaauucaagauuucccauaccuuuagaaaaacuauuuacaggaccaucuucagcauucguaguccaaccacaaaacggacgauguacaacagacggaguccuucuaggaacaacacaacuuucaccuguuaauauauguacauuucgaggagauguaacccauauagcuggcucucgaaauuauacaaugaaccuagcaucauuaaacuggaacaauuacgaucccacagaagaaauaccagcaccacuaggcacaccagauuuuguaggaaaaauacaaggaguauuaacacaaacgacaaaaggugauggcucaacaagaggacacaaagcuacaguauauacaggaucagcaccauuuacccccaaacuaggaucaguucaauuuucuacagauacagaaaaugacuuugaaacacaccaaaacacaaaauuuacaccaguaggaguaauucaagacggagguacuacacacagaaaugaaccacaacaauggguauuaccauccuauucaggaagaaacguccccaacguacacuuagcaccugcugucgccccaacuuucccaggugaacaauuacuauuuuuucguucaaccaugccuggaugcucaggcuacccaaauauggaccuagauuguuuauuaccccaagaauggguccaacauuuuuaccaagaagcagcaccagcacaaucagauguagcauuacuuagauuuguuaauccagacacuggacgaguauuauucgaauguaaauuacacaaacccggauauguaacgguagcucauacaggacaacacgauuuaguaauaccacccaacggauauuuuagauucgauagcuggguaaaccaauucuauacacuugcaccaaugggaaaugguacaggacgaagaagagcacuauaa

SEQ ID NO: 32621 - RNA, 1623 nt, Artificial Sequence
  derived and/or modified sequence opt6 from capsid_protein__Norovirus__AFQ00523
augaaaauggcaucuaaugacgcaaacccaucagauggcucagcagcaaauuuaguaccagaaguaaacaacgaaguuauggcuuuagaacccguagucggagcagcaauagcugccccuguagcaggucaacaaaauguaauagauccauggauucgaaauaauuuuguacaagcaccaggaggagaauuuacaguaucuccaagaaacgcacccggagaaauccuauggucugccccacucggaccagacuuaaauccauaucuuucacauuuagcacgaauguauaacgguuacgcaggagguuuugaaguccaagucauucuagcuggaaaugccuucacagcaggaaaaauaaucuucgcugcaguaccaccaaauuuuccaacugaaggccuaucaccaucccaaguaacaauguuuccacacauaauaguagacguaagacaauuagaaccaguauuaauuccuuuacccgauguuagaaacaauuuuuaccauuauaaccaaucuaaugauucuacaaucaaacuuauagcaauguuauacacuccacuuagagcuaauaacgcaggcgaagacguauucacaguaagcugucgaguacuaacaagaccaucaccagacuuugauuuuauauuucuaguaccaccuacaguagaaucccgaaccaaaccauucacaguccccauucucacuguagaagaaaugacaaauucuagauuucccauacccuuagaaaaauuauuuacaggucccuccuccgcauucguuguccaaccacaaaauggaagauguacaacagauggaguuuuacugggaacaacucaauuaucaccuguaaacauauguacauuucgaggagacguaacacauauagcaggaucaagaaacuacacaaugaauuuagccucauuaaauuggaacaauuacgacccaacagaagaaauaccugccccccuaggaacuccugacuuuguaggaaaaauacaaggaguacucacacaaacaacuaaaggagacggcucaacaagaggacacaaagccacaguauauacugguuccgcacccuuuaccccaaaacuaggaucaguacaauucucaacagauacagaaaacgauuucgaaacacaucaaaauaccaaauuuacaccaguaggcguaauacaagacggaggaacaacucauagaaaugaaccacaacaauggguacuacccucauacucaggcagaaacguuccaaacguacaccuugcaccagcaguugccccuacauuuccaggagaacaauuacuauucuuuagaucaacaaugccagguugcucaggcuauccaaacauggaccuugacugccuauuaccacaagaauggguacaacauuucuaucaagaagcagcaccagcacaaucugauguugcauuacuaagauuuguaaauccagauacaggcagaguauuauuugaaugcaaacuucauaaaccaggauaugucacaguagcacauaccggccaacaugacuuaguaaucccaccaaauggauauuuuagauuugauucaugggucaaucaauuuuacacucuagccccuaugggaaauggaacaggcagacguagagcacuauaa

SEQ ID NO: 32622 - RNA, 1623 nt, Artificial Sequence
  derived and/or modified sequence opt6 from capsid_protein__Norovirus__AFQ00524
augaaaauggccucaaaugaugccaacccaucagaugguucagcagcaaaucuaguaccagaaguaaauaaugaaguaauggcauuagagccaguaguuggugcagcaauagcagcaccaguagcaggucaacaaaauguaauagacccauggauaagaaauaacuuuguacaagccccagggggagaauuuaccguuuccccacguaaugcacccggagaaauccuuuggagcgcaccauuagguccagauuuaaacccauaccuuucacacuuagcgagaauguacaauggauaugcuggaggauuugaaguacaaguaauauuagcaggcaacgcauucacagcaggcaaaauaauauuugcagcaguaccaccuaauuuuccaacugaaggacuauccccaucccaagucacaauguucccacacauaauuguagauguaagacaauuagaaccaguacugauuccauuaccagacguaagaaauaacuuuuaucauuauaaccaaucuaaugauucaacaauuaaacuaauugcaaugcuauauacuccauuacgagccaacaaugcuggcgaagauguuuuuacaguaaguugcagagucuuaacaagaccaucaccagacuuugacuuuauauuucuaguaccaccaacaguagaaucuagaacaaaaccauuuacaguaccaauccuuaccguagaagaaaugacuaacagccgauuuccaauuccauuagaaaaacuauucacaggcccaucgucagcuuucgucguucaaccacaaaacggaagauguacgacagacggcguacuccuuggaacuacccaauuauccccaguaaauauaugcacauuuagaggagacguaacacacaucgcaggcucacgaaauuacacaaugaauuuagcuucacuaaacuggaauaacuaugacccaacagaagaaauaccagccccacuaggaacaccagacuuuguaggcaaaauacaaggaguuuuaacacaaacaacaaaaggagaugguucuacuagaggucacaaagcaacaguauauacuggaagugcaccauuuacacccaaauuaggaucaguccaauucucuacagacacagaaaaugauuuugaaacacaucaaaauacuaaauucacaccaguaggaguaauacaagacgggggaacuacucaucgaaaugaaccacaacaauggguacuacccucauauucugguagagauguacccaauguacaccuagccccagcaguagcacccacauuuccaggagaacaauuauuauuuuuucgaaguaccaugccuggaugcucaggauauccaaauauggauuuagacugccuacuaccacaagaauggguucaacauuuuuaucaagaagcagcaccagcucaaucagacguagcacuauuacgauucguaaauccggacacaggaagaguuuuauuugaauguaaauuacauaaaucaggauauguaacugucgcacacacuggacaacaugacuuaguaauuccuccaaacggauauuuucgauucgauuccuggguaaaccaauucuacacauuagcaccaaugggaaacggaacaggcagacgcagagcauuauaa

SEQ ID NO: 32623 - RNA, 1623 nt, Artificial Sequence
  derived and/or modified sequence opt6 from capsid_protein__Norovirus__AFQ00525
augaaaauggcaucaaacgacgcaaaccccucugacggaagcgcagccaaccucguaccagaagucaacaacgaaguaauggcauuagaaccaguaguaggagcagcaauagcugcaccagucgcaggacaacaaaauguaauugacccauggauaagaaauaauuucguccaagcaccuggcggugaauuuaccguauccccacgaaacgcacccggagaaauauuauggucagcaccacuaggaccagaccuaaacccauauuuaucacaccuagcacgaauguauaacggauaugccggaggauucgaaguacaaguaauauuagcaggaaaugcauuuacagcagguaaaauaauauuugcugcaguaccaccaaacuuuccaacagaagguuuaucucccucacaaguaacaauguuuccucauauaauaguugacguuagacaacuagaaccuguacuaauuccacuaccagauguacguaacaauuuuuaucauuacaaccaaucuaaugacucuacuauuaaauuaauagcuaugcuauauacaccauuaagagcaaacaacgcaggagaagauguuuuuacuguuucaugccgaguacuaacacgcccuucaccugauuucgauuuuauuuuuuuaguaccaccaacaguagaaucaagaacaaaaccauucacaguaccaauauuaacaguugaagaaaugaccaacucaagauuuccaauuccacuugaaaaauuauuuaccgguccuucaagugccuucgucguacaaccacaaaacggacgauguacaacagacggugucuuacuaggaacaacucaauuaucacccguaaacaucuguacauucagaggagacguaacacauaucgcaggaucuagaaacuauacaaugaaucuagcauccuuaaacuggaauaauuaugauccaacagaagaaaucccugcaccacucgguacaccagauuucguagguaaaauacaaggaguacucacacaaaccacaaaaggugacggaucuacaagaggucacaaagcaacagucuauacaggaucagcuccauucaccccaaaauuaggaucaguacaguuuuccacagauacagaaaacgauuuugaaacacaccaaaauacaaaauucacaccaguaggaguaauacaagacggaggaacaacacauagaaaugaaccacaacaauggguacuuccuucauauucagguagagaugugccaaacguacauuuagccccagccguagcaccgaccuuuccaggagaacaauuacuauucuucagaagcaccaugccagguugcucaggauauccuaacauggaucuagauugccuauuaccacaagaauggguacaacauuuuuaccaagaagcugccccagcacaaucagacguugcacuccucagauucguuaauccagauacaggaagaguacuauuugaaugcaaauuacauaaaucuggcuauguaacaguagcacauacaggccaacaugacuuaguuauaccaccaaacggcuauuuccgauucgacucauggguaaaucaauuuuacacuuuagccccaaugggcaauggcacaggaagaagacgagcacuuuaa

SEQ ID NO: 32624 - RNA, 1623 nt, Artificial Sequence
  derived and/or modified sequence opt6 from capsid_protein__Norovirus__AFQ00526
augaaaauggcuucaaaugaugcuaaccccucagaugguucagcugcaaaccucguaccugaaguaaacaaugaaguaauggcacuagaaccagugguaggagcagcaauagcagcccccguagcaggacaacaaaauguaauagauccuuggauaagaaacaauuuuguacaagcaccagguggagaauuuacaguuucaccucgaaaugcaccuggagaaauauuauggucugcaccucuaggaccagauuuaaacccauaccuaucacauuuagcacgaauguacaacggauacgcaggcgguuucgaaguccaaguaauucuagccggaaaugcauuuacugcaggcaaaauaauauucgcagcaguuccaccaaacuuucccacggaaggacuuucaccgagucaaguaaccauguuuccucauauaauuguagacguacgacaacuagaaccaguauuaauaccauuacccgauguaagaaacaacuuuuaucacuacaaucaaucaaaugacaguaccaucaaacuuauagcaaugcuauauacaccucuacgagcaaacaaugcaggagaagauguauuuacaguaucaugcagaguucuuacaagaccaucuccugacuucgacuuuauauuccuuguucccccaacuguagaaucuagaaccaaaccauuuacaguaccaauacuaacaguugaagaaaugacaaauucaagauucccaauaccuuuagaaaaacucuucacagguccauccucagcauucgucguacaaccacaaaauggaagauguacuacagauggugucuuacuaggaacuacacaacuuucuccaguaaauauaugcacauuuagaggugauguaacacauauagcugguucacauaauuaugcuaugaacuuagcaucauuaaauuggaacaauuacgaucccacugaagaaauuccagccccacuaggaacaccagacuuuguuggaaaaauucaaggaguauuaacacaaacaacaaaaggagacggaucaacaaggggucauaaagccaccauauauacaggcucagcaccauuuaccccaaaacuuggauccguacaauuuucaacagauaccgaaaacgauuucgaaacccaucaaaauaccaaauuuacaccaguaggagucauacaagauggaggaacaacccacagaaaugaaccacaacaauggguauuaccaucuuacucaggacgaaauguuccuaacguccacuuagccccagcuguugccccaacauuuccaggggaacaauuauuauucuuuagaucaacaaugccuggauguucaggauaucccaacauggaccucgacugccuccuaccacaagaauggguucagcauuuuuaucaagaagcugcaccagcacaaucagauguugcauuacuucgcuucguaaauccagacaccggccgaguacuauucgaaugcaaauuacauaaaucuggauauuuaacagucgcacauacaggccaacaugaccuaguuauaccuccaaauggcuauuucagauucgauucauggguaaaccaauucuacacccucgcacccaugggcaauggaacaggaagaagacgagcacuauaa

SEQ ID NO: 32625 - RNA, 1623 nt, Artificial Sequence
  derived and/or modified sequence opt6 from capsid_protein__Norovirus__AFQ00527
augaaaauggccucaaaugacgcaaauccaucagauggaucugcagcaaaccucguuccagaaguaaauaaugaaguaauggcauuagaaccaguaguaggcgcugcaauagcagcacccgucgcuggacaacaaaacguaauagauccauggaucagaaacaauuuuguacaagccccuggaggagaauuuacaguaucaccaagaaaugcaccuggcgaaauauuauggucagccccucucggucccgauuuaaauccauaucuaagucaccuagcaagaauguacaacggauacgccgguggauuugaaguacaaguaauucuugccggaaacgcuuucacagccggaaaaauaauauucgccgccguaccuccaaauuuuccaacagaaggauuaucaccaucucaaguaacaauguucccacauauaauaguugacguacgacaauuagaaccaguauuaauuccauuaccugauguaagaaacaacuucuaucauuacaaucaaucaaaugauucaacuauaaaauuaauagccaugcuauauacaccacuuagagcaaacaacgcaggagaagaugucuucacaguaucauguagaguccuaacaagaccaucaccagacuucgacuuuauauuucuuguaccuccaaccguugaaucccgaaccaaaccauuuacaguuccuauauuaaccguugaagaaaugacuaacucaagauucccuauaccauuagaaaaauuauucacaggcccaucuuccgcauucguaguacaaccccaaaacggaagauguacaacagauggaguauuacuaggaaccacacaacuaucaccaguuaacauauguacauucagaggugacguaacacauaucgcaggaucucgcaacuacacaaugaaucuagcaucauuaaacuggaacaacuacgauccaacagaagaaauuccugcaccauuaggaacaccggauuucguagguaaaauucaagguguacuuacacaaacaacaaaaggugacggaucaacaagaggacacaaagcaacugucuauaccggaucagcuccauuuacaccuaaacuaggaucaguacaauucucaacagauacagaaaaugauuucgaaacccaucaaaacaccaaauucacgccaguuggcguuauucaggaugggggaacaacucauagaaaugaaccacaacaaugggugcuaccuucuuauuccggacgagauguaccuaacguacaccuugcccccgcagucgcaccuacauuuccaggagaacaacuacuauuuuucagaucaacaaugccaggcugcucuggauauccaaacauggacuuagauugucuacuaccacaagaauggguacaacauuucuaccaagaagcagcaccagcacaaucugacguagcacuauuacguuucguaaauccagacacagguagagucuuauucgaauguaaacuccacaaaucaggauauguaacuguagcacauaccggucaacaugaucuaguuauaccaccaaaugguuauuuuagauuugauucaugggucaaccaauuuuauacuuuagcuccaaugggaaaugguacaggcagaagaagagcauuauaa

SEQ ID NO: 32626 - RNA, 1623 nt, Artificial Sequence
  derived and/or modified sequence opt6 from capsid_protein__Norovirus__AFQ00528
augaaaauggccaguaaugaugcaaauccaucagauggaucagcugcuaauuuaguacccgaaguaaacaaugaagucauggcacuagaacccguagucggagcagcaauagcagcaccuguagcaggucaacaaaacguaauugacccauggauaagaaacaacuuuguacaagccccuggaggagaauucacaguuucuccuagaaaugcaccuggugaaauacuauggucagcuccacuaggaccagauuuaaauccauaccuaucacacuuagcaagaauguauaaugguuacgcaggagguuucgaaguucaaguaauucuagcaggaaacgcuuucacagcuggaaaaauaauauuugcagcaguaccaccaaacuuucccacagaaggucuuucccccucacaagucacaauguuuccacauauaauaguagaugucagacaacuagaaccuguacuaauaccuuuacccgauguuagaaacaacuucuaccauuacaaucagucaaaugacccaacaauuaaauuaaucgcaauguuauauacaccccuaagagcaaacaaugcaggagaagacguauuuacaguuucaugccgaguuuuaacacgaccaucaccggacuuugacuuuaucuuuuuaguaccaccaacaguagaaucaagaacaaaacccuucacaguaccaauuuuaaccguagaagaaaugacaaauucaagauuuccaauaccucuagaaaaauuauuuacaggaccaucuucugcauucguuguccaaccccaaaacgguagaugcacuacagauggaguacuacuagguacaacucaauuaucacccguaaacauaugcacauuucgaggagacguuacacacauagcaggaucaagaaacuauacaaugaaucuagcaagccuuaacuggaauaacuacgaucccacugaagaaauaccugcaccucuaggaacaccugacuuuguuggaaaaauacaaggaguacuuacacaaacaacaaaaggagacggauccacaagaggucauaaagcaacagucuacacagguuccgcaccauuuacaccaaaacuaggaagcgugcaauucucaacagauaccgaaaacgacuuugaaacacaucaaaauaccaaguucacaccagucggagucauacaagacgguggaacaacacauagaaaugaaccacaacaauggguacuaccuucauauaguggaagagacguuccaaacgcacaucuugcaccugcaguagcuccaacauucccaggagaacaauuacuauuuuucagaucaacuaugccaggauguucuggauauccaaauauggauuuagauugccuauuaccccaagaauggguacaacacuuuuaucaagaagcagcaccagcucaaucagauguagcacuacuccgauuuguaaacccagacacaggaaggguuuuauuugaaugcaaauuacauaaaucaggauacgucaccguugcacacacaggacaacacgaucuaguaauaccacccaacggcuacuucagauuugacucaugggucaaucaauuuuacacauuagccccuaugggcaacggaacuggaagacgcagagcuuuauaa

SEQ ID NO: 32627 - RNA, 1644 nt, Artificial Sequence
  derived and/or modified sequence opt6 from capsid_protein__Norovirus__AGC66782
augaaaauggcaucaaacgaugccgcaccaaguaaugauggagcagcaaaucuagucccagaagcaaacaacgaaguaauggcacuagaaccaguaguaggugcuucaauagcagcuccaguuguaggacaacaaaauauaauagacccauggauaagagaaaauuucguucaagcaccacaaggagaauucacaguuucaccaagaaacucuccuggugaaauguuacuaaaucuugaacuuggaccagaacuaaacccauaucuuucacaucuaucuagaauguauaauggauaugcaggagguaugcaaguacaagucguauuagcaggaaacgcauucacagcaggaaaaauuauauuugcagcuguaccaccacauuucccaguugaaaauauaucugcagcucaaauaacuauguguccacacguaaucguugauguacgccaacuagaaccaguacuauuaccucuaccagacauaagaaaccgcuuuuuucacuauaaucaagaagacaccccccguaugagauuaguagcaaugcuuuauacaccauuaagagcaaauaguggagaagacguguuuacagucuccuguagaguucuaacaagacccgcacccgauuuugaauuuacauuccuuguaccaccaacaguagaaucuaaaacaaaacccuuuacauuaccaauauuaacauuaggugaacuuuccaauucaagauucccagcaccaauugauaugcuauauacagacccaaacgaaaccauaguaguacaaccacaaauaggcagauguacacuagaugguucgcuacaaggcacaacccaacucguccccacacaaauauguagcuuuggaggcacacucauaucacaaacauccagauccgcagacucaacagauagugcaccaagaguaagaaaucacccauuacacguacaacuaaaaaauuuagacggaacaccauacgacccaacagaugaaguaccagccguccuaggagcuauagauuucaaaggaacaguauuuggaguagcaucacaaagaaacacuacaggaggaagugucggggcaaccagagcacaugaaguacauauagauacuacaaacccacgauacacaccaaaacuaggaucagccuuaauguauucagaaucagacgacuucgaugauggacaacccacaagauuuacaccaauaggaaugggagcagaugauuggcaucaaugggaauuacccgaauauucuggccaucuaacauuaaauaugaauuuagcaccagcaguagcaccagcauuuccaggcgaaagaauauuauuuuucagaucaguaguuccaucugcaggagguuacggaucaggacaaauagauugucucauaccacaagaauggguacaacacuuuuaucaagaggccgcaccaucacaaucugcuguagcacuaauaagauauguuaauccagacacaggaagaaacauacuagaagcaaaacuucauagagaaggauuuauaacuguagccaacucaggaaacaacccuauagugguuccaccaaacggauacuucagauucgaagcauggguuaaucaauucuacacauuaacaccaaugggcacuggacaaggcagaagaagaguccaauag

SEQ ID NO: 32628 - RNA, 1623 nt, Artificial Sequence
  derived and/or modified sequence opt6 from capsid_protein__Norovirus__AGC66784
augaaaauggcaucuaaugacgcaaacccuagugauggcucagcagcaaaccucguaccagaagucaauaaugaaguaauggcacuggaacccgucguaggagcagcaauagcagccccaguagcaggacaacaaaauguaauagacccauggauuagaaacaauuucguacaagcaccugguggagaauucacuguuagcccaagaaaugcaccaggagaaaucuuauggucugcuccacuaggaccagaccuaaauccauaucuuucacaucucgcaagaauguauaaugguuacgccggagguuucgaaguccaagugauacuagcuggaaacgccuuuacagcuggaaaaauaauauucgcagcaguuccaccaaacuuuccaacagaaggauuaucaccaucacaaguaacuauguucccucacauaaucguugacguacgccaauuagaaccaguauuaauaccauuaccagauguaagaaacaauuuuuaucacuacaaucaaucaaaugacaguacaauaaaacuaauagcuauguuauauacuccauuaagagcaaauaacgccggcgaagacguguuuacaguaucaugcagaguuuuaacacgaccauccagugacuucgacuuuauauuucuaguaccacccacaguagaaucucgaacaaaaccauucacaguaccaaucuuaaccguagaagaaaugacaaacucacgauuuccaauacccuuggaaaaacuauucacaggaccaucaucagccuucguuguacaaccacaaaacggaagauguacuaccgacggaguucuucuaggaacaacucaauuaucaccagucaacacauguacauuuagaggugacguuacacacauugcugguagccgaaauuacaccaugaaucuagcaucauuaaacuggaacaauuaugacccaacagaagaaaucccagcaccauuaggcacacccgauuuugucggaaaaauacaagguguacuaacacaaacaacaaaaggagacgguucuacacgaggucauaaagcuacuauauauacaggaucugccccauuuacaccaaaauuaggcucaguacaauucaauacagauacugaaaacgauuuugaaacccaucaaaacacaaaauucacaccgguuggaguaauacaagauggaggaacaacacaucguaaugaaccucaacaauggguuuuaccaucauauuccgguagaaauauaccuaacguccauuuagcaccagccguugcuccuacuuuuccuggugaacaacuccuauuuuuuagaucaacuaugccagguugcucaggauauccaaauauggacuuagacugcuuauuaccacaagaauggguacaacauuucuaucaagaagcagcuccagcacaaucugacgucgcacuuuuacgauucguaaauccagauacaggcagaguauuauucgaauguaaauuacacaaaucgggauauguaacaguagcacacacaggacaacacgaucuagucauaccaccaaauggauauuucagauuugacucauggguaaaucaauuuuacacacuagccccuaugggcaacggaacaggaagaagacgagccuuauaa

SEQ ID NO: 32629 - RNA, 1647 nt, Artificial Sequence
  derived and/or modified sequence opt6 from capsid_protein__Norovirus__AGC66785
augaaaauggccaguaaugaugcaaccccaucaaaugacggcgcagcaggauuaguuccagaaauaaacucagaagcaauggcuuuagaacccguagcaggcgcagcaauugcugccccucuaacuggacaacaaaacauaauagacccuuggauaaugaauaacuuuguacaagcacccggaggagaauucacaguuuccccaagaaauucaccuggagaaguauuacuaaaccucgaauuaggcccagaaauaaauccuuaccucgcucacuuagcaagaauguauaacggauacgcaggugguuucgaaguucaagucguucuagccggaaaugcauuuacagcuggaaaaauaaucuuugcagcaaucccuccaaauuucccaauagacaauuuaucugcagcccaaauaacaaugugcccacacguuauaguagauguacgacaauuagaaccaguaaaccucccaaugccagauguacguaacaauuucuuucacuacaaccaaggaucagauucaagacucagacuaauagccaugcucuauacaccucucagagcaaacaacuccggagacgacguuuucacaguaucaugcagaguauuaacaagaccaucccccgauuucuccuucaacuuuuuaguacccccaacaguagaaucaaaaacaaaacccuucucucuacccauacuaacaauauccgaaaugucaaauucaagauucccaguccccauagacucacuacauacaucaccaaccgaaaauauagucguacaaugucaaaacggaagagucacucuagacggagaauuaaugggaacaacacaacuguuaccaagucaaauaugugcauucagaggaaugcuaacaagaucaacauccagagcaucugaccaagcagacacagcaacccccagacuauucaacuauuauuggcauauacaacuagacaaccuaaacggaacaccauacgacccggcagaagauauaccuggaccauuaggaacaccagauuuccgcggaaaaguauuuggaguagcaucacaaagaaacccagaugcaacaacaagagcccacgaagcaaaaauagacacaacuaguggacguuucacaccaaaacuaggcucacucgaaauaucaacagaaucaggagacuuugaucaaaaccaaccaacaagauuuacaccuguaggcauuggaguagacagagaagcugacuuccaacaauggacacuaccugauuacgcaggucaauuuacacauaauaugaaccucgcacccgcgguugcaccaaauuuuccaggugaacaauuacuauuuuuucguagucaacuuccaucuagcggaggacguucaaaugguauacuagacuguuuaguuccacaagaauggguacaacacuucuaucaggaaucagcaccaucacaaacacaaguagcauuaguaagauauauaaacccagacacaggaagaguauuauucgaagcuaaauuacauaaauuaggauuuaugacaauagcaaaaucaggugauucaccaauaaccguaccaccgaacgguuauuuuagauucgaaucauggguaaacccuuucuauacucuagcaccaauggguaccgguaauggaagacguagaauccaauaa

SEQ ID NO: 32630 - RNA, 1644 nt, Artificial Sequence
  derived and/or modified sequence opt6 from capsid_protein__Norovirus__AGC66786
augaaaauggcaucaaacgaugcagcaccaucuaaugacggagcagcaaaucuaguaccugaagcagauaaugaaguaauggcauuagaaccaguaguaggagcaucuauugcugcaccagucguaggacaacaaaauauaauagaccccuggauaagagaaaauuuuguccaagcuccucaaggugaauucacaguaucaccaagaaauucaccaggagaaauguuauuaaaucuagaauuaggcccaggacuaaauccauauuuaucacaucuaucaagaauguacaauggauaugcuggaggaaugcaaguacaaguaguacuagcaggaaaugcauuuacagcugguaaaauuauauucgccgcuguuccaccacauuucccaguagaaaauauauccgcugcacaaauaacaauguguccccaugucauaguagaugucagacaauuagaaccugucuuauuaccauuaccugauauccgaaacagauuuuuucauuauaaucaagaagauaccccccgaaugcgccuagucgcaaugcucuacacaccuuuacgagcaaauuccggagaagauguauuuacaguaucaugcagaguccuuacuagaccugcaccagacuuugaauucacauuccuuguacccccaacaguagaaucaaaaacuaaaccauuuacauuacccauacuuacacuaggagaacuauccaacucaagauuuccagcuccaauagacauguuauacacagacccaaaugaaacaauaguaguccaaccacaaucagguagauguacauuagauggaacauuacaaggaacaacacaacucguaccuacacaaauauguucauuuagaggaacccuuauaucacaaacaucaagaucagcagauucaacugauagugcaccuagagucagaaaucaucccccccauguacaauuaaaaaaucuagauggcacucccuaugauccaacagaugaaguaccugcaguacuaggcgcuauagauuuuaaaggaacaguauuuggaguagccucacaacguaacacaacuggaggaucagucggcgcaacuagagcucaugaaguacacauugacacaacaaaucccagauauacaccuaaacuaggcucuguucugauguauucagaaucagaugacuuugacgacggacaaccgacuagauuuacaccaauaggcaugggggcagaugauuggcaccaaugggaacuacccgaauauucaggucauuuaacauuaaauaugaauuuagcgccagccguagcaccugcauuuccaggcgaacgaauacucuuuuuuagauccguaguaccaucagcaggaggauacggaucaggucaaauagacuguuuaauuccucaagaauggguacaacauuuuuaucaagaagcagcuccuucucagucugcaguugcauuaaucagauauguaaauccagacacaggucgcaauauauucgaagcaaaauuacauagagaaggauuuauaacaguugcaaauucugguaauaauccaauugucguacccccaaaugguuauuucagguucgaagcauggguaaaucaauuuuacacucuuacaccaaugggaacaggucaagguagaagacguguacaauaa

SEQ ID NO: 32631 - RNA, 1623 nt, Artificial Sequence
  derived and/or modified sequence opt6 from capsid_protein__Norovirus__AGC66788
augaaaauggcuaguaaugaugcaaacccauccgauggaucugcagcaaaccuuguaccugaaguaaauaaugaaguaauggcauuagaaccaguagucggcgcagcaaucgcugccccuguagcuggccaacaaaacguuauagauccauggauaagaaacaauuucguucaagcuccaggaggcgaauucaccguaucuccaagaaaugcaccuggcgaaauauuauggucagcaccucuuggucccgauuuaaaccccuacuuaagccauuuagcccgaauguacaauggauaugcaggaggauuugaaguacaaguaauacuugcuggaaacgcauuuacagcaggaaaaauaauuuuugcagcaguccccccaaauuucccaacagaaggacuuucacccucacaaguaaccauguuuccacauaucauuguagacguuagacaacuagaaccuguacuuauaccacuuccagauguacgcaauaauuucuaccacuauaaccaaagcaaugacucaacaauaaaacuaauagcaaugcuuuauaccccauuacgugccaauaaugcaggcgaagauguauuuacaguaucaugucgcguacuuacaagaccaagcccagacuuugauuucauauuuuuaguaccaccaacaguagaaucaagaacuaaaccuuucacagucccaauucuaacaguagaagaaaugacuaauuccagauuucccauaccauuagaaaaauuauuuacagguccauccucugcauucguagugcaaccacaaaacggccgauguacgacagacggaguacuacuaggaacuacccaauuaucuccaguaaacauaugcaccuuuagaggagacguaacacacauagcaggaucaaggaacuacacaaugaauuuagcaucacucaauuggaauaauuacgauccaacagaagaaaucccagcaccuuuaggaacuccagauuuuguaggcaaaauacaaggcguacuuacucaaacuacaaaaggagauggaucaacuagaggacauaaagcaacaguauacacaggaucagcaccauucacuccaaaauuaggcucaguaagauuuucaacugacacagaaaaugacuucgaaacacaccaaaauacaaaauucacucccgucggcguuauacaagaugguggaaccacucauagaaacgaaccacaacaauggguacuaccaaauuauucaggcucagauguaccuaauguacauuuagcaccagcuguugcaccuaacuucccaggagaacaacuacuauucuucagaucaacaaugcccgguuguucaggauauccaaauauggacuuagauuguuuacuaccacaagaauggguucaacauuuuuaucaagaagcagcuccagcucaaagugauguagcccuacuacguuuugucaauccagauacuggacguguccucuuugaauguaaacuacauaaaucaggauauguaacuguagcacauacaggucaacaugaccuaguaauaccaccaaauggauauuuccgauuugacuccuggguaaaucaauuuuauacacuagcaccaaugggaaacgguacaggaagacgacgagccuuauag

SEQ ID NO: 32632 - RNA, 1629 nt, Artificial Sequence
  derived and/or modified sequence opt6 from capsid_protein__Norovirus__AGL96587
augaaaauggccucuaacgaugcagcaccguccaaugacggagcagcaagccuaguaccagaaggcauaaacgaaacaaugccgcuagaaccaguagcaggugccucuauagcagcacccguagcaggacaaacuaacauuauagaucccuggauucguacaaacuucguacaagcucccaauggcgaauucacaguuuccccucgaaacucaccaggcgaaauauuauuaaacuuagaacuaggcccagauuuaaauccauaccucgcacauuuaccaagaauguauaacggauacgcaggagguguugaaguccaaguauuauuagcagguaacgcuuucacagcagguaaaauauuauuugcagcaauaccuccaaauuuuccaguagacaugauauccccagcucaaauuacaauguuaccacacuuaaucguagauguuagaacauuagaaccaauaaugauaccuuuaccagacguaagaaauguauuuuaccauuucaauaaccaaccacaaccaagaaugagacuagucgcaauguuauacacaccauuaagaucaaauggaaguggagaugacguccuaaccguaagcugcagaguacuaacacguccaacaccagauuucgaauucauauacuuaguaccaccaucaguagaaucaaaaacuaaaccauucacccuaccaauccuaacuauaagugaauuaaccaauucacgcuuuccaauacccauagaacaauuauauacagcaccuaacgaaacuaauguaguccaaugccaaaaugguagaugcacauuagacggagaauuacaaggaaccacacaauuacuuucaucagccguauguucuuauagaggaagaaccguagcaaauaauggagacaauugggaucaaaacuuauuacaacuaacauaucccaauggagcaucauaugacccaacagacgaagucccagcuccuuuaggaacucaagauuuuagcggaaugcuauacggcguacuaacacaagacaacguuaacguuucaacaggcgaagcaaaaaacgcaaagggaauauacaucucaaccacuucuggcaaauuuaccccaaaaaucggaucaaucggacuacauagcaucaccgaacauguucacccaaaccaacaauccagauucacaccaguaggaguagcaguaaaugaaaauacuccauuucaacaauggguccuaccccauuacgcagguucaacccguucccauacuaaucuaggaaccgcauuagcuccaacauuuccaggagaacaauuacuauuuuuccgaucaagaguaccaugcguacaaggauuacaaggacaagacgcauucaucgacuguuuacucccacaagaauggguaaaucacuucuaucaagaagcagcaccaucacaagcagaugucgcauuaaucagauauguaaacccugauaccggacgaacuuuauucgaagcuaaauuacaucgauccgguuuuauuacagugucacauacaggugcauaucccuuaguaguccccccuaauggacacuuucguuuugauuccuggguuaaucaauucuauucccuagcacccaugggcaccgguaacggaagacguagaauacaauaa

SEQ ID NO: 32633 - RNA, 1623 nt, Artificial Sequence
  derived and/or modified sequence opt6 from capsid_protein__Norovirus__AGQ57036
augaaaauggcaucaaaugacgcugcacccagcaaugauggcgcugcaggauuaguaccagaaauuaauaaugaaguaaugccacuagaaccaguagcaggagcaucacuagcaacuccuguaguaggacaacaaaauauuauugaucccuggauaagaaacaauuuuguacaagccccagcaggagaauucaccgucucaccaagaaauagcccaggcgaaauacuacuagaucuugaauuaggaccagaacuaaauccuuaucuagcacauuuagcaagaauguauaauggucaugcaggagguauggaaguucaaauaguuuuagcaggaaacgcauuuaccgcaggaaaaauaauauuugcagccauaccaccaggauuucccuacgaaaaucuuucaccuucucaaauuacaauguguccucauguaaucauagacguacgucaauuagaaccaguacuauuaccaaugccugacauaagaaauaauuucuuucacuacaaccaaggaaaugauccaaaacuaagacucguagcaauguuauacacuccucuaagagcaaacaauucuggcgacgauguauuuacaguaucaugcagaguauuaacaaaaccuucaccugacuucgaauuuacauuccuuguaccaccaacuguggaauccaaaacaaaacaauucacacucccaauccuuaaaauaucagaaaugacaaacuccagauucccaguaccaguugaaaugauguauaccgcaagaaaugagaaucaaguaguacaaccacaaaacggcagagucacauuagacggagaacuacuaggaacaacccccuuauuagcagucaauauauguaaauuuaaaggugaaguaauagcaaaaaauggagacguaagaucuuacagaauggacauggaaauaacuaauacugacggcacaccaauagauccaacagaagauacuccagguccaaucggaucacccgauuuccaaggaauacuauucggaguugcaucacaaagaaacaaaaaugaacaaaacccagcaacaagagcacaugaagcagacauaaacacaggaggagaccaauacgcacccaaauuagcacaaguuaaauucuucucagaaucacaagacuuugaaguacaucaaccaacugucuucacacccguaggaguugcuggugacgcaagccauccuuucagacaauggguauuaccacgcuauggaggacacuuaacaaacaacacucaccuugccccagcaguugccccacuauuuccaggagaacaaauauuauuuuuucgaucacaaauaccaucauccggcggacaugaacuuggcuauauggauuguuuaguaccacaagaauggguacaacauuucuaucaagaagccgcaacugcacaauccgaaguagcauuaauucguuucauaaauccagauacaggaagaguacuauucgaagcaaaacuucacaaacaaggauuuauaacaguagcacauacuggagauaauccaauaguaaugccaccuaacggauauuuucgauucgaagcaugggucaaccaauuuuacucauuagcaccaguaggaacagguaauggacgacgaagaauacaauaa

SEQ ID NO: 32634 - RNA, 1623 nt, Artificial Sequence
  derived and/or modified sequence opt6 from capsid_protein__Norovirus__AGT95926
augaaaauggcaucaucugaugcuaauccuucagauggcucagcagcaaacuuaguaccagaaguuaauaaugaaguaauggcacuagaaccuguaguaggagcagcaauagcugcaccagucgcaggccaacaaaauguaauagauccauggauuagaaauaacuucguccaagcaccaggcggugaauuuacuguauccccucgaaaugcaccaggagaaaucuuauggucagcaccauuaggaccagaucuaaacccauaucuaucucaccuagccagaauguauaacggauacgcaggcggauuugaaguacaagucauuuuagcaggaaacgcauucacagcagguaaaguaauauucgcagcaguaccaccaaauuuucccacagaaggucuuucaccaucucaaguuacaauguuuccccauauaguaguugacguaagacaauuagaaccaguacuaauaccacuaccagacguacgaaacaauuucuaucacuauaaccaaucaaacgauccuaccauaaaacuaauugcaaugcuauacacacccuuacgcgcaaacaaugcuggagacgaugucuucacaguaucauguagaguauuaacaagaccaucaccagauuuugacuuuauuuuucuaguaccaccaacagucgaauccagaacaaaaccauucucaguaccaguauuaaccguagaagaaaugacaaacucacgauuuccuauaccccuugaaaaacuauucacuggaccauccuccgcauucguuguacaaccacaaaacggacgcuguacaacugacggaguacuacuagguacuacacaauuaucaccaguuaauauauguaccuuuagaggagauguaacucauauaacugguucgagaaauuacacaaugaauuuagcaucacaaaacuggaauaauuacgauccuacugaagaaauaccagcaccuuuaggaaccccagacuucgucggaaaaauacaaggaguacuaacccaaacaacuagaacugauggaucuacccgaggccauaaagcaacuguuuauacugguucagccgauuucgcacccaaauuagguagaguacaauucgaaacagauacugaucaugacuucgaagccaaucaaaauaccaaauucacaccaguaggaguaauucaagaugguuccacaacucacagaaaugaaccacaacaauggguauuaccaucauacucaggaagaaacacacacaauguacaucuagcaccugcaguagcaccaaccuuuccaggugaacaauuacuauuuuucagaucuacaaugcccggauguucgggauaucccaauauggaucuagauugccuacuaccacaagaauggguacaauacuucuaucaagaagccgcuccugcacaauccgacgucgccuuacuaagauucguuaauccagauacuggacgaguacuauuugaaugcaaauuacauaaaucaggcuauguuacaguagcacacacuggacaacaugaucuaguaauaccuccaaauggcuauuucagauucgauuccuggguaaaccaauuuuauacccucgccccuauggguaauggcacuggacgaagacgaguaguauaa

SEQ ID NO: 32635 - RNA, 1623 nt, Artificial Sequence
  derived and/or modified sequence opt6 from capsid_protein__Norovirus__AGT95927
augaaaauggcaucuucagacgccaaucccucagauggaucagcagcaaaucuaguaccugaaguaaauaaugaaguaauggcacuagaaccuguaguaggugcagcuauugcagcaccugucgcaggucaacaaaacguaauagauccauggaucagaaauaauuuuguccaagcaccaggcggagaauuuacuguuagcccaagaaacgcaccaggcgaaauacuuuggucagccccacucgguccagaucuaaauccauaucucucucauuuagcacgaauguauaaugguuaugcaggcggauuugaaguacaaguuauucuagcaggcaacgcauucacagcaggaaaaguaaucuuugcagcaguaccuccaaacuucccaacagaagguuuaagucccucacaaguaacaauguuuccacauauaguaguagacguaagacaauuagaaccaguucuaauaccacuaccagauguaaggaauaauuuuuaucauuauaaccaaucaaaugauccaacaauaaaauuaauugcaauguuauacaccccauuaagagcaaacaacgcuggagaugauguauucacaguauccugucgaguucuaacaagaccaucaccugauuuugacuucaucuuucuaguuccuccuacagucgaaucaagaacaaaaccuuuuucuguccccgucuuaacuguugaagaaaugacaaacucuagauucccuacaccauuggaaaaauuauuuacaggcccaucuuccgcauucguaguacaaccacaaaacggaagauguacaacagacggaguacuucuaggaaccacacaacuauccccaguaaauauauguacuuucagaggcgauguaacacauauaacaggaucaaggaauuauacuaugaauuuagcuagucaaaacuggaauaacuaugauccaacugaagaaauaccagcaccauuaggaacaccggauuuuguuggcaaaauucaaggaguuuuaacucaaaccacaagaacagaugguucaacaagaggucacaaagccacagucuauacaggcucagccgauuuugcaccaaaauuggguagaguucaguuugaaacagauaccgaucaugauuuugaaguaaaucaaaauacaaaauucacuccaguaggaguuauacaagacggcggaacuacucauagaaaugaaccacaacaauggguacuaccaucuuacucaggaagaaacacacauaauguccauuuagccccagcaguagccccaacauuuccaggcgaacaacuuuuauuuuuccgaaguacaaugccuggcuguucaggauauccaaacauggauuuagacugucuccuaccucaagaauggguucaauauuuuuaccaagaagcugcuccagcacaaucagacgucgcacuacuucgauuuguaaauccugauacaggaaggguauuauucgaauguaaauuacauaaaucagguuacguaacagucgcacauacaggccaacaugauuuagucauaccuccaaauggcuacuuucguuucgauucauggguuaaccaauuuuauacacuagccccgaugggcaauggcacaggccgacgaagaguaguauaa

SEQ ID NO: 32636 - RNA, 1623 nt, Artificial Sequence
  derived and/or modified sequence opt6 from capsid_protein__Norovirus__AGT95928
augaaaauggcaucaagugaugccaauccaucugacgguucagcggcaaaucucguaccagaaguaaauaaugaaguaauggcucucgaaccgguaguaggugcugcuauagccgccccaguagcaggccaacaaaacguuauugauccuuggauacgcaauaacuuuguacaagcaccaggaggagaauuuacaguaucaccaagaaaugcaccaggcgaaauuuuauggucagcaccauuaggaccggaucuaaaucccuacuuaucacacuuagcuagaauguacaauggauacgcagguggauucgaaguacagguaauauuagcaggaaacgcuuuuacugcaggaaaagugauauuugcagcaguucccccaaauuuuccaacagaaggacuaucaccaucacaaguaacaauguuuccucauauaguaguagauguacgucaacuagaaccaguccuaauaccacuaccugauguaagaaauaacuuuuaucauuacaaucaauccaaugacccaaccauaaaacucaucgcaauguuauauacuccauuaagagcaaauaacgcaggagaugacguauuuacaguuucuuguagaguccuuacaagaccaucaccagauuuugauuuuauauuucuaguaccaccaacaguagaaucacguacaaaaccauucucaguaccaguucuuacagucgaagaaaugacaaauucacguuuuccaauaccauuagaaaaauuauucacaggaccaucaucagccuucguuguacaaccucaaaauggucgaugcacaacugauggaguauuacuaggaacuacacaauuaucaccugucucaauaugcacauuccguggagauguuacucacauaacuggaucaagaaauuauacaaugaaucuagcaucacaaaacuggaauaauuaugaccccacagaagaaauuccagcaccauuaggaacaccagauuuuguaggaaaaauacaaggaauguuaacacaaacaacuagagcagauggcagcacccgaggccacaaagcaacaguauacacuggaucagcagauuuugcaccaaaacuaggaagaguucaauuugaaacagauacagaucaugauuuugaagcaaaucaaaauacaaaauuuacaccuguaggaguaauucaagacggaucaacuacucacagaaaugaaccccaacaauggguucucccaucauauucaggaagaaacacccacaauguacacuuagcuccagcuguagcaccaacuuuuccuggcgaacaacuacuauuuuucagaucaacaaugccagguuguaguggauauccaaauauggaccuagacugcuuauuaccacaagaauggguacaauacuucuaccaagaagcagccccagcucaaucagacguagcauuacuaagauuuguaaauccugacacaggaagaguuuuauuugaauguaaauuacacaaaucagguuauguuacuguagcacauacuggucaacaugauuuagucauaccuccuaacggauauuuccgcuuugauucuuggguaaaucaauucuacacauuagcaccaauggguaacggaacuggcagaagaagaguuguauaa

SEQ ID NO: 32637 - RNA, 1623 nt, Artificial Sequence
  derived and/or modified sequence opt6 from capsid_protein__Norovirus__AGT95929
augaaaauggcaagcucagacgcuaacccaucagauggauccgcagccaaccuuguuccugaaguuaauaacgaaguaauggcuuuagaacccguaguaggcgcagcaaucgcagccccaguugcuggacaacaaaauguuauugauccauggauacgaaauaacuucguacaagcacccggaggagaauucacaguaagcccuagaaaugcuccaggcgaaaucuuauggucagcacccuuaggucccgauuuaaauccauaucuuucacauuuagcaagaauguauaaugguuacgcaggaggauuugaaguacaaguaauauuagcaggaaaugccuucacagccggaaaaguaauauuugcugcagucccaccaaauuuuccaacagaaggucuaucuccaucacaaguuacaauguuuccacacauaguaguagauguaagacaacucgaaccaguacuaauaccacuucccgacgucagaaacaauuuuuaucacuauaaucaaagcaacgaccccacaauuaaacucauagcgauguuauacacacccuuaagagcaaauaacgcaggagacgauguauuuaccguaucauguagaguauuaacacgacccuccccagacuuugauuuuauauuccuaguaccacccacgguagaaucaagaacaaaaccuuucucaguuccggucuuaacaguagaagaaaugacuaacucaagauucccaauaccauuagaaaaacuauuuacaggaccauccagcgcuuucguaguacaaccacaaaauggacgaugcacaacugauggcguauuauuaggaacaacccaacuuucaccuguaaauauauguacauuucgaggagauguaacacacauaacagguucaagaaauuacacaaugaaucuagccagccaaaacuggaauaacuaugauccaacagaagagauaccagccccacuaggaacaccagacuuuguaggcaaaauacaaggcguauuaacucaaacaacacgaacagauggaagcacuagaggacacaaagcaaccguauauacagguuccgcugacuucgcacccaaacuaggaagaguacaauucgaaacagacacggaccacgauuuugaagcaaaucaaaauacaaaauucacaccaguaggaguaauacaagacggaucaacaacacauagaaaugaaccacaacaauggguuuuaccauccuacucaggucgaaauacacacaacguucauuuggcaccagcaguugccccuacauuucccggagaacaacuucuuuucuucagaucaacaaugccaggaugcucuggcuacccaaauauggaucuagauugccuacuaccacaagaaugggugcaauacuuuuaucaagaggccgcaccagcacaaucagacguugcauuacuacgauuuguaaauccugacacuggaagaguauuauucgaauguaaacuacacaaaucaggauaugucacugucgcacauacaggacaacacgauuuaguaauaccacccaauggauacuucagauucgacucauggguaaaccaauuuuacacacuagcgccaaugggaaauggaacaggaagaaaaagaguagucuaa

SEQ ID NO: 32638 - RNA, 1623 nt, Artificial Sequence
  derived and/or modified sequence opt6 from capsid_protein__Norovirus__AGT95930
augaaaauggcuucuucagacgcaaauccaucagauggaucagcagcuaacuuaguuccagaaguaaauaacgaagucauggcuuuagaacccguaguaggagcagcuauagcagcuccuguugcuggacaacaaaauguaauugauccauggauacguaauaauuucguucaagcaccaggcggggaauuuacugucagcccgagaaaugcuccaggugaaauacuauggagugcaccauuaggucccgaucuaaauccauaccuuucccacuuagcaagaauguauaacgguuaugcagguggauuugaaguacaaguuauauuagcaggaaacgcuuucacugcaggaaaaguaauauuugcugcaguaccccccaauuuuccuaccgaagguuuaucaccuucacaagucacaauguucccacauauaguaguagacguacgacaauuagaacccguuuuaauuccauuaccugauguaagaaacaauuucuaccauuauaaccaaucaaaugauccgaccauaaaauuaauugcaaugcuauauaccccauuaagagcaaacaaugcaggagaugacgucuucacaguuucuuguagaguacuaacacgacccucuccagauuuugauuucauauuucuaguuccuccaacaguugaauccagaacaaaaccauucuccguaccuguucucacaguagaagaaaugacaaauaguagauucccuauaccauuagaaaaauuauuuacaggaccaaguagugcauuuguaguacaaccacaaaauggucgaugcacuacagacggaguauuacuaggaacaacccaacuaucuccaguuaacauauguacauuuagaggagauguuacacauauaacaggaucuagaaauuacacaaugaaucucgcaucucaaaauuggaauaauuaugauccaacagaggaaaucccugcuccacuaggcacuccagauuuugucggaaaaauacaaggaguucuuacacaaacaacacgaacagauggaucaacuagaggccacaaagcaacaguuuauacaggaucaacagauuuugcaccaaaauuagguagaguccaauuugaaacagauaccgaccaugacuuugaagcaaaccagaauaccaaauuuacaccuguagguguaauacaagauggaucuacaacucauagaaaugaaccucaacaauggguauuaccaucauauucaggaagaaauacccauaacguacaucuagccccagcugucgcaccuacauuuccaggugaacaacuauuauuuuuccgcaguacaaugccaggauguucagguuauccuaacauggaucuagauugucuauuaccacaagaauggguacaauauuucuaccaagaagcugcuccugcacaaucagauguugcauuauuacgauuuguaaauccagacacaggaagaguucuauucgaauguaaacuacacaaaucaggauacguaacaguugcacauaccggucaacaugauuuaguuauaccaccaaauggauauuuuagauuugauucauggguuaaucaauucuauacuuuagccccaaugggaaauggcacaggaagaagaagagcaguuuaa

SEQ ID NO: 32639 - RNA, 1623 nt, Artificial Sequence
  derived and/or modified sequence opt6 from capsid_protein__Norovirus__AGT95931
augaaaauggcauccucagaugcaaacccuagcgacgguucagcagcuaaucucguaccagaaguaaauaacgaaguaauggcacuagaaccaguagucggagcugcaauagcagcaccuguagccggacaacaaaauguaauagacccauggauacguaauaauuuuguacaagcuccaggaggagaauuuacaguaucuccuagaaaugcaccuggugaaauauuauggucagcaccauuaggacccgaucuaaauccauaucuaucccacuuagcacgaauguauaacggauacgcaggaggauuugaaguacaaguuauccuagcuggaaacgcauuuacagcagguaaagucauauucgcugcaguuccaccaaacuuuccaaccgaagguuuaucaccaucacaaguaacaauguucccacauauaguaguagacguaagacaauuagaacccguacuaauaccauuaccagauguaagaaauaauuucuaucacuauaaccaaucaaacgacccaacuauuaaauuaauagccaugcuauauacaccucuacgagccaauaacgcuggugaugauguauuuacaguaucauguagaguccuaacacgaccuucuccagacuucgauuuuauauuuuuaguaccaccuacagucgaaucaagaaccaaaccauuuuccguaccaguuuuaacuguagaagaaaugacaaauucacgcuucccaauaccauuagaaaaacuauuuacaggaccaucaucagcauuuguuguacaaccucaaaacgguagauguacaacagacggaguacuucuuggaacaacucaacuuucaccaguaaauaucugcaccuucaggggagacgucacacauauaacuggaucaagaaauuauacuaugaauuuagccagucaaaacuggaauaacuaugauccuacagaagaaaucccagcacccuuaggaacaccagauuuuguaggaaaaauacaaggaguauuaacucaaacaaccagaacagacggaucaacaagaggacacaaagcaacaguauauacaggcagcgcagauuuugcaccaaaacucgggagaguacaauuugaaacagauacagaccacgauuuugaaacaaaucaaaauacaaaauucaccccaguaggaguaauacaagaugguaguacaacucaccgaaacgaaccacaacaauggguauuaccuuccuauucuggacgaaauacacacaacguacaccuugcacccgcagucgcgccaacauucccaggagaacaauuauuauuuuuuagaucaacuaugccgggaugcucaggauacccaaacauggauuuagacugccucuuaccccaagaauggguacaauauuucuaucaagaagcagccccagcacaaucagacguagcacuuuuaagauuuguaaauccugauacaggaagaguccucuuugaaugcaaacuccauaagucaggauaugucacuguagcacacacaggucaacacgaucuaguaauuccaccaaauggcuacuuuagauuugauuccuggguuaaccaauuuuauacacuagcucccaugggcaauggaacaggccgaagacgcgcaguuuaa

SEQ ID NO: 32640 - RNA, 1623 nt, Artificial Sequence
  derived and/or modified sequence opt6 from capsid_protein__Norovirus__AHC12655
augaaaauggcuucaucagacgccaaucccucugauggcucagcugcaaacuuaguacccgaaguaaauaaugaaguaauggcucuagaaccaguaguaggagcagcaaucgcagcuccaguagcaggacaacaaaauguaaucgauccauggauacgcaauaauuuuguacaagcaccaggaggagaauuuacaguaucaccacgaaacgcuccaggagaaauccuuuggucagcaccauuaggaccagaucucaauccauaucuaucucaccuugcuagaauguauaaugguuaugcaggcggauucgaaguacaaguuauauuagcaggaaaugcauucacugcaggaaaaguaauauuugcagcaguuccaccaaauuuuccaacagaaggucuuaguccuucccaaguaacaauguucccccacauaguaguugacguuagacaacuagaaccaguacuuauaccauuaccagacgucagaaacaauuucuaucacuauaaccaaucaaacgauccaacaauaaaauuaaucgccaugcuauacacaccauuaagagcaaacaaugcaggagacgauguaucaacagucaguuguagaguccuaaccagaccaucuccugacuuugacuuuauauuucuaguaccuccaacaguugaaucaagaacaaaaccuuucagcguaccaguauuaacaguagaagaaaugacuaauagucguuuuccaauaccauuggaaaaacucuuuacaggaccaucaucagcauucguaguacaaccacaaaauggacgcugcacaaccgaugguguacuacuagguacaacccaacuaucaccuguuaauauaugcacauuuagaggugacguuacccauauaacaggcagcagaaauuacaccaugaauuuagcuagucaaaacuggaauaauuacgauccaacugaagaaauaccagcaccauuaggcacacccgauuuuguaggaaaaauacaggguaugcuaacucaaacaacaagaacagauggaucaacaagaggacacaaagcaacuguauauacagguucagcagacuucgcaccaaaauuaggcagaguacaauuugaaacagauacagaucacgauuucgaagcuaaucaaaacaccaaauucacaccuauaggaguuauacaagaugguuccacaacacaucguaaugaaccacaacaauggguauuaccaucuuacucuggaagaaauacgcacaacguacauuuagcaccagcaguugcuccuacauuccccggagaacaauuacuauuuuuuagaucaacaaugccuggauguucaggauaucccaacauggauuuagauugucuucuaccacaagaauggguacaauacuucuaucaagaagcagcaccugcucaaucagauguagccuuauuacgcuucguaaauccagacacaggcagaguauuauuugaauguaaacuacauaaaucuggauauguaacuguagcucauacaggacaacacgaccucguaauaccacccaauggauauuuccgauuugauuccuggguaaaccaauucuauacacucgcaccaaugggcaaugguacaggaagaagaaggguuguauaa

SEQ ID NO: 32641 - RNA, 1623 nt, Artificial Sequence
  derived and/or modified sequence opt6 from capsid_protein__Norovirus__AHC12658
augaaaauggcuaguucugacgcaaacccaucagacggauccgccgcaaaucuaguacccgaaguaaacaacgaaguaauggcauuagaacccguaguaggagcggcaauagcagcucccguagcaggucaacaaaauguaauagauccuuggauucgaaacaacuuuguacaagccccaggaggugaauuuacaguaaguccaagaaacgccccaggagaaauauuauggucagcaccacuaggccccgaucuaaacccauauuuaucacauuuagcaagaauguacaacgguuacgcaggaggauuugaaguacaaguaauauuagccggaaacgcauucacagcuggaaaaguaaucuucgcugcaauaccacccaauuuuccaacugaaggacuuucacccagucaagucacaauguucccacacauagucguugacgucagacaacuagaaccaguacuaaucccauuaccugauguacguaacaacuucuaucacuacaaccaaucuaacgacccaacaauaaaauuaauagcaauguuauauacaccacuaagagcaaacaaugccggaggugauguauuuacaguaucauguagaguauuaacuagaccaucaccagacuuugacuucaucuucuuaguucccccaacuguugaaucaagaacaaaaccuuuuucaguaccuguauuaacuguagaagaaaugacaaacagccguuuuccaauaccauuagaaaaauuguuuacaggaccaucaucagcuuucguaguacaaccacaaaauggaagauguacaacagacggaguacuucuaggcacaacacaauuaucacccguaaacauauguacauuucgcggagauguuacacacauaacaggaucaagaaauuauacaaugaaccucgcaucacaaaacuggaauaauuaugaccccacagaagaaauaccagcaccccuaggcacaccagacuuuguaggaaaaauucaaggaaugcuaacacaaacuaccagaacagacgguucaacaagaggacauaaagcaacuguauauaccgguucagcggacuuugcaccaaaacuaggacgcguacaauucgaaaccgauacagaucaugauuucgaagcuaaucaaauaacaaaauucacaccaauaggaguaauacaagacgguucuacuacacauagaaacgaaccacaacaaugggucuuaccaucauauucaggacgaaauacccacaauguucacuuagcaccagcagucgccccuacauuuccaggugaacaacuuuuauuuuuucgaucaacaaugccagguuguucaggcuauccaaauauggauuuagauugucuucuaccccaagaauggguccaauauuucuaucaagaagcagcaccagcacaaucugauguagcacucuuaagauuugucaauccagauacuggucguguacuauucgaaugcaaauuacauaaaucugguuauguaaccguagcccauacaggacaacaugaccuaguuaucccaccaaaugguuacuucagauucgauucaugggucaaucaauuuuacacacucgcaccaaugggaaacggaacaggaagaagaagaguaguauaa

SEQ ID NO: 32642 - RNA, 1632 nt, Artificial Sequence
  derived and/or modified sequence opt6 from capsid_protein__Norovirus__AHW99832
augaugauggcaucaaaagaugcacccucaucugcagauggagcaaauggagcaggacaauuaguuccagaaguaaacaaugcagaaccucuaccucuagauccaguugcaggugcaucaacagcacuugcaacugccggacaaguaaacaugauagauccauggauauucaauaauuuuguacaagcaccacaaggcgaauuuacaaucucacccaauaauacaccuggugauauuuuauuugaucuacaauuaggaccacaucuaaacccuuuucuugcucaucuuucacaaauguauaacgguuggguaggaaauaugagagucagaguuauccuagcaggaaaugcauuuacagcaggaaaagucauaauauguugugucccaccaggauuccaaagcagaacauuaucaauugcucaagcaacacuauuuccacauauuauugcugauguacgaacauuagaacccauagaaauaccauuagaagauguccgcaauaccuuauaccauacuaaugauaaucaaccaaccaugagacuacuauguaugcuauauacucccuuacgaacagguggcggcucuggaggaacagaugccuuugucguagcaggacgaguucuaacaugcccauccucagacuuuaauuuucuauuuuuaguacccccaacuguagaacaaaaaacaagaccuuucucuguaccaaacauaccccuacaauuacuauccaacucaagaguaccuaacuuaauacaaucuaugguauuaucuccagaucaagcucaaaauguucaauuucaaaauggaagauguacaacugacggacaauuauuagguacaacuccuguaucuguaucacaaauacuaaaauucagaggaaaaguaucagccggaucaaaaguuauaaaucuaacagaacuugacgguucaccauucuuagccuuugaagcacccgccccaacaggcuucccugaucuaggcacaucagauuggcauguagaaaugucccuaaacucaaauucucaaucaucaggaaaccccauacuauugagagacauacauccaaauucaagcgaauuuguuccucaucuagguucugucugcguaacagcagcaauugaagucgcaggagauuauacuggaacaauucaauggaccucacaaccaucuaauguaacaccaguaccagauguaaauuucuggacuauuccacauuauggaucaaacuuagcagaagcaucucaauuagcuccuguaguauacccuccaggauuuggcgaagccauaguauauuucaugucaccaauaccugguccaaacacagcacauaaaccaaauuuaguaccauguuuacuuccccaagaauuuguuacucauuuuguaucagaacaagcccccucaaugggagaagcagcacuaguccacuauguugauccugauacuaauagaaauuuaggugaauuuaaauuauacccagaaggauuuauuaccuguguaccaaauggaacaggaccucaacaauuacccuuaaacggaguauucguauuugcaucauggguaagccgauucuaucaauuaaaacccguaggaacagccucaucagcacgagguagacuuggaguucgucgauaa

SEQ ID NO: 32643 - RNA, 1647 nt, Artificial Sequence
  derived and/or modified sequence opt6 from capsid_protein__Norovirus__AHZ12735
augaagauggcaucaaaugacgcaacuccaucaaaugauggagcagcaggccuuguaccugaaauaaauaaugaagccauggcacuagaaccaguagcaggagcagcaauagcugcuccccuuacuggacaacagaauaucauagaucccuggauaaugaacaauuucguacaagcuccuggcggugaauuuacuguauccccuagaaauucuccuggagaaguuuuacuaaaccucgaacuaggacaagaaauaaacccuuauuuagcacaucuagcacgaauguauaacggauaugcaggaggauuugaaguacaaguaguauuagcaggcaaugcauuuacagcaggaaaaauaauuuuugcagccauaccaccaaauuucccaauagacaaucuaucagcagcacaaauaacaauguguccucauguaaucguugauguaagacaacucgaaccaguaaauuuaccaaugccagauguaagaaacaauuucuuccacuauaaucaaggaucugauucacgauuaagacuaguagcaaugcucuacacucccuuaagagcaaauaauuccggugacgaugucuuuacaguaaguugcagaguccuaacaagacccagcccagaauuuucuuuuaacuuucuuguacccccaacuguugaauccaaaacuaaaccauucacauuaccaauauuaacaaucagugaaaugucaaacucaagauuuccaguacccauagacucucuucacacaucaccuacagaaaacauagucguucaaugccaaaacggacgaguuacacuagacggcgagcuuauggguaccacccaauuauuaccuucacaaaucugcgcauuucgaggaguacuaacaagaucuacuucaagaacaucagaccaagcagauacagcaacaccaagacucuuuaauuacuauuggcauauacaauuagauaauuuaaacggaacccccuacgacccagcagaagauauaccuggaccacuagggacaccugacuuccgcggaaaaguauucgguguagcaucucaacguaacccagacucaaccacaagagcacaugaagcaaaaguugauacaacagcaggacguuucacaccaaaauuaggaagcuuagaaauaucuaccgaaucuggagauuucgaccaaaaucaaccaacacgcuuuacaccaguaggaaucggaguagauagagaagcagacuuucaacaauggucgcuaccugacuauucaggucaauucacacauaauaugaacuuagcaccagcagucgcuccaaacuucccaggagaacaacuacuuuucuuucgaucacaauuaccaucaucuggcgguagaagcaauggaauauuagacugcuuaguaccacaagaauggguacaacacuuuuaccaagaaucugcuccagcccaaacucaaguagcauuaguucgauauguaaacccagacacaggcagaguauuauucgaagcuaaauuacauaaauuaggauuuaugacaauagccaaaaauggcgauucacccaucacuguaccucccaauggauauuuuagauuugaaucguggguaaauccguuuuacacuuuagccccuauggguacaggcaacggaagaagaagaguacaauaa

SEQ ID NO: 32644 - RNA, 1647 nt, Artificial Sequence
  derived and/or modified sequence opt6 from capsid_protein__Norovirus__AHZ12736
augaaaauggcaucaaaugacgcuacuccaucaaaugauggcgcagccggacuaguaccagaaauuaacaaugaagcuauggcacuagaccccguagccggugcugcuauagcagcaccauuaaccggacaacaaaauaucauugacccauggauuaugaauaacuuuguucaagcaccuggaggagaauuuacaguuucuccaagaaauucucccggcgaaguacuucuuaaucuagaauuaggacccgaaauaaaucccuaccuagcacauuuagcacgaauguacaauggauaugccgguggauucgaaguacaaguuguacuagcaggaaaugcuuuuacagcaggaaaaauaauauucgcagccauaccaccaaauuuucccauagacaaccucucagcugcucaaauuaccauguguccacacguaauagucgacguacgccaacuagaaccaguaaaccucccaaugccagacguuagaaauaacuucuuucacuauaaccaaggcucagacucuagacuaagacuaguagcuauguuauacacaccacugagagcuaauaauucaggagaugauguauuuacagucaguuguagaguucuuacaagaccuagcccagaauuuuccuuuaacuuuuuagucccaccaacaguagaaucaaaaacuaaaccauuuaccuuaccaauacucacaaucucagaaaugucaaacaguagauuuccuguuccaauugacaguuuacauacuuccccaacagaaaauauagucguacaaugucaaaacggaagaguaacacuugacggugaauuaaugggaacaacccaauuauuaccaucacaaauaugcgcauuucgcggaguauuaacucguucaacuucaagagcaucagaucaagcugauacagcaacuccacgacuuuuuaauuacuauuggcacauacaauuagauaaucuaaacggaacaccauaugacccugcagaagauauaccaggaccacuaggaacaccugacuucaggggaaaaguauuuggcguagccucacaacgaaauccagauaauacaacaagagcacaugaagcuaaaguugauacaaccgcaggaagauuuacaccaaaacuaggaucucuagaaauauccaccgaaagcggagauuuugaccaaaaucaaccaacacgauucacaccaguaggaauaggaguugaccacgaagcagacuuucaacaauggucacuuccagauuauucuggacaauuuacacauaacaugaacuuagccccugcaguugccccuaauuuuccaggugaacaacuuuuauucuuuagaucccaauuaccaaguucaggaggaagaucaaauggcauccuagauuguuuaguaccccaagaauggguacaacauuucuaucaagaaucagccccagcccaaacacaaguagcauuaguaagauacgucaacccugauaccgggcgaguauuauuugaagcaaaauuacauaaauuaggauuuaugacaauagcaaaaaacggagauuccccaauaacagucccuccuaauggauacuucagauucgaaaguuggguuaauccuuuuuacacacuagcgcccaugggaaccggcaauggaagaaggagaguccaauaa

SEQ ID NO: 32645 - RNA, 1647 nt, Artificial Sequence
  derived and/or modified sequence opt6 from capsid_protein__Norovirus__AHZ12737
augaaaauggcaucuaacgacgccgcaccaucaaaugauggagccgcaggacuagucccagaaauuaauucagaagcaauggccuuagaaccaguagcaggagcagcaauagcagcuccuuuaaccggucaacaaaacauaaucgacccauggauaaugaacaauuucguacaagcacccggaggugaauucacaguaucaccaagaaacucaccaggagaaguacuauuaaaccuagaauuaggaccagaaaucaacccuuaucuagcacaucuagcaagaauguacaauggauacgcaggaggauucgaaguucaaguaguacuugcaggaaaugcauuuacagcuggaaaaauaauauuugcagccauacccccaaauuucccaaucgacaaucuaucugcugcacaaauaacaauguguccacauguaauaguagaugucagacaacuagaaccaguuaauuuaccaaugccagauguccgaaauaauuuuuuccacuauaaucaaggcuccgacucaagacucagauuaauagcaauguuauacacaccucuccgagcaaauaacucaggagacgacguauuuacaguaucaugucguguauuaacaagaccaucacccgacuucucauucaauuuuuuaguuccucccaccguugaaucaaaaacuaaacccuucagccucccaauccuaacaaucuccgaaaugucaaauucaagauucccaguuccaauugacuccuuacacacaucaccaacagaaaauauugucguacaaugucaaaacggacgaguuacucuagauggagaauuaaugggaacuacacaauuguuaccaagucaaauaugcgcauuuagaggaacauuaacccgaucaaccucacgagcaucagaccaagcagacaccgcaacaccuagacuauucaacuauuacuggcauauucaauuagacaaccuaaauggaacaccuuacgacccagcugaagacauaccaggaccauuaggcacaccugacuuuagagguaaagucuucggaguagcaucccaaagaaaccccgaugcaacaacuagagcacaugaagcaaaaauagauacaacuucaggaagauucacaccaaaauuaggaucuuuagaaauaucaacagaaucagacgauuuugaucaaaaccaaccaacacgauucacaccaguuggaguaggaguagaccaugaaccggauuuucaacaauggguucucccagacuacgccggacaauucacacauaauaugaaccuugcaccagcaguagcaccaaacuuuccuggcgaacaacuacuauucuucagaucacaacuaccaaguucagguggaagaucaaacggcauacuagacugucuugucccacaagaauggguucaacacuuuuaccaagaaucagcuccuucucaaacacaaguagcacuaguuagauacguaaacccagacacaggccgaguucuauuugaagccaaauuacauaaacuagguuuuaugacaauagcaaaaagcggugacucaccaauaacagucccaccuaacggcuauuuccgauuugaaucauggguaaauccauuuuacacauuagcaccaaugggaaccggcaaugguagaagacgaauacaauaa

SEQ ID NO: 32646 - RNA, 1647 nt, Artificial Sequence
  derived and/or modified sequence opt6 from capsid_protein__Norovirus__AHZ12738
augaaaauggcuucaaaugacgcaacgccaucaaaugacggugcagccggucuuguaccugaaaucaacaaugaagcaauggccuuagacccagucgcuggcgcagccauagcagcaccucucacaggacaacaaaauauaaucgacccauggauuaugaauaacuuuguacaagcacccggaggagaauuuacagucucgccgaggaauucaccaggagaaguauuauuaaauuuagaacuaggccccgaaauaaauccauauuuagcucaccuagcccgaauguauaacggauacgccggagguuucgaaguacaaguaguacuagcaggaaaugcauucacagcaggaaaaauaauauucgcugcuauacccccaaacuuucccaucgauaaccuaucagccgcacaaauuaccaugugcccacacguaauaguagacgucagacaacuagaaccaguuaaucuaccuaugcccgauguccgaaacaauuuuuuucacuacaaucaagguucagauucaagacuaagacucguagcaaugcuauauacaccuuuacgagcuaauaacucaggcgaugacgucuuuacaguauccugcagaguacuaacaagaccaucaccagaauuuucauucaauuuuuuaguacccccuacaguagaaaguaaaacaaaaccauucacauuaccuauacuaacaauauccgaaaugucuaacucacgauuucccguuccaauagacucacuacauacaucaccaacugaaaacauaguaguacaaugccaaaauggaagaguuacauuagacggagaacuuaugggaacaacacaacuccuaccuucucaaaucugcgcauucagaggaguacuaacaagaucaacaucaagagcauccgaucaagcugacacagcuacaccaagacucuuuaauuauuacuggcacauacaacuagacaacuuaaacgguacaccauacgauccagcagaagauauaccagguccacuuggaacaccagauuucagaggcaaaguuuucggagucgcaucacaaagaaaucccgacucaacaacaagagcacacgaagcaaaaguagacacaacagcagguagauucacaccaaaacuaggaucauuagaaauaucaacugaauccggagacuucgaucaaaaccaacccacaagauuuacaccaguuggcauagguguugaccacgaagcagauuuucaacaauggucucuaccugacuacucuggucaauuuacacacaauaugaaucuagcaccagcaguagccccaaauuuuccuggugaacaacuauuauucuuuagaagccaacuaccaucuucaggaggaagaucaaacggaauacuagauugcuuaguuccucaagaauggguacaacauuuuuaccaagaaucagcaccagcccaaacacaaguagcacuaguaagauauguaaauccugacacaggaagagucuuauuugaagcaaaacuacauaaacuuggauucaugacaauagccaaaaauggagacucacccauuacaguuccacccaauggauauuuuagauucgaauccuggguuaacccauucuacacacuagcaccaaugggaacaggaaauggaagaagaagaguccaauaa

SEQ ID NO: 32647 - RNA, 1647 nt, Artificial Sequence
  derived and/or modified sequence opt6 from capsid_protein__Norovirus__AHZ12739
augaaaauggcauccaacgaugcaacaccuaguaaugacggggcagcaggccuuguaccagaaauaaauaaugaagcuauggcacuagacccagucgcaggagccgcaaucgcagcaccauuaacaggacaacaaaauauaauugauccauggauuaugaacaacuucguccaagcacccgguggugaauuuacaguaucaccuagaaauaguccuggcgaaguuuuacuuaacuuagaacuaggcccagaaauaaacccauaucuugcucacuuagcaagaauguauaacgguuacgcagguggauuugaaguacaaguaguacuugcagguaaugcauucacagcuggaaaaauaauauucgcagcaauuccaccuaacuucccgauugacaauuuaucugcagcccaaauaacaaugugcccacauguuauaguagacguaagacaacuagaacccguuaaccuuccaaugccagauguaagaaauaauuuuuuccauuauaaucaaggaucugacucaagacuaagauuaguagcgaugcucuacaccccauuaagagcaaauaauucaggagacgauguauuuacuguaucauguagaguucuaacuagaccaagcccagaauuuucauucaauuucuuaguaccuccaacaguugaauccaaaacaaaaccuuuuacacuacccauucuaacaauuuccgaaaugucuaacucaagauucccaguaccuauagacucucuucauacaagucccacagagaauaucguaguacaaugccaaaacgguagaguaacauuagauggagaauuaauggguacaacacaacuacuuccuucucaaauaugugcauuuagaggaguacuaacacgaucaacaucaagaacaucagaccaagcagacacagcaacaccaagauuauucaauuauuauuggcauauacaauuagauaauuuaaauggaaccccauacgaucccgcagaagacauaccaggcccacuugguaccccagacuuccgaggaaaaguauucggaguagcaucacaacguaaucccgauuccacaacaagagcccaugaagcaaaagucgauaccaccgcuggaagauucaccccaaaacuaggaagcuuagaaauaucaacggaaucuggugauuuugaucaaaaucaaccaacaagauucacucccguaggaauuggaguagaccaugaagcagacuuucaacaauggucauuaccugacuauucaggucaauucacacauaacaugaacuuagcuccagcaguagcaccaaacuucccaggugaacaacuauuauucuucagaucacaauuaccuagcucaggcggacguucaaaugguauauuagacugcuuaguaccacaagaauggguacaacacuucuaucaagaaucugcaccagcacaaacucaagucgcacuagucagauaugucaauccugauacaggaagaguauuauuugaagcaaaacuacacaaauuagguuuuaugacaauagccaaaaacggugauuccccuauaacaguaccuccaaauggauacuucagauucgaaucauggguaaauccauuuuauacuuuagcccccaugggcacaggaaauggacgcagacgaguacaauaa

SEQ ID NO: 32648 - RNA, 1623 nt, Artificial Sequence
  derived and/or modified sequence opt6 from capsid_protein__Norovirus__AHZ12912
augaaaauggcauccucagaugccaacccaucagauggaagcacagcgaaccuaguaccagaaguuaauaaugaaguuauggcccuugaaccaguagucggagcagcuauagcugcucccguugcaggacaacaaaauguaauugacccauggauaagaaauaacuucguacaagcacccggaggcgaauuuacagucaguccuagaaaugcaccuggagaaauacuuuggucagcccccuuaggcccagaucuaaauccauaccucucacaccuagcaagaauguacaacggauacgcugguggauuugaaguacaaguaauacuagcaggaaaugcauuuacagcaggaaaaauaauauucgcagcuguaccaccaaauuucccaacagaaggauuaucuccaucacaaguuacaauguucccucauauaaucguagacguacgacaacuagaaccagucuuaauuccuuuacccgacguccgaaacaauuuuuaucacuacaaccaaucaaacgacuccacaauaaaauuaauagcuauguuauacaccccacucagagccaacaaugcaggugacgacguauucacaguaucuuguagaguacuaacuagaccauccccagacuuugacuuuauauuuuuaguaccccccacaguagaaucuagaaccaaaccauucucuguaccagucuuaacaguugaagaaaugacuaauucaagauucccuauaccccuagaaaaauuauuuacaggucccuccucugcauuuguuguacaaccccaaaacggucgauguaccaccgacgguguacuucuuggaacaacacaacuaagcccaguaaguaucuguacuuuuagaggagacguaacacauauuccagguucucacaauuacacaaugaaccuagcaucccaaaacuggaauucuuacgauccuacagaagaaauaccagcaccacuugguacaccagauuuuguaggaaaaauacaaggaguacuaacucaaacaacaagaacuaacgguucaacaagaggacacaaagcaacagucuauacaggaucagcugauuucucuccaaaacuuggaagaguacaauuugcaacagauacaaauaacgauuucgaaaccaaucaaaauacuaaauuuacuccaguugguguaauccaagacggaagcacuacaccaagaaaugaaccccaacaauggguccuaccaaguuauucuggucguaauauacauaacguccaucuagcucccgcaguagcaccuacauuuccaggagaacaauuacuauuuuuuagaucaacaaugccaggcugcucaggauauccaaauauggauuuagacuguuuacucccacaagaauggguccaauauuuuuaucaagaagcagcacccgcacaauccgacguagcacuacucagauuugucaacccagacacaggaagaguacuuuucgaaugcaaacuacacaagucagguuacguaacagucgcccacacaggacaacaugaucuaguaaucccaccaaauggauauuucagauucgacucauggguaaaucaauuuuacacauuagcuccaaugggaaaugguaccggaagaagaagagcucuuuaa

SEQ ID NO: 32649 - RNA, 1623 nt, Artificial Sequence
  derived and/or modified sequence opt6 from capsid_protein__Norovirus__AHZ12913
augaaaauggcaucaucagacgcaaacccaucagaugguucaacagccaaucuaguacccgaaguaaauaaugaaguaauggcauuagaaccaguaguaggcgccgcaaucgcagcaccaguagccggacaacaaaauguaauagauccauggauaagaaauaauuuuguucaagcaccagguggagaauucacaguauccccacgaaacgcaccaggagaaauccuuuggucagccccacuuggcccagacuuaaauccauacuuaagccaccucgcaagaauguacaauggauacgcaggaggauucgaaguacaaguuauacuagccggcaaugcauucacagcuggaaaaaucauuuucgcagcaguacccccaaacuuuccaacagaaggauuaaguccaucucaaguuacaauguucccacauauuauaguugauguaagacaacucgaaccaguauuaauacccuuaccagacguaagaaauaauuucuaucauuauaaucaaucaaaugauucaaccaucaaauuaauagcaaugcuauacacaccacuuagagcaaacaaugcaggugacgaugucuuuacuguuucauguagaguccuaacaagaccgagcccagauuuugacuucauauuccuagucccuccaacaguagaaagucggacaaaaccauuuuccguaccaguuuuaaccguagaagaaaugacuaacucuagauuucccauaccacucgaaaaacuauuuacaggacccucuagugccuuuguaguacaaccccaaaacggacgauguacuaccgauggaguauuauuaggcacaacacaacucucuccuguaucuauauguacauuuagaggcgacgucacacauauuccugguucucacaacuauacuaugaaucuagcuagccaaaacuggaauuccuacgauccaaccgaagaaauucccgcaccccuaggaacaccagacuucgucgguaaaauacaaggaguacuaacccaaacaacacgaacaaacggauccacaagaggacacaaagcuacuguauacacaggaucagcagauuucucaccaaaacuuggaaggguacaauucgcuacagacacaaauaacgauuuugaaacaaaccaaaauacaaaauuuacuccaguaggagucauacaagacggaaguaccaccccaagaaaugaaccacaacaauggguacuaccuucauauucagguagaaauauucauaacguacacuuagcaccagcaguagcaccaaccuuuccuggagaacaacuccuauucuuuagaucuacaaugccaggauguucaggcuacccaaacauggaucuagauugcuuacuaccacaagaauggguacaauacuucuaccaagaagcagcaccagcacaaucagaugucgcacuacuacgauuuguuaacccugacacuggaagaguauuauucgaaugcaaauuacauaaaaguggauauguaacuguugcacacacaggacaacacgauuuaguaauaccaccaaauggauauuuccgauucgauaguuggguaaaucaauucuauacccuugcaccaaugggaaauggaacuggccgaagaagagcacuauaa

SEQ ID NO: 32650 - RNA, 1623 nt, Artificial Sequence
  derived and/or modified sequence opt6 from capsid_protein__Norovirus__AHZ12998
augaaaauggcaucaucagacgcaaauccgucagauggaucaacagcaaaucuuguaccagaaguaaacaacgaaguaauggcacuugaaccagucguaggcgcagcaauagccgcuccaguagcaggacagcaaaacguaauagauccauggauaaggaauaacuucguacaagcaccaggcggcgaauuuacaguuaguccccguaaugcaccaggggagauauuauggucagcaccauuaggaccagauuuaaacccauaccuaucacaccuagccagaauguauaacgguuacgcaggaggauuugaaguccaaguaauucuagcaggaaacgcauucacagcaggcaaaauaauauucgcagcaguacccccuaauuuuccaacugaaggacuauccccaucucaaguaacaauguucccacauauaauuguagacgucagacaauuagaaccaguacuaauaccacuaccagauguaagaaacaauuuuuaucacuauaaucaaucaaaugauccuacaauaaaacuaauagcuauguuauauacuccacuaagagcaaacaaugcaggugaugaugucuuuaccguaucauguagaguauugaccagaccaucccccgauuuugacuuuauauuuuuaguaccaccaacaguagaauccagaacaaaaccauuuucagucccaguauuaacaguagaagaaaugacaaauucaagauuuccuauuccucuagaaaaauuauuuacagguccaucauccgcauucguaguacaaccacaaaaugguagaugcaccacagacggagugcuacuuggaacaacacaacuauccccaguaaauauauguacauuucgaggagauguaauacauauaucaggaucuagaaauuacaccaugaauuuagcaagucaaaauuggaacucuuacgauccuacagaagaaauacccgccccacucgguacaccagacuucguagguaagauccaaggaguauuaacacaaacaacacgaacaaacggauccacacguggucauaaagcaacaguuuauacuggauccgcugacuuuucaccuaaacuaggaagaguacaauuugccacugacacagauaaugacuucgaaacaaaucaaaauacuaaauucacaccaguaggaguuauacaagacggaucuacuacaccacgaaaugaaccucaacaauggguucuacccucuuauagcgguagaaauauacauaauguacaccuagcccccgcaguugcaccaacauuuccaggagaacaacuacuuuuuuuuagaucuacaaugccaggaugcaguggcuacccaaacauggaucuagacugccuucuaccacaagaauggguacaauauuuuuaucaagaagcagcaccagcacaaucagacguagcuuuacuuagauuuguuaauccagacacaggcagagucuuauucgaaugcaaacuacauaaaucaggauaugucacagucgcacacacaggacaacacgauuuaguaauaccaccaaacggcuacuucagauucgacagcuggguaaaucaauuuuauacauuagcuccaaugggaaauggcacaggacgccgacgugcacuauag

SEQ ID NO: 32651 - RNA, 1623 nt, Artificial Sequence
  derived and/or modified sequence opt6 from capsid_protein__Norovirus__AHZ13001
augaaaauggcauccuccgaugcaaacccuucagauggaucaacagcaaaucuaguuccugaaguuaacaacgaaguaauggcuuuagaaccuguaguaggagcagcaaucgcagcaccagucgcaggacaacaaaaugucauugacccauggauuagaaauaacuucguacaagcaccuggaggggaauucaccgucucaccacgaaaugcaccuggagaaauauuaugguccgcaccucuaggaccagaccucaauccauaucuaucacauuuagcaagaauguauaacggauaugcuggaggauuugaaguucaaguaauauuagcaggaaaugccuuuaccgcaggaaaaauaauuuucgcagcaguacccccuaacuuccccacagaaggacuaucacccucacaagucaccauguucccacacauaaucguugauguacgacaacucgaaccugucuuaauacccuuaccagacguucgaaacaauuuuuaucacuacaaccaaucaaaugacccgacaauaaaauuaaucgcaaugcuauacacacccuuacgagcaaauaaugccggagaugacguauuuaccguaucaugucgaguacuaacaagacccucaccugauuuugauuuuauuuuucuaguaccaccaacuguugaauccagaacaaaaccauuuucaguaccuguucuuaccguugaagaaaugacuaauucacgauuuccaauaccuuuagaaaaacuauuuaccggaccaucaucagccuuuguuguucaaccccaaaacggcagauguacaacagacgguguacuauuaggaacaacacaauuaucuccaguaaauaucuguacauucagaggagacguuauucauauauccggcucacgaaauuacacaaugaaucuagcaucacaaaauuggaacucauaugaccccacugaagaaauaccagcaccccuagguacaccagauuuuguaggaaaaauacaaggaguauuaacacaaacaacaagaacuaacggaucaacaagaggucacaaagcuacagucuacacaggauccgccgacuucucaccuaaauuaggaagaguccaauuugccacagacacagacaacgacuucgaaacaaaucaaaauacaaaauuuacuccaguuggcguaauacaagaugguucaacaaccccacgaaacgaaccacaacaauggguuuuaccuucauacucuggaagaaacauacauaacguacacuuagcacccgcuguagcaccaacauucccaggagaacaacuacucuucuuccgaucaacaaugccaggauguucaggcuauccaaacauggaccuagauugucuacuaccacaagaauggguucaauauuucuaccaagaagcagcaccagcccaaucagacguagcauuauuaagauucgucaacccagacacagggcgcguccuauuugaauguaaauuacauaaaucagguuacguaacaguagcucacacaggacaacacgacuuagugauuccaccaaauggauauuuucgauucgauuccuggguuaaccaauuuuauacacuugcacccaugggaaaugguacuggaagaagacgcgcacuuuaa

SEQ ID NO: 32652 - RNA, 1623 nt, Artificial Sequence
  derived and/or modified sequence opt6 from capsid_protein__Norovirus__AHZ13004
augaaaauggcuucaucagacgcaaacccaucugacggaucaaccgcaaaccuaguaccagaaguaaacaaugaagucauggcacuagaacccguaguaggagcagcaauagcagcaccaguagcuggacaacaaaacguaauagaucccuggauacgaaauaacuuuguucaagcaccaggaggagaauuuaccgucucaccaagaaacgcaccaggagaaauacuuuggucagcaccccucgguccagaucuaaacccauaucuuucccaccuagccagaauguauaacggauacgcaggaggauucgaaguacaaguaauauuagcaggaaaugcauuuacugcuggcaaaauaauauucgcagcagucccacccaacuucccaacagaaggacuaaguccaucacaaguuaccauguucccacacaucauaguugauguaagacaacuagaacccguauuaauaccacuuccagaugucagaaacaauuucuaucacuauaaucaauccaaugacccaacaauuaaauuaauagccaugcuuuacacaccacuaagagcuaauaaugcaggagacgacguauuuacaguaucaugcagaguacuaacccgaccauccccagauuuugacuuuauauuccucguaccaccaacaguugaauccagaacaaaaccauuuucuguacccguacuaacaguugaagaaaugaccaacucaagauucccaauaccccuagaaaaacuauucacaggaccuucaucagcuuuuguaguacaaccacaaaacggcagauguaccacugacgguguauuacuagguacaacacaauuauccccaguaaacauauguacuuucagaggagauguuauacacauaagcggauccagaaauuacacaaugaaccuagcaucgcaaaacuggaauucauaugacccaacugaagaaauaccagcaccauuaggaaccccugacuuugucggaaaaauacaagguguauuaacacaaacaacccgaacuaauggaucaacaagaggucauaaagcaacaguauauacaggauccgcagacuucaguccuaaauuaggacgaguucaauuugcuacagauacagauaaugacuuugaaacaaaucaaaacacaaaauucacuccuguaggaguuauacaagacggauccacaacaccucgaaaugaaccacaacaauggguucuaccaucauacucaggucguaauauacauaacguacaccuugcaccagccguagcaccaacauucccaggagaacaacuauuauucuuccgcucaacaaugccagguugcucugguuauccaaauauggauuuagauugccuacuaccacaagaauggguccaauauuucuaucaagaagcugcacccgcacaaucagauguagcccuccuacgauuuguaaauccagacaccggaagaguacuuuuugaauguaaacuacacaaaucuggauauguaacagucgcucauaccggacaacacgauuuaguaauuccgccaaacggauacuucagauuugacucaugggucaaucaauucuacacguuagcccccaugggaaauggcacaggccgaagaagagcacuauaa

SEQ ID NO: 32653 - RNA, 1623 nt, Artificial Sequence
  derived and/or modified sequence opt6 from capsid_protein__Norovirus__AHZ13010
augaaaauggcaaguucugaugcuaacccaagugacggaucuaccgcaaacuuaguaccagaaguuaacaaugaagucauggcacuagaaccaguaguaggugcugcaauagcagcaccaguugcaggccaacaaaaugucauugauccauggaucagaaacaacuuuguacaagcaccaggaggagaauuuaccguaucuccuagaaacgcaccaggagaaauacuauggucagcuccccuaggaccugaucuaaacccauacuuaucacacuuagcaagaauguacaacggauaugcuggugguuuugaaguacaaguaauauuagcagguaacgcauuuacagcaggcaaaauaauauucgcagcaguuccaccuaacuuuccuacggaggguuuaucaccaagccaaguuacaauguuuccacacauuauaguugacguaagacaacuugaaccgguacuuauuccucugccagacguaagaaacaauuuuuaucacuacaaccaauccaacgacccaaccauaaaacuuaucgcaauguuauacacaccacuacgugcaaacaaugcaggagaugacguauuuacaguuucaugccguguauuaacacgaccaucaccagacuuugacuuuauauuccuaguaccaccaacaguagaauccagaacaaaaccauucucaguaccaguucuaacaguugaagaaaugacaaacucaagauucccaauuccacuagaaaaacuauuuacaggaccaucuucagcauucgucguacaaccacaaaacggaagauguacaacugaugguguacuacucggaacaacacaacuaagcccaguuaacaucuguacauuucgaggagacguaauacacauaucaggaucacgaaacuauacaaugaacuuagccucccaaaacuggaauucauaugauccaacagaagagauaccagcaccauuaggaacuccagacuuuguaggaaaaauucaaggcguacucacacaaacuacaagaacgaacggaucaacuagaggccauaaagcaaccguauauaccggaucagcagacuuuucaccaaaauuaggaagaguucaauucgcaacugauacagacaaugacuucgaaacaaaucaaaauacaaaauuuacacccguagguguaauacaagacggaagcacaacacccagaaaugaaccccaacaauggguacucccaucauauucaggcagaaauauacauaacguacacuuagccccugcaguagcaccuaccuucccaggagaacaacucuuauucuuccguucuacaaugccagguugcuccgguuauccaaauauggaucuagauugucuacuaccacaagaauggguacaauauuuuuaccaagaagcagcuccagcacaaagcgacgucgcacuacuaagauucguuaaucccgacacaggacgcguucuauuugaaugcaaacuacauaaaucuggauacguaacaguagcacauacaggccaacacgaucuaguaauaccaccaaacggauauuuuagauucgauucaugggugaaccaauuuuacacacuagcucccaugggcaacggaacaggaagacgcagagcacuauaa

SEQ ID NO: 32654 - RNA, 1623 nt, Artificial Sequence
  derived and/or modified sequence opt6 from capsid_protein__Norovirus__AHZ13015
augaaaauggcaucaucagacgcaaacccaucagauggaucuacagcaaacuuaguaccugaagucaacaaugaaguaauggcauuagaaccagucguaggagcugcaauagcugcaccaguugcaggccaacaaaauguaauugacccauggauaagaaacaacuuuguacaagcaccuggaggcgaauuuacaguaucaccacgaaacgcccccggagaaauuuuauggucugcaccccucggaccagaucuaaauccauaccuaucucacuuagcacgaauguauaacggauacgccggaggauucgaaguacaaguaauucuagccgguaaugcauucacagcaggaaaaauaauuuuugcugcagucccaccaaacuucccaacagaagguuuauccccuucacaaguaaccauguuuccacacauaauaguugacguuagacaauuagaaccuguucuuauaccucuacccgauguuagaaauaauuucuaucauuauaaccaauccaaugacccaacuauaaaauuaaucgcuauguuauacacaccauugagagcaaacaaugcaggagaugacgucuuuacaguuucauguagaguauuaacacgccccucaccagacuucgacuuuauauucuuaguacccccaacaguagaaucuagaacaaaaccauucucagucccaguauuaaccguagaagaaaugacuaauucaagauucccuaucccauuagaaaaauuauuuacuggaccauccucagcauuuguuguucaaccccaaaacggaagauguacaacagacggaguucuacuaggaaccacacaauuaucacccguuaauaucuguacauucagaggagacguaauacauauuucaggaaguagaaauuacaccaugaauuuagcaucacaaaacuggaacucuuaugauccaacagaagaaauaccagcaccacuagguaccccugacuuuguaggaaaaauacaaggaguacuaacacaaacaacaagaacaaacggauccacaagaggccacaaagcaacuguauacacagguucugcagauuucucacccaaauuaggcagaguucaauucgccacagauacagacaacgacuucgaaaccaaucaaaacacaaaauucacacccguaggcguaauucaagacggcucuacuacaccaagaaaugaaccucaacaauggguucuaccaucauacuccggaagaaauauacauaacguacacuuagcaccagccguagcaccaacauuucccggagaacaacuauuauuuuuccguucaacaaugccaggauguucuggauauccaaauauggaucuagacugucucuuaccacaagaauggguacaauacuuuuaucaagaagcagcuccagcacaauccgauguagcacuuuuacgcuuuguaaauccagacacuggcagaguacuauuugaaugcaaacuucauaaaucuggauauguaacuguagcucauacuggucaacacgaucucgucauaccaccaaacggauauuucagauucgauuccuggguaaaucaauuuuacacacuagcuccaaugggaaacggaacaggaaggagaagagcacuuuaa

SEQ ID NO: 32655 - RNA, 1623 nt, Artificial Sequence
  derived and/or modified sequence opt6 from capsid_protein__Norovirus__AHZ13020
augaaaauggcaucaucagacgcaaauccgucagauggcucaacagcaaacuuaguuccagaaguaaacaaugaaguaauggcccuagaacccguaguaggagcugcaauagcugcaccaguagcaggacaacaaaacguaauugacccuuggauaagaaauaacuuuguacaagcaccaggaggagaauuuacaguaaguccaagaaaugcaccaggcgaaauacuauggucagcuccucuaggucccgaccuaaauccauaucuaucccaucuagcaagaauguauaacggauacgcaggaggcuucgaaguacaaguaauauuagcgggaaaugcauucacagcuggaaaaauaauauucgcugcagucccaccaaacuuucccacagaaggacuuuccccaucacaaguaacaauguuuccucacauaauaguagacguaagacaauuagaacccguauuaauuccacuaccagauguaagaaacaauuuuuaccacuauaaccaaucaaaugacccaacaaucaaauuaauagcgauguuauacaccccauuacgagcuaacaaugcaggagacgauguauuuacaguaucuugccgaguacucacuagacccucuccugacuuugacuucauauuucuuguuccuccaacuguagaaaguagaacuaaaccauucucaguaccaguacuaacaguagaagaaaugaccaacucaagauuuccaauaccacuagaaaaauuguucacaggaccaucaagugcauuuguuguacaaccccaaaauggcagauguacuacagacggaguuuuacuaggaacaacacaauuaucuccuguuaauauauguaccuucagaggagauguaauccauauaucugguagcagaaacuacacaaugaauuuagcuucccaaaacuggaacaguuaugauccaacagaagaaauaccagcaccacucggaacuccagacuuuguagggaaaauucaaggcguucuaacccaaacuacacgaacaaauggaucuacaagaggucacaaagccacuguauauaccggaucagcagacuuuucacccaaacugggaagaguacaauucgcuacagauacagacaacgauuucgaaacaaaucaaaauaccaaauuuacaccaguaggagucauccaagauggaucaaccacaccuagaaacgaaccacaacaauggguacuacccucauauucuggaagaaacauacauaauguacaucuagcaccugcagucgcaccaacauuuccuggcgaacaacuauuauucuuuagaucaacaaugccaggaugcucugguuacccaaauauggaucucgauugcuuauuaccucaagaauggguacaauauuuuuaucaggaagcagcaccagcucaaucagacguagcauuacuaagguucguuaauccagacacaggaagaguccuauucgaaugcaaacuacacaaauccggauauguaacaguagcacacacaggucaacaugaccuaguaauaccaccaaacggauacuucagauucgacucauggguaaaucaauuuuacacauuagcaccaaugggaaaugguacagguagacgacgugcuuuauga

SEQ ID NO: 32656 - RNA, 1623 nt, Artificial Sequence
  derived and/or modified sequence opt6 from capsid_protein__Norovirus__AHZ13023
augaaaauggcuuccucagaugcaaaccccagcgauggaucaaccgcaaaccuaguaccagaaguaaacaacgaaguaauggcacuagaaccaguaguaggagccgcaauagcagcaccaguagcgggacaacaaaauguaauagaucccuggauucgaaauaauuuuguacaagcaccuggcggagaauuuacaguaucaccgagaaacgcuccaggagaaauauuauggucagcaccacuaggaccagaucucaaucccuacuuaucccaccucgccagaauguauaauggauacgcuggaggauuugaagugcaaguaauacuagcaggaaacgcauuuacagcuggaaaaauaauauuugcagccguaccaccaaauuuuccaacugaaggacuaucacccucacaaguaacuauguuuccacauauaauaguagauguacgacaacuagaaccuguacuuauaccauuaccagaugucagaaacaacuucuaucauuauaaccaaagcaaugauccaacaauaaaauuaauagcaaugcuauacacaccauuaagagcaaauaaugcuggcgacgacgucuuuaccguuuccugcagaguacucacuagaccaucucccgauuucgacuuuauuuuucuaguaccccccacaguagaauccagaacaaaaccauucucaguaccaguacuaacuguugaagaaaugaccaauagucgauucccaauuccauuagaaaaacuauucacaggaccauccucugcauuuguaguacaaccacaaaacggccgauguacaacagacggaguauuauuaggaacaacacaauuaagcccugucaacauauguaccuucagaggagauguaauacauauuuccggaucucgaaauuacacaaugaauuuagcaucacaaaacuggaauuccuaugacccaacagaagaaauacccgccccauuagguacaccugacuuuguaggcaaaauacaaggaguuuuaacucaaacuacaagaacaaacggaagcacaagaggucauaaagcaacaguuuauacaggaucagcagauuucuccccaaaacuaggaagaguacaauuugcaacugauacagacaaugacuucgaaacaaaucaaaacaccaaauuuaccccaguaggaguaauacaagacggaucuaccacuccaagaaaugaaccccagcaauggguacugccauccuacucagguagaaauauacauaacguacauuuagcaccagcaguagcaccaacuuuuccaggagaacaauuauuauuuuucagaucuacaaugccaggcuguucaggauaccccaacauggaccuagauugucuacuaccacaagaaugggugcaauauuucuaccaagaagcagccccagcucaaucugacguagcauuacucagauuuguuaauccagacacugguagaguacuauucgaauguaaacuacauaaaucaggauauguaacaguagcccacacaggacaacaugaccuaguuauaccuccaaacggcuauuuuagauuugauucauggguaaaucaauuuuacacucuagcaccaaugggcaacggcacaggaagaagacgagcucuuuaa

SEQ ID NO: 32657 - RNA, 1545 nt, Artificial Sequence
  derived and/or modified sequence opt6 from capsid_protein__Norovirus__AIC32559
auggcacuagaacccguaguaggagccgcaauagcagcaccuguagcaggacaacaaaacguaauagacccauggauaagaaacaacuuuguacaagcaccuggaggugaauuuacuguaagcccuagaaacgcaccaggagaaauauuauggagugccccacuaggcccagaccuaaaucccuaucucucacauuuagcaagaauguauaauggauaugcagguggauucgaaguccaaguaauccuagcaggaaaugcauuuacagcuggaaagguaauauuugcagcuguuccaccuaacuuuccaacagaaggucuuucaccaucacaaguaacuauguucccucacauaguaguagacguaagacaacuagaaccaguauuaaucccccuaccagauguaagaaacaacuucuaucauuauaaucaaucuaacgaccccaccauaaaauuaaucgcaauguuauauacuccauuaagagcuaacaacgcaggugaugaugucuuuacuguaucauguagaguauuaacaaggccaucacccgauuucgauuuuauauuucuuguacccccuacaguagaauccagaacaaaaccauuuucagucccaguuuuaacaguagaagaaaugacaaauucuagauucccaauaccauuagaaaaacuauucacuggaccaucgucagcauuuguaguacaaccacaaaauggaagauguacuacagacgguguacuacuaggaacaacacaacuaucuccaguaaauauauguaccuuucgaggagacguaacacauauaacuggaucaagaaauuauacaaugaauuuagccucacaaaacuggaacaacuacgauccaacugaagaaauaccagccccacugggugcaccagacuucguaggcaaaauacaaggcauguuaacucaaacuacacgagcagauggcucaacacgaggucacaaagcaacaguauauacagguucagccgacuuugccccuaaacucggcagaguacaauuugaaacagauacugaucaugauuucgaagcaaaucaaaauaccaaauucacaccaguugguguuauacaagacggauccacaacacauagaaaugaaccacaacaauggguauuaccuucauauuccgguagaaacacacauaacguacaccuagcaccagcaguugcaccaacauuuccaggugaacaacuauuauucuuucgaucuacaaugcccgguugcuccggauauccaaauauggauuuagauugcuuacuaccccaagaauggguacaauauuucuaucaagaagcagcuccagcacaaucagacguugcacucuuaagauucguaaauccagacacuggacgaguauuauuugaaugcaaauuacauaaaucuggauauguaacaguugcucacacaggacaacacgaucuagucauaccaccaaauggauauuuccgauuugauucaugggugaaccaauucuacacauuagcaccaaugggaaauggagcaggaagaagaagaguaguauaa

SEQ ID NO: 32658 - RNA, 1617 nt, Artificial Sequence
  derived and/or modified sequence opt6 from capsid_protein__Norovirus__AID51474
auggcuucaaaugacgcaaccccauccaaugacggagcagcugggcuaguuccagaaucuaauaaugaagcaauggcacuagaacccguaguaggagcaucuuuagcagcuccaguaacaggacaaacaaauauuauugauccuuggauucgaacaaacuucguucaagcaccuaacggagaauuuacaguuucaccucgaaacucacccggagaaauauuaguuaacuuagaauuaggcccagaauuaaacccuuacuuagcucaucuugcaagaauguacaacgguuaugcagguggaauggaaguacaaguaaugcuagcuggcaaugccuucacagcaggaaaaauaauuuuugcagcuguuccaccauacuuuccaguugaaaauuuaagcccaucacaaauaacaauguuuccccacguuauaauugacguaagaacucuagaaccaguauuacuucccaugccagauguaagaucgacacuauuccacuuuaaucaaaaagaugaaccaaaaaugcgacuuguugcaaugcuuuauacacccuuacgaucaaacgguucaggagacgauguauucacuguaucauguagaauuuuaacaagaccaucaccagaauuugauuucacuuauuuaguuccaccuacaguagaaucaaaaacaaaaccauuuacacuucccguacucacuuuaggagaauuaagcaacucucgauuucccuuaucaauagacgaaaugguaacaucaccaaaugaaucuauaguuguacaaccccaaaacggaagaguaacauuagauggcgaacuacucggaacaacacaacuucaagcauguaauauauguuccauacgaggaaaaguaaccggacaaguaccaaaugaacaacacauguggaauuuagaaauaacaaauuuaaauggaacacaauuugauccaacagacgacgucccagcaccucuaggagucccagacuuugcaggagaaguuuuugguguacuaucacaaagaaaucgaggagaaucuaauccagcaaauagagcacacgaugccguaguagcaacauauucagauaaauauacaccaaaguuaggccuaguacaaauaggcacuuggaacacaaaugauguagaaaaucaaccaacaaaauucacaccaaucggacuaaacgaaguagcaaacggacauagauuugaacaauggacacuaccacgauauuccggugcauuaacacucaauaugaaccuugcaccugcaguagccccauuguuuccaggagaaagacuauuauuuuucagaucauaugucccacuaaaaggaggcuuugguaacccagcaauagauugcuuagucccacaagaauggguccaacacuucuaucaagaaucagcuccaucauuaggugauguugcauuaguucgauauguaaauccagacacagguagaguucuauucgaagcaaaauuacacaaaggaggauuuuuaacaguaucaucaacaaguacuggaccaguuguaguuccugcaaacggauauuuccgauucgauucuugggucaaccaauuuuauucacuugcaccaauggguacuggaaacggaagaagaagauuccaauaa

SEQ ID NO: 32659 - RNA, 1617 nt, Artificial Sequence
  derived and/or modified sequence opt6 from capsid_protein__Norovirus__AID51477
auggcaucuaaugaugcuacaccaucaaaugacggagcugccggcuuaguuccagaaucuaacaacgaagcaauggcauuagaaccuguaguaggagcuucauuggcagcaccaguaacaggacaaacaaauauaaucgauccauggauaagaaccaauuuuguacaagccccuaauggugaauuuacaguaucaccacgaaacucaccuggugaaauauuaguaaauuuagaacuaggacccgaauuaaauccauaucuagcacaucuagcuagaauguacaauggauaugcuggagguauggaaguacaaguuaugcuagcaggaaaugcauuuacagcagguaaaauaauuuuugcagcugucccaccauauuuuccaguugaaaaucuaucccccucucaaauaaccauguuuccacauguaauaauagacguccgcacauuagaaccaguucuacuaccuaugccagauguaagauccacauuauuucacuuuaaucaaaaagacgaaccuaaaaugagauuaguugcuaugcuauauacaccacuacgaucuaauggauccggagaugacguauuuacaguuuccugccgaauauuaacaagaccaaguccagaguuugauuuuacauaucuaguaccaccaacuguagaaaguaaaacaaaaccauuuacacuaccaguuuuaacccucggagaauuauccaacucucgauuuccacuauccauagaugaaaugguaacuucaccaaaugaaucaaucguaguacaaccacaaaacggucgaguuacauuagauggagaauuacuaggaacuacucaauuacaagcaugcaacauaugcucaauacgaggaaaaguuacuggccaaguuccaaaugaacaacauauguggaaucuagaaauaacaaaucuaaacggaacacaauucgacccuacagaugauguaccagcaccauuaggaguaccugacuuugccggagaaguauuuggaguauuaucacaacgcaaccguggcgaaucaaauccugcaaaucgagcacaugaugcagucguagcuaccuauucagauaaauacacacccaaacuagguuuaguccaaauagguacuuggaauacaaacgauguagaaaaucaacccacaaaauuuacaccaauaggacuaaaugaaguagcaaacggucauagauuugaacaauggacauuaccaagauauucaggagcacuaacguuaaauaugaacuuagcacccgccguugcaccacuauuuccaggagaaagauuacuuuucuuucgaucauaugucccauuaaaaggugguuucgguaacccagcaauagauuguuuaguaccacaagaauggguacaacacuuuuaucaagaaucagcaccuucacuaggagacguugcauuaguaagauauguuaauccugauacuggaagaguacuauuugaagcuaaacuccauaaaggagguuuuuuaacaguaaguucaacuucaacaggacccguaguuguaccagcaaauggauauuuuagauuugauucuuggguaaaccaauuuuauucauuagcaccaaugggaacagguaauggaaggaggagauuccaauaa

SEQ ID NO: 32660 - RNA, 1617 nt, Artificial Sequence
  derived and/or modified sequence opt6 from capsid_protein__Norovirus__AID51480
auggcuucuaaugaugcaacaccaucaaaugauggagcagcaggauuaguaccugaaucaaauaaugaagcuauggcacuugaaccaguaguuggagccucauuagcagcaccaguaacaggacaaacuaauauaauugauccauggauacgcacuaauuuuguacaagcuccuaauggugaauuuacgguaucccccagaaacucaccaggagaaauccuagucaacuuagaacuaggaccagaauuaaaucccuauuuagcacauuuagccagaauguauaacggcuaugcagguggaauggaaguacaaguaaugcuagcagguaaugcuuuuacagcaggaaaaauaauauuugcagcaguacccccuuacuuuccagucgaaaaccuaucaccaucacaaaucacaauguuuccacacguuauaauagauguaagaacauuagaaccaguauuacuacccaugccugauguuagaucaacucuauuccauuuuaaccaaaaagaugaaccaaaaaugagacuaguagccauguuauauacaccauuacgguccaacgguagcggugacgacguauuuacugucucauguagaauacucaccagaccuucaccagaauuugauuucacauaucuaguaccaccuaccguagaaagcaaaacaaaaccauucaccuuaccaguauuaacucuaggagaauuaucaaauucacgauuucccuuaucaauagaugaaaugguaaccucaccuaaugaaucaauuguaguacaaccacaaaacggaagaguaacuuuagauggagaauuacuaggcacaacucaauuacaagcuuguaauaucugcagcauaagaggaaaaguaacaggacaagugccaaaugaacaacacauguggaauuuagaaauaacaaacuuaaauggaacucaauuugacccaacugacgacguaccagcaccuuuaggagucccugacuuugcaggagaaguauuuggaguauuaagccaacgaaauagaggagaauccaauccagcuaaucgagcacacgacgcaguaguagccacauauuccgacaaauacacacccaaacuugguuuagugcaaauaggaaccuggaacacaaaugacgucgaaaaucaaccuacaaaauuuacaccaauaggcuuaaacgaaguagcaaacggccauagauucgaacaauggacauuaccaagauauagcggugcauuaacucuaaacaugaaccuugcaccagcagucgcaccacuauuuccaggugaaagauuauuauuuuuuagaaguuauguaccuuuaaaaggaggcuuugguaauccugcuauagauuguuuaguaccacaagaauggguucaacauuucuaccaagaaagcgcaccaucauuaggagacguagcacuaguaagauacguaaaccccgauacaggacguguucucuuugaagcaaaauuacauaaaggaggcuucuuaacuguaucaucuacauccacuggaccugucgucgucccagcaaauggauacuuuagauucgacucauggguaaaccaauucuacucuuuagcucccaugggaacaggaaauggaagaagaagauuccaauaa

SEQ ID NO: 32661 - RNA, 1617 nt, Artificial Sequence
  derived and/or modified sequence opt6 from capsid_protein__Norovirus__AID51483
auggcaucgaaugaugcaacaccaucaaaugauggagcagcuggacuagucccagaaucaaacaaugaagcuauggcacuugaaccaguaguaggagcaucuuuagcagccccaguaacaggacaaacaaauauaauagacccauggauacgaacaaacuucguacaagcaccuaacggugaauuuacaguaucaccucgaaacucaccuggagaaauacucguuaauuuagaauuaggcccagaauuaaauccauaucuagcgcauuuagcaagaauguauaacgguuaugcagguggaauggaaguacaaguaauguuagccggaaaugcauuuacugcagguaaaauaauauuugcugcgguaccaccauacuuuccaguagaaaauuuaaguccuucacaaauuacaauguuuccacauguaauaauagacguaaggacacuugaaccaguucuucucccaaugccagauguaagaucuacacuauuucacuucaaccaaaaagaugaacccaaaaugcgauuagucgcaaugcuauacacaccucuaagaucaaauggaucaggagacgacguauuuaccguaucaugccgaauacuaacacgaccuucaccagaauuugauuucacauacuuaguaccuccaacaguugaaucaaaaacaaaaccauuuacacuaccaguacuaacacuuggagaauuaaguaacucaagauuuccauuaucaauagaugaaaugguaacaucaccaaaugaaucaauaguaguucaaccucagaauggaagaguaacucuagacggagaauuguuaggaacaacacaacuacaagcauguaacauaugcucaauacgaggcaaaguaacuggacaaguaccaaacgaacaacacauguggaaccuggaaaucacaaaucuaaaugguacacaauuugacccaacagaugauguaccugcaccauuaggaguaccagauuucgcaggagaaguuuucggcguacuuagucaaagaaaccgaggagaaaguaaccccgccaaucgagcucaugaugccguuguagcuacuuauucagacaaauauacaccuaaacuuggacuuguacaaauaggaacauggaacacaaacgauguagaaaaucaaccaacaaaauuuacaccaauaggauuaaaugaaguugcaaauggacaucgauuugaacaauggacucuaccaagauacucaggagcauuaacauuaaacaugaaucuagcaccagcaguugcccccuuguuuccuggugaacgacuuuuauucuuccgaucuuacguaccucuuaaagguggauuugguaacccagcaauugauugucuaguaccccaagaauggguacaacauuucuaucaagaaucggcuccuagcuuaggcgauguagcauuaguuagauaugucaacccagacacuggaagaguauuauuugaagcaaaauuacacaaaggaggauucuuaacuguaaguucaaccucaacaggaccaguugucguaccagcaaacgguuauuucagauuugauagcuggguaaaucaauuuuauucacuugcaccaaugggaaccggaaacgguaggaggagauuccaauaa

SEQ ID NO: 32662 - RNA, 1617 nt, Artificial Sequence
  derived and/or modified sequence opt6 from capsid_protein__Norovirus__AID51486
auggcaucuaaugacgcaacacccucaaaugacggcgcagcaggguuaguaccagaauccaauaaugaagcaauggcauuagaaccuguuguaggugcaaguuuagcugcuccaguuacuggucaaacaaacauuauagacccauggauacgaacaaauuuuguacaagcaccaaacggcgaauuuacuguaucaccacgaaauucaccaggagaaauccuaguaaauuuagaauugggaccagaacuaaauccauauuuagcucauuuagcuagaauguauaacggauaugcagguggaauggaaguacaaguaauguuggcuggcaaugcauuuacagcuggaaaaauaauauuugcugccguaccaccuuauuuuccuguagaaaacuuaucaccaucgcaaauuacuauguuuccacacguaauaauagacguacgcacauuagaaccagucuuacuaccaaugccagauguaagaucuacacuauuucauuuuaaccaaaaagacgaaccaaaaaugagacuuguugcaaugcuauacacaccauuacgaucaaauggaucaggagaugauguauuuacgguaucauguagaauauuaacaagaccaagcccugaguuugauuuuacauauuuaguaccuccaacaguugaaucaaaaacgaaaccauuuaccuuaccaguauuaacuuugggugaacuaucuaacaguagauucccacuaucaauagaugaaauggucacaaguccuaaugaauccauuguuguacaaccucaaaacggaagaguaacucuugauggugaauuacuaggaacaacacaauuacaagcauguaacauauguucaauaagaggaaaaguaacaggacaaguuccgaaugaacaacauauguggaaucuugaaauaacuaaucuaaauggaacacaauuugauccaacagaugauguaccugcuccacuaggaguacccgauuuugccggagaaguauuuggaguauuaucucaacgaaauagaggugaaucaaacccagccaauagagcacaugaugcugucgucgcuacauacucagacaaauacacaccaaaauuaggacucguacaaauuggaacauggaacacaaaugauguugaaaaucaaccaacaaaauucacaccaauaggacuuaaugaaguagcaaacggacacagauuugaacaauggacacuaccaagauauuccggugcacuaacacuuaauaugaacuuagcaccugcaguagccccacuauuuccaggagaaagacuacucuucuuuagaucauacguaccauuaaaaggaggauuuggaaauccagcuauagacugccuaguaccacaagaauggguucaacauuucuaccaagaaucagcgccuucccuaggagacgucgcucugguucgauauguuaacccugauacuggccgaguacuauuugaagcaaaacuacauaaaggaggcuuccuaacaguaucauccacaucuacaggaccuguuguuguaccagcaaacggauacuucagauucgacucauggguuaaucaauucuacucauuagcaccaaugggaacaggaaauggcagaagacguuuucaauaa

SEQ ID NO: 32663 - RNA, 1617 nt, Artificial Sequence
  derived and/or modified sequence opt6 from capsid_protein__Norovirus__AID51489
auggcuucuaaugaugcaacaccaucaaaugacggagcagcuggucuaguaccugaaucaaacaaugaagcaauggcucucgaaccaguaguaggagcaagucuagccgcaccuguaacaggccaaaccaauaucauugacccauggauacguacaaauuucguacaagcuccaaauggagaauuuacaguaucuccaagaaauucaccaggagaaauucuaguaaaucuagaauuaggaccagaacuaaacccauacuuagcacacuuagccagaauguauaaugguuaugcaggugguauggaaguacaaguaaugcuagcuggaaaugcauucacagccggaaaaauaauauuugcugcgguuccaccauacuucccaguagagaacuuaagcccaucgcaaauaacaauguuuccucacguaaucauagauguaagaacuuuagaaccaguauuacuaccuaugccagauguacguucgacauuauuucauuuuaaucaaaaagacgaaccaaaaaugaggcucguagccaugcuauauacaccacuuagaucuaacggaaguggagaugauguauucacaguaaguuguagaauacugacaaggccauccccagaauuugauuuuacauauuuaguaccuccaacaguagaaucuaaaacaaaaccauuuacacuuccuguuuuaaccuuaggcgaacuaagcaauucucgauuucccuuaucaauagaugaaaugguaacaucucccaaugaaucaauaguaguacaaccacaaaacgguagaguaacauuagauggcgaauuacuaggcaccacacaauuacaagcuugcaauauauguucaauucgagguaaaguaacaggacaagucccaaaugaacaacauauguggaauuuagaaauaacaaaucuaaaugguacacaauuugauccaacagaugacguaccagcuccacuuggaguaccagacuucgcaggagaaguauuugguguauuaucucaaagaaauagaggugaauccaacccagcaaauagagcacaugacgcaguaguagcaacauauucugauaaauacacuccuaaacucgguuuaguccaaauagguacauggaacacaaaugauguagaaaaccaaccaacaaaguucacaccaauaggacuaaaugaaguagcuaacggacacagauucgaacaauggacuuuaccaagauauucaggagcacuuacacuuaauaugaauuuagcuccagcaguagccccucuauuucccggagaaagacuacuauucuuuagauccuacguaccauuaaaaggaggauuuggaaauccagcaauagacuguuuaguaccacaagaauggguacaacauuuuuaucaagaaucagcacccucauuaggcgaugucgcauuaguaagauauguaaauccagacacaggacgaguacuauucgaagcaaaacuacacaaaggagguuuuuuaacuguaucgucaacaucuacaggaccagucguaguaccagcuaaugguuauuuccgauucgauuccuggguaaaccaauuuuauagucuagcuccaaugggaacaggaaacgguagaagaagauuucaauaa

SEQ ID NO: 32664 - RNA, 1617 nt, Artificial Sequence
  derived and/or modified sequence opt6 from capsid_protein__Norovirus__AID51492
auggcauccaaugaugcaacaccuucaaacgacggagcugcaggacuuguaccagaauccaauaacgaagcaauggcacuagaaccuguagucggugccucauuagcagccccaguaacaggacaaacaaauauaauagacccauggauaagaacaaacuucguacaagcaccaaauggagaauucacaguuucaccaagaaacucaccaggugaaauacuugucaaccuagaauugggaccugaauuaaaucccuaucuagcacacuuagcaaggauguauaaugguuacgcaggaggaauggaaguccaagucaugcucgccggaaacgcuuuuacagcaggaaaaauaauauucgcugccgucccaccauauuuccccguagaaaauuuaucaccaucacaaauaacaauguuuccacauguaauuauagauguaagaacacuagaaccuguauuauuaccuaugcccgauguacguaguacauuauuucauuuuaaccaaaaagaugaaccaaaaaugagacuaguagcgaugcuauacacuccacuaagaaguaauggaaguggcgacgaugucuuuacaguaucauguagaauccuaacaagaccaucuccagaauucgacuuuacauauuuaguaccaccuaccguagaaucaaaaacaaaaccauucacauuaccugucuuaacacuaggagaacuaucaaacucacguuuuccauuauccauagaugaaaugguaacaucaccaaaugaaucaauaguaguucaaccucaaaacggaagaguaacuuuagauggagaacuacucgguacaacucaacuucaagcauguaauauauguucuauaagaggaaaaguaacaggccaaguaccuaaugaacaacauauguggaaucucgaaauaacaaaccuaaacggaacacaauucgacccaacagacgauguaccagcaccacuugguguaccugauuucgcaggcgaaguauucggaguauuaucacaaagaaauagaggcgaauccaacccugcaaaucgagcacacgaugcaguaguugcaacuuacucagauaaauauacaccaaaacuugguuuaguucaaauaggaacuuggaacacuaaugacguagaaaaucaacccacaaaauucacucccauaggauuaaacgaaguugcaaauggacacagauuugaacaauggacacuaccaagauauuccggagcacucacccuaaauaugaaucuagcaccugcaguagcaccacuauuuccaggagaacgauuauuauuuuuuagauccuauguaccauuaaaaggaggauuuggaaauccugcuauagauuguuuaguaccucaagaauggguacaacauuucuaccaagaaagugcaccuuccuuaggagacgucgcacuaguucgauauguuaauccagauaccggaagagucuuauucgaagcaaaacuacauaaaggcggcuuucuaaccgucucaucaacuucuacuggccccguaguuguaccagcaaacggauacuucagauuugauuccuggguuaaucaauuuuacucauuagcaccaauggguacaggcaauggaagaagacgauuccaauaa

SEQ ID NO: 32665 - RNA, 1617 nt, Artificial Sequence
  derived and/or modified sequence opt6 from capsid_protein__Norovirus__AID51495
auggcaucaaaugacgcaacuccaucaaaugacggagcugcaggcuuaguaccagaaucaaacaaugaagccauggcauuagaaccuguagucggagccucuuuagcagcacccguuacaggucaaaccaacauuauagauccauggauacgaaccaauuuuguucaagcaccaaauggcgaauucaccguaagcccaagaaacucuccaggcgaaauacucguuaacuuagaauuaggaccagaacuaaauccuuaccuugcccaucucgccagaauguauaauggauaugcaggaggaauggaaguucaaguaauguuagccggaaaugcauuuaccgcaggaaaaauaauauucgcugccguacccccauauuuuccuguugaaaaccuauccccaucucaaauaacaauguuuccacacguaauaauugacguaagaacauuagaaccaguacuacuaccuaugccagauguaagaucaacacuuuuccauuucaaucaaaaagaugaaccuaaaaugcgauuaguagccaugcuauacacaccauuaagaucaaacggaucaggugacgauguauucacaguaucauguagaauauuaaccagaccauccccugaauucgauuuuacauauuuaguaccaccaacaguagaaucaaaaacaaaaccauucacauuaccaguacucacacuaggcgaauuaucaaacagcagauuccccuuaucaauagacgaaaugguuacuucacccaacgaaucaauuguuguacaaccacaaaacggaagaguaacacuagauggagaacuucuuggaacaacacaauuacaagcauguaauauuuguucuauacgaggcaaaguaacaggucaagucccuaacgaacaacauauguggaacuuagaaauuacaaaccuaaacggaacucaauucgacccuacagaugauguuccagcaccauuaggaguaccagauuucgcaggagaaguauucggaguauuaucacaacguaauagaggagaauccaacccugcaaaucgagcacacgaugcuguuguagcaacuuacucagauaaauauacaccaaaacuaggcuuaguacaaauaggaacauggaauacuaacgauguagaaaaccagccaacaaaauuuacaccaauaggacuaaacgaaguagcaaauggucacagauucgaacaauggacacuaccgagauauucaggagcccuuacacuuaacaugaaucuagcacccgcuguagcuccacuauucccaggugaaagacuacuguuuuuuagaucauauguccccuuaaaaggugguuucggcaauccugcaauugauugucuuguaccucaagaauggguacaacauuucuaucaagaaucagcaccauccuuaggagacguugcauuaguaagauacguaaacccagauacagggcgagucuuauuugaggccaaacuacacaaaggaggauuucucacuguaucaucaaccuccacaggaccagucguaguaccugcaaaugguuauuuccguuucgauaguuggguuaaucaauuuuacucacuagcaccaauggguacaggaaauggacgaagaagauuucaauaa

SEQ ID NO: 32666 - RNA, 1623 nt, Artificial Sequence
  derived and/or modified sequence opt6 from capsid_protein__Norovirus__AIE40036
augaaaauggccucaaaugacgcuaacccuucugacggaucagcagccaauuuaguaccugaaguuaacaaugaaguuauggcuuuagaaccaguaguuggagcagcuauagcagccccuguagcaggucaacaaaacguaauagacccuuggauucguaauaacuuuguccaagcaccuggaggugaauuuacaguaucucccagaaaugcuccaggagaaauacuauggucagccccucuugguccagacuuaaauccauacuuaucacaccuagcaagaauguauaauggauacgcaggaggcuucgaaguacaaguaauacuagcaggaaaugcauucacugcuggaaaaauaauauuugcugcaguaccaccaaacuucccuacagaaggauuaucaccaucucaaguaacaauguucccacacauuauaguagacguuagacaacuagaaccaguacuaauuccacuacccgauguacgcaacaauuucuaccacuauaaucaaucaaaugacucuacuauaaaacuaauagcaauguuauauacaccacuacgugccaacaacgcaggagacgauguauuuacaguaucaugcagaguauuaacaagaccaucuccagauuuugauuuuauuuucuuaguuccaccuacaguagaaucaagaacaaaaccauuuucuguaccaguuuuaacaauagaagaaaugaccaacucucgauuuccaauuccuuuagaaaaauuauuuacagguccauccuccgcauucguaguacaaccacaaaacggaagaugcacaacagacggaguacuucuaggaacaacacaauuaucuccuguaaauauauguaccuuccguggagacgucacacauaucacaggaucuagaaauuauacaaugaauuuagcaagccaaaacuggaauaauuacgauccaacagaagaaauaccugcaccucucggaacuccagauuuuguagguaaaauacaaggaauguuaacucaaacaacucgaacagacgguuccaccagaggacacaaagcaacugucuacaccggcuccgccgauuuugccccaaaauuagguagaguacaauucgaaacugacacagaccacgauuucgaagcaaaucaaaauacaaaauucacuccaaucggcguaauccaagauggaucaacuacacauagaaaugaaccccaacaauggguauuaccauccuauucaggaagaaacacacacaacguacauuuagccccagcaguagcuccuaccuucccaggagaacaacuauuauucuucagaucuaccaugccaggcugcucaggauauccaaauauggaccuugauugcuuauuaccucaagaauggguacaauauuucuaucaagaagcagcuccugcucaaucggacguagcacuccuacgauucguuaacccagacacagguagaguauuauuugaaugcaaacuccauaaaucaggauacguaacaguagcccauacaggacaacacgaucuuguaauaccgccaaauggauauuucagauuugacuccugggucaaucaauucuauacucuagcaccaaugggaaauggaacaggacguagaagggcacuauaa

SEQ ID NO: 32667 - RNA, 1647 nt, Artificial Sequence
  derived and/or modified sequence opt6 from capsid_protein__Norovirus__AJW87644
augaaaauggcuucaaacgacgcagcuccaucaaacgauggagcagcaggacuaguaccugaaauuaauaaugaagcaauggcucuagaaccgguagcaggagcagcaauagcagcaccauuaacuggccaacaaaacauaauagacccauggauaaugaauaacuuuguacaagcgcccggaggugaauuuacaguuucacccagaaauucaccaggagaaguacuacuaaaucuagaauuaggaccugaaauaaaccccuaucuagcacauuuagcaagaauguacaauggauaugccggaggcuuugaaguacaaguaguacuagcagguaacgccuuuacagcuggaaaaauuauauucgcagcaauuccuccuaacuuuccaauagacaaucuaagugccgcacaaauaacaauguguccgcauguuauaguagauguaagacaacuagaaccaguuaaucuuccaaugccagaugucagaaacaauuucuuucauuauaaccaaggauccgacuccagacuaagacuuauagcaauguuauauacaccauuacgagcaaauaauucaggcgacgacguauuuacaguauccugucgaguacuaacaagaccuucaccugacuuuucauucaauuuuuuaguacccccuaccguugaaucuaaaacaaaaccuuuuucuuuaccaaucuuaacuauauccgaaaugucaaauucacgauuuccuguaccaauagacucucuacacacaucacccacagaaaacauaguuguacaaugccaaaacggcagaguaacauuagauggagaacuuaugggcacaacccaauuacuacccucgcaaauaugugcauuucgagguguauuaauacguucaacaucaagagcaagugaccaagcagauacugcaacaccaagacuauuuaauuauuauuggcauauccaacuugauaaccuaaacggcaccccauacgauccagcagaagauauccccggaccacuaggaacaccagauuucagaggaaaagucuuuggcguagcuucccaacgaaacccagauacaacaacaagagcacaugaagcuaaaauagacaccacuucuggaagauucacacccaaacuagguucauuagaaauaucuacagaaucagacgacuucgaucaaaacaaaccaacaagauuuacaccuguagguauaggaguagaucaugaagcagauuuccaacaauggacauuacccgauuaugccggccaauuuacccauaacaugaaucuagcuccagcaguugcuccuaacuuuccaggugaacaauuacuuuucuucagaucacaauuaccaucuucaggaggaagaagcaauggaauuuuagauuguuuaguuccacaagaauggguucaacacuuuuaucaagaaagcgcaccaucacaaucucaaguagcacuaguucgcuacauuaacccugacacaggaagaguucuauucgaagcuaaauuacauaaauuaggauucauaacaauagccaaaaauggagauucaccuauaacuguuccuccaaacggauauuucagauuugaauccuggguaaauccauucuauacauuagcucccaugggaaccggaaauggaagacgaagaauacaauaa

SEQ ID NO: 32668 - RNA, 1623 nt, Artificial Sequence
  derived and/or modified sequence opt6 from capsid_protein__Norovirus__ALG05457
augaaaauggcaagcaaugacgcagcaccaucaaacgauggcgcagccggcuuaguaccagaaggaaacaaugaaacauuaccauuagaacccguagcaggugcagcaauagcugcaccaguuacaggacaaaacaauauaauagacccuuggauuagaaccaacuucguacaagcaccaaauggugaauuuaccguuucaccaagaaauucaccaggagaaauauuacuuaaucuagaacuauccccagauuuaaaucccuaccuagcucaccuuuccagaauguauaacggauacgcuggaggaguagaaguacaaguauuacucgccggaaaugcauucacagcaggaaaaaucuuguucgccgcaguacccccaaacuuucccguagaauuucucucccccgcucaaauaacuaugcuaccccaccuaauuguagauguucgaacacuagaaccaauaaugauaccauuaccagacguuagaaauacauuuuuucacuauucaaaucaaccuaacaguagaaugagauuaguagcaauguuauacacaccacugagaucaaacgguucaggugacgacguauuuacuguuagcuguagaguucuaacuagaccaacaccugauuuugaauucacauauuuaguaccaccuagugucgaaucaaaaacaaaaccuuucucauuaccgauauuaacauuaucagaauuaacaaauucaagauuucccguacccaucgacucauuauuuacagcacaaaacaauguauuacaaguacaaugccaaaacggaagaugcacacuagacggcgaauuacaagguacaacacaauuacuaccauccgguaucugugcauucagagguagaguuacugcucaaauuaaccaaagagaucgauggcacaugcaauuacaaaaucucaauggaacaaccuaugacccaaccgaugacguacccgcaccacuaggaaccccagauuuuaaaggaguaguauuuggaaugguaucucaaagaaacguugguaacgacgcacccggaucaacuagagcacaacaagcauggguaucaacguacucaccacaauucguaccaaaacuuggaucagucaaucuaagaauauccgauaaugacgacuuucaauuccaaccaacuaaguucacuccaguaggaguaaacgacgacgacgauggacaucccuuuagacaaugggaacucccuaauuacucuggugaacuuacauuaaacaugaacuuagccccucccguagcacccaacuucccaggugaacaacuauuauucuuuagauccuucgucccauguucaggaggauauaaccaaggcauaauagauuguuuaauaccacaagaauggauccaacauuuuuaccaagaaucagcaccaucucaaucagacguagcauuaauaagauauguaaacccagauacgggaagaacacuauuugaagcaaaacuccauagaucaggauauaucacaguugcucauucaggcgauuauccauuaguaguaccagcaaacggacauuucagauuugauuccuggguaaaccaauucuauucccuagcuccaaugggaaccgguaacggaagacgaagagcacaauaa

SEQ ID NO: 32669 - RNA, 1623 nt, Artificial Sequence
  derived and/or modified sequence opt6 from capsid_protein__Norovirus__ALG05460
augaaaauggccuccaaugaugcagcaccaucuaaugacggugcagcuggcuuaguuccugaaggaaacgaugaaacacuuccucuugaaccaguagcuggcgcagcaauugcagcacccguaacaggccaaaacaauauaauugauccauggauuagaacaaacuuuguccaagccccaaauggagaauucacuguaucaccacguaauucaccaggugaaauacuuuuaaaucucgaacuaggccccgauuuaaauccauauuuagcacaccuaagcagaauguauaauggauacgcuggcggaguagaaguacaaguauuacuugcaggaaaugcauuuacagcagguaaaauacuauuugcagcaguccccccaaacuuuccaguagaauuucuauccccugcacaaauaacaaugcuuccacacuuaauuguggauguucgaaccuuagaaccaauuaugauaccacuaccagauguccguaacacuuucuuucauuguucaaaucaaccaaauucuagaaugagauuaguagcaaugcuuuacacuccuuuacgauccaauggauccggagacgauguuuucacaguaucauguagaguacucacaagaccaacuccagauuuugaauuuaccuauuuaguaccuccaucaguagaaucuaaaaccaaaccuuuuucacuaccaauauuaacacuaucagaauuaaccaacucucgauuuccaguaccaauagauucauuauuuacagcucaaaauaacguacuacaaguacaaugucaaaauggccgaugcacccuagauggagaacuacaagguacaacacaacuacuuccuucaggcauaugcgcauuucgaggaagaguaacagcucaaauaaaccaaagagacagauggcacaugcaacuccaaaaccuaaacggaacaacauacgacccaaccgacgauguacccgcuccauuaggaacaccagauuucaaaggaguaguauuuggaaugguuucacaacgaaacguaggaaacgacgcacccggauccacaagagcacaacaagcauggguaucaacauauucaccacaauucguaccaaaacucgguucaguaaauuuaagaaucucagauaaugaugauuuccaauuucaaccuacacaauuuacgccuguaggaguuaaugacgaugaugacggacaccccuuuagacaaugggaauuaccaaauuacagcggagaauuaacccuaaacaugaacuuagcaccaccaguagcccccaacuuuccaggagaacaacuacuauuuuuuagauccuucguuccauguuccggaggauauaaccaaggaauaaucgauuguuuaauuccucaagaauggauucaacauuucuaucaagaauccgcaccaucucaaucagacguagcauuaauaagauacguaaauccagacacaggcagaacacuauuugaagcaaaauuacauagaaguggcuauauaacaguagcacacaguggagacuacccucuaguaguacccgcaaauggccauuuccgcuucgauucauggguaaaucaauuuuacucacuagcaccaaugggaacuggaaacgguagaagacgugcucaauaa

SEQ ID NO: 32670 - RNA, 1623 nt, Artificial Sequence
  derived and/or modified sequence opt6 from capsid_protein__Norovirus__ALL73873
augaaaauggcuucaaaugaugcagcuccuucaaaugauggugccgcuggauuaguuccagaaggaaauaaugaaaccuuaccauuagaaccaguagccggagcagcaauagcagcaccaguaacaggacaaaacaauauaauagacccauggauaagaacaaauuucguacaagcaccuaacggagaauuuacaguuucaccaagaaauucuccuggagaaaucuuacucaaucuagaacuaggaccagaucuuaauccuuaucuugcacacuuauccagaauguauaauggauaugcaggagguguugagguacaaguauuauuagccggcaacgcauuuacugcuggaaaaauccuauucgcagcagucccaccaaacuuuccaguagaauuccuuaguccugcacaaauaacaaugcuaccacacuuaaucguugauguacgaacuuuagaaccaauaaugauaccacuuccagacguucguaacacauucuuccauuauucaaaucaaccaaauucucgaaugagauuagucgcuaugcucuauacuccccuacgaucaaauggaucaggagaugauguauucacaguaucauguagaguccuaacacgaccaacuccagacuuugaauucacauaucucguaccuccuucagucgaaucuaaaacaaaaccuuuuucuuugccaauacuaacacuaucugaacuaaccaacucuagauucccuguuccaauugacucacuauuuacagcucaaaacaacguauuacaaguucaaugucaaaauggaagaugcacacuggauggagaauuacaaggcacuacucaauuacuaccaucaggaauaugugcauuucgaggaagaguuacagcccaaauaaaccaaagagaucgauggcacaugcaauuacaaaacuuaaaugguacaacuuacgauccuaccgacgacgucccagcuccuuuagggacuccagauuucaaagguguaguauuuggcauggucagucaaagaaacguuggaagcgacgcaccugguucaacacgagcacaacaagccuggguaucaaccuacucaccacaauuuguuccuaaacuaggcucaguaaauuuaagaauaucagauaacgacgacuuccaauuccaaccaacuaaauucacacccguaggagucaaugacgaugacgauggccacccauuucgacaaugggaacuaccaaauuauucaggagaauuaacccuaaacaugaauuuagcaccuccaguagcucccaauuuuccaggugaacaacuucuauucuuuagaucuuuuguacccuguuccgguggauacaaccaaggaauuauagauugucucauaccacaagaauggauacaacauuucuaucaagaaucagcacccucacaaucagacgucgcacuaauacguuacguaaauccugacacaggaagaacauuauucgaagcuaaauuacaccguucagguuauauaacaguagcacacucuggcgacuacccacuaguuguccccgcaaacggacauuuuagauuugauucauggguaaaccaauuuuauucauuagcuccaaugggaacagguaauggacgcagaagagcacaauga

SEQ ID NO: 32671 - RNA, 1623 nt, Artificial Sequence
  derived and/or modified sequence opt6 from capsid_protein__Norovirus__ALL73876
augaaaauggcaucuaaugacgcagcuccaucaaaugauggagcagcaggccuuguuccagaaggaaacaacgaaacucuuccguuagaaccuguagccggugcagcaauagccgcgccagucacaggacaaaacaacauaauagacccauggauacgaacuaacuuuguacaagccccaaauggagaauuuacaguauccccaagaaauagcccaggagaaauacuacucaauuuggaauuagguccagauuuaaauccauaucuagcacacuuaucacguauguauaacggauaugcaggaggagucgaaguacaaguauuacuugccggaaaugcuuuuacagccggaaaaauauuauuugcagcaguaccaccaaauuuucccguugaauuucuaucaccagcacaaauaacaaugcuaccucaucuaaucguugauguacguaccuuagaaccaauaaugauaccguuaccagacguaagaaauaccuuuuuucacuacucaaaucaaccaaacucacguaugcgacuugucgcaaugcuauacacuccccuacgcucgaacggaucaggagacgacguauucacaguaucauguagaguacuaacucgacccacacccgauuucgaauucacuuaucuagucccaccaucaguagaauccaaaacaaaaccuuucuccuuaccaauauuaacacuaucagaauuaacuaacuccagauuuccaguacccauugauucacuauucacagcacaaaauaauguacuacaaguacaaugucaaaaugguagauguacacucgacggagaacuucaaggaaccacacaacuacuuccaucaggaaucugugcauuuagaggacgaguuacagcacaaauaaaucaaagagacagauggcacaugcaacuacaaaauuuaaaugguacaacauacgauccaacagacgacguaccagcuccauuaggcaccccagacuuuaaaggaguaguauuuggaaugguaucccaaagaaacguuggaaaugacgcacccggaucaacaagagcacaacaagcauggguauccacauacucaccacaauucguacccaaauuaggaucagucaaccuaagaauaucagacaacgaugauuuucaauuccaacccacaaaauuuacuccaguaggaguuaaugaugacgaugacggacauccauucagacaaugggaacuacccaacuauucaggagaacuaacacuaaacaugaauuuagcaccacccgucgccccuaacuuuccaggagaacaauuacuauucuucagaucauucguacccugcucaggagguuacaaccaagguauuaucgacugcuuaaucccucaagaauggauacaacauuucuaucaagaaagcgcaccaucucaauccgacguagcauuaauaagauacguaaacccagacacaggccguacacuuuucgaagcaaaacuccauagaucuggauacauaacuguagcacacucaggagauuacccacuaguaguaccugcaaauggacauuucagauuugacagcuggguuaaccaauucuacucacuagcaccaauggguaccggaaacggaagaagaagagcccaauaa

SEQ ID NO: 32672 - RNA, 1623 nt, Artificial Sequence
  derived and/or modified sequence opt6 from capsid_protein__Norovirus__ALL73879
augaaaauggcaucaaaugaugcagcaccaucaaaugacggggcagcaggauuaguaccagaaggaaacaaugaaacucuaccauuagaaccaguagcaggagcagcaauugcugcuucuguaacuggucaaaacaacaucaucgacccauggauaagaacuaacuuuguacaagccccaaacggagaauuuacaguaucaccaaggaacucaccuggagaaauauuacuaaauuuagagcuaggcccagaucuaaauccauauuuagcacauuuaucucgaauguacaacggauacgcaggaggaguagaaguacaggucuuacuagcaggaaacgcauuuaccgcaggaaaaauauuauucgcugcuguacccccaaacuuucccguagaauuccuaucacccgcucaaauaacaaugcucccacaucuaauagucgacguacguacauuagaaccuauaaugauaccuuuaccggauguacgcaacacauuuuuucacuauucaaaccaaccaaacucaagaaugagauuaguagcaauguuauacacuccacucagauccaacggcucaggagaugauguauucacuguaucauguagaguacuaacaagaccaacaccagauuuugaauucacauacuuaguaccaccauccguagaauccaaaaccaaaccauucucauuaccaauacuaacccuaucagaacuaacaaauucucgauuuccaguuccaaucgacucuuuauuuacagcacaaaacaacguuuuacaaguacaaugucaaaacggaagaugcacacuugacggagaauuacaaggaacaacucaacuauuaccauccgguauaugugcauucagaggcagaguaacagcucaaauuaaccaacgagaccgauggcauaugcaacuucaaaaccucaaugguacaacauaugacccaacagaugauguacccgccccauuggguacacccgauuucaaaggaguagucuuuggaaugguaucccaaagaaauguaggcaacgaugcaccagguucaacucgggcucaacaagcuuggguaucaacauauucaccacaauucguccccaaacuuggcucggucaaucuaagaauauccgauaaugacgauuuccaauuucaaccaacaaaauucaccccaguugggguaaacgacgaugacgacggacauccauuuagacaaugggaauuaccaaauuacucuggagaauuaacacuaaacaugaauuuagcaccaccaguagcuccaaacuuuccaggagaacaacuacuauuuuuuagaucauuuguaccaugcaguggaggauauaaccaaggcauaauagauuguuuaaucccacaagaauggauacaacacuucuaucaagaaucugcacccucacaaagugacguagccuuaauacgauacguaaauccagauaccggaagaacacuauuugaagcuaaauuacauaggucaggauacauaacaguagcucauucaggagauuauccacuaguuguaccugccaauggccauuuuagauuugacaguuggguaaaucaauuuuauucucucgcaccaaugggaacaggaaauggaagacgaagagcucaauaa

SEQ ID NO: 32673 - RNA, 1623 nt, Artificial Sequence
  derived and/or modified sequence opt6 from capsid_protein__Norovirus__ALL73882
augaaaauggcaucaaacgacgcagcaccaucaaaugacggugcagcaggcuuaguucccgaaggaaacaaugaaacauuaccauuagaaccaguagcaggugcagccauagcagcacccguuacaggacaaaauaacauaauagauccauggauaagaacaaauuuuguacaagcaccaaauggagaauuuacagucucaccacgaaacucaccaggagaaauauuacuaaaucucgaacuaggaccagaucuaaauccauacuuagcacacuuaaguagaauguacaacggauacgcuggaggaguugaaguccaaguucuacuagcaggaaacgcauucacagcaggaaaaauccuauucgcagccguaccaccaaacuuuccagucgaauuucuaucacccgcacaaauaacaaugcuuccacauuuaaucguagacguaagaacccuagaaccaauaaugauaccauuaccugauguaagaaacacuuucuuucacuauuccaaccaaccuaacagucgaaugagauuagucgcgauguuauacacacccuuacgaucaaacggaucaggagaugauguauucacuguaucauguagaguucuuacaagaccaacaccugacuuugaauuuacauaccuaguaccaccaagcguugaaucuaaaacaaaaccuuuuucucuaccaauacuaacucuuucagaguuaacaaacucccgauuuccuguaccaauagauucucucuucacugcacaaaauaauguacuacaaguacagugccaaaauggaagauguacauuagauggagaacuacaaggaaccacacaauuauuaccuuccggaauaugugccuuuagaggacgcguaaccgcucagauaaaccaacgagaucgauggcacaugcaacuccaaaauuuaaauggaacaacauaugauccuaccgaugacgucccagcuccacuagguaccccagauuucaaaggaguugucuuugguaugguaucacaaagaaauguaggaaaugacgcaccaggaucaacaagagcacaacaagcauggguaucaacauauaguccucaauucguuccaaaacuaggaucaguuaaccuaagaauaucagauaaugacgauuuccaauuccaaccaaccaaauucacaccagucggcgucaaugaugacgacgauggucauccauuucgccaaugggaauuaccaaauuauuccggcgaacuaacccuaaacaugaaucuugccccaccaguagcaccuaacuuuccaggagaacaacuauuauucuuuagaucauucgucccauguuccgguggauacaaucaaggaauaauugauugucuaauuccccaagaauggauacaacacuuuuaucaagaaucugcacccucacaaucagacguagcacucauuagauacguaaacccagacacaggacgaacauuauuugaagcaaaacuacacagaucuggcuauaucacagucgcccauuccggagacuauccacuaguuguaccagcaaauggucauuuuagauucgauucuuggguaaaucaauucuacucacuagcacccaugggaacaggaaacggaagaagaagagcucaauaa

SEQ ID NO: 32674 - RNA, 1623 nt, Artificial Sequence
  derived and/or modified sequence opt6 from capsid_protein__Norovirus__ALL73888
augaaaauggcaucaaacgaugcagcaccaucaaaugacggagccgcaggauuaguaccagaagguaacaaugaaaccuuaccauuagaaccagucgccggagcagcuauugcagcaccuguaacaggacaaaacaauauaauagacccuuggauaagaaccaauuuuguucaagcuccaaauggugaauuuacaguaucaccaagaaauucaccaggagaaauacuauuaaaccuagaacuaggaccagauuuaaacccauaucuagcucauuuaucuagaauguauaacggcuacgcaggcggcgucgaaguucaaguucuauuagcuggcaaugcauuuaccgcaggaaaaauuuuauuugcagcuguaccaccuaacuuuccaguagaauucuuaucaccagcacaaaucacaaugcuaccacacuuaauaguugacguacgaacacuagaaccuauaaugauaccucuccccgauguacgaaacacuuuuuuccacuauagcaaucaaccuaacucaagaaugcgcuuaguagcaauguuauacacacccuuacgcucaaacggaagcggagaugauguauucacaguuucuugcagaguauuaacucgaccaaccccagacuucgaauuuacuuauuuaguaccacccucaguagaauccaaaacuaagccuuuuucauuaccuauauuaacauuauccgaauuaacaaacucacgauuuccaguaccaauagacagccuauuuacagcacaaaacaacguucuucaaguucaaugccaaaauggaagauguacacuagacggagaacuacaaggaacaacacaacuuuuaccuuccggcauaugcgcauucagaggaagaguuacugcacaaaucaaucaacgagauagauggcacaugcaacuacaaaauuuaaacggcacaacauacgacccaaccgacgacguucccgcuccauuaggcaccccagauuucaaaggaguaguauuugguaugguaucccaacguaacguuggaaaugaugcucccggaucaacaagagcucaacaagcaugggucucuacuuacucaccacaauucguaccgaaacuaggaucaguaaaucuaagaauuucagauaaugacgauuuccaauuccaaccaacuaaauuuaccccuguaggaguuaacgacgaugaugauggacaucccuuuagacaaugggaacucccaaacuauuccggagaauuaacauuaaacaugaacuuagcaccaccaguagccccuaauuuuccaggagaacaacuuuuauuuuuuagaucauucguaccauguucuggugguuauaaucaaggcauaauagacugccuaauaccacaagaauggauacaacacuuuuaucaagagucagcaccaucacaaucagacguugcacuaaucagauauguaaacccagacaccggaagaacacuauucgaagcaaaacuucaucgaucagguuauauuacuguagcacacucuggagauuauccucuaguaguaccagcaaauggacauuuccgauuugauucaugggucaaucaauuuuauucacuugcaccaauggguacuggaaauggacgacgaagagcucaauaa

SEQ ID NO: 32675 - RNA, 1623 nt, Artificial Sequence
  derived and/or modified sequence opt6 from capsid_protein__Norovirus__ALQ43927
augaaaauggcaucaagcgaugcuaauccaucagauggaucagcugccaaucuaguacccgaaguaaauaaugaaguuauggcauuagaaccaguaguaggagccgcaauagcugccccaguugcaggucaacaaaauguuauagacccauggauaagaaauaauuucguccaagcaccaggaggagaauucaccguaagucccagaaaugcaccaggagaaauauuauggucugcaccauuagguccagaucuaaauccauacuuaucacaucuagcaaggauguauaacggcuacgcagguggauuugaaguacaaguaauacucgcugguaacgccuuuacagcgggaaaaguuauauuugcugcaguaccuccuaauuuucccacagaaggauuaucuccaucacaaguaacaauguuuccacauauuguaguagacguuagacaauuagaaccuguacuaauaccacucccagacguaaggaauaauuuuuaccauuacaaucaaucaaaugacccaacaauaaaacuuauugccaugcuuuacacaccacuaagagcuaauaacgcaggagaugaugucuuuacaguaucauguagaguuuuaacacgaccaucgccagacuucgauuuuauauuuuuaguaccuccaacaguagaaucacgaacaaaaccauuuucuguaccaguacuaacaguugaagaaaugacaaacucacgauuuccaauuccauuagaaaaauuauucacaggaccaucaucagcauucgucguacaaccccaaaauggacgauguacaaccgauggaguacucuuaggaacaacacaauuaucaccuguuaacauaugcacauuuagaggcgacguaacacauauuacaggcagccauaauuacacaaugaaucuugcaagccaaaacuggucaaacuacgauccaacagaagaaauaccugcaccacuaggaacaccagacuucgucggaaaaauacaaggaguacuaacacaaaccacuagaacugauggaucaacacguggccauaaagcuaccguauauacuggcucugcagauuuugcuccuaaauuaggcagaguacaauucgaaacagauacagaccacgauuuugaagcuaaucaaaauaccaaauucaccccaguagguguaauacaagacggaggaacaacacauagaaaugaaccacaacaauggguauuaccauccuauucuggaagaaacacuccaaauguacaccuugcuccagcaguagcuccaaccuuuccuggagaacaauuacucuucuuuagaucuacaaugccaggaugcucagguuacccgaacauggauuuagacuguuuauuaccucaagaauggguucaauauuucuaccaagaagcugcaccagcacaaucagauguagcacuacucagauuuguuaacccugacacaggaagaguauuauuugaauguaaacuacacaaaagcggcuauguaacaguagcccacacuggacaacaugaucuaguaauacccccaaauggauacuuuagauucgacagcuggguaaaucaauuuuacacacuagcaccuaugggaaaugguacuggacgccgacgaccauuauaa

SEQ ID NO: 32676 - RNA, 1623 nt, Artificial Sequence
  derived and/or modified sequence opt6 from capsid_protein__Norovirus__ALQ43928
augaaaauggccucaucugaugcaaacccaucagauggaucugcagcaaaccucgucccagaaguuaauaaugaaguaauggcacuagaaccaguaguuggagcagcuauagcagcuccuguagcaggacaacaaaauguaauugaccccuggauaagaaauaacuuuguccaagcaccaggaggugaauuuacaguuucaccucgcaaugccccaggagaaauacuauggucagcaccuuuaggaccugauuuaaauccauaccuaucucaccuagcuagaauguauaauggauacgcagguggauucgaaguacaagucauucuagcuggaaacgcauuuacagcagguaaaguaauauuugcagcaguaccaccaaauuuuccaacugaaggcuuaucaccaucccaaguaacaauguuuccccacauaguaguagacgugagacaauuagaaccaguauuaauuccauuacccgauguuagaaacaacuucuaucacuauaaccaaucaaaugacccuacaauaaaauuaauagcuaugcuuuacaccccccuccgagcuaacaaugcaggagacgacguauuuacuguaucaugcagaguacuaacuagaccaucuccugacuuugacuucauauuucuaguuccaccaacaguagaaucaagaacuaaaccauucucaguaccagucuuaacaguagaagaaaugaccaacucucgauuuccaauaccauuagaaaaauuauuuaccgguccaucaucagcuuucguaguacaaccccaaaacggaagaugcaccacagauggaguauuacuaggaacaacacaacuuucuccagucaauauauguacauucagaggagauguuacacauauaaccggcucaagaaauuauacuaugaaucuagcaucacaaaacugguccaauuacgauccaacagaagaaauaccagcucccuuagguaccccagacuucgucggaaaaauucaaggaaugcuaacucaaacaacacgaacagacggauccacaagaggucauaaagcaacaguauauacagguucagcagacuucgcaccaaaacuaggaagaguacaauucgaaacugauaccgaucaugauuucgaagcaaaucaaaacacaaaauuuacaccugucggaguuauacaagauggaaguacuacacauagaaaugaaccccagcaauggguuuuacccucuuauagcggucguaauacaccaaauguacaccucgccccagcaguagcaccaacauuuccaggugaacaacuauuauucuuuagaucaacuaugccggguuguucaggauauccaaacauggacuuagauugccuauuaccacaagaauggguacaauauuucuaccaagaagcagcaccagcacaaucagauguagcuuuacuacgauucguaaacccugacacaggaagaguauuauucgaaugcaaacuccacaaaucaggauauguaacgguagcacacaccggucaacaugaccuaguuauaccaccaaauggauacuuuagauuugauucauggguaaaccaguucuauacucuagcaccaaugggaaauggaacuggacgucgaagaccccuauaa

SEQ ID NO: 32677 - RNA, 1623 nt, Artificial Sequence
  derived and/or modified sequence opt6 from capsid_protein__Norovirus__ALQ44123
augaaaauggcaucaaaugacgcagcuccaaguaaugacggagcagccggauuaguaccagaaggaaauaaugaaacacuaccccuugaacccguagccggagcagcaauagcagccccaguuacaggacaaaauaauauaauugaucccuggauaaggaccaacuuuguacaagcacccaacggcgaauucacaguuuccccuagaaacucaccaggugaaauacuauuaaauuuagaacuuggaccagaucuaaaccccuacuuagcccaucuuucacgcauguacaacggcuaugcaggcggcgucgaaguucaagucuuauuagcaggaaacgcauuuacagccggaaagauauuauucgcugcaguaccucccaauuuuccaguagaauuucuaucuccagcccaaauaaccaugcuaccccacuuaauaguagauguuagaacuuuagaacccauuaugauaccauuaccugauguacgaaacacauucuuccauuauucuaaucaaccaaacucaagaaugagacuaguagcuauguuauauacuccucuacgaaguaacgguucaggagacgauguauuuacagucucgugucguguucuaacacgaccaacaccagauuuugaauuuacuuaucucguaccaccaucuguagaauccaaaacaaaaccauucucucuucccauccuuacacuaucagaauuaaccaacucuagauucccaguaccaauugacuccuuauuuacagcccaaaauaauguacuccaaguacaaugucaaaacggaagaugcacauuagacggugaauuacaaggaacaacccaacuacuuccuacaggaauaugugcauuucgaggacgagucacagcucaaaucaaccaacgagauagauggcacaugcaauuacaaaauuuaaaugguaccacuuacgauccaacagaugacguuccagcaccauuaggaacaccagacuucaaaggugucgucuuuggcaugguaucacaaagaaacguaggaaaugacgcacccggaucuacccgagcucaacaagccuggguaucuacauacucaccacaauuuguaccaaaauuaggaucagucaaccucagaaucuccgauaaugacgacuuccaauuucaaccaacaaaauuuaccccaguaggaguaaacgacgaugaugacggccacccauuuagacaaugggaacuuccaaauuauucaggugaauuaacacuaaacaugaacuuagcaccaccaguagccccuaauuuuccuggagaacaauuacuauucuucagauccuuuguuccaugcucaggaggauacaaucaaggcauuauagauugccuaaucccacaagaauggauacaacauuuuuaccaagaaucagcuccaucacaaucugacguagccuuaaucagauauguaaacccagacacuggaagaacucuauuugaagccaaauuacauagaucaggauacauaaccguagcucacucaggugauuacccacuaguaguaccagccaacggccauuuccguuucgauucauggguaaaucaauuuuacucuuuagcaccuaugggaacaggaaauggacgacgcagagcacaauaa

SEQ ID NO: 32678 - RNA, 1623 nt, Artificial Sequence
  derived and/or modified sequence opt6 from capsid_protein__Norovirus__ALQ44124
augaaaauggcaucaaacgacgccgccccaucuaacgacggagcagcaggacuaguaccagaaggaaauaaugaaacauuaccuuuagaaccaguagcaggggcagccauagcggcacccguaacaggucaaaacaauauaauagauccauggauacguacaaacuucguacaagcaccgaauggugaauucaccgucucaccaagaaauucaccaggagaaauauuauuaaaccucgaacuaggaccagaucuaaacccauaccuagcacaucuauccagaauguauaacggauacgcuggcggugucgaaguacaaguacuacuagcuggaaacgccuuuacagcugguaaaauauuauucgcagcaguuccaccaaauuuuccagucgaauuucuauccccagcccaaauaacaauguuaccacacuuaauaguagauguacguaccuuagaaccaauuaugauaccucucccagauguaagaaacacauucuuccacuauuccaaucaaccaaacucaagaaugagacuaguagccaugcuauacacucccuuacgaucaaauggaucuggcgaugauguauuuaccguuucauguagaguauuaacaagaccaacaccagauuucgaauucacauaucucguaccaccaucaguagaauccaaaacuaaaccuuuuucccuuccaauccuuacuuuauccgaauuaacaaauucucgauuuccgguaccaauagacucucuauuuacagcacaaaacaauguauuacaaguacaaugucaaaacggucgauguacucuagacggcgaauuacaagguacaacacaauuauuaccaucaggaauaugugccuuuagaggccgcguuacagcccaaauuaaccaaagggauagauggcauaugcaacuacaaaaccucaauggcacuacauacgacccaacagaugauguacccgcuccacuaggaacuccagauuucaaaggaguaguuuuuggaauggucucacaaaggaacguaggaaaugaugcaccuggaucuacaagagcucaacaagcuuggguuucaacuuauucaccacaauuuguaccuaaauuaggaucaguaaauuuacgaaucucagacaaugacgacuuccaauuccaaccaaccaaauuuacaccaguaggugucaacgaugaugacgauggacauccauuuagacaaugggaauuacccaacuauucaggagaauuaacacuaaacaugaaccuagcaccaccugucgcacccaauuuuccaggugaacaauuacuauuuuuuagaucauucguaccaugcucuggaggauauaaccaagguauaauagauugccuaauaccacaagaauggauacaacauuuuuaucaagaaucagcuccaucacaaucagacguagcacuuauacgauauguaaacccagacacaggaagaaccuuauuugaagcaaaauuacauagaucuggauauauaacuguagcacacucaggagauuacccauuaguaguaccugcaaauggacauuuccgcuucgacucuuggguaaaucaauucuacucacuugcaccaaugggaacaggaaauggaagacgaagagcacaauaa

SEQ ID NO: 32679 - RNA, 1623 nt, Artificial Sequence
  derived and/or modified sequence opt6 from capsid_protein__Norovirus__ALQ44125
augaaaauggcuucuaacgacgcagcccccuccaaugauggagcagcuggacuaguaccagaagguaacaacgaaacacuaccccuagaaccuguagccggagcagcaauugcagcaccagucacaggacaaaacaacauaauagacccauggauccgcacaaacuuuguacaagcaccuaacggagaauuuacaguauccccaagaaauucaccuggagaaauccuacuaaaccuagaacuaggacccgaccuaaauccauaccuagcucacuuaucuagaauguacaacggcuacgcaggcggaguagaaguucaaguauuacucgcaggaaacgcauuuacagcaggaaaaauauuauucgccgccguaccuccaaauuuccccguagaauuuuuaaguccagcacaaauaacuauguuaccacaucuaauaguugacguaagaacucuagaaccaauaaugauucccuuaccagacguaagaaauaccuuuuuucacuacuccaaucaaccuaacucacgcaugcgauuaguagcuaugcuauauacaccacugagaucaaauggaucaggugaugacgucuuuacuguaucauguagaguauuaaccagaccaacuccagacuuugaauuuacuuaccucguaccaccaucaguagaaucuaaaacaaaaccauucucacuaccaauucuaacacuaucugaacuaacaaauucacgcuuuccaguaccaauugauaguuuauuuacagcacaaaauaauguacuacaaguacaaugccaaaacgguagauguaccuuagacggagaauuacaagguacaacucaauuauuacccucaggaauuugugcauuccguggaagaguaacagcucaaauaaaucaaagagaccgcuggcacaugcaacuacaaaacuuaaacggaacaaccuacgauccaacugaugacguaccagcaccacuagguaccccagauuucaaaggaguuguauucgguaugguaucacaacgaaacgucggcaaugaugcucccggaucuacacgagcacaacaagcauggguaucaacuuacucaccacaauuuguaccaaaauuaggaucaguaaaucuacgaauuucagauaaugacgacuuucaauuucaaccaaccaaauucacuccaguaggaguaaacgaugacgacgauggacauccauuuagacaaugggaauuaccaaacuacuccggagaauuaacauuaaacaugaaucuagcaccaccaguagcccccaauuucccaggugaacaauuacuauucuuccgcucauuuguaccaugcuccgguggauacaaucaaggaauaauugauugccuaauaccacaagaauggauacaacacuuuuaccaagaaucugccccuucacaaucagauguggcucuaauuagauacguaaacccagacacaggcagaacacuauucgaagcaaaacuacacagaucaggauacauaacagucgcacacucuggagauuacccacuuguagucccagcaaauggucauuucagauucgauucuuggguaaaucaauucuacucacuagcaccuauggguacaggaaacggaagacgaagagcucaauaa

SEQ ID NO: 32680 - RNA, 1644 nt, Artificial Sequence
  derived and/or modified sequence opt6 from capsid_protein__Norovirus__BAB83514
augaaaauggcaucaucugaugccgcaccaaguacugauggaagugcagguuuaguaccagaaguaaauaacgaaacaauggcacucgaaccagucguuggugcaccacucgcugcaccagucgcaggacaacacaacauuauagacccauggauuaaaaugaacuuuguacaagcaccaaacggagaauuuacaguaucacccagaaacgccccuggcgaaauacuucuugaucuagaauuaggaccagacuuaaauccauacuuaucacacuuagcaagaauguauaauggguaugccggaggaauggaaguacaaguaguuuuagcaggcaaugcauuuacagcugguaaaauaauauuugcagcaguaccaccgaacuuuccagcagaaaauuuaucagcagcucaaguaacaaugugcccacauguaauuguagacguaagacaacuagaaccaguaaugcuaccaaugccagauauaagaaacaaacuauuucauuacaaccaaguagaugacccuaaacucagacuacuagcuuaucuauacacaccuuuacgagcaaacaacgcaggagacgauguauuuacaguuucuugcagaguacuaacucgacccaccccagauuucgaauuuauguuucuugugccuccaaccguagaaucuaaaacuaaaccuuucucacuacccaguuuaacucuagacgagcuaucaaacucaagauuuccugcaccaauaguacaacucuauaccaauccccacgauaaucuaguaguccaaccacaaaauggaagauguacaauagacggacucuuacaagguacaacucaauuaguaucuuguaacguauguaguuuucgaggaacuauaggagauggacaaccagcgagucacucagaagaagaaauaaugccaauggccuucaacauucaaagagaaaucauguuagaaaaccuagacggaacaccauacgacccagcagacgacauaccagcuguauuaggaucuccagacuuccaagguguuauauuuggcauauuaagccaaagaaacacagaugggcaaacuagagcccacgaagcuaaaguagauacaagagcagcccgauuugcaccaaaauuaggauucguaguagccacaguagagucuacagacuuucaugcaaaucaaccaucacguuuuacaccaguaggacuaggaggcgacaacaaccaagauuucaaucaauggcgucuaccagcauacggaggagcacuaacuaacaacacuaaucuagcaccuccaguaaugcccguuuauccaggagaacaauuacuauuuuucagaagccaauuaccauccucaggcgguguaguaggagguugguuagacuguuuacuuccacaagaauggguacaacauuuuuuccaagaaucugcaacaucacaaucagauguagcacuaguacgauacauaaacccaacaacaggaagagucuuauuugaagcaaaauuacacaaacaaggcuucuuaacaguugcugcaucaggaaguuauccacuaguaguaccagcagaugguuauuuuagauuugaaucauggguuaaucaguucuauaccuuagccccaauggguaacgguaguggaagaagaagagcaagauaa

SEQ ID NO: 32681 - RNA, 1644 nt, Artificial Sequence
  derived and/or modified sequence opt6 from capsid_protein__Norovirus__BAB83516
augaaaauggcaucaagugaugcaccaccaucaacagauggaucagcaggucuaguaccagaaguuaacaaugaaacaauggcuuuagaaccaguuguaggagcaccacuagcagcaccaguagcaggacaacauaauauaauagaucccuggauaaaaaugaauuuuguucaagcacccaauggagaauuuaccguaucaccaagaaaugcuccaggugaaauauuauuagaccucgaacuaggaccugacuuaaacccuuauuuaucacacuuagcucgaauguauaacggauacgcuggaggaauggaaguacaaguuguacuugcaggcaaugcauucacagcaggaaaaaucauauuugcagcaguuccaccaaauuucccagcugaaaaucuaucugcagcacaaguaacaauguguccacauguaauaguugauguccgacaacucgaaccuguaauguuaccaaugccagacauuagaaacaaacuauuccacuauaaucaaguagaugauccuaaauuacgauuauuagcauauuuauauacaccacuacgagcaaauaacgccggagaugaugucuuuacaguauccugucgaguucuuacaagaccuacuccagauuuugaauuuauguuucuaguaccaccuaccgucgaaaguaaaacuaaaccauuuucuuuaccaggacuaacauuagaugaauuaaguaauucacgauuuccagcacccauaguacaauuauauaccaacccccaugauaaccugauaguacaaccacaaaauggcagauguaccauugauggucuauuacaaggaacaacacaauuaguuaguugcaauguauguuccuuucguggaacaaugggugaaggccaaccugcugcacauucagaagacgaaauaaugccaauggccuuuaauguccaaagagaaaucaugcuugaaaauuuagauggaucaccuuaugacccuacagaugacauaccagcuguacuaggaucaccagauuuucaaggagucauguucggaauucuaagccaaaggaauacagauggucaaacaagagcacacgaagcaaaagucgacacaagggcagcaagauucgcaccaaaauuaggauuuguaguagcuacaguagaaaguacugacuuucacgcaaaucaaccaucuagauucacuccuguuggucuaggaggugauacaaacagagauuuuaaccaauggcaauuaccagcauauggaggagcuuuaacaaauaauacuaauuuagcaccaccuguaaugccagucuacccaggcgaacaauuauuauucuuuagaagucaauuaccuagcucgggcggaguagucgcuggaugguuagauuguuuauuaccucaagaauggguacaacacuuuuuccaagaauccgcaacgucgcaaucagauguagcucuaguaagauaugucaacccaacuaccggaagaguucuuuucgaagccaaauuacauaaacagggauucuuaacaguagcggcaaguggaucauacccacuaguaguaccagcagacgguuacuuuagauucgaaucauggguaaaucaauucuauacauuagcaccuaugggaaacgguucaggaagaagaagagccagauaa

SEQ ID NO: 32682 - RNA, 1629 nt, Artificial Sequence
  derived and/or modified sequence opt6 from capsid_protein__Norovirus__BAD72797
augaaaauggcaagcaaugacgcagcuccaucuacagauggugcagcaggacuaguaccugaaucaaauaaugaaguaauggcauuagaaccaguagcaggagcagcuuuagcugcaccaguaacaggacaaacaaacauaauagauccauggauaagagcuaauuucguacaagcaccaaauggugaauuuacaguuuccccaagaaaugcaccuggagagguacuauuaucauuagaauuaggaccagaacucaacccuuaccucgcccauuuagccagaauguauaacggauacgcaggugguauggaaguccaaguuauguuagcuggaaaugcuuuuacagccggaaaauugguauuugcagccgucccaccacauuuucccguagaaaauuuaucuccacaacaaauuacuauguuuccacacgucauuauugacguacgaacccuugaacccguacuauuaccacucccagauguccgaaauaauuucuuucacuacaaccaaaaagaugauccuaaaaugagaauaguagcaauguuauacacaccauuaagaucuaauggaucgggcgacgauguauuuacagucucauguagaguauuaacaagaccaaguccagauuuugauuuuacuuaucuaguuccaccaacaguugaaucaaaaacuaaaccuuucacucuaccaauauuaacauuaggagaacuaaguaauucaagauucccaguaucaaucgaucaaauguacacaucuccuaacgaaguaauauccguacaaugucaaaacgguagauguacauuagauggagaauuacaaggaacaacacaacuccaaguuucaggcauaugugcauuuaaaggagaaguaacugcccacuuacacgauaacgaucauuuauacaacgucacuauaacaaauuuaaaugguccccccuucgacccuucagaagauauaccagcaccauuagguguaccagauuuccaaggacgaguauuuggaguaaucucucaacgugauaaacaaaacgccgccggacauucugaaccagcuaauagaggacaugaugcuguaguuccuacauacaccgcccaauauacaccuaaauuaggacaaguacaaauaggaacauggcaaacugaugacuuacaaguaaaccaaccaguaaaguucacuccaguaggacuaaaugauacugaacauuuuaaucaauggguagucccuagauacgcaggugccuuaaaucuaaacacaaaucuugcaccaucaguugccccaguauuucccggagaaagauuacuauuuuuuagaucuuacauuccccuaaaaggaggauacggaaaucccgcaauagauugucuauuaccccaagaauggguccaacauuuuuaccaagaagcugcaccaucaaugucagaaguugcauuaguaagauauauaaauccagauacgggaagagcauuauuugaagcaaaacuucacagagcuggauuugucacaguauccucaaauacaagcgcaccuguagucgucccugcaaauggauauuuucgauuugauucauggguuaaccaauuuuauucucucgcaccaaugggagcaggcaacggcagaagaagaguccaauaa

SEQ ID NO: 32683 - RNA, 1647 nt, Artificial Sequence
  derived and/or modified sequence opt6 from capsid_protein__Norovirus__BAD72798
augaaaauggcaucuaaugaugcagccccuucaaaugacggggcagcaggacuaguaccagaaauaaauaacgaagcaauggcccuagauccaguugccggugcugcaauugcagccccacuaacuggacaacaaaacauaauagauccauggauaaugaauaauuuuguacaagcaccaggaggagaauuuacaguuuccccaagaaauaguccaggugaaguucuauuaaauuuagaacuaggaccagaaaucaauccauaccuagcucauuuagcaagaauguauaauggauaugccggcggauucgaaguacaaguuguacuugcaggaaacgcauuuacugcaggaaaaauaauuuucgcagcaauaccaccaaauuucccaauagacaauuuauccgcagcacaaauaacaaugugcccacauguuauaguagacgucagacaacucgaaccaguuaauuuaccaaugccugauguacgaaacaacuucuuuuauuauaaccaagguuccgacucccgucuaagauuaauagcaaugcuauacacuccauuaagagcaaacaauucaggagacgauguuuuuacaguuucaugcagagugcuaaccagacccucuccagacuuuucauuuaacuuuuuaguaccuccuaccguagaaucaaaaacaaaaccauucaccuuaccaauccucacaaucucugaaaugucaaacaguagauucccaguacccauagaaucacuccauaccucuccaacagaaaacauaguaguacaaugucaaaauggccgaguaacauuggacggagaauuaaugggaacaacacaacuauuaccaucacaaauaugcgcauuccgagguguucuaaccagaucuacaucaagagcaucagaccaagcagauacugccacaccacguuuauuuaacuacuacuggcauguacaauuagauaaccucaacggaacacccuacgauccagcagaagacauacccgguccacuaggcacaccagauuuuagaggaaaaguauuuggcguagccucucaaagaaacccagacucuacaacaagagcacaugaagccaaagucgauacaacagccggaagauuuacacccaaauuaggaucucucgaaauauccacagaaucauccgacuuugaucaaaaucaaccaacaagauucacaccaguaggcauuggaguagauaacgaagcagauuuccaacaaugguccuuaccagacuauucaggucaauucacacauaacaugaacuuagcaccagcaguagcacccaauuuuccaggagaacaauuauuauucuuuagaucucaacuaccaucaucaggaggcaggucgaacggagucuuagauugcuuagucccucaagaauggguacaacauuuuuaucaagaaucggcaccagcacaaacacaaguagcacuaguaagauacguuaauccagauacaggaagaguuuuauucggugcaaaauuacauaaacuuggauuuaugacuauugcaaaaaauggagauuccccaauaacaguaccacccaauggauacuuuagauucgaaucauggguaaauccauucuacacacuagcuccaaugggaacaggcaauggaagaagacgaauacaauaa

SEQ ID NO: 32684 - RNA, 1647 nt, Artificial Sequence
  derived and/or modified sequence opt6 from capsid_protein__Norovirus__BAD72799
augaaaauggcauccaacgaugcagcaccaucaaaugauggagcagccggauuagucccagaaucaaauaaugaaguaauggcacuugaaccagucgcaggcgcaucauuagcugcacccguuacaggacaaaccaauauaauagaucccuggauaagaaugaauuuuguacaagcaccuaacggagaauuuaccguauccccuagaaauucaccaggcgaaguuuuacuaaaccuagaacuuggaccagaacuuaauccauaucuagcacaucuuuccagaauguauaauggauaugcaggaggaauggaaguacaaauaauguuagcaggaaaugcuuucacagcaggaaaacuaauauucgccgcaguacccccucauuuuccuauagaaaauuuaucccccccacaaauaacaauguuuccccacguaauaauagauguacgcacacuugaaccaguccuccuuccaaugccagacauacgaaacucuuuuuuucauuuuauacaaagagaugaacccaaaaugagacuuguagcaaugcuauacacuccccuaagauccaaugguucuggagacgacguauuuacagucucuugucguguauuaacacguccaacaccagacuuugauuuuacauauuuaguuccacccacuguagaaucaaaauccaaacccuuuacacuccccauauuaacacuuggcgaauuaacaaacucccgcuuuccacuaccuauagacguacucuauacuaauccaaaugaaucagcuauaguccagugccaaaauggucgcuguacauuaggcggagaacuacaaggaaccgcacaacuauuaccaacaggaaucugugcauucagaggaaaaguaacucaacaaguacaagaugaacauagaggaacacauuggaauaugacugucacaaaacuuaacgguacaccuuucgauccaacugaagacguacccgccccacuuggaacaccugauuuuucaggacaaauauacggaguaauuucacaaagaaauacuaauacaguuccaggagaaggaaauuuaccugcaaauagagcccaugaagcuguuauagcaacauacucaccuaaauucacaccaaaauuagguaauauucaauuuucuacuugggaaacacaagacgucucaucaggacaaccaacaaaauuuacaccaguaggacucgcaucuguagaugcaaacucacauuuugaucaauggacuuuaccuucuuacaguggugcauuaacuuuaaauaugaaucuagcacccucaguagcuccagucuucccaggagaaugucuauuauucuucagaucuuuuauaccccuaaaagguggauauggaaauccagcaauagauugcuuaaugccacaagaauggguccaacacuuguaccaagaauccgcuccaucauuaucagauguugcauuaguaagauacguaaauccugaaacaggacguacacuuuuugaagcaaaauuacaccgaaaugguuuuuuaacaguagcuagaaacuccgccgguccaguuguugcaccuacuaacggcuacuuccguuucgauuccugggucaaccaauuuuacacacuagcaccaaugggaaacggaucuggaagacguagaauacaauaa

SEQ ID NO: 32685 - RNA, 1623 nt, Artificial Sequence
  derived and/or modified sequence opt6 from capsid_protein__Norovirus__BAD72800
augaaaauggcaucaaaugaugcagcacccucaaaugauggcgcagcaggccuuguuccagaaguaaacaacgaaacaauggcacucgaaccaguagcaggugcauccauagcugcccccuuaacuggacaaaauaacguuauagacccuuggaucagauuaaauuucguucaagcucccaauggagaauucacaguaucaccaagaaauucuccaggagaaauauuauuaaaucuagaacuaggaccugaacuaaaccccuaucuugcacaucuagcaagaauguauaaugguuacgcaggagguguagaaguacaaguccuauuagccggaaaugcuuucacagcaggcaaauuaguuuuugcugcuauaccaccacacuucccaguagacaacuuaucaccaggacaaauaacaauguuuccacauguaauaauagaugucagaacuuuagaaccagucuuauuaccacuaccagauguaagaaauaauuuuuuccauuauaaucaacaaucagaccaaagaaugagauuaauagcaauguuauacacaccucuaagaucaaauggaucuggcgacgauguauucacuguuucauguagaguucuaacaagaccuucacccgauuuccacuuccauuaccuaguacccccaacaguagaaucaaaaacaaaaccauuuucugucccaguacuaacacucaacgaauuaacuaauucaagauucccuguaccaauagaugcaauguacacaucaccaaaugauucaauaguaguacaaccacaaaacggaagagcaaccauagacggugaacuauuaggcacaacacaacucauacccucaggaauauguucuuucaggggcaaaauaacaacacaucuagcagaugauagacacuuauggaauauucaaguaucaaacuuaaacggaacaccauuugacccaaccgaugacgucccagcaccgcuaggaaugccagauuuuucuggacaaauauucggcguagucucagaaagagauacaggaacuaauccagcaaaucgagcacaugacgcaguacuagcaacauacucugccaaauacacaccuaaauuaggaucaguacaaauaggcacaugggacacagaagacuuauuagaaagacaacccguaaaauuuacaccugucggacuuaacgaaauaggccaagacaaacacuucgaccaaugggugcucccaaacuacuccggugcauuaggacuaaauaugcaccuugcaccagcaguaucuccccuauucccaggugaaagauuacuauuuuuccgaucauauauaccacuaaaaggaggacacggugauccauuuauagauuguuuagucccacaagaauggauccaacauuuuuaucaagaaucagcuccagcacaaucaucugucgcacuucuccgauacguaaauccugauacaggaagaacacuauucgaagcaaaauuacauaaagaaggauucauaaccguuaguucuacagaaaaccgaccaguaauaguaccaccaaacggauauuucagauuugauucuugggucaaccaauuuuacucccuugcaccaaugggaacagguaauggcagaagacgaauucaauaa

SEQ ID NO: 32686 - RNA, 1620 nt, Artificial Sequence
  derived and/or modified sequence opt6 from capsid_protein__Norovirus__BAD88558
augaaaauggccagcaaugacguaaaccccucugauggaucagcagcaaacuuaguacccgaaguaaauaacgaaguuauggcauuagaaccuguaguuggagcagccauugcagcaccaguagcaggacaacaaaauauaauagaucccuggauaagaaauaauuuuguacaagcacccggcggagaauucacaguaucaccccgaaaugcaccaggcgaaauauuauggucagcaccucucggaccagacuuaaauccauaccuaucccaucuaucacgcauguauaauggcuacgcuggaggcuuugagguacaaguuauauuagcaggaaacgccuuuacagcaggaaaaguaauauuugcugcuguuccaccuaacuucccuacagaaggacuuuccccaagucaaguaacuauguucccacauauuauaguagauguacgccaacuagaaccaguauugauaccacuuccagauguccguaacaacuuuuaccauuauaaucaagcucacgauucuacauuaaaacuaauagcuaugcuauauacaccgcucagagcaaauaaugcuggagaugauguauucacuguuucauguagaguccuuacaagacccucaccagauuuugacuuuauauuucuaguaccacccacaguugaaucucgaacaaaaucauuuacuguaccaguuuuaacaguagaagaaaugacaaauucccgauuuccaauaccacuugaaaaauuauauacaggcccaucaucugcuuuuguaguucaaccacaaaauggacgauguacaacagauggaguacuauuaggaacuacucaauuaucagcaguuaacauaugcacauuuagaggagacguuacacauauagcagggucaagaaacuauaccaugaaucuugcaucucaaaauuggaacaauuaugaucccacagaagaaauaccagccccacuagguauacccgauuuuguaggaaaaauccaaggacuacuaacacaaacaacuagagccgacgguucaacacgagcacauaaagcuacagucucaacaggaucaguccacuucacaccaaaauuaggcucaguucaauucucuacugacacagacaacgacuuucaacccggacaaaauaccaaauucacaccaguaggaguuauucaagauggagauagacaccaaaaugaaccacaacaauggguucuacccgacuauagcgguagaacaggacacaacguccaucuugcaccagccguagcaccaacuuuuccaggagaacaauuauuauuuuuucguuccaccaugccuggauguuccggauauccaaacaugaaccuugauugucuacuaccacaagaauggguauuacauuuuuaccaagaaucugcaccagcucaaucugauguagcucuauuacgauuugucaacccagauacuaauagaguuuuauucgaaugcaaacuacacaaaucaggauacauaacaguagcacauacuggacaacaugauuuaauacuaccaccaaacggauacuuuagauucgacucauggguaaaucaauuuuauacacucgccccuaugggaaacggugccggaagaagacgagcaccauaa

SEQ ID NO: 32687 - RNA, 1623 nt, Artificial Sequence
  derived and/or modified sequence opt6 from capsid_protein__Norovirus__BAD98240
augaaaauggccucaaacgacgcuacaccuucaaaugauggugccgccggacuaguaccagaauccaauaaugaagcaauggcauuagaaccaguaguaggagcaucacuagcagcucccguaacaggacaaacaaacauaauagacccuuggauaagaacaaauuuuguccaagcuccaaauggagaauuuacuguaagcccuagaaauucaccaggagaaauauuaguaaauuuagaauuagguccagaacuaaaucccuaucuagcccaccuagccagaauguauaauggauaugcuggaggaauggaaguccaaguaauguuagcuggaaacgcauucacagcaggaaaaauaauauuugcagcuguaccuccauacuuucccguagaaaaccuaucaccaagucaaauaacaauguuuccacacguaauaauagauguaagaacacuagaaccaguacuacuacccaugccagauguaagaucuacuuuauuucacuuuaaucaaaaagaugaaccaaaaaugagauuaguugcaauguuauacacaccacuaagaucgaacggaucaggagacgacguuuucacaguuucauguagaauauuaaccagaccuucaccggaauucgacuuuacuuaucuaguaccaccgacaguagagucaaaaaccaaaccauuuacacuacccguacuaacccuaggagaauuaucuaauucaagauuccccuuaucuauagaugaaauggucacuucuccaaacgaaucuauaguaguacaaccucaaaacggucguguaacacuagauggagaauuauuaggaacaacacaauuacaagcauguaauauauguucaauaagaggaaaggucacaggacaagucccaaaugaacaacauauguggaauuuagaaauaacaaaucuaaaugguacucaauuugacccaacggacgacguaccagcaccacuuggaguaccugauuuugcaggagaaguuuucggcgucuuaucacaaagaaauagaggagaauccaacccugcuaaucgcgcucaugaugcaguaguagcaacauauucagauaaauacaccccaaagcuaggauuaguacaaaucggaacauggaauacuaacgauguugaaaaccaaccuaccaaauucaccccaauaggauuaaaugaaguagcaaaugggcauagauuugaacaauggacacuuccacguuauucaggugcauuaacauuaaauaugaauuuagcucccgcaguagcaccauuauucccuggugaaagacuacuauucuucagaucuuauguaccauuaaaaggagguuuuggaaauccagcaauagauuguuuaguuccacaagaauggguacaacacuuuuaccaagaaucugccccuucucucggagacguagcacuuguaagauacguuaaccccgauacaggaagaguauuauuugaagcuaaacuacauaaaggcggauuccuuaccgucuccucaacaucuacaggcccaguuguaguaccugcgaauggauacuuuagauuugauaguuggguuaaucaauuuuacucuuuagccccuauggguaccggcaacggaagaagaagauuucaauaa

SEQ ID NO: 32688 - RNA, 1632 nt, Artificial Sequence
  derived and/or modified sequence opt6 from capsid_protein__Norovirus__BAE43833
augaugauggcaucaaaagaugcaccaacaaacauggauggcacuucaggagcaggacaauuaguaccagaagcauccaccgcugaaccaaucucaauggaaccaguagcuggagcagcaacugcagcagcaacagcaggacaaguaaauaugauagauccauggauaaugucaaacuauguacaagcaccucaaggagaauucacaauaagcccaaacaauacaccaggagacauauuauuugaucuccaauuaggcccacaccuuaauccuuuucuuagucacuuagcccaaauguacaacgguuggguuggcaauaugaaaguacguguucuucuugcagguaaugcauucacagccggcaaaauaauaauauccuguguaccaccaggauucgcagcacaaaacguaucaauagcccaagcaacuauguuuccacaugucauagcagaugucagaguauuagaacccauugaaguaccacuagaagauguaagaaauguauuauuccacaauaaugacucuaccccaacuaugagacuaauaugcaugcuuuauacaccucuacgagcaucaggcucaucaucaggaacagaucccuucguaaucgccggaagaguauuaaccuguccauccccagauuuuaauuuucuauuccuagucccaccaaauguagaacagaaaacaaaaccauuuucugucccaaauuuaccacucaauguauuaucaaauucacgaguaccaucuuuaauaaaaucaaugauggucucacaagaccacggacaaaugguucacuuucaaauaggcagaguaacucuagauggucaacuucaaggaacaacuccaacuucugcaucacaauuaugcaaaauaagagguacaguuuaucaugcaacaggaggacaaggacucaaccuaaccgaaauagaugguacaccuuaccaugccuuugaaucaccagcacccauagguuuuccagaucuaggagaaugcgauuggcauauaaacgccucacccgccaacgcuuuuaccgacggauccauaauacauagaauugacguagcacaagauucuacauuugcaccacaccuuggaacaauacauuauacaaaugcaaauuaugacgcaaaugucucacuaaucuguucccuagaauggcuaucucccccuucagguggugcuccaaaaguuaauccaugggcaaucccaagauacggaucaacucuuacagaagcagcacaacuagccccuccaauauacccuccuggcuucggagaagccauuguauuuuucaugucagacuuucccauagcaaauggaucugauggacuaucaguaccaugcacaauaccucaagaauuuguaacucauuuuguaaacgaacaagcuccaacaagaggagaagcagcauuauuacauuauguagauccagacacucauagaaacuuaggagaauuuaaacuauauccugaaggauucaugacaugugucccaaauucaucuggaucaggaccacaaacacucccaauaaacggaguauuuacauuuauuucuuggguauccagauucuaucaacuuaaaccuguaggaacuacuggaccaguacguagacuugguauaagaagaucauaa

SEQ ID NO: 32689 - RNA, 1647 nt, Artificial Sequence
  derived and/or modified sequence opt6 from capsid_protein__Norovirus__BAE48588
augaaaauggcaucaaacgacgcaacuccaucaaaugacggcgcagcuggacuaguaccugaaauaaauaaugaagccauggccuuagaccccgucgcaggagcagcaauagcagcuccacuaaccggacaacaaaauauaaucgauccuuggauaaugaauaacuucguccaagcacccggcggugaguuuacaguaucaccuagaaacuccccaggcgaaguacuauuaaauuuagaauuagguccagaaauaaauccauaucuagcacacuuagccagaauguauaauggauaugcaggcggauuugaaguacaaguaguauuagcaggaaaugcauuuaccgcuagaaaaauaauauucgccgcaauaccaccuaacuuuccaauugacaacuuaucagcagcccacauaacaaugugcccucacguaauuguagacguaagacaacuagaaccaguaaacuuaccaaugccagauguaagaaacaacuucuuucauuauaaccagggaucagauuccagacuaagacuaauagcaaugcuauacacaccacuaagagcaaacaauucaggagaugaugucuucacaguauccugucgaguucuaacacgaccaucaccagacuuuucauuuaacuuccuaguucccccaacacuagaaucaaaaacaaaaccuuucacauuaccaauacuuacaauaucugaaaugucaaacucuagauucccaguaccaaucgacaguuuacauaccucaccuaccgaaaacauaguaguacaaugccaaaauggaagaguuacacuugauggagaauuaaugggaacaacucaacuauuaccaucacaaaucugugcuuuucgaggaguauugaccagaucaaccagccgagcacgagaccaagcagauacagcaacaccaagacuauuuaacuacuauuggcacauucaacuagauaaucucaauggaacuccauacgacccugcagaagauauacccggacccuuaggaacuccagacuuucguggaaaaguuuucggcguagcaucacaaagaaauccagacucuacaacucgagcacaugaagcuaaaguagauacaacagcaggacgauucacaccaaaauuagguucauuggaaauaucuacagaaucagacgauuucgaucaaaaucaaccaacaagauucacuccaguaggcauagguguugacaaugaagccgauuuucaacaauggucccuaccagauuacucaggccaauucacucacaacaugaacuuagcaccagcuguagcaccaaacuuccccggugaacaacuauuauucuuccgaucccaacuaccaucaagcggaggaagaagcaauggaauacuagacugucuuguuccccaagaauggguacaacauuucuaucaagaaucagcuccaucacaaacucaaguugcacuaguccguuacgucaauccagauacuggaagggucuuauucgaagccaaauuacauaaauuaggauuuacuacaauugcaaaaaauggcgauaguccaauaacuguaccuccaaauggcuauuuuagauucgaaucauggguaaauccauuuuauacacuagcaccaaugggaacaggaaauggacgucgcagaaaccaauaa

SEQ ID NO: 32690 - RNA, 1647 nt, Artificial Sequence
  derived and/or modified sequence opt6 from capsid_protein__Norovirus__BAE48589
augaaaauggcaucaaaugacgcaacacccaguaaugauggagcugccggauuaguaccugaaauaaauaacgaagcaauggcacuagacccaguagcaggcgcugcuauugccgcaccauuaacaggucaacaaaacauaauagauccauggauaaugaacaacuucguacaagcuccaggcggagaauucacugucucgccaagaaauucaccuggagaaguuuuacucaauuuagaauuaggaccagaaauaaaucccuaccucgcacacuuagcaagaauguacaacggauacgcaggcggauuugaaguacaaguaguauuagcaggaaacgcauucacugccggcaaaauaauauuugccgcaauaccuccauauuuucccauagauaaccucucagcagcacaaauuacuaugugcccacacguaauaguagauguucgacaauuagaaccaguaaaccuuccuaugccagacguacguaacaacuucuuucacuacaaccaagguucagacucaagacuaagauuaguagcaaugcuuuauacaccauuaagagcaaacaauaguggcgaugauguuuuuacuguuucauuacgaguacuaaccagaccauccccagacuuuucauuuaacuuuuuaguacccccaacagucgaaucaaaaacaaaaccauucacacuaccaauacuaacaauaucugaaaugucaaauagcagauuccccguaccaauagauaguuuacacacuucaccaacagaaaauauagucguccaaugccaaaauggaagaguaacauuagacggugaacucaugggaacaacacaauuauuaccaucacaaauaugcgcguuuagaggagucuuaacacgaucuacaucucgagcaucugaucaagcagacacugcaacaccacgauuauuuaauuacuacuggcacauacaauuagauaaccuaaacggaacaccauacgacccagccgaagauauacccggaccauuagguacaccggacuuuagagguaaaguauuuggagucgccucacaacgaaaccccgauucuacaacaagagcccacgaagcaaaaguagacacaacugccggucgauucacaccuaaauuaggcucauuagaaauuuccacagaaucagacgacuucgaucaaaaucaaccaacaagauuuacuccaguaggcauaggaguagaucacgaagcugauuuccaacaguggucccuaccagacuauucuggacaauucacacauaacaugaauuuagcaccugcaguagcccccaacuucccaggcgaacaauuauuauuuuucagaucacaauuaccaucaucaggaggacgcuccaacgguauacuagacugccuaguaccacaagaauggguacaacauuucuaucaagaaucagcaccugcacaaacucaaguagcuuuaguaagauacguaaacccugacacaggaagaguacuauucgaagcaaaacuacacaaacucggauucaugacaauagccaaaaauggagacuccccuauaacagucccaccaaauggauauuucagauuugaaucauggguaaaucccuucuacacacuagcaccaaugggcacaggcaaugguagacgaagaauacaauga

SEQ ID NO: 32691 - RNA, 1647 nt, Artificial Sequence
  derived and/or modified sequence opt6 from capsid_protein__Norovirus__BAE48590
augaaaauggccucuaaugacgcaacaccaucuaaugacggugcagcugggcuagucccagaaauaaauaacgaagcuauggcauuagaucccguagccggagcugcuauagcagcaccacuaacuggacaacaaaauauaauagaucccuggauaaugaauaacuuuguccaagcaccagguggagaauuuaccguaucuccuagaaauucaccaggagaaguuuuauuagauuuagaacuagguccagaaaucaauccauaucucgcacaccucgcaagaauguauaauggcuaugccggaggauuugaaguacaaguaguacuagcaggaaaugcauuuacagcaggcaaaauaauauucgcagcaauacccccaaacuucccuaucgacaaucucucagcagcacaaauuacaaugugcccacaugugauaguagacgucagacaacuugaaccaguuaaucuccccaugccagauguaagaaacacauuuuuucacuauaaucaagguucagacucacgucuaagacuuaucgcaaugcuauacaccccacuacgagccaacaauuccggcgaugauguauucacagucucaugucgcguacuuacaagaccuucuccagauuucucauuuaacuuucuaguaccaccaacaguagaaucaaaaacaaaaccuuucacauuaccaaucuuaacuauaucagaaaugucaaacuccagauuuccaguaccaauagauucucuacacacuuccccaacugaaucaauaguaguacaaugucaaaacggacgaguaacauuagauggcgaauuaaugggaacaacacaacuacuucccucacaaauaugcgcuuuuagaggaguacuaacacgaucaacaucaagagcaucagaccaagcagauacagcuacuccaagacuauucaacuacuauuggcauauucaacuagacaacuuaaacggaacaccuuacgacccagcagaagacauucccggcccucuaggaacaccugacuuuagaggaaaaguauuuggagucgcuagucaaagaaauccagauucuacaacccgagcccaugaagccaaaguugauacuacuaccggcagauucaccccaaaauuaggaucuuuagaaauaaguacagaaucagaugacuuugaucaaaaucaaccuacaagauucacaccaguaggaauaggaguagaccacgaagccgacuuucaacaauggucucuaccugauuauucaggacaauuuacacauaauaugaaccucgcucccgcagucgcaccaaacuuuagaggagaacaauuacuauuuuuucgcucacaauuacccucaucaggaggacguucaaauggaaccuuagacugccuuguaccacaagaauggguucaacacuucuaucaagaaucugcaccugcacaaacucaaguagcacuagucagauacguaaacccagacacuggaagaguauuauucgaagcaaaacuacacaaauuaggcuuuaugaccauugcuaaaaauggagauucacccauaacaguacccccaaaugguuauuuuagauuugagucauggguuaauccauuuuauaccuuagcaccuaugggcacaggaaauggccgaagacgaauacaauaa

SEQ ID NO: 32692 - RNA, 1644 nt, Artificial Sequence
  derived and/or modified sequence opt6 from capsid_protein__Norovirus__BAE92970
augaagauggcuucuaaugaugcaucuccuucuacagacggaucugcaggauuagucccagaaguaaauaacgaaacaauggcauuagaaccaguaguaggugcuccguuagcagcuccaguagcaggacaacauaauauaauugauccauggauaaaaaugaauuuuguacaagcaccaaacggagaauucaccgucuccccucgcaaugccccaggcgaaauacuacuagaucuagaauuagguccagacuuaaauccauauuuaucucaccuugcccguauguauaauggauaugcuggcggaauggaaguccaaguaguacuagcugguaaugcauucacagcaggcaaaaucauauucgcagcaguuccaccaaacuuucccgcagaaaauuuaucagccgcucaaguuacaauguguccacacguuauaguugauguaagacaauuagaaccaguaauguuaccaaugccagauauaagaaauaaacuauuccacuacaaucaaguagaugacccuaaauuaagauuacuagcauaccucuacacaccauuaagagcuaauaacgcaggcgacgacguuuuuacugucucauguagaguauuaacuagaccaacaccagacuucgaauuuauguuucuuguacccccaacaguugaauccaaaacaaaaccuuuuucacuuccaucauuaacauuagaugaauuaucaaacucaagauuuccagcacccauuguacaacuuuauaccaauccacaugauaauuuagucguacaaccacaaaacggaagauguacaauagauggacuacuacaaggcacgacucaauuaguaucaugcaauguauguucuuuuagaggaacauuaggagacggucaacccgcuucccacucagaagaagaaauaaugccuauggcauuuaauguacaacgagaaauuauguuagaaaacuuagauggaucacccuaugauccuacagacgacauaccagcaguauuagguucuccagauuuccaaggaguaguuuuuggaauacuaucacagagaaacacagacggucaaacaagagcccaugaagcaaaaguagauacuagagcagccagauucgcaccaaaacuuggauuuguuguagcaacaguagaaucaacugauuuucaugcaaaucaacccucacgauucacaccuguaggauuagguggggacggaaaucaagauuucaaucaauggucucuaccagcauauggaggagcauuaacuaacaacacaaaucuugcuccaccagcaaugccaguauauccaggagaacaacuacuauuuuuccguucacaauuaccaucaucuggaggaguuguaggaggauggcuagauuguuuacucccucaagaauggguacaacacuuuuuucaagaaagcgcaacaucccaaucagacguagcuuuaguaagauauauuaacccuacuacaggaagaguauuauuugaagcuaaauuacauaaacaaggauucuuaacaguagcagcaagcggaucauauccucuuguaguaccagcugacgguuauuucagauucgaaucauggguaaaccaauucuauacucuagccccaaugggaaauggaucuggcaggagauccgcaagauaa

SEQ ID NO: 32693 - RNA, 1623 nt, Artificial Sequence
  derived and/or modified sequence opt6 from capsid_protein__Norovirus__BAE98191
augaaaauggcaucuaacgaugcaucuccaucagauggcaguacagcaaaucuuguacccgaaguaaauaacgaaguaauggcacuagaaccaguaguaggagcagcaauagcugcaccaguugcaggacaacaaaacguaaucgacccuuggauaagaacaaauuuuguacaagccccaggaggcgaauuuacaguaucaccucgcaaugcaccuggagaaauuuuauggucagcaccacuaggaccagauuuaaauccauauuuaucacaucuagcucgaauguauaacggauaugcuggaggauucgaaguucaaguaauacucgcaggaaacgccuuuaccgcaggaaaaauaauuuucgcagcaguaccaccaaauuuuccaacugaaggccuaaguccaagccaaguuacaauguuuccacauauuauaguagacguacgacaacuugaaccaguucuuauuccucuuccagauguaagaaacaauuuuuaucauuauaaucaauccaacgauucuacuauaaaacuaauagcaaugcuuuacacaccacuucgugcaaauaaugcaggugaugacguauuuacaguaucauguagaguccuaaccagaccaucaccagacuuugauuuuauauucuuaguacccccaacaguugaaucuagaacuaaaccuuuuacaguaccaauccucacuguagaagaaaugacaaauucaagauuccccauccccuuagaaaaauuauucacaggacccucaucagcauucguaguacaaccacaaaacggaagauguacaacagacggaguacuauuaggaacaacucaacucucuccaguuaauauuuguacauuuagaggagacgucauacauauaccaggaacaagaacauauagaaugaaucucgcaagccaaaacuggaauaauuacgaucccacagaagaaauaccagcaccuuuagguacaccagacuuuguaggcaaaauccaaggaaugcuaacacaaacaacaaaaggagacggaucaacuagaggacauaaagcuacaguaucaaccggauccguagauuucacuccuaaacuaggaucaguccaauucgcaacagauaccgauaaugauuucgaaacaggucaaaauacaagauuuacuccuguaggaguaauacaagacggcuccucagcacaucgaaaugaaccucaacaauggguauuacccgacuauucuggucgaacaguacacaacguacauuuagcaccugccgucgccccaaccuuuccaggagagcaacuauuauuuuuucgaucaacaaugccagguuguucuggauauccuaacauggauuuagauugucuacuaccacaagaauggguacaacacuuuuaucaagaagcagccccaucccaaagcgaugucgcccuacuacgauuuguaaauccagauaccggaagaguauuauucgaauguaaauuacauaaagcaggcuauguaacaguagcacauacaggccaacaugaucuaguuaucccaccaaauggcuauuucagauucgauucuuggguaaaucaauuuuauacacuagcaccaaugggaaauggcgcaggacgacgaagagcucuauag

SEQ ID NO: 32694 - RNA, 1623 nt, Artificial Sequence
  derived and/or modified sequence opt6 from capsid_protein__Norovirus__BAE98194
augaaaauggcauccaaugacgcaucaccuucagauggaaguacagccaauuuaguaccugaaguuaauaaugaaguaauggcuuuagaacccguaguaggagcagcaaucgcagccccaguagcaggacaacaaaauguuauugauccuuggauaagaaacaacuuuguacaagcaccuggaggagaauuuacaguaucuccaagaaacgcaccaggcgaaauccuauggucagcaccacuaggcccagaucucaauccuuaucuuucucacuuagcacgaauguacaacggauacgccgguggauucgaaguacaaguaauauuagcaggaaaugcauuuaccgccggaaaaauaauauuugcugcgguaccuccaaauuuuccaacagaaggcuuaucaccaucacaaguaaccauguuuccucacauuaucguagacguaagacaauuagaaccaguucuuauuccucuucccgauguaagaaauaacuuuuaucacuacaaucaaucaaacgauucaacuauaaaauuaauagcaauguuauacacaccauuacgagcaaacaaugcaggcgacgauguauuuacuguuucauguagaguauuaacccgcccauccccagauuuugacuuuauauuccuuguuccaccuacaguagaaucaagaacaaaaccguucacaguaccaauauuaacaguugaagaaaugacaaacucuagauucccaauuccacuagaaaaauuauuuacaggaccuucuucugcauuuguaguacaaccacaaaacggaagauguacaacagauggaguacuauuaggaacuacacaauuaucccccguaaacaucuguacauucagaggcgacguaacucauauacccggaacaagaacauaccgaaugaauuuagcaagucaaaauuggaauaacuaugauccuacagaagaaauacccgcuccacuagguacaccugacuuuguaggaaaaauacaagguauguuaacccaaacaacaaaaggagacggaucuacacgaggccacaaagccacaguuucuacaggauccguagacuuuacaccaaaacuagguagcguccaauucgcaacagauacagauaacgacuucgaaacaggucaaaauacacgauuuacuccaguaggcguaauacaagacggaucauccgcacacagaaaugaaccucaacaauggguacucccugacuauucaggacgaacaguccauaacguacauuuagcuccagcaguagccccaacauuuccaggugaacaauuacucuucuuuagaucaacaaugcccggauguucaggauacccgaauauggaucuugauuguuuacuaccacaagaauggguacaacauuucuaucaagaagcagcaccaucucaaucugacguagcauuauuaagauucguuaacccugauacaggaagagucuuauucgaaugcaaacuacauaaagcaggauacguaaccguagcucauacgggccaacaugauuuagucaucccacccaauggauauuuuagauuugacucauggguaaaucaauuuuacacauuagcaccaaugggaaauggagcaggaagaagaagagccuuauaa

SEQ ID NO: 32695 - RNA, 1623 nt, Artificial Sequence
  derived and/or modified sequence opt6 from capsid_protein__Norovirus__BAE98197
augaaaauggcaucaaaugaugcauccccaucugaugguucaacagcuaauuuaguaccugaaguaaacaaugaaguaauggcacucgaaccagucguuggagcagcaaucgcugcuccaguagccggacaacaaaaugucauagacccauggauuagaaauaauuucguacaagcaccaggaggagaauucacaguuucaccaagaaaugccccaggagaaauacuauggucugccccauuaggacccgauuuaaauccauaucucucgcaccuagcacgaauguacaaugguuacgccggaggauucgaaguacaagucauccuagccggaaaugcauuuacagcaggaaaaauaauauuugcagcagucccaccuaacuuucccacugaaggauuaucuccaucucaaguaacaauguucccacacaucauaguugauguuagacaacuagaacccguacuaauaccacucccagauguccgaaacaauuucuaucacuauaaucaaucaaacgauucuacaauaaaauuaauagcuaugcuauauacuccauuaagagcaaacaaugcaggagaugaugucuuuacaguaucuugccgaguauuaacuagaccaucaccagacuuugauuuuauauuuuuaguaccacccacaguagaaucaagaacuaaaccuuucacagucccuauauuaacaguugaagaaaugacaaauucccgauuuccaauacccuuagaaaaacuauucacaggcccauccucagcauuuguuguacaaccucaaaauggaagauguaccacagacggaguucuuuuaggaacaacucaacuauccccuguaaauauaugcacauuuagaggagauguuacucacauauccggaacacgaacauacagaaugaauuuagcuucacaaaacuggaacaauuaugauccaacugaagaaaucccagcacccuuaggaaccccugauuuugucggcaaaauacaaggaauguuaacccaaacaacaaaaggagacggcucaacacgaggacauaaagcaacuguaucaacaggaucaguagauuuuaccccaaaacuagguucaguacaauuugcuacagauacugacaacgauuuugaaacaggacaaaauacaagauucaccccaguaggaguaauccaagacggaucaucuacucauagaaaugaaccacaacaauggguccucccagacuauucuggucgaacuguucacaauguacacuuagccccugcuguagcaccaacauuucccggugaacaacuacuauucuuuagaucaacaaugccagguuguuccggauauccaaauauggaucuagacugucuacuaccucaagaauggguucaacauuucuaucaagaagcagcaccuucacaaucagauguugcacuuuuacgauucguaaauccagacacaggaagaguccuuuuugaaugcaaacuucacaaagcaggauauguaacaguugcacacacaggucaacacgauuuaguaauaccaccaaauggauauuucagauucgauucuuggguaaaccaauuuuauaccuuagccccaaugggaaauggagcaggacguagaagagcccuauaa

SEQ ID NO: 32696 - RNA, 1623 nt, Artificial Sequence
  derived and/or modified sequence opt6 from capsid_protein__Norovirus__BAF45861
augaaaauggcaucuaacgacgcaaacccuucagacggaucagcagcaaaccuaguaccagaaguuaacaaugaaguaauggcauuggaaccaguuguaggagcagcaauagcugcacccgucgcaggacaaacaaauguaaucgacccauggauaagaaauaauuuuguacaagcaccaggaggugaauuuacaguaucuccaagaaaugcaccaggagaaauacuuuggucugcaccccuaggaccggauuuaaauccauaucuaucacacuuagcuagaauguauaacggacacgcaggcggauucgaaguacaagugauacuagcaggaaacgccuuuacagcaggaaaaauaaucuucgcugcaguaccuccaaacuuuccaacugaaggacuaucucccucacaagucacaauguucccccacaucauaguagacguacgucaacuagaaccaguccucauaccuuuaccagauguaagaaacaauuucuaucacuauaaccaaucuaaugacucuacaauuaaacuaauagcaaugcuauauacaccacuaagagcaaacaaugcaggagaagacgucuuuacaguaucauguagaguacuaacaagaccaucaccagacuucgacuuuauauuucuaguacccccaacuguagaaucuagaaccaaaccuuucacaguuccaauauuaacaguagaagaaaugacaaacucaagauucccaauaccauuagaaaaauuauuuaccggcccaucaggugcauucguuguacaaccacaaaauggaagauguacaacugacgguguauuacuaggaacaacacaauuaucaccuguaaauauaugcaccuuuagaggagacguuacacauauagcuggcaguagaaacuauacuaugaauuuagcaucauuaaacuggaauaacuaugauccaaccgaagaaauaccugcaccacuaggaacaccugauuuuguagguaaaauacaaggaguauuaacacaaacuaccaaaggagaugguucuacuagaggacacaaagcaacuguauauacuggcucagcuccauuuacaccaaaauuaggaucaguucaauuuucuaccgacacugaaaaugauuucgaaacucaucaaaauacgaaauucacaccaguaggaguaauacaagauggaucuacuacacauagaaaugaaccacaacaauggguauuaccaucauacucaggaagaaauguacauaauguucauuuagcacccgcaguagcaccaacauuccccggugaacaacuacucuuuuuuagaucaacaaugcccggaugcucaggauauccaaacauggaucucgauugcuuacuaccucaagaauggguacaacauuuuuaucaggaagcagcaccagcacaaagcgacgucgcauuauuacguuuuguaaauccagauacagguagaguacuauuugaaugcaaacuccauaaaucaggguacguuaccguagcucauacaggccaacacgaucuuguaauaccuccuaauggauauuucagauucgauuccuggguuaaucaauuuuauacauuagccccuaugggaaacgguacaggacgaagaagagcauuauaa

SEQ ID NO: 32697 - RNA, 1620 nt, Artificial Sequence
  derived and/or modified sequence opt6 from capsid_protein__Norovirus__BAF74508
augaaaauggcaucaaacgaugcaacaccuucagacggaucaacagcaaaucuaguaccagaaguuaauaacgaaguaauggcacuugaaccagucguuggagcagcaauagcugcaccagucgcaggacaacaaaauguuauagaucccuggaucagaucaaacuuuguacaagcaccagguggagaauuuacugucuccccacgaaaugcuccaggugaaauacuauggucagcaccauuaggacccgaucuaaauccuuaccuaagccacuuagcgcguauguacaauggauaugcaggaggauuugaaguacaagucauacuugcagguaacgcauuuaccgcagggaaaauaaucuucgcagcaguuccaccaaauuuucccacagaaggacuaucaccuucucaaguaacaauguucccucacauaauaguugacguuagacaauuagaaccaguccuaauaccauuaccagauguuagaaauaauuuuuaucacuauaaucaaucaaaugacucuaccauaaaacuaauagcuaugcuauauacuccuuuaagagcuaauaacgcaggagaugauguauucacaguaucuuguagaguauuaacaagaccaucccccgacuuugauuuuauuuuuuuaguuccuccaacaguagaaucacgaacaaaacccuuuacuguuccaauacucacagucgaagaaaugucuaacaguagauuucccauuccauuagaaaaauuguauacagggccgucaucagccuucguuguccaaccacaaaacggcagaugcacuacagauggaguuuuauuaggaacaacacaauuaucagcaguaaacauaugcacauuuagaggagauguaacacauauagcuggaagucacgauuauaccaugaauuuagcaucacaaaacuggaacaauuacgauccaacagaagaaaucccagcaccuuuaggcacaccagacuuuguaggaaaaauacagggaguacuuacacaaacaacacgaggugaugguuccacuagagcccacaaagcaacagucaguacaggaucaguacauuuuacuccaaaauuaggaucaguacaauacacaacagauacaaauaaugacuuucaaacaggacaaaacacuaaauucacaccaguuggaguaauucaagacggagauaaccaucaaaaugaaccucaacaauggguacucccuaauuauucaggaagaaccggacacaauguacaucuagcuccagccguugcuccaacauuuccaggagaacaauuacucuuuuucagaucaacaaugccaggcuguucaggauauccaaauaugaaucuugauugccuacuaccucaagaauggguacaacauuuuuaucaagaagcggcuccagcacaaucagauguagcauuauuaagauuuguaaaucccgauacaggcagaguauuauuugaaugcaaauuacauaaaucaggauacguaacagucgcacacacaggcccacacgacuuaguaauuccucccaauggcuauuucagauucgauaguugggucaaucaauuuuauaccuuagcaccaaugggaaauggcgcaggcagaagaagagcucuuuaa

SEQ ID NO: 32698 - RNA, 1620 nt, Artificial Sequence
  derived and/or modified sequence opt6 from capsid_protein__Norovirus__BAF74509
augaaaauggcuaguaacgaugcuaacccaucagacggaucaacagcaaaccucgucccugaaguaaacaaugaaguuauggcacucgaaccaguuguaggugcugcaauagcagcaccagucgcuggccaacaaaauguaauugacccuuggauaagaaauaauuucguacaagcccccgguggagaauuuacuguaagcccaagaaacgcaccuggagaaauacuaugguccgcaccccucggaccagacuuaaauccauaucuaagucaccuagcuagaauguauaacggauacgcuggcggauucgagguacaaguaauucuugcaggaaacgcuuuuacagcagggaaaauaauauucgccgcaguaccaccaaacuuuccaaccgaaggacuaaguccaucccaaguaacaauguucccacacauaauagucgauguaagacaacuagaacccguacuuauaccauuaccagauguacgaaacaauuucuaucacuacaaucaaucaaaugauucaacaauaaaacucauagcaaugcuauacacacccuuaagagcaaacaaugcaggugaugacguauucacaguauccuguagaguacuaacacgaccaucuccagauuucgauuucauuuuucuaguaccuccaacaguagaauccagaaccaaaccauuuacuguaccaauacuaacuguagaagaaaugucaaauucacgcuucccaauaccauuagaaaaacuuuacaccggaccaucauccgccuucguaguucaaccacaaaacggcagaugcacaacugauggaguacuacuaggaacaacucaauuaucugccguuaauauaugcacauucagaggagacguaacacauaucgcaggaucacacgauuacacuaugaauuuagcuucacaaaauuggaauaauuaugauccaacagaagaaauaccagcaccauuaggaacucccgacuuuguagguaaaauacaaggaaugcuaacacaaacaacuagagaagacggaucaaccagagcccauaaagccacaguaaguacagguucuguacauuuuacaccaaaauuagguucaguucaauacacaacugacaccaacaaugacuuucaaaccggacaaaacacaaaauucacacccguaggaguaauacaagauggaaacaaucaccaaaaugaaccacaacaauggguauuaccuaauuacaguggaagaacuggacacaacguacaccuagcccccgcuguagcacccacauuuccaggagaacaacuuuuauucuuuagaucaacaaugcccggaugcucaggauaucccaauaugaaccuagauugccuauuaccacaagaauggguacaacauuucuaccaagaagcagcaccagcucaauccgacgucgcacuauuaagauucguaaacccagauacaggaagaguccuuuucgaaugcaaacuacauaaaucaggauauguaacugucgcacauacaggcccacaugauuuagucaucccaccaaacggauacuucagauucgauucuuggguuaaucaauuuuauacauuagcaccaaugggaaacggugcaggucgaagaagagccuuauaa

SEQ ID NO: 32699 - RNA, 1620 nt, Artificial Sequence
  derived and/or modified sequence opt6 from capsid_protein__Norovirus__BAF74510
augaaaauggcauccaaugacgcuaacccaucagauggcucuacagcaaaucuaguucccgaaguaaauaaugaaguaauggcacuagaacccguagucggagcagcaauagcagcaccugucgcaggccaacaaaauguaauagacccauggauucgaaacaauuuuguccaagcaccaggcggagaauuuacaguaucaccacgcaacgcaccuggagaaauauuauggucugcaccuuuaggcccagacuuaaauccauacuuaucgcacuuagcaagaauguacaauggauacgcaggugguuucgaaguccaagucauauuagcaggaaaugccuucacagcaggaaaaauaauuuuugcagcaguaccaccaaauuucccaacagaaggacucucuccaucacaaguuacuauguucccucacaucauuguagacguaagacaacuugaaccaguauuaauaccacucccugacguacgaaauaauuucuaucacuauaaucaaaguaaugauucaacaauaaaacuaauagcuauguuauacacaccucuuagagcaaauaacgcgggagacgauguuuuuacaguauuuugucgaguuuuaacccgaccuuccccagauuuugacuuuauauucuuaguaccacccacaguugaaucacgaacaaaaccuuucacaguacccauauuaacaguugaagaaaugucaaauagcagauuuccaauaccccuugaaaaauuauauaccggucccucaucagcauuuguaguacaaccacaaaacggucgauguacuacagaugguguucuacucggaacaacacaauuaucagcaguaaauauaugcacauucagaggcgacguaacacacauagcagguucccacgacuacacaaugaaccuugccucacaaaauuggaacaauuaugauccuacagaagaaauuccagcuccauuagguacaccagauuuuguaggaaaaauucaaggaauguuaacacaaacaacacgcgaagauggaucaacacgagcacauaaagcuacugucucaacaggaucaguccacuuuacaccaaaauuaggauccguacaauauacaacagacacaaacaacgauuuccaaacuggacaaaauacaaaauuuacuccagucggaguaauacaagauggaaauaaucaucaaaaugaaccacaacaauggguacuaccaaauuauagugguagaacaggucacaauguacaccuagcaccagcuguugccccaacauuuccaggagaacaacuauuauucuuccguucaacuaugccaggauguucugguuacccaaacaugaaccuugacugccuauuaccacaagaauggguacaacauuucuaccaagaagcagcuccagcacaaucagauguagcauuauuaagauuuguaaauccagauacaggaagaguacuauuugaauguaaauuacauaaaucaggauauguaacagucgcacauacagguccacacgacuuaguaauacccccuaacggcuauuuuagauuugacucuuggguuaaucaauuuuauacacuugcaccaauggguaacggugcaggaagaagaagagcacuauaa

SEQ ID NO: 32700 - RNA, 1620 nt, Artificial Sequence
  derived and/or modified sequence opt6 from capsid_protein__Norovirus__BAF74511
augaaaauggcauccaaugaugcaaaccccagugauggaucaacagcaaaucuuguaccagaaguaaauaaugaaguuauggcauuagaaccaguaguaggagcagcuauagcugcacccguagcaggacaacaaaacguaauagacccuuggauaagaaauaacuucguacaagcuccuggaggugaauuuacagucucaccaagaaaugcaccuggagaaauacucuggucugcaccacucggcccagaccuaaauccuuacuuaucacacuuagcaagaauguacaacggauacgcuggaggauucgaaguacaaguaauacuugcaggaaacgcauuuaccgcaggcaaaauaauauuugcagcagucccaccaaacuucccuaccgaaggccuaucaccaucacaaguaacuauguuuccacacauaauaguagaugucagacaacuagaaccaguacucauaccuuugcccgauguucguaacaauuucuaccacuauaaccaaucaaaugauucaacaauaaaacuaauagcaauguuauauacaccucuaagagcaaauaaugccggagaugauguauucacaguaucaugcagaguacuaacgagaccaucuccagauuuugacuucauauuucuaguacccccuacaguagaaagcagaacaaaaccuuucaccguaccaauacucacaguugaagaaaugucaaacucccgauuuccuauaccacuugaaaaauuauuuacaggaccuaguucagccuucguaguacaaccacaaaaugguagauguacuacagauggaguauuauuaggaacaacucaauuaagcgcaguaaauauuugcacuuuuagaggagacguaacacauauagcugguucucacgauuauacaaugaaccuagcuucccaaaacuggaauaauuaugacccuacugaagaaaucccagcaccauuaggaacaccagacuuuguaggcaaaauacaaggaauguuaacacaaacaacucgagaagacggaucuacacgugcccauaaagccacaguuuccacaggaucaguacauuucacaccuaaacuagguucaguacaauauacuacagacacaaacaaugauuuccaaacaggacaaaauacaaaauuuacaccagucggcguaauccaagauggaaauaaucaucaaaaugaaccacaacaaugggucuuaccaaauuacucaggaagaacaggccacaacguacacuuagcaccugcaguagccccuacuuuuccaggagaacaacuacuauucuuuagaucaacaaugccuggauguuccggauacccaaacauggaccuagacugcuuacuaccucaagaauggguacaacauuuuuaucaagaagcagcaccugcacaaagugacgucgcauuauuaagauucguuaauccugacacaggacgcguauuauuugaauguaaauuacacaaaucagguuacguaacgguagcccauaccggaccucacgauuuaguaauaccaccaaacgguuacuucagauuugacucauggauaaaucaauucuauacucuagcaccuaugggaaacggagcagguagaagaagagcuuuauaa

SEQ ID NO: 32701 - RNA, 1620 nt, Artificial Sequence
  derived and/or modified sequence opt6 from capsid_protein__Norovirus__BAF74512
augaaaauggcaucaaacgacgcaacaccaucagacgguucaacugcaaaucuaguaccugaaguaaauaaugaaguaauggcuuuagaacccguaguaggagcagcaauagcagcacguguagccggacaacaaaauguaauagauccuuggaucagaaauaacuuuguacaagcaccaggaggugaauuuacaguaucaccucgaaaugccccaggagaaauauuguggucagccccacuaggcccagaucuaaauccauauuuaucucaccucgcuagaauguauaacggauaugcuggaggauucgaaguacaagucauucuagccggaaacgcauuuacagcaggaaaaaucaucuuugcagcaguaccaccaaauuuuccuacagaagguuuaagcccaucacaaguuacaauguuuccacacauaauagucgauguacgacaacuagaaccaguucuaaucccacuuccagacgucagaaauaacuucuaucacuauaaccaaucaaaugacucuacuauuaaacuuauagcaauguuauacacuccacuaagagcaaacaacgccggcgaugauguuuuuacaguaucauguagaguauuaacacgaccuucaccagacuuugacuuuaucuuucuagucccuccuacaguagaaucuagaacuaaaccauuuaccgucccuaucuuaacaguagaagaaaugucaaacucaagauuuccaguaccacucgaaaaauuauauacagguccaucaucugcuuuugucguacaaccacaaaacgguagaugcacaacagacggaguauuacugggaacuacacaauuaucugcaguaaauauauguacauuuaggggagacgucacacauauagcaggaagucacgauuacaccaugaaccucgcaucacaaaacuggaauaauuaugaucccaccgaagaaauuccagccccauuagguacaccagacuucguagguaaaauacaaggcguuuuaacucaaacaacaagagaagacggaucuacaagagcacacaaagccacuguaucuaccggauccguacacuuuacaccuaaacuuggcucaguacaauauacaacagauacaaacaacgacuuucaaacaggacaaaauacaaaguuuacuccaguaggaguuauacaagauggaucaaaucaccaaaacgaaccacaacaauggguauuaccaaacuauucaggaagaacaggccacaauguacauuuagcaccagcuguugcaccaacuuuuccaggugaacaauuauuauuuuucagaucaacaaugcccggaugcucaggcuacccuaauaugaaccucgauugcuuauuaccacaagaauggguacaacacuuuuaccaagaagcagcaccagcacaaucagacguagcauuacuaagauuuguaaacccagacacagguagaguacuauucgaauguaaauuacauaaaagcggauauguaacuguagcacauacagggccacaugaucuaguuaucccaccaaacggauauuuccguuuugauaguuggguaaaccaauucuauaccuuagcacccauggguaacggugcuggccgcucaucagcgcuauaa

SEQ ID NO: 32702 - RNA, 1620 nt, Artificial Sequence
  derived and/or modified sequence opt6 from capsid_protein__Norovirus__BAF74513
augaaaauggcaucgaacgaugcaaaucccucagauggauccacagcaaaucuaguaccagaaguaaacaaugaaguaauggcacuagaaccaguaguaggagcagcaauagcagcuccaguugccggacaacaaaauguaauagauccauggaucagaucuaacuuuguacaagcaccaggaggagaauucaccgucucaccacgaaaugcaccaggcgaaauacuaugguccgcuccucuaggaccagauuugaauccauaucuaucacaucuagcuagaauguacaauggauacgcaggagguuuugaaguacaaguaauacuagcuggcaaugccuucacagcaggaaaaauaauauucgcagcaguuccaccaaacuuuccaacggaaggacuaaguccuucucaagucacuauguuuccccacauaauaguugauguaagacaacuagaaccagugcuaauuccauuaccugacguaagaaacaauuucuaucacuauaaucaaucaaacgacucaacaauuaaacuaauugcaauguuauacaccccauuaagagccaauaacgcaggagacgacguauucacaguuucauguagaguacuaacacguccaucaccugacuuugacuuuauauuuuuaguaccaccaaccguagaaucuagaaccaaaccauuuacugucccaauccuuaccguugaagaaaugucaaacucucgauucccuguacccuuagaaaaacuauacacaggaccauccuccgccuucguaguacaaccgcaaaauggacgauguacaacagauggcguauuacuagguaccacacagcuuucagcaguaaauaucugcacauuuagaggagacguuacacauauagcaggaucacaugauuacacaaugaacuuagcaucacaaaauuggaauaauuacgacccaacugaagaaauacccgcaccuuuaggaacacccgacuuuguaggaaaaauucaaggaguuuuaacccaaacuaccagagaagauggcucaacaagagcacacaaagccacaguaucuaccggaucaguacauuucacacccaaacuaggaucaguacaauacaccacagauacaaauaaugauuuccaaacaggucaaaauacaaaauuuacaccaguuggaguuauacaagaugguaguaaccaccaaaaugaaccacaacaauggguauuaccaaauuacagcggaagaacaggacacaauguacauuuagcaccagcuguagcucccacauucccaggagaacaacuucuauuuuucagaucaacaaugccuggauguucaggauauccaaacaugaaccuagacugccuccuaccacaagaauggguacaacacuucuaccaagaagcagcaccagcacaaucagauguagcuuuauuaagauucguaaaccccgauaccggaagaguacuuuuugaauguaaacuucauaaaucaggauacguuaccguagcacauacaggaccccaugaccuugucauuccaccaaacgguuauuuuagauuugacucauggguuaaccaauucuauacacuagcaccaaugggcaacggagcuggacgaagaagagcauuauaa

SEQ ID NO: 32703 - RNA, 1623 nt, Artificial Sequence
  derived and/or modified sequence opt6 from capsid_protein__Norovirus__BAF74514
augaaaauggcuucaaacgaugccaauccaucagauggaucaacugcaaauuuaguaccagaaguaaauaaugaaguaauggcucuagaaccagucgucggagcugccauagcagcuccaguagcagggcaacaaaauguuauagacccauggauuagaaacaauuuuguacaagcucccggaggagaauuuacgguaagucccagaaaugcuccaggagaaauacuauggucagcaccauuaggaccagacuuaaauccauaucuaucucaccuagcacguauguauaacggauacgcaggcgguuucgaaguccagguuauacuagccggaaaugcauuuaccgcaggaaaaauuauuuuugccgcuguuccaccuaacuuuccuacagaaggucuaucacccucucaaguaacaauguucccccacauaauaguagacguacgccaacuagaaccaguauuaaucccacuaccagauguaagaaauaauuucuaucacuacaaccaaucaaaugauccaaccauaaaauuaauagcaauguuauacacccccuuaagagccaauaacgcaggagaagauguauuuacaguaucaugcagaguacuuacacgaccuucuccagacuucgacuucauauuucuaguaccacccacaguagaaucaagaacuaaaccauucacuguuccaauacuaacaguagaagaaaugacuaacagcagauucccaaucccauuagaaaaacuuuucacugguccaucuggcgcuuucguaguacaaccacaaaacggacgcuguacaacugacggaguacuacuaggaacaacucaauuaucaccaguaaauauaugcacacuaagaggagauguaacucauauagcaggaacacauaauuauaccaugaaucuagcaucucaaaacuggaauaauuacgauccaacagaagaaauaccagcaccauuaggaacaccagacuuuguaggucgaauucaagguguacuaacucaaacaacaagaggagauggauccacaagaggacauaaagcaacaguaucaaccggagacguacacuuuacaccuaaauuaggcucaguacaauucaauaccgacacaaauaacgauuucgaaauuggacaaaauacucgauuuaccccaguuggaguaguacaagacggaaauggaacacaucaaaacgaaccacaacaauggguuuuaccaucauauuccggcagaacaggacauaauguucaccuugcaccagcuguagcacccacauuuccaggugaacaacuauuauuuuuuagaucaacaaugccaggauguuccggauauccaaauaugaaccuagauugcuuacuaccacaagaauggguucaacauuuuuaucaagaagcagcaccagcacaaucugacguagcacuucuacgauucgucaacccggauacaggaagaguuuuauuugaaugcaaacuacauaaaucaggauauguaacaguugcacauacaggucaacacgauuuagucauaccaccaaauggcuacuuuagauuugacucauggguuaaccaauuuuauacacucgcuccaauggguaauggaacaggaagaagaagagcauuauga

SEQ ID NO: 32704 - RNA, 1620 nt, Artificial Sequence
  derived and/or modified sequence opt6 from capsid_protein__Norovirus__BAF74515
augaaaauggcuucuaaugaugcaaauccaucugacggaucagcagcaaaucuagugccagaaguaaacaacgaaguaauggccuuagaaccaguaguaggagcagcaauagcugccccagucgcgggacaacaaaacauaauagauccauggauaagaaauaacuuuguacaagcaccaggaggugaauucacaguaucaccccgcaacgcaccaggcgaaauauuauggucagcaccauuaggcccagaccuaaaccccuaucuuucccauuuaucacgaauguacaacggcuacgccggaggauucgaaguacaagucauauuagcaggaaaugcauucacagcaggaaaaguaauauuugcugccguaccaccuaauuuuccuacugaaggacuaucaccuucacaaguaacaauguuuccacauauaauuguagauguaagacaacuugaaccaguauuaauaccucuaccagauguaagaaauaauuuuuaucacuauaaccaagcacaugauaguacacucaaacucauagccaugcuuuauacaccucuuagagcaaauaaugccggagaugacguauucacuguauccuguagagucuuaacaagaccaucaccagacuucgauuucauuuuuuuaguaccaccaacaguagaaucacgaacuaaaccauuuacagucccaguucuaacagucgaagaaaugacaaauucaagauuccccauacccuuagaaaaacuuuauaccggaccaucaucagcaauaguaguacaaccucaaaacggaagauguacaacagacgguguauuauuaggaacaacacaacuauccgcaguuaauauauguacauuuagaggggauguaacacacauugcagguucuagaaacuacacaaugaacuuagcaucucaaaacuggaauaacuacgacccaacagaagaaauaccagcaccccuaggaacaccagacuucguuggaaaaauacaaggacuauuaacacaaacaacuagagcugaugguucaacacgagcccacaaagccaccguauccacuggaagcguacauuuuaccccaaaauuaggauccguacaauuuucuaccgauacagauaaugauuuccaacccggacaaaacacaaaauuuaccccaguaggcguaauacaagauggagaucgacaucaaaacgaaccacaacaauggguauuaccugauuuuuccggaagaacaggacacaauguacaucuugcacccgcuguagcucccacauuuccaggugaacaauuauuauuuuuccgaucaacaaugccaggcagaucaggauauccaaauaugaauuuagauugucuauuaccacaagaauggguccuacacuucuaucaagaaucugcaccagcccaaucagauguugcauugcuaagauuuguaaacccugacacaaauagaguucuauuugagugcaaacuacauaaauccggauacauuacaguagcacauacaggccaccacgauuuaauacuaccucccaacggauacuuccgauuugacucguggguaaaucaauucuauacacuagcaccaaugggcaauggagcuggucgacgcagagcuccauaa

SEQ ID NO: 32705 - RNA, 1623 nt, Artificial Sequence
  derived and/or modified sequence opt6 from capsid_protein__Norovirus__BAF74516
augaaaauggcaucuaacgacgccacacccucagaugguucaacagccaaucuuguaccagaaguaaauaaugaagucauggcccuagaaccaguaguuggugcagcaauagcugccccaguagccggacaacaaaacguaauagacccuuggauaagaaauaacuucguacaagcucccgguggugaauuuaccguaucccccagaaaugcaccaggagaaauauuauggucagcaccucucggcccagaucuuaauccauaccuaagccacuuagcaagaauguauaauggauaugcuggcggauucgaaguucaaguuguacuagcagguaaugccuuuacagcaggaaaaauaaucuucgcugcagucccaccaaacuuuccaacagaaggauuaucuccuucacaaguuacaauguuuccacauauaauaguagacguaagacaacuagaaccaguuuuaauaccacuaccagauguacguaauaauuuauaucacuauaaccaaucuaaugauccaacaauaaaauuaaucgcaaugcuauacaccccccuaagagcuaauaaugcaggagaagaugucuucacaguaucuugucgaguucuaacacgccccagcccagauuuugauuucauauuuuuaguuccgccaacaguagaaucaagaacaaaaccauuuacuguaccaauacuaacaggagaagaaaugacaaacucaagguuccccaucccacuugaaaaacuauuuacagguccaaguggagcauuugucguucaaccacaaaacggcagaugcacaacagacgguguacuucuaggaacuacacaauuacuaccuguaaauaucuguacauuucgaggugacguaacacauauagcaggaacacacaauuacaccaugaaucuagcuucacaaaauuggaacaacuaugaucccacagaagaaauaccagcaccauuagguaccccugauuuuguaggaagaauacaaggcaugcuuacacaaaccacuagaggagacggaucuacaagaggucauaaagcgacuguaucaaccggagacguacacuucacgccaaaauuaggaucuauacaauucaacacagauacaaauaacgauuuugaaacaggacaaaacacaaaauucaccccaguaggaguuguccaagacggaaacggcacacaucaaaaugaaccacaacaauggguauuacccucauauucaggucgaacgucucauaauguacacuuagcuccugcaguugcaccaacauuuccaggagaacaauuauuauucuuuagaucuacaaugccaggaugcucuggauauccaaauaugaaucuagauugccuauuaccacaagaauggguucaacacuucuaucaagaagcagcaccagcccaauccgauguagcucuacuaagauucguuaaucccgauacaggaagaguacuauucgaauguaaauuacacaaaagcgguuauguaacuguugcccacacaggacaacacgaucuaguaauaccuccaaacggauacuuuagauuugauucaugggucaaucaauuuuacacacuagcucccaugggcaacggaacuggcagacguagagcacuauaa

SEQ ID NO: 32706 - RNA, 1623 nt, Artificial Sequence
  derived and/or modified sequence opt6 from capsid_protein__Norovirus__BAF74517
augaaaauggcaucaaacgacgcuaaccccucagacggaucugccgcaaaucucguaccagaaguuaauaacgaaguaauggcuuuagaaccaguaguaggugcagcuaucgcugcacccguggcaggacaacaaaauguuauagacccauggauaagaaauaacuuuguacaagccccugguggagaauuuacaguuucacccagaaaugcaccaggagaaauauuauggucagcaccccuagggccagaucuaaauccauauuuaucccaccuugcaagaauguauaacggauacgcaggagguuuugaaguacaaguaauauuagcaggaaaugcuuuuaccgccggcaaaauaauauucgcagcagucccucccaacuuuccaaccgaaggauuaucccccucacaaguuacaauguuuccacacauaauaguagacguaagacaacuagaaccaguacuaauaccacuaccugauguccgaaacaauuucuaucacuacaaccaauccaaugacucaacaaucaaauuaauagcuaugcuauacacaccauuacgagcaaacaaugcaggagaagauguauuuacaguaucuuguaggguauuaaccagaccaagcccagauuuugacuucauauuuuuaguaccaccaaccguagaaucaagaacaaaaccauuuacagugccaaucuuaacagucgaagaaaugacaaacaguagauuuccaauacccuuagaaaaauuauuuacaggaccaucuggcgcauucguuguucaaccucaaaauggcagaugcaccacugauggaguauuauuaggaacaacacaauuaucuccagucaauauauguacauuuagaggugacguaacucauauagccggaacacauaauuacacaaugaacuuagcuucucaaaacuggaauaauuaugauccaacagaagaaauaccugccccacucggcacaccagauuuugucggaagaauacaaggaaugcuaacacaaacaacaagaggagauggcaguacaagaggacauaaagccacugucagcacuggggacguacacuuuaccccaaaacuuggauccauucaauucaacacagauacuaauaaugauuucgaaacuggacaaaacacaaaauuuacacccguaggcguaguacaagacggaaacggagcacaucaaaaugaaccacaacaauggguauuaccaucauauucaggaagaacaggacauaacguacauuuagcaccagcaguagccccaacauucccaggagaacaacuacuuuuuuuucgcucuacaaugccaggaugcucuggauacccaaauaugaaucuagauugucuauuaccucaagaauggguacaacauuuuuaucaagaagcagcaccagcacaaucugauguagcauuacuaagauucguuaauccugacacaggucguguacuauuugaaugcaaauuacauaaaucaggauauguaacuguagcacauacuggacaacacgaucuaguaauacccccaaauggauauuucagauucgauuccugggucaaucaauucuacacccuagcucccaugggaaaugguacagguagaagaagagcacuauaa

SEQ ID NO: 32707 - RNA, 1623 nt, Artificial Sequence
  derived and/or modified sequence opt6 from capsid_protein__Norovirus__BAF74518
augaaaauggcaucaaaugaugcuaacccauccgauggaucaacagcaaaccuuguaccagaaguaaacaaugaaguuauggcauuagaacccgucguuggagcagcuaucgcagcgccaguugcaggacaacaaaacguaauagacccauggauacguaacaauuuuguacaagccccuggcggagaauuuacuguaucacccagaaacgcaccaggagaaauacuauggucagcaccacuagggccagaucucaacccauacuuaucucauuuagccaggauguauaacggauaugcuggaggauucgaaguacaaguaauccuagcaggaaaugcuuuuacugcaggcaaaauaauauuugcugcaguacccccaaacuucccaacagaaggacuaucaccuucacaaguuacaauguuuccacacauaauagucgauguacgacaacuagaaccaguacuaauuccacuaccagauguccgaaauaauuucuaucauuauaaccaaucaaaugauccuacuauaaaacuaaucgcaauguuauacacuccccuuagagcaaacaacgccggcgaagacguauuuacuguaucuugccgagucuuaacacgaccaucaccugacuuugauuuuauauuucucgucccaccaacaguagaaucucgaacaaaaccauuuacagucccaauauuaacaguugaagaaaugacaaauucccgauuucccauaccucuagaaaaauuauuuacaggaccaucaggagcauucguaguacaaccccaaaauggcagauguacaaccgauggaguauuacuugguacaacucaacuaucaccaguuaauauaugcacauuuagaggugacguaacucauauagcuggaacacacaacuacacaaugaauuuagcaucccaaaacuggaauaauuacgacccaaccgaagaaauaccugcaccccuaggaacaccagacuuuguaggaagaauucaaggaaugcuaacccaaacaacaagaggcgacggauccaccaggggucacaaagcaacaguaucuacaggcgacguacauuuuacaccaaaauuggguucaguacaauucaauacagauacaaauaacgauuucgaaacaggacaaaauacacgauucacaccagucggcguaguccaagacggcaauggaacccaccaaaaugaaccccaacaauggguauuaccuucauacuccgguagaacaggacacaauguacacuuagcuccagcaguagcaccaaccuuccccggcgaacaauuacuauuuuuuagauccacaaugcccggaugcucaggauacccaaauaugaacuuagacugccuuuuaccacaagaauggguacaacacuucuaucaagaagcugcuccagcccaaucagacguagcauuacuacguuucguaaauccagacacaggccgaguacucuucgaaugcaaacuacauaaaucaggauauguaacaguagcucacacaggacaacacgaucuaguaaucccuccuaauggcuauuuuagauuugauagcugggucaaucaauuuuauacuuuagcuccaaugggaaacgguacaggacguagacgagcacuauaa

SEQ ID NO: 32708 - RNA, 1623 nt, Artificial Sequence
  derived and/or modified sequence opt6 from capsid_protein__Norovirus__BAF74519
augaaaauggcaucaaacgaugcaacaccaucugacgguucaacagcuaaccucguaccagaaguuaacaaugagguaauggcacuagaaccagucguaggcgcugcaauagcagcaccugucgcaggccaacaaaauguuauagacccauggauacgcaacaauuuuguccaagcaccaggaggagaguucaccguaucaccucguaaugcucccggcgaaauacuauggucagcaccacuaggaccagaccuaaauccauaucuaucacacuuagcaagaauguauaaugguuaugccggaggauuugaaguacaagucauauuagcuggaaaugccuucacagccgguaaaauaauauuugcugcaguucccccaaauuucccaacagaaggcuuaucuccuucacaagucaccauguuuccacauaucauaguagauguucgacaacuugaaccaguauuaauaccacuaccagauguaagaaacaauuucuaccacuacaaccaaucaaaugacccuacaauuaaauuaauagcuauguuauauacaccauuacgagccaacaaugcuggugaagacguuuuuacaguauccuguagagucuuaacaagaccaucaccagauuuugacuucauauuuuuagucccaccaacaguagaaucaagaacaaaaccauuuacaguaccaauucuaacuguagaagaaaugacaaauuccagauucccaauaccauuagaaaaacuauucacaggaccuucaggagcauucguaguacaaccacaaaauggacgaugcacaacugacggaguauugcuaggaacaacacaauuaucaccaguaaauaucuguacuuuccgaggugacguaacacauauagcaggaacucacaacuauacaaugaacuuagcaucacaaaauuggaacaacuaugauccaacagaagaaauaccagcuccacuaggaacaccagacuucguagguagaauacaaggaaugcuaacacaaaccacaagaggagacggauccacaagaggucacaaagccaccguaucaacaggagacguacauuuuacuccuaaauuaggaucaauccaguucaauacagauaccaacaacgauuuugaaacaggccaaaacacaaaauuuacaccaguuggaguaguccaagaugguaauggaacacaucaaaaugaaccacaacaauggguccuaccauccuauucaggaagaacuggucacaacguucauuuagcaccugcaguagcaccuacauuuccaggagaacaauuauuauucuuuagaucuacaaugccagguugcagugguuauccuaauaugaaucuugauugccuucuaccacaagaauggguacaacauuuuuaucaggaagcagcacccgcacaaucagacguugcauuauuaagauucguaaauccugacacuggcagagucuuauuugaaugcaaacuucauaaaaguggauaucucacaguagcacacacaggccaacacgauuuaguaaucccaccaaauggauauuuucguuucgauucuugggucaaucaauucuacacacucgcuccaaugggaaacggcacaggaagaagaagagccuuauaa

SEQ ID NO: 32709 - RNA, 1623 nt, Artificial Sequence
  derived and/or modified sequence opt6 from capsid_protein__Norovirus__BAF74520
augaaaauggcaucaaaugaugccaacccuucagacggaucuacugcaaauuuaguaccagaaguuaacaaugaaguaauggcauuagaaccaguuguaggagcagccauagcagcaccaguagcuggacaacaaaauguuauagacccauggauacguaauaacuuuguacaagcaccaggaggagaauuuacaguaucuccaagaaaugcaccaggagaaauacuauggucugcaccacuaggaccagaccuaaauccauaccuaucacacuuagccagaauguauaaugguuacgcuggcggauucgaaguucaaguaauacuagccggcaacgcauucaccgccggcaaaauaauauucgcugcaguaccaccaaacuucccaacugaaggacuaucuccaucacaagucacaauguucccacacaucauaguagauguaagacaacuagaaccaguacuaauaccacuuccagacguaagaaacaacuuuuaucacuauaaucaaucuaaugacccaacaauaaaauuaauagcuaugcuauauacaccacuuagggcgaacaaugcaggagaagauguauuuacaguuucgugccgaguucucacaaggccaucaccagacuucgacuucauauuucuaguaccaccaacaguagaaucuagaaccaaaccauucacaguaccaauauuaacagucgaagaaaugacaaauucccguuuuccaauaccauuagaaaaacuauuuacaggaccaucaggagcuuuuguuguacaaccacaaaacgguagauguacaacagauggcguacuacuaggaacaacacaacuaucaccuguaaacauauguacauucagaggagacguaacacauauagcugguacacacaauuauaccaugaacuuagcuucacaaaauuggaauaauuacgauccaaccgaagaaauaccagcacccuuaggaacaccugacuuuguaggacguauacaaggaaugcuaacacaaacaacaagaggcgacgguucaacuagaggucacaaagcaacaguaucaaccggugacguacacuuuaccccaaaauuaggaucuauacaauuuaauaccgauacaaauaaugacuucgaaacaggacaaaacacaaaauucacaccaguaggaguaauccaagaugguaacggagcacaucaaaaugaaccacaacaauggguccuacccucauauucaggacgaacuggccauaacguacaccuagccccagccguagcaccaaccuuucccggcgaacaauuacuauuuuuccgaucaacaaugcccggaugcagugguuauccaaauaugaauuuagauugcuuacucccacaagaauggguucaacauuucuaccaagaagcagcacccgcacaaagugacguugcguuauuaagauuugucaauccagacaccggaagagucuuauucgaaugcaaacuccacaaaucaggcuauauaacuguagcucacacaggucaacacgaucucgucauaccaccaaauggauauuucagauucgauucuuggguaaaccaauuuuauacauuagcaccaaugggaaauggaacagguagaagaagagcauuauaa

SEQ ID NO: 32710 - RNA, 1623 nt, Artificial Sequence
  derived and/or modified sequence opt6 from capsid_protein__Norovirus__BAF74521
augaaaauggcaucaaacgacgcaaacccaucagaugguucuacagcaaacuuaguuccugaaguaaacaaugaaguaauggcauuagaaccaguaguaggagcugcuauagcagcacccguagcuggccaacaaaacguaauagacccauggauaagaaacaacuuuguccaagcaccaggaggagaauucacuguaagcccaagaaacgcaccaggagaaauccuuuggucagcaccacucggcccagauuuaaacccauacuuaucucaccuugcaagaauguacaaugguuacgcuggaggauuugaaguacaaguaauacuagcuggaaaugcauuuacagcaggcaaaauaauauucgcagcuguaccaccaucauuucccacagaagguuuaucaccaucccaaguaacaauguucccacauauaauaguugauguucgacaacuagaaccaguauuaauaccccuccccgacguaagaaauaauuuuuaccacuauaaucaaucuaaugacccaacaauaaaacuaauagcaauguuauacaccccuuuaagagcaaauaacgcuggcgaagauguuuucacaguuucuugucguguacucacacgaccgucaccagacuucgacuuuauauuuuuaguaccaccaacagucgaaucaagaacaaaaccauuuaccguaccuauacuaacaguagaagaaaugacuaauucacgauuucccauaccauuagaaaaacuuuucaccggacccuccggagcuuuuguaguacaaccacaaaacggaagauguaccacagacggaguauuacuaggcacaacacaauuaucucccguaaauauuugcacauuuagaggagauguaacacacaucgcagguacacacaacuacacaaugaaucuagcaucacaaaauuggaacaacuacgauccaacugaagaaauaccugcaccacuagguacccccgauuuugucggaagaauacaaggcaugcuaacacaaacaacaagaggagacggaucaacaagaggucacaaagcuacaguaagcacaggcgauguacacuuuacacccaaacucggaaguauacaauuuaauacagauacaaacaacgauuucgaaaccggacaaaauacaaaauucacccccguaggaguuguacaagacgguaacggaacacaccaaaaugaaccccaacaauggguacuaccuucauacucaggaagaacuggacauaacguucaucuagcaccagcaguugcaccuacauucccaggugaacaacuauuauuuuuuagaucuacaaugccuggauguucaggcuacccaaauaugaaucuagacugccuauuaccucaagaauggguacaacacuuuuaucaagaagcggcaccagcacagucugacguagcacuucuaagauucguaaacccagauacaggcagaguacuuuuugaaugcaaacuacauaaaucaggcuacguaacaguagcacauaccggccaacaugauuuaguaauuccaccaaauggauauuucagauuugauucauggguuaaucaauucuacacacuagcacccaugggcaacgguacuggaagaagaagagcauuauaa

SEQ ID NO: 32711 - RNA, 1623 nt, Artificial Sequence
  derived and/or modified sequence opt6 from capsid_protein__Norovirus__BAF74522
augaaaauggcaucaaaugacgcaacuccaucugauggaucaacagcaaacuuaguaccagaaguaaauaacgaaguaauggcauuagagccaguaguaggagcagcaauagcugcuccugucgcaggacaacaaaacguaauagacccauggauacgaaacaauuucguccaagccccaggaggagaauuuaccguuucaccacgaaaugcuccaggagaaauacucuggucugccccauuaggaccugaucuaaacccauacuuaucccauuuagccagaauguauaacgguuaugccggagguuucgaaguacaagucauuuuagcaggaaacgcuuuuacagcuggaaaaauaauauucgcagcaguacccccaaguuuucccacagaaggauuaucacccucacaaguaacaauguuuccacacauaaucgucgauguuagacaacuagaaccaguacuuaucccauuaccagauguaagaaacaauuuuuaucacuauaaucaaucaaacgauccaacaauaaaauuaauagcaauguuauauacaccucuaagagcaaauaaugcaggagaagauguauuuacaguaucuuguagaguauuaacaagacccucucccgauuucgacuuuauuuuucucguaccaccaacaguagaaucucguacaaaaccauuuacaguaccaaucuuaaccguagaagaaaugacaaacucaagauuuccaaucccacuugaaaaacuauucacuggaccaucaggcgcauuuguaguacaaccucaaaauggaagauguacaacugacgguguacuauuaggcacaacacaacuaucaccaguuaauauuugcacauuuagaggagacguuacacacauagcaggaacacacaauuacacaaugaaucuugcaucacaaaacuggaauaacuaugaucccacagaagaaauaccagcaccacucggaacaccagauuuuguagggcgcauacaaggaaugcuuacacaaacaaccagaggggaugguucaacacgaggacacaaagcaaccgucuccacaggcgauguucauuucacuccaaaacuugguucugugcaauuugauacagauacaaauagugacuuugaaaccggucaaaacacuaaauucacacccguagguguaguacaagacggaaauggagcacaucaaaaugaaccacaacaauggguucuaccaucauauucuggaagaacaggacauaaugcacaccuagcaccagcaguagcuccuacauuucccggagaacaacuauuauucuuuagaucuaccaugcccggaugcucaggauauccaaauaugaauuuagacugccuucuaccccaagaauggguacaacauuuuuaccaagaagcagcaccagcucaauccgacguagcauuacuaagauucguaaaucccgauacuggaagaguacuuuucgaauguaaacuucacaaaucaggauauguaaccguagcacauacaggacaacacgauuuaguuauaccaccuaacggcuauuuccguuucgauucauggguaaaucaauuuuauacauuagcaccuaugggcaaugguacuggaagacgucgagcccuauaa

SEQ ID NO: 32712 - RNA, 1623 nt, Artificial Sequence
  derived and/or modified sequence opt6 from capsid_protein__Norovirus__BAF74523
augaaaauggcaucaaaugacgcaacaccuucagauggaucuacagcaaacuuaguaccagaaguaaauaaugaaguaauggcucuagaaccuguaguaggagcugcuauugcagcaccaguagcaggccaacaaaaugucauagacccauggauacgaaauaauuucguacaagcuccaggcggagaauuuacaguaucaccaagaaaugcuccaggagaaauauuaugguccgcaccauuaggccccgaccucaacccauacuuaucucauuuagcaagaauguauaauggauaugcaggcggauucgaaguacaaguuauacucgcagguaacgcuuucacagcaggaaaaauaauauucgcagcaguuccuccaaacuuuccaacagagggauuaucccccucccaaguaacuauguuuccucacaucauugucgacguaagacaauuagaaccaguacuaauacccuuaccagauguccgcaacaauuucuaucacuauaaccaaucaaaugacccaaccauaaaacuaaucgcuaugcuauacacaccacuaagagcaaacaacgcaggagaugacguauuuacaguaucauguagaguauuaacaagacccaguccagacuucgauuuuauauuccuaguaccaccaacaguagaaucaagaacaaaaccuuuuucaguuccaaucuuaacaguugaagaaaugacuaauucaagauucccaauaccacuagaaaaacuauuuaccggaccaucaucagcauuuguaguccaaccacaaaacggccgauguacaaccgacggcguauuauuagguacaacucaacuauccccaguaaauauaugcacauuuagaggcgauguuacucauauugcuggaacacaaaauuauacaaugaaucuugcaagucaaaacuggaacaauuacgaccccacagaagaaauccccgccccucuugguacaccagacuucgucggaaaaauucaaggaguauuaacacaaaccacaagaagagauggaucaacccgaggccacaaagccacaguaucaacagguagcguccacuuuacaccaaaacucggcucaguacaauucuccacagauacuucaaacgauuuugaaacaggacaaaauacucguuucacaccaguaggaguaguacaagacggaucaacaacacaccaaaaugaaccccaacaauggguauuacccgauuacuccggucgcgauucacacaauguacaccuagcaccagcaguugccccaacuuuuccaggagaacaauuauuauuuuuuagaucaacuaugcccggcugcucaggauacccaaauaugaaccuugacuguuuauuaccacaagaauggguacaacauuucuaucaagaaucagcuccugcacaaucagauguugcauuacuaagauuuguuaacccagacacaggaagaguacuauuugaaugcaaauuacauaaauccggcuacgucaccguugcacacacaggacaacacgacuugguaauaccacccaauggauauuuucguuucgauucauggguaaaucaauuuuauaccuuagcacccaugggaaauggagcugguagaagaagagcccuuuaa

SEQ ID NO: 32713 - RNA, 1623 nt, Artificial Sequence
  derived and/or modified sequence opt6 from capsid_protein__Norovirus__BAF74524
augaaaauggcuucuaacgacgcaaccccaucugacggaucaacagcaaauuuaguaccagaaguaaacaacgaaguuauggccuuagaaccaguuguuggagcagccauagcagcaccaguagcaggacaacaaaacguaauagacccauggauaagaaauaacuuuguacaagcaccaggaggugaauuuaccgucagcccaagaaaugcuccaggagaaauucuauggucagcaccacuaggucccgaucuaaauccauaucuaucacacuuagcacgaauguauaacggauaugcaggaggcuucgaaguucaagucauauuagcaggcaaugcauucacagcaggaaaaauaauauucgcagcaguaccaccaaacuuuccaaccgaaggacuaucuccaagucaaguaaccauguuuccacacauaauaguugacguaagacaauuagaaccagugcuaauaccacuuccagauguacgaaauaauuuuuaucacuauaaccaaucuaacgacccaaccauuaaacuaaucgccaugcuauacacaccacuaagagcaaacaaugcuggagacgacguauuuacaguaucaugccgaguauuaacaagaccauccccagacuuugacuucauauuucuaguuccaccaacagucgaaucuagaacuaaaccuuucucagucccaauucuuacaguagaagaaaugacaaauucaagauuuccaauaccacuagaaaaacuauuuacaggaccuucgucagcuuucguuguacaaccccaaaauggacgaugcacaacagauggcguauuacuagguaccacucaauuaucaccaguaaauaucugcacauuuagaggagacguuacgcauauagcugguacacaaaacuacacaaugaauuuagcaucacaaaauuggaacaauuacgacccaaccgaagagauaccugcaccuuuaggaacuccagacuuuguaggaaaaauucaaggaguacuaacccaaacuacaagaagagacggaaguacccgaggacauaaagcuacaguaucaacaggaucaguacacuuuacuccaaaacuaggaucaguacaauucucuacagacacaucuaaugacuucgaaacaggacaaaauacacgauuuacaccaguaggaguaguacaagacggaucaacaacacaucaaaacgaaccccaacaauggguauuaccagauuauaguggaagagauucccauaacguucaccucgccccagcagucgcaccuacauuuccaggagaacaacuuuuauucuucagaagcaccaugccaggaugcuccgguuaccccaacaugaauuuagacugccucuuaccacaagaauggguacaacauuuuuaucaagaaucagcuccugcacaaagugacguugcacuacuaagauucguaaauccugacacaggcagaguauuauuugaauguaaacuacauaaaucaggauacguaacaguagcacauaccggacaacaugauuuaguaauaccucccaaugguuacuucagauucgacagcugggugaaucaauucuauacauuagcacccaugggaaauggagccggucguagaagagcauuauaa

SEQ ID NO: 32714 - RNA, 1623 nt, Artificial Sequence
  derived and/or modified sequence opt6 from capsid_protein__Norovirus__BAF74525
augaaaauggcuucaaaugaugcaaccccaucagauggaucaaccgcuaaccuagucccagaaguaaauaacgaaguaauggcacuagaaccaguaguaggagcugcaauagcagcuccaguagcaggacaacaaaacguaauagauccauggauaagaaauaacuuuguacaagcaccaggcggagaauuuacaguaaguccucgaaacgcaccaggagaaaucuuauggucagcaccucuaggaccagacuuaaauccauaucuaagccacuuagcacguauguauaauggauacgcaggaggauucgaaguacaaguuauucuugcaggcaaugcauucacugcaggaaaaauuauuuucgcagcaguaccucccaacuuuccaacagaaggauuaucaccuucacaaguaacuauguucccacacauaauaguugacguuagacaacuugaaccaguccuaauaccacuacccgaugucagaaacaauuuuuaucauuauaaccaaucaaaugacccaacaauaaaauuaauagcuauguuauacacaccccuaagagcgaauaacgcaggagacgacguauuuacuguaucaugccgaguacuaacaagaccuucaccugauuuugacuucauauuccuaguaccaccaacugucgaaucuagaacaaaaccauucagcguaccuauauuaacagucgaagaaaugacaaacucccgcuucccuauaccauuagaaaaacucuucacugguccaucaucggcauucgucguacaaccccaaaacgguagaugcacaacagauggaguacuacucggaacaacacaacuaucaccuguuaauauaugcacuuuuagaggcgacguaacacauauagcagguacacaaaauuauacaaugaauuuagccagucaaaauuggaacaauuaugauccaacagaagaaauaccugccccacuagguacacccgacuuuguuggaaaaauacaaggaguucuaacacaaacaacacgcagagacgguuccacucgaggacauaaagcuacaguaucaacaggauccguacacuucacaccuaaauuaggaucaguacaauuuucaacagacacaucuaacgacuucgaaacaggucaaaauaccagauuuacaccuguaggaguuguacaagauggaucaacaacacaucaaaacgaaccacaacaauggguucuaccagauuacaguggaagagacucacauaauguucacuuagcaccugcaguagcaccuacauuuccaggcgaacaauuacuauuuuuucgaaguacaaugccaggcuguaguggauaccccaauaugaauuuagacugcuuacucccccaagaauggguccaacacuucuaccaagaaucugcaccagcacaaucugacguagcacuucuacgauucguaaacccagacacaggaagaguuuuguuugaaugcaaacuacauaaaucaggauaugucacaguagcucacaccggccaacacgauuuaguuauucccccuaacggauacuucagauucgauucuugggucaaucaauuuuacaccuuagcuccaaugggaaauggagcaggaaggagacgugcuuuauaa

SEQ ID NO: 32715 - RNA, 1623 nt, Artificial Sequence
  derived and/or modified sequence opt6 from capsid_protein__Norovirus__BAF74526
augaaaauggcaucaaaugacgcaaccccaucagauggcucuaccgccaaucuaguaccagaaguuaauacagaaguaauggcucucgaaccaguaguaggagcagcaauagcagcaccagucgcaggacaacaaaauguuauugauccuuggauacguaacaauuucguacaagcucccggcggagaauuuaccgucucacccagaaaugcacccggagaaaucuuaugguccgcaccauuaggaccagacuuaaacccauauuuaucacacuuagccagaauguacaauggcuacgcugguggcuuugaaguacaagucauacuugcaggaaaugcauuuaccgcaggaaaaauaauuuucgccgcaguuccaccaaacuuuccuacagaaggauuaagcccaucacaaguaacuauguucccacacauaauaguagacguacgucaacuagaaccaguacucauaccacuaccagauguccgaaauaauuuuuaucauuauaaccaauccaaugauccaacaaucaaacuaauugcuaugcuauauacaccacuaagaacaaacaacgcaggcgaugauguauuuacaguauccuguagagucuuaacacgaccaaguccagacuuugacuuuauuuuuuuaguuccacccacaguagaaucucgaaccaaaccauucucagucccuauauuaacaguugaagaaaugaccaacucccgauuuccaauuccacuugaaaaauuauucacuggaccuucuagcgcuuucguaguccaaccacaaaauggacgauguacaacagacggaguacuauuaggaacaacacaacuuucaccaguaaauauauguacauuccgaggagauguaacacauauagcagguacccaaaauuacacaaugaaccuagcaagccaaaauuggaacaacuacgauccaaccgaagaaauaccugccccauuagguacaccugauuucguuggaaaaauacaaggagucuuaacacaaacuacaagaagagacggaucaacacgaggacacaaagcaacuguaucaacaggaucaauucacuuuacaccaaaauuaggaucaguacaauuuucuacagauacuucaaacgacuuugaaacaggacaaaauacaagauuuacacccguaggagucguacaagacggaucaaccacacaucaaaaugaaccacaacaauggguacuacccgacuauuccgguagagauucacauaauguucauuuagcuccagcuguagcaccaacauucccaggugaacaauuacuauuuuuucgaucuacaaugccuggauguucaggauaucccaacaugaaucuugauugcuuauuaccacaagaauggguacaacauuuuuaucaagaaagcgcaccagcacaaucagauguagcacuucuaagauucgucaauccggacacaggaagaguucuauucgaaugcaaauuacacaaaucuggcuauguaaccgucgcccacacuggacaacacgauuuaguaauaccaccaaauggauauuucagauucgacucauggguaaaucaauuuuauacauuagcaccaaugggaaacggagcugguagaagaagagcacuauaa

SEQ ID NO: 32716 - RNA, 1623 nt, Artificial Sequence
  derived and/or modified sequence opt6 from capsid_protein__Norovirus__BAF74527
augaaaauggcaucaaacgaugcuacuccaucugacggaaguacagcaaaucuaguaccugaaguaaauaaugaaguuauggcacuagaaccaguaguaggagcagcuauagcugccccagucgcaggccaacaaaacguaauugacccauggauaagaaauaauuuuguacaagcaccuggaggagaauuuacaguaucaccaagaaaugcccccggcgaaauauuauggucagccccauuaggacccgaccuaaaucccuaccuaucucauuuagccagaauguauaacggauaugcuggcggauuugaaguacaaguaauacuagcagguaaugcauuuacagcuggaaaaauaauauuugcagcaguaccacccaacuucccaacugaaggacuaucuccuucacaaguaacaauguuuccccacaucauaguugaugucagacaauuagaaccaguuuuaauaccauuaccagacguacgaaacaauuuuuaccauuauaaucaaucaaaugauccaacaauuaaacuaauagcaauguuauacacaccuuuaagagcaaauaaugcaggagaugacguauuuacaguuucgugucguguauuaacuagaccaucaccagauuuugacuucaucuuccucgucccuccaacaguagaaucacgaacaaagccuuuuucaguaccuauuuuaacaguagaagaaaugacaaacucuagauuucccauaccauuagaaaaauuauuuacagguccaucaucagcauuuguaguacaaccacaaaaugguagauguacaacagauggaguacuucuaggaacaacacaauuaucaccuguaaauauauguacauuuagaggugacguuacacacaucgcaggcacucaaaauuacaccaugaacuuagcaucucaaaacuggaacaacuaugauccgacagaagaaauacccgcaccucucggaacaccugauuuuguuggcaaaauacaagguguacuaacacagacaacacgucgagauggaaguacaagaggucacaaagcaaccguauccaccgguaguauacauuucacaccaaaacuaggcucaguccaauuuucaacagauacuucaaaugacuucgaaacaggacaaaauacaagauuuacaccuguaggagucguacaagacgguucuacaacacaucaaaaugaaccccaacaauggguucuaccugauuauuccggaagagauucacauaacguacauuuagccccagcagucgcuccuacauuuccaggagaacaacuauuauucuuuagaucaacuaugcccggauguucgggauacccaaauaugaacuuagacugucuccuaccucaagaauggguacagcauuucuaucaagaauccgcucccgcacaaucagauguugcuuuauuaagauuuguaaacccagauacagguagaguacuuuucgaaugcaaacuccacaaaucuggauauguuacuguagcucauacaggacaacacgauuuaguaauuccaccuaacgguuauuuucgauuugauucauggguaaaccaauuuuacacauuagccccaaugggaaauggugcaggaagacgaagagcacuauaa

SEQ ID NO: 32717 - RNA, 1620 nt, Artificial Sequence
  derived and/or modified sequence opt6 from capsid_protein__Norovirus__BAF95499
augaaaauggcaucaaaugacgcaaauccaucugaugguucaacagcaaaucuagucccagaaguaaacaaugaagucauggcauuagaaccaguaguaggcgcagcaauagcagcacccguagcaggacaacaaaauguuauugaccccuggauccgaaauaauuucguacaagcaccuggaggugaauuuacaguuuccccucguaaugcaccuggugaaauauuauggucagcaccgcuuggaccggaucucaaucccuaccuuucacacuuagcuagaauguauaauggauaugcaggagguuuugaaguccaagucauauuagcagguaacgcauuuacagcugguaaaauaauauuugcagcaguaccacccaauuucccuacugaaggucuaaguccuucccaaguuaccauguucccucauauaauaguagauguccgacaauuagaaccaguucuaauaccacucccagauguaagaaauaauuucuaucauuauaaucaaucaaaugauucaacaauaaaguuaauagcaauguuauacacaccauuacgcgccaauaaugccggagaugacguauucacaguaucuugucgaguauuaacuagaccaucaccugauuuugauuuuauauuucuaguaccaccuacaguugaaucccgaaccaaaccauuuacaguccccauacuaacaguagaagaaaugucgaauucaagauuuccuguaccacuagaaaaauuauacacagguccaagcucagcauuuguaguccaaccacaaaacgguagauguacaacagacggaguacuuuuaggcacaacacaacuaucagcuguaaacauauguacauuuagaggugaugucacacauauugcaggaucacaugauuauacuaugaaccuagcaucacaaaauuggaauaauuacgacccuacugaagaaauuccagccccacuuggaacaccagauuuuguuggcaaaauacaaggaguuuuaacucaaacaacaagagaagacggaucaacaagagcucauaaagccacaguaucaacaggaucaguacauuuuacuccaaaacuuggaucaguucaauauacaacagauacuaauaaugacuuccaaacaggacaaaauacuaaauuuaccccaguagguguuauacaagauggauccaaucaucaaaacgaaccacaacaguggguacuaccaaacuauucaggaagaacaggacacaacguccaucuugcaccagcagucgcaccaacuuucccaggagaacaauuacuuuucuuuagaucaacaaugccugguugcucuggauauccuaauaugaauuuggacugccuacuaccacaagaauggguucaacauuuuuaucaagaagcagcuccagcacaaagcgauguagcacuauuaagauuuguaaauccagauacuggacgaguccuauuugaauguaaacuacauaaauccggauauguaaccguagcacauacaggaccucaugauuuaguaauaccaccaaacggauauuuuagauuugacaguuggguaaaucaauuuuacacucuugcacccaugggaaauggugcagguagaagacgugcauuauaa

SEQ ID NO: 32718 - RNA, 1620 nt, Artificial Sequence
  derived and/or modified sequence opt6 from capsid_protein__Norovirus__BAF95501
augaaaauggcaucuaaugacguaaacccaucagauggaucagcagcuaaccuaguaccagaaguaaauaacgaaguaauggccuuagaaccuguaguaggagcagccauugcugcaccaguagcaggucaacaaaacauuauagacccauggauaagaaauaauuuuguacaagcacccggaggagaauuuacaguaucaccaagaaaugccccaggugaaauacuauggucagcaccucucgguccagaccuuaacccauaucuaucucaccuuucucgaauguauaauggauaugcaggaggcuuugaaguacaagucauuuuagcaggaaaugcguucacugccggaaaaguaauauucgcagcaguuccaccaaacuuuccuacagaaggauuaucaccaagccaaguaacuauguuuccucacauaauuguagacguccgacaauuggaaccaguacuaauaccacuaccagauguaagaaacaauuuuuaucauuauaaucaagcucaugauucuacuuuaaaauuaauugccaugcuauauacuccauuaagagcaaauaacgcaggagaugauguauucacuguaagcuguagaguccuaacaagaccuucaccagacuuugacuucauauucuuaguaccacccacaguagaaucaagaacaaaaccauucacaguaccaguauuaacaguugaagaaaugacaaacucacgcuuuccaauaccacuagaaaaauuauauacaggacccucaucagcuuuuguaguucaaccccaaaacggcagaugcaccacagacggaguauuacuuggaacaacucaauuaucagcaguaaauauuuguacauucagaggagacguaacacacauagcaggaucacguaauuauacaaugaaccuagcuagccaaaauuggaauaauuaugacccuacagaagaaauuccagcaccacuagggacaccugacuucguagguaaaauccaaggacuauuaacgcaaaccacaagagcugauggauccacaagagcacauaaagcaacuguaucuacaggauccguacacuucacuccaaaacuaggaagcguacaauuuaguaccgacacagacaacgauuuccaaccaggacaaaauacaaaauuuacaccaguuggaguuauacaagacggagaccgucaucaaaaugaaccacaacaauggguacuaccagauuacuccggaagaacaggacacaacguacauuuagcaccagcgguagccccuacuuuuccaggagaacaacuacuuuuuuuuagaucaacaaugccaggcugcuccggauauccuaauaugaaccucgauugcuuauuaccacaagaauggguacuacauuuuuaccaagaaucagcaccugcacaaucagacguagcuuuauuaagauucguaaauccagauacaaauagaguacuauucgaauguaaacuacauaaaucagguuauauuacaguagcucauacaggacaacaugaccuaauccuaccgccuaauggcuacuuuagauuugacucauggguuaaccaauuuuauacucucgcaccuaugggcaacggcgcaggacguagaagagcuccauaa

SEQ ID NO: 32719 - RNA, 1623 nt, Artificial Sequence
  derived and/or modified sequence opt6 from capsid_protein__Norovirus__BAF95503
augaaaauggcuucaaaugacgcaaaccccagcgacggaaguacugcaaacuuaguuccagagguaaacaacgaaguaauggcauuagaaccaguagucggcgcagcuauagccgcuccaguagcaggacaacaaaauguaaucgauccuuggauaagaaauaauuucguacaagcaccaggaggugaauuuacaguaucaccacgaaacgcacccggagaaauacuauggucagccccccuaggcccugacuuaaacccuuauuuaucacaccuagccagaauguacaacggauaugcaggcggauuugaaguacaaguaauucuagccgguaaugcauuuacagcuggaaaaauaauauuugccgcaguaccccccaauuuuccaaccgaaggacucagcccgagccaagucacaauguucccacacauuauaguagacgucagacaacuagaaccaguauuaauaccuuuaccagauguaagaaauaauuucuaucacuacaaccaaucaaaugacccaacaaucaaacuaauagcgaugcuauacacucccuuacgagcuaacaacgcaggagaagauguauuuaccguaucaugcagaguucuaacaagaccaucuccagacuuugacuucauauuucuaguaccaccaacaguagaaucaagaacaaaaccuuucacaguuccuauauuaacagucgaagaaaugacaaauucaagauuuccaauuccacuagaaaaauuauuuaccggucccagcggagcauucguaguacaaccucaaaacggaagauguacaacagacggaguauuauuaggaaccacucaacuaucaccaguaaauauauguacauuuagaggugacguaacacauauagcaggaacacauaacuauacaaugaaccuagcaucacagaauuggaauaauuaugauccaacagaagaaauaccagcuccacuaggaacaccagacuucguaggaagaauacaaggaauguuaacacaaacaacaaaaggagacggaagcacacgaggacacaaagcaacuguuucuacuggcgauguacacuuuacaccaaaacuuggaucuauacaauuuaauacagacacaaauaacgauuucgaaacaggacaaaauacaaaauucacaccaguaggaguaguacaagacgguaauggcacacaucaaaaugaaccccaacaauggguacuaccaucauauucaggccguacuggacauaacguucaccuagcaccugcaguagcaccaacauuuccaggcgaacaauuacuuuucuuuagauccacaaugccaggaugcucuggauauccaaauaugaaucuagauugcuuacuuccucaagaauggguacaacauuuuuaucaagaagccgcacccgcacaaucugacguagcccuauuaagauuuguuaauccagacaccggaagaguauuauucgaaugcaaauuacacaaaucaggauacguaacaguagcucacacaggacaacacgacuuaguaauaccaccaaaugguuauuucagauuugauuccuggguaaaucaauuuuacacucuagcaccaaugggcaauggaacuggcagaagaagagcacuuuaa

SEQ ID NO: 32720 - RNA, 1623 nt, Artificial Sequence
  derived and/or modified sequence opt6 from capsid_protein__Norovirus__BAF95505
augaaaauggcauccaaugaugcaaacccaagcgacggaucuacagcaaauuuagucccagaaguuaauaacgaaguuauggcacuagaaccaguaguaggagccgcuauagcagcaccagucgcaggacaacaaaauguaaucgacccauggauaagaaauaacuuuguacaagccccaggcggagaauuuaccguuuccccacgaaacgcaccaggagaaauacuauggucagcaccacuaggaccagaucuaaauccguaccuaucucaccuagcacgaauguacaacgguuaugcaggaggauucgaaguucaagucauacuagcuggaaaugcauuuaccgcuggaaaaaucaucuucgcagcaguaccaccaaacuuuccaacagaaggacuaucuccaucacaaguaaccauguucccacauauaaucguugacguaagacaauuagaaccuguacucauaccauuaccugauguucgaaauaacuucuaucacuauaaccaaucaaaugacccaacaauuaaacuuauagcaaugcuauacacaccauuacgagcaaacaacgcaggagaagacguauuuacagucucauguagaguacuaacaagaccaucaccagacuuugauuuuaucuuuuuaguaccaccuaccguagaaucuagaaccaaacccuuuacaguaccaguucuuaccguagaagaaaugacuaacuccagauuccccauuccauuagaaaaacuauuuacaggcccauccggagcuuucguaguccaaccacaaaauggucguuguacaacugacggaguauuacuuggaacaacucaacuaucaccagucaauaucuguacauuuagaggugacguaacacauauagcaggcacacacaauuauacaaugaaccuagccucacaaaacuggaacaacuacgauccaaccgaagaaauaccugccccacuaggaacuccagauuucguaggaagaauucaaggaaugcuaacacaaacaacaaaaggagacggaaguacuagaggccauaaagcuacagucuccaccggugacguucacuucacaccuaaauuaggaucaauacaauuuaauaccgauacaaauaacgacuucgaaaccggacaaaauacaaaauuuacaccagucggcguaguucaagauggcaauggcacacaucaaaaugaaccacaacaaugggucuuacccucauacuccggcagaacuggacacaacguccacuuagcccccgcaguagcaccaacauuuccaggagaacaauuacuuuucuucagaucaacaaugcccggaugcucuggauaucccaauaugaauuuagauugcuuacuaccucaagaauggguacaacauuucuaucaagaagcagcuccagcccaaucagacguagcauuauuaagauucguaaacccagauacaggacgaguauuauuugaauguaaauuacauaaaucaggauauguaacaguagcccauaccggacaacacgaccuaguaauaccaccaaaugguuacuuccgauuugauucauggguaaaccaauuuuacacauuagcuccuaugggcaacggaacugguagaagacgcgcauuauaa

SEQ ID NO: 32721 - RNA, 1623 nt, Artificial Sequence
  derived and/or modified sequence opt6 from capsid_protein__Norovirus__BAF95507
augaaaauggcauccaacgacgcaucuccaucagauggaucaacagccaaucuaguaccagaaguuaacaaugaaguaauggcccuagaacccguuguaggcgcagcaauugcagcaccaguugcaggucaacaaaauguuauagacccauggauacguaauaauuuuguacaagccccaggaggugaauuuacaguaucacccagaaacgcaccuggagaaauacuaugguccgcaccacuagguccagauuuaaaccccuaucuuucccaucuugcacgaauguauaauggauaugcaggcggauucgaaguacaaguaauacuagcagguaaugcuuuuacagccggaaaaauaaucuucgcagcaguuccaccuaacuuuccuacugaaggacuuucuccaucucaaguaacaauguucccacacauaauaguagauguaagacaacuagaaccaguacuaauaccauuaccagauguacgaaauaacuucuaucacuauaaccaaucaaaugacucuacaauuaaauuaauugcuaugcuauacacuccucuaagagcaaauaacgcuggagacgacguauuuacaguuucuugucgaguauuaacaagaccuucaccagacuucgauuucauauucuuaguaccaccaacuguagaaucaagaacaaagccauucacagucccaauacuaacaguagaagaaaugaccaacucacgauuuccaauaccacucgaaaaacuuuucaccgguccaucaucagcuuucgucguacaaccacaaaauggaagauguaccacagacggcguacuauuaggaacaacacaacuuucacccguaaauauauguaccuuucgaggagauguuacucauauaccagguacaagaacauauagaaugaaucuagcaucccaaaacuggaauaauuaugacccaacagaagaaauaccugcccccuuagguacccccgauuuuguaggaaaaauucaaggaauguuaacacaaacuaccaaaggcgacggauccacccgaggacauaaagcaaccguaagcacaggaucaguagacuuuacuccaaaauugggcucaguacaauucgcuacugacacugauaaugauuuugaaacaggacaaaauacaagauuuacaccaguaggggucauacaagacggaucaucugcacauagaaaugaaccucaacaauggguacuacccgacuauucaggucgaacaguacauaauguacaucuugcacccgcuguagcaccaaccuuuccaggcgaacagcuuuuauuuuucagaucaacaaugccugguuguucuggcuauccuaacauggaucuagauugcuuauuaccucaagaauggguucaacauuuuuaucaagaagcagcacccucucaaucagacguagcauuauuaagauuuguaaacccagacacuggaagaguauuauuugaaugcaaacuacauaaagccggauauguuacaguugcacauacagggcaacaugaucucgucauaccuccaaacggauauuuuagauuugauucauggguaaaccaauucuauacacuugccccaauggguaacggcgcuggcagacguagagcauuauaa

SEQ ID NO: 32722 - RNA, 1623 nt, Artificial Sequence
  derived and/or modified sequence opt6 from capsid_protein__Norovirus__BAF95509
augaaaauggcaucaaacgacgcaacaccuucagaugguucaacagcaaauuuagucccagaaguaaauaaugaaguaauggcccuagaaccaguaguaggagcagcaauagccgcaccaguugcaggacaacaaaaugucauagacccauggaucagaaauaacuuuguacaagcaccuggaggcgaauuuaccguuucaccacgaaaugcacccggugaaauacuauggucagccccacuagguccagauuuaaauccauacuuaucacaucuagcaagaauguauaauggauaugcaggcggauuugaaguucaagucauacuagcaggaaacgccuuuacagcaggaaaaauuauauuugcagcuguaccaccaaauuuuccaacagaaggauuauccccaucacaaguuacaauguucccucauauaauaguugacguucgacaacuagaaccuguacugauuccauuaccagacgucagaaauaauuucuaucauuauaaucaauccaaugaccccacaauaaaauuaauagcaauguuauauaccccacuacgcgcaaauaaugcaggagacgauguauuuacaguuuccuguagaguacucacaagaccaagcccugacuuugacuucauauuucuaguaccacccacaguagaaucacgaacaaaaccauucucaguccccauacuaacaguagaagaaaugacaaacucaagauuuccaauuccucuugaaaaacuauucaccggaccaucaucagcauucguuguccaaccacaaaacggacgauguacuacagacggaguacuacuagguacaacacaacuaucacccguuaauauuuguacauuuagaggagacguaacacacauagcagguacacaaaauuacaccaugaaccuugccucucaaaacuggaacaauuaugauccuacagaagaaauuccugcaccuuuaggaacaccugacuuuguagguaaaauacaaggcguauuaacacaaacaacccgaggugacggcucaacaagaggacauaaagcaacagucucaacaggaucaguacauuuuacaccaaaacuuggcucaguacaauucucuacagauacaucgaacgacuuugaaacaggacaaaacacuagauucacaccaguagguguaguacaagauggaucaacaacacaucaaaacgaaccacaacaauggguauuaccaaacuauucuggacgugauucucauaauguacacuuagcuccagcuguagccccaacauuuccaggugaacaacuacuuuuuuuuagaucaacaaugcccggaugcucuggauauccaaauaugaaucuagacugucuucugccucaagaauggguacaacacuucuaccaagaauccgcucccgcccaaucagauguagcacuacuacguuucguaaauccugauacaggacgaguauuauuugaauguaaacuacauaaaucaggauauguaacaguagcacacacaggccaacacgaucuaguuauuccucccaaugguuacuuuagauuugauuccugggucaaccaauucuacacauuagcuccaauggguaauggagccggacgaagaagagcuuuauaa

SEQ ID NO: 32723 - RNA, 1623 nt, Artificial Sequence
  derived and/or modified sequence opt6 from capsid_protein__Norovirus__BAF95511
augaaaauggcaucaaacgaugcaacuccuuccgauggaucaacagcaaaucuaguaccagaaguaaacaacgaaguaauggccuuagaacccguaguaggugcagcaauagcagcaccaguugcaggacaacaaaacguaauagauccuuggauuagaaauaacuuuguacaagcaccaggaggcgaauuuacaguaucaccaagaaacgcaccaggagaaauauuauggucagcaccauuaggcccugacuuaaauccauaccuaucgcaccuagccagaauguauaauggauacgcuggcggauuugaaguccaaguaauuuuagcagguaacgcuuuuacagcaggcaaaauuauauuugcagcaguaccacccaauuuucccacugaagguuuaucccccagccaagucacaauguucccacacauaauaguagauguaagacaauuagaaccagucuuaauaccacuacccgaugucagaaacaauuucuaucacuauaaucaaucaaacgacccaacaauaaaauuaaucgccauguuauauaccccacuaagagcaaacaaugccggagaugauguauucacaguaaguuguagaguauuaacaagaccuucaccugacuuugacuuuauauuuuuaguacccccaacaguagaauccagaaccaaaccauuuucaguuccaauauuaacuguugaagaaaugacaaauucacgauucccaaucccauuagaaaaauuauucaccggaccaucuucagcuuucguaguccaaccacaaaauggcagauguacaacugacggaguauuacuaggaacaacacaauuaucaccuguuaauaucuguacauuucgaggagacguaacacauauagcuggaacacaaaauuauacaaugaaucuagccucacaaaacuggaauaauuacgauccaacagaagaaauacccgcaccuuuaggaacuccagacuuugucggaaagauacaaggagucuuaacccaaaccacacgacgagacggauccacucgaggacacaaagcaacaguaucaacugguucaguccacuuuacuccuaaacucggcaguguacaauuuucaacugauacauccaacgacuucgaaaccggacaaaauacaagauucacuccagucggcguaguacaagacgggucaacaacucaucaaaaugaaccacaacaauggguauuacccaacuauucaggaagagauucccauaauguacauuuagcuccagcaguagcaccaacauuccccggugaacaacuacuuuucuuccgaucaacuaugccaggaugcucaggauauccuaauaugaaccuagauugccuauuaccacaagaauggguacaacauuucuaucaagaaucugcaccagcacaaucugacgucgcauuacuucguuucguaaauccagacacuggaagaguccuauuugaauguaaauuacacaaaaguggauauguaacaguagcucacacuggacaacacgaucuuguuauaccaccaaauggauacuucagauuugacuccuggguaaaucaauucuacacacuugcaccaaugggcaacggagcaggcagaagaagagcauuguaa

SEQ ID NO: 32724 - RNA, 1623 nt, Artificial Sequence
  derived and/or modified sequence opt6 from capsid_protein__Norovirus__BAF95513
augaaaauggccucuaaugaugcuacaccaucugauggaucaacagcaaaccucguaccagaaguaaauaaugaagucauggcacuagaaccaguuguaggugccgcaaucgcagcccccguagcaggucaacaaaauguaauagacccauggauacgcaauaacuucguccaagcaccaggaggagaauuuacaguaucaccaagaaaugcacccggagaaauauuaugguccgcaccacuaggaccagauuuaaauccauaucuaucacaucuagcacgaauguauaacgguuaugcaggagguuuugaaguccaaguaauccuagcaggcaaugcauucacagcagguaaaauuauauucgcagcagugccaccaaacuuuccaacagaaggacuaaguccaucacaaguaacaauguucccacacaucauaguagacguaagacaauuagaaccaguauuaauacccuuaccagauguaagaaacaauuuuuaucauuauaaucaaaguaacgacucuacaauaaaauuaauagcaaugcuauacacaccuuuaagagcaaauaaugccggagaugacgucuuuacuguaucuugccgaguucuaacaagaccaucaccagauuucgacuuuauuuucuuaguccccccaaccguagaaucuagaacuaaacccuucucaguaccaauauuaacuguagaagaaaugacuaauuccagauuuccaauaccucuagaaaaacuuuuuacaggaccaucaucagcauuuguaguacaaccucaaaauggaagaugcacaacagacggaguauugcuuggaaccacacaacuauccccugucaauauuuguacauucagaggagauguaacucacauagcuggaacacaaaauuacacaaugaaucuagcaagucaaaauuggaacaauuacgauccaacagaagaaauaccugcaccccuuggaacaccagacuuuguagguaaaauucaaggaguuuuaacacaaacaacaagaagagauggaucaacaagaggccacaaagcaacaguuuccacaggaagcguacacuuuaccccaaaacuuggaucaguacaauucucaacagauacaucuaacgauuucgaaacaggacaaaauacaagauucacacccguaggcguaguacaagauggaaguacaacacaccaaaaugaaccgcaacaauggguacuaccaaauuauucaggaagagacucacauaauguucaccuagcaccugccguagcuccaacauuccccggugaacaauuauuauucuuuagaucaacaaugccaggaugcucaggcuacccaaauaugaauuuagauugccuucuaccccaagaauggguacaacauuucuaccaagaaagugcaccagcacaaagugacguagcuuuacuuagauuuguuaacccugacacaggaagaguacuauucgaaugcaaacuacauaaaucaggcuacgucaccguagcacauacaggucaacaugacuuaguaauaccuccaaacggcuacuuucgauucgacucuugggucaaucaauucuacacgcuugccccaaugggaaacggugcaggcagacgaagagcacuauaa

SEQ ID NO: 32725 - RNA, 1623 nt, Artificial Sequence
  derived and/or modified sequence opt6 from capsid_protein__Norovirus__BAF95515
augaaaauggcaucaaacgacgcuucaccuagcgacggaucuacagcuaaccuaguuccagaagucaacaacgaaguuauggcuuuagaacccguaguaggugcagccauagcugccccugucgcaggacaacaaaaugucauagacccauggaucagaaauaacuuuguacaagcacccggcggugaauuuacaguaucucccagaaaugcaccaggagaaauauuauggucagcaccuuuaggaccagacuuaaacccauaucuuucccacuuagccagaauguauaauggcuacgcuggcggcuucgaaguccaagucauauuagcuggaaaugcuuuuaccgcagguaaaauaauauucgcagcagucccaccuaacuuuccaacagaagguuuaucacccucucaaguuacaauguucccucacauuauagucgauguuagacaauuagaacccguacuaauuccauuaccagauguacggaacaauuuuuaucauuacaaucaaucaaaugacucaacaaucaaacuaauagcaauguuauacacaccacuaagagcuaauaacgcaggagaugauguauucacaguaucuuguagaguacuaacaagaccaaguccagacuuugacuucauauuuuuaguaccaccuacaguagaaucaagaacaaaaccauuuacagucccaauucuaacaguagaagaaaugacaaauagcagauuuccaauuccacuagaaaaauuauuuacaggaccuagcucugcauuuguaguccaaccccaaaauggcagauguacaaccgacggaguacuucuaggaacuacacaacucuccccaguuaauaucuguacauuuagaggagauguaacacauauaccuggaacacgaacuuacagaaugaauuuagcaucucaaaacuggaauaacuacgauccaacugaagaaauaccggccccacucggaacaccagacuuuguaggaaaaauacaaggaauguuaacacaaacuacuaaaggagacggaucaacacgcggacauaaagcuacagucucaacaggaucaguagacuucacuccuaaauuaggaaguguacaauucgcaacagacaccgauaaugauuuugaaacaggucaaaauacaagauucacaccaguaggaguuauacaagauggauccucaacacauagaaacgaaccucaacaauggguauuaccagacuacucuggaagaaccguacauaauguucauuuagcccccgcaguugcccccacauuuccaggcgaacaacuauuauuuuuuagaucuacaaugccaggaugcuccggauaccccaauauggaccucgauugccuauuaccacaagaauggguccaacauuucuaucaagaagccgccccuucucaaagugacguugcauuauuaagguucguaaacccugacacuggcagagucuuauucgaauguaaacuucacaaagcaggauacgucacaguagcacauacaggacaacacgauuuaguaauaccuccuaauggcuauuucagauucgauuccuggguaaaucaauucuacacauuagcuccaaugggaaauggagcaggcagacgaagagcauuauaa

SEQ ID NO: 32726 - RNA, 1623 nt, Artificial Sequence
  derived and/or modified sequence opt6 from capsid_protein__Norovirus__BAF95517
augaaaauggcauccaaugaugcauccccaucagacggaucugcagcuaaucuuguuccagaaguuaauaacgaaguaauggcauuagaaccaguaguaggagcagccauagcagcaccagucgcuggccaacaaaacguuauagaucccuggauacgaaacaauuuuguacaagcacccggaggagaauucacaguaucaccuagaaaugcaccuggugaaauauuaugguccgcaccccuaggaccagaucuuaacccauaucuaucacauuuagcacgaauguauaacggauaugcugguggauucgaaguacaaguuauauuagcaggaaacgcauucacagcaggcaaaauaauuuucgcagcuguacccccaaacuuuccaacugaaggccuuucuccaucccaaguuacaauguuuccacacauaauaguagauguaagacaacuagaaccaguauuaauaccuuuaccagauguccgcaauaauuuuuaucauuacaaucaaucaaaugacucaacuauaaaauuaauagcaauguuauacacuccccuacgugcaaacaaugcuggagacgaugucuuuacaguuagcugcagaguacuaacuagaccaucaccagacuuugauuuuauauuuuuaguucccccaaccguugaaaguagaacaaaacccuuuacaguaccaauacuaacagucgaagaaaugaccaauaguagauucccaaucccacuagaaaaacuauucaccggaccuucaucagccuuuguaguacaaccacaaaauggaagauguacuacagacggaguucuucuaggaacaacacaacuaucacccguaaauauaugcacauuuagaggcgacguuacccauauaucaggaaccagaacauacagaaugaauuuagcuucacaaaacuggaauaacuaugauccaacagaagaaauuccagcuccuuugggaaccccugacuucguaggcaaaauacaaggcauguuaacacaaacaacuaaaggugacggaucuacaagaggacacaaagcuacagucucaacagguucuguagacuuuacaccuaaguuaggaucuguucaauuugcuacagauacugauaaugauuuugaaacaggucaaaauacaagauucaccccuguagguguaauacaagacggaucuucagcacacagaaacgaaccucaacaauggguauuaccagauuauuccggaaggacaguacauaacguccaucuagcucccgcuguagcuccaaccuuucccggugaacaauuacuauucuucagaucaacaaugccagguuguucaggauauccuaacauggacuuagauugcuuauuaccacaagaauggguacaacauuuuuaucaagaagccgcaccuucacaaagugauguugcauuauuaagauucguaaauccagauacaggacgaguucuuuucgaauguaaauuacauaaagcaggauacguuaccguagcacacaccggacaacacgaucuaguuauuccuccaaauggauauuuuagauuugauaguuggguuaaucaauucuauacgcucgcaccaaugggaaacggagcagguagaagaagagcacuauaa

SEQ ID NO: 32727 - RNA, 1623 nt, Artificial Sequence
  derived and/or modified sequence opt6 from capsid_protein__Norovirus__BAF95519
augaaaauggcuucaaaugaugcuacacccucagauggaucaacagcaaacuuaguaccagaaguaaauaaugaaguuauggcacuagaaccaguaguaggugcagcuauagcagcaccgguugcaggacaacaaaacguaauagauccauggauccguaauaacuucguacaagcaccaggcggagaauuuaccgucucaccaagaaacgcaccaggagaaauuuuauggucugcccccuuaggucccgaucuaaacccauaucuuucacacuuggcaagaauguauaauggcuacgcagguggcuucgaaguucaaguaauccuagcaggaaaugccuuuacugccggaaaaauaauauuugcagcagucccaccuaauuuuccaacagaaggauuaucacccucacaaguuacuauguucccccacauaauaguagacguuagacaacuagaaccaguucuaauaccacuaccagauguaagaaauaauuucuaucacuauaaucaaagcaaugacucuacaauaaaacuaauagcgauguuguauacacccuuaagagcaaacaaugcaggagacgauguauucacaguaucauguagagucuuaacucgaccuucaccugacuuugacuuuaucuuuuuaguccccccuacaguagaauccagaacaaaacccuucucagucccaauccuuacaguagaagaaaugacaaacucaagauuuccuauaccauuagaaaaacuauuuacaggaccuuccucagcauuuguuguacaaccacaaaacggccgaugcaccacagauggagucuuacucggaacaacucaacuuuccccaguaaauauauguacauuuagaggagaugucacacauauagcaggaacacaaaauuacacaaugaaccuagcuucacaaaacuggaauaauuaugauccaacagaagaaauaccugcaccauuaggaacuccagacuuugucggaaaaauacaaggaguacucacacaaaccacaacaagagacggcuccacaagaggccacaaagcaacaguaaguacuggcuccguucauuuuacuccaaaauuaggaucaguacaauucucaaccgauacaucaaacgauuucgaaacaggacaaaauacacgauucacaccuguuggagucguacaagauggauccacaacccaucaaaaugaaccacaacaauggguacuacccgacuauagcggaagagauucacauaauguccacuuagcaccagccguagcacccacauuuccaggcgaacaacuauuauuuuuucgaucaacaaugccugguuguucaggauacccaaacaugaaucucgauugcuuacuaccacaagaauggguacaacacuuuuaucaagaaucggcaccagcacaauccgauguagcacuacuccgauucgucaaccccgacacaggcagaguauuauuugaauguaaauuacauaaauccggauacguaacuguagcacauacaggucaacaugacuuaguuauaccccccaacggauauuucagauucgauagcuggguaaaucaauucuacacucuagcuccaaugggaaauggagcuggaaggagaagagcacuuuaa

SEQ ID NO: 32728 - RNA, 1623 nt, Artificial Sequence
  derived and/or modified sequence opt6 from capsid_protein__Norovirus__BAF95521
augaaaauggcaucaucagacgccaauccuucugaugguucaacagccaauuuaguacccgaaguuaauaaugaaguuauggcacuugaaccaguaguaggugcagcuauagcagcuccuguagcaggacaacaaaauguaauugacccauggauaagaaacaauuuuguccaagcaccaggcggugaauuuacaguuucaccuagaaaugccccaggagaaaucuuauggucagcaccacucgguccagacuuaaauccauaucuaucucauuuagcacgaauguauaauuccuaugcuggaggcuucgaaguacaaguaauacuagcaggaaaugcauucacugcagguaaaaucauauuugcugcagucccaccaaauuuuccaacagaaggcuuaagcccaucacaaguaaccauguucccucacauaauaguugacguuagacaacuagaaccaguacuaauuccauuaccagauguacgaaauaauuucuaucacuacaaucaauccaaugauccaacaauuaaauuaauagcaauguuauacaccccauuacgagccaacaacgccggagaugauguuuuuacaguaucauguagaguucuuacaagacccuccccagauuucgauuuuauauuucuaguaccaccuacaguugaaucacgaacuaaaccauucucugucccaauuuuaaccguagaagaaaugacaaacucaagauuccccaucccauuggaaaaacuuuucacaggaccaaguucugcauuugucguucaaccacaaaacggucgauguacaacagacggaguauuacuaggaacaacccaacuuucaccugucaauauuugcacauuuagaggagaugucacacacaucgcuggaacacaagaauauacaaugaauuuagcaucacaaaauuggaacaacuaugauccaacagaagaaauaccugcaccacucggaacaccugacuucguaggaaaaauacaaggaguauuaacccaaacaaccagaagagacggaucuacaagaggacacaaagccacaguaucaacaggaucaguccauuuuacaccaaaacuuggaagaauacaauucaguacagacacaucaaaugacuuugaaaccggacaaaauacacguuuuacacccguaggaguaguacaagauggaggaacuacacaucaaaaugaaccccaacaauggguacuaccuaacuauucaggaagagauucacauaacguacaccuagcaccugcagucgcaccaucauuccccggagaacaacuauuauucuuucgauccacaaugccaggcugcucuggcuauccuaauaugaaccuugauugcuuacuuccacaagaauggguacaacauuuuuaucaagaagcagcaccugcacaaucugacguugcccuacuaagauucguuaacccugauacagguagaguacuauucgaaugcaaacugcauaaauccggauaugugacagucgcacacacaggacagcacgacuuagucauaccaccaaacggauauuuuagauucgauucuuggguaaaucaauuuuauacacuagcaccaaugggaaauggaacaggcagaagaagagcacuuuaa

SEQ ID NO: 32729 - RNA, 1623 nt, Artificial Sequence
  derived and/or modified sequence opt6 from capsid_protein__Norovirus__BAF95523
augaaaauggcaucauccgacgcaaaccccucugauggaucaacagcaaauuuaguaccagaaguaaacaaugaaguaauggcccuagaaccaguaguaggagcagcuauugcagccccaguagcaggacaacaaaacgucauagacccauggauaaggaauaacuuuguacaagcaccaggaggagaauuuaccguauccccuagaaaugcaccuggagaaauauuguggucugcaccacuaggaccagaucuaaauccuuauuuaagucacuuagcaagaauguacaacuccuaugcaggaggauuugaaguacaaguaauacuagcaggcaaugcauucaccgcaggaaaaauaauauucgcugccguaccacccaauuuuccaacugaaggauuaucuccaucacaaguuacuauguuuccacauauaauagucgacguuagacaacuagaacccguacuaauaccauuaccagacguacguaauaauuuuuaccauuacaaucaaucaaaugauccaacaauuaaacuaaucgcaaugcuauacacaccacuacgagcaaacaacgcaggagacgacguauucacaguaucaugcagaguucuaacaagaccaucaccagacuuugauuucauauuuuuaguaccuccgacaguagaaaguagaacaaaacccuuuaguguuccaauacuaaccguugaagaaaugaccaacucuagauucccaauaccacuagaaaaacuauucacaggaccaucuuccgcauucguaguacaaccacaaaauggacgcuguacaacagacggaguauuauuaggaacuacacaauuaucacccguuaacauuugcacauuucguggugauguaacacacaucgcaggaacacaagaauauacaaugaaucuagcaucacaaaauuggaauaauuaugauccaacagaagaaauaccagcaccacuuggcacaccagacuuuguaggaaaaauucaaggaguauuaacacaaacuacaagaagagauggcucaacucgaggacauaaagcaacagucucaaccggaagcguccacuuuacacccaaauuagguagaauacaauucucuacugacaccucaaaugacuuugaaacaggacaaaacaccagauucaccccuguaggcgucguacaagacgguucuacaacucaucaaaaugaaccccaacaauggguacuaccuaacuacuccggcagagauucacacaacguucacuuagcacccgcaguagcaccaucauuuccaggagaacaacuccuuuucuuuagaucaacaaugccaggauguagcgguuacccaaauaugaaucucgacugccuauuaccacaagaauggguacaacauuucuaucaagaagcugccccagcucaauccgauguagcauuacuacgauuuguuaacccagacaccggcagaguuuuauuugaaugcaaacuacauaaaucaggauaugucacaguagcacacacaggucaacacgauuuagucauaccaccgaauggauauuuuagauucgacucuugggucaaucaauuuuacacacuggcacccaugggcaacgguacuggaagaagaagagccuuauaa

SEQ ID NO: 32730 - RNA, 1623 nt, Artificial Sequence
  derived and/or modified sequence opt6 from capsid_protein__Norovirus__BAF95525
augaaaauggcauccaaugacgcaucuccaucagauggaucaacagcaaacuuaguaccugaagucaacaaugaaguaauggcucuagaaccaguuguaggcgcagcaauagcugcaccuguagccggacaacaaaacgucauagaucccuggauacgcaauaauuucguucaagcuccaggaggagaauucacaguuucgcccagaaaugcaccuggcgaaauauuauggucagcaccucuaggaccagauuuaaaccccuauuuaucccacuuagcaagaauguauaacggauacgcuggagguuucgaaguacagguaauucuagcaggaaacgcauucacagcuggaaaaaucauauucgcagcuguaccuccuaauuuccccacagaaggauuaucacccucacaaguaacgauguucccccauauaaucguagauguuagacaacuugaaccaguacuaauaccacuaccagauguaagaaacaacuucuaccacuacaaucaauccaacgacucaacaauaaaacuuauagcaauguuauacacaccauuacgagcaaacaacgcaggagacgaugucuuuacaguaucaugccgaguacuuacacgucccaguccagauuuugauuuuauauuucuaguaccaccaacaguagaaucacgaacaaaaccauucacaguaccuaucuuaacagucgaagaaaugacuaauucaagauuucccauaccacuugaaaaacuauucaccggaccaucaucagcguuuguuguucaaccacaaaacggacgcuguaccacagauggaguacuacuagguacaacacaacucucuccaguuaauauaugcacauuucgaggagaugucacacacauaccaggaacaagaacauacagaaugaaccuagcaucccaaaacuggaauaacuacgaucccacagaagaaauaccagccccacuaggaacuccagacuuuguaggaaaaauucaaggcauguuaacacaaacaacuaaaggagacgguucaacaagaggacauaaagcaacaguaucaacaggaucaguagacuuuacuccaaaacuugguucaguacaauucgcaacagauacagauaaugauuucgaaaccggacagaacacuagauucacaccaguaggaguaauacaagacggcucaucaacacauagaaaugaaccucaacaauggguauuaccagacuauuccgguagaacuguccauaauguacacuuagcaccugcaguugcaccaacauuuccaggugaacaauuauuguuuuucagauccacuaugccaggcugcucaggauacccaaauauggauuuagauugucuucuuccacaagaauggguacaacauuucuaucaagaagcugcaccaucacaaucagacguagcauuauuaagauucguaaaccccgacacaggacgaguccuauucgaauguaaacuacauaaagccgguuaugucacagucgcacauacaggacaacacgauuuaguaauacccccaaaugguuauuucagauucgacaguuggguuaaucaauuuuacacacuagcuccaaugggaaauggcgcaggacgcagacgcgccuuauaa

SEQ ID NO: 32731 - RNA, 1623 nt, Artificial Sequence
  derived and/or modified sequence opt6 from capsid_protein__Norovirus__BAF95527
augaaaauggcuucaaaugacgcaucaccuucagacggaucaacagcuaaucuaguaccagaagucaacaacgaaguaauggcauuagaacccguaguaggcgccgcaauagcagcaccuguugcaggacaacaaaauguaauagauccauggaucagaaacaauuucguacaagcgccuggaggugaauuuacagucucaccaagaaacgcuccaggugaaauucuguggucagcuccacuuggaccagacuuaaaucccuaccuuucucaccuagcaagaauguacaacggauaugcaggagguuuugauguacaaguaaucuuagcaggaaaugcauuuacagcaggaaaaauaauuuucgcugcaguuccaccaaacuucccaacagaaggacuauccccaucccaaguaacaauguuuccccacauuaucguagacgucagacaauuagaaccaguacuaauaccauuaccugauguaagaaauaauuucuaccauuauaaucaaucuaacgauuccacaauuaaguuaauagcaaugcuuuauacaccacuaagagcuaauaacgcaggagaugauguauuuacaguaucauguagaguauuaacaagaccaucaccagacuuugauuucauuuuucuaguaccaccaacaguagaaagccgcacuaaaccauucacaguaccaauacucacaguagaagaaaugacaaacucuagauuuccaauacccuuagaaaaauuauucacaggacccucaucagcauuuguuguacaaccccaaaaugguagauguacaacagacggaguauuacuaggaacaacacaauuaucaccagucaauauauguacauuuagaggagacguaacacauauaccaggcacacgaacuuacagaaugaaucuagcaucacaaaauuggaacaacuaugauccaacagaagaaauacccgcaccacucgguacaccagauuuuguuggaaaaauacaaggaaugcugacacaaacgaccaaaggagacgguucaaccagaggucacaaagcaacuguauccacaggaucuguagauuucacacccaaauuaggaucaguacaauuugcuacagauacagauaacgacuucgaaacaggacaaaauaccagauucacaccagucggaguaauacaagauggaucuucaacccaccguaaugaaccucaacaauggguacucccugauuauucaggacgaacaguacacaacguacaccuugcacccgcuguagcuccaaccuuuccaggcgaacaacuacucuucuuuagaaguaccaugccaggauguuccggcuaucccaauauggacuuagauuguuuacuaccacaagaauggguacaacauuucuaucaagaagcugcuccaucacaaucugauguugcucuacuacgauuuguaaacccagauaccggaagaguacuuuucgaauguaaauuacauaaggcaggauauguaacaguagcucacacaggucaacaugauuuaguaauaccaccgaauggauauuuuagauuugauucuuggguaaaucaauuuuauacuuuagcccccaugggaaauggagcagggagacgaagagcauuauaa

SEQ ID NO: 32732 - RNA, 1623 nt, Artificial Sequence
  derived and/or modified sequence opt6 from capsid_protein__Norovirus__BAF95529
augaaaauggcaucaaacgaugcaaacccuucugacggaucugcagcgaaccuugucccagaaguaaacaaugaaguaauggcacuugaaccaguagucggggcagccauagcugcuccaguagcaggacaacaaaauguaauagacccauggauuagaaauaauuuuguacaagcaccaggaggagaauuuacuguaucaccucgaaaugcaccaggagaaauccuuuggagugcaccuuuaggaccagauuuaaauccauaucuuagccaccuagcuagaauguauaacggcuaugcaggaggcuucgaaguacaaguaauauuagcaggaaaugcauuuacagcagguaaaauaauuuuugcugcugucccuccaaauuuucccacagaaggucuaucuccaagccaaguuacuauguucccucacauaauaguugaugucagacaacucgaacccguccugauaccauuaccagauguaagaaacaauuuuuaccacuauaaucaauccaacgacucaacuauuaaauuaauagcaauguuauacacuccauuaagagcaaacaaugccggagaagauguauuuacuguaucuuguagagucuuaacaagaccuucaccggacuucgacuuuauauuucuaguaccaccaacaguagaaucaagaacaaaaccauucacuguaccaauauuaacugucgaagaaaugacaaauucaagauuuccaauucccuuagaaaaauuauucacaggaccaucaggagcauuuguuguccaaccacaaaacggaagauguacuacagacgguguauuauuaggaacuacucaauuaucaccuguaaacauaugcacauuuagaggagacguuacacacauugcuggaucaagaaacuacacaaugaaucuagcaucauuaaacuggaacaacuacgauccaacugaagaaauaccagcaccccuaggcacccccgauuuuguagguaaaauacaaggaauguugacccaaacaacaaaaggagacggauccacaagaggucauaaagccaccguauacacagguuccgcucccuuuaccccaaaauuaggcucaguucaauucucaacagauacggaaaaugacuuugaaacccaucaaaacacaaaauuuacuccaguaggaguaauacaagauggaaguacuacccauagaaacgaaccacaacaauggguucuuccaucauauaguggucgaaauguacauaauguucaccuagcaccagccguagcaccaacauuuccaggagaacaacuauuauucuuucgaucaacaaugccaggauguucaggauauccaaauauggaucuagauugcuuauuaccacaagaauggguacaacacuucuaucaagaagcagcaccugcacaaagugacguagcauuauuaagauuuguaaaccccgauacuggcagaguauuauuugaaugcaaauuacauaaaucuggauauguaaccguugcacauacuggacaacacgauuuaguaauaccaccuaauggauauuuccgcuuugacaguuggguaaaucaauucuacacacuagcaccaaugggaaauggcacaggaagacgaagagcacuauaa

SEQ ID NO: 32733 - RNA, 1623 nt, Artificial Sequence
  derived and/or modified sequence opt6 from capsid_protein__Norovirus__BAF95531
augaaaauggcaucuaaugacgcaaaucccucugaugguucugcagcuaauuuagucccagaagucaacaaugaaguaauggcucuagaaccaguaguuggagcugcaauagccgcuccaguugcaggccaacaaaacgucauagauccauggauuagaaauaauuuuguacaagcaccaggaggcgaauucaccguaucaccaagaaaugccccaggagaaauauuauggucagcuccacuaggaccugacuuaaauccauaucuaucacacuuagcaagaauguauaauggauaugcuggugguuuugaaguacaaguuauacuagcaggaaacgcauucacagcuggaaaaauuauuuucgcagcaguaccuccaaauuuuccaacagaaggucuuuccccaucacaaguaaccauguucccacauaucauaguugacguacgacaacuagaaccaguacuaauaccauuaccugacguaagaaacaacuucuaucacuauaaccaaucaaacgacucaacuauuaaacuaauagcaauguuauacacaccauuacgugcaaacaacgcaggugaagaugucuuuacaguuuccugccgaguacuuacacgcccuucucccgauuuugacuucauauuucuaguaccuccuacaguagaaucacgaacaaaaccauucacagucccaauacuuacaguagaagaaaugacaaauucacguuuuccaaucccucuugaaaaacuauucaccggccccucaggugccuucguaguacaaccccaaaacggacguuguacaacagauggaguauuacuaggaacaacacaacuaucacccguaaauauaugcacuuuucgaggagacguuacacauauagcaggaucacgaaauuauacaaugaacuuagcaucacuaaauuggaacaacuaugacccaacagaagaaauaccagcaccucuaggaacaccagacuucgucggcaaaauacaaggaguauuaacacagacaacaaaaggugacggaucaacacgaggucauaaagcaacuguuuacacaggaucagcaccauucacaccaaaacuaggcucaguacaauuuucaacugacacagaaaacgauuuugaaacacaccaaaauaccaaauuuacucccguaggaguaauacaagacggauccacaacacauagaaaugaaccucaacaauggguacucccuucauauucaggaagaaacguucacaacguucaccuagcaccugcuguugcaccaaccuuccccggcgaacaacuauuauucuuucgaucuacaaugccagguuguucaggauaccccaauauggaucuagacugccuuuuaccucaagaauggguacaacacuucuaucaagaagcugcacccgcucaaucagacguagcguuacuaagauuuguaaacccagacacuggaagaguauuauucgaauguaaauuacacaaaucuggauauguuacagucgcacacacuggacaacacgaucuaguaauaccccccaaugguuauuucagauuugauagcugggugaaccaauuuuacacauuagcaccuaugggaaauggcacuggacgucgacgcgcauuauaa

SEQ ID NO: 32734 - RNA, 1623 nt, Artificial Sequence
  derived and/or modified sequence opt6 from capsid_protein__Norovirus__BAG30923
augaaaauggcaucaaacgaugcuaacccuucagacgguucaacagcuaaucuagucccagaaguaaauaaugaaguaauggcacuagaaccaguagucggagccgcaauagcugcaccuguagcuggucaacaaaacgucaucgacccauggaucagaaauaacuucguacaagcaccaggaggugaauuuaccguaucaccaagaaacgcaccaggagagauauuauggagugcuccauuaggacccgaucuaaaucccuauuuaucccaccuagcaagaauguauaacggauacgcaggaggauuugaaguacaaguuauauuagcaggcaaugcuuuuacagcugggaaaauuauauuugcugcaguaccaccaaauuuucccacugaaggucuaucuccaucacaaguaacaauguuuccacauauuauaguugauguacgccaauuagaacccguacugauuccacuaccagauguaagaaauaauuuuuaucacuauaaccaaucaaaugaccccacuauaaaauuaauugcaauguuauacacaccucuaagagccaauaaugcuggagaugacguuuucacaguaucauguagaguauuaacaagaccauccccugauuuugauuuuauauuuuuaguuccaccaacaguagaaucucgaacuaaaccauucacagucccaauauuaacaguagaagaaaugacaaacucaagauuuccaauaccccuugaacgacucuacacaggacccucauccgcuuucguuguacaaccccaaaacggccgauguacaacagauggaguauuacuuggaaccacacaauuaucagcaguaaacauauguacauucagaggugauguaacacauauagcaggaagcagaaauuauacaaugaauuuagcuucucaaaauuggaacaauuacgacccaacagaagaaauaccugccccacuagguacaccagauuuuguaggaaaaauucaaggaauguuaacacaaacaacaagauccgacggaucuaccagaggacauaaagcaacaguauuaacagguucggcagauuuugcuccuaaacuuggaagaguacaauucgcaacagauacagauaacgauuucgaaagcggucaaaauacaaaauucacuccagucggaguuauacaagaugguaguacuacccaucgaaaugaaccacaacaauggguuuuaccaaacuauagcggaagaacaggacauaacguacaucuagcaccagccguugcaccaacauacccaggagaacaacuauuauucuuucguucaaccaugcccggaugcucuggauaccccaauauggaucucgauugcuuauuaccacaagaauggguccaacauuucuaucaagaagcagcaccagcgcaauccgacguugccuuauuaagauucguuaauccugauacaggacgaguacuauuugaauguaaacuucauaaaucagguuauguaaccguagcacacaccggacaacacgaucuaguaauaccaccaaauggauauuucagauuugauucauggguaaaccaauuuuauacacuugcuccaaugggcaacggaacaggcagaagaagagcagucuaa

SEQ ID NO: 32735 - RNA, 1629 nt, Artificial Sequence
  derived and/or modified sequence opt6 from capsid_protein__Norovirus__BAG34630
augaaaauggccucaaacgaugcagcccccucuacagacggagcagcaggccuaguaccugaauccaauaacgaaguuauggcccuagaaccaguagcaggagcugcucuagccgcucccguaacaggacaaaccaauauaauagacccauggauaagagcaaauuuuguccaagccccaaacggagaauuuaccgucucuccacgaaacgcaccaggcgaaguacuuuuaaauuuagaauuaggaccagaacuaaauccauauuuagcccauuuagcaagaauguauaacggauacgccggagguauggaaguacaaguaaugcuagcaggaaaugcuuuuacagcuggaaaauugguauucgcagcagucccaccacauuuuccaguugaaaaccuaucaccccaacaaauaacaauguuuccacauguuauaauagauguuagaacuuuagaaccaguauuacuaccuuuaccugauguaagaaauaauuuuuuucacuacaaucaaaaagaugauccaaaaaugagaauaguugcuauguuauacacaccauuaagaucaaacgguucaggagaugauguauuuaccguuucuugcaggguacuuacuagaccaucaccagacuuugacuucacauaucuaguaccucccacaguugaaucaaaaaccaaaccauuuacacuuccaauauuaacauuaggagaacuaucuaauucaagauucccaguuuccauugaccaaauguacacauccccuaaugaagucauaucaguacaaugucaaaacggacgauguacauuagacggugaauuacaaggcacaacacaauuacaaguaucaggaauaugugccuuuaaaggagaaguaacugcccaccuacaugacaaugaucaucuauacaacguaacuauaacuaacuuaaacggaucaccauucgauccaucagaagacauaccugccccacuaggcguaccagauuuucaaggaagaguuuuuggaguuauaucucaaagagauaaacaaaaugcugcaggacacaaugaaccagcaaauagaggucacgaugcuguaguaccuacauauacagcacaauauacuccaaaauuaggacaaauacaaauaggaacauggcaaacagacgaccuuacaguaaaucaacccguaaaauucacaccaguaggacugaacgacacagaacauuuuaaucaauggguaguaccuagauaugcaggagcacuaaaucuaaauacaaauuuagcaccaaguguagcuccaguauuuccaggagaacgacuacuuuuuuuuagaucauacauuccacuaaaaggugguuauggaaacccagcaauagauugccucuuaccacaagaauggguucaacauuucuaucaagaagcugcaccauccaugucagaaguagcucuuguaagauauauuaacccugacaccggacgcgcccuuuucgaagcaaaacuacacagagcaggauuuaugacaguaucuucaaauacuucugcuccaguaguaguacccgccaacggauauuuuagauuugauucuugggugaaccaauuuuacucacucgcuccaaugggaacuggaaacggaagaagaagaguacaauaa

SEQ ID NO: 32736 - RNA, 1629 nt, Artificial Sequence
  derived and/or modified sequence opt6 from capsid_protein__Norovirus__BAG34632
augaaaauggcaaguaaugacgcagcaccaaguacugauggugcagcaggucuaguaccagaaucaaauaaugaaguaauggcauuggaaccaguagccggagcagccuuagcagcaccaguaacuggacaaaccaauauuauagacccauggauaagagcaaauuuuguacaagcaccaaacggugaauucaccguaucacccagaaaugccccuggcgaaguauuacuaaaccuagaauuaggaccugaauuaaauccauacuuagcacaccuagcaagaauguauaacgguuaugcaggcggaauggaaguacaaguaauguuagcaggaaaugcuuucaccgccggaaaauuaguauucgcagcuguaccaccacauuuuccaguagaaaauuuaaguccccaacaaauaacuauguuuccacauguaauaauagacgucagaacacuugaaccuguacuacuaccuuuaccagacguacgaaacaauuuuuuccacuauaaucaaaaagaugauccaaaaaugagaaucguagcaaugcucuacacaccacuaagaucaaauggaucaggagaugaugucuuuacaguaucauguagaguccuaacacgaccuucaccagauuuugauuuuacauacuuaguaccacccacagucgaaucaaaaaccaaaccuuuuacacuaccuauauuaacauuaggagaauuauccaacucuagauuuccaguaucaauugaucaaauguucacuucaccaaaugaaguaaucucaguacaaugccaaaauggacgcugcacacuagauggagaacuacaaggaacaacucaauuacaagucucagguauauguguauuuaaaggagaagucaccgcacaccuacacgauaacgaccacuuauauaauauaacaauaacaaacuuaaauggaucuccauuugauccauccgaagaugucccugcaccacuaggcguuccagacuuccaaggaagaguauuuggaguaaucucacaaagagauaaucauaaugcaucaggacacaaucaaccagcaaaucgaggccaugaugccguaguaccaacuuauacagcacaauacacccccaaauuaggucaaauccaaauaggcacauggcaaacagacgaucuaacaguaaaucaaccuguuaaauucacaccaguaggauuaaaugaugucgaacauuuuaaucaauggguuguacccagauacgcaggcgcuuuaaauuuaaauacuaaucuugcucccucaguagccccaguauuuccgggugaacgacuauuauucuuucgaucauaucucccacuaaaaggagguuauggaaacccuguaauagacugccuucucccucaagaauggguacaacacuuuuaccaagaagcagcaccaucuaugucugaaguagcucuaguuagauacauuaaccccgauacaggaagagccuuauucgaagcuaaauuacauagagccggauucaugacuguuucuuccaauacuucugcaccuguagucguaccagcaaaugguuacuuuagauuugacucauggguaaaucaauuuuauucuuuagcaccaauggguacuggaaacggucgaagaagaauacaauaa

SEQ ID NO: 32737 - RNA, 1629 nt, Artificial Sequence
  derived and/or modified sequence opt6 from capsid_protein__Norovirus__BAG34634
augaaaauggcaaguaacgaugcagcaccuucaaccgauggagcagccggucuagucccagaaucuaauaaugaaguaauggcuuuagaaccugucgcaggugcagcacuagcugcaccaguaaccggucaaacuaacauaauagauccauggauacgagcaaacuuuguccaagcaccuaacggcgaauuuacaguaucaccaaggaacgccccaggugaaguauuacuaagcuuagaacuaggaccagaacuaaauccauaccuagcacacuuagcacgaauguauaauggauaugcaggagguauggaaguacaaguaauguuagcaggcaaugcauucacagcaggaaaacuaguuuuugcagcaguuccaccacauuucccaguagaaaaccugucaccacaacaaauaacaauguuuccacacguaauaauagaugucagaacuuuagaaccaguucuacuaccauuacccgacguucgaaauaacuuuuuccauuacaaucaaaaagacgacccaaaaaugagaauugucgcuaugcucuacacaccauuaaggaguaaugguucuggagaugauguauuuacaguaucauguagaguacuaacuagaccaucacccgacuuugauuuuacauauuuaguaccaccaacuguagaaucuaaaacaaaaccuuuuacauuaccaauucuaacauuaggagaauuaucaaauucaagauuuccaguauccauagaucaaauguauaccucaccaaacgaaguuauaucaguucaaugucaaaauggucguuguaccuuagacggagaauuacaaggaacaacccaauuacaaguaucagguauaugugcauuuaaaggagaagucacugcucaccuccaugauaacgaucacuuauacaauguuacaaucacaaaucuaaacggaucaccuuuugauccaucugaagacauaccagcaccacuuggaguaccugauuuccaaggaagaguauuugguguaauaucacaaagggauaaacauaacgcaucuggucauaaugaaccugccaauagaggacacgacgcagucguuccaacauauacagcacaauauacaccaaaacuuggccaaauacaaauaggaacauggcaaaccgaugaucuaacaguaaaucaaccugucaaauuuacaccaguaggcuuaaacgacacugaacauuucaaccaaugggucguccccagauacgcaggagcucuaaauuuaaauacaaaucuugcaccaucaguugcaccugucuuuccaggugaaagacuacuauucuucagaucauauauuccauuaaaaggagguuauggcaacccugcuauagauugucuacuaccucaagaaugggugcaacauuuuuaccaagaagccgcaccaucaaugagugaaguugccuuaguacgauacauuaacccagauacaggaagagcacuguuugaagcuaaauuacauagagcaggauuuaugacaguaucaucaaauacaucagcaccagucguaguaccagcaaaugguuacuucagauucgauucauggguaaaucaauuuuacucacuugcaccuaugggaacugguaacggaagaagaagaguacaauaa

SEQ ID NO: 32738 - RNA, 1629 nt, Artificial Sequence
  derived and/or modified sequence opt6 from capsid_protein__Norovirus__BAG34636
augaaaauggcaucuaacgaugcagcaccaucaacagauggugcagcaggacucguaccugaaagcaacaaugaaguaauggcacuagaaccaguagcaggagcagcacuagcagcaccaguaacuggacaaacuaacauaauagaucccuggauacgagcuaauuuuguacaagcaccaaacggagaauuuacaguaucaccuagaaacgcacccggagaaguauuacuaaauuuagaauuagguccagaacuaaauccauaucuagcacacuuagccagaauguauaacggcuaugccggaggcauggaaguacaaguaauguuagccgguaaugcauucacggccggaaaacuaguuuuugcagcaguaccaccacauuuucccguagaaaacuuaaguccucaacaaauaacaauguuuccacauguaauaauugauguaagaacuuuagaaccaguucuuuuaccacuaccugauguaagaaauaauuuuuuccacuauaaucaaaaagacgacccaaaaaugagaauagucgcaaugcuauauacaccauuaagaucuaauggcucaggagacgauguuuucacaguaucuugccgaguucucacaagaccuucaccagacuucgauuucacauaccuuguuccuccuacaguagaaaguaaaaccaaaccauucacacuaccaauauuaacacuaggcgaacuaucaaauucacgauucccaguuucaauagaucaaauguucacaucaccaaaugaaguuauuuccguacaaugccaaaacggacgauguacccucgacggagaacuacaagguucaacucaauuacaaguaucaggaauuugugcauuuaaaggagaaguaacagcccacuuacaugauaaugaucaccuauacaauauaacaaucacuaaccuaaacggcucaccuuucgacccaagcgaagauguacccgcaccuuuaggaguuccagauuuucaaggccguguauucggaguaaucucucaaagagacaaccauaacgcaucaggucauaaccaaccagcaaaucgaggccaugaugcaguugucccaacauacacaucucaauauacaccaaaacuaggacaaauacaaauagguacauggcaaacagacgauuuaacaguaaaucaacccguaaaauucacaccaguuggucuuaacgacguagaacauuuuaaccaauggguaguaccacgauaugcaggagcauuaaaccuaaacacaaauuuagcacccucuguugcaccaguauucccaggagaaagauuauuauucuuuagaucuuacuuaccacuaaaaggaggauauggaaacccagcaauagauugccuacuaccacaagaauggguacaacauuucuaccaagaagcagcaccauccauguccgaaguagcauuagucagauacauuaacccagacacaggccgcgcauuauucgaagcaaaauugcaucgcgcaggauucaugacaguaucuucaaacacaucagcacccguuguuguaccagcaaauggauacuuccgauucgacucauggguuaaccaauucuauucucuagcaccaaugggaacaggaaauggaagaagaagaauacaauaa

SEQ ID NO: 32739 - RNA, 1629 nt, Artificial Sequence
  derived and/or modified sequence opt6 from capsid_protein__Norovirus__BAG34638
augaaaauggcaucaaaugaugccgcaccaucaacagacggagcagcaggucuuguuccagaaucaaauaaugaaguuauggcucuugaaccaguagcaggagcagcauuggcagcaccgguaacuggucaaacaaacauuauagacccauggaucagagcuaauuuuguacaagcaccuaauggagaauuuacagucucuccaagaaaugcaccaggagaagucuuacuuaaucuagaacuuggaccagaacuaaauccauaucuagcacauuuagcaagaauguauaauggcuaugcaggagguauggaagugcaaguaauguuagcuggaaacgcauuuaccgccggaaaauuaguauuugcagcaguuccaccacacuuccccgucgaaaauuuauccccucaacaaauaacaauguuuccacauguaauaauagacguuagaacauuagaaccaguucuacuaccuuuaccugauguaagaaacaauuuuuuucacuauaaccaaaaagaugacccaaaaaugagaauaguagcaaugcuauacaccccucuaagaucaaacgguucaggcgacgacguauuuacaguaucauguagaguuuuaacaagaccaucaccagauuuugacuuuacauauuuaguuccaccaacaguagaaucaaaaacaaaaccauucacacuaccaauccuaacacuuggagaacuauccaauucaagauuucccguaucaaucgaucaaauguacacaucaccuaaugaagucauaucaguucaaugccaaaauggacgauguacauuagauggugaguuacaaggaacaacucaauuacaaguauccggaauaugcgcauuuaaaggcgaaguaacagcccauuuacaugauaacgaucaccuuuauaauguaacaauaaccaaucuuaacggaucacccuucgauccauccgaagauauaccagcaccauuaggagucccugauuuucaaggcagagucuucggcguaauuucacaaagagauaaacacaacucaccuggacauaaugaaccagcaaauagaggucaugacgccguagucccuaccuauacaucacaauauaccccuaaauuaggucaaauacaaauaggaacauggcaaacagacgaucuaacaguaaaucaaccaguaaaauuuacuccaguaggacuuaaugauaccgaacacuucaaccaauggguaguaccaagauaugcuggagcacuaaaccuuaauacuaauuuagcacccucuguagcuccaguauucccaggagaaagguuacuauucuuucgaucuuauauacccuuaaaaggcgguuacggcaauccagcaauugauugcuuacuaccacaagaauggguucaacauuucuaucaagaagcagccccaucuauguccgaagucgcuuuaguacgauauauaaauccagacacuggacgagcauuauuugaagcaaaacuccacagagccggcuuuaugaccguaucgaguaacaccucagcaccuguagucguaccugccaauggauauuuccgauucgauucauggguaaaucaauuuuacucauuagcaccaaugggcacugguaacggaagaagaagaguacaauag

SEQ ID NO: 32740 - RNA, 1629 nt, Artificial Sequence
  derived and/or modified sequence opt6 from capsid_protein__Norovirus__BAG34640
augaaaauggcaucaaacgacgccgccccaucaacagacggagccgcaggacucguaccugaaucuaauaaugaaguaauggcauuagaaccugucgcuggcgcagcacuugcagccccaguaacaggacaaacaaauauaauagauccauggauaagagccaauuuuguacaagcaccaaacggagaauucaccguauccccaagaaaugcacccggagaaguauuacuaaaucuagaacucggaccagaauuaaaucccuacuuagcacauuuagcaagaauguacaacggauacgccggaggaauggaaguucaaguaauguuagcuggaaaugcauuuacagcaggcaaacuuguuuucgcagcagucccaccucacuuucccguagaaaaccuaucaccacaacaaauuacaauguuuccacauguaauuauagauguucgaacauuagaaccaguucuacuaccauuaccugauguacgaaauaauuuuuuccauuauaaucaaaaagacgauccaaaaaugagaauagucgcaauguuauauacaccacuaagauccaauggauccggagaugauguauucacaguaucauguagaguacuaacuagaccaucaccggacuuugacuuuacuuauuuagugccaccuacaguagaaucaaaaacaaaaccauuuacuuuaccaauacucacauuaggagaacuaucaaacucaagauuuccaguaucaauagaucaaauguauaccucaccaaacgagguaauaucuguucaaugucaaaacggaagaugcacacucgauggagaacuacaaggaacaacccaauuacaaguaucagguauaugugcauuuaaaggugaagugacugcacaucuucaugauaaugaccaucuauacaaugucacaauaacaaacuuaaacggaucaccauucgauccaucagaagacauaccagcuccacucggaguaccagauuuucaaggaagaguuuucggagugauaucacaacgcgauaaacacaauucuccugggcacaacgaaccagcaaaccgaggacaugaugcaguaguuccaaccuauacaucacaauacacaccaaaacuaggacaaauucaaaucggaacauggcaaacagaugauuuaaccguaaaccaaccaguaaaauucacuccaguagguuuaaacgauacagaacauuucaaccaauggguaguuccacguuacgcaggagcacuaaaccuaaacacuaaucuugcccccuccguugcaccaguauuuccgggugaacgacuacuuuuuuuucgauccuacauaccauuaaaaggaggauacggaaauccugcaauagauugcuuauuaccucaagaauggguacaacauuuuuaucaagaagcagcacccucaaugucugaaguagcacuuguacgcuacauuaacccagauacaggaagagcuuuauucgaagcaaaauuacauagagccggauuuaugacaguaucaucaaauacuuccgcuccaguaguaguaccagccaauggauauuuccgauucgacucauggguaaaucaauuuuauagucuagcaccaauggguacuggaaauggaagaagacguguucaauaa

SEQ ID NO: 32741 - RNA, 1629 nt, Artificial Sequence
  derived and/or modified sequence opt6 from capsid_protein__Norovirus__BAG34642
augaaaauggcaucaaaugaugcagcacccucaacagauggagcagcaggccuaguaccugaaucaaauaaugaaguaauggcacuagaaccaguugccggagcagcauuagcagcaccagucacuggacagacaaauauaauagacccauggauuagagcaaauuuuguacaagcaccaaauggugaauuuacaguaucaccacgaaacgcacccggagaaguacuacuaaaucuagaacuaggaccugaauuaaauccauauuuagcacaccuagcuagaauguauaacggauacgcaggaggaauggaagugcaaguuaugcuagcugguaacgcuuucacugcagguaaacuaguauuugcagcagucccaccucauuucccaguugaaaaucucuccccacaacaaauaacuauguucccacauguaauaauagacguaagaacucuagaaccagucuuacuuccauuaccagacguccgaaacaauuucuuucacuacaaucaaaaagaugacccuaaaaugagaauaguagcaaugcuauauacaccacuacgaucuaauggaucuggcgaugauguuuucaccguuucuuguagaguauuaacacgaccaucaccagacuuugauuuuacauaucuuguaccaccaacagucgaaucaaaaacaaaaccauuuacacuaccaauacuaacucuaggagaacuaucuaauucuagauucccaguuagcaucgaucaaauguauacaucaccuaacgaaguaauuucaguacaaugccaaaacggucgaugcacacuagacggagaauuacaaggaacaacccaacuccaaguuagcggaauaugugcuuuuaaaggcgaaguuaccgcacaccuucaugacaaugaucaccucuauaacguuacuauaacaaacuuaaacgguucaccauuugauccaucagaagauaucccagcaccgcuaggcguaccugacuuucaaggaagaguauucggcguaauaucacaaagagauaaacauaacucucccggccauaaugaaccagccaaucgaggacacgaugccguaguaccaaccuacacaagucaauacacacccaaacuuggucaaauacaaaucggaacuuggcaaacagacgaucuaacaguaaaucaaccaguaaaauuuacacccgucgguuuaaacgacacugaacauuucaaccaauggguuguaccaagauaugcaggcgccuugaacuuaaauacaaaccuagccccauccguagccccuguauucccuggcgaacgacuacuuuuuuuccgaucuuacauaccuuuaaaaggagguuauggaaacccagcaauagacuguuuacuuccacaagaauggguucaacacuuuuaucaagaagcagcaccuucuaugucagaaguagcauuaguuagauacauaaauccagacacagguagagcacucuucgaagcaaaacuucacagagcuggauuuaugacaguaucuucaaacaccucugcaccaguaguaguacccgccaaugguuauuuccguuucgauucauggguaaaucaauucuauucauuagcaccaaugggaaccggcaauggaagaagaagaguacaauaa

SEQ ID NO: 32742 - RNA, 1629 nt, Artificial Sequence
  derived and/or modified sequence opt6 from capsid_protein__Norovirus__BAG34644
augaaaauggcuagcaaugacgccgcaccaucuacugauggcgcagcaggacuaguaccugaaucaaauaaugaagucauggcauuagaaccaguagccggagcagcacucgcugccccaguaacaggucaaacaaacauaaucgauccauggauacgagcaaacuucguacaagcaccaaauggugaauuuacaguauccccacgaaaugccccuggagaaguccuacuaaaucuagaacuaggaccagaacuaaauccauauuuagcacaccuagcuagaauguauaaugguuacgcaggaggaauggaaguacaaguaaugcuagcaggaaacgccuucacagcaggaaaauuagucuuugcagcaguaccuccacacuucccagucgaaaauuuaucuccccaacaaauaacaauguuuccucacguaauaauagauguaagaacacuugaaccaguacuacuaccacuaccagauguaagaaacaacuucuuucacuacaaccaaaaagacgacccaaaaaugagaauaguagcaauguuauacacaccauuaagaucuaauggaucaggagacgacguuuuuacaguauccuguagagucuuaacuagaccauccccugacuuugacuucacauauuuaguaccaccaaccguugaaucaaaaacaaaacccuucacccuaccuauacucacacucggagaauuauccaacaguagauuucccgucucaauagaucaaauguacacaucaccaaaugaaguaauaucaguucaaugucaaaaugguagaugcacauuagauggagaauuacaaggaacaacacaacuucaaguuagcggcauaugugcuuuuaaaggcgaaguuacagcacaucuacacgauaaugaccaccuauauaacguaacuauaacuaauuuaaauggcuccccuuucgauccaucugaagacauaccagcaccucuaggaguccccgacuuucaaggacgaguauuuggaguaauaucacaaagagauaaacacaauucaccaggucauaaugaaccagcaaacagaggacaugacgcaguuguaccaacauacacaucucaauacacaccgaaacuaggacaaauccaaauagguacauggcaaacagaugauuuaaccguuaaucaaccaguaaaauuuaccccaguaggacucaacgacacagaacacuuuaaucaauggguaguacccagauacgcaggagcauuaaaccuuaauacuaaucuagcaccauccguagcacccguauucccaggugaaagacuauuauucuuucguuccuacaucccauuaaaaggaggcuauggaaauccagcaaucgauugucuuuuaccacaagaauggguacaacacuuuuaucaagaagcagcaccaucaauguccgaaguagcuuuaguacgauacauuaacccagacacagguagagcauuauucgaagcaaaguuacaucgagcaggcuucaugacagucagcucuaauacuucugcaccagucguaguacccgccaacggauauuucagauuugauucauggguaaaccaauucuauucuuuagcaccaaugggcacaggaaaugguagaagaagaguucaauaa

SEQ ID NO: 32743 - RNA, 1629 nt, Artificial Sequence
  derived and/or modified sequence opt6 from capsid_protein__Norovirus__BAG34646
augaaaauggcaucuaaugaugcugcucccucaacagauggcgcagcaggacuaguaccagaauccaauaaugaagucauggcacuugaaccaguagccggagcugcacucgcagccccuguaaccggacaaacaaauauaauagacccuuggauaagagcaaauuucguacaagcacccaacggugaauucacuguaagcccaagaaacgcaccaggugaaguuuuacuaaaccuagaacuaggaccagaauuaaauccauaucuagcacaccuagcaagaauguauaauggcuaugcuggaggaauggaaguacaaguaaugcuagcaggaaacgccuucacagcuggaaaauuaguauuugcugcaguacccccacacuuuccagucgaaaaccuaucaccacaacaaauuacaauguucccccauguaauaaucgauguuagaacccuugaacccguccuacuuccacuuccagacguacgaaauaacuuuuuccacuauaaucaaaaagacgacccuaaaaugagaauaguagcaauguuauacacaccauuacgaucaaacggaucaggagaugacguauuuacaguaucauguagaguauuaacaagaccaucaccagacuucgacuucacauaccugguaccaccaacaguugaaaguaaaacuaaacccuucacacuaccaauccuuacacuaggagaauuaucaaacucaagauucccaguuucaauagaccaaauguauacaucaccaaacgaagucauuaguguacaaugccaaaacgguagauguacacuugacggagaacuucaaggaaccacacaacuccaaguaucgggaauaugugcauuuaaaggagaaguaacagcucauuuacaugauaacgaucauuuauauaaugucacaauaacaaaccucaacggaucaccauuugacccuucagaagacaucccagcuccacuuggaguaccugacuuccaaggacgaguauuuggaguaauaucucaaagagacaaacauaauucuccaggacacaaugaaccagcaaauagaggacacgaugcaguuguaccaaccuauacaucacaauauacuccaaaacuaggacaaauacaaauaggaacuuggcaaaccgacgauuuaacuguuaaccaaccuguaaaauuuacaccaguaggacuaaaugacacagaacacuucaaccaaugggucgucccaagauaugcaggagcauuaaauuuaaauacaaacuuagcuccuuccguagcaccaguauucccaggagaaagauuauuauucuuuagaaguuacauuccauuaaaaggaggauaugguaauccagcaauagacugccuacuaccgcaagaauggguacaacauuucuaccaagaagcagcuccaucaaugucagaaguugcauuaguucgauacauaaacccugacacaggacgagcauuauucgaagcuaaauuacauagagcaggcuuuaugacaguaagcagcaacaccucagcaccaguagucguaccagcaaauggcuauuucagauuugacucauggguaaaucaauuuuauagucuagccccaaugggaacuggaaauggaagaagacgaguacaauaa

SEQ ID NO: 32744 - RNA, 1629 nt, Artificial Sequence
  derived and/or modified sequence opt6 from capsid_protein__Norovirus__BAG34648
augaaaauggcaaguaaugaugcagccccaagcacugauggugcagcaggacuagucccugaaucuaacaaugaaguuauggcacuagaaccaguagccggagcagcuuuagcugcccccguaacuggucaaacuaacauaauagauccauggauaagagcaaauuuuguacaagcuccaaauggagaauucacugucucgccaagaaacgcaccuggagaaguauuacuaagucuagaacuaggacccgaacuaaacccauaucuagcgcacuuagcaagaauguacaauggauacgcagguggaauggaaguacagguaauguuagccggaaacgcauuuacagcaggaaaacuuguuuuugcugcaguacccccacauuuuccaguagaaaaucuaucaccacaacaaauaacaauguuuccucacguaauaauagaugucagaacgcucgaaccaguucuauuaccacuaccugauguacgaaauaauuuuuuucacuacaaucaaaaagacgauccaaaaaugagaauaguagcuaugcuauauacaccccuaagaucaaacggaucaggagaugaugucuuuacaguaucuuguagagucuuaacacgaccaucaccagacuuugauuucacauaucuaguaccccccacuguagaaucaaaaacaaaaccauuuacauuaccaauauuaacauuaggugaauuaucaaauagccguuucccaguaucaauagaucaaauguauacaucaccaaaugaaguaauaucuguacaaugucaaaacggacgauguaccuuagacggugaacuacaaggaucuacacaacuucaaguuucagguauaugcgcauucaagggagaaguaacagcucaucuacaugacaaugaucaucuuuauaacguaacaauaacuaauuuaaacggaucaccauucgauccauccgaagauauaccagcaccacuagguguaccugauuuucaaggaagaguauuuggcgucauaagucaacgagauaaacauaauucaccaggacacaaugaaccugcuaacagaggacaugacgcugucguaccaacguauaccucacaauauacaccaaaacuaggucaaauacaaauagguacauggcaaacagacgaucucacuguaaaucaaccaguaaaauuuacaccagucggauuaaacgauacugaacacuuuaaccaguggguuguaccaagauacgcaggagcuuuaaaucuaaauacuaaccuagcacccucaguagcuccaguauucccaggagaacgacuauuguuuuuuagaucuuacauaccauuaaaagguggauauggaaaucccgcuauagauugccuauuaccacaagaauggguucaacacuuuuaucaagaagcugcuccaagcaugucagaaguagcauuaguccgauacauaaauccugauacaggaagagcauuauuugaagcaaaauuacauagagcagguuucaugacuguauccucaaacacaucugcccccguuguaguaccagccaacggauacuuccgauuugacuccugggucaaccaauucuauucacuagcuccaaugggcacuggaaauggaagaagaagaguacaauaa

SEQ ID NO: 32745 - RNA, 1629 nt, Artificial Sequence
  derived and/or modified sequence opt6 from capsid_protein__Norovirus__BAG34650
augaaaauggcauccaaugaugcagcaccaucuacagauggugcagcaggauuaguaccagaaucaaacaaugaaguaauggcuuuagaaccaguugcaggcgcagccuuagcagcucccguaacaggacaaacaaauauuauagauccuuggauaagagcaaauuucguacaagcaccuaacggagaauucacaguaucuccaagaaacgccccuggagaaguacuauuaaaucuugagcuuggaccagaauuaaauccauaucuagcacacuuagcaagaauguauaauggauacgcaggagguauggaaguucaaguaauguuagcaggaaaugcauuuacagcagguaaacuagucuucgccgcaguaccaccacacuuuccaguugaaaauuuaucuccacaacaaauaacaauguucccacauguaauaauugauguacgaacauuagaacccguucucuuaccauuacccgauguacguaauaacuucuuucauuacaaccaaaaagacgauccuaaaaugagaauaguagcaauguuauauaccccacuaagaucaaacggauccggugacgacguauuuacaguaucauguagaguacuaacucgaccaucaccugacuuugacuucacauaucuaguuccaccuacagucgaaucuaaaacaaaaccauuuacuuuaccuauacuaacauuaggagaacuaucuaacuccagauucccuguaaguaucgaucaaauguacaccaguccaaaugaaguaauaucaguucaaugucaaaaugguagauguacauuagauggugaacuacaaggaacuacacaauuacagguaucaggcauaugugcauuuaaaggagaaguaacagcucacuuacacgacaaugaucaccuauauaaugugacaauaacaaacuuaaauggaaguccauuugauccaagugaagauauaccagcaccacuaggagucccagacuuccaagguagagucuuuggaguaauaucacaaagagauaaacauaauagucccggacacaaugaaccagcaaaucgcggccaugaugcaguagucccuacuuauacaagucaauauacaccaaaauuaggacaaauacaaauagguacauggcaaacagaugauuuaacaguaaaccaacccguuaaauuuacacccguaggcuuaaaugauacagaacacuuuaaccaaugggucguuccucgauacgcaggugcacucaaucuuaauacaaacuuagcaccuagcguugcaccaguuuuuccaggagaaagauuauuauuuuuccgaaguuauauaccacucaaaggcggauauggaaauccagcaaucgacugucuuuuaccccaagaauggguucaacacuuuuaucaagaagcugcuccaucaauguccgaaguugcuuuaguaagauacauuaaucccgacacaggaagagcuuuauuugaggcaaaacuucaccgagcaggauucaugacaguauccucaaauacaagugcaccagucguaguuccagcaaaugguuauuuuagauucgauucauggguaaaccaauucuauucauuagcaccaaugggaacuggaaacggacgaaggagaguacaauaa

SEQ ID NO: 32746 - RNA, 1629 nt, Artificial Sequence
  derived and/or modified sequence opt6 from capsid_protein__Norovirus__BAG34652
augaaaauggcaucuaacgacgcugcaccaucuacagauggagcagcuggacuuguaccagaauccaacaaugaaguaauggcccuagaaccuguugcaggagcagcauuagcagcaccaguaacaggacaaacaaacauaauagacccauggauaagagccaacuucguacaagcuccaaacggagaauuuacagucucaccuagaaacgcacccggugaagucuuacuaaauuuagaacuuggacccgaauuaaacccauacuuagcacauuuagcacgcauguacaauggauacgcaggaggcauggaaguacaaguuaugcuagcaggaaacgcauuuacagccggaaaacuaguuuuugcagcaguuccaccacacuuucccguagaaaaccuaucuccacaacaaaucacuauguuuccucauguuaucauagacguaagaacauuagaaccaguacuauuacccuuaccagacguaagaaacaacuuuuuccauuauaaucaaaaagaugauccaaaaaugagaaucguagcaauguuauauacaccacuacgaucaaacggaucaggagaugauguauuuacaguuuccugccguguccuaacuagaccaucuccagacuucgacuuuacauaccuaguaccacccacuguagaaaguaaaacaaaaccauuuacauuaccuauacucacauuaggugaacuaucuaauagccgauuuccgguaucaauagaccaaauguauacaaguccaaacgaagucauauccguacaaugucaaaacggaagauguacauuagauggugaacuacaaggcacaacacaacuacaagucucaggaauuugcgcauucaaaggagaaguaacagcacaccuacaugacaaugaucacuuauacaauguaacaauaacaaaucuaaacggaucaccauucgauccaucagaagacauaccagcaccacuaggagucccagacuuucaaggcagaguuuuugggguuauaucacaaagagacaaacacaacuccccaggucauaacgaaccagcaaauagaggacaugaugcuguaguaccaacauauacaccacaauauacaccaaaacuuggacaaauacaaauaggaacauggcaaacugaugaccuuacaguaaaucaaccaguaaaauuuacaccaguaggucuaaaugacacagaacauuuuaaucaaugggucguuccacgauacgcaggugcuuuaaaccuaaauacuaaucuagcaccaucuguugcaccaguuuuuccuggugaacgauuacuauucuucagaagcuacauaccuuuaaaagguggcuauggaaauccagcaauagauugcuuacuaccucaagaauggguucaacauuuuuaccaagaagcugcuccaucaauaucagaagucgcacuaguaagauacaucaacccagacacaggaagagccuuauucgaagcaaaauuacauagagccggauucaugacuguaucuucaaauacaucugccccaguaguaguuccagcaaacggauauuuuagauucgauucauggguuaaucaauuuuacagccuagcaccuaugggaacaggaaauggaagaagacgcguacaauaa

SEQ ID NO: 32747 - RNA, 1629 nt, Artificial Sequence
  derived and/or modified sequence opt6 from capsid_protein__Norovirus__BAG34654
augaaaauggcaucaaaugaugccgcuccaucaacugauggagcagcaggauuaguuccagaaucaaauaaugaaguaauggcauuagaaccuguagcaggagccgcacuugccgcuccaguuacuggucaaacaaauauaauagacccauggauaagagcuaauuuuguacaagcuccuaauggcgaauuuacaguaucaccaagaaaugcaccaggagaaguacucuuaaauuuagaguuaggaccugaauuaaauccauaucuugcacaucuagcaagaauguauaauggcuacgcaggugguauggaaguacaaguaaugcuagccggaaacgcauucacagcaggaaaacuaguauucgcagccguaccaccacacuuuccaguugaaaaucuuucuccucaacaaauaacaauguuuccgcacguaauaauugacgugcgaacucuagaaccaguucuauuaccauuaccagauguaagaaauaacuuuuuucacuauaaucaaaaagacgauccaaaaaugcgaauaguagcaauguuauauacaccccuuaggucuaauggaucaggcgacgacguuuuuacaguuucuuguagaguccucacaagaccuuccccugacuucgauuuuacauaccucguaccaccuacaguagaaucuaaaacaaaaccauuuacauuacccauacuaaccuuaggugaauuaaguaacucuagauucccaguaucuauagaucaaauguauacuucaccaaacgaaguaaucucaguacaaugucaaaacgguagaugcacacuagauggugaacuucaaggaacaacacaauuacaagucuccggaauaugcgcuuuuaaaggugaaguuacagcccaucuacaugauaaugaccauuuauacaacguaacaaucacgaaucuaaacggauccccauuugaucccuccgaagacauaccagcaccacucggaguaccagauuuucaaggaaggguauuuggaguaauaucacaacgagacaaacacaauucaccaggacauaaugaaucagcaaacagaggucaugacgccguaguaccaacuuacacuucacaauauacaccaaaauuaggccaaauacaaauagguacuuggcaaacugacgaccuaacaguaaaucaaccuguaaaauuuacuccaguaggacuaaaugauacagaacauuucaaucaauggguaguuccaagauacgcuggagcucuaaaccuaaauacaaaccuagcacccucuguagccccaguauucccaggagaacgcuuauuauucuucagaucuuacauaccacuaaaaggagguuauggaaaccccgcaauagauugucuacuaccacaagaauggguacaacauuuuuaccaagaagcagcacccucaaugucugaaguagcacuuguuagauacauaaaucccgauaccggacgcgccuuauucgaagcaaaacuacauagagcuggauucaugacaguaucauccaauacuuccgcaccaguaguaguaccugcaaacggcuacuuuagauuugauucuuggguaaaccaauucuauucacuagcaccaaugggaacaggaaauggaagacgacgaguucaauaa

SEQ ID NO: 32748 - RNA, 1629 nt, Artificial Sequence
  derived and/or modified sequence opt6 from capsid_protein__Norovirus__BAG34656
augaaaauggcaucuaacgaugcagcaccaucaacagacggagcagccggauuaguaccugaauccaauaaugaaguaauggcauuggaaccagucgcuggagcagcauuagcagcaccaguaacaggucaaacaaacauaauagacccauggauaagagcuaauuucguacaagccccaaacggugaauuuacuguuuccccaagaaacgcaccaggugaaguacuacuaaauuuagaacucggaccagaauuaaacccauacuuagcacaccuagcccgaauguauaacggauacgccggaggaauggaaguccaaguaaugcuagcaggaaaugcauuuaccgcagguaaacuugucuucgcagcaguucccccucauuucccuguagaaaaccuaucuccucaacaaauaaccauguuuccacauguuaucauagacguaagaacacuagaaccaguacuacuaccacucccagauguaagaaauaacuuuuuccauuacaaucaaaaagaugacccuaaaaugagaauaguagcaaugcuauacacaccacucagguccaaugggucaggagaugacguauuuacuguaaguuguagagucuuaacaagacccucaccagauuucgauuuuacauaucuaguaccccccacaguagaaagcaaaacaaaaccauucacauuaccaauuuuaacacuaggagaauuaagcaauaguagauuuccaguaucuauagaucaaauguauaccaguccaaaugaaguaauaucuguucaaugucaaaauggaagauguacccuagauggagaauuacaaggcacuacacaauuacaaguaucaggaauaugugccuucaaaggugaaguaacagcacaucuucaugacaaugaccacuuauauaauguaacuauaaccaaccuuaaugguucaccauuugauccuucagaagauauuccagcuccacucggaguuccagauuuucaaggaagaguuuuuggaguaauuucucaacgagacaaacauaacuccccaggacauaacgaaccagcaaauagaggacaugacgcuguaguaccuaccuauaccucacaauauacaccaaaacuaggacaaauacaaauaggaacuuggcaaacagaugaccuaauaguuaaccaaccagucaaauuuacaccaguaggcuuaaaugauacagaacauuuuaaucaauggguaguucccagauaugcaggagcacuaaaucuaaauacaaaccuagccccaucaguagcaccaguuuucccaggagaacgauuacuauucuuuagaucauauauuccacuaaaaggagguuacggaaauccagcaauagacugucuccuaccacaagaauggguacaacauuuuuaccaagaagcagcaccuuccaugucggaaguagcacuuguaagauacauuaauccagauacaggaagagcauuauuugaagcuaaacuacauagagcagguuucaugacuguaucaucaaacacuuccgccccuguaguaguaccagcuaauggguacuuucgauuugacagcuggguaaaccaauucuauucacuagccccuaugggcacagguaauggaagaagacgaguacaauaa

SEQ ID NO: 32749 - RNA, 1629 nt, Artificial Sequence
  derived and/or modified sequence opt6 from capsid_protein__Norovirus__BAG34658
augaaaauggcuagcaaugaugcagcaccuucuacugauggagcagcaggauuaguaccagaaucaaacaaugaaguaauggcuuuagaaccaguagcaggagcggccuuagccgcacccgucaccggacaaacaaauauaauagacccauggauaagagcaaauuucguacaagcuccaaauggagaauucacagucuccccuagaaacgccccaggagaaguccuacuuaauuuagaauuaggaccagaacuaaacccauaucuugcacaucuugcaagaauguauaacgguuaugcagguggcauggaaguacaaguaauguuagccggaaaugcauuuacugcaggaaaauuaguauuugcagcgguaccaccacacuuuccaguugaaaaucuuucaccacaacaaauuaccauguucccacacguaauuaucgacguaagaacccuagaacccguacuacuuccacuuccagacguaagaaauaauuucuuccacuauaaccaaaaagaugauccaaaaaugagaauaguagcuaugcuuuacacaccacuaagaucaaauggaucuggagaugacguauucacagucucauguagaguccucacccgcccauccccagauuuugauuucacauacuuaguaccucccacaguagaaucaaaaacaaaaccuuuuaccuuacccauccuaacauuaggagaacuaucuaacuccagauuccccgucuccauugaucaaauguauacaucuccuaaugaaguaauaucaguacaaugccaaaauggacgauguacucuagacggcgaauuacaagguacaacacaauuacaaguaucuggaauaugcgcuuucaaaggagaaguuaccgcacacuuacaugauaacgaucauuuauauaauguaacaauaacaaaccuuaaugguaguccauuugauccaucagaagauauaccagcaccuuuagguguuccagacuuucaagguagaguauuugguguaauuucacaaagagauaaacacaauucacccggacauaaugaaccagcaaauagaggacaugacgcaguuguaccaacauacacaagccaauauaccccaaaauuaggacaaauucaaauaggaacauggcaaacagacgaccucaccguaaaucaaccuguaaaauuuacaccaguaggauuaaaugacacagaacauuucaaccaauggguaguucccagauaugcuggcgcacucaaucuuaauacuaacuuagcaccaucaguagccccaguuuuuccuggagaaagauuauuauucuuuagaaguuauauaccucuaaaaggaggauauggaaacccagccauugauuguuuacuaccacaagaauggguucaacauuucuaucaagaagcugcacccucaaugucagaagucgcauuaguuagguauauaaauccagacaccggccgcgccuuauuugaagcaaaacuucacagagcaggauucaugacaguaucaucaaauacaucagcuccugugguugucccugcaaauggauacuuuagauuugauucauggguaaaucaauuuuauucuuuagcaccaaugggcacuggaaauggaagaagaagaguacaauaa

SEQ ID NO: 32750 - RNA, 1629 nt, Artificial Sequence
  derived and/or modified sequence opt6 from capsid_protein__Norovirus__BAG34662
augaaaauggcuucaaacgacgcugcaccaaguacagacggagccgccggacuuguaccugaaucaaauucagaaguuauggcauuagaaccaguggcaggagcagccuuagcagcacccguaacaggacaaacaaauauaauugacccuuggauacgaucaaauuuuguucaagcaccuaacggcgaauuuacaguuucaccaagaaacgcaccaggagaaguccuccugaauuuagaacuagguccagaacuaaauccauacuuagcacacuuagcacgaauguauaacggauacgcaggaggaauggaaguacaaguaauguuagcaggcaaugcauuuacagccggaaaacuuguuuucgcagccgucccaccacacuucccaguagaaaaucuaucuccacaacaaauaacaauguucccucacguuauaauagacguaagaacguuagaaccaguauuauuaccauuaccagacguaagaaauaauuucuuucacuacaaucaaaaagaugauccaaaaaugagaauaguugccauguuauacacaccauuaagaucaaacggaucaggcgaugacguauucacaguaucauguagaguacuaacaagaccuucuccagauuuugauuucacauaucuaguaccacccacaguagaaucaaaaacaaaaccauuuacacuaccuaucuuaacauuaggagaauuaaguaauagccguuuuccuguaucaauugaccaaauguauacuucaccaaaugaaguaauaucuguucaaugucaaaacgguagauguacacuugauggugaauuacaagguacaacacaacuccaagucucuggcauaugugccuuuaaaggugaaguaacagcacacuuacaaaaugacgaucaucuuuacaacauuacaauaacuaaucuaaauggcucaccauucgaucccucagaagauauaccugcaccacuagguguaccagacuuucaagguagaguuuucggcguaauaacacagagagauaaacaaaacgcaacuggccaaaaucaaccagccaauagaggucacgaugccguuguaccaaccuauacagcacaauauacaccaaaacuaggacaaauccaaauaggaaccuggcaaacagacgacuuaaaaguaaaucaaccaguaaaauucacaccaguaggauuaaaugacacagaacauuucaaccaauggguaguaccaagauacgcaggagcauuaaaucuuaacacuaauuuagcaccaucaguagcuccaguguuccccggagaacgauuacuauuuuuucgcuccuaucuuccccuaaaagguggauacggcaaccccgccauagauugucuauuaccacaagaauggguccaacacuuuuaucaagaagcagcaccguccaugucugaaguagcacuaguuagauauauuaacccagacacuggccgugcauuauucgaagccaaacuacacagagcuggcuucaugacaguaucaucaaauacuucugcuccaguaguuguaccugcaaauggauauuuuagauucgauucuuggguaaaucaauuuuauucacuggcaccaaugggaaccggaaauggucgaagaagaauacaauaa

SEQ ID NO: 32751 - RNA, 1629 nt, Artificial Sequence
  derived and/or modified sequence opt6 from capsid_protein__Norovirus__BAG34664
augaaaauggcuuccaaugaugcagcaccaucaacagacggugcagcagguuugguaccagaaucuaacaaugaaguaauggcacuugaaccaguagcaggagcagcauuagcagcaccagucacaggacaaaccaauaucauugacccuuggauaagagcaaacuuuguacaagcaccaaauggagaauucacaguaucaccacgaaaugcaccuggagaaguauuacuaaacuuagaacuaggaccugaacuaaauccauacuuagcacaccuagccagaauguauaacggauaugcaggaggcauggaaguacaaguaaugcuagcagguaaugcuuucacugcaggaaaacuaguuuucgcagcaguaccaccacacuuucccguagaaaaucuaucaccucaacaaauaacaauguuuccucacgucauaauugaugucaggacacuugaaccaguccuauuaccacuaccagauguaagaaauaauuucuuucacuacaaucaaaaagaugacccuaaaaugcgcauagucgcaauguuauacacuccucuaagaucaaauggaagcggcgacgauguauucacaguaucuugccgaguuuuaacuagaccaucaccagacuucgauuuuacauaucuaguuccaccaacaguagaaucaaaaacaaaaccuuuuacucuaccaauauuaacacuuggugagcucucaaacucaagauuuccugucucuauagaccaaauguauacauccccaaaugaagucauaucaguucaaugucaaaauggacgauguacauuagacggagaauuacaagguacaacacaauuacaaguaucagguauaugugccuuuaaaggagaaguaacugcucacuuacaugauaaugaucaucuuuauaauauaacaauaacuaacuuaaauggaucaccauuugauccuucugaagauacacccgcaccacuaggaguaccugacuuucaaggccgaguauucggaauaauaucacaaagagacaaacagaacgccacaggacacaaugaaccagcuaacagaggacaugaugcagucguaccuacauacacagcucaauauacaccaaaacuaggacaaauacaaaucgguacuuggcaaacagacgaccuaacaguaaaucaaccuguaaaauucacuccuguaggauuaaaugacacagaacauuucaaccaauggguaguaccaagauaugcaggugcucuaaauuuaaacacuaauuuagcaccaucaguugcacccguauucccaggagaaagauuacucuucuuccgaaguuacaucccacuuaaaggaggauacggaaaucccgcaauagauuguuuauuaccacaagaauggguccaacacuucuaucaagaggcugcaccuucaaugagugaagucgcuuuaguaagauacauaaauccagacacaggcagagcacuuuuugaagcaaaauugcacagagcuggauuuaugacaguuucuucaaauacuucagcaccagucguaguaccugcaaacggauauuuccgauuugauucauggguaaaucaauuuuauucacuagcuccaaugggaacaggaaauggaagaagacguguucaauaa

SEQ ID NO: 32752 - RNA, 1629 nt, Artificial Sequence
  derived and/or modified sequence opt6 from capsid_protein__Norovirus__BAG34666
augaaaauggcaucuaaugacgcagcaccaucuacagacggagcugccggccuaguaccagaaucuaacaaugaagucauggcauuagaaccaguagcaggagcagcauuagcagcaccaguaacaggucaaacuaacauaauagauccauggauaagagcaaauuucguacaagcaccaaacggagaauucacuguaucaccacguaacgcuccaggagaaguauuacuuaauuuagaacuaggaccagaauuaaacccauaccucgcacaccuagcaagaauguauaaugguuaugcagguggaauggaaguacaaguaauguuagcuggaaaugcauuuacagcaggaaaacucguuuucgcugcuguaccaccccacuuuccaguugaaaaucuaucaccacaacaaauaacuauguucccucaugucauaauagacguacguacccuugaaccaguauuacuaccacuuccagacgucagaaauaauuucuuucacuauaaucaaaaagaugauccaaaaaugagaauagucgcaaugcuauacacaccucucagaucaaacggaucaggcgaugacguauucaccguaucuuguagaguauuaacaagaccaucaccagacuuugauuuuacauauuuaguaccaccaacaguagaaucuaaaaccaaacccuuuacacuaccaauacuuacccuaggcgaacucucuaauagcagauuuccaguaucuauagaccaaauguauacaucaccuaacgaaguaauaucaguccaaugucaaaauggucgauguacucuagauggagaauuacaagguacuacacaauuacaaguaucuggaauaugugcauuuaaaggugaaguaacagcacauuuacaugauaaugaucaucuauauaauguaacuauuaccaaucuaaacggaucaccauuugauccaucugaagacauuccagcaccacuaggaguaccugacuuccaaggaagaguuuucggaguaaucucccaaagagauaaacauaacagcccaggacauaacgaaccagcuaauagaggccacgacgcugucguacccacauacaccucacaauacacaccaaaacucggacaaauacaaauaggcacauggcaaacugaugacuuaacaguaaaccaaccaguuaaauuuacucccguaggauuaaaugauacagaacacuuuaaucaauggguaguacccagauacgcuggcgcacuaaaccucaacacaaaccuagccccaagcguugcaccuguauucccuggagaacgacuuuuauucuucagaucauauauaccauuaaaaggaggcuacggcaacccagcuauagacugcuuauuaccacaagaauggguccaacauuucuaccaagaagcagcuccaucuaugagcgaaguagcauuaguaagauauauaaaucccgacacagguagagcacuauuugaagcgaaguuacaccgagcaggcuuuaugacaguaucaucaaacacaucagcaccaguaguaguaccagcaaacggauauuuuagauuugacucauggguuaaucaauucuacaguuuagcaccuaugggaacaggaaacggaagacgacgaguacaauaa

SEQ ID NO: 32753 - RNA, 1629 nt, Artificial Sequence
  derived and/or modified sequence opt6 from capsid_protein__Norovirus__BAG34668
augaaaauggcaucaaaugacgcagcaccaaguacagacggugccgcaggauuagucccugaaucaaacaacgaagucauggcuuuagaaccaguagcaggugcugcucuugcagccccaguaaccggacaaacaaacaucauagaccccuggauacgagcaaacuucguacaagcuccaaacggagaauucaccguaucaccaagaaacgcgccuggagaaguucuucuaaacuuagaguuaggaccugaacuaaauccuuaccuagcacacuuagccagaauguacaacggcuaugcugguggaauggaaguacaaguaauguuagcaggaaacgcauuuacagcuggaaaauuaguauuugcagcaguuccaccucacuuuccaguugaaaaccuaucaccccaacaaaucacaauguuuccucacguaauaaucgauguucgaauauuagaaccaguauuacuaccacuaccagauguaaggaacaacuuuuuucacuauaaccaaaaagacgaccccaaaaugagaaucgucgcaauguuauauacaccauuaagaucuaacggauccggcgacgauguauucacaguuucaugucguguacuaacaagaccauccccugacuuugacuucacauauuuaguaccuccaacaguagaaagcaaaacuaaaccauuuacucuaccgauccuaacauuaggagaauuaucaaacucaagauuucccguuucaauagaccaaauguauacauccccaaaugaaguuauaucuguacaaugucaaaauggccgauguacauuagauggagaauuacaaggaacaacucaacuacaaguaucagguauaugugccuuuaaaggagaaguaacugcucauuuacaugacaaugaucaccuuuauaauguaacaaucacaaaccuaaaugguucaccauucgauccaucugaagauauaccugccccuuuagguguaccugauuuccaaggcagaguuuucggaguaaucucucaaagagacaaacacaacaguccuggucacaacgaacccgcaaacagaggucaugaugcaguuguaccuacauacaccucacaauauacaccaaaauuaggacaaauacaaauagguacuuggcaaacagaugaccucacagucaaccaaccaguaaaauuuacuccaguaggcuuaaacgacacagaacauuucaaucaauggguaguaccaagauacgcaggugcacuaaaucuuaauacaaaccucgcaccuucaguagccccaguauuuccaggcgaaagacuauuauuuuuuagaucauacauuccccuaaaaggaggauauggaaauccagcaauagacuguuuacuaccucaagaauggguacaacauuucuaucaagaagcagcacccucuaugucugaagucgcacuaguuagauacauaaacccugacacaggacgugcauuauuugaagcaaaauuacauagggcaggauuuaugacuguaucuucaaauacaucagcaccuguuguugucccugcaaauggauauuuccgauucgauucauggguaaaucaauucuauucauuagcacccaugggaacaggaaacggaagaagaagaguacaauaa

SEQ ID NO: 32754 - RNA, 1629 nt, Artificial Sequence
  derived and/or modified sequence opt6 from capsid_protein__Norovirus__BAG34670
augaaaauggcaucaaaugacgcagccccgucaacagauggagcugcaggacuaguaccagaaucuaauaaugaaguaauggcacucgaaccaguugcaggagcagcauuagcagcaccaguaacuggacaaacaaauauuauagauccauggaucagagcuaacuuuguucaagccccaaauggagaauucacaguuucuccaagaaacgcaccaggagaaguuuuacuaucauuagagcuaggaccagaauuaaauccauaucuagcccaucuagcaagaauguacaacggauaugcaggcggcauggaaguccaagucaugcuugcaggaaaugcuuuuacagccggaaaauuaguuuuugcugcaguaccaccucacuuuccaguagaaaaucuuucaccacaacaaauuacaauguucccacacguaauaaucgauguucguacguuagaaccaguccuauuaccacuacccgaugucagaaauaauuucuuucacuauaaucaaaaagaugacccaaaaaugagaauaguagccaugcuauacacacccuuaagaucaaacggaucgggagacgauguauuuaccguuuccuguagaguacuaacaagaccuucaccugauuucgacuuuacauauuuaguuccacccacaguagaaucaaaaaccaaaccauucacuuuaccaauauuaacuuuaggagaauuaucaaauucacgauuuccaguuucuauagaccaaauguauacaucacccaaugaaguuauaagcguccaaugucaaaauggaagauguacacuagauggcgaauuacaagguucaacucaacuucaaguuucagguauaugugcauuuaaaggugaagucacagcacaccuacacgauaacgaccauuuauauaacgucacuauaacaaacuuaaaugguaguccauucgacccaucagaagacauaccagcaccacuuggcgucccugacuuucaaggcagaguauucggcgucaucagucaaagagauaaacauaauuccccaggacauaaugaaccagcaaauagaggacacgaugccguuguuccaacuuauaccucucaauauaccccaaaacuaggccagauccaaauaggaaccuggcaaacagacgaucuaacaguaaaucaaccagccaaauuuacaccagucggauuaaacgauacagaacauuuuaaccaauggguuguuccaagauacgcuggagcauuaaacuuaaacacuaaucuagcaccaucaguagcaccaguauuuccuggugaaagauuacuauuuuuccgaucauacauucccuuaaaaggaggauacggaaauccagcaauagauugccuauuaccacaagaauggguccaacauuuuuaucaagaagcagcaccaucaaugagcgaaguagcacuaguacgauauauaaacccagacacaggaagagcacucuucgaagcaaaacuacauagagcaggauucaugacaguaucauccaauacaucagcaccagugguaguaccagcaaauggauauuucagauuugacucauggguaaaucaauuuuauucauuagccccaaugggaaccggaaauggaagaagaagaguucaauaa

SEQ ID NO: 32755 - RNA, 1623 nt, Artificial Sequence
  derived and/or modified sequence opt6 from capsid_protein__Norovirus__BAG55289
augaaaauggcaucaucagacgcaaacccuuccgauggcucaacagccaaccuaguaccagaaguaaauaaugaaguaauggcacuugaaccaguagucggcgcagccauagcugcuccaguugcuggacaacaaaacguaauagauccuuggauaagaaauaacuuuguacaagcaccaggaggagaauuuacuguuucaccacguaaugcaccaggagaaauacuuugguccgcuccucuaggacccgaccuaaauccuuauuuaucccaucuagcaagaauguauaacgguuaugcaggaggauucgaaguacaaguaauacuagcagguaacgcauuuacugccgguaaaauaauauuugcagcagucccaccuaacuuuccaacagaaggacuauccccaucccaaguaacaauguuuccucauauaauaguagaugucagacaacuagaaccaguacucauaccacuaccagauguaagaaauaacuuuuaccacuauaaucaaucuaaugaucccacaauaaaacuaauagccaugcuauauacuccauuaagagcaaacaaugcaggagacgaugucuuuacaguaucaugucguguauuaacacgaccuucaccagauuuugacuuuauuuuucuaguaccaccaacuguagaaucuagaacaaaaccuuucucaguaccuauauuaacaguugaagaaaugacaaauucaagauuuccaauaccauuagaaaaacuauuuacaggaccaagcucagcauucguuguacaaccucaaaauggucguugcacaacagacgguguauuacuaggaacaacacaacugucuccuguuaauauauguacauuucguggagacguuacucauauaacaggaucaagaaauuacacaaugaaccucgccacucaaaacuggaacucauacgauccaacagaagaaaucccugcuccacuaggcaccccagacuuuguagguaaaauacagggaguauuaacacaaacaacacgugcagauggaaguacaagaggacacaaagcaaccguauauacaggaucugcugauuuugcaccaaaacucggcagaguacaauucgccacagauacagauaaugacuuugaugcaaaccaaaacacaaaauucacgcccguaggaguaauacaagacggagacacagcucaucgaaaugaaccacaacaauggguccuaccuucauacaguggacgaaauaaucauaacguucaccuagcacccgcaguugcaccaacauuuccaggugaacaauuacuauucuucagaucuaccaugccaggauguucugguuauccaaauauggauuuagauugcuuauuaccacaagaauggguacaauacuuuuaccaagaagcagcaccagcacaaucagaugucgcuuuacuaagguuuguaaacccagacacugguagaguauuauuugaauguaaacuacacaaaucaggauaugucacuguagcacacacaggacaacaugauuuagucauaccaccaaauggauauuucagauucgauucaugggucaaucaauuuuauacauuagcuccaaugggaaauggaacaggaagaagacgcgcauuauaa

SEQ ID NO: 32756 - RNA, 1629 nt, Artificial Sequence
  derived and/or modified sequence opt6 from capsid_protein__Norovirus__BAG68707
augaaaauggccucaaacgaugcugcaccuucaacagacggagccgcaggacuaguuccagaauccaacaaugaaguaauggccuuagaaccaguagcuggugcggcacuagcugcaccggucacaggacaaacaaauauaaucgacccauggauaagagcaaauuuuguacaagcaccaaauggagaauuuacagucucaccacgaaacgcaccaggcgaaguuuuauuaaaucuagaacuaggaccagaacuaaacccuuaccuagcacacuuagccagaauguacaacggauacgcaggagguauggaaguacaaguaaugcuugcagguaaugcauucaccgcaggcaaauuaguuuucgcagcaguaccaccacauuucccuguagaaaaucuaucaccacaacaaaucacaauguucccacauguaaucauagacguacgaacacuagaaccuguacuccuaccacucccagacgucagaaacaauuuuuuucauuacaaucaaaaagacgauccaaaaaugcgaauaguagcaaugcucuacacaccacuucgaucaaacgguucaggagaugauguuuucacaguaucaugccguguauuaacacgacccucaccagauuucgauuuuacauauuuagucccaccaacaguagaaucaaaaacaaaaccauucacacucccuaucuuaacauugggagaacuaucaaauucaagauucccaguaucaauagaucaaauguacacaucaccaaacgaaguuauaucaguacaaugucaaaaugggagauguacauuagacggugaacuacaaggaacaacacaauuacaaguauccggaauaugugcauuuaaaggagaaguaacugcacaucuucaugacaacgaucaccuauauaauauaacaauaacaaauuuaaacggcucuccauuugauccaucagaagauaucccugcaccucucggcguaccagacuuucaaggcagaguuuucggaauaauaucacaacgagauaaacaaaaugcuacaggacauaaugaaccugccaaucguggacaugauguaguggucccaacuuauacugcacaauauacaccaaaacuaggacaaauacaaauaggaacuuggcaaacugacgauuuaaccguaaaucaaccagcaaaauucaccccaguaggauuaaaugacacagaacacuucaaucaauggguaguaccaagauaugcaggcgcauuaaacuuaaauacaaacuuagcuccaucugucgcaccuguauucccaggugaaagacuacuuuucuuuagaucuuauauuccauuaaaaggcggauacggaaauccagcaauugauugcuuacucccacaagaauggguacaacacuucuaucaagaagcagcucccucaauguccgaaguagcauuaguacgauacauaaauccagacacaggaagagcucuuuucgaagccaaacuacauagagcaggauuuaugacaguaucaucaaacacaucugcuccaguaguuguaccagcaaacggauacuuuagauuugauaguuggguaaaccaauuuuacucacuagccccaauggggacaggaaacggacgaagaagaguucaauaa

SEQ ID NO: 32757 - RNA, 1629 nt, Artificial Sequence
  derived and/or modified sequence opt6 from capsid_protein__Norovirus__BAG68708
augaaaauggcaucaaaugaugcagcaccaucaacagacggagccgcuggauuaguaccagaauccaauaaugagguaauggcccuugaaccagucgcaggagcagcacuagccgcucccguaacuggacaaaccaacauaauagauccauggauuagagcaaacuuuguacaagcacccaacggagaauucacaguaucaccucgaaaugcaccaggugaaguauuauuaaaucuagaauugggccccgaacuaaacccuuauuuagcucauuuagcaagaauguauaacgguuaugcaggagguauggaaguccaaguaaugcuugcaggaaaugcauucacagcuggaaaacuaguauucgccgcaguacccccacacuuuccaguagaaaaucuaucaccucaacaaauuacuauguuuccacauguuauaauagauguaagaacauuagaaccaguacuauuaccacuaccagacguaagaaauaacuucuuucauuacaaccaaaaagacgauucuaaaaugagaauaguagcaauguuauauacaccauuacguuccaauggcaguggugaugauguauucacaguaaguuguagaguacucacaagacccucaccugauuuugauuuuacauaucucguaccaccaacaguagaaucaaaaacuaaaccauuuacauuaccuauauuaacauuaggagaacuaucaaacucaagauuucccguaucaauugaccaaauguauacaucuccaaacgaaguuauaucaguacaaugucaaaauggcagaugcacguuagacggagaacuccaaggaacaacacaacuacaaguuucagguauaugugcauucaaaggggaaguuacagcucaccuacaugauaacgaucaucuguauaauauaacuauuacaaaccuaaauggaagcccauucgacccaucagaagauauaccagccccucuaggaguuccagacuuucaaggaagaguuuucggaauaauaucccaacgagacaaacaaaacgcaacuggccauucagaaccagcaaauagaggucacgaugcuguaguaccaacauauaccgcacaauauacaccaaaauuaggucaaauacaaauaggaaccuggcaaacagacgaucuaacaguaaaucaaccaguaaaauucacgccaguaggcuuaaaugacacagaacauuuuaaccaauggguaguaccaagauaugcaggcgcacucaaucuaaauaccaacuuagcaccaucaguugcccccgucuucccaggcgaaagauuacuauucuuuagaucauacaucccauuaaaaggagguuauggaaauccagcuaucgauugcuuauuaccucaagaauggguacaacauuuuuaucaagaagcagcaccaucaauguccgaagucgcuuuagucagauauaucaauccagacacaggaagagcauuauucgaagcaaaacuucacagagcaggcuuuaugacaguaucauccaauacaucagcuccaguuguagccccugcaaacggauacuuuagauuugauuccuggguaaaucaauuuuauucuuuagccccaaugggaacaggaaauggacgacgaagaguacaauaa

SEQ ID NO: 32758 - RNA, 1629 nt, Artificial Sequence
  derived and/or modified sequence opt6 from capsid_protein__Norovirus__BAG68709
augaaaauggcauccaacgacgcagccccuaguacagacggagcagcaggccuaguaccugaaucuaacaaugaaguaauggcuuuagaaccaguagcaggagcagcacuagccgcaccaguaacaggacaaacaaacauaaucgacccauggaucagagcaaacuuuguacaagcaccaaacggugaauucacaguaucaccaagaaacgcaccaggagaaguauuauuaaauuuagaauuaggaccagaacucaacccauaccuagcacacuuagcaagaauguacaacggauaugcaggcggaauggaaguacaaguuauguuagccggaaacgcauucacagcaggaaaauuagucuucgcagcaguaccaccucacuucccuguagaaaaucuuagcccacaacaaauuaccauguuuccucacguaaucauagacguaagaacuuuagaaccaguacucuuacccuuaccagauguacgaaacaacuuuuuucacuauaaccaaaaagacgauccaaaaaugcgcauaguagcaauguuauauacaccccuaagaucaaacgguucuggagaugacguauucaccguaucauguagaguauuaacuagaccaucuccagauuuugauuuuaccuaucucguuccaccaacagucgaauccaaaacaaaaccauucaccuuaccaauacuaacacucggcgaacuaucaaauucaagauucccaguauccauagaccaaauguauacaucacccaaugaaguaaucucaguacaaugucaaaacggaagauguacccuagacggagaacuacaaggaacaacccaacuacaaguuucaggaauaugcgcauucaaaggagaagucacagcucauuuacaugauaacgaccacuuauauaauauaacuauaaccaaucucaauggaucuccauucgacccaucagaagauauaccagcaccucuaggagucccugauuuucaaggaagaguauucggaauuauaucacaacgcgauaaacaaaacgcaacaggacacaacgaaccagccaacagaggacaugacgcagucguaccuacauauacagcccaauauacaccaaaauuaggacaaauacaaauaggcacauggcaaacugaugaccuaacuguaaaucaaccuguaaaauucacacccguaggacuuaacgauacagaacacuucaaucaauggguaguucccagauacgcaggcgcauuaaaucuuaacacaaauuuagcacccucuguagcaccaguauucccaggagaacgacuauuauucuuuaggucauauauaccacucaaaggaggauacggaaaucccgcaauagauugcuuacuaccacaagaauggguucaacacuucuaccaagaagcagcaccaaguaugucagaaguagccuuagucagauacauaaacccagacacaggaagagcuuuauuugaagcaaaacuacaccgcgccggauucaugacuguaucaucuaacacaucagcuccagucguaguaccagcuaacggauauuuucgauucgauucaugggucaaucaauucuacucauuagcaccaaugggaacaggaaacggaagaagaagaguacaauaa

SEQ ID NO: 32759 - RNA, 1629 nt, Artificial Sequence
  derived and/or modified sequence opt6 from capsid_protein__Norovirus__BAG68711
augaaaauggcaucaaaugaugcagcaccaucaaccgacggagcagcaggcuuagucccagaaaguaauaaugaagucauggcacuagaaccuguugccggugccgcauuagcugcaccaguaacaggacaaacaaauaucauagauccauggauaagagcaaacuuuguccaagcacccaauggagaauuuacgguaucuccuagaaaugccccaggagaaguauuauuaaaccuagaauuaggaccagaacuaaacccauaucuagcacauuuagccagaauguauaauggauaugcuggagguauggaaguccaagucaugcucgcagguaaugcuuucaccgcuggaaaauugguauucgcagcaguaccaccccacuuuccugucgaaaaccuaucaccccaacaaauaacuauguucccacacguaauaauagacguaagaacacuagaaccaguacuacuaccuuuaccagauguucguaauaauuucuuucauuauaaccaaaaagacgaucccaaaaugagaauagucgcaaugcuauacacaccacuaagaucaaacggaagcggagaugauguauuuacaguauccuguagaguuuuaacuagaccaagcccugauuucgacuucacauaccuaguccccccuacaguagaauccaaaacuaaacccuuuacacuacccauacuaacccuaggagaacucucuaacucaagauucccaguaucaauagaucaaauguauacauccccaaaugaaguaaucuccguacaaugucaaaauggucgauguacacuagacggagaauuacaaggaacuacacaauuacaaguuucaggaauaugcgcauuuaaaggugaaguaaccgcucaucuacaugacaaugaucacuuauauaacgucacuauaacuaaccuaaaugguucuccauucgacccaucagaagauauaccagcaccauuaggaguaccagauuuucaaggacgaguauuugguguaauuucacaaagagauaaacauaucgcaaguggacauaaugaaccagccaauagaggucacgacgcaguaguuccaacauacaccgcacaauauacuccuaaauuaggccaaauacaaauaggcacuuggcaaaccgacgaccucacaguaaaucaaccaguaaaauucacacccguaggauuaaaugauacagaucacuuuaaccaauggguaguaccuagauaugcaggagcacuaaaccuaaauacaaacuuagcaccguccguagcaccuguauucccaggugaaagacuacuuuuuuuuagaucauauauuccauuaaagggugguuauggaaauccagcaauagauuguuuacuaccccaagaauggguccaacauuucuaucaagaaucagcacccucuauguccgaagucgcuuuaguaagguacauaaacccagacacaggaagagcacuuuucgaagcaaaacuacauagagcuggauuuaugacuguaucaucaaauaccucagcuccaguaguagucccugccaauggauauuuccgauuugauucauggguuaaucaauuuuacucacuagcuccaaugggaacaggaaauggacgacgacgaacacaauaa

SEQ ID NO: 32760 - RNA, 1629 nt, Artificial Sequence
  derived and/or modified sequence opt6 from capsid_protein__Norovirus__BAG68712
augaaaauggcaaguaacgacgcugcaccaucuacagacggugcagccggacuaguaccagaaucaaauaacgaaguaauggcauuagaaccaguagcaggugcagcucuagccgcuccuguaacaggccaaacaaauauuauagacccauggaucagagccaacuuuguccaagcuccuaacggagaauuuacaguuaguccuagaaaugcuccaggagaaguauuacuaaauuuagaacuuggacccgaacuaaauccauaucuugcccauuuagcaagaauguauaacggauacgcuggaggaauggaaguacaaguaaugcuagcaggaaaugcauuuacagcaggaaaauuaguauuugcugcuguuccaccucacuuuccaguagaaaacuuaucuccucaacaaauuacaauguucccacauguaauuauagacguacgaacacuagaaccaguauuacuaccacuuccagauguuagaaauaauuucuuccacuauaaucaaaaagaugacccaaaaaugagaauuguagcaaugcuauacacaccacuuagaucuaauggaucaggggaugauguauuuacaguuucauguagaguauuaacaagacccucacccgauuuugauuuuacauaucuaguaccucccacaguagaaucaaaaacuaaaccauuuacacucccaauacuaacacuaggagaauuaucaaauucaagauucccuguaucaaucgaccaaauguauacaucucccaacgaaguaauaucagugcaaugccaaaacggucgaugcaccuuagauggugaacuacaaggaacaacacaacuccaaguuuccggaauuugugcauuuaaaggcgaaguaacugcccaucuucacgauaaugaccacuuauacaaugucaccauaacaaauuuaaauggaagcccauuugauccaucagaagacaucccagccccacuaggaguaccagauuuucaaggucgugucuucggugucauuucccaacgcgauaaacauaacgcaucuggucauaaugaaccugcaaauagaggccacgaugcaguaguaccuacuuacacagcccaauauacaccaaaacuaggccaaauccaaauaggaacauggcaaaccgaugaucuaacuguaaaucaaccagucaaauucacaccaguuggauuaaacgauacagaacauuuuaaccaauggguuguuccacgauaugccggagcauuaaaccuaaacacaaacuuagcaccaucaguugcuccaguguucccaggcgaaagauuacuauucuucagaucauauauaccauuaaaaggaggauauggaaauccagcuauagacugccucuuaccccaagaauggguacaacauuucuaucaagaagcagcaccaagcaugucggaaguagccuuaguacgauacauuaauccagauacagguagagcccuuuucgaagcaaaacuacacagagcuggauuuaugacaguaucaucaaauacuucugcaccaguaguaguaccugcaaauggcuacuuccgauuugauucauggguaaaucaauucuacucauuagcaccaauggguacaggaaacggaaggagaagaguacaauaa

SEQ ID NO: 32761 - RNA, 1629 nt, Artificial Sequence
  derived and/or modified sequence opt6 from capsid_protein__Norovirus__BAG68713
augaaaauggccucaaaugacgcugcacccucuaccgacggagcagcaggacuagucccugaaucaaacaaugaaguaauggcguuagaaccaguagcaggagcagcacuagcagcaccaguaacuggccaaacaaauauuauagaccccuggaucagagcaaauuuuguacaagcaccuaauggcgaauuuacaguuuccccaagaaaugcaccaggcgaaguauuacuaaaucuagaauuaggaccagaacuaaacccauauuuagcucauuuagcaagaauguacaauggauacgcuggaggaauggaaguacaaguaaugcuagcaggaaaugcauuuacagcaggcaaauuaguuuucgcagcaguuccaccucacuucccaguagaaaacuuaucuccacaacaaauuacaauguuuccacauguaauaauagauguaagaacccucgaaccaguauuacuaccauuaccagacguacgcaauaauuuuuuccauuauaaucaaaaagacgacccaaaaaugcgaauaguagcaauguuauauaccccacuccgaucaaauggaucuggagaugacguauucacagucucuugcagaguucuaacaagaccuaguccagacuuugauuuuacauauuuaguaccacccacagucgaaucaaaaaccaaaccauucacauuaccaauucuaacauuaggugaacuaagcaacagcagauuuccaguauccauugaccaaauguauacuucuccaaaugaaguaaucucuguacaaugucaaaacgguagaugcacccuugacggagaauuacagggaacaacccaacuucaagucucagguauaugugccuuuaaaggagaagucaccgcccauuuacacgauaacgaucaccuauacaaugucacaauaaccaaucuaaacggcucaccauuugacccuucagaggauauaccagcaccacuaggaguaccugacuuucaagguagaguauuuggagucauuucucaaagggauaaacacaaugcaucaggccacaaugaaccagcaaaucguggacaugaugcuguuguaccaacauacacggcucaauauacaccaaaauuaggacaaauacaaauaggaacauggcaaaccgacgauuuaacaguaaaccaaccuguaaaauuuacuccuguaggacuuaacgauacugaacauuuuaaccaauggguaguaccaagauaugccggagcauuaaaccuaaauacaaaucucgcaccuaguguagcaccaguauucccuggugaaagacucuuauuuuuucguucauauauaccauuaaaaggaggauaugguaauccagcaauugauuguuuacuuccccaagaauggguacaacacuuuuaucaagaagcagcuccaucaaugucagaaguagcauuaguucguuauaucaacccugauacaggaagagcccuauucgaggcaaaacuacacagagcaggauucaugacaguuucuucaaauacuagcgcaccaguaguagugccugcaaauggauacuucagauuugauuccuggguaaaucaauuuuauucuuuagcaccaaugggaacaggaaauggaagaagaagaguucaauaa

SEQ ID NO: 32762 - RNA, 1629 nt, Artificial Sequence
  derived and/or modified sequence opt6 from capsid_protein__Norovirus__BAG68714
augaaaauggccucuaaugaugcugcaccuucuacagauggcgcugcaggauuagucccagaaucaagcaacgaaguaauggcacuugaaccaguagcaggugcagcacuagcagcaccaguaacaggacaaacaaauauuauagauccauggauaagagccaauuuuguucaagcacccaauggagaauuuacaguuucaccaagaaaugcacccggugaagugcuauuaaaucuagaauuaggaccagaauuaaacccuuaccuagcacauuuagcaagaauguacaauggauaugcuggagguauggaaguacaaguaauguuagcaggaaacgcauuuacugcaggaaaauuaguauucgccgccguaccuccccauuuuccaguagaaaauuuauccccacaacaaauaacaauguuuccacauguaauaauagacgucagaaccuuagaaccuguucuauuaccauuaccagacguaagaaauaacuuuuuccauuacaaucaaaaagacgauccaaaaaugagaauagucgcaauguuauacacaccauuaagaucuaauggcuccggugacgaugucuuuacagucucauguagaguuuuaacuagaccuaguccagauuuugacuuuacauaucuaguuccaccaacagucgaaucaaaaaccaaacccuuuacacuaccaauacuuacuuuaggcgaacuuaguaauucaagguuuccuguaucaauagaucaaauguauacaucaccuaaugaaguaauuucaguacaaugucaaaacgguaggugcacacuugacggagaauuacaaggaacaacccaauuacaaguaucaggaaucugcgcauuuaaaggagaaguaacagcccaucuucaugauaaugaccaucuauauaauguaacuauaacuaaucuaaacggaucaccauucgacccuucagaagacauaccagccccacuaggaguaccagauuuucaaggcagaguauucggaguaauuagucaacgcgauaaacauaacgcaucaggucacaaugaaccagcaaaucggggacaugaugcaguaguacccacauacacugcacaauacaccccuaaacuaggacaaguccaaauaggaacauggcaaacagaugauuuaacuguaaaccaaccaguaaaauucacuccaguaggauuaaacgacacugaacauuuuaaccaauggguaguuccaagauaugcaggagcacucaauuuaaauacaaaccuagcacccucuguagcacccguauuuccuggugaacgacuauuauuuuuuagaucauacauuccauuaaaaggugguuauggaaauccagcaauagauuguuuauuaccucaagaauggguacaacauuucuaucaagaagcugcaccuucaaugucugaaguagcauuaguaagauacauaaauccugauaccggcagagcucuauuugaagcaaaacuacacagagcaggauuuaugaccguauccagcaauacaucugcaccagucguaguuccugcaaacggauacuuucgcuuugacucauggguaaaucaauucuacucuuuagcaccaaugggaacaggaaacggcagaagaagaguucaauaa

SEQ ID NO: 32763 - RNA, 1629 nt, Artificial Sequence
  derived and/or modified sequence opt6 from capsid_protein__Norovirus__BAG68715
augaaaauggcuucaaaugaugcagccccaagcaccgacggagcugcaggauugguuccagaaucuaacaaugaaguaauggcauuagaaccaguagcaggagcagcacuagcagcaccaguaacaggacaaacaaauauaauagacccuuggauacgagcaaauuuuguacaagcuccaaauggagaauucacgguaucacccagaaaugcacccggagaaguacuauuaaacuuagaauuagguccagaacuaaacccauauuuagcacauuuagcacgaauguacaacggauaugcaggaggaauggaaguacaaguaauguuagcaggcaaugcauuuacagcuggaaaacuuguauuugccgcaguuccaccucacuuuccaguagaaaaccucucaccacaacaaauuacaauguucccacauguaauaauagauguaagaacauuagaacccguccuauuaccauuaccagauguacgaaauaauuuuuuccauuauaaucaaaaagacgauccaaagaugcgaauuguagcaauguuauacacaccauuaagaucaaacgguaguggagacgacgucuuuacaguaucaugcagaguauuaacuagaccaucaccugauuucgauuucacauauuuaguaccaccaaccguagaaucuaagacaaagccauuuacuuuacccauuuuaacacucggagaauuaucuaauucuagguuuccaguuuccauugaucaaauguacaccaguccaaacgaaguaauaaguguccaaugccaaaacgguagauguacauuagauggugaacuccaaggcacuacucaauuacaaguauccggaaucugugcauucaaaggagaaguaacagcacaucuacaugauaacgaccacuuauauaacguaacuauuacaaacuuaaauggaucaccuuucgauccaucagaagauauaccagcaccuuuaggaguaccugacuuucaaggaagaguuuucggaguaaucucacaaagagauaaacauaauucaccuggacauaaugaaccagcaaauagaggucaugacgcaguaguuccgacauacacagcacaauauacaccaaaacuaggccaaauacaaauuggaacauggcaaacugacgaucuaacuguaaaccaaccgguaaaauuuacaccaguaggcuugaacgacacagaacauuuuaaccaauggguagucccaagauaugcuggagccuuaaacuuaaauacaaaccuagcaccaucaguagcaccaguauuuccaggcgaaagauuacuauuuuuucgaaguuacauuccauuaaaaggaggcuauggaaaucccgcuauagacuguuuauuaccacaagaauggguucaacauuucuaucaagaagcagcaccauccaugagcgaaguagcauuaguacgcuacauuaacccggacacaggacgugcauuauucgaagcaaaacuccauagagcaggauuuaugacaguaucauccaauacaucagcaccaguaguaguaccugcaaauggauauuucagauuugauucauggguuaaucaauucuauucacuagcaccuaugggaacgggaaauggucgcagaagaguacaauaa

SEQ ID NO: 32764 - RNA, 1629 nt, Artificial Sequence
  derived and/or modified sequence opt6 from capsid_protein__Norovirus__BAG68716
augaaaauggcauccaacgaugcagcuccuucaacagacggugcugcaggacucgucccagaaucaaauaaugaaguaauggcauuagaaccaguagcaggugcagcacuagcagcaccaguaacaggccaaacaaacauaauagacccauggauaagagcuaacuuuguacaagcaccaaauggagaauuuacaguaucaccaagaaacgcaccaggagaaguacuauuaaaucuagaacuaggaccagaacuaaauccauaucuagcacaccuagcaagaauguauaacggcuaugccggaggcauggaaguacaaguaauguuagcagggaaugcauuuacagcagguaaacuagucuucgcugcaguaccuccacauuuucccgucgaaaacuuaucaccccaacaaauaacaauguucccucauguaauuauugauguaagaacauuagaaccaguucuacucccauuaccugauguaagaaauaauuucuuccacuauaaucaaaaagaugauccaaaaaugagaauagucgcaauguuauauacaccauuacguucaaacggauccggugacgacguauuuaccguaucauguagaguuuuaacucgcccuaguccagacuucgacuucacuuauuuaguaccaccaacaguagaauccaaaacaaaacccuucacacuacccauauuaacauuaggcgaauuaucaaacucccgauuuccuguuagcauagaucaaauguacacaucaccaaaugaaguuauaucuguacaaugucaaaacggucgaugcacauuagauggagaacuacaaggaacuacucaauuacaagucucaggcauaugugcauuuaaaggugaagucacugcccacuuacaugacaacgaucauuuauacaacguaacaauuaccaaucuaaauggcucgccauucgauccaagcgaagacauaccagccccacucggaguaccagauuuucaaggaagagucuucggcauaauaucccaaagagauaaacauaacuccccaggacacaaugaacccgccaauagaggccacgacgcugucguaccuacuuauacagcacaauacacaccaaaacuaggacaaauacaaauaggaacauggcagacagaugaucuaacaguaaaccaaccaguuaaauucacuccagucggauuaaacgacacugaacacuucaaccaauggguuguaccaagauaugcaggcgcauuaaaccuaaacacgaaucuugcaccaucaguagcgccuguuuuuccaggugaaagacuuuuauuuuucaggucauauauacccuuaaaagguggauauggaaauccagcaauagauuguuuacuaccacaagaauggguacaacacuuuuaucaagaagcagcaccaucaaugucugaaguagcauuaguacgauacaucaauccagauacaggccgugcacuauuugaagcaaaacuacacagagccggauucaugacaguaucauccaacacuucagcaccaguuguugucccugcaaacggauacuucagguucgacuccuggguuaaucaauucuauagcuuagcaccaaugggaaccggaaacggaagaagaagaguacaauaa

SEQ ID NO: 32765 - RNA, 1647 nt, Artificial Sequence
  derived and/or modified sequence opt6 from capsid_protein__Norovirus__BAG68799
augaaaauggccucaaaugaugcugcaccaucuaaugacggugcagcaggacuaguuccagaaauuaacaacgaagcuauggcauuagaaccaguagcaggagcagcuauagccgcaccacuuacuggacaacaaaauauaauagacccauggauaaugaacaauuuuguacaagcaccaggaggcgaauuuacaguaucaccaagaaacuccccaggggaaguauuacuaaacuuagaauuaggaccugaaauaaaucccuauuuagcacacuuagcucgaauguauaacggauaugcaggaggcuucgaaguccagguugucuuagcagggaacgcuuuuacagcaggaaaaauaaucuucgccgcuauaccaccaaauuuuccuauugauaaccuuucagcagcucaaaucacaaugugcccacauguaauaguagauguacgccaauuagaaccaguaaauuuaccaaugcccgacguaagaaacaauuucuuccauuauaaucaaggcucagauucaagacuaagacuuauagcuauguuauauacacccuuacgugcaaauaacucaggugaugacguauucacaguaucaugcaggguauuaacaagaccaucaccugacuucaguuuuaauuuuuuaguacccccuacaguagaaucaaaaacaaaaccuuuuucucuaccaauauuaaccauaucagaaauguccaacagcagauuuccaguaccaauagauucuuuacacacauccccaacagaaaacauuguaguacaaugucaaaauggacgaguaacacucgacggugaacuaauggguacuacacaacucuuaccuucacaaauaugugcauucagaggaguuuuaacaagaucaacguccagagcaagugaccaagcagauacugcaacaccaagacuuuucaauuacuacuggcauauacaauuagauaacuuaaauggaacaccauaugauccagcagaagauaucccaggacccuuaggcacacccgauuuuagaggaaaaguauuuggaguagcaucucaaagaaaucccgaugcuacaacuagagcucaugaagcaaaaauugacaccgcaucaggacguuucacuccaaaauuagguucucucgaaauaucaacugaaucagaugauuucgaucaaaauaaaccaaccagauuuacaccagucgggaucgguguggaucacgaagaagauuuccaacaauggacuuuacccgauuaugcaggucaauuuacccacaacaugaauuuagcaccugcagucgccccuaacuuuccaggagaacaacucuuauucuucagaucacaacucccauccucagggggcagauccaauggaauacuagauugccuuguaccccaagaauggguacaacauuuuuaccaagaaucagccccaucucaaagccaaguugcacuuguccgcuauaucaauccagacacagguagaguacuauucgaagcuaaacuacauaaauuagguuuuaugacaauugcuaaaaauggagacucaccaauaacaguacccccaaaugguuauuuuagauuugaaucauggguaaauccauuuuauacauuagcacccauggguacaggaaacgguagaagaagaauucaauaa

SEQ ID NO: 32766 - RNA, 1647 nt, Artificial Sequence
  derived and/or modified sequence opt6 from capsid_protein__Norovirus__BAG68800
augaaaauggcuucuaacgaugccgcaccaaguaaugauggcgccgcaggcuuaguaccagaaauaaauaaugaagccauggcacuugaaccaguugcuggcgcugcaauagcagcuccauuaaccggacaacaaaauauaaucgacccauggauaaugaauaauuuuguacaagcaccaggaggugaauuuacaguaucuccacgaaauaguccaggagaaguacuucuaaaccuagaauuaggacccgaaauuaauccuuauuuagcccauuuagcacguauguauaacgguuaugcaggaggauuugaaguacaaguagucuuagcagguaaugcauuuacugcaggaaaaauuauuuuugcagcaauaccuccaaauuucccaauugauaaccuaucagcagcacaaauaacaaugugcccccauguuauaguagauguaagacaacuagaaccugucaaucuaccuaugccugauguaagaaacacauucuuccauuacaaucaagguucugauuccagacuacgacuaauagcaaugcucuauacaccacuacgagcaaacaacucaggcgaugauguuuucacuguaucuugccgaguacuaacacgaccaaguccagauuucucuuuuaacuuucugguaccaccuacaguagaaaguaaaacaaaaccuuuuagccuaccaauccuaacaauaucugaaaugucaaauagucgauucccaguacccauagacucuuuacacacaaguccuacugaaaauauagucguucaaugucaaaauggaagaguaacacuagauggugaacuaaugggaacaacacaauuauuaccaucacaaauuugcgcuuucagaggaguauuaacucguucuacuucaagagcaucagaccaagccgauacagcaaccccaagauuauucgacuacuauuggcauauacaacucgacaauuuaaauggaacaccauaugauccagcagaagauauuccaggcccacuagguacaccugauuuuagaggaaaaguauucggaguagcuucacaacgaaacccagacacaacaacacgugcucacgaagccaaaauagacacagcuucaggacgauuuacaccaaaauugggaucacuagaaauaucuacugaaucagaugauuuugaccaaaauaaaccaacaagauuuaccccaguaggaauaggugucgaucacgaagaagauuuucaacaauggacccuuccaaauuaugcaggccaauuuacccauaauaugaaucuagcaccugcaguagcaccaaauuuuccuggugaacaaguacuauucuuuagaucacaauuacccuccucaggagguagaucaaacgguauauuagauuguuuaguaccccaagaauggguacaacauuuuuaccaagaaucugcuccuucacaaucacaaguagcuuuagucagauaugucaaucccgauacugguagaguauuauucgaagccaaacuacauaaacucggauucaugaccauagcuagaaacggagacucaccuauaaccguacccccaaacggauauuucagauuugaauccuggguaaacccuuuuuauacauuagcaccaaugggaacagguaauggaagacgaagaauacaauaa

SEQ ID NO: 32767 - RNA, 1623 nt, Artificial Sequence
  derived and/or modified sequence opt6 from capsid_protein__Norovirus__BAG68801
augaaaauggcaaguaaugacgccacaccaucugacggaucaacagcaaaucucguuccagaagucaacaaugaagucauggcuuuagaacccguaguaggagcagccaucgcagcaccagucgccggacaacaaaacguaauagacccauggaucagaaauaauuuuguacaagcucccggaggagaauuuacaguauccccaagaaaugccccaggagaaauacuauggucagccccauuaggaccagaucucaaucccuaccuaucccaccuagcaagaauguauaaugguuaugcaggaggauucgaaguucaaguaauuuuagcaggaaaugcauuuacugcaggaaaaauaaucuucgcagcaguaccaccaaauuuuccaacggaaggacuaucaccaucacaaguuacaauguuuccccauauaaucguagauguuagacaacuagaacccguacuaauaccauuaccagauguuagaaacaacuucuaucauuauaaccaaucaaaugacccaacaauaaaacucauugcuaugcuauacacgccacuucgcgcuaacaaugcaggugaugauguuuuuacaguauccugcagaguucuaacaagaccaucaccagacuucgauuuuauuuucuuagucccaccaacaguagaaucacguacuaaaccauuuucuguacccauauuaacuguagaggaaaugacuaacucacgcuuuccaauuccacuagaaaagcuauucacaggaccaucaucagcuuucguuguacaaccacaaaacggaagauguacaaccgauggcguacuucuaggcacuacccaauuaucaccugucaauauauguacuuuuagaggagacgucacccauaucgcaggaacacaaaacuauacaaugaauuuagcuagucaaaacuggaauaauuaugacccuacugaagaaauaccagcaccacucggcaccccagacuucgucggaagaauacaagguguacuaacucaaaccacaagacgugauggaucaacaagaggacacaaagcaacagucucaacaggaucuguacacuuuacaccaaaauuaggaucaguccaauucucuaccgauacauccaacgauuuugaaacaggacaaaacacaagauuuacacccguuggcguuguacaagacggaucaacaacacaucaaaaugaaccacaacaauggguacuaccagacuauucaggaagagauucacauaacguacaccuagcaccugcaguugcuccaacauuuccuggagaacaacuccuuuucuuuagaucuacaaugcccgguugcucuggauaucccaauaugaaucuagauugcuuauuaccacaagaauggguacaacauuuuuaccaagaaucagcuccagcacaaucagacguugcccuacuaagauucguaaauccagauacaggcagaguucuauuugaaugcaaacuacacaaaucaggauauguaaccguagcacauacaggacaacacgacuuaguaauaccaccaaauggcuacuucagauuugacucauggguuaaucaauucuacacacuagcaccaaugggaaacggcgccggcagaagaagagcauuauaa

SEQ ID NO: 32768 - RNA, 1623 nt, Artificial Sequence
  derived and/or modified sequence opt6 from capsid_protein__Norovirus__BAG68802
augaaaauggcaucaaacgacgcuacaccauccgaugguucaacagcaaaccuaguuccagaaguaaacaaugaaguaauggcacucgaaccaguugcaggugcagcaauagcagcacccguagcaggacaacaaaaugucaucgauccuuggauacguaauaauuuuguacaagcaccaggaggugaauuuaccguaucaccccgaaaugcaccaggcgaaauacuauggucugcaccacuaggaccagauuuaaacccauaccuuucccacuuagccagaauguauaacgguuaugcaggagguuuugaaguccaagucauacucgcaggaaaugcauucacagcaggaaagauaauauuugcagcaguucccccaaacuuuccaacagaaggcuuaucacccucccaagucacuauguucccacacauaauuguagacguuagacaauuagaacccguacuaauaccacuaccagauguaagaaauaauuucuaucacuauaaccaaucaaaugauccuacuauaaaauuaauagccaugcuuuacacacccuuaagagcaaauaaugcuggugacgauguauuuacuguaucaugucguguauuaacaagaccaucuccagacuucgacuuuauauuccuaguucccccuacaguugaaucaagaacuaaaccauucucuguaccaauacuaacaguugaagaaaugacuaacucacguuucccaauaccacuugaaaaauuauuuaccgguccaaguagcgcauucguaguacaaccucaaaauggcagauguaccacugaugguguauuacucggaacuacacaacuaucaccaguaaacauauguacuuuuagaggugacguaacucauauugcuaauacacaaaauuacacaaugaaucuagcaucacaaaacuggaauaacuacgaucccacagaagaaauuccagcaccacuaggaacaccugacuucguuggacgaauccaagguguuuuaacucaaacaacucgaggagaugguucaacaagaggucauaaagccacaguauccacaggaaguguccauuuuaccccaaaauuaggaucaguacaauuuucuaccgauacaucaaacgaccuagaaacaggacaaaauacaagauuuacaccaguugguguaguccaagacggaggaacaacucauaggaaugaaccacaacaauggguauuaccugacuacucaggacgagauucacacaacgugcaccuagcaccagccguagcaccaaccuucccaggagaacaauuauuauucuuuagaaguacaaugcccggcuguucaggauauccaaauaugaacuuagauugccuucuaccacaagaauggguucaacacuucuaucaagaaucagcaccagcacaaucagacguugcucuuuuaagauucguuaauccagacacgggcagaguacuauuugaaugcaaauuacauaaauccgguuacguuacaguagcacauaccggccaacacgauuuaguaaucccaccaaacggauauuucagauucgacucuuggguaaaccaauucuacacucucgcuccaaugggaaauggcgcaggucgacgaagagcauuauaa

SEQ ID NO: 32769 - RNA, 1623 nt, Artificial Sequence
  derived and/or modified sequence opt6 from capsid_protein__Norovirus__BAG68803
augaaaauggcaucaaaugacgccaauccaucagauggauccgcagcuaaccuaguaccugagguaaacaaugaagucauggcucuagaaccagucgucggagcagcaauagccgccccaguagcaggccaacaaaauguaauugacccauggauaagaaauaacuucguccaagcaccaggcggagaauuuacgguauccccacgaaaugcccccggugaaauauuauggucagcuccacuaggcccagauuuaaauccauaucuaucucacuuagcacgaauguauaacggcuacgcaggaggauuugaaguccaaguaauacuugccggaaaugcauucacagcaggaaaaauaauauucgcagcaguaccaccaaacuuuccaacagaaggacuaucaccaucacaaguaacuauguuuccacauauuauaguugauguacgacaacuagaaccaguuuuaauaccauuaccagauguaagaaacaauuucuaucacuauaaucaaucaaaugauaguacuauaaaacucauagcaaugcuauauacucccuuaagagcaaacaaugcaggugaagacguauuuaccguuucaugcagaguacuaacaagacccucuccagacuuugacuucauuuuccuaguuccaccaacagucgaaucaagaacaaaaccauucacaguaccaaucuuaacaguugaagaaaugacaaauucaagauuucccauaccauuagaaaaauuauuuaccggaccaaguggcgcauuuguaguccaaccacaaaauggcagauguaccacugacggaguauuacuaggaacaacacaacuauccccgguaaauaucuguacauuuagaggagacguaacacauauugcaggcucucgaaauuauacuaugaaucuugcaucccuaaacuggaacaauuaugacccaacagaagaaauuccugcaccauuaggaacccccgacuucguagguaaaauacaaggaguauuaacacaaacuacaaaagaagacgguucuacuagaggucacaaagcaacugucuauacaggaucagcaccauuuacaccuaaacucggaucuguacaauuuucaacagacaccgaaaacgacuucgaaacacaccaaaauaccaaauucaccccaguaggaguaauacaagaugguaguaccacacaucguaaugaaccacaacaguggguacuaccaucauauucaggaagaaauguacacaacguacaucuagcaccagcgguagcacccacauuuccuggagaacaacuauuauuuuuuagaucaacuaugcccgguuguagugguuacccaaacauggaccuagauugucuuuuaccacaagaguggguacaacauuuuuaucaagaagcagcaccagcacaauccgacguagcccuauuacguuuuguuaauccagacacaggacguguauuauucgaauguaaauuacauaaaucaggauaugucacuguagcacacaccggucaacacgauuuaguaauacccccaaauggcuauuucagauucgauucauggguuaaucaauucuacacacuagcuccuaugggaaaugguacaggacgacguagagccuuauaa

SEQ ID NO: 32770 - RNA, 1623 nt, Artificial Sequence
  derived and/or modified sequence opt6 from capsid_protein__Norovirus__BAG68804
augaaaauggccucaaaugaugcaaacccaucagacggaucagcagccaaucuaguuccagaaguuaauaacgaaguaauggcccuagaaccuguaguuggagcagcaauagccgcacccguagcaggacaacaaaauguuauagacccauggaucagaaacaacuucguacaagcaccaggcggugaauuuacagucucaccaagaaaugcaccaggagaaaucuuauggagcgcacccuuaggaccagaucuaaauccauaucuaucacaucuagcacgaauguauaauggauaugcaggaggauucgaaguacaaguaauauuagcaggcaacgccuuuacagcaggaaaaauaauauuugcagccguuccacccaacuuuccaacugaaggccuaucuccgucccaaguaacaauguuuccacacauaauaguagacgucagacaacuagaaccaguuuuaauaccauuaccagauguaagaaauaauuucuaucacuacaaccaaucaaaugauucuacaauaaaauuaaucgcuauguuauacacaccucuaagagcaaauaacgcaggcgaagacguauuuacaguuaguugccgaguacuaaccagaccuucaccagacuuugauuucauauuuuuagucccacccacaguugaaaguagaacuaaaccuuuuaccguaccuauccuuaccguagaagaaaugacaaauaguagauucccuauuccacucgaaaaauuauuuacuggaccaucaggagcauucguaguacaaccucagaacggaagaugcacaacugauggugucuuacuaggaaccacccaacuuucaccgguaaauauauguacuuuuagaggagacguaacacacauagcagguucaagaaacuacacaaugaaucuagcaucuuuaaauuggaauaauuaugaccccacugaagaaauaccagcaccacuagguaccccugacuucguaggaaaaauucaaggaguacuaacacaaacaaccaaaggagauggauccacacgaggacacaaagcaacagucuauacgggaucagcuccauuuaccccaaaacuagguucuguacaauuuuccacagacacagaaaacgauuuugaaacccaucaaaauacaaaauuuacaccaguaggcguuauccaagacggauccacuacacauagaaaugaaccucaacaauggguacugccaucuuauucuggacgaaacguccauaauguacacuuagcucccgcaguugcaccaacauucccgggugaacaauuauuauuuuuuagaucaacaaugccaggauguucaggcuauccaaacauggaccuagauuguuuauuaccccaagaauggguacaacauuuuuaucaagaagcagcuccagcacaaucagauguagccuuauuaagauucguuaacccugacacaggucgaguccuauuugaauguaaauuacauaaaucaggauauguaacaguagcacacacaggucaacacgaucuaguaauuccaccaaauggcuauuucagauuugauucauggguaaaucaauuuuauacacuugcaccaaugggcaauggaaccggcaggcguagagcacuauag

SEQ ID NO: 32771 - RNA, 1623 nt, Artificial Sequence
  derived and/or modified sequence opt6 from capsid_protein__Norovirus__BAG68805
augaaaauggcuucaucagacgcaaaucccagugaugguucuaccgccaauuuaguaccagaaguaaauaaugaaguaauggcacuagaaccuguaguaggagcagcuauagcagcaccaguugcaggacaacaaaacgucauagauccauggauucguaacaacuucguacaagcuccugguggagaauucacaguaucaccaagaaaugcaccuggugaaauacuuuggucagcaccauuaggaccagaccuuaauccauaucuaagucaccuagcacguauguauaauucauacgcaggaggauucgaaguccaaguuauacuagcuggaaaugcauuuacugcaggaaaaauuguuuucgcagcggucccaccaaacuucccaacagaaggauuaucaccuucccaaguaaccauguucccacacauaauugucgauguaagacaacucgaaccggugcuuaucccacucccagaugucagaaauaauuucuaccacuacaaccaauccaacgauccuacaauaaaacuaauagcaaugcucuauacaccauuacgagcuaacaaugcaggagaugauguauuuacaguaucaugcagaguauuaacccgaccuucaccagauuuugacuuuauauuuuuaguccccccaacaguagaaucuagaacuaaaccauucucaguuccaauacuaacuguagaagaaaugacaaauucacgcuuccccauaccucuagaaagacucuuuacaggcccuuccucagcauuuguaguacaaccacaaaauggaagaugcacaacagaugguguacuauuagguacuacccaacuauccccuguaaauaucugcacauuucgaggagacguuacacauauagccggaacacaagaauauacaaugaacuuagcuucucaaaauuggaacaacuaugacccaacagaagaaguacccgcaccacuaggcacaccagauuucaugggaaaaauacaaggggucuuaacacaaaccacuagaagagacgguucaacaagaggccauaaagcuaccguuucaaccggcucaguccauuucacaccaaaacuagggcgaauacaauuuucgacagauaccucaaacgauuucgaaacaggacaaaauacaagauucacaccugucggaguaguccaagauggaagcacaacacaccaaaacgaaccacaacaauggguacuaccuaauuacuccggucgcgauucucauaacguccaccuagcuccugcaguagcacccuccuuucccggcgaacaauuauuauuuuucagaucaaccaugccaggaugcuccggauauccaaauaugaaucuagacugcuuacuuccacaagaauggguucaacacuuuuaccaagaagcugcaccagcccaaucggauguagccuuauuaagauucguaucaccagacacagguagaguauuauuugaauguaaauuacauaaauccggauacguaacuguagcacauacuggacaacaugauuuaguaauaccuccaaacggauacuuucguuucgauuccuggguaaaucaauuuuauacacuagcgcccauggguaacggaacuggacgucguagagcacuauga

SEQ ID NO: 32772 - RNA, 1623 nt, Artificial Sequence
  derived and/or modified sequence opt6 from capsid_protein__Norovirus__BAG68806
augaaaauggcauccuccgacgcaaauccaucagacggaucaacugcaaaucuaguaccagaaguaaacaaugaagucauggcacuugaaccuguuguaggagcagcaauagcagccccaguagcaggacaacagaauguuauagauccauggauccgaaauaacuucguacaagcaccaggaggagaauuuacuguauccccaagaaaugcaccaggcgaaauccuauggucagcuccacucggcccagaucuaaacccauaccucucccaccuagcacgcauguauaacgguuaugcaggagguuuugaaguacaaguaauacuggcaggaaaugcuuucaccgcuggaaaaauaguauucgcagcuguucccccaaauuuuccaacagaagguuuaucaccaucucaaguuacaauguucccucacauaauaguagauguaagacaauuagaaccuguauuaauaccauuaccagacguaagaaauaauuuuuaucacuacaaucaaucaaaugacucuacuauaaaauuaauagcaauguuauacacaccauuaagagcaaacaacgcaggagaugauguauuuacaguuuccuguagagucuuaacaagaccaucacccgauuucgacuucauuuucuuaguaccaccuaccguugaaucacgaacuaaaccauucucaguaccaauacuuacuguagaagaaaugacuaauucaagauucccaauaccacuagaaaaacuuuuuacaggacccucaucagcuuucauaguacaaccccaaaauggucgcuguacaacugacggaguauuacuaggcacaacacaacuaucaccuguuaacaucuguacauuuaggggagacguaacucauauagcaggaacacaagaauacacaaugaaucucgcaucucaaaacuggaauaacuacgaccccacugaagaaauaccagcuccucuagguacaccagacuucguagguaaaauucaaggaguccuaacacaaaccacaagaagagacgguucaaccagaggucacaaagcaaccguuucaacaggaucaguacauuuuacaccaaaauuaggacgaauacaauucaguacagauacauccaaugacuuugaaacuggacaaaacacaagauucacaccaguuggaguaguacaagacggaucuacuacacaucaaaaugaaccccaacaauggguacuaccaaacuaccuuggaagagauagccacaauguacacuuagcaccagcagucgcacccucauuucccggagaacaacuucuauucuuuagaucuacaaugcccggaugcagcggcuauccaaauaugaaccucgacugucuuuuaccucaagaauggguucaacauuuuuaucaagaagccgcuccagcucaaucagauguagcucuguuacgauucguaaacccugacacagguagaguacuauucgaaugcaaauuacauaaaucaggcuacguaacaguagcacacacuggacaacacgacuuagucauaccaccaaacggauacuuuagguuugauucauggguaaaccaauuuuacacacuagccccaaugggaaacggaacaggaagaagacgugcacuuuaa

SEQ ID NO: 32773 - RNA, 1647 nt, Artificial Sequence
  derived and/or modified sequence opt6 from capsid_protein__Norovirus__BAG68807
augaaaauggcaucaucugaugcuacaccuucaaacgauggagccgccggauuagucccugaaauaaacaaugaagcuauggcauuagauccaguugcaggugcagcaauagcagccccuuuaaccggacaacaaaacauaauagaccccuggauaaugaauaacuucguacaagcaccaggaggugaauuuacuguauccccacgaaauagcccaggagaaguccuacuaaaucuugaacuugguccagaaauaaauccauaucucgcacacuuagcaagaauguacaacggauacgcaggaggauucgaaguccaaguuguacuagcuggaaaugccuucacugcuggaaaaauaauauucgcagcaauuccaccaaacuucccaauugacaauuuaucugcugcacagaucacaaugugcccacauguaauuguugauguucgucaacuagaacccguaaacuuaccaaugccagacguuagaaauaauuuuuuucacuacaaucaaggaucugauucuagauuaagacucaucgcaauguuauacacuccacuacgagcaaauaauucuggagaugacguauuuacaguaucaugcagagugcuaacaagaccaagcccagauuuuucuuucaacuuccuagucccaccaacaguagaaucaaaaaccaaaccuuuuacuuuaccuauacucacaauuucagaaaugucaaacagcagauucccuguccccaucgacucccuacauacauccccaacagaaaacauuguaguacaaugucaaaauggacgaguaacauuagacggugaauuaauggguacaacacaauuacuaccaagccaaauaugugccuuuagaggaguauuaacaagauccacaucacgagccuccgaccaagcagacacagcaacaccacgacuuuuuaacuacuauuggcauauucaacuagacaaccuaaacgguacaccauaugacccagccgaagacauaccagguccauuaggaacuccagauuuuagagguaaaguuuuuggcgucgcaucacaaagaaauccugauucuacaacaagagcacacgaagcaaaaguagauacaacugcuggaagauucaccccaaaacuaggaucacuagaaauaucuacagaaagugaugauuucgaucagaaucaaccaacccguuucacaccaguaggaauagguguugaccaugaagcagauuuucaacaauggucacuaccugacuauucaggacaauuuacucauaacaugaacuuagccccugcagucgcgccuaacuuuccuggagaacaauuacuauucuuccguucucaacuuccaucuucaggaggcagauccaacgguauacuagauugccuuguaccacaagaauggguucaacauuucuaccaagaaucagcacccgcacaaacacaaguagcuuuaguaagauacguuaacccagacacuggaaggguauuauucgaagcaaaauuacacaaauuaggauuuaugacaaucgcaaaaaauggagauucaccuauaacaguaccaccaaauggauauuucagauucgaauccuggguaaauccauuuuacacauuagcuccuaugggcacaggaaauggacguagaagaauacaauaa

SEQ ID NO: 32774 - RNA, 1623 nt, Artificial Sequence
  derived and/or modified sequence opt6 from capsid_protein__Norovirus__BAG68808
augaaaauggcaucaaaugaugccaccccuucugacgguucaacagcgaaucuaguacccgaaguaaacaacgaaguuauggcccuagaacccguaguaggggcagccauagcagcaccaguagcaggccaacaaaauguaauagacccauggauacgaaacaauuucguacaagcaccuggcggagaauuuacaguaucuccaagaaacgcacccggagaaauauuauggagcgccccacuagggccagauuuaaauccauauuuaucacaccuugcuagaauguauaauggauacgccggcggauucgaaguccaagucauauuagcaggcaacgcguucaccgcaggaaaaauaauuuucgcagcaguacccccaaacuuucccacagaaggucuuucuccaucacaaguaacuauguucccacauauaauaguagacgucagacagcuagaaccaguacuuauaccauuaccagauguccgaaauaauuuuuaucacuauaaucaaucuaaugauccuacuauaaaacuaaucgcaauguuauacacaccccuaagagcaaacaaugcaggugacgacguauuuacagauuccugcagaguacuaacaagaccaucaccugacuuugauuucauauuucuaguaccucccacaguugaaucaagaacaaaaccuuuuucagugccuauacuuacaguagaagaaaugaccaauucacgauuuccaauaccauuagaaaaauuauucacaggacccagcuccgcauucguaguccaaccucaaaacggcagaugcacaacagacgguguauuacucgguacaacacaauuauccccugucaacaucugcaccuuuagaggagacguaacacauauagcaggaacacaaaauuauacaaugaauuuagcuucacaaaauuggaauaauuacgauccaacugaagaaauucccgcaccuuuaggaacacccgacuucguaggaaagauacaaggaguacuaacacaaaccacacgaagagacggaucaacaagaggacacaaagcuacuguaucaaccggcucaguacacuucacaccuaaauuaggaucaguacaauucucaacagacacuucuaaugauuuagaaacuggacaaaauaccagauucacaccaguuggaguaguacaagaugguucaacaacccaucaaaacgaaccacaacaauggguauuacccgacuacucaggucgagacagccauaauguacacuuagcaccagcaguagcacccacauucccaggugaacaacuccucuuuuuuagaucuacaaugcccggaugcucuggauauccaaauaugaaucuagacugccuucuuccacaagaauggguacaacacuuuuaucaagaaucagcaccagcacaaucggacguagcacuauuaagauucgucaacccagauacagguagagucuuauucgaaugcaaauuacacaaaucaggauauguaacaguagcacauacuggacaacaugauuuaguaauaccuccaaacggauauuuuagauuugauucaugggucaaucaauuuuauacauuagcaccaaugggaaacggagcaggaagaagaagagcauuauaa

SEQ ID NO: 32775 - RNA, 1623 nt, Artificial Sequence
  derived and/or modified sequence opt6 from capsid_protein__Norovirus__BAG68809
augaaaauggccagcaacgaugcaacuccaucagacggcucaaccgcaaacuuaguaccugaagucaauaaugaaguaauggcauuagaacccguugucggagcagcaauagcagcuccaguagcaggucaacaaaauguaauagauccauggauccguaacaacuuuguacaagcaccaggaggagaauucacaguuaguccaagaaaugcuccaggagaaauucucuggucugcaccucuaggaccagauuuaaaucccuauuuaucccaccuagcacgaauguauaauggauacgcaggagguuucgaaguacaaguaauccuagcaggcaaugcuuuuacagcugguaaaauaaucuucgccgcaguaccaccaaacuuccccacugaaggacucucuccgucucaaguuacaauguuuccucacauaauuguagauguuagacaacucgaaccagucuuaauucccuuacccgacguccgcaacaacuuuuaucauuauaaucaaucuaacgauccaacaauaaaacuaauagcuaugcucuauacaccauuaagagcaaacaaugcaggagacgacguauuuacagacucauguagaguauuaacaagaccaucaccagacuuugacuuuaucuucuuaguaccacccacagucgaaagucgaacaaaacccuuuuccguacccauauuaacaguagaagaaaugacuaacucacgauuuccuaucccacuagaaaaauuauucacugguccaucaucagcuuucguaguacaaccccaaaacggaagauguaccacagauggaguuuuacuuggaacaacucaauuaucuccaguaaauaucuguacauuuagaggcgacguuacccacaucgcuggaacacaaaauuauacaaugaauuuagcuagccaaaauuggaacaacuacgauccaacagaagaaauacccgcuccccuaggaacaccagauuucguaggaaaaauucaaggaguucuuacacaaacaaccagaggagacggaucaacacgcggucauaaagcaacaguuagcacaggaaguguucauuuuacaccaaaacuaggcucaguacaauuuucuacagauacaucaaaugaucuagaaacaggccaaaauacaagauuuacuccaguaggaguuguucaggacggaucuaccacccaccaaaaugaaccacaacaauggguacuaccaaacuauagugguagagauucacauaauguacaccuagccccugccgucgccccuacauucccaggagaacaacuauuauucuuuagaucuacaaugcccgguugcucuggcuaucccaacaugaaucuagauugcuuauuaccucaagaauggguacaacauuucuaucaagaaucagcuccagcacaaucagauguugcacuccuaagauuuguaaaucccgacacaggaagaguacuauucgaaugcaaacuccacaaaucugguuacguaacugucgcacacacaggucaacacgauuuagucauaccaccaaauggauauuucagauuugacucauggguaaaucaauuuuauacacuagcaccaaugggaaauggagcuggucgucgaagagcacuauaa

SEQ ID NO: 32776 - RNA, 1623 nt, Artificial Sequence
  derived and/or modified sequence opt6 from capsid_protein__Norovirus__BAG68810
augaaaauggccucaucagacgcaaauccuucagacggaaguacagcaaaccuaguuccagaaguuaacaaugaaguaauggcacuagaaccaguaguaggagcagcaauagcagccccagucgcaggacagcaaaaugucauugacccauggauacgaaauaacuuuguccaagccccaggaggagaauucacaguauccccaagaaaugcuccaggcgaaauuuuauggucugcuccuuuaggaccagaucucaacccuuaucuaucacauuuagcaagaauguauaauucauacgcugguggauuugaaguacaagucauauuagcaggaaaugcuuuuacagcagguaaaauaauauucgcagcaguaccacccaacuuuccaacugaaggauuaucaccaucacaagucaccauguucccccauauaauuguagacguaagacaauuagaacccguauuaauuccacuacccgacguacgaaacaacuucuaucauuauaaucaaucaaaugacccaacaaucaaacuaauagcuauguuauacacacccuuaagagcaaauaaugcaggagaugauguauuuacaguauccugcagaguacuaacucgaccaucuccagacuuugacuucauuuuucuaguuccuccaacaguagaaucuagaaccaaacccuuuucuguuccaauuuuaacaguagaagaaaugacaaauucucgauuccccauaccucuagaaaaacuauuuacagguccuucaucagcauucguaguacaaccacaaaacggcagaugcaccacagauggaguacuauuaggaaccacucaauuaucacccguuaauauuuguacuuucagaggagauguaacccauaucgcaggaacucaagaauacacuaugaaccuugccucccaaaauuggaauaauuacgauccaacagaagaaauacccgcuccacucggaacaccagacuuuguaggaaaaauucaaggaguucuaacacaaacaacaagaagagauggcucaacaagaggacacaaagcuacuguaucaaccggauccguacacuucacaccuaaacuaggaagaauacaauuuucaacugauacaucaaaugauuuugaaacaggccaaaauacacgauuuacgccaguaggaguaguacaagaugguaguacaacacaucaaaaugaaccacaacaauggguucuaccaaacuauucaggaagggacggucauaauguacauuuagcaccagcaguagcaccaaguuuuccaggcgaacaacuauuauucuuuagaucaacuaugcccgguuguucaggauauccaaacaugaaucuagacugucuacuuccacaagaauggguacaacauuuuuaucaagaagccgcucccgcacaaucagacguugcauuacuaagauucguaaauccagauacaggcagaguauuauucgaauguaaacuacauaaaucagguuacguaacaguagcacauacaggucaacacgauuuaguaauaccaccaaauggcuauuuuagauucgauucauggguaaaucaauucuauacguuagcaccaauggguaauggaacaggacgaagacgagcauuauaa

SEQ ID NO: 32777 - RNA, 1623 nt, Artificial Sequence
  derived and/or modified sequence opt6 from capsid_protein__Norovirus__BAG68811
augaaaauggccucuagugacgcaaauccaucagacggaucuacagccaaccucguaccagaaguaaauaacgaaguaauggcacuagaaccaguuguaggugcugcuauugcagcaccuguagccggccaacaaaauguaauagacccauggaucagaaacaacuuuguccaagcaccagguggagaauucacuguaucaccaagaaaugcaccaggagaaaucuuauggucagcaccauuaggaccagacuuaaaucccuauuuaucacaucuugcaagaauguauaacucuuacgcaggaggauucgaaguacaagucauacuagcaggaaaugcauuuaccgcaggaaaaauaauuuucgcagccguacccccuaacuucccaacagaaggauuaucaccuucccaaguuacaauguuuccacacauaauaguagacguacgacaacuagaaccagugcuaauaccucucccagauguacgaaacaauuuuuaccauuauaaccaaagcaaugauccaacaauaaaacucauugcuaugcucuacacaccacuacgcgcaaacaaugcaggagacgacguauuuacuguauccuguagaguacuaacccgaccauccccagacuuugacuuuauauuuuuaguaccaccaacagucgaaucacgaacaaaaccuuucucaguuccuauucuaacaguugaagaaaugacuaacuccagauuuccaauaccuuuagaaaaauuauuuaccggaccaucuuccgcauucguaguucaaccucaaaacggucgaugcacaacagacggaguuuuauuagguaccacccaauuaucaccuguaaauauauguacauucagaggugacguaacacauauugcuaacacacaagaauacacaaugaauuuagcaucacagaacuggaauaauuacgaucccacagaagaaaucccagcaccacugggcacaccugacuucguaggcaaaauacaaggcguucuaacucaaacaacaagaagagaugguuccacacguggacauaaggcuaccguaucaacaggaucuguacauuuuacaccaaaauuaggacgaauacaauuuucaacagauaccucaaaugacuucgaaacuggacagaauacaagauuuacuccaguagguguuguacaagacggaucaacaacacaccaaaacgaaccacaacaaugggucuuaccaaauuauuccggaggagacggacauaacguacaccuagccccagcaguagcaccaucuuucccaggagaacaauuacucuucuuccgaucaacaaugcccggaugcucaggauauccaaauaugaaucuagauugcuuacuaccacaagaauggguacaacacuuuuaucaagaagcagcaccagcacaaucagacguagcacuucucagauucgucaacccagacacaggaagaguucuuuucgaaugcaaacuacauaaaucuggguauguaaccguagcacauacuggacaacaugauuuaguuauaccaccaaauggcuauuuuagauuugauagcuggguaaaccaauucuauacauuagcaccaaugggaaauggaaccggacgacgaagggcacuauaa

SEQ ID NO: 32778 - RNA, 1623 nt, Artificial Sequence
  derived and/or modified sequence opt6 from capsid_protein__Norovirus__BAG68812
augaaaauggcaucaucagacgcuaauccuuccgauggcuccaccgcaaaucuaguaccugaagucaauaacgaaguaauggcucuagaaccuguaguaggagcagcuaucgcagcaccuguagcaggucaacaaaacguaauagauccauggauaagaaauaacuuuguacaagcaccaggaggagaauuuacuguaucaccucguaaugcaccaggagaaauauuaugguccgcuccucuuggaccagauuuaaaccccuaucuuagucaccuagccagaauguauaacucuuacgcaggaggauucgaaguacaagucauauuagcaggaaaugcauucacagccggaaaaauaauauuugccgccguaccaccaaauuuucccacagaaggacucucacccucacaaguaacuauguuuccucacauaauaguagacguaagacaacuagaaccuguucuaauuccacucccagacguaagaaacaauuucuaucauuauaaucaaucaaaugauccaacaaucaaacuaauagcaaugcucuacacaccuuuacgugcaaauaaugcaggcgacgacgucuucacaguaaguuguagaguauuaacaagaccuucaccugauuucgacuuuauauuucuuguaccaccaaccguagaaucaaggacuaaaccauucucugucccuauccucacaguugaagaaaugacaaacucaagauuuccaauaccucuagaaaaacuauuuacaggaccaaguagcgcauucgucguacaaccucaaaacgguagauguacuacagacggaguacuauuaggcacuacacaacuuagcccaguaaacauauguacauuuagaggagacgucacacacauagcuggcacacaagaauacacaaugaacuuagcaucgcaaaacuggaauaauuacgauccaacagaagaaauaccagcaccacuaggaacacccgauuucguaggaaaaauacaaggaguuuuaacacaaacaacuagaagagaugguucaacaagaggacauaaagcuacuguauccacuggcaguguacauuucacaccaaaacuaggccgaauucaauucuccacagacaccuccaaugacuucgaaacaggucaaaauacaagauuuacacccguaggaguuguacaagacggcucaaccacacaucaaaaugaaccacaacaauggguacuacccaacuauucaggcagagauucacacaacguucaccuagcuccugcaguagcccccucuuuucccggagaacaacuacuuuucuucagauccacaaugcccgguugcucuggauauccaaacaugaacuuagacugcuuacucccacaagaauggguccaacauuucuaccaagaagccgcacccgcacaauccgacgucgcacuauuacgcuuuguaaauccugauacaggcagaguccuuuucgaaugcaaacuacauaaaucaggcuauguaacagucgcacacacuggucaacaugaccuagucauaccacccaauggauauuuucgauucgauaguuggguaaaccaauuuuauacucuagcuccuaugggaaacggaacaggacguagaagagcuuuauaa

SEQ ID NO: 32779 - RNA, 1623 nt, Artificial Sequence
  derived and/or modified sequence opt6 from capsid_protein__Norovirus__BAG68813
augaaaauggcuucaucagaugcaaauccaucagauggaucuacagccaaccuaguaccagaaguuaauaaugaaguaauggcucuagaaccaguaguaggagcagcaauagcagcuccaguagcuggacaacaaaauguaauagauccuuggauaagaaacaacuuuguacaagcaccaggaggagaauuuacaguaagcccaagaaacgcaccuggagaaauauuauggucugcuccucuaggcccagaccuaaacccauaucuaucacacuuaagucguauguauaauagcuacgcuggcgguuuugaaguacaaguaauacuagcaggcaaugcauuuacugcagguaaaauaauauucgcagcaguaccaccaaacuuuccuauagaaggacuaaguccuucacaaguuacaauguucccacacauuauaguugauguacgacaacuagaaccaguauuaaucccucucccagacguaagaaacaauuuuuaucauuacaaccaaucaaaugacccaacaauaaaauuaauagcaaugcuauacacaccacuacgagccaauaaugcaggagaugauguauucacaguaucaugucguguucuaacuagaccuucaccagacuuugauuucauauuccuaguaccaccaacaguagaaucucgaacaaaaccuuucucaguaccaauauuaacagucgaagagaugacaaauucaagauuucccacaccaguagaaaaacuauuuaccgguccauccucugcauucaucguacaaccccaaaacgguagauguaccauugauggaguacuacucggaacaacacaauuaucuccuguaaauauauguacauuccgaggagacguuacacauauagcuggaacacaagaauauacaaugaaucuagcaucacaaaauuggaacaauuacgauccaacagaagaaauaccagcuccacuuggcacaccagauuucguagguaaaauacaaggaguacuaacccaaacaacucgacgagauggaucaacuagaggacauaaagcaacaguuucuacaggaucaguacauuuuaccccaaaacuuggacgaauacaauucuccacagacaccucaaaugauuuugaaacacgacaaaauacaagauucacaccagucggagucauacaagacggaucuaccacucaccaaaacgaaccucaacaauggguucuuccaaacuauucaggaagagauagccauaacguacacuuagccccugcuguagcaccauccuucccaggggaacaauuacuauuuuuuagaucaacaaugccaggaugcucuggauauccaaacaugaauuuagauugcuuacuaccacaagaauggguacaacauuucuaucaagaagccgcaccagcucaaucugauguagccuuacuacgauucguaaacccagacacaggcagagucauguucgaaugcaaacuacauaaauccggauacauaacaguagcacacacaggacaacaugaucuaguuauaccuccuaacggcuauuuccgauucgaugcauggguaaaccaauucuacacacuugcacccaugggcaauggaacaggaagacgcagagcucuuuaa

SEQ ID NO: 32780 - RNA, 1647 nt, Artificial Sequence
  derived and/or modified sequence opt6 from capsid_protein__Norovirus__BAG68814
augaaaauggcuucaaacgacgcagcaccaucuaacgacggagcagcaggauuagucccagaaauaaauaaugaagcaauggcgcuagaaccuguagcaggagcugcaauugcagcaccacucacaggacaacaaaauauaauagauccauggauaaugaacaacuuuguacaagcaccaggaggagaauuuacaguaucaccacgaaacucaccaggagaaguuuuauuaaaucuggaacucgguccagaaauaaacccauaucuugcccauuuagcccgaauguauaauggauacgcaggcggauuugaaguucaaguuguauuagcaggaaacgcauucacugcaggaaaaauaauauuugcugcaaucccacccaauuuccccauagacaauuuaucagccgcacaaauaacuauguguccacauguaauaguugacguaagacaauuagaacccguaaacuuaccuaugccagauguaagaaauaacuuuuuccacuacaaccaaggaagugacuccagacucagacuaaucgcaaugcuauauacaccacuaagagcaaauaauucaggagacgacgucuuuacaguaucaugccgaguauuaacaagacccagcccugacuucucauucaauuuccuaguacccccaacuguagaauccaaaacaaaaccauucucacuacccauacuaacaauaucagaaaugaguaacucaagauuuccaguuccaauagacucauuacacaccagccccacagaaaacauaguaguacaaugucaaaauggaagagucacacuugacggcgaauuaauggggaccacacaauuacuaccaucucaaauaugcgcuuuuagaggaguauuaacaagaucaacuagcagagcuucugaucaagcagacacugcaacaccaagauuauucaauuauuacuggcacauacaacuagacaaccucaaugguacuccuuacgacccagcugaagauauaccagguccccuaggcacaccagauuuuagaggcaaagucuucggugucgcaucacaaagaaacccagauacaacaacuagagcacaugaagcuaaaauagauacaacaucuggaagauucacaccaaaacuaggaucacucgaaauaucaacagaaucagaugacuuugaccaaaauaaaccaaccagauucaccccaguaggaauagguguagauagagaaguagauuuccaacaaugggcauuacccgacuaugcaggacaauucacgcacaauaugaaucuagcacccgcuguagcacccaauuucccaggagaacaauuauuauuuuucagaucacaacuaccuuccucuggagguagaucaaacggaauacuagacugucuaguaccucaagaauggguccaacauuuuuaucaagaaucagcaccaucucaaucacaaguagcccuaguaagauacauuaaucccgacacagguagaguacucuuugaagcaaaacuacacaaacuaggauuuaugacaauagcuaaaaacggagacucaccaaucacaguaccuccuaacggauacuucagauuugaaucauggguaaacccauuuuauacauuagcuccaaugggaacaggcaauggaagaagaagaauacaauaa

SEQ ID NO: 32781 - RNA, 1647 nt, Artificial Sequence
  derived and/or modified sequence opt6 from capsid_protein__Norovirus__BAG68815
augaaaauggcauccaaugaugcagcaccuucaaaugacggagccgccggccuuguaccugaaauaaauaaugaagccauggcuuuagaaccaguagcuggagcagcaauagcugcaccacuaaccggacaacaaaacaucaucgacccauggauaaugaauaacuucguacaagcaccaggcggcgaauuuacaguuucaccaagaaacucacccggagaaguauuacuuaaccuagaacuaggaccagaaauaaauccauaccuugcacauuuagccagaauguauaaugguuacgcaggagguuucgaaguacagguagucuuagcaggaaacgcauuuacagcugguaaaauaaucuucgcagcaauaccaccaaacuuuccaauugauaacuuaucagccgcucaaauaacaauguguccacacgugauaguugauguacgacaauuagaaccaguuaacuuaccaaugccggacguaagaaacaauuuuuuucacuauaaccaaggcucagacucaagauuaagacuuauugcaaugcuauauacucccuuaagagccaacaacucaggagacgauguauuuacaguaucauguagaguacuaacaagaccauccccugacuucucauucaacuuucuaguuccaccaacuguagaaucaaaaacaaaaccuuucucacuaccaauacuuacaauuagugaaaugucuaacuccagauucccagucccaauagauucacuacacaccucccccaccgaaaauaucguuguucaaugccaaaacggacgaguuacacuagauggugaauuaaugggaacaacacaacuacuaccaucccaaauaugugcauuccgagguguauuaacccgaucaacaucaagagcaagugaucaagcagauacagcaacaccuagauuauucaauuauuacuggcauauacaacuugacaacuuaaaugguacaccuuaugauccagcugaagacauuccaggaccacuugguaccccagauuuucgaggaaaaguauuuggaguagcaucacaacgaaacccagauaccacuacuagagcacaugaagccaaaauagauacaacuucaggaagauucacuccaaaauuaggaucacuagaaaucucaacagaaucagaugauuucgaucaaaauaaaccaacacgauucaccccuguagguauaggagucgaccaugaaguagacuuucaacaaugggcuuuacccgacuacgcaggucaauuuacacacaauaugaacuuagcaccagcuguagcacccaacuuuccaggagaacaauuauuauucuuccguagucaacuaccaaguucaggagguagaucaaauggcaucuuagacugcuuagucccccaagaauggguccaacauuucuaccaagaaucagcaccaagccaaucucaagucgcauuaguaagauacauuaauccugauacuggacgcgucuuauuugaagcuaaacuacauaaacuuggauuuaugacaaucgcaaaaaauggagauucuccaaucacaguuccuccuaauggauacuuuagauucgaaucauggguaaacccuuuuuauaccuuagcaccaaugggaacagguaauggaagacgacgaauacaauaa

SEQ ID NO: 32782 - RNA, 1623 nt, Artificial Sequence
  derived and/or modified sequence opt6 from capsid_protein__Norovirus__BAG68816
augaagauggcaucuucagacgcaaacccaucagauggcucaacagcuaacuuagucccagaaguaaauaaugaaguuauggccuuagagccaguagucggagcagcuauagcagcacccgucgcaggacaacaaaauguuauagauccuuggauaagaaauaacuucguacaagcacccggcggagaauuuaccgucucuccacgaaaugcaccuggagaaaucuuauggucagcaccacuaggacccgaucucaauccauaccucucacaucuagcaagaauguauaacggauacgcagguggauuugaaguacaaguuauacuagcagguaacgcauucacagccgguaaaaucauauuugcagcaguccccccaaauuucccaacagaaggcuuaaguccuucacaaguuacuauguuuccacacaugauaguagacguaagacaauuagaaccaguauuaauaccauuaccagacguacgaaacaauuucuaucauuauaaccaaaguaaugauccaaccauaaaacuaauagcaaugcucuauacaccauuacgugcaaacaacgcuggagaugauguauucacaguaaguugcagaguacuaacaagaccuucaccagacuuugacuucauauuuuuaguaccaccaacaguggaaucacgcacuaaaccauucucagucccuauacuaacaguugaagaaaugacaaauucaagauucccaauaccacuagaaaaauuauucacaggaccuagcucagcauucguaguacaaccacaaaauggaagauguacaaccgacgguguacuauuaggaacaacccaauuaucaccagucaauauuuguaccuuuagaggagauguuacacauauagcagguacucaagaauacacaaugaaccuagcaagucaaaauuggaacaauuaugaucccacagaagaaauaccugccccacuaggaacaccagacuuugucggaaaaauacaaggcguauuaacacaaacaacaagaggagacggaucgacaagaggacacaaagcaacaguaucaaccgguucuguacacuuuaccccaaaguuaggaagaauacaguuuucuacagauaccucaaacgauuuugaaacaggucaaaauacuagauucacuccugucggaguuguacaagacggaucaacuacccaucaaaacgaaccacaacaauggguacuaccaaauuauucaggaagagauucacauaacguacacuuagcaccagcagucgcaccuuccuuuccaggugaacaacuauuguucuuuagauccaccaugccuggaugcuccggauauccaaauaugaaucuagacugucuacuaccacaagaauggguacaacauuuuuaucaagaagcagcacccgcacaaucagacguagcauuauuaagauucguaaauccugacacaggaagaguauuauucgaauguaaauuacauaaaucaggauaugucacuguagcgcauaccggucaacaugaccuaguuauaccaccaaacgguuacuucagauuugauucauggguaaaucaauuuuacacauuagcacccaugggaaauggcacuggaagacgaagagcauuauaa

SEQ ID NO: 32783 - RNA, 1626 nt, Artificial Sequence
  derived and/or modified sequence opt6 from capsid_protein__Norovirus__BAH04374
augagaaugucagacggcgcagcaccaaaagcaaauggaagugaagcaucaggacaagaccuuguaccaacagcaguugaacaagcugugcccauacaacccguugcaggugcugccuuagcugcucccgcagccggacaaauaaaucaaauugaucccuggauuuuucaaaauuuuguacaauguccauuaggagaauuuucaauaucuccaagaaauacaccaggagaaauauuauucgacuuagcuuuaggaccagguuuaaauccuuaucuagcacauuuaucagcuauguauacggguuggguuggaaauauggaaguacaauuaguauuagcaggaaaugcauuuacagcagguaaaguaguaguagcucuaguuccaccuuacuucccuaaaggauccuuaacuacggcacaaauaacuuguuuuccccauguaaugugugaugucagaacucuggaaccuauacaacucccacuucuagauguaagacgcguucuauggcaugcaacacaagaucaagaagaaucaaugagauuaguaugcauguuauauaccccauuaagaacaaauucacccggagacgaaucauucguaguuucaggaagacuguuaucaaaaccugcagcugauuucaauuuugucuauuuaacuccaccaauagaaagaacaauauauagaaugguagaucuaccaguccuacaaccaagauuauguacacaugcccgauggccugcaccaaucuauggacuauuaguagacccaucauuaccaaguaacccacaauggcaaaacggacgaguacauguugauggaacacuauuaggaacaaccccaguaagcggaucauggguauccuguuuugcagcagaagcagcauaugaauuucaaucuggaacuggagaaguagcaaccuuuacauuaauugaacaagacggaucagcauacguaccuggagauagagcggcacccuuaggcuauccugacuucucaggucaauuagaaauagaaguucaaacagaaacaacuaaaaaaggugaaaaauuaaaaguaacaacauuugaaaugauacuaggcccaaccacaaaugucgaucaaguuccuuaucaaggacgaguauaugcuucuuuaaccgcagcagcaucucuagauuuaguugauggaagagucagagcaguuccaagaucuguuuacggauuucaagacguaguaccagaauacaacgaugguuuacuaguuccuuuagcaccaccuaucgguccauuuuuaccaggugaaguacuuuuaagauucagaacuuauaugagacaaauagacucuacagaugcagcagcagaagcaauugacugcgcacuuccucaagaauuuguuaguugguucgcaaguaaugccuuuacaguacaaucagaagcauuacuauuacgauauagaaauaccuuaacaggccaacuucuauuugaaugcaaauuauacucagaaggauauauugcacuaucauauucugguucaggaccucuaacauuuccaacagauggauuuuuugaaguuguaucuuggguaccuagauuauaucagcuagcaucaguaggaucccucgcaaccgggcgaacauuaaaacaauaa

SEQ ID NO: 32784 - RNA, 1626 nt, Artificial Sequence
  derived and/or modified sequence opt6 from capsid_protein__Norovirus__BAH04377
augagaaugucagacggggccgcuccaaaagcaaauggcucagaagcaucuggacaagauuuaguaccaacagcaguagaacaagcaguaccaauacaaccaguugcaggagcagcauuagcagcacccgccgcuggucaaauaaaucaaauugacccauggauauuccaaaacuuuguacaauguccacuaggcgaauucucaauuucuccuagaaacacaccaggcgagauauuauucgaucuagcauuaggaccaggacuuaauccauacuuagcacaucuuucagcaauguauacaggauggguaggaaauauggagguacaauuaguucuagcagguaaugcauuuacagcaggaaaaguaguaguagcauuaguucccccauacuuucccaaaggaucuuuaacaacagcucagauuacauguuuuccucaugugaugugugauguaagaacacuugaaccuauacaauuaccacuucucgauguacgacgaguacuauggcaugcuacacaagaucaagaagaaagcaugagauuaguuugcaugcuauacacaccacuuagaacaaauagcccaggugacgaaucauuugucguaaguggaagacugcuuuccaaaccagcagcugauuuuaacuuuguauaccuaacuccaccuauagaaagaacaauauauaggaugguagaucuaccaguauuacaaccaagauuauguacacacgccagauggccugcaccaauauacggucuauuaguagauccaaguuuaccaaguaauccacaauggcaaaaugguagaguacauguugauggaacauuauuagguaccacuccuguuaguggaucauggguaaguuguuuugcagcagaagcagcauaugaauuucaaucaggaauuggagaagucgcuacauucacauuaauagaacaagacgguucugcauaugugccuggagauagggcugcaccacuaggauauccagauuuuucaggacaacuagaaauagaaguacaaacugaaacaacaaaaaaaggagaaaaauuaaaagugacuaccuucgaaaugauccucggaccuacaacuaaugucgaucaagugccauaucaaggaagaguauaugcaucacuuaccgcagcagcuagccuagaucucguagauggacgagucagagcaguacccagaucaguuuacgguuuucaagauguaguuccagaauauaaugauggauuauuaguaccacuagcuccaccaauaggccccuucuuaccuggcgaaguuuuauuaagauuuagaacauauaugcgacaaauugauucuacagacgcugcugcugaagcgauagauugugcacuaccacaagaauucguuucaugguuugcaucaaacgcuuucacaguacaauccgaagcuuuacuauuaagauaucgcaauacacuaacuggacaauuacuuuuugaaugcaaacuauacucugaagguuauauugcucuaucuuacucaggaaguggacccuuaaccuucccaacagauggauuuuuugaaguaguaucguggguaccaaggcuauaucaacuagcuucuguaggcucauuagccacagguagaacauuaaaacaauaa

SEQ ID NO: 32785 - RNA, 1623 nt, Artificial Sequence
  derived and/or modified sequence opt6 from capsid_protein__Norovirus__BAH29786
augaaaauggcaucuucagaugcuaacccuagugacggaagcacagcaaacuuaguaccagaaguaaacaaugaaguaauggcauuagaaccaguaguaggugcagcaauagcagcacccguagccggacaacaaaacguaaucgauccauggauacguaauaauuucguccaagcucccggcggagaauuuacaguuucaccaagaaaugcaccaggcgaaauauuauggagugcuccucuaggcccagaucuaaauccauaucuaucacauuuagcacgaauguauaacggcuaugcuggaggauuugaaguacaaguaauacuagcuggaaacgcuuucacagcuggcaaaaucauauuugccgcagucccacccaacuucccaacagaaggacucuccccaucccaaguaacaauguuuccacauauaauaguagacguccgacaacuagaaccaguucuaauaccauuaccagauguacgaaauaauuuuuaucauuacaaucaaucaaaugacccuaccauuaaauuaaucgcuauguuauauacuccauuaagagcuaauaacgcaggagaugauguuuuuacuguaucaugucgaguacuaacacguccaucuccagacuuugacuucauuuuucuaguuccaccaaccguagaaucuagaacaaaaccuuucucaguaccaauuuuaacuguagaagaaaugacaaauucuagauucccaaucccauuagaaaaauuauuuacuggcccaagcuccgcauuuguaguacaaccacaaaauggaagaugcacuacagacggaguacuauuaggaacuacacaauuaucaccuguaaauaucugcacauuuagaggugacguaacccauauaacugguucaagaaacuauacaaugaauuuagcaacccaaaauuggaauucauaugauccaacagaagaaauaccagcaccacuuggaacuccagacuucguuggaaaaauucaaggaguacuaacacaaacuacacgugcagacggaucaacaagaggacauaaagcaacaguuuacacaggaucugcagacuucgcaccgaaacuaggaagaguucaauuugcaaccgauacagauaaugauuuugaugcuaaucaaaauacaaaauuuaccccaguaggaguuauccaagauggagauacagcccauagaaacgaaccacaacaauggguacuaccaucauauucaggacgaaauucccauaauguacacuuagcuccuacuguagcaccaacauuuccaggcgaacaauuacuauucuuuagaucuacaaugccagguugcucaggauaucccaauauggauuuggacugccuucuaccucaagaauggguacaauauuucuaucaagaagcugcaccagcacaaagugauguugcauuauuaagauucguuaacccagacacaggacgaguacuauucgaaugcaaauuacauaaaucaggcuacguaacaguugcucauacaggacaacaugaccuaguaauacccccuaacggcuauuuuagauucgacucauggguaaaucaauucuacacacuagcaccaaugggaaauggaacaggcagaagaagagcccuuuaa

SEQ ID NO: 32786 - RNA, 1623 nt, Artificial Sequence
  derived and/or modified sequence opt6 from capsid_protein__Norovirus__BAH30707
augaaaauggccucaaacgacgcaacuccaucagauggaucuaccgcuaauuuaguaccagaaguaaauaaugaaguuauggcauuagaacccguaguuggugcugcuaucgcagcacccguugcaggacaacaaaauguaauugacccauggauucgcaauaacuucguacaagcaccuggaggagaauuuacaguaucuccaagaaaugcccccggagaaauuuuauggucugcaccacuaggacccgaucuuaauccauaucuaucacacuuagcaagaauguacaacggcuacgcuggaggauuugaaguccaaguaauauuagcaggaaaugcauucacugcaggaaaaauuauauucgccgccguaccuccaaacuuucccacagaagguuuaucacccucacaagucacaauguuuccucauaucaucguagacguaagacaauuagaaccaguacuaauuccacuaccagauguaagaaacaauuuuuaccauuauaaucaaagcaacgaccccacaauaaaacucauagcuauguuauacacaccuuuaagagccaacaaugcuggagaugacguauuuacaguaaguuguagaguucuaaccagaccaaguccagauuuugauuuuauauuucuagucccaccuacaguagaaucuagaaccaaacccuucucaguaccaauacuuacaguugaagaaaugacaaauagccgauuucccauaccacucgaaaaacuauucacaggcccaucaucagcauucguuguacaaccacaaaauggaagauguacaacagacggaguuuuacuaggaacaacacaacuauccccuguaaauauauguaccuuccgcggcgacguaacacauauaucaggaagucguaacuauacuaugaauuuagcaacacaaaauuggaacucauacgaccccacugaagaaaucccagcaccucuaggcaccccagacuucguagguaaaauucaaggaguauuaacacaaacaacaagagcugaugguucuaccagaggccauaaagcaacagucuauacaggaucagcagacuuugcaccaaaacuaggucgaguacaauucgcgacagacacagacaacgauuuugaugcaaaucaaaacaccaaauuuacuccaguaggaguaauacaagauggaaacacugcacauagaaacgaaccacaacaguggguccucccaucauauucuggacgaaauucucauaauguucacuuagcaccagccguagcacccaccuucccaggagaacaauuacuuuuuuucagaagcacaaugcccggauguucaggauauccuaauauggaccuugauugccuccuaccacaagaauggguucaauacuucuaucaagaagcagcaccagcucaaagugacguagcuuuacuucgauucguuaauccagacacuggcagaguccuauucgaaugcaaacuacauaaaucuggauacguaacagucgcucacacuggacaacaugaccuaguaauaccucccaauggauauuuuagauuugauucauggguaaaucaauuuuacacacucgcaccaaugggaaacggcacaggcagaagaagagccuuauaa

SEQ ID NO: 32787 - RNA, 1653 nt, Artificial Sequence
  derived and/or modified sequence opt6 from capsid_protein__Norovirus__BAL40869
augaaaauggcaaguaacgaugcagcacccagcaaugacggagccgcuaaccuuguaccugaagcaaacaaugaaguuauggcauuagaaccaguaguaggagcaaguauagcagcaccagucguaggccaacaaaacauaauagacccauggauaagagaaaacuuuguacaagcaccacaaggugaauuuaccgucucaccaagaaauagcccaggagaaauguuacuaaauuuagaacuaggaccagaauugaacccauaucuaagucauuuaucacguauguauaaugguuaugcaggugguaugcaaguucaaguuguuuuagcuggaaacgccuuuacugcaggaaaaauuauauuugcagccguccccccacacuucccaguagauaauauaucugcugcacaaauaaccaugugcccacauguaauagucgacguaagacaacuagaaccaguacuauuaccauuaccugauauaagaaauagauuuuuccauuacaaucaagaaaauacaccuagaaugagauuaguagcaauguuauauacuccucuacgagcaaauaguggagaagacguauuuaccguauccuguagaguccuaacaagaccagccccagauuucgaauucaccuuccuaguuccacccacagucgaaucuaaaacaaaaccauuuacauuaccaauuuuaacauuaggcgaauuaagcaacaguagguucccagcugcaauagauaugcuuuauacagacccaaaugaaucaauaguaguucaaccacaaaauggacgauguacauuagacgguacacuacaaggaacuacacaauuaguaccaacacaaauaugugcauucagaggaacauugauaucucaaaccgcgcgagcaguagauucaacagacagcccacaaagagcaagagaccacccacuacauguacaaguaaaaaauuuagauggaacacaauacgaucccaccgaugauauaccugcuguccuaggugcaauagauuuuaaaggaacaguauuuggagucgcuucacaaagagaugucagcgguacacaagaacaaggucauuaugccacccgagcacacgaagcccauauagacacaacagauccuaaauaugcaccaaaacuugguacuauauuaauaaaaagcgaaucaccagacuuuaacacuaaucaacccauuagauuuacaccuguaggaaugggagauaacaauuggagacaaugggaacuaccugacuauaguggaagacuaacauuaaacaugaaucuagcaccugcaguaagcccaucauuuccuggugaaagaauacuauuuuuuagaucaauuguaccaucagccggcggauacgguucuggauauauagacugucuaauaccucaagaauggguacagcauuucuaucaagaagcugcaccaucacaaucugcaguagcacuaguacguuauguaaauccagacacuggccguaauaucuuugaagccaaauuacauagagaagguuucuuaacagucgcaaauucaggaaacaacccaauaguagucccacccaauggauacuuccguuucgaagcauggguaaaccaauuuuacacuuuagcucccaugggaucaggucaaggccgaagaagggcccaauaa

SEQ ID NO: 32788 - RNA, 1644 nt, Artificial Sequence
  derived and/or modified sequence opt6 from capsid_protein__Norovirus__BAL40870
augaaaauggcauccuccgacgcugccccaucaaaugauggagcagcuaaucuaguaccggaagcaaauaaugaaguaauggcccuagaaccaguuguuggagcuucaauagcagcaccugucguaggucaacaaaauauaauagauccauggauacgugaaaacuuuguacaagcaccacaaggagaauuuacagucucaccaagaaauaguccaggagaaaugcuacucaaucuagaacuaggaccugaacucaacccuuaucuaucacaccuauccagaauguauaacggauaugcagguggaaugcaaguacaaguaguauuagcaggcaaugcuuuuacugcaggaaaaauuauauuugcagccguaccaccucacuuucccguagaaaauauaagcgcagcucaaauaacaauguguccucauguaauaguagauguaagacaacuagaaccuguauuauuaccuuuaccugauauuagaaauagguuuuuucauuauaaucaagaaaacacaccaagaaugagacuaguagcaaugcuuuauaccccacuaagagcuaauucaggagaagauguauuuacaguaucaugucgaguauuaacacguccagcaccugauuuugaauucaccuuccugguuccaccaacaguagaaaguaaaaccaaaccuuucacacucccuauuuuaacucuaggcgaacuaucaaauaguagauuuccugcaccaauugauauguuauauaccgauccaaaugaggggauaguaguacaaccacaaaauggaagaugcacacuugacggcacauuacaaggaacaacacaacuugucccuacacaaauaugcgcuuuucgagguacuuuaauaggacaaacuucuagaucaagcgauaguacagauucagcaccuagaagaagagaucauccucuucacguacaauuaaaaaacuuagauggaacacaauaugacccaacagaugaagucccagcaguuuuaggugcuauagauuuuaaaggaacuguauuuggcguagcuucacaacgagauguaucuggacaacaaguuggagcaacaagagcccaugaaguacauauaaacacaacagaucccagauauacacccaaacuaggaucuauauuaaugcauucugaaucagaugauuuuguaacuggacaaccaguaagauucacaccaauuggcaugggagauaacgacuggcaccaaugggaauuaccagauuacuccggacauuuaacacuuaacaugaauuuagcacccgcaguagcuccagcauuuccuggcgaaagaauucuauuuuuuagaucaauaguaccaucagcaggaggauauggaaguggacaaauagauugccuuauaccacaagaauggguccaacauuucuaucaagaagcagcaccaagucaauccgcaguagcacuuauaagauauguaaauccagauacaggacgaaauauauuugaagcuaaacuacacagagaaggauucauaaccguugcuaauucuggaaauaacccaauugucgcaccuccaaauggauauuuuagauucgaagccuggguuaaccaauuuuauacauuaacccccaugggaacaggacaaggaagaagaagaaaccaauaa

SEQ ID NO: 32789 - RNA, 1644 nt, Artificial Sequence
  derived and/or modified sequence opt6 from capsid_protein__Norovirus__BAL40871
augaaaauggcguccaacgacgcugccccaucaaaugacggggcagcaaaccucguaccggaagcuaacaaugaaguuauggcacucgaaccagucguaggugcuagcauagcagcaccuguaguaggucaacaaaacauaauagacccauggauucgagaaaacuuuguacaagcuccacaaggagaauuuacaguaucaccuagaaacucaccaggagaaaugcuauuaaaucuagaauuaggaccagaacuaaaucccuaucuaucacaccuaucaagaauguauaauggauacgcuggaggaaugcaaguccaaguaguauuagcaggaaaugcauuuacugcaggaaaaauaauauucgcagccguaccaccacauuuucccguagaaaauauuucagcagcacaaauaacuaugugcccacauguaauaguagacguaagacaacuagaaccaguacuucugccuuuacccgauauaagaaacagauuuuuccauuacaaucaagaaaauacuccaagaaugagacuaguugcaaugcuauacacaccauuacgugcaaauucaggugacgauguauucacaguaucaugucgaguacuaacaagaccagcaccagauuuugaauuuacuuucuuaguaccaccaaccguugaaucuaaaacaaaaccuuucaccuuaccaauacuaacucugggagaauuaagcaauucaagauuuccagcaccaauagauauguuauauacugauccaaaugaaggaauuguaguacaaccacaaaauggaagguguacacuagacggaacguuacaaggaacaacucaauuaguaccuacacaaauaugugcauuuagaggaacuuuaauaggacaaacaucacgaucuucagacucaacagauucagccccacguagaagagaucacccauuacacguacaacuaaaaaaucuugacgguacacaauaugacccuacugaugaaguaccagcaguauuaggcgcaauagauuuuaaaggaaccguauucggaguagcaagucaaagagauguuagcggucaacaaguaggcgccacacgagcacaugagguacacauaaauacaacagaucccagauauacuccuaaauuagguucaauauuaaugcauucugaaucagaugauuucguuacuggacaaccaguuagauuuacaccaauaggaaugggugauaaugacuggcaucaaugggaacuaccagauuauucaggacauuuaacauuaaauaugaacuuagcaccagcaguagcuccugcauuuccuggagaacgcauucuuuucuuuagaaguaugguaccaucagcuggagguuauggaaguggacaaauagacugccuaauaccacaagaauggguacaacauuuuuaccaggaagcagcuccaagucaaucagcaguagcuuuaauaagauauguaaauccagacacaggaagaaauauauucgaagcaaaauuacaucgagaaggauuuauuacaguagcuaauagcggaaauaauccaauaguaguaccaccaaacggauauuuccgauuugaagcauggguaaaucaauuuuauacauugacaccaaugggcacuggacaaggaagacgaagaaaucaauaa

SEQ ID NO: 32790 - RNA, 1644 nt, Artificial Sequence
  derived and/or modified sequence opt6 from capsid_protein__Norovirus__BAL40872
augaaaauggcauccaaugaugccgcaccaucaaaugauggagcagcaaauuuaguaccagaagccaacaacgaaguaauggcacucgaaccugucguaggugcuuccauagcagccccugucguaggacaacaaaauauaauagacccuuggauaagagaaaauuuuguacaagcaccacaaggagaauuuacuguaucaccaagaaacuccccaggugaaaugcuucucaauuuagaacucggacccgaauuaaauccauauuuaucacaucuaucucgaauguauaauggauaugcaggaggaaugcaaguacaaguaguacuagcaggcaaugccuucacagcugguaaaauaaucuuugcugcuguuccaccacauuuuccaguagaaaauauuucagcagcucaaaucacaauguguccacauguaauaguagauguacgacaacuagaaccaguauuacuaccacuucccgauaucagaaauagguuuuuccauuauaaccaagaagauacaccacgaaugcgauuaguagcuauguuauauacaccacuaagagccaacucgggggaagacgucuuuaccguaaguuguagaguauuaacacguccagcuccugauuuugaauuuacauuccuaguaccaccaacaguagaaucaaaaacaaaacccuucacucuaccuauccucacccuaggagaauuaaguaauagcagauuuccagcaccuauagacaugcucuauacagaucccaaugaaaccauaguaguacaaccacaaaacggaagaugcacauuagacggcaccuuacaaggaacaacacaacuaguaccaacacaaauaugcucauucagaggaacacuaauaucacaaacuucuagaucagcagacucuacugacagugcaccacgaguaagaaaucauccauuacauguacaauuaaaaaaccuagacggaacaccuuacgacccaacagaugaaguaccagcaguacuaggagcaauugauuuuaaaggaacagucuuuggcgucgcaucacaaagaaauacaacaggaaauucagucggugcgacaagagcacaugaaguacauauagauacaacaaauccaagauacacuccaaaacuaggaucaguccucaugaacagcgaaucaucagauuucgaugauggucaaccaacuuguuuuacuccuauaggcaugggugcagaugauuggcaccaaugggaacuacccgaauauucaggacaucuaacacucaacaugaaucuagcaccugcuguagcaccagcauuuccaggugaacgaauacuauuuuuuaggucaguaguaccaucagcaggcgguuauggcucaggacaaauagacuguuuaauaccacaagaauggguacaacauuucuaccaagaagcagcacccucucaaagcgcuguagcauuaauaagauauguaaauccagacacuggcagaaauauauuugaagccaaauuacacagagaaggguuuaucacuguagccaauucuggaaauaauccuaucgucguaccucccaauggauacuuuagauuugaagcuuggguaaaccaauuuuacacacuaacaccuaugggaacaggucaaggacgaagaagaguacaauag

SEQ ID NO: 32791 - RNA, 1644 nt, Artificial Sequence
  derived and/or modified sequence opt6 from capsid_protein__Norovirus__BAL40873
augaaaauggcaucaaaugacgcugcaccaagcaacgacggagcagcuaauuuaguuccagaagcaaauaaugaagucauggcacucgaaccaguagcaggugcaucaauagcagcaccaguuguaggacaacaaaauauuauugauccauggauucgcgaaaauuucguacaagcuccacaaggagaauuuaccguaagcccaagaaauuccccaggugaaaugcuucuuaacuuagaacuaggcccugaauuaaacccauauuuaucacauuuaucuagaauguacaacggauaugcaggaggaaugcagguacaaguaguauuagcaggaaaugcauuuacagcuggcaaaaucauauuugccgccguaccaccccauuuuccaguagaaaauaucucagccgcacagauaacaaugugcccucaugugauaguugauguaagacaacuagaaccaguccuacuaccauuaccagacauuagaaaucguuuuuuucauuauaaucaagaagauacuccuagaaugagauuaguagcaauguuguauacaccacuaagagcaaauucaggagaagauguauuuaccgucucaugcagaguacuuacacgaccugccccagauuuugaauuuacauucuuaguaccuccuacaguagaauccaaaacaaaaccauuuacauuaccaauacuaacacuaggagaacuaucaaauucacguuuuccagcacccauugacaugcuauacacagauccaaaugaaacaauaguaguucaaccacaaaauggcagaugcacucuagacggaacuuuacaaggcacaacucaacuaguaccuacacaaauauguucuuucagaggaacccucauaagucaaacaucaagaucagcugauucaacagacagugcuccaagaguaagaaaucauccacuucacguucaauuaaaaaauuuagauggaaccccauaugacccaacugaugaaguaccagcaguucuaggcgccauagacuuuaaaggaacaguauucggaguagcaucacaaaggaauacaacuggaaauucaguaggagcgacaagagcccaugaaguucauauugacacaacaaauccacgauauacccccaaauuaggcucaguauuaaugcauucagaaaguagcgauuuugacgauggucaacccauaaguuuuacuccaauaggaaugggagcugacgauuggcaucaaugggaauuacccgaauauucaggucaucuuacauuaaacaugaacuuagcuccagcaguagcaccagcauuuccaggagaaagaauacuauuuuuuagaucagucguaccaucagcaggaggauacggaucaggacaaauagacugcuugauaccacaagaauggguacaacauuuuuaucaagaagcagcaccaucacaaucagcaguagcauuaguuagauauguaaacccagauacagguagaaauauauucgaagccaaauuacauagagaaggauuccuaaccgucgcuaauucgggcaauaauccaauaguaguaccaccaaauggauacuucagauuugaagccuggguaaaccaauuuuacacuuuaacuccaaugggaacaggacaaggaagacgcagaguucaauaa

SEQ ID NO: 32792 - RNA, 1626 nt, Artificial Sequence
  derived and/or modified sequence opt6 from capsid_protein__Norovirus__BAL60900
augcgcaugucagauggugcagcacccaaagcaaaugguagugaagcuucuggucaagaucuaguauuaacugcuguagaacaagcaguaccuauacaaccaguagcaggagcugcucuugcugcaccagcugcuggacaaauuaaucaaaucgauccuuggauauuucaaaauuuuguucaaugcccccucggugaauucucaauuagcccacgaaauaccccuggagaaauauuauuugaucuugcuuuaggcccuggauuaaauccauauuuagcccaucuuucagcuauguacaccggauggguaggaaauauggaaguacaacuaguauuagcaggaaaugcauuuacagcagguaaaguuguaguagcauuaguuccuccauacuucccaaaaggaagucuaacaaccgcacaaauaacauguuuuccccauguaaugugcgauguuagaacuuuagaaccaauacaauuaccauuacuagauguaagaagaguacuauggcaugcuacacaagaucaagaagaaagcaugagauuaguauguaugcuauauacaccccuuagaacaaauucaccuggugacgaaucauucguaguaucagguagauuauuaagcaaaccagccgcugacuuuaauuuuguauaucuaacuccacccauagaaagaacaauauauagaaugguagaucuaccaguacuucaaccaagacucuguacacacgcucgauggccagcaccuguuuacggacuucuaguagauccauccuuaccauccaauccacaauggcaaaacggucguguacauguagacggaacacuauuagguacaacuccaguaucaggaagcuggguuaguuguuuugcagcagaagcagcauaugaauuucaauccgggacaggagaaguugcaacauucacauuaauagaacaagaugguucagcauauguuccaggagaaagagcugcaccacugggauacccagauuuuucaggacaauuagaaauagaaguucaaaccgaaacaacaaaacgcggagaaaagcuaaaaguaacaacauuugaaaugauccuugguccaaccacgaauguagaccaagcuccauaucaaggcagaguauaugcaucccuaucagcagccgcaucacuugauuuaguagacggacggguaagagcagucccacgauccauauauggauuucaagauguaauaccagaauauaacgaugguuuacuuguaccacuagcaccaccaauaggacccuuuuuaccaggcgaaguauuauuaagauuuagaacauauaugagacaaguagauaguagcgacgcugccgcugaagcaauugacugugcuuugccucaagaauuuguaucaugguuugcauccaauggauuuacuguucaaucagaagcauuauuacuaagauauagaaacacauuaacaggucaacuauuauuugaaugcaaauuauacagugaaggauauauagcacuuucauauuccggaucaggaccacucacuuucccaacagaugguuuuuuugaaguagugucauggguaccaagacucuaucaauuagcaucaguaggaucauuaguuacuggaagaacacuaaaacaauaa

SEQ ID NO: 32793 - RNA, 1623 nt, Artificial Sequence
  derived and/or modified sequence opt6 from capsid_protein__Norovirus__BAQ55211
augaaaauggccuccaaugaugcaucacccucagauggaucaacagcaaauuuaguaccugaaguaaacaaugaagucauggcauuagaaccugucguaggugcagcaauagcagcaccaguugcaggacaacaaaauguaauugacccauggauaagaaauaauuuuguacaggcucccggaggagaauuuaccguaaguccuagaaacgccccuggcgaaauuuuauggucugcaccauuaggccccgauuuaaauccauauuuaucacacuuagcacgaauguauaacggauaugcaggaggauucgaaguacaaguaauauuggcaggaaacgccuuuacagcagguaaaauaauuuuugcugccguucccccaaauuuuccaacugaaggacuaucaccaucacaaguuacaauguucccacauauuauaguagauguuagacaacuagaacccguuuuaauaccacuaccugauguaagaaauaauuuuuaucacuacaaccaaucaaacgacucgacaaucaaacucauagcaaugcucuauacaccauuaagagcuaacaacgcaggagaugacguuuuuacaguuucaugucguguacuaacaagaccaucuccagauuuugacuuuauauuuuugguaccgccaacuguagaaucuagaacaaaaccauuuacagucccaauuuuaacuguagaagaaaugacaaacucaagauuuccaauuccauuagaaaaacuauucacaggaccaucaucagcauucguuguccaaccacaaaaugggagauguacuaccgacggaguacuacuaggaaccacccaacuuucaccaguaaauauauguacauuuagaggugauguaacccauauuccugguaccucuacauacagaaugaauuuagcuucccaaaauuggaauaauuacgauccaacagaagaaauaccagcaccauuaggaacaccagacuuuguuggaaaaauucaaggaauguuaacccagacaacuaaaggagacgguagcacacguggccauaaagcaaccguaucaacagguucaguugacuucacaccaaaauuagguuccguucaauuugcaacagauaccgauaaugauuuugaaacaggacaaaauacuagauucacaccuguaggcguaauacaagacgguucaggagcacaucgcaaugaaccacaacaauggguauuaccaaacuauucaggucguacuguacauaacguacauuuagcacccgcaguagccccaacauucccaggugaacaacuauuauuuuuuagaucaacaaugccagguugcucuggauauccaaacauggaucuggacuguuuauuaccucaagaauggguacaacauuucuaucaagaagcagcuccagcccaaucugauguagcuuuauuacgauuuguaaauccugacacagguagaguacuauuugaauguaaacuacauaaaacagguuacguaacugucgcucauacaggccaacacgauuuaguaauaccaccaaauggcuauuucagauuugacucauggguuaaccaauucuauacauuagcaccuaugggaaauggagcagguagaagaagagcccuauaa

SEQ ID NO: 32794 - RNA, 1623 nt, Artificial Sequence
  derived and/or modified sequence opt6 from capsid_protein__Norovirus__BAQ55212
augaagauggcuucuaaugacgcaucaccuuccgauggaucaacagcuaaucuaguuccagaaguaaauaacgaaguaauggccuuagaacccguaguaggagcagccauagcagcaccaguagcuggucaacaaaacguaauagacccauggauuagaaauaauuuuguacaagcaccuggcggcgaauuuacuguuucuccaagaaaugcuccaggagaaauacuuuggucugcgccucuagguccagacuuaaaucccuaucuaucacaccuagcaagaauguacaacgguuaugcaggugguuucgaaguccaaguaauacuagcuggcaaugcauuuacugcaggaaaaauaauauuugcagccguaccaccaaacuuuccaacagaaggguuaucuccaucucaaguaacaauguucccacacauaauaguagacguaagacaacuagaaccaguauuaauuccauuaccagaugucagaaauaacuucuaccauuauaaucagaguaaugacucuacaauaaaacuaaucgcuaugcuauacacuccauuaagagccaauaacgcuggagaugaugucuuuacaguuuccugucgcguauuaacucgaccaucuccagacuucgacuuuauauuucuaguaccaccaaccguugaaucaagaacaaaaccauuuacagucccuauauuaaccguagaagaaaugacuaauagucgauuuccaauaccacuagaaaaacuauuuacugguccaucaucagcauuuguaguacaaccacaaaauggcagauguaccacagacgguguccuacuaggaacaacacaauuaucacccguaaacauauguacauuuagaggagacguaacacauauaccaucaacaagaacauauagaaugaaucucgcaagccaaaacuggaauaauuacgauccaacugaagaaauuccugcaccacuaggaacaccagacuuuguaggaaaaauucaaggcauguuaacacaaacaacaaaaggagacggcagcacacgaggacacaaagcaacuguauccacuggauccguugacuuuacuccuaaacuaggaucaguacaauucgcuacugacacagauaaugauuucgaaacaggucaaaacacaagguucacuccugucggaguaauacaggacggaucaagugcacacagaaaugaaccccaacaauggguauuaccagauuacuccggaagaacaguacauaauguccaccuugcaccagccguugcacccacauuuccaggcgaacaauuacuauuuuucagaucaaccaugccagguugcucaggauacccaaauauggaucuagauuguuuauuaccucaagaauggguacaacauuuuuaucaagaagcagcacccgcacaaucagacguugcccuauuaagauucgucaaucccgauacaggacgcguauuauuugaaugcaaacuacauaaaacuggauauguaacaguagcacauacaggacaacacgauuuaguaauaccaccaaauggauauuucagauucgauucauggguaaaucaauucuacacauuagcacccaugggaaacggcgcaggaagaagaagagcacuauaa

SEQ ID NO: 32795 - RNA, 1620 nt, Artificial Sequence
  derived and/or modified sequence opt6 from capsid_protein__Norovirus__BAQ55213
augaaaauggcaucaaacgaugcgucaccaucagacggcucaacagcaaaucucguaccugaaguaaacaaugaaguaauggcacuugaaccaguaguaggagcagccauugcugcuccugucgcaggccaacaaaacguaauagauccuuggauaagaaauaauuuuguacaagcacccggaggagaauuuacaguaucaccaagaaaugcaccaggagaaauauuauggucugcaccauuagguccagacuuaaauccauauuuaagucauuuagcacgaauguacaauggcuaugccggugguuucgaaguacaaguaauauuagcaggaaacgcauucacugcuggaaaaauaauauucgcagcugucccuccaaacuuuccaacagaaggacuaucuccaucacaaguaacaauguucccacauaucauaguagacguccgucaauuggaacccguacuaauacccuuaccggaugucagaaacaauuucuaucacuacaaccaguccaaugauucuacaauaaaauuaauagcaaugcuauacacaccauuaagagcuaacaaugcaggagaugacguauuuacaguaucuugucgaguauuaacaagaccaucaccagacuuugauuuuauauuucuaguaccacccacaguagaaucuagaacuaaaccauucacuguaccuauacuuacaguagaagaaaugacaaacucucgauuuccaaucccccuugaaaaacuauuuacagguccaucuagugcauucguaguacaaccacaaaacggaagauguacaacagacggaguauuauuaggaacaacacaacucaguccuguaaauaucuguacauuuagaggcgacguuacacauauaucuggaacuucuacauaucguaugaaccuagccucccaaaauuggaacaauuaugauccaaccgaagaaauccccgccccauuagggacaccagauuuuguuggaaaaauucaaggaaugcuuacgcaaaccacaaaaggagacggaucaacacgaggacauaaagcaaccguaucaaccggaucaguugauuuuacaccaaaauuaggaucaguacaguuugauacagauacaaauaaugaccuagaaacaggucaaaacacacgauucacuccagucgguguaauacaagacggaucagcacaucgaaaugaaccucaacaauggguacuucccgauuacucagguagaaccguacacaacguccaccuagcaccagcaguagcaccaacauuuccaggagaacaauuacuauuuuucagaucaaccaugccuggaugcucaggcuacccaaacauggaucuagacugccuauuaccacaagaauggguacaacauuuuuaucaagaagcagcaccagcacaaucugauguagcuuuauuaagauuuguaaauccagauacaggcagaguacuauuugaauguaaauuacacaaaacagguuaugucacaguagcacacacuggucagcacgaucuuguaauaccaccuaacgguuauuuucgauuugacucauggguuaaccaguuuuauacauuagcacccaugggaaacggagcaggaagacgaagagcauuauaa

SEQ ID NO: 32796 - RNA, 1623 nt, Artificial Sequence
  derived and/or modified sequence opt6 from capsid_protein__Norovirus__BAQ55214
augaaaauggcaucaaaugaugcuucaccaagcgauggaucaacagcaaaucuaguaccagaaguaaacaaugaagucauggcacuugagccaguagucggagcagcaauugcagcaccaguagcaggccaacaaaaugucaucgauccauggauacgaaacaacuuuguacaagccccaggaggugaauucacaguuucuccuagaaaugcaccuggcgaaauauuauggucagcaccucuaggcccagaucuaaauccauaucuaucacauuuagcuagaauguauaacggcuaugcuggagguuucgaaguacaaguaauacucgccgggaaugccuuuaccgcaggaaaaauaauauucgcugcaguacccccaaacuuuccgacugaaggccuaucaccaucacaaguaacuauguucccacauauuauaguugauguuagacaauuagaaccaguucuuauuccacuaccugauguaagaaacaauuucuaucauuauaaucaauccaaugauucuaccauaaaacuaaucgcaaugcuauacacaccucuaagagcaaacaacgccggagacgauguauucacaguaucuugcagaguacuaacaagaccaucucccgacuuugacuucauauuccuaguacccccaacaguagaaucaagaacaaaaccauuuacuguaccaauccuaacaguagaagaaaugacuaauucaagauucccaauuccauuagaaaaacuuuucacaggaccaucaucugccuucguaguacaaccacaaaacgguagauguacaacagaugguguacuacuuggaaccacucaacuuuccccaguaaauauauguacauuuagaggugauguuacccacauaucagguacaucaacauacagaaugaauuuagcaucacaaaacuggaacaauuacgauccuacugaagaaauaccagcaccuuuagguacaccagacuucguaggaaaaauccaaggaaugcuaacucaaacaacaaaaggugaugguaguacaagaggacauaaagcaacuguauccaccggauccguugacuuuacaccaaaacucgguucuguucaauuugcaacagauacagauaacgacuucgaaacuggacaaaauacaagauucacaccagucggaguaauucaagacggcuccggagcccacagaaaugaaccacaacaauggguacuaccagacuacucaggaaaaacuguacauaacguccauuuagcacccgcagucgccccaacauuuccaggagaacaauugcuauucuuuagaucaacaaugcccggaugcucaggauauccaaauauggaccuagauugucuucucccacaagaauggguacaacauuucuaucaagaagcagcaccagcccaaagugauguagcacuacuacgcuucguaaacccagacacuggaagaguacuuuucgaauguaaacuacauaaaacagguuauguuacaguugcacacacaggacaacacgacuuaguuauaccaccaaauggauauuuuagauuugauucauggguaaaucaauuuuacacacuagcaccaaugggaaauggugcuggucgaagaagagcacuauaa

SEQ ID NO: 32797 - RNA, 1620 nt, Artificial Sequence
  derived and/or modified sequence opt6 from capsid_protein__Norovirus__BAQ55215
augaaaauggccucuaacgacgcaucaccaucagauggcucaacagcaaaucuaguacccgaaguuaauaaugaaguaauggcuuuagaaccaguagucggugcagcaauagcagcaccaguagcaggacaacaaaacguaaucgauccauggauaagaaauaauuuuguucaagcaccaggcggugaauuuacaguuucuccuagaaaugcaccaggagaaauccuauggucugcaccucuaggucccgaccuuaauccuuaucuaucacaucuagcaagaauguauaauggauacgcaggaggcuuugaaguacaaguaauacucgcaggaaaugcauuuacagcaggaaaaauuauauucgcagcaguuccuccaaacuuucccacugaaggccuaucaccaucacaaguaacaauguuuccacauauaauaguagauguaagacaauuagaaccaguacuuauaccacuaccagauguacgcaacaauuuuuaccauuauaaucaaucaaaugauagcacaauaaaauuaauagcaauguuauauacaccacuaagagcaaauaaugcaggugacgauguauucacgguaucaugccguguucuaacaagaccaucgccagauuucgauuuuauuuuuuuaguaccaccaacaguagaaucuagaacuaaaccuuuuacuguacccauauuaaccguagaagaaaugacaaauucaagauuuccaauaccauuagaaaaacuauuuacaggaccaagcucugcuuucgucguccaaccacaaaacggaagaugcacuaccgacggagucuuauuaggaaccacacaacuuaguccaguaaauauauguacguuuagaggagacguuacucauauaccaggaacaagaacauaucgaaugaaucuagcuagucaaaauuggaauaauuacgauccaacugaagaaauacccgccccacuugguacaccagauuucguagguaaaauacaagguauguuaacacaaacuacuaagggagacggauccacacgaggacacaaagcaacagucaguacugguucuguugauuuuacaccaaaauuaggaucaguacaauucgauacagauacaaauaaugaucucgaaacaggacaaaacacccgauuuacaccaguugggguuauacaagauggaucagcacaucguaaugaaccucagcaauggguacuaccagauuacucaggaagaacaguacauaacguacaucucgcaccagcaguagcaccaaccuuuccuggugaacaacuuuuauucuuuagaucuacaaugccuggauguucaggauacccaaauauggaccuugauugcuuacuaccccaagaauggguacaacacuuuuaucaagaagcugcuccagcacaaucagauguagcuuuauuacgauuuguuaauccugacacagguagaguacuauuugaauguaaacuacauaaaacuggauauguaacuguagcacauacaggucaacaugauuuaguaauacccccaaacggcuauuucagauucgauucauggguuaaucaauuuuauacccuagcgccaaugggcaauggagcaggccgaagaagagcccuauaa

SEQ ID NO: 32798 - RNA, 1620 nt, Artificial Sequence
  derived and/or modified sequence opt6 from capsid_protein__Norovirus__BAQ55216
augaaaauggcuucuaaugacgcaucaccaucagauggaucuacagcaaaucuaguaccagaaguaaauaaugaaguaauggcauuggaaccaguaguaggugcagccaucgcugccccaguagccggacaacagaaugucaucgacccauggauacgaaauaauuucguacaggcaccuggcggagaauucacaguaucaccaagaaaugcuccaggagaaauauuauggucagcaccacuuggaccugaucuuaauccauaccucucccacuuagcacgaauguauaacggcuaugcagguggauuugaaguacaaguaauauuagcaggcaaugcauuuacagcaggcaaaauaauauucgcagcaguuccccccaacuucccaacagaaggccuuuccccaucacaaauaaccauguuuccacauaucauaguagauguacgccaacuagaaccaguacugauaccacuaccugauguucguaauaauuuuuaccauuauaaucaaucaaacgauagcacuauaaaauuaauagcaaugcuauauacaccauuacgagcuaauaaugcuggagacgaugucuuuacuguaucaugcagaguacuaacuagaccaucaccugauuucgacuucauauuuuuaguaccaccaacaguugaaucaagaacaaaaccauuuacaguuccuaucuuaacaguagaagaaaugacaaauucaagauucccaauuccacucgaaaaauuauucacuggaccauccucugccuucguaguacaaccucaaaauggaagaugcacuacagauggcguacuauuaggaacaacucaacuaucaccaguaaauauauguacauuucgaggagacguaacacacauacccgguacaagaacuuauagaaugaacuuagcuucacaaaacuggaacaacuacgauccaaccgaagaaauacccgcuccacucggaacacccgauuucguaggaaaaauacaaggcauguuaacacaaacaacaaaaggcgauggaucaacacgaggacauaaagcuacuguaucaacagguucuguagauuucacaccaaaacuuggcucaguacaauuugacacagauacaaacaaugaucuagaaacaggacaaaacacuagauucacaccagucgguguaauucaagauggaucugcccacagaaaugaaccacaacaauggguauuacccgauuacuccgguagaacaguacauaauguccaccuugcaccagccguagcaccgacauuuccaggugaacaacuauuauucuuucgauccacaaugccaggauguucaggauacccaaauauggaccucgauugucuacuaccacaagaauggguccaacauuuuuaucaagaagcagcuccagcccaaucagauguagcucuauuaagauucguuaacccagacacaggaagaguucuguuugaaugcaaacuccauaaaacagguuauguuacaguagcacacacaggacaacacgauuuaguaauaccaccaaauggauacuucagauuugauucauggguaaaccaauuuuauacacuagcaccaaugggaaacggagcaggaagacgaagagcccuuuaa

SEQ ID NO: 32799 - RNA, 1620 nt, Artificial Sequence
  derived and/or modified sequence opt6 from capsid_protein__Norovirus__BAQ55217
augaaaauggcaucaaaugaugcuucaccaucagacgguucaacagcaaacuuaguacccgaaguaaauaaugaagucauggcauuagaaccagucguaggagcugcaauagcugcaccaguagcuggccaacaaaauguaauagacccauggauuagaaauaacuuuguccaagcuccaggcggugaauuuacagucucuccaagaaacgcaccaggagaaauauuauggucagccccuuuaggcccugauuuaaauccauauuuaucacacuuagcaagaauguacaaugguuaugcaggcggauuugaaguccaaguaauacuagccggaaacgcauucacagcuggaaaaauaauauuugcagcaguacccccaaauuucccaacagaaggcuuauccccaucccaaguaacaauguucccucauauaauaguagacguaagacaacuugaaccuguacuuauaccucuacccgacguacgaaauaauuuuuaccauuacaaucaaucuaacgauucaacaauuaaauuaauugcaauguuauauaccccauuaagagccaauaacgcaggagacgauguauuuacaguaucauguagaguacucacacguccuucuccugauuuugacuucauauuucuagucccaccaacaguugaaucaagaacaaaaccuuuuacaguaccaauacuaacaguagaagaaaugacaaauucaagauuuccuauuccacuugaaaaauuauucacagguccaucauccgcuuucguaguacagccacaaaacggaagauguaccacugauggcguacuacuuggaacaacucaauuaaguccaguaaauauaugcacguuuagaggagacguaacucauauauccggaacucauacauaucgaaugaauuuagcuucucaaaacuggaacaauuaugauccaacagaagaaauaccugcaccucuaggcaccccagauuucguaggaaaaauacaaggaaugcuaacacaaacaacaaaaggagacggaaguacaagaggacacaaagccacuguaucaacaggaucaguagauuucacuccuaaacuaggauccguucaauuugccacagauacuaacaaugauuucgaaacuggacaaaauaccagauuuacuccaguaggaguuauacaagauggcuccgcacauagaaaugaaccacaacaauggguauuaccugauuauucaggaaaaaccguccauaauguacaucuugcaccugcugucgcaccuacauuuccaggagaacaacuacuguuuuucagauccacaaugccagguuguuccgguuauccuaauauggacuuagacugucuacuaccucaagaauggguacaacauuuuuaucaagaagcugcaccugcacaauccgacguagcuuuacuaagauuuguaaaucccgacacuggaagagucuuauucgaaugcaaacuccauaaaacaggcuacguaacaguagcucauaccggacaacaugaccuaguaauaccaccaaacgguuauuuucgauuugacuccuggguaaaccaauuuuauacacuagcaccaaugggaaacggagcaggaagacgacgugcacuauaa

SEQ ID NO: 32800 - RNA, 1623 nt, Artificial Sequence
  derived and/or modified sequence opt6 from capsid_protein__Norovirus__BAQ55218
augaaaauggcuucuaaugacgcuucuccaucagauggaucaacugcaaacuuaguaccugaaguuaauaaugaagucauggcuuuagaaccaguuguaggagcagcaaucgcagcuccagucgcaggacaacaaaaugucaucgacccauggauaagaaacaauuuuguacaagcaccuggaggagaauuuacuguaucaccuagaaaugcuccuggagagauuuuauggucagcuccacuaggaccagaucuaaauccauacuuaucacacuuagcccgaauguacaauggcuacgcaggaggcuuugaaguacaaguaauacucgcaggaaaugcauuuacagcuggaaaaauaauuuuugcagcaguaccacccaauuucccaaccgaaggcuuaucuccaucucaaguuaccauguucccucacauaauaguagacguaagacaauuagaaccaguacucauaccacuaccagauguacgcaauaauuucuaucauuauaaucaaucuaaugauucaacaauaaaacuaauugcaauguuauauacuccccuaagagcaaacaacgccggugacgauguauuuacagucuccugucguguacuaaccagaccuucaccagauuuugauuuuaucuuucuaguaccuccaacaguagaaucaagaacuaaacccuuuacaguccccauacuaacaguagaagaaaugacaaauucaagauuuccuaucccauuagaaaaacuauuuacaggaccauccucugcauuuguaguccaaccacaaaacggaagauguacaacugacgguguacuacuagguacaacucaauuauccccuguaaacauauguacauucagaggugauguuacacauauacccaauacacauacauacagaaugaaccucgcuucccaaaauuggaacaauuaugaucccaccgaagaaauaccagccccacuagguacaccugacuuugucggaaaaauucaaggaauguuaacacaaacaacuaaaggagauggaucaacaagaggucauaaagcuacaguauccaccggaucaguagauuucacaccaaaacuuggcagcguccaauuuacaacagauacagauaacgauuucgaaacaggacaaaacaccagauuuacuccaguaggaguaauacaagacggaaauggagcucacagaaaugaaccacaacaaugggucuuaccagacuauucuggaggaaccguacauaacguacacuuggcuccagcagucgcccccacauuuccuggugaacaacuauuauucuucagaucaacaaugcccgguugcucaggauauccaaauauggauuuagacuguuuauuaccacaagaauggguacaacauuucuaucaagaagcagcaccagcacaaucagacguagcucuauuaagauuuguuaauccagacacuggaagaguacuauuugaaugcaaacuacacaaaaccgguuacguaacaguugcccacacuggccaacaugaucuaguaauuccaccaaauggauacuuuagauuugauuccuggguaaaucaauuuuacacacuagcaccuaugggcaauggagcuggacguagaagagcauuauaa

SEQ ID NO: 32801 - RNA, 1623 nt, Artificial Sequence
  derived and/or modified sequence opt6 from capsid_protein__Norovirus__BAR47396
augaaaauggcaucaaaugaugccaauccaucagauggauccgcagcuaacuuagucccagaaguaaauaacgaaguaauggcccuagaaccaguaguaggagccgcuauagcagcaccaguagcaggacaacaaaacguuauugaccccuggauacgaaacaacuuuguacaagcuccaggaggagaauuuaccguaucaccaagaaacgcacccggagaaauacucuggucugcaccauuagguccagacuuaaauccauaucuaucacauuuagccagaauguauaacggauaugccggaggauucgaagugcaaguaauauuagcaggaaacgccuuuacagcugguaaaauaauuuucgcagcaguucccccaaacuuucccacagaaggauuaucaccuucacagguaacaauguucccacacauuauaguugacgucagacaauuagaaccaguauuaauuccacucccagaugucagaaauaauuucuaccauuacaaucaaucaaaugacagcacaauuaaauuaauagcuaugcuauacaccccauuaagagccaauaacgcaggugaagauguauuuaccgucaguuguagaguacuaacaaggccaucaccagacuuugacuucauauuucuaguaccaccuaccguugaaucaaggacaaaaccauucacaguaccaauacuaacaguagaagagaugacaaacucacguuucccaaucccauuagaaaaacuauuuacuggaccaucuggagcauucguuguacaaccacaaaaugguagauguacaacugauggaguuuuauuaggaacuacacaauuaucaccaguaaauauuuguacuuucagaggugauguaacccacauagcuggcagucgaaauuacacaaugaaucuugcaagucuuaacuggaauaauuaugauccaacugaagaaauaccagccccacuuggaacaccugacuuuguaggaaaaauucaaggcguauuaacacaaaccacaaaaggagauggaucaacucgaggucauaaagcaaccauauauacaggcucagcacccuuuacaccaaaauuagguucuguacaauuuuccacagauacagaaaacgauuucgaaacacaccaaaacacaaaauuuacaccaguaggcguaauucaagauggauccacuacacacagaaaugaaccacaacaauggguacuuccauccuauucagguagaaauguacauaauguccaccuagccccugccguugcacccacauuucccggggaacaacuauuauucuuuagaucaaccaugccaggaugcucuggauauccaaauauggacuuagauugccucuuaccacaagaauggguucaacauuucuaucaagaagcagcacccgcacaaucugacguagcacuacuaagauuuguuaauccagacacuggacguguacuuuucgaauguaaauuacauaaaucaggauauguaacaguagcacauacagggcaacaugauuuagucaucccuccaaauggauauuuucgcuucgacucuuggguaaaucaauuuuacacauuagcuccaaugggaaauggcacaggaagacgacgagcauuauaa

SEQ ID NO: 32802 - RNA, 1623 nt, Artificial Sequence
  derived and/or modified sequence opt6 from capsid_protein__Norovirus__BAR47397
augaaaauggcaucuaaugacgcaaauccauccgauggauccgcugcaaacuuaguacccgaaguaaacaacgaaguaauggccuuagaaccaguuguaggagcagcuaucgccgcaccuguagcaggccaacaaaacgucaucgauccguggauacgaaacaacuuuguacaagcaccuggaggagaauucacaguaagcccucguaacgcaccuggcgaaauauuaugguccgcacccuuagguccagaucucaauccuuauuuaucucauuuagcacguauguauaacggauacgcagguggauucgaaguacaaguaauacuagcuggaaaugcauucacagcaggcaaaauaauauuugcagcuguaccacccaauuuccccacugaaggauuaucaccaagccaaguaacaauguucccccacauaauaguagacguucgacaacucgaacccguauuaauuccacuacccgauguaagaaauaauuuuuaccacuacaaccaaucaaacgacucuacaauuaaacuaauagcaaugcucuacacaccauuaagagcuaauaaugccggugaagauguauucacagucucauguagaguauuaacuagacccaguccagauuuugacuucauauuuuuaguuccaccaaccgucgaaucaagaacuaaaccauucacaguaccuauacuaacaguagaagaaaugacaaacucaagauuuccuauaccuuuagaaaaacuauuuacagguccaucaucagcauucguaguacaaccacaaaacggaagauguacaacagauggaguauuauuaggaacaacacaacuaucuccaguaaauauuuguacauuucgaggagacgucacucacauugccggaagcagaaauuauacaaugaaccuagcaucauuaaauuggaauaacuacgauccaacagaagaaaucccagccccauuaggcacaccagacuucguagguaaaauacagggaguauugacacaaaccacuaaaggcgauggauccaccagaggacauaaagcaacaguuuacaccggaucagcaccauuuacaccaaaauuaggcucaguacaauucucaacugauacagaaaacgacuucgaaacacaucaaaauacgaaauucacaccaguuggaguaauacaagacgguucaacuacacauagaaaugaaccucaacaauggguuuuacccucauauucagguagaaaugcucacaacguacauuuagcaccagcaguugcaccaacauucccaggagaacaacuacuauuuuucagaucaacaaugccaggaugcucagguuacccaaauauggacuuagacugucuuuuaccacaagaauggguacaacauuucuaucaagaagcagccccagcccaaucagacguagccuuauuacgauucguaaacccagauacuggacgaguauuauucgaauguaaauuacauaaaucaggauauguaacagucgcacacaccggacaacaugaccuaguaauaccccccaauggauacuuccgauucgauagcuggguaaaucaauuuuauacacucgcaccgaugggaaauggaacuggaagacgaagagcuuuauaa

SEQ ID NO: 32803 - RNA, 1623 nt, Artificial Sequence
  derived and/or modified sequence opt6 from capsid_protein__Norovirus__BAR47398
augaaaauggcuucaaaugaugcaucaccuucagauggauccgcugcaaaucucguaccagaaguaaacaaugaagucauggcacuggaaccaguagucggagcagcaauagccgccccuguagcaggccaacaaaacguuaucgacccauggauaagaaacaacuuuguacaagcaccaggcggugaauuuaccguaucuccuagaaaugcaccuggcgaaauacucuggucagcaccacuagguccagaucuaaauccuuaucuuagccaucuugcaagaauguauaaugguuaugcaggcggauucgaaguacaaguuauacuagcaggcaaugcauuuaccgcaggaaaaauaauuuuugcugccguaccccccaacuucccaacggaagguuuaucaccaucacaaguaaccauguucccacacauaauaguagacguaagacaacuagaaccaguacuaauaccauuaccugauguacgaaacaauuucuaucauuauaaucaauccaaugauucaaccauuaaacuaauugcaaugcuauauacuccauuaagagcaaacaaugcaggagaagauguauucacaguaucuugcagaguacuaacuagaccaucaccugauuucgauuucaucuuuuuaguuccaccaacagucgaaucccgaaccaaaccuuucacuguaccuauacuaaccguagaagaaaugacaaauucuagauuucccauaccacuagaaaaacuuuuuacuggacccucuggcgcauucguaguucaaccacaaaacggcagaugcaccacagauggaguauuauuagguacaacccaacuaucaccaguaaauauaugcacauuccgaggagaugucacccacauagcaggaucacgaaauuacacuaugaauuuagcugcauuaaacuggaacaauuaugauccuacagaagaaauaccagccccacuaggcacaccagacuuuguaggaaaaauucaaggaguacuaacucaaacaaccaaagcagacgguucaacaagaggccacaaagcaacuguauacaccggaucagcugacuuuacaccuaaacuaggaucuguccaauucuccacagauacagaaaacgacuuugaaacucaucaaaauacaaaauucacaccuguuggcguuauacaagacgguucaacaacacauagaaaugaaccacaacaauggguucuaccuucauacucaggucguaacguucauaauguucaccuagcaccagccguugcaccaacauuuccaggagaacaauuauuauucuucagaucuacaaugccuggauguuccggauauccaaacauggacuuagauugcuuauuaccucaagaauggguacaacauuuuuaucaagaagcagcaccagcacaaucagauguagcacucuuaagauuugucaacccugaccaaggaagaguccuauucgaauguaaacuccauaaaucaggcuauguaacaguagcacacacuggacaacacgaccuaguuaucccaccaaacggauacuuucgauuugacucauggguaaaucaauuuuacacuuuagcaccaaugggaaacggaacaggaagaagacgugcacuuuaa

SEQ ID NO: 32804 - RNA, 1623 nt, Artificial Sequence
  derived and/or modified sequence opt6 from capsid_protein__Norovirus__BAR47400
augaaaauggcaucaaaugaugcuaauccaucugacggaucagcugcuaaccuagucccagaaguaaacaaugaaguaauggcauuagaaccagucgucggagcagcaaucgcagcaccaguagcaggucaaacaaacguaauagacccauggauaagaaauaacuucguacaagcaccagguggagaauuuacaguaucaccacgaaaugcaccaggcgaaauucuauggucagcaccauuaggcccagaccuaaaucccuauuuaucacacuuagcuagaauguauaauggauacgcaggaggauucgaaguucaagucauuuuagccgguaaugccuucacagcaggaaaaaucauauucgccgccguccccccuaauuucccaaccgaagguuuaucaccaucacaaguaaccauguucccacacauaauaguagacguaagacaacuagaacccgucuuaauuccacuacccgacgucagaaacaauuucuaccacuauaaccaaucuaaugacucaacaauaaaacuaaucgcaauguuauauacacccuuaagagcuaacaacgcuggagaagauguauuuacaguaucaugucguguacucacaagaccaucaccagacuucgauuucauauuccucguaccacccacaguugaaucaagaacaaaaccauucacaguaccuauauuaacaguggaagaaaugacaaauuccagauuuccaauuccacuugaaaaacuuuucacaggcccuucaggagcauuuguaguacaaccacaaaauggaagauguacaacagacgguguauuacuaggcacaacacaacuaagucccgucaauauauguacuuuuagaggcgauguaacacacauagcagguucaagaaauuauacuaugaaccuugcaucucuuaacuggaauaauuacgauccaacagaagaaaucccagcuccauuagguacaccagacuucguuggaaaaauccaagguguauuaacacaaaccacaaaaggagacggaucaacaagaggucauaaagccacaguauauacaggaucagcacccuuuacaccaaaacugggaucaguacaauucucaacagacacugaaaacgauuuugaagcucaccaaaauacuaaauucacuccagucggaguuauacaagauggaucaacuacacaucgaaaugaaccacaacaauggguauuaccauccuacuccggaagaaauguucaaaauguacaccuagccccagccgucgcaccaacauuuccaggugaacaacuacuauucuuucgauccacaaugccaggauguucuggcuaccccaacauggaucuagacuguuuacuaccacaagaauggguacaacacuucuaucaagaagcagcacccgcacaaucugacguagcauuacuaagauucguaaacccagauacaggaagaguauuauucgaauguaaacuacauaaaucuggauacguaacaguagcacauacaggucaacaugauuuaguaaucccaccaaauggcuauuucagauuugauucauggguuaaucaauuuuacacucuagcaccaaugggaaacggaacaggacgaagacgugccuuauaa

SEQ ID NO: 32805 - RNA, 1623 nt, Artificial Sequence
  derived and/or modified sequence opt6 from capsid_protein__Norovirus__BAR47401
augaaaauggcuucaaacgaugcaaauccaagcgacggcucagcagcaaaccucguaccugaaguaaauaacgaaguuauggcuuuagaaccaguagucggcgccgcuauagcagcaccaguagccggacaacaaaacguaauagacccauggaucagaaacaauuuuguacaagcacccgguggagaauucacaguaucaccuagaaaugcaccaggugaaauauuauggucagcuccuuuaggacccgauuuaaaucccuaucucucacacuuagcacgaauguauaacggauaugcuggcggcuucgaaguacaaguaauacuagccggaaaugccuuuaccgcaggcaaaauaauauucgcugcaguaccaccgaacuuuccaacagaaggucuuucaccaagucaagucacuauguucccacauauaauaguagacguacgccaauuagaaccugucuuaauaccacuaccugacguucgaaauaacuuuuaucacuacaaucaaucaaaugacucuacuauaaaauuaauagcaaugcuauauacuccucuaagagcuaauaaugccggugaagauguauuuacagucucuugccgaguucucaccagaccaucaccagacuuugacuuuauauuuuuaguccccccuacaguagaaucuagaacaaaacccuuuacuguaccaacauuaacaguagaagaaaugacaaacucaagauucccaauaccauuagaaaaauuauuuaccggccccucaucagcauucguaguccaaccacaaaauggacgguguacaacugacggaguacucuuaggcacaacacaauuaucuccaguaaauauauguacauuucguggcgauguuacacauaucgcaggaucucgagacuacacaaugaaccucgcaucuuuaaauuggaauaacuaugacccaacugaagaaauaccagccccccuuggaacaccagauuuuguaggaaaaauacaagguguauuaacacaaacaacaaaaggagauggaaguacaagaggccauaaagccacaguauacacuggaucagcaccauucacacccaaauuaggcucaguaagauucagcaccgauacugaaaaugauuuugaaacucaccaaaauacuaaauucacucccguaggagucauucaggacggaaguacaacacaucgcaaugaaccccaacaauggguauuaccaucauacuccggcagagauguacauaauguacacuuagcuccagcaguagcaccuacauuuccaggagaacaacuauuauuuuuuagaucuacaaugccagguugcaguggauacccaaauauggauuuagauugcuuauuaccacaagaauggguacaacauuucuaccaagaagcagcaccagcacaaagugacguagcauuacuaagauuuguaaauccagauacaggcagaguuuuauucgaaugcaaacuacauaaaucugguuauguaacuguagcacacacuggccaacaugauuuaguuauacccccaaacggauauuucagauuugauucauggguaaaccaauuuuauacauuagcaccaaugggaaaugguacuggacguagacgagccuuauaa

SEQ ID NO: 32806 - RNA, 1623 nt, Artificial Sequence
  derived and/or modified sequence opt6 from capsid_protein__Norovirus__BAR47403
augaaaauggcaucaaacgacgcaaacccuucagauggaucugcagccaauuuaguacccgaaguaaacaacgaaguaauggcacuagaaccaguaguaggugcugccauagccgcacccguagcaggacaacaaaacguaauagacccauggauaaggaauaauuuuguacaagccccaggaggagaauuuaccguaucaccacgaaacgccccaggugaaauauuaugguccgccccccuaggaccagauuuaaauccauaccuaucccacuuagcacgaauguauaacggauacgccggaggauucgaaguacaaguaauauuagcuggaaacgcauuuacugcaggaaaaauuauauucgccgcaguaccaccaaauuuuccaacagaaggauuaucucccucacaaguaacaauguucccucacaucaucgucgacguacgucaacucgaaccaguuuuaauaccacuaccagauguaagaaacaauuuuuaucauuauaaucaaucuaaugauucaacaauuaaacucauagccaugcuauacacaccauuacgagcaaacaaugcaggagaagauguauucaccguauccugcagaguacuuacaagacccuccccagauuuugauuuuauauuucuaguacccccaaccgucgaauccagaacaaagccauuuacaguacccauacuaacuguugaagaaaugacaaacucacgauuuccaauaccacuugaaaaacuauucacuggacccucuuccgcauuuguaguacaaccacaaaacggcagauguacaacagauggaguucuuuuaggaacuacacaacucucaccaguaaacauauguacuuuucggggugacguaacacauauagccggaaguagaaauuacacaaugaaucuagcaucucuaaacuggaauaacuacgauccaacagaagaaauaccagcacccuuaggaacuccugauuuuguaggaaaaauacaaggaguauuaacacaaacaacaaaaggagauggaucuacacgaggacauaaagcuacaauauauacgggaagugccccuuuuacaccaaaauuaggauccguacaauucucaacagauacagaaaacgauuuugaaacccaucaaaauaccaaauucacaccaguuggcguaauacaagacgguggcacaacacauagaaacgaaccacaacaauggguuuuaccuucauacucaggacgagauguaccuaacguacacuuagcuccagccguugcaccuacuuuuccaggagaacaauuacucuuuuuuagaucaacaaugccuggaugcucuggauauccaaacauggaucuugauugccuucuaccccaagaauggguucaacauuucuaucaagaagcagcaccagcacaaucagacguagcucuauuaagauucguaaauccagauacaggucgaguauuauucgaaugcaaacuucacaaaucagguuauguaacugucgcacacacaggacaacaugaucuagucauaccacccaauggcuacuucagauucgauucuuggguaaaucaauuuuacacauuagcaccaaugggaaauggaacaggaagaagaagagcacuuuaa

SEQ ID NO: 32807 - RNA, 1623 nt, Artificial Sequence
  derived and/or modified sequence opt6 from capsid_protein__Norovirus__BAR47404
augaaaauggcuuccaacgacgcaaaccccuccgauggaagugcagcaaauuuaguaccagaaguaaacaacgaaguaauggcuuuagaaccaguaguaggagcugccauagcugcaccugucgcaggacaacaaaauguuauagacccauggauaagaaauaauuuuguucaagcccccggaggagaauucacaguaucaccaagaaacgcuccuggcgaaaucuuauggucugcaccuuuaggcccagaccuaaaccccuaucuaucucacuuagccagaauguauaacgguuaugcaggaggauucgaaguucaaguuauacuugcuggaaaugcauuuacugcuggaaaaauaauuuucgcagccguaccuccaaauuuucccacagaaggacuaucaccaucccaaguaacaauguucccccacauaauaguugauguacgacaauuagaaccuguacuaauaccuuuaccagauguacguaauaauuuuuaucacuacaaucaaucaaaugacucaacuauaaaauuaaucgcuaugcuuuacacgccauuaagagcaaacaaugccggagaagacgucuucacaguuucuugcagaguucuaacaagaccaucaccagauuuugauuucaucuucuuaguaccuccuacaguagaaucccgaacaaaaccauucacaguaccaauccuaacuguagaagaaaugacaaauucacgauuuccaauaccacucgaaaaacucuucacaggaccaucauccgcauucguaguccaaccacaaaauggacgcuguacaacugaugguguucuucuaggaacaacacaacuaucuccaguuaauauauguacauuuagaggugacguaacacauaucgcuggaucacgaaauuacacaaugaaucuagcaucacuaaacuggaacaacuaugauccaacugaagaaauucccgcuccuuuaggaacucccgauuucguuggaaaaauacaaggcguccugacacaaacaacaaaaggagauggaucuacuagaggacauaaagcaacuguauauacagguucugcacccuuuacuccaaaacuuggcucaguccaauucucaacagauacagaaaacgacuuugaaacacaucaaaacaccaaauucacaccaguaggaguuauucaagauggugguacaacacacagaaaugaaccacaacaauggguacuaccaaguuacucaggaagaaaugucccaaacguacacuuagcaccugcaguagcacccacauuuccuggagaacaacuauuauucuucagaucaaccaugccaggaugcuccggauacccaaauauggauuuagauugcuuacuaccacaagaauggguacaacauuucuaucaagaagccgcaccagcucaauccgacguagcacuauuaagauuuguaaauccagauacaggaagagucuuauucgaaugcaaacuccauaaaucaggcuacguaacaguagcacauacaggacaacaugaccucguaauaccccccaacggcuauuucagauuugacagcuggguuaaucaauucuacacucuagccccaaugggcaacggaacaggacgacguagagcauuauaa

SEQ ID NO: 32808 - RNA, 1623 nt, Artificial Sequence
  derived and/or modified sequence opt6 from capsid_protein__Norovirus__BAR47405
augaaaauggcaucaucugaugcuaacccauccgauggaucugcagcaaaccuuguuccagaaguaaauaaugaaguaauggcacuagaaccaguuguaggugcugcaauugcagcuccuguagcuggucaacaaaauguaauagauccauggauaagaaacaauuuuguccaagcacccggaggagaauuuacaguaucaccaagaaaugcaccaggcgaaauacuuuggucagcaccuuuaggacccgaucuaaacccauaucuaucucaccuagcaagaauguauaacggcuacgcaggaggauucgaaguacaaguaauauuagcuggcaaugcauuuacugcaggaaaaaucauauucgcagcaguacccccaaacuuuccaaccgaaggacuaucaccuucacaaguuaccauguuuccacauauaaucguagacguacgacagcucgaacccguauuaaucccuuuaccagauguuagaaauaacuucuaucacuauaaucaaagcaaugacucaacaauuaaacucauagcaauguuauauacaccuuuacgcgcuaacaaugcaggagaagaugucuuuacuguuuccuguagaguucugacaagaccauccccagauuuugacuuuauauuuuuaguacccccuacaguagaaucccgaacaaaacccuucacagucccaaucuuaacaguagaagaaaugaccaacucaagauuuccaauaccauuagaaaaacuauuuacaggaccaucaucagcauucguuguccaaccccaaaacggacgauguacaacagauggagucuuauuaggaacuacucaauuaaguccaguaaacaucugcacuuuucgaggugacguaacacauauagcaggaucaagaaauuacacaaugaauuuagcuucauuaaacuggaacaauuacgacccaacagaagaaaucccagcaccacuaggcacacccgacuuuguuggaaaaauccaaggaaugcuuacacaaacaacaaaaggagacgguuccacacgaggccauaaagcaacaguauauaccggaucaacaccuuuuacaccuaaacuugguucaguacaauucucaaccgacaccgaaaacgauuucgaaacacaucaaaacacuaaauuuacacccguaggaguaauccaagacggcucaacaacacaucgaaaugaaccacaacaauggguauuacccucauauaguggaagaaauguuccaaauguucaccucgcaccagcagucgcaccuacauuccccggagaacaacuauuauuuuuuagaucaacuaugcccggaugcucaggauauccaaauauggaucuagauugccuauuaccacaagaauggguacaacauuucuaucaagaagccgcaccagcacaaucugacguugcacuauuacguuuuguaaauccagacacaggacguguucuuuucgaaugcaaacuucauaaauccggcuauguuacuguagcacacacaggacaacacgaccucguuaucccgccaaauggauauuucagauucgauuccugggucaaucaauuuuauacacuagcaccuauggguaauggaacaggccguagaagagcauuauaa

SEQ ID NO: 32809 - RNA, 1623 nt, Artificial Sequence
  derived and/or modified sequence opt6 from capsid_protein__Norovirus__BAR47406
augaaaauggcaucaaaugacgcaaacccaucagacggauccgcagcaaacuuaguuccugaaguuaauaacgaaguaauggcacucgaaccagucguaggugcagcaauugcugccccaguugcaggucaacaaaauguaauugacccauggauaagaaacaacuuuguccaagcaccaggaggcgaauucaccguuucaccacgaaaugcaccaggagaaauauuauggucagcaccacuaggcccagaucuaaauccauaccuuucacacuuagcccguauguauaauggauacgcuggaggauucgaaguacaaguaauauuagccggaaaugccuuuacagcaggaaaaauuauauucgcagcaguaccaccaaauuuucccacugaaggacucuccccaagccaaguaacgauguucccacacauaauaguugacgucagacaacuugaaccaguauuaauaccauuaccagauguaagaaacaauuucuaucacuauaaucaaucuaaugacucaacaauaaaauuaauagcuaugcuuuacacaccauuaagagcaaacaacgcuggagaagauguauucacaguaucuugucgcguccuaaccagaccaaguccugauuuugacuucauauuucuuguucccccuacaguagaaucaagaacaaaaccauuuacaguuccaauacuaaccguagaagaaaugacuaauucuagauuucccauaccauuagaaaaacucuucacuggccccuccucagcauucgugguccaaccucaaaacgggagauguacaacagacgguguauuauuaggaacaacacaacuaucaccaguaaauauaugcacauuuagaggagacguuacccacauagcaggcucuagaaauuacacaaugaaccuagcuucuuuaaauuggaauaacuaugauccaacagaagaaauaccagcaccacuaggaacaccagauuucguugguaaaauacaaggaguauuaacacagacuacaaaaggagacggcucgacaagaggacauaaagccacaguauacacaggauccgcuccauuuaccccaaaacucggaucuguacaauucggaacagacacagaaaacgauuuugaaacccaucaaaauacaaaauucacgccaguaggaguaauccaagauggagguacuacucauagaaacgaaccacaacaauggguauuaccaucauauucuggaagaaauguacccaauguacaucuagcaccugcaguagcaccaacuuuuccaggagaacaauuauuauuuuuucgcucuacuaugccaggaugcucuggcuauccuaauauggauuuagacugucuacuaccucaagaauggguacaacacuuuuaucaagaagcagcaccagcucaaucagauguagcauuacuaagauucguaaauccugacacaggaagaguauuauucgaaugcaaacuacacaaaucaggauacguaacaguagcucauacuggccaacacgauuuaguaauaccaccaaacggcuauuuucgauuugauuccuggguaaaccaauuuuauacacuugcaccaaugggaaauggaacagguagaagaagagcacuauaa

SEQ ID NO: 32810 - RNA, 1623 nt, Artificial Sequence
  derived and/or modified sequence opt6 from capsid_protein__Norovirus__BAR47407
augaaaauggcuucaucagaugcaaacccuucagacggauccgcugccaacuuaguaccugaaguaaacaaugaaguaauggcuuuagaaccaguuguuggagccgcuauagcagcaccaguagcaggacaacaaaauguaaucgacccauggauaagaaacaauuucguccaagcaccaggaggagaauucaccguaucaccccgaaaugccccaggagaaauacuuuggucagcaccacuagguccagaccuaaaucccuaucuaucacacuuagcccgaauguacaauggauaugcuggagguuucgaaguucaaguaauauuagcaggaaacgcuuuuacugcugguaaaauaauauuugcagcuguaccacccaauuuuccuacagagggucuaucuccaucacaagucacaauguuuccacacauaauagucgacguaagacaacuugaaccaguauuaauaccuuuaccagauguacgcaauaauuucuaucauuauaaucaaucaaaugauucaacaauaaaauuaaucgccaugcuauacaccccacuaagagcaaauaaugcaggagaagauguauucaccguaucauguagaguacuaacaagaccauccccugauuucgauuuuaucuuuuuaguaccaccaacaguagaaucacgaacaaaaccauucacaguccccauacuaacaguagaagaaaugaccaacucuagauuuccuauacccuuagaaaaacuauucacaggaccuagcucagcauucgucguacaaccucaaaacggacgauguacaacugauggaguauuacuuggaacaacacaauuaucaccaguaaacaucugcacauucagaggagacguuacacacauagcaggcucagguaacuauacaaugaacuuagcuucaguaaacuggaacaauuacgauccaacagaagaaauuccagcaccuuuaggcacaccagacuucguaggaaaaauacaaggaaugcuaacacaaacaacuaaaggagacggaucgacacgaggucacaaagcaaccguauauacaggauccgcaccauuuacaccuaaauuagguucgguacaauuuucaacagauaccgaaaacgauuucgaaacacaccaaaauaccaaauucacuccaguaggaguaauccaagacggaaauacaacacaucgcaaugaaccacaacaauggguacuaccauccuauucaggaagaaaugucccuaauguacauuuagcacccgcaguagcacccacauuccccggugaacaauuacuauucuuucgaucaacaaugccagguuguucuggauauccaaauauggauuuagacugcuuauuaccucaagaauggguucaacauuucuaucaagaagccgcaccagcacaaucagauguugccuuacuuagauucguaaacccugauacugguagaguacuauucgaauguaaauuacacaaaucuggauauguuacagucgcacauacaggccaacacgaucuuguuauaccaccaaauggcuauuucagauucgauucauggguaaaucaauucuacacacucgcaccaaugggaaauggaacaggcagacgcagagcucuauaa

SEQ ID NO: 32811 - RNA, 1623 nt, Artificial Sequence
  derived and/or modified sequence opt6 from capsid_protein__Norovirus__BAR47408
augaaaauggcuagcaaugacgcaaacccauccgacggaucagccgcaaaccuaguaccugaaguaaacaacgaaguaauggcauuagaaccuguaguaggagcugcaaucgcagccccaguugcaggccaacaaaaugucauugauccauggauaaaaaauaauuuuguccaagcaccaggcggggaauuuacaguauccccaagaaaugcacccggagaaauccucuggucagcaccauuaggaccagauuuaaauccauacuuaucucacuuagcaagaauguauaacggcuacgcaggaggauucgaaguacaaguaauccuugcaggaaaugcuuucacugcuggaaaaauaauauucgcagcaguaccaccaaacuucccaacugaaggauuaucucccucacaaguuaccauguucccacauauaaucguagauguuagacaacuagaaccuguacuaauuccacuaccagauguaagaaacaacuucuaucacuauaaccaauccaacgauucaacuauuaaauuaauagcaauguuauacacacccuuaagagcaaacaacgcaggagaagauguauuuacagucucuugucgaguuuuaacccgcccaucccccgacuuugauuuuauauuucuagucccaccaacaguagaaucucgaacaaaaccauucacuguuccaaucuuaacaguagaagaaaugacaaauagcagauuuccaauaccauuagaaaaacuauuuacgggaccaucaggagcuuucguaguccaaccacaaaacggaagaugcaccacagacggcgucuuauuaggaacuacacaauuaucaccaguaaauauaugcacauuccgaggagacgucacacauauagcaggaucaagaaauuauacaaugaaccuagcagcauuaaacuggaauaauuacgaccccacagaagaaauuccagcaccacuagguacaccagauuucgucggcaaaauccaaggagucuuaacccaaacaacaaaaggugacggaucuacaagaggccauaaagcuacugucuauacaggaagugcagauuuuacaccaaaacuaggaucaguacaauucucaacugauacagaaaaugauuucgaaacucaucaaaauacuaaauucacaccaguagggguaauacaagacggaucaacaacacauagaaacgaaccacaacaauggguuuuaccuuccuauucuggaagaaacguacauaacguacacuuagcaccagcagucgcaccuacuuucccaggagaacaacuauuauucuucagauccacuaugccagguugcucagguuaccccaauauggaccuagauuguuuauuaccacaagaauggguacaacacuucuaucaagaagcagcaccagcacaaucugauguugcccuauuaagauuuguaaacccagauacaggaagaguauuauucgaauguaaacuucauaaaucagguuauguaacuguagcucacacuggccaacacgaucuaguaauaccaccuaauggauacuuucguuuugauucauggguaaaucaauucuauacacuagccccaaugggcaauggcacaggaagacgacgagcauuauaa

SEQ ID NO: 32812 - RNA, 1623 nt, Artificial Sequence
  derived and/or modified sequence opt6 from capsid_protein__Norovirus__BAR47410
augaaaauggcaaguaaugacgcaaauccaucagacggaucagcagcaaacuuaguaccagaaguaaacaaugaagucauggcacucgaaccagucgucggagcagcaauagccgcaccagucgcuggacaacaaaauguaaucgauccauggauacgaaauaauuuuguccaagccccaggaggugaguuuacaguauccccacgaaaugcaccuggagaaauacuauggucugcuccacuagguccagaucuuaacccauaucuaucccacuuagccagaauguauaacgguuacgcuggaggauucgaaguccaaguaauacucgccggaaaugccuuuacagcagguaaaauaauauucgccgccguaccacccaacuucccaacagaaggauugucacccagucaaguuacaauguucccacacauuauaguagauguuagacaacuagaaccaguauuaauaccacuacccgacguaagaaauaauuuuuaccacuauaaccaaucaaaugacuccacaauaaaacuuauagcaaugcuauacacuccauuaagagcuaacaaugcaggagaagauguauucacagucuccuguagaguuuuaacuagaccaucaccagacuuugauuucauauucuuaguaccacccacugucgaauccagaacuaaaccauuuaccguaccaauacuaacaguagaagaaaugacaaauucucgauuccccauaccauuagaaaaacucuuuacaggaccaucaucagccuucguuguacaaccacaaaacggacgcuguaccacagacggcguacuucuagguacaacacaauuaucacccguaaauauaugcacauucagaggagaugugacacauauagcaggaucacgaaacuacacaaugaaccuagcaucacuuaauuggaacaacuaugauccaacagaagaaaucccagcaccacuaggcacaccagacuucguaggaaaaauacaaggcauguuaacacaaacaacaaaaggagacggauccacacguggccauaaagcaaccguauauacaggaucagcaccauucacuccuaaauuaggauccguacaauucgaaacagauacugaaaaugauuucgaaacacaccaaaauacuaaauucaccccaguaggaguuauccaagauggaggcacuacacauagaaacgaaccacaacaguggguucuaccuucauauuccgguagaaauguaccaaauguacacuuagcaccagcaguagcaccaacauuuccaggagaacaacuccuguuuuuuagaucaacgaugcccggaugcucagguuauccaaauauggaccuugauugucuuuuaccacaagaauggguucaacauuucuaucaagaagccgcucccgcacaaagugacguugcauuacuuagguuugucaaccccgacacaggacgcguauuauuugaauguaaacuacauaaaucaggcuauguuacaguagcucacacaggacaacacgaucuaguaauaccuccuaacggauauuuuagauuugauucauggguaaaucaauucuauacauuagcaccaaugggaaacggcacaggacgaagacgagcauuauaa

SEQ ID NO: 32813 - RNA, 1623 nt, Artificial Sequence
  derived and/or modified sequence opt6 from capsid_protein__Norovirus__BAR47412
augaaaauggcaucuagugaugcaaaucccucagaugguucagcagcaaaucuagugccagagguuaauaaugaaguaauggcucuagaaccaguaguaggugcagccauagcagcuccuguagcaggacaacaaaauguaauagacccauggauacguaauaacuucguacaagcaccaggaggagaauucacaguaucaccaagaaacgcaccaggagaaauauuauggucugcaccacucggaccugauuuaaauccauaccuuucacaucuagcuagaauguacaacggauacgcaggaggcuucgaaguacaaguaauauuagccggaaaugcauuuacagcaggaaaaguaauauuugcagcaguaccaccaaauuucccaacagaaggacucucuccaucccaaguuacaauguuuccccauauaguaguagacguuagacaauuagaaccuguauuaauaccacuuccugauguacgaaacaacuuuuaucauuauaaccaauccaaugauccuacaauaaaacuuauugcaaugcuauacacaccauuacgagcgaacaaugcaggggaugauguauucacaguaucauguagaguauuaacaaggccaucaccagauuucgauuucauauuucuaguaccaccaacaguagaaucaagaacaaaaccauucuccguaccuguauuaacaguagaagaaaugacaaauuccagauuuccaaucccacuagaaaaacuguucacaggaccuucaucagcauucguaguacaaccccaaaacgguagauguacaacagacggaguauuauuaggaacaacacaacuauccccaguaaauauaugcacauuuagaggugauguaacccacauaacaggaucacgaaacuauacaaugaaccuagcuucccaaaauuggaauaauuacgaccccaccgaagaaauaccagcaccacuaggaacaccugauuuuguaggaaaaauacaaggagucuuaacacaaacaacccguacagauggaucaacaagaggccauaaagcaacuguauacacagguucagcagauuucgcacccaaauuaggacgaauucaauuugaaaccgacacagaucacgacuucgaagcuaaccaaaauacaaaauuuacacccguuggaguuauccaagauggaggaacuacacaucgaaaugaaccucaacaauggguucuaccaucauacucuggaagaaauacacacaauguccauuuagcuccagcaguagcuccaacauucccuggugaacaauuacuauuuuuucgaucaacaaugcccggauguagcggauauccaaacauggaucuugauugucuacuaccacaagaauggguacaauauuuuuaccaagaagcagcaccagcacaaucagaugucgcucuacuccguuuuguuaauccugauacuggaagaguccuauucgaaugcaaauuacauaaaucuggauacguaacagucgcucauacagggcaacaugaucuaguaaucccucccaacggguacuucagauucgacuccuggguaaaucaauuuuauacuuuagcacccaugggaaaugguaccggaagacgaagaguagcauaa

SEQ ID NO: 32814 - RNA, 1623 nt, Artificial Sequence
  derived and/or modified sequence opt6 from capsid_protein__Norovirus__BAR47413
augaaaauggcauccucagaugcaaacccuucugacgguagugcggccaacuuagucccagaaguaaacaaugaaguaauggccuuagaaccaguaguaggggcagcuauagccgcaccaguagcuggccaacaaaauguaauagauccuuggaucagaaauaauuuuguucaagcacccggaggagaauuuacaguuagcccaagaaaugccccaggagaaauacucuggucugcaccauuagguccagaccuaaacccauacuuaucucacuuagcaagaauguauaaugguuacgccggaggcuucgaaguccaaguaauacuugcaggaaacgcauuuacugcaggaaaaguaauauuugcagcaguacccccgaauuuuccaaccgaaggcuuaucaccaucacaaguaacaauguucccacauauagucguagacguaagacaauuagaaccaguucuaauaccauuaccagacguaagaaacaauuuuuaucauuauaaccaaucaaaugacccuacaauaaaauuaauugcaauguuauacacuccacuaagagcuaacaacgcaggagaugaugucuuuaccguaucaugucgcguacuaacaagaccaucaccagauuuugauuuuauauuccuaguaccacccacuguagaaucuagaacaaaaccauucucuguaccuguauuaacaguagaagaaaugacaaacucaagauuuccaauacccuuagaaaaacuauuuacaggaccaucuagugcauuuguaguccaaccccaaaauggucgcuguacuacagacggaguacuacuaggaacuacacaacuauccccugucaauauauguaccuuucgaggcgaugucacacauauaaccggaaguagaaauuauacaaugaauuuagcuucacaaaacuggaacaauuacgaucccacagaagaaauaccagcaccucuaggaacaccagacuuuguaggaaaaauucaaggaguacuaacucaaacaaccagaaccgacggaucaaccagaggccauaaagcaacaguauauacaggaucagcggauuucgcacccaaacuaggaagaauacaauucgaaacagacacagaucaugauuuugaagcaaaucaaaauacaaaauucacaccaguagguguaauccaagacggaggaacaacucauagaaacgaaccacaacaauggaugcuuccuucauacucaggaagaaacacucauaauguucaccucgcaccagccgucgcaccaacauuuccaggagaacaacuacuauuuuuucgcucaacuaugccaggauguuccggauauccaaacauggacuuagacugccuauuaccacaagaauggguucaauauuuuuaucaagaagccgcuccagcccaaucagacguagcacuuuuacgauuuguaaacccagauacuggaagaguacuauuugaaugcaaacuacacaaauccgguuauguaacuguagcacauaccggacaacaugaucucguaauaccaccaaacggauacuuucguuuugauucauggguaaaucaauuuuauacacuagcaccaaugggaaaugguacuggaagaagacgaguagcauga

SEQ ID NO: 32815 - RNA, 1623 nt, Artificial Sequence
  derived and/or modified sequence opt6 from capsid_protein__Norovirus__BAR47414
augaaaauggcaucaucagacgcaaaucccucugacggaucugcagcuaauuuagucccugaaguaaacaacgaaguaauggcacuagaaccagucguaggugcagcaauagccgcacccguagcuggacaacaaaacguaauagauccguggauacgaaauaacuucguucaagcaccaggaggagaauucacaguauccccaaggaaugcaccuggagaaauacuauggucagcaccucucggcccagauuuaaacccauauuuaucucauuuagcacgaauguacaauggauacgcagguggauucgaaguacaaguaauacuagcagguaaugcauuuacagcagguaaaguaauauucgcagcuguaccaccaaauuuuccuacugaaggacuaaguccuucacaaguaaccauguucccacacaucguaguugacguaagacaacuagagccaguacuaauaccccuaccagacguaagaaauaauuucuaucacuauaaccaauccaacgauccuacuauaaaauuaauagcaaugcuauauacaccauuaagagcaaacaacgcaggagaugauguauuuacugucucuuguagaguuuuaacucgcccaucaccagauuuugacuucauauuucuuguuccuccaacaguagaaucucgaacaaaaccuuuuuccgucccuguauuaacaguagaagaaaugacaaacucaagauucccaauuccauuagaaaaauuauuuaccggcccaucaagcgcuuucguuguacaaccacaaaacgguagaugcaccacagauggaguauuacuaggaacaacccaauuaucaccuguaaacauaugcacauuucgcggcgauguaacacacauaacaggaucucgaaauuacaccaugaaccucgcaucucaaaacuggaacaacuacgauccuacagaagaaauaccugcaccauuaggaacacccgauuuuguagguaaaauacaagguguauuaacacagaccaccagaacagacgguucaaccaggggacauaaagcuacaguauauacaggcucagcagacuuugcaccaaaauuaggcagaauccaauuugaaacagauacagaccacgacuucgaagcaaaucaaaauacaaaauuuacuccaguaggaguuauacaagauggaggaacuacacauagaaaugaaccacaacaauggauguuacccucuuauucaggaagaaauacacacaacguacacuuagcaccagcaguagcaccaacauucccaggagaacaacuucuuuuuuuuagaucaacaaugccagguuguucaggcuaccccaacauggauuuagauugcuuacucccccaagaauggguccaauauuuuuaccaagaagcagcaccagcacaaucagauguagcauuacuuagauucguaaauccagacacaggacgcgucuuauucgaauguaaauuacauaaaucuggauacguaaccguugcucauacuggucaacacgaucucguaaucccaccaaaugguuacuucagauuugauuccuggguaaaccaauucuacacauuagcucccaugggcaacggaacaggacgccgacgagucgcauaa

SEQ ID NO: 32816 - RNA, 1623 nt, Artificial Sequence
  derived and/or modified sequence opt6 from capsid_protein__Norovirus__BAR47415
augaaaauggcuucuucagacgcaaacccaucagauggcuccgcagccaauuuaguaccagaaguaaacaacgaaguaauggcacuagaaccuguaguuggcgcagcuauagcagcaccuguagcaggacaacaaaacguaaucgacccauggauacgaaacaauuucguucaagcacccggaggggaauuuacaguuucgccaagaaaugcaccuggagaaauauuauggucugcaccauuagguccugauuuaaauccauauuuaucccaccuugcaagaauguauaacggauaugccggcggauuugaaguccaaguaauauuagcaggaaacgcuuuuaccgcaggaaaaguuaucuucgccgcaguaccaccuaacuuuccaacagaaggucuauccccuucacaagucacaauguuuccucauauagucguagacguaagacaauuagaaccaguauuaauucccuuaccugacguccgaaauaauuucuaccacuauaaccaaucaaaugauccuacaauuaaauuaauagcaaugcuauacacaccucuccgagcuaacaaugcaggagacgacguuuucaccguaaguugcagaguauuaacacgcccuucuccugauuucgauuuuauuuuucuagucccaccuacaguagaaucuagaacuaaaccuuucucaguaccaguacucaccguugaagaaaugacaaacuccagauucccaauaccauuagaaaaauuauuuaccggcccaucaucagcauuuguaguacaaccacaaaaugguagaugcaccacagauggaguacuacuaggaacaacacaauugucuccaguaaacauauguacauuuagaggagacguaacacacauaacaggaucuagaaauuauaccaugaauuuagcaucacaaaacuggaauaacuaugauccuacagaagaaauaccagcaccacuaggaacaccagacuuuguaggaaaaauacaagguguauuaacucaaacaacuagaacagacgguuccacuagaggacauaaagccacaguauauacaggaucagcagacuuugcuccaaaauuaggccgaauacaauuugaaacugacacagaucaugauuuugaagcuaaccaaaauacaaaauuuaccccaguaggcguaauccaagacggcgguacaacacauaggaacgaaccucaacaauggaugcuaccauccuauucagguagaaacacccauaacguucaucuagcaccagcgguagccccuacauuuccuggagaacaacucuuauucuuccgaucuacaaugccagguugcucaggauauccaaauauggaccuagacugcuuacucccucaagaauggguacaauauuuuuaucaagaagcugcaccagcacaaucagauguugcauuacuaagauucguuaacccugauacuggaagaguauuauucgaauguaaauuacauaaaucaggauacguaacaguagcacacacaggacaacaugauuuaguuauaccaccuaauggauauuuuagauucgauucauggguaaaucaauuuuacacucuagcuccgaugggcaaugguacuggacgaaggagaguagcauaa

SEQ ID NO: 32817 - RNA, 1623 nt, Artificial Sequence
  derived and/or modified sequence opt6 from capsid_protein__Norovirus__BAR47417
augaaaauggcuucaucagacgcaaacccaagcgauggaucagcugcaaaccucguaccagaaguaaauaaugaaguaauggcacuugaaccaguaguaggagccgcaauagccgcaccuguagcaggacaacaaaauguaauugacccauggauacgaaauaauuucguccaagccccaggaggugaauucacaguaucaccacguaaugccccaggcgaaauacuauggucugcacccuuaggaccagacuuaaacccauauuuaucucacuuagccagaauguacaauggauaugcuggaggauucgaaguacaaguaauacuugccggaaaugcauuuacugcuggaaaagucauauucgcagcaguaccaccaaacuuuccaacagaaggucuaucaccaucucaaguaaccauguuuccccacauaguaguugauguaagacaacuagaaccaguacucauaccacuaccagauguaagaaauaacuucuaccacuauaaccaaucaaaugaccccaccauaaaauuaauagcuaugcuauacacaccacuccgugcaaacaacgcaggagaugauguuuuuacuguaucaugcagaguacucacacgaccaucaccagacuucgauuucauuuuccuaguuccuccaacagucgaaucccgaacuaaacccuuuucaguuccaguuuuaacuguugaagaaaugacuaauucaagguuuccaauaccccuagaaaaacuauuuacaggaccaucgucagcuuucguaguacaaccacagaacgguagauguacaacagacggcguacuucucggaacaacacaauuaucaccuguaaauauauguaccuucagaggagacguaacccauauaaccggaucaagaaauuacacaaugaaccuagcuucacaaaacuggaacaacuacgauccuacagaagaaauacccgcuccacuaggaacuccagacuucgucggaaaaauacaagguguacucacacaaacaacaagaacagacggauccacaagaggacauaaagcaacaguuuacacagguuccgcagauuucgcaccaaaauuaggacgaguacaauucgaaacagauaccgaucaugauuucgaagcaaaucaaaauacuaaauucacaccuguugguguaauacaagacgguucuacaacacauagaaaugaaccacaacaauggguauuaccaucuuacucagguagaaacacacacaacguacaccucgcaccagccguagcuccaacauuucccggugaacaacuauuauucuuuagaucaacaaugccaggaugcucaggauauccaaauauggaucuagauugccuacuaccacaagaauggguacaauacuucuaccaagaagcagcaccugcucaaucagaugucgcccuacuaagauuuguaaauccagacacuggccgagucuuauuugaaugcaaacuccauaaaucaggauaugucacaguagcacauacaggacaacacgacuuaguaauaccuccuaauggauauuucagauuugauucaugggucaaucaauucuacacauuagcaccaauggguaacgguacaggccgaagaagagccguauaa

SEQ ID NO: 32818 - RNA, 1623 nt, Artificial Sequence
  derived and/or modified sequence opt6 from capsid_protein__Norovirus__BAR47418
augaaaauggcaucaucagaugcaaacccuccagacgguuccgcagcaaaucucgucccagaaguuaauaaugaaguaauggcacuagaaccaguagucggagcagcaauagccgccccaguagcuggacaacaaaauguaauagacccuuggauuagaaauaacuuuguacaagcaccaggaggagaauuuacuguaucacccagaaacgcaccaggagaaauauuauggucugcaccauuaggaccugacuuaaacccauaucuaucacaucuagcaagaauguauaacgguuacgcuggagguuuugaaguacaaguaauuuuagcagguaaugcauuuacagcuggaaaagucauauucgcugcaguuccaccaaauuuucccacagaaggauuaucaccaucacaaguaacaauguucccccacauuguaguugacgugcgacaacuagaaccaguauuaaucccucuacccgauguaagaaauaauuucuaccauuauaaucaaucaaaugauccaacaauaaaacuaauagcuauguuauacacaccccuccgagcuaauaacgccggagacgauguauuuacaguaagcuguagaguauuaaccagaccauccccugauuuugacuuuaucuuucuaguuccuccuacaguagaaucacgaacaaaaccauuuaguguaccugucuuaacaguagaagaaaugacaaauucaagauuccccauaccauuagaaaaacuauuuaccggaccaucaucagcauucguuguacaaccacaaaacggacgauguacuacagacggaguacucuuagguacaacccaauuaucuccaguaaauauaugcacauuccgaggagaugucacacacauaacaggaucacacaauuacacaaugaaucuagcaucgcaaaacuggaacaauuacgauccaaccgaagaaauacccgcacccuuaggaacuccagacuuuguuggaaaaauacaaggaguauuaacucaaacaacaagaacagacggaucaaccagaggacauaaagcaacaguauauacaggcucagcugacuuugcaccaaaauuaggacgaguacaauuugaaacugauacaaaccaugauuucgaagcaaaucaaaauacaaaauuuacaccuguuggagucauacaagacggaggaacaacucacagaaaugaaccucaacaauggguacuaccaucuuacagcggaagaaauacacauaauguacacuuagcaccugcaguugcacccaccuuuccaggagaacaacugcuauuuuuuagaagcacaaugccaggaugcucagguuaucccaauauggaccuagauuguuuauuaccacaagaauggguacaauauuucuaccaagaagccgcucccgcucaaucagacguagcucuauuaagauucguaaauccugacacaggaagaguacucuucgaaugcaaacuacauaaaucagguuauguaacaguagcacauacaggacaacacgauuuaguaaucccuccaaacggauauuuuagauuugauucguggguaaaucaauuuuacacacucgcuccaaugggcaauggaacaggcagaagacgagcaguauaa

SEQ ID NO: 32819 - RNA, 1623 nt, Artificial Sequence
  derived and/or modified sequence opt6 from capsid_protein__Norovirus__BAR47421
augaaaauggcuucaucagaugcuaauccaucugacgguucagcagcuaauuuaguaccagagguuaacaaugaaguaauggcauuagaaccaguaguaggagcagcuaucgccgcccccguagccggacaacaaaacguaauagacccauggauaagaaauaacuuuguacaagcaccaggaggggaauuuacaguaucuccacguaaugcaccaggagaaauacuauggucagcaccauuaggaccugauuuaaaccccuauuuaucacauuuagcaagaauguauaacggauaugcaggagguuuugaaguucaagucauacuagcagguaaugcauuuaccgcaggaaagguaauauuugcugcaguaccuccaaacuuuccuacagaagguuuaucgccaucacagguaaccauguucccucauauaguaguagacguaagacaacuagaaccaguauuaauuccacuaccagacguacgaaacaauuucuaucauuauaaucaaucaaaugauccaacaaucaaacuaauagcaauguuauauacaccauuacgagcaaacaaugcaggcgaugacguauuuacaguuagcugucgaguauuaacacgaccaucaccagacuuugacuuuauauuucuaguccccccuacuguagaaucaagaacaaaaccauucucaguuccuguacuuacaguagaagaaaugacuaacucaagauucccaauaccauuagaaaaacuuuuuacaggucccagcuccgcauucguaguacaaccucaaaauggaagguguacaacagaugguguuuuacuuggaacaacucaauuaucaccaguaaauauauguacauuucgaggagauguaacacauauuacaggaagcagaaauuauacuaugaaucuagcaucacaaaauuggucaaauuaugacccaacugaagaaaucccagcaccauuagggacuccagauuuuguagguaaaauucaagguguucuaacacaaacaacaagaacagaugggucaacuagaggacauaaagcuacugucuauacaggcuccgcagacuuugccccaaaacuaggacgaguacaauucgaaaccgacacugaccaugauuuugaagcaaaucaaaauacaaaauucacaccuguaggaguaauacaagauggaggaacuacacauagaaaugaaccucaacaauggguacucccaaguuauucuggaagaaauacucauaacguucauuuagcacccgcaguagcacccacuuucccaggagaacaacuauuauuuuuuagaucaaccaugccaggaugcucagguuacccaaauauggaucuagauugucuacuaccccaagaauggguacaauauuucuaucaagaagcagcaccugcccaaucagacguagcccuacuuagauucguuaauccagacacaggaagaguuuuauucgaaugcaaacuucauaaaucaggauaugucacaguagcccauacaggacaacacgauuuaguaauuccaccaaauggcuauuucagauucgacaguugggucaaccaauucuauacauuagcuccaaugggaaauggaacaggaagaagaagagccguauaa

SEQ ID NO: 32820 - RNA, 1623 nt, Artificial Sequence
  derived and/or modified sequence opt6 from capsid_protein__Norovirus__BAR47422
augaaaauggcuagcucagacgcuaacccaucugacggaucagcugcaaaccuaguaccagaaguaaacaaugaaguaauggcuuuagaacccguaguuggagcagcuauugcagcaccaguagcaggacaacaaaauguaauagacccauggauucgaaauaauuucguacaagcuccuggcggagaauuuacaguaucaccaagaaaugcucccggagaaauucuuuggucagcaccacuagguccagaucuaaacccauauuuaucucaucuagcucgcauguauaauggauaugcaggaggauucgaaguacaaguuauucuagcuggcaaugcuuuuacagcuggaaaaguaaucuucgcagcuguaccuccaaauuuuccuacagaaggauuaaguccaucacaaguaacuauguucccacacauugucguagauguaagacaguuagaaccaguacuuauaccccuaccagacguaagaaauaauuuuuaccauuacaaucaaucaaaugauccaacaauaaaauuaauugcaaugcuauacacaccucuacgagcaaacaaugcaggcgacgauguauuuacaguaucuugucgcguacuaacaagaccuaguccagauuuugauuuuauuuuuuuaguaccaccaacaguugaaucaagaaccaaaccuuucuccguuccaguauuaacaguagaagaaaugacaaauuccagauuucccauucccuuagaaaaauuauuuacaggaccaucaucagcauuuguaguccaaccacaaaacggaagauguacaacagacggcguacuacuaggaacuacacaacuuuccccugucaacauauguacuuuuagaggagacguaacucacauaacaggaucaagaaauuacacaaugaacuuagcuucacaaaacuggucuaacuacgauccaaccgaagaaauuccagcaccauugggaacuccagacuucgucggcaaaauacaagggguacuaacacaaacaacucgaacagacggauccacacgaggacauaaagcaacagucuacaccgguucagcagacuucgcaccaaaacuaggaagaguacaauucgaaacagauacagauagagauuuugaagcaaaucaaaacacaaaauuuacaccugucggaguaauacaagacggaggaacaacacauagaaaugaaccgcaacaguggguacucccuucauauaguggaagaaacaccccaaauguacaucuagcuccugcaguagcaccuacauuuccaggagaacaauuacuauucuucagaucaacaaugccaggcugcuccggauacccaaauauggauuuagauugccuuuuaccacaagaauggguacaguacuuuuaucaagaagcugcaccagcccaaucagauguagcauuacuucgauucguuaauccugauacuggcagaguacucuucgaaugcaaauugcauaaaagugguuauguaacaguugcacauacaggacaacaugaucuaguaauaccaccaaauggauauuuuagauuugauagcuggguuaaucaauuuuauacacucgcaccaaugggaaacggaacagggcgcagaagagcauuauaa

SEQ ID NO: 32821 - RNA, 1623 nt, Artificial Sequence
  derived and/or modified sequence opt6 from capsid_protein__Norovirus__BAR47423
augaaaauggcaaguucagacgccaacccuucagaugguucagccgcaaauuuaguaccagaaguaaauaacgaaguuauggcacucgaaccaguuguuggagcagcaauagcagcaccuguugcaggccaacaaaacguaauagauccuuggauuagaaauaacuucguacaagcaccaggcggcgaauuuacuguuucaccacgcaaugcuccaggugaaauacuauggucugccccacuaggaccagauuuaaauccauaucuaucucauuuagcacguauguauaauggauaugcaggagguuucgaaguacaaguaauacuggccgguaacgcuuucacggcaggaaaaguuauauuugcagcaguaccuccaaacuuuccaacagaaggccuuucaccaucacaaguuacuauguucccacauauagugguagauguacgacaauuagaaccaguauuaauuccuuuaccagacgucagaaauaacuuuuaccauuauaaucaaucaaaugauccaacaauaaaauuaauugcaaugcuuuacacaccuuuacgagcuaacaaugcuggagaugacguauucacaguaucaugucgaguacuaacuagaccauccccagauuucgauuuuauauuuuuaguaccaccaacaguagaaucaagaacaaaaccauuuucuguuccaguauuaacaguugaagaaaugacaaacucaagauucccaauaccacuagaaaaacuauuuacaggaccaucauccgcauucgucguacaaccacaaaacggaagaugcacaacagauggaguccuacuaggaacaacacaauuaucuccaguaaacauauguacauuuagaggugauguaacccacauaacaggaaguagaaauuauacaaugaaccuagccucccaaaacuggaauaauuaugauccuacagaagaaauaccagcuccacuagguacuccugacuuuguaggaaaaauucaaggaguuuuaacacaaacaacuagaacagauggauccacuagaggucacaaagcaacaguauauacugguucagcugauuuugcaccaaaauuaggaagaguacaauucgaaacagauacagaucgagauuucgaagcaaaccaaaacacaaaguucacccccguuggaguaauacaagacgguggcacaacacauagaaaugaaccacaacaaugggucuuaccauccuacucugguagaaauacaccaaauguacaucuagcucccgcaguagcaccaacuuuuccaggagaacaacuuuuguucuuuaggucaacuaugccaggauguucaggauacccuaacauggaccuagauugucuacuaccacaagaauggguacaauauuuuuaccaagaagcagcaccagcacaaucugauguagcccuccucagauuuguuaauccugauacuggcagaguauuauucgaauguaaauuacacaaaucaggauacgcaacaguagcacauacaggacaacacgauuuagucauuccaccaaaugguuacuuucgauuugauucauggguuaaucaauuuuauacauuagcuccuaugggaaauggcaccggcagaagaagagcacuauaa

SEQ ID NO: 32822 - RNA, 1623 nt, Artificial Sequence
  derived and/or modified sequence opt6 from capsid_protein__Norovirus__BAR47424
augaaaauggcuucuucagaugcuaacccuucagauggaucugcagcaaauuuaguaccagaagugaacaacgaaguaauggcuuuagaaccaguaguaggagcugcaauagcugcuccuguagcaggucaacaaaauguaauagacccauggauaagaaauaauuuuguccaagcaccaggaggagaauuuacaguaucaccucgaaacgcaccuggagaaauuuuauggucagcaccacuagguccagauuuaaacccuuaccuaucacauuuagccagaauguacaauggauacgcaggugguuuugaaguucaagucauauuagcagguaaugcuuuuacugccggaaaagucauauuugcagcuguaccaccaaacuucccaacagaaggucuaucucccucacaaguaaccauguuuccacacauaguaguagacguuagacaauuagaaccaguacuaauaccccuaccagauguucgaaacaauuuuuaucacuauaaucaaucaaaugacccaacaauaaaacuuauagccaugcuauauacaccacuaagagcaaauaacgcaggagacgacguuuuuacuguaucuuguagaguacuaacaagaccaaguccagacuucgacuucauauucuuaguucccccaacaguagaaucaaggacaaaaccguuuucaguuccuguucuaaccguugaagaaaugacaaacagccgauuucccauaccuuuagaaaaacuauuuacaggaccaucuagugcauucguaguucaaccacaaaacggacgauguaccacagaugguguauuauuaggaacuacacaauuaucaccagucaauauuugcacuuuucguggagauguaacucauauaacugguucgagaaauuauacuaugaaucuagccucucaaaacuggaauaauuacgaccccacagaagaaauaccagcaccauuaggaacaccagacuuugucggaaaaauucaagguguucuaacacaaaccacaagaacagauggauccacuagaggacauaaagcaacuguauauacuggaucugcagacuucgcuccaaaauuaggacgaguacaauuugaaacagauacagaucaugauuuugaagccaaccaaaacacaaaauucacaccuguaggaguaauccaagaugguggcacaacacaucgaaaugaaccacaacaaugggucuuaccaucuuauucaggccguaauacacacaauguucaucuugcaccagcagucgcucccacuuuuccaggcgaacaacuauuauuuuuuagaaguacaaugccugguuguucagguuauccaaauauggaucuagauuguuuacucccacaagaauggguucaauacuuuuaccaagaagcugcaccagcacaaucagauguugcacuauuaagauucguaaauccagacacaggacgaguuuuauuugaauguaaacuacauaaaucaggauauguuacaguagcacauacuggacaacacgaucuugucauacccccuaaugguuauuucagauuugacucauggguaaaucaauuuuauacauuagcaccuaugggaaauggcaccggacgucgucgcgcaguauaa

SEQ ID NO: 32823 - RNA, 1623 nt, Artificial Sequence
  derived and/or modified sequence opt6 from capsid_protein__Norovirus__BAR47426
augaaaauggcaucauccgaugcaaguccaucagauggaucagcagcaaaucuagucccagaagucaacaacgaaguaauggcucuugaacccguuguaggcgcugcaauugcagcuccaguagcaggacaacaaaacguaauagacccuuggauccgaaauaauuuuguacaagcaccaggcggagaauuuacaguuucuccaagaaaugcccccggagaaauauuauggucugcuccauuaggaccagaucuaaacccauacuuaucacaccuugcaagaauguauaacggauacgcuggaggauuugaaguccaaguuauucuugcaggaaacgcauucaccgcagguaaaguaauuuucgcagcaguuccuccaaauuuuccaacugaaggucuauccccaucucaaguuacaauguucccacacauaguaguagacguucgccaacucgaaccaguacuaauuccucuucccgauguccgaaauaauuuuuaucauuauaaccaaucaaaugaccccacaauaaaauuaauagccauguuauacacaccccuacgagcaaacaacgcaggagacgauguauuuaccguaucauguagaguccugacaagaccuucaccagacuucgacuuuauauuuuuaguaccacccacaguagaaucccguacaaaaccuuuuucaguaccaguacuuacuguugaagaaaugacuaauucccgauucccaauaccauuagaaaaacuauuuacaggcccaucaucagccuucguaguacaaccacaaaacgguagauguaccacagacggaguauuauuaggcacaacacaauuaucaccuguaaauauaugcacauucagaggggauguaacacacauaacaggaucaagaaauuauaccaugaauuuagcaucucaaaacuggucaaauuaugauccaaccgaagaaauaccugcuccuuuaggaacuccugacuucgucggaaaaauucaaggcguacuaacucaaacaacacgcacagauggaucuacucgaggacacaaagcaacaguuuauacagguagugcagauuuugcacccaaacuaggcagaguccaauucgaaacagacaccgaucacgauuuugaagcuaaucaaaauacaaaauuuacaccaguaggaguaauacaagaugguggaacaacacacagaaaugaaccacaacaauggguccucccaucauauucaggaagaaacacaccaaacguccacuuagcuccagcaguagcuccaacuuuuccaggagaacaauuauuauucuuucgaucaacaaugccaggcuguucuggauauccaaacauggaccuagauugccuacuuccacaagaauggguucaauauuuuuaucaagaagcagccccagcacaguccgacguggcauuauuaagauucguuaauccugauacuggaagaguauuauuugaauguaaauuacauaaaucaggauauguaacaguagcacacacuggacaacacgauuuagugauaccacccaauggauauuuuagauucgauagcuggguuaaucaauucuacacuuuagcaccaaugggcaacggcacagggagaagaagagcacuauaa

SEQ ID NO: 32824 - RNA, 1623 nt, Artificial Sequence
  derived and/or modified sequence opt6 from capsid_protein__Norovirus__BAS53731
augaaaauggccucuaaugacgcaaauccuucugauggaucagcugcaaaccuaguaccagaaguaaauaaugaaguaauggcuuuagaacccguaguaggcgcagcaauagcagcacccgucgcaggacaacaaaacguaauagacccauggauaagaaauaacuuuguccaagccccgggaggagaauuuacaguaucaccuagaaacgccccuggagaaauacuaugguccgcaccccuaggaccagaucuaaaucccuaccuaucucauuuagccagaauguauaacggcuacgcaggcggauucgaaguacaaguaauacuagcuggaaaugcauucacagcaggaaaaauaaucuucgcagcaguucccccaaacuuuccaacagaagguuuaucaccaucacagguaacuauguuuccacauauuauaguagacguaaggcaacuagaaccaguacuaauaccauuaccugauguaagaaauaauuucuaucacuacaaucaguccaaugacuccacuauaaaacuuaucgcaauguuauacacuccauuaagagccaacaacgcaggagaagacgucuucacaguaucauguagaguauuaacuagaccaucaccagauuuugauuucauauuucuaguaccaccaacaguagaauccagaacuaaaccuuuuacagucccaauauuaacaguagaagaaaugacaaauucacguuuccccauuccauuagaaaaacuauuuaccggaccauccucagcauuuguaguacaaccacaaaauggaagaugcacaacagacgguguacuauuaggaaccacacaauuaucuccuguaaacauauguaccuuucgaggagacguaacacauauagcagguucaagaaauuauacaaugaaucuagcaucuuuaaacuggaauaacuaugauccaacugaagaaauaccagcaccauuaggaacaccagauuuuguaggaaaaauacaaggaguccuaacacaaacaacuaaaggagacggaucaacaagaggacacaaagcaaccguauauacaggaucagcaccauuuacuccaaaauuaggaucaguacaauuuucaacagacacagaaaacgauuuugaaacacaccaaaauacgaaauucacuccaguaggaguaauacaagacggaggcaccacacauagaaaugaaccucaacaauggguauuaccuucauauucuggaaggaauguacccaacguacacuuagcccccgcaguagcaccuacauuuccaggagaacaauuauuauuuuuccgaucaaccaugccagguuguucagguuauccuaauauggaucuagacugucuuuuaccacaagaauggguacaacauuucuaucaagaagcugcuccagcccaaagugauguagcacuauuaagauucguaaacccagauacuggaagaguauuguucgaauguaaauuacacaaaaguggguaugucacaguagcacacacuggacaacaugauuuaguaauaccaccuaacgguuauuuccguuucgauucuugggucaaccaauucuacacacuagcacccauggguaauggaacaggaagaagaagagcacuauaa

SEQ ID NO: 32825 - RNA, 1623 nt, Artificial Sequence
  derived and/or modified sequence opt6 from capsid_protein__Norovirus__BAS53732
augaaaauggcuucuaaugaugcaaaccccuccgacgguucagcagcuaacuuaguaccagaaguuaacaaugaaguuauggcucuagaacccguaguuggcgcagcaauugcagcaccaguagcaggccaacaaaacgucauugacccauggauacgaaauaauuuuguacaagcacccggaggugaauuuaccgucucaccacgaaaugcccccggagaaauauuauggucagcacccuuaggaccagaucuaaauccauauuuaucccaccuugcaagaauguauaauggauacgcuggaggauucgaaguacaaguaauacucgcaggaaaugcuuucacagcuggaaaaauuauauuugcagcaguaccuccaaacuucccaaccgaaggcuuaucaccaucacaaguuacaauguuuccacacauaauugucgacgucagacaacuagaaccugugcuaauucccuuaccugacguaagaaauaacuuuuaucauuauaaccaaucuaacgacucaacaauaaaauuaauugcuauguuauacacuccacuccgagcuaauaaugccggcgaugauguauuuacaguaucaugcagaguauuaacuagaccaucaccagauuucgacuuuaucuucuuaguuccacccaccguugaaucuagagcuaaaccauucaccguaccaauauuaacugucgaagaaaugacaaacucaagauucccaauaccauuagaaaaauuauuuacaggaccaucaucagcauucgucguccaaccacaaaaugguagauguaccacugaugguguccuacuaggaaccacccaacuuucaccuguaaauaucuguacauuucgaggugacguuacacacauagcaggcucuagaaacuauacaaugaaucucgcuucacuaaauuggaacaacuacgauccaacagaagaaauaccagcuccacuagguacaccagauuuuguagguaaaauacaaggaguauuaacccaaaccacuaaaggagacggaucaacaagaggucacaaagccacuguauauacaggaucugccgacuuuacaccuaaauuaggaucuguacaauucgguaccgauacagaaaaugauuuugaaacccaucaaaauaccaaauucaccccaguaggaguuauacaagauggaggaacaacucauagaaaugaaccucaacaauggguuuuaccaucauauucaggaagaaauguccauaauguacacuuagcuccagccguagccccuaacuuuccaggagaacaauuauuauucuuuagaucuacaaugccaggcuguucaggauaucccaauauggaccuagauuguuuacuaccucaagaauggguucaacauuucuaccaagaagcagcaccugcucaaucugauguagcauuauuaagauuuguaaacccagauacaggacguguacuuuuugaaugcaaauuacauaaaucaggcuaugucacaguugcucauacaggacaacaugacuuaguaauuccuccaaauggauauuuccgauucgauucauggguaaaucaauucuacacacucgcaccuaugggcaaugguacaggaagaagacgagcacuauaa

SEQ ID NO: 32826 - RNA, 1623 nt, Artificial Sequence
  derived and/or modified sequence opt6 from capsid_protein__Norovirus__BAS53733
augaaaauggcaucaaaugaugcaaacccaucagacggaucugccgcaaacuuaguaccagaagucaacaacgaaguaauggcucuagaaccaguaguaggagcagcaaucgcagcacccguugcuggacaacaaaacguaauagauccauggauuagaaacaacuuuguacaagcuccaggaggagaauuuacuguuagcccucgaaaugccccaggcgaaauacuauggucagcaccauuaggaccagacuuaaauccauauuuaucccaucuagcaagaauguauaacggauacgcuggaggauucgaaguacaaguaauacucgcagguaacgcauuuaccgcagguaaaauaauauuugcagccguaccaccuaacuucccuauagaaggacuauccccaucgcaaguuacaauguuuccacacauaauaguagacguaagacaacuagaacccguacuuauuccacuaccagacguaagaaauaacuucuaccauuauaaccaaucuaacgacucaacaauaaaacuuauagcaauguuauauacaccauuaagagcaaauaaugcaggugaugaugucuuuacaguuucuugcagaguucuaacaagaccaagcccugacuuugacuuuauauuuuuaguaccaccaacagucgaauccagaacuaaaccauucacuguaccaauauuaacaguagaagaaaugacaaacucaagauucccaauaccccuagaaaaauuauuuacaggaccaucaucagcauucguaguacaaccacaaaauggacgaugcacaacagauggagucuuacuaggaacaacacaacuaagucccguaaauauaugcacauuuagaggugacguuacacauauagcagguucaagaaauuacacaaugaaucuagcaucauuauccuggaacaauuacgauccaacugaagaaauaccugcaccacuuggaacaccagacuucguaggaaaaauccaaggaguauuaacacaaacaacaaaaggagacggcuccacucgaggacacaaagcaacaguauauacuggcucagcgcccuucacucccaaacuaggaucaguccaauucuccacagauacagaaaacgauuucgaaacacaucaaaauacaaaauucacaccaguaggggucauacaagacggaggcacaacacaucguaacgaaccacaacaaugggucuuaccaucauauucugguagaaaugucccaaacguucaccuagcaccagcuguggcaccaacuuucccaggagaacaacuacuauuuuuuagaucaaccaugccagguugcucaggauaucccaauauggacuuagacugcuuauuaccacaagaauggguacaacacuuuuaucaagaagccgcacccgcccaaucugacguagcuuuauuaagauucguaaacccagauacaggaagaguacuauucgaaugcaaacuacacaaaucaggauacguuacagucgcacacacuggacaacaugaucucguuauaccacccaauggauacuuccgauucgauuccugggucaaccaauuuuauacacucgcuccaaugggcaauggaacuggacgcagaagagcucuauaa

SEQ ID NO: 32827 - RNA, 1623 nt, Artificial Sequence
  derived and/or modified sequence opt6 from capsid_protein__Norovirus__BAS53734
augaaaauggcaucaaaugacgcuaacccgucagacggaucagcagcaaacuuaguaccagaaguaaauaaugaagugauggcacuagaaccaguaguaggugcagcaauagcagcaccaguagcaggacaacaaaacguaauagacccuuggauaagaaauaacuuuguacaagcaccagguggugaauuuacuguaucacccagaaaugccccaggagaaauuuuauggucagcaccucuugguccagaucuuaaucccuaucuaucccacuuagcacgcauguauaauggauaugcaggaggauuugaaguacaaguaauacucgccggaaaugccuuuaccgcuggaaaaaucauauuugcagcaguaccaccuaacuucccaacagaaggauuaucucccucacaagucacuauguuuccucacauuauaguagacguaagacaacuagaaccaguacuuauaccauuaccagacguacgaaacaacuuuuaccauuauaaccaaucaaaugauucaacaaucaaauuaauagcuaugcuauauacaccauuacgugccaauaacgcaggagaugaugucuuuacaguaucauguagaguauuaacucgcccaucaccagauuuugacuuuauauuucucguaccuccaacaguugaauccagaacaaaaccauuuaccguaccuaucuuaaccgucgaagaaaugacuaauagucgauuuccaauuccucuagaaaaacuauuuacaggacccucuucugccuucguuguacaaccucaaaauggaagauguacaacagauggaguauuauuaggaacaacccaacuuucaccaguuaauaucuguacauuucgaggagacguuacacauauagcaggcucacgaaacuacacaaugaauuuagcuucauuaaauuggaauaauuaugaucccacagaagaaauaccagcaccuuuaggaacacccgacuuuguagguaaaauccaagguguauuaacacaaacaacaaaaggugacggaucaacuagaggacauaaagcaacaguauauacaggcucagcagauuuuacaccuaaauuagguucaguacaauucggaacagauacagaaaaugauuuugaaacacaucaaaauacaaaauucacaccaguugguguaauacaagaugguucuacaacacaucgcaaugaaccacaacaauggguacucccuucauauucagguagaaauguucauaacguacacuuagcaccugcaguugcaccaaacuuuccaggagaacaguuucuauucuuucgcucaaccaugccaggaugcuccgguuauccaaacauggacuuagauugccuacuaccacaagaauggguacagcacuucuaucaagaagcagcucccgcacaaucagacguagcauuacuccgauucguaaauccagauacagguagaguacuauucgaauguaagcuacauaaaucaggauauguaacuguagcacacacaggucaacacgaucuaguaauaccaccaaauggauauuuccguuucgacucauggguuaaucaauuuuacacacuagcaccaaugggcaacggaacagguagaagaagagcguuauaa

SEQ ID NO: 32828 - RNA, 1623 nt, Artificial Sequence
  derived and/or modified sequence opt6 from capsid_protein__Norovirus__BAS53945
augaaaauggcuucaucagacgcuaacccauccgacggauccgcagcaaauuuaguucccgaaguaaacaacgaaguaauggcacuagaaccaguaguaggagcagcuauagccgcaccagucgcaggacaacaaaauguaauagaccccuggauaagaaacaacuucguacaagcuccuggcggugaauuuacaguauccccaagaaaugccccaggagaaauuuuauggucagcaccacuaggaccagaucuaaauccauaucuaucacaccuagccagaauguauaacggcuacgcagguggcuucgaaguucaaguaauacuagcaggaaaugcuuuuacagcuggaaaaauaauauucgcugcaguaccaccaaacuuuccaacagaaggauuaucuccuagccaagucacaauguucccccacauaauaguagacguccgccaacuagaaccaguccuuauaccacuaccagacguacgcaacaauuuuuaccauuacaaucaauccaaugacucaaccauaaaauuaauagcaaugcuauacacaccacuuagagcuaauaaugccggagaagacgucuuuacuguaucauguagaguacuaacaaccccaucaccagacuucgacuucauuuuccucguucccccaacagucgaaucuagaacaaaaccuuuuaccguaccaauauuaacaguagaagaaaugacaaacucacgauuucccauaccccucgaaaaacuauuuacuggaccaucauccgccuuuguaguacaaccacaaaauggaagauguacaacagacggaguauuacuuggaacaacucaauuaucaccugucaauauauguacuuuuagaggugacguaacccacauagccgguucucgcaauuacacaaugaaucuagcaagcuuaaauuggaauaacuacgauccaacugaagaaauaccagcaccuuuaggaacacccgacuuuguuggaaaaauacaaggaauguuaacacaaacuacuaaaggugacggaucaacuagaggccauaaagcuacaguauauacugguucagcuccauuuacaccaaaauuaggauccguacaauuuucaacagacacugaaaacgauuucgaaacucaucaaaauacaaaauuuacuccaguaggcguaauacaagacgguaacacaacacaucgaaacgaaccccaacaauggguucuuccaucauacucaggacgaaauguaccaaauguucaucucgcaccagcaguagcaccaacuuucccaggugaacaacuucuauuuuuuagaucaacuaugccugguuguuccggcuacccuaauauggaucuagauuguuuauuaccucaagaauggguucaacauuucuaucaagaagcagcuccugcucaaucagacgucgcauuacuaagauucguaaacccagacacaggacgaguccuuuucgaaugcaaacuacacaaaucaggcuauguaacuguugcucacaccggacaacacgaucuaguaauaccaccaaauggcuacuucagauucgacuccuggguaaaccaauuuuacacacuagcaccuaugggaaacggcacaggucguagaagagcacuauaa

SEQ ID NO: 32829 - RNA, 1632 nt, Artificial Sequence
  derived and/or modified sequence opt6 from capsid_protein__Norovirus__CAK22261
augaugauggccuccaaagaugcaucaccuucugcagauggagcaaacggugcaggacaauuaguaccugaaguaaauaaugccgaacccuuaccauuagacccaguagcaggagcaagcacagcacuagccacagcaggucaaguaaauaugauagaucccuggauauuuaacaauuucguucaggcaccucaaggagaauucacaauauccccaaauaacacgccuggugacauauuauucgaucuacaacucggaccacaccuaaauccauucuuagcccaucuuucacaaauguacaacggauggguaggaaacaugagaguucgcguaauauuagccggaaacgcauuuacagcagguaaaguaauaguaugcuguguaccacccgguuuccaaagcagaacauuaucaauagcccaagcaacauuauucccacauauaauagcagauguucgaacacuagaaccaauugaaauuccccucgaagacguaagaaauacacuauaucacacaaaugacaaccaaccuacaaugcgauuacuuugcaugcuauacacaccauuacgaacaggugguggauccggaggaacagaugcauuuguaguagccggaagaguucuaacaugcccuagcagugacuuuaacuuucuauucuuaguaccuccaacuguagaacaaaaaaccagacccuuuuccguaccaaauaucccacuacaauuacucucaaacuccagaguacccaaccuuauacaaucaaugguacuaucuccagaccaagcacaaaacguucaauuucaaaacggaagauguacaaccgacggacaacucuuagguacaacucccguaucagucucacaaauauuaaaauuucgagguaaaguauccgcuggaucacgcguaauaaauuuaacugaacuagauggaucacccuucuuagcuuucgaagcaccagcaccaacaggauucccagauuuaggaacuucagacuggcacguagaaauguccuuaaauucaaacucacaaucuaguggaaauccaauucuacuucgagacauacaaccaaauucuucagauuuuguaccccauuuaggaucaguugccgucaccacagcaauagauguagccggagacuauacaggaacaauacaauggacaucucaaccaucaaacguuacaccaguaccagauguaaacuuuuggacuauuccacaauacggauccaaccuagcagaagcaucacaacuagcaccaguuguauacccacccggauuuggugaagcaauagucuauuuuaugucaccaauaccaggcccaaauacagcacacaaaccaaaucuaguuccaugcuuauuaccacaagaauuuguaacccacuucguaucagaacaagccccaucaaugggugaagcagcuuuaguacauuauguagaucccgauacaaacagaaaccuaggagaauucaaacuuuauccagaaggauuuauaacaugcguaccaaacggcacaggaccacaacaacuuccacuuaauggaguauuugucuuugccuccuggguaucaagauuuuaucaacuaaaaccuguuggaacagcaucaucagcaagaggaagacuaggaguuagacgcuaa

SEQ ID NO: 32830 - RNA, 1671 nt, Artificial Sequence
  derived and/or modified sequence opt6 from capsid_protein__Norovirus__CAR95870
augaaaauggcaaguucagaugcagccccaucaacugauggagcaggaaaucuugucccagaaucacaacaagaaguauuaccauuagcaccaguagcaggcgcagcauuagcagcuccaguaguaggucaaaccaauauuauagauccauggauuaaagaaaauuucguucaagccccucaaggagaauuuacaguauccccaaaaaacucaccaggagaaauacuuguuaacuuagaauuaggaccgaaauugaacccuuauuuagaccaucuaucucgaauguacaauaguuacgcagguggaauugacguaaugguuguauuagcagguaaugcguucacugccgguaaagucuuaauagcagcaauaccacccaauuuuccaguagaaggaguaagcgcaagccaagccacucaauucccccacgucauaauagauguaagaacacuagacccaguccgauuaccacuaccagacguccguucaacauuuuuccauuauacuaacgauacagaacccaaaaugagacuuguuauaugguuauacaccccacuaagaacaaauggaucaggagacgacucauucacagucuccggacgaauacuuacacgaccaucccaagauuuugaauucgcauuccucauuccaccaacagucgaaacaaaaaccacaccauuuagcguuccaggauuuuccguccaagaaaugucaaauuccagauggccagcagccauaucugccauggucguaagaggaaacgaaccacaaguaguacaauuucaaaaugguagagcacaccuugauggcauguuauuaggaacuaccccgguaucaccaaacuacauagcuagcuauagagguauaucaacaggaaacucuagaucagcaagcucugaagccgaugaaagagcagucggaaguuuugacguauggguacgauuacaagaaccagauggucaaccauacgauauuuuuggaaaacaacccgcacccauaggcacaccagauuuuaaagccguaaucguaggauuugcagcuagaccauuaacaagcggaaguuaugcaaaugaagcuuacguaaacaccacugcaagcgauuaugcaccugcaacaggaaacaugagauuuacagugagaaacggagguaccggacacauaucagcuaauaaauauugggaauuuaaaaguuuuggaguagaaggugaaagacauacaaauauacaauaucaagaauacgaauuaccagauuacucaggacaaguagccucaaaccauaacuuagcuccaccaguagcaccaagaaugccaggagaaucucuucuacuauuucaaagcaacaugccaguuugggacgacggacauggugaaucaacuccaaaaaaaauacacugccuauugccacaagaauuuauaggacacuuuuuugauaaacaagccccuucuuuaggugaugcagcauuacucagauauguuaaccaagaaacuaacagaguacuauuugaauguaaauuauacagagacgguuacaucacuguagcagcaucaucuggucuacuagauuucccacuagaugguuuuuucagauuugauucauggguaucaagcuucuacauacuaucaccaguagguucugggcaaggaagacguggaagaguaagauuccaauaa

SEQ ID NO: 32831 - RNA, 1623 nt, Artificial Sequence
  derived and/or modified sequence opt6 from capsid_protein_VP1__Norovirus__ADB27914
augaaaauggcaucaaaugaugcaaauccaagcgauggaucugcugcaaaucuaguaccagaaguaaauaaugaaguuauggcauuagaaccuguuguaggugccgcaauugcagcaccaguugcaggucaacaaaacguaauugauccauggauaagaaauaauuuuguucaagcuccaggcggagaauuuacaguauccccacgaaaugcacccggagaaauucuauggucagcaccauuaggaccugauuuaaauccuuauuuaucacacuuagcuagaauguauaauggcuacgcagguggauuugaaguacaaguaauuuuagcaggaaacgcauuuacagccggcaaaauuauauucgcagcugucccaccaaacuuuccuacagaaggauuaucacccucucaaguuacuauguucccacacauaauuguagacguucgucaacuugaacccguacucauaccuuuaccugauguucguaauaauuuuuaucacuauaaucaaucaaaugacucaacaauaaaacuaauugcaaugcuauauacaccuuuaagagcaaauaaugcuggagacgacguuuucacaguaucuugccguguacuuacacguccauccccagauuuugacuuuauauuucuugucccuccaacaguagaauccagaacaaaaccuuucacaguaccaauacuaacagucgaagaaaugacaaauucacguuuuccaauuccauuagaaaaacucuuuacaggcccuucauccgcauucguaguucaaccucaaaacgguagaugcacaaccgaugguguacuuuuagguacaacacaauuaagcccaguaaacauauguacauuuagaggagauguaacucauauagccggaucucgaaauuauacaaugaacuuagcaucccuaaacuggaauaacuaugacccuacagaagaaauaccugcaccacugggaacuccagauuuuguaggaaaaauacaaggaguccuuacacaaacaacaaaaggggauggaucuaccagaggacacaaagcaacggucuacacgggaagugcugacuuuacuccaaaauuaggaucaguacaauuuggaaccgauacagaaaacgauuucgaaacccaccaaaacacaaaauuuacaccuguaggaguaauacaagaugguucaacaacccaucguaaugaaccccaacaauggguacuaccuuccuauucaggucgaaauguacauaacguacauuuagcacccgccgucgcuccuaauuuuccuggagaacaacuauuauuuuuucgaucuacaaugccuggaugcucaggauacccaaacauggaucuagauuguuuacuaccacaagaauggguacaacauuuuuaucaagaagcagcuccagcacaaucagauguagcacuauuaagauuuguuaacccagauaccggaagaguucuauuugaauguaaauuacauaaaucuggauacguaacuguugcacauacaggacaacaugauuuaguaauuccaccaaaugguuauuuuagauuugacuccuggguaaaccaauuuuauacucuagccccaaugggaaauggaaccggcagaagaagagcuuuauaa

SEQ ID NO: 32832 - RNA, 1623 nt, Artificial Sequence
  derived and/or modified sequence opt6 from capsid_protein_VP1__Norovirus__ADI45809
augaaaauggcaucuucagacgcaaauccauccgauggaucuacagccaaccuaguaccugaaguuaacaaugaaguaauggcuuuagaaccaguugucggcgccgcaauagccgcaccaguagcuggacaacaaaacguaauugacccauggauacgcaauaacuuuguucaagcaccuggaggagaauuuacaguuagcccacguaaugcaccaggagaaauccuauggucagcaccacuaggaccagaccuaaauccauaucuaucacacuuagcucgaauguauaauggcuaugcagguggauucgaaguacaaguaauacuagcaggcaaugcuuuuacugcaggaaaaauaauauucgcagcaguaccaccaaacuuuccaacagaaggacuaaguccaucucaaguuacuauguuuccacacauuauaguugauguaagacagcuagaaccaguacuuauaccauuaccugacguccgaaacaauuucuaucacuacaaccagucaaaugacccaacaauaaaacuaauagccauguuauauacaccacuaagagccaacaacgcaggagacgaugucuuuacagucucauguagaguuuuaacuagacccucaccugacuuugauuuuauauuucuaguaccacccacaguugaaaguagaacaaaaccuuucucuguaccaauccuaacuguugaagaaaugaccaacucaagauuuccaauuccacuagaaaaacuauuuacaggcccaucaucugcauucguaguacaaccccaaaauggaagauguaccacggacggcguguuauuaggaacaacucaacuaucuccagucaacauaugcacauuccgaggagacgucacacauauaacaggcucaagaaacuauacaaugaauuuagcaacacaaaacuggaacucauaugauccaacagaagaaauacccgcuccccuagguacccccgacuucguaggaaaaauucaaggaguuuuaacacaaacaacuagagcagacggaucaacaagaggacauaaagccacagucuacacgggcucugcagacuuuacacccaaauuaggaagaguacaauucgcaacugauacagauaaugauuucgaugcaaaccaaaacacaaaauuuacacccguaggaguaauacaagacggaaacacagcacacagaaaugaaccacaacaauggguauuaccaucuuacucaggaagaaacagccauaacguucacuuagcaccagcuguagccccuacauuuccaggagaacaacucuuauucuucagaucaacaaugccugguuguucaggauacccaaauauggaucucgauuguuuacuaccacaagaauggguucaauauuuuuaucaagaagccgcaccagcccaaucugacguagcauuacuuagauucguuaauccagauacaggccgaguauuauuugaauguaaacuacauaaaucugguuauguaacagucgcucacacaggacaacacgacuuaguaauuccaccaaaugguuauuucagauuugauucauggguuaaucaauucuauaccuuagcaccuaugggcaauggaacaggaagacgaagagcauuauaa

SEQ ID NO: 32833 - RNA, 1623 nt, Artificial Sequence
  derived and/or modified sequence opt6 from capsid_protein_VP1__Norovirus__ADI45810
augaaaauggcuuccucagacgcuaauccaagugacggaucaacagcaaaccucguaccagaaguaaacaaugaaguuauggcauuagaacccguaguaggagcagcaauagcugcaccuguugcuggacaacaaaacguaauagaccccuggauaagaaacaacuucguacaagcaccaggcggagaauuuacaguuucuccuagaaacgcaccuggcgaaauauuauggucagccccuuuaggaccagaucucaaccccuaucuuucacaccucgcaagaauguauaacggauacgccggaggauucgaaguacaaguaauacuagcaggcaaugccuuuacagcuggcaaaauaaucuucgcagccgucccacccaacuucccgacagaaggccuaucuccaucucaagugacaauguuuccacacauaauaguugauguaagacaauuagaaccaguauuaauaccacuaccagauguacguaacaacuucuaucauuauaaccaaaguaaugacccuacaaucaaauuaauagcaaugcuauacacaccacuaagagcaaauaaugcuggagaugauguauucaccguaucauguagaguucuaacacgcccaucaccugauuucgacuuuauauuuuuaguacccccaacgguagaaucucgaacaaaaccuuucucagucccaauauuaaccguugaagaaaugacaaacucuagauucccuauaccacuugaaaaacucuuuacuggcccaagcucagcauuuguuguacaaccccaaaacggaagaugcacaacagaugguguacuacuaggaacaacccaauuauccccaguaaauaucugcaccuuccgaggagaugucacacacauaacaggcucaagaaauuacacaaugaacuuagcaacucaaaacuggaacucauacgauccaacagaagaaauaccagcaccacuaggaacaccugauuuuguagguaaaauacaaggaguauuaacacaaacaacaagagcagacggaucuacuagaggacacaaagcaacaguauacacagguucagccgauuucgcaccuaaacuagguagaguacaauuugcuacagauacagauaacgauuucgaugcaaaucaaaauacuaaauuuacaccaguagguguaauccaagauggcgacacagcacauagaaacgaaccacaacaauggguacuaccaucuuauagcggaagaaauucacauaauguacacuuagcucccgcaguagcaccaacuuuuccaggcgaacaauuacuauucuucagaucaacaaugcccggaugcucaggauacccaaauauggacuuagauugccuuuugccacaagaauggguacaauauuuuuaucaagaagcagcaccagcacaaucagauguagcauuacucagguucgugaacccagacacaggccguguuuuauucgaaugcaaauuacauaaaucaggauauguaacaguugcacacacaggacaacaugaccucgucauaccacccaacggauacuucagauucgauucguggguuaaccaauucuauacacuagcuccaaugggaaauggcacaggaagaagacgagcacuauaa

SEQ ID NO: 32834 - RNA, 1623 nt, Artificial Sequence
  derived and/or modified sequence opt6 from capsid_protein_VP1__Norovirus__ADI45813
augaaaauggcaucaagugacgcaaaccccuccgacggcucuacagcuaaccucguaccagaagucaauaacgaaguuauggcauuagaaccaguagugggugccgcaauagcagcaccuguagcuggccaacaaaacguaauagacccuuggauaagaaacaacuuuguacaagcaccuggaggagaauuuacaguuucaccaagaaacgccccuggcgaaauauuauggucagcaccauuagggccugaccuuaacccauauuuaagucaucuugcacgaauguacaacggauacgcuggaggcuucgaaguacaaguaauccuagcaggaaaugcauuuacagcaggaaaaauaauuuucgcugcaguaccaccaaauuuuccaacagaaggacuaagucccucacaaguaacaauguuuccacauauaauaguagauguaagacaacuagaaccaguacuaauuccacuaccagauguucguaacaauuucuaucacuauaaucaaucaaacgacccuaccauaaaauuaauagcaauguuauacacacccuuacgagcuaacaacgcaggagacgauguauuuacagucucaugccgaguauuaacuagaccaucaccagacuuugauuuuaucuuucucguacccccaacuguagaaagcagaaccaaaccauuuucaguaccaauacuaacaguugaagaaaugacaaauucaagauuuccaauaccauuggaaaaacuauuuacagguccaucuucagccuucguuguacaaccacaaaaugguagauguacaacugauggaguauuguuaggaacuacacaacuaaguccaguaaauauauguaccuuuagaggagacguaacacauauagcaggauccagaaacuacacuaugaaccuagcuacacaaaacuggaauuccuacgauccaacagaagaaauuccagcaccucuaggcacaccagacuuugucggaaaaauucaagguguccuaacacaaacaacaagagccgauggaucaacuagagggcacaaagcgacaguuuauaccgguucagcagacuuugcacccaaauuagguagaguacaauuugcaacagauacagauaaugauuuugaugcaaaucaaaauacaaaauucacucccgucggaguuauucaagauggagauacagcacauagaaaugaaccacaacaauggguucuuccuucauauuccgguagaaauucacacaacguacaccuugcaccagcaguagcaccaacauucccaggagaacaacuauuauuuuuucgaucaacaaugccaggaugcucaggauaccccaacauggacuuagauuguuuacuaccucaagaauggguacaauacuucuaccaagaagccgcaccagcccaaagugacguagcauuacuaagauucguaaauccagauacaggacguguauuauucgaaugcaaacuacauaaaucaggauauguaacugucgcccauacaggacaacacgauuuaguaauuccuccaaauggauauuuccgauucgacaguugggucaaucaauuuuacacucucgcacccaugggcaacggaacagguagacgacgugcacuauaa

SEQ ID NO: 32835 - RNA, 1608 nt, Artificial Sequence
  derived and/or modified sequence opt6 from capsid_protein_VP1__Norovirus__ADT70684
augaaaauggccucaaacgacgccgccccaucaaacgacggagcugcuggauuaguuccagaagugaauaacgaaaccauggcccuugaaccaguugcaggagcauccauagcagcaccacucacaggacaaaacaauguaauagacccauggauaagauuaaauuucguacaagcacccaacggcgaauucacaguaucaccuagaaauucaccuggagaagucuuacuaaauuuagaacuaggaccagaacuaaacccauaucucgcacacuuaucaagaauguacaauggauacgcaggagguguagaaguucaaguauuacuagccggaaacgcauucacagcaggaaaacuaguuuucgcagcagucccaccacacuucccauuagaaaacaucucacccggucaaauaacaauguuuccucauguuauaauagacguacgaacucuagaaccaguauuacuaccauuaccugacgucagaaacaauuucuuccacuauaaccaacaaaaugaaccacgaaugcgauuaguugcuaugcucuacacuccccuccgcucaaauggauccggcgacgacguauucaccguaucaugcagaguacuaaccagacccucacccgacuucgacuuuaacuaucuagucccacccacaguugaaucaaaaacaaaaccauuuacucuacccauauuaacaauuggagaauuaacaaacucacgcuuuccaguaccaaucgacgaacuauacacaucuccaaacgaauccuuaguuguacaaccacaaaacggaagaugcgccuuagacggugaacuacaaggcacaacacaauuacuacccaccgcaauaugcucauuuagagguagaauaaaucaaaaaguuaguggagaaaaccacguauggaauaugcaaguaacaaacauaaacggaacuccauuugaucccacagaagacguaccugcaccacucggcacaccagacuuuuccggaaaacuauucggcguucuaucacaaagagaucaugauaaugccuguagaucacacgacgcaguuauagcaacaaauagcgcaaaauucacaccaaaauuaggagccauucaaauaggaacaugggaacaagacgacguucacauaaaccaaccuaccaaauuuacacccguuggcuuauuugaaucagaaggauuuaaucaauggacccuaccuaauuacucaggagcauuaacacuaaauaugggacuagcacccccugucgcucccacuuucccaggagaacaaauauuauucuucagaucacacauaccacuaaaaggaggaguagcugaccccguaaucgauugucuacucccacaagaauggauacaacaccuauaccaagaaucagcacccagccaaacugacguugcauuaauaagauucacaaacccugauacaggaagaguauuauuugaagcaaaauuacaccguucagguuacauaacaguagcaaauacaggauccagaccuauaguaguuccagcaaacggauacuucagauuugauucauggguuaaccaauucuauuccuuggcaccaauggguacaggaaauggaagaagaagaguacaauaa

SEQ ID NO: 32836 - RNA, 1608 nt, Artificial Sequence
  derived and/or modified sequence opt6 from capsid_protein_VP1__Norovirus__ADZ24003
augaaaauggcuagcaacgaugccgcuccaaguaacgauggcgcagcaggacuaguaccagaaguaaauaacgaaacaauggccuuagaaccaguagcaggagcaucaauugccgcaccacuaaccggacaaaauaauguaaucgacccauggaucagacuaaauuucguccaagcuccaaauggagaauucacagucucucccagaaauucaccaggagaaguacuacuaaauuuagaacuuggccccgaauuaaauccuuauuuagcacauuuaucacgaauguacaauggauacgcaggcggaguagaaguucaaguuuuauuagcaggaaacgccuuuacugcagguaaacuaguuuuugcugccguaccuccacacuucccucuagaaaacauaaguccaggacaaauaacaauguuuccacacguaauaauugauguaagaacacuugaaccuguacuacuaccucuaccagacgucagaaauaauuucuuucauuacaaucaacaaaaugaaccaagaaugagacuaguagcaaugcuauacacaccucuaagaucaaauggaucgggagaugauguauucacaguaucauguagaguauuaaccagaccuucaccagauuuugauuucaauuauuuaguaccccccacaguagaaucuaaaacaaaaccauuuacacuucccauacuaaccaucggcgaacuuacgaauagccgauucccaguuccaaucgaugaacuauacacuaguccaaacgaaucauuaguaguccaaccccaaaacggaagaugcgcacuagacggcgaacuccaaggaacaacacaauuacuuccaacugcaauauguucauuuagaggaagaaucaaccaaaaaguaucaggagaaaaccaugucuggaacaugcaaguaacaaauauugaugguacaccauuugacccaacugaagacgucccagcaccauuaggaacucccgacuucucaggaaaauuauucggaguacuaucacaaagagaccacgauaaugcaugucgaucacacgacgcuguaauagcaacaaacucugccaaauucaccccuaaacuaggagcaauccaaauagguaccugggaacaagaugacguacauauaaaucaaccaacaaaauucacaccaguaggacucuuugaaucagaagguuuuaaccaauggacccuaccuaauuacaguggagcuuuaacacuaaauaugggcuuagcaccuccaguugcuccuacauuuccaggagaacaaauacuauucuuuagaucacacauuccacuuaaaggaggagucgcagauccaguaauagacugcuuacuaccacaagaauggauacaacaucuauaccaagaaucugcuccaucccaaacagacguagcauuaauucgauuuacaaacccagacacaggcagaguauuauucgaagcaaaacuacaccguucuggauauauaacaguugcaaauacaggcagcagaccaauagucgucccagcaaacggauacuuucgauucgacucauggguaaaucaauuuuauucacuagcuccaaugggaacaggaaauggaagaagaagaguacaauaa

SEQ ID NO: 32837 - RNA, 1623 nt, Artificial Sequence
  derived and/or modified sequence opt6 from capsid_protein_VP1__Norovirus__AFI08234
augaaaauggcaucaaaugaugcaaaccccucagauggaucagcagcaaacuuaguaccugaaguuaguaaugaagucauggcuuuagaacccgucguaggagcugcaauagcugcaccuguagcaggacaacaaaauguaauagacccauggauacgaaauaacuucguacaagcacccgguggagaauucacaguauccccuagaaaugcuccuggugaaauacucuggucagcaccauuaggaccagaucucaacccuuaucuaucacacuuagcaagaauguauaacggcuaugcagguggauuugaaguacaagucaucuuagcaggcaaugcauucacagcuggaaaaauaauuuuugcagcaguacccccaaacuucccaacagaaggucucucacccagccaaguaaccauguuuccacacauaauuguagacgucagacaauuagaaccaguacuaauuccacuaccagacguaagaaacaauuucuaucacuauaaucaaacaaaugacagcacaauaaaauuaauagcuauguuauauacacccuuacgugccaacaaugcaggagaagacguauuuacagucucaugucgcguauuaacaagaccuucacccgauuucgacuucauauucuuaguaccaccaacaguagaaagucgaaccaaacccuucacuguaccaauacuaacaguagaagaaaugacaaacagcagauuucccauuccccuugaaaaacuauuuacaggaccuucaggugcauucguaguacaaccucaaaauggccgcugcacaacugacggaguauuacuaggcacaacacaguuaagcccaguaaauauauguacauucagaggagauauuacacauauugccgguucaagagauuauacaaugaacuuagcuucacuaaacuggaauaauuacgacccaacugaagaaauaccagcaccucuaggaacaccagauuuuguaggaaaaauacaaggaguacuaacccaaaccaccaaaagagacggcucaacaagaggacauaaagcgaccguauacacaggaagcgcuccauuuacaccaaaauuaggaucaguaagauucagcacagacacagaaaacgacuuugaaacacaucaaaacaccaaauucaccccaguaggcguaauucaagacggaucaacaacucauagaaaugaaccacaacaauggguauuaccaucuuauucaggaagagauguacauaauguccaccuugcuccagcaguugcaccaacauuuccaggagaacaacuccuauucuucagaucuacaaugccuggauguucuggauacccaaauauggacuuagauugcuuacuaccacaagaauggguucaacauuuuuaucaagaagcugcaccagcccaaucagacguagccuuacuaagauuuguaaauccagauacuggacgcguacuauuugaauguaaacuacacaaaucagguuauguuacugucgcacauacaggacaacacgacuuaguaauaccucccaauggauauuuucgauuugauucuuggguaaaucaauuuuauacucuugcuccaaugggcaacgguacuggacgacgcagagcacuauaa

SEQ ID NO: 32838 - RNA, 1623 nt, Artificial Sequence
  derived and/or modified sequence opt6 from capsid_protein_VP1__Norovirus__AFI08237
augaaaauggcaucuaaugacgcaaaccccagugacgguucugcagcuaaccuugucccagaagucuccaaugaaguaauggcccuugaaccaguaguaggagcagcaaucgcugcaccuguagcaggacaacaaaacgucauagauccauggauacgaaauaauuucguacaagcaccagguggugaauucacaguaucaccaagaaaugcuccaggagaaaucuuauggucagcaccauuaggcccagauuuaaacccauaucuaucccauuuagccagaauguacaauggauaugccgguggauuugaaguacaaguaauacucgcuggcaaugcauucacagcuggcaaaauaauauuugcagccguaccaccgaauuuuccaacagaaggacuuucaccuucacaaguaacuauguucccacauauaauuguagauguaagacaacuagaaccaguacuaaucccacuuccggauguaagaaacaauuuuuaucauuauaaucaaacaaacgacucaaccauaaaauuaauagcuauguuauacaccccacuacgagcaaauaacgccggagaagaugucuucacaguuucauguagaguucuaacuagaccuucucccgacuucgacuuuauauuucuaguuccaccaacuguugaaucaagaacaaaaccauuuacaguaccuauauuaacaguagaagaaaugacaaacuccagauucccaauaccacuagaaaaauuauuuacaggcccuucuggagcauucguaguacaaccacaaaacggaagauguacaacugacgguguacuccuaggaaccacacaauuaucacccguaaauauuuguacauucagaggagacgucacacauauagcagguucaagaaauuauacaaugaaucuagcuucccuaaauuggaacaauuaugauccaacugaagaaauacccgcaccauuaggaacuccagauuucgucgguaaaauucaaggcguccuaacacaaacaacuaaaggagacggcucuacacgaggacauaaagcuacaguauauacuggaucugcucccuuuaccccuaaauuaggcucaguccaauucucuacagauacugaaaacgauuucgaaacacaccaaaauacaaaauuuacuccaguaggcguaauucaagacggaggaacaacacauagaaaugaaccacaacaauggguuuuacccucauacuccggaagagauguacauaacguacacuuagcaccagcaguagcaccuacauuuccaggagaacaauuauuauucuuuagaucaacaaugccuggcugcucaggauauccaaacauggacuuagauugccuacuaccucaggaauggguucaacauuuuuaccaagaagcagcuccagcacaaucagacguagcucuauuaagauucguuaauccugacacuggaagggucuuauucgaauguaaauuacauaaauccggauacguaacuguugcacauacuggacaacacgaucuaguaauuccacccaauggauacuuuagauuugauucaugggucaaccaauuuuauacacuagcaccaaugggcaauggaacaggaagacgcagagcacuuuaa

SEQ ID NO: 32839 - RNA, 1623 nt, Artificial Sequence
  derived and/or modified sequence opt6 from capsid_protein_VP1__Norovirus__AFI08243
augaaaauggcaucaaaugaugcaaaucccucagauggcucagcagcaaaccuuguaccagaaguauccaaugaaguaauggcucuagaaccagucguaggagcagcaaucgcugcaccagucgcaggacaacaaaauguuauagaccccuggauaagaaauaacuuuguacaagcuccaggcggagaauuuacaguaagucccaggaaugcacccggagaaauacuauggucagcaccacuaggaccagauuuaaauccauaucuaucucacuuagcaagaauguauaacgguuaugcaggcgguuucgaaguacaagucauacuagcuggcaacgcauucacggcuggaaaaauaauauucgcagcaguaccaccaaauuuuccaacagaaggacuuuccccaucccaaguaaccauguuuccacauauaauaguugauguaagacaacuagaaccuguccuaauuccauuacccgauguaagaaacaacuucuaucauuacaaccaaaccaaugacucaaccauuaaauuaauagcaauguuauauacaccauuacgugccaauaacgcuggagaagauguuuuuacuguuuccuguagaguauuaacaagacccucaccagacuuugauuuuauauuucuaguaccaccaacuguagaauccagaacaaaacccuucaccguaccaauacuaacaguugaagaaaugacaaacucgagauucccaauaccauuagaaaaacuauuuacaggaccaucuggagcauuuguaguacaaccacaaaaugggagauguacaacagacggaguuuuacuaggaacuacacaauuaucaccagugaacaucugcacuuuuagaggugacgucacacauauagcuggaucaagaaauuauacaaugaaucuagccucucuuaacuggaauaauuaugacccaacugaggaaauucccgcaccacuagguacaccagacuucguaggaaaaauacaaggaguacuaacacaaacaacuaaaggagacggauccacacgaggacauaaagccacaguauauacaggcucugcaccauuuaccccaaaacucggaucaguacaauucucuacagauacugaaaacgauuucgaaacacaucaaaauacaaaauucaccccaguaggaguaauacaagacgguggaacaacucaucgaaaugaaccacaacaaugggcauuaccuucauauucaggaagagauguacauaacguacaucuagcaccagcaguugcaccaacauucccaggagaacaauuauuauucuucagaucaacaaugccaggaugcaguggauauccuaauauggaccucgauugcuuauuaccccaagaauggguacaacacuuuuaucaagaagccgccccagcgcaaucugacguugcucuacuaagauuuguaaacccagauacaggaagaguacucuucgaauguaaauuacauaaaucaggcuacguaacaguagcucauacaggucaacacgacuuaguaauaccaccaaacggauacuucagauucgauucauggguaaaucaauuuuauacacuugcuccaaugggaaacggaacuggaagaagaagagcacuauaa

SEQ ID NO: 32840 - RNA, 1593 nt, Artificial Sequence
  derived and/or modified sequence opt6 from capsid_protein_VP1__Norovirus__AFJ38516
augaugauggcaucaaaagaugcaacauccucuguagauggagcaagcggugccggucaauuaguaccagaaguaaaugcuucagauccacuagcuauggacccaguagcaggaucaucuacagcuguagcaaccgcaggccaaguaaacccaauagacccauggauaauuaauaauuuuguacaagcaccacaaggagaauuuacuauaucaccaaacaauacuccaggagauguacuuuucgaucucucuuuaggaccacauuuaaauccauuccuauuacaucuaucucaaauguauaacggauggguaggaaacaugagaguaagaauaauguuagccggaaaugccuucacagcuggaaaaauaauaguuucuuguauaccaccugguuucggaucacauaaucuaacaauagcucaagcaacucuauucccacauguaauugcagacguuagaacacuagauccaauagaaguaccuuuagaagacguacgaaauguucuuuuccauaacaaugaucguaaucaacaaacaaugcgcuuaguuugcauguuauacacuccauuaagaacaggcggaggcacaggagauucauucgucguagcuggaagagucaugacaugcccaucaccugacuuuaacuuucuuuuccucguaccaccuacuguagaacaaaaaacuagaccauuuacauuaccaaacuuaccauuaaguucuuuaucaaacucacgagcaccuuuacccauaucaucaaugggaauaucaccagacaauguacaaucaguacaauuucaaaauggaagauguacacuagacgguagauuaguagguacaaccccaguaucccuaucacaugucgccaaaauuagaggaacuucaaacggaacuguaauuaaucuaacugaauuagaugguacaccuuuucaucccuuugaaggcccagccccuauaggauucccagaucuaggaggaugugacuggcacauaaauaugacacaauuuggacacucaucacaaacccaauaugauguugacacaacaccugauacauuuguaccacaucuaggcucaauucaagcaaaugguauaggaucaggcaacuauguagguguacuauccuggauaucaccuccaucccacccuucaggaagucaagucgaucuuuggaaaauaccaaauuacggaaguucuauuacagaagcuacucaccuugcaccuucaguauauccaccaggauuuggagaaguauuaguauuuuucaugucuaaaaugccaggaccuggagcauacaauuuaccuugucuuuuaccacaagaauauauaucucauuuagcaucagaacaagcaccaacuguaggcgaagcugcauuauuacacuaugucgacccagauacagguagaaaccuaggugaauuuaaagcauacccagaugguuuccuaacaugcguacccaauggagccucaagugguccacaacaacuuccaaucaacggaguuuuuguauucguaucuuggguaucuagauucuaccaacucaaaccagucggaacagcaucaucagcacguggaagauuaggacuacgcagauaa

SEQ ID NO: 32841 - RNA, 1620 nt, Artificial Sequence
  derived and/or modified sequence opt6 from capsid_protein_VP1__Norovirus__AFJ38519
augaaaauggcaucaucagacgcaaauccauccgacggaucagcugcaaaucuaguucccgaaguaaacaaugaaguaauggcucuagaaccuguaguaggcgcagccaucgcugcaccagucgccggacaacaaaacauaauagacccauggauaagaaauaauuucguacaagcaccuggaggagaauucacaguaucaccaagaaacgccccuggagaaauauuauggagugcaccauuaggaccagauuuaaauccuuaccuaagucaccuaucuagaauguauaacggauacgccggaggauuugaaguacaaguaauacucgcuggaaaugcauucacagcuggcaaaguaauauuugcagcaguaccuccaaacuuuccuacagaaggauuaucaccaucgcaaguaacaauguuuccacacauaauaguagauguaagacaacuagaaccaguacuaauaccacuuccagacguacgaaauaauuuuuaccauuauaaccaagcccacgacuccacauuaaaacuaauagccaugcuauacacaccuuuaagagcaaacaacgcuggagaugacguauuuacaguaucaugccgagucuuaacacgaccauccccagacuuugacuucauauuccuaguuccaccaacaguagaaucuagaacaaaaccauucacugucccaauacucacaguagaagaaauguccaauucaagauucccaauaccacucgaaaaauuauauacaggaccauccagugcauucguaguccaaccacaaaauggacgaugcacaacugacggaguauuauuagguacaacccaauuaucagcaguaaauauuugcaacuuucgcggagacguaacacgaguagguauaucccaugacuacaccaugaaccucguaucccaaaacuggaacaacuaugauccaacagaagaaauaccagcaccauuaggaacaccagauuuuguagguaaaauucagggauuauuaacacaaaccacuagagcugacggaucuacaagagcacauaaagcuaccguauccacagguucuguacacuucacaccuaaacuuggcucuguacaauuuacuaccgacacaaauaacgacuuucaaacaggacaaaacacaaaauucacaccaguaggaguaauacaagauggagaccaccaccaaaacgaaccacaacaauggguacuaccaaauuauucaggaacauccggucacaacguucauuuagcuccugcaguugcuccaacuuucccaggagaacaacuccuuuucuuuagaucaacaaugccaggauguucaggauauccuaacaugaaccuagacuguuuacuaccccaagaauggguacuacacuucuaccaagaagcagcaccagcacaaucugacguagcacuacuacgauuuguaaacccagacacaggaagaguauuauucgaaugcaaauuacacaaaucuggauauauaacaguagcacacacaggaccauaugacuuaguuauaccaccuaauggauauuuuagauucgauucauggguaaaucaauuuuacacauuagcaccaauggguaauggaacaggaagacgaagagcccuauaa

SEQ ID NO: 32842 - RNA, 1623 nt, Artificial Sequence
  derived and/or modified sequence opt6 from capsid_protein_VP1__Norovirus__AFW15937
augaaaauggcaucaaaugaugcaaaucccucagauggaucagcagccaacuuaguaccagaaguaaauaaugaagucauggcacucgaaccuguaguaggagcagcaauugcagcaccagucgcaggucaacaaaauguuaucgauccuuggauaagaaauaauuuuguucaagccccuggcggcgaauucacuguaucaccuagaaaugcaccaggagaaauacucuggucagcaccauuaggaccagauuuaaauccuuaucuaucucaccuugcucgcauguauaacggauacgcagguggcuucgaaguacaaguaaucuuagcaggaaacgcauucacagcaggaaaaauuauauuugcagcuguaccaccaaacuucccaacugaaggacuaucaccaucucaaguaaccauguuuccucacauaauaguagauguuagacaacuagaaccuguauuaauuccauuaccagacguacgaaacaauuuuuaucacuauaaccaaucuaacgauucaacaaucaaacuaauagcuaugcuauauacaccacuaagagcaaacaaugcgggagaagauguauuuacaguauccugcagaguacuaacacguccauccccagauuuugauuuuauauuuuuaguaccaccaacaguagaaucacguacaaaaccauucaccgucccaauauuaacaguagaagaaaugaccaacucaagauuuccaauaccucuagaaaaauuauuuacagguccaucuuccgcauuuguaguacaaccacaaaauggccgauguacgacagacggaguccuacucgguacaacacaacuaucaccaguaaauauauguacauuuagaggcgacguuacacauauagccggaucaagaaauuacacaaugaauuuagcuucuuuaaauuggaacaauuacgauccgacugaagaaauaccagcuccacucggaacacccgauuucguaggaaaaauacaaggaguauuaacccaaacaacuaaaggagauggcucaacuagaggacauaaagccaccguuuacacaggcucugcacccuuuaccccaaaacuaggcucuguacaauucuccaccgauacugaaaaugauuucgaaacacaccaaaauacaaaauucacaccgguaggcgucauccaagacggaucaacuacccaucgaaacgaaccacaacaauggguucucccaaguuauucaggaagaaacguucaaaauguucauuuagcaccagcuguagcaccaacauuuccaggugaacaacuacuauuuuuucgaucaacuaugccaggauguucaggcuauccaaacauggauuuagauugccuauuaccacaagaauggguacaacauuucuaccaagaagcagccccagcacaaucagauguugcacuacucagauucguaaauccugacacaggcagaguauuauuugaaugcaaauuacauaaaucaggauacguaacuguagcacauacuggccaacaugacuuagucauuccaccaaacggauauuuuagauucgauucauggguaaaucaauucuacacacuugcaccaaugggaaaugguacaggaagacguagagccuuauaa

SEQ ID NO: 32843 - RNA, 1623 nt, Artificial Sequence
  derived and/or modified sequence opt6 from capsid_protein_VP1__Norovirus__AFW15939
augaaaauggcaucuaaugacgcaaacccaucugaugguucugcagcaaacuuagucccagaaguaaauaaugaaguuauggcacuugaaccuguagucggagcagcaauagccgccccagucgcaggacaacaaaauguaauagauccuuggauucgaaauaauuucguacaagcaccaggaggagaauuuacuguaucaccaagaaacgcccccggagaaaucuuauggucagccccacucggacccgaucuaaacccauauuuaucccaucuugcaagaauguacaacggauacgcaggaggauuugaaguccaaguuauccuugcaggaaaugcauucaccgcaggcaaaauaaucuuugcagcugucccaccuaacuuuccaacagaaggccuaucacccagccaaguaacuauguucccacauauaauaguagacgucagacaacuagaaccaguacuaauaccauuaccagacgucaggaauaauuuuuaucauuacaaucaaucaaacgacuccacaauuaaacuuauagcaauguuauauacaccacuucgagcuaauaacgcuggagaagauguauuuacaguuucaugucgugucuuaacaagaccaucaccagauuucgauuucauauuuuuaguaccaccuacugucgaauccaaaaccaaaccauucacuguaccaauacuaacaguagaagaaaugacaaacucaagauuuccuauaccacuagaaaaauuauuuacuggaccuucuuccgcauucguaguacaaccacaaaacggucgauguacaacagaugguguacuacucggaacuacacaauuaucccccguuaacauaugcacauuucguggcgacguuacacauauagcaggaucucgcaauuauacaaugaauuuagcaaguuuaaacuggaauaauuacgauccaacagaagaaaucccagcaccauuaggcaccccagauuuuguuggaaaaauucaaggaguauuaacacaaaccacaaaaggcgacggaucaacgagaggacacaaagcuacaguuuacacaggaucagcacccuuuacuccaaaacuaggcucuguccaauuuucaacagauacagaaaacgacuuugaaacacaucaaaacacaaaauuuacaccuguugguguaauucaagacggaucuacaacacauagaaaugaaccucaacaauggguucuacccucauauuccgguagaaacgcacaaaacguacacuuagccccagcagucgcaccaacauuucccggugaacaauuauuauuuuuuagauccacaaugccaggauguucgggauauccaaauauggauuuagauugucuuuuaccacaagaauggguccaacauuuuuaccaagaagcagcaccagcccaaucagauguagcacucuuaagauucguaaacccugauacaggacgaguauuauuugaaugcaaacuccacaaaucaggcuaugucacaguagcacacacaggccaacaugaucucguaauaccaccaaauggauacuucagauuugacaguuggguaaaucaauuuuacacuuuagcuccaaugggaaacgguaccggacgucgaagagcacuuuaa

SEQ ID NO: 32844 - RNA, 1623 nt, Artificial Sequence
  derived and/or modified sequence opt6 from capsid_protein_VP1__Norovirus__AFW15942
augaaaauggcaagcaacgacgcuaacccaucagaugguucagcagcaaaccuaguaccagaaguaaacaaugaaguuauggcacuagaaccaguaguaggagcagcuaucgcagcaccagucgcaggccaacaaaacgucauagauccauggauccgaaauaacuucguucaagcaccuggcggcgaauuuacaguaucaccaagaaacgccccaggugaaauauuauggucagcaccucuuggaccagaucuuaauccauaucuaucacauuuagcacgaauguacaacgguuaugccggaggauucgaaguacaaguaauacuugcaggaaaugcauuuacagcuggaaaaauaauuuucgccgcuguuccuccaaauuucccuacugaaggauuaucaccaucacaaguuacaauguucccacacauaauagucgauguuagacaacuugaaccaguauuaauaccauuacccgauguacgaaauaauuucuaccacuacaaucaauccaaugauucaacaauuaaauuaauagcaaugcuuuauacaccacuacgagccaauaaugcaggagaagauguauuuacaguaucaugucguguucuaacaagaccaaguccugauuuugacuucaucuuccuaguaccuccaacaguagaaucaagaacuaaaccauuuacuguaccuaucuuaacaguggaagaaaugacaaacuccagauuccccauaccuuuagaaaaauuauuuacaggaccaucauccgcuuuuguuguacaaccucaaaacggaagauguacaacagacggaguucuauuagguacaacacaacuuucuccuguaaauauaugcacauuuagaggagacguuacacauauagcagguucaagaaauuauacaaugaaucuagcaucccuaaacuggaacaacuaugauccaaccgaagaaauaccagcacccuuaggaacuccagacuucguaggaaaaauacaaggagucuuaacccaaacaacaaaaggagacgguucaacuagaggacauaaagcgacaguauacacagguucagcaccauuuaccccaaaacuagguucuguacaauuuucaacagauacagaaaaugacuuugaaacccaucaaaacaccaaauucacuccaguuggaguaauucaagacggaggaacaacacauagaaacgaaccacaacaauggguauuaccaucauauucuggaagaaauguaccaaacguucaucuagcaccugcaguugccccaacauuuccaggagaacaauuauuauucuucagaaguacaaugccuggaugcucaggauaccccaauauggaccuagauugcuuacuuccacaagaauggguacaacauuucuaucaagaagccgcaccagcacaaagugacguugcacuauuaagauucguaaauccagauacaggcagaguauuauucgaaugcaaauuacauaaaaguggauacguaacuguagcccacacaggacaacaugaccuuguaaucccaccuaacggauauuuccgauucgacagcuggguaaaccaauucuauacauuagcacccaugggaaauggaacagguagaagacgugcuuuauaa

SEQ ID NO: 32845 - RNA, 1623 nt, Artificial Sequence
  derived and/or modified sequence opt6 from capsid_protein_VP1__Norovirus__AFW15943
augaaaauggcauccucagacgccaacccaucagacggaucaacagcaaaucuaguaccagaaguaaacaacgaaguaauggcucuagaaccaguugucggagcagcaauagcugcaccaguagcuggucaacaaaauguuauugauccauggauacguaauaacuuuguacaagcaccaggaggagaauuuacagucucaccaagaaaugcaccgggagaaauacuuugguccgcaccacuaggccccgauuuaaauccauaucuaagucaccuagcuagaauguacaacggauaugcaggaggcuuugaaguacaaguaauacuagccggaaaugcauuuacagcuggaaaaauaauauucgcugccguucccccuaauuuuccaacugaaggauuaucuccaucucaagucacaauguucccccacauaauaguagauguaagacaauuagaacccguuuuaauaccauuaccagauguuagaaacaauuuuuaucauuauaaccaaucaaacgacucaacaauuaaauuaauagcuauguuauacacaccauuaagagcaaauaacgcaggugaugaugucuuuacaguauccugucgcguacuaacacgaccaucaccagauuuugacuuuauauuuuuaguaccaccaacagucgaaucccgcacaaaaccuuucucagucccaguauuaacaguagaagaaaugacaaacucaagauuuccaauaccauuagaaaaacucuuuacaggcccuuccucagcauuuguaguacaaccacagaacgguagauguacaacagaugguguuuuacucggcacaacucaacuaucaccuguaaacauauguacauuuagaggugacgugacacauaucccaggcagucgcaauuacacaaugaauuuagcaucacaaaacuggucaagcuacgauccaacagaagaaauaccagcaccacuagguacaccagacuuuguuggaaaaauacaaggaguacuuacucaaacaaccagaacuaacggaucaacaagaggacauaaagcaacagucuacacaggcuccgcugauuucagcccaaaacuagguagaguacaauuugcuacagacaccgauaacgacuucgaaacaaaucaaaauacaaaauucacaccuguaggaguuauacaagacggaucaacaacaccaagaaaugaaccccaacaauggguacucccaucauacucaggcagaaauauccauaauguacaccucgcaccagcaguagcuccaacauuuccuggcgaacaauuacuauucuuuagaucgaccaugccagguugcuccggauauccaaacauggaccuagauugcuuacuaccacaagaauggguacaauauuuuuaucaagaagccgcccccgcccaaucugacguagcacuauuacguuuuguuaauccagacacuggcagagucuuauuugaaugcaaacuacacaaaucaggauauguuacagucgcacacacaggacaacacgaucucguaauaccacccaacggauacuucagauucgauuccuggguaaaucaauuuuauaccuuagcaccaaugggaaauggaaccggaagaagaagagcacuauaa

SEQ ID NO: 32846 - RNA, 1623 nt, Artificial Sequence
  derived and/or modified sequence opt6 from capsid_protein_VP1__Norovirus__AFW15946
augaaaauggcaagcucugaugcaaauccuucagaugguucaacagcaaacuuagucccagaaguuaauaaugaaguuauggcucuagaaccuguagucggcgcagcaauugcagcaccuguugcaggacaacaaaaugucauagacccauggauaagaaauaauuuuguacaagcaccaggaggagaauuuacugucucaccacgcaacgccccaggagaaauucuuugguccgcaccauuaggaccagauuuaaauccauaccucagucaccucgcaagaauguauaacggauaugcaggaggauuugaaguucaaguaauacucgccgguaaugcauucacagcagggaaaauaauauucgcagccguacccccaaacuucccaacugaaggauuaucaccaucacaaguaaccauguuuccucauauaauaguagauguaagacaauuagaaccaguauuaauuccauuacccgauguaagaaacaacuuuuaccacuauaaccaauccaaugauucuacaauaaaauuaauugcaauguuauauacaccacuacgugcaaauaaugcaggagacgacguauuuaccguuaguugcagaguacuaacucgcccuucaccagacuuugauuuuauauuccuuguaccccccacuguugaaucaagaacaaaaccauuuucuguacccguacuaacuguagaagaaaugacaaacucucgauuuccaauaccauuagaaaaacuuuuuacaggaccaucuuccgcuuucguuguccaaccacaaaauggaagauguacaacugauggaguauuauuaggaaccacacaauuaucaccuguuaauauuuguacauucagaggcgauguuacacauauaccaggaucaagaaauuauacaaugaaucuagcuucacaaaacuggaauucuuacgacccaacagaagaaauaccagcaccacuaggaacaccagauuuugucggaaaaauacaagguguauuaacccaaaccacaagaacaaacgguuccacaagaggccacaaagcaaccguauauacaggauccgcugacuucuccccaaaauuaggaagaguucaauucgccacugauacagauaaugacuuugaaacaaaucaaaacacuaaauucacaccuguaggaguaauacaagacggcucaaccaccccccgaaaugaaccacaacaauggguucuaccauccuauagcggaagaaacauccauaauguucauuuagcaccagcaguugccccaacauuuccaggagaacaacuauuauucuuuagauccacaaugccaggaugcucaggauaucccaacauggaucuagacugcuuacuaccacaagaauggguacaauauuucuaccaagaagcagcuccagcacaaucagacguagcccuacuuagauuuguaaacccagacacaggccgcguacuguuugaaugcaaacuucauaaaucagguuauguaacaguagcucauaccggacaacacgacuuaguaauaccacccaacggauauuucagauuugacuccuggguaaaucaauuuuauacacuagcaccaaugggaaaugguacaggaagaagaagagcauuauaa

SEQ ID NO: 32847 - RNA, 1647 nt, Artificial Sequence
  derived and/or modified sequence opt6 from capsid_protein_VP1__Norovirus__AFX71656
augaaaauggcaucuaacgacgcagcaccaucaaacgacggagcagcaggacuaguaccagaaauaaauaacgaagcaauggcccuagaacccguagcaggagcagcuauagcagcuccucuaacaggacaacaaaauauaauagauccauggauaaugaacaauuucguacaagcacccggaggcgaauucacuguauccccacgaaacucaccaggagaaguucuucugaauuuagaacuaggaccugaaauaaaccccuaucuugcccaucuagcacgaauguauaacggauaugcuggaggauucgaaguucaaguuguccuugcuggaaacgcauucacagcaggaaaaguaauuuuugcugccauuccuccaaauuuccccauagauaaccucuccgcagcacaaauaacaauguguccccauguaauaguugacguaagacaauuagaacccauuaacuuaccaaugccugauguucgcaacaauuuuuuccauuacaaucaaggaucugauucucgccuacgacuaauagcaauguuauacaccccauuaagagccaacaacucaggcgaugacguauucacagucucauguagaguauuaaccagaccaucuccagauuuuucauucaauuucuuaguaccucccacaguagaaucuaaaacaaaaccauuuacccuaccaauauuaacuauauccgaaaugucaaacucuagauuuccugucccaauagauucccuucauacaucaccaacagaaaacauagucguacaaugccaaaacggaagaguaacacuagauggagaauuaaugggaacaacacaauuauuaccaucccaaauuugcgccuuccgcggaacauuaacacgauccacauccagagcaucugaucaagcagauacagccacaccccguuuauuuaacuauuacuggcauauccaacuagacaaucuaaauggaaccccuuaugacccugcagaagauauaccagcaccacuagguacacccgacuucagagguaaaguauuuggaguagcaucccaacgaaauccagauucaacaacacgcgcacacgaagcaaaaguugauacuacuucaggaagauucacucccaaauuagguucuuuagaaauauccacagaaucagaugacuuugacccaaaccaaccaaccagauuuacacccgucggaauuggagucgacaaugaagcagacuuucaacaauggucacuacccgauuacucaggccaauuuacacacaauaugaaccuagcuccagcaguagcuccaaauuuuccaggugaacaacuuuuauuuuuuagaucucaauuaccuucauccggcggacgaagcaacggcauauuagacugcuuaguaccacaagaauggguacaacauuuuuaccaagaaucagcaccagcacaaacacaaguagcucuugucagauacguuaauccagacaccggcagaguucuuuuugaagcuaaacuucacaaauuaggauucaugaccaucgcaaaaaacggugauucaccaauaacaguaccaccuaacggcuacuucagauuugaaucuugggucaacccauuuuacacauuagcaccuaugggaacagguaauggaagacgacgaauucaauag

SEQ ID NO: 32848 - RNA, 1629 nt, Artificial Sequence
  derived and/or modified sequence opt6 from capsid_protein_VP1__Norovirus__AFX71659
augaaaauggcaucuaaugaugccgcuccaucuacagauggagcagcuggacucguaccagaaucaaacucagaaguaauggcacuagaaccaguugcaggagcagcauuagcagcaccuguaacuggacaaacaaacauaauagauccuuggauaagagccaauuuuguacaagcuccuaauggagaauuuaccguaagcccacgaaaugcaccaggagaaguauuacuaaaucuagaauuaggaccagaacuuaaucccuaucuagcacaccuagccagaauguacaauggauaugcuggagguauggaaguacaaguuauguuagcuggaaaugcauuuacagcuggaaaacuugucuuugcagcaguaccaccccauuucccagucgaaaaucuaucaccacaacaaauaacaauguucccacacgugauaauugauguaagaacucuagaaccaguccuacuaccauuaccagacguaagaaauaauuucuuccacuacaaucaaaaagaugacccuaaaaugcguauuguagcaauguuauacacuccauuaagaucaaacgguucuggagaugacguuuuuaccguaucauguagaguauuaacaagaccaucaccugacuuugauuuuacauaucuaguaccaccaaccguagaaagcaaaaccaaaccauucacacuacccauucuaacauuaggagaauuaaguaauucaagauucccaguaucaauagaucaaauguauacaucuccuaaugaaguuaucucuguacaaugucaaaacggacgauguacauuagacggagaauuacaaggaacaacucaacuacaagucucaggaauaugugccuucaaaggcgaaguaacagcacacuuacaagauaaugaucauuuauauaacauaacuauaaccaauuuaaacgguagcccuuuugacccaucagaagauauaccagcucccuuaggugucccagauuuccaaggaagaguauucggaguaauuacccaacgagauaaacaaaacgcugcaggacaaucacaaccugccaauagaggacacgacgccguaguaccaacauacacagcacaauauacaccaaaauuaggacaagugcaaauaggaacauggcaaacagacgauuuaaaaguaaaccaaccaguaaaauucacaccuguaggacuaaaugacacagaacauuuuaaucaauggguagucccacgauacgccggugccuuaaacuugaacacaaaccuagcaccuuccguagcaccugucuucccaggagaaagauuauuauucuuucguucauauuuaccacuaaaagguggauacggcaauccagcaauagauugccuucuaccucaagaauggguacaacauuucuaucaagaagcagcaccaucaaugucagaaguagcucuuguaagauacauuaaucccgauacuggaagagcauuauucgaagcaaaguuacauagagcaggauuuaugaccguaucaucaaauacaucagcaccaguaguaguaccagcaaauggauauuuccgauucgauucuuggguaaaccaguucuacucacuagccccuaugggaacaggaaacgguagaagaagaauacaauaa

SEQ ID NO: 32849 - RNA, 1623 nt, Artificial Sequence
  derived and/or modified sequence opt6 from capsid_protein_VP1__Norovirus__AFX81124
augaagauggcaucaaaugaugcaaauccaagugaugguucugcugccaauuuaguuccugaagucucaaaugaaguaauggccuuagaacccguaguuggagcagcaauagcagcacccguagcaggacaacaaaauguaauagaccccuggauacguaacaauuuuguccaagcuccaggcggagaauucacaguaucuccaagaaaugccccaggagaaauauuauggucugccccacuggggccugaucuaaauccauauuuaucacacuuagcucgaauguauaacggauaugccggaggcuucgaaguacaagucauauuagcagguaaugcauuuaccgcaggcaaaauaauuuucgcagccguuccaccaaauuuuccaacugaagguuuaucaccaucucaaguaacaauguuuccacacauaauuguagacguaagacaacuagaaccaguucuaauaccauuacccgacguaagaaacaacuuuuaucauuacaaucaaaccaacgauucaacuauuaaauuaauagccauguuauacacaccccuaagggccaauaacgcuggugaagacguauucacagucucauguagagucuuaacacgaccuucaccugacuuugacuuuauauuccuagucccaccaacaguagaaaguagaacuaaaccauucaccgucccaaucuuaacaguagaagaaaugacuaacuccagauuuccuauuccacuagaaaaauuauuuacaggaccaucuggugcauucgucguacaaccacaaaauggacgauguacaacagacgguguucuacucggaacaacacaacuauccccuguaaacauauguacuuucagaggugauguaacucauaucgcaggaucaagagauuauacaaugaauuuagcaucacuaaauuggaacaauuacgauccaaccgaagaaauaccagcaccauuagguacuccagacuuuguaggcaaaauucaaggaguacuaacccaaacaacuaaaggagacggaagcacacgcggacauaaagcaacaguuuauacaggaucugcccccuucacaccaaaacuugguucaguucaauuuucaacagauacagaaaacgauuuugaaacacaccaaaauaccaaauuuacaccaguaggaguaauacaagauggaggcacuacacauagaaaugaaccgcaacaauggguauuaccauccuauucgggaagagauguacauaacguacaucuagccccagcaguagcaccaacuuuuccaggagaacaauuauuauuuuuccgaagcacaaugccaggaugcucaggauauccuaacauggauuuagauugccuucuaccacaagaauggguccaacauuuuuaucaagaagccgccccagcacaaagugacguagcacuuuuaagauuuguuaacccagacacaggcagaguacuuuucgaaugcaaauuacauaaaucuggcuacgucacaguugcccacaccggucaacaugaucuaguaauaccaccaaauggauacuucagauucgauagcuggguaaaucaauuuuauacacuagcuccaaugggaaauggaacuggcagaagaagagcucuuuaa

SEQ ID NO: 32850 - RNA, 1623 nt, Artificial Sequence
  derived and/or modified sequence opt6 from capsid_protein_VP1__Norovirus__AFX81133
augaaaauggcaaguaacgacgcaaacccuucagauggaucugcagcaaaccuaguaccagaaguaucaaaugaaguaauggcuuuagaaccaguaguuggagcugcaaucgccgcaccaguagcgggacaacaaaacguaauugacccauggauaagaaauaauuuuguacaagcaccaggaggagaauuuacaguaucaccaagaaaugcuccuggagaaaucuuauggagugccccucuagguccagauuuaaacccauauuuaucacaccucgcuagaauguauaauggauacgcaggaggauuugaaguacaaguaauacuagcaggaaaugcauucacugcaggaaaaaucauauucgcagccguaccaccaaauuuuccaacagaaggauuaucuccuucacaaguuaccauguuuccacauaucauuguagacguuagacaacuagaaccaguauuaauuccuuuaccagacgucagaaauaauuucuaccauuauaaccaaacaaaugacucuaccauuaaauuaauagcaaugcuauacacaccacuaagagcaaauaacgcaggagaagauguauucacaguaucaugcagaguauuaacacgacccucaccagacuuugacuuuauuuuucuaguaccaccaacaguagaaucaagaacuaaaccuuuuacaguaccaauacuaacaguagaagaaaugacaaacucucguuuuccuauaccacuugaaaaacuauucacaggaccaucaggugcauucguaguacaaccccaaaauggucgcugcacuacugauggaguacuauuagguacaacacaacuaucaccaguaaauauaugcaccuuucgaggcgacguaacccauaucgccggaucaagaaauuauacgaugaaucuagccucauuaaacuggaauaauuacgacccaacagaagagauaccggcaccucucgguacaccagacuucguaggaaaaauacaaggugucuuaacacaaacaacaaaaggagacggaucaacacgaggacacaaagcaacaguauacacaggcucagcaccauuuacaccaaaacuaggcucaguccaauucucaaccgauacagaaaacgacuucgaaacacaucaaaacacaaaauuuacuccaguagguguaauacaagacggauccacuacccauagaaacgaaccacaacaauggguacuaccaucauauuccggacgugacguacauaauguacaccuugcaccggcaguagcaccuaccuuuccaggugaacaauuacuauucuuccgcucaacuaugccaggaugcucaggcuacccuaacauggauuuagauugccuacuuccacaagaauggguacaacauuucuaucaagaagcagcgccagcacaaucagaugucgcauuauuaagauucguuaauccagacacuggcagaguauuauucgaauguaaacugcauaaaucaggcuacguaacuguagcacacacaggccaacacgaucuaguaauaccuccuaacggauauuuccgauuugauucauggguaaaucaauucuacacacuagcaccaauggguaauggcacaggccgucgaagagcauuauaa

SEQ ID NO: 32851 - RNA, 1623 nt, Artificial Sequence
  derived and/or modified sequence opt6 from capsid_protein_VP1__Norovirus__AFX81151
augaaaauggcaucuaacgacgcuaacccuucagauggaucugcagcuaaucuaguuccagaaguauccaaugaaguaauggcacuagaacccguagucggagcagcaauagcagcaccagucgcaggacaacaaaauguaauagauccauggauacgaaauaacuucguccaagcaccaggaggagaauuuacagugaguccaagaaaugcaccaggagaaauauuauggucggcaccccuaggucccgaucuaaauccauaccuaucucaccuagcaagaauguacaacggauaugcaggaggauucgaaguccaaguaauacuagcaggaaaugcauuuacugcaggaaaaauuauauuugcagcuguuccaccaaauuucccaacagaaggauuaucaccaucacaaguaaccauguucccacauauaaucguugauguaagacaauuagaaccaguacuaauuccauuaccagauguaagaaacaacuucuaucacuauaaccaaacaaaugacucuacaauaaaauuaaucgccauguuauauacaccauuaagagcaaauaacgccggagaagacgucuuuacaguaucauguagaguacuuacacgaccaucaccagacuucgacuuuauuuucuuagucccaccaacaguagagucacgaacaaaaccauucacaguaccaauccuaacaguagaagaaaugacaaauucuagauucccaaucccauuagaaaaauuauucacagggcccucuggagcauucguuguacaaccgcaaaacggcagaugcacaacagauggaguacuauuagguacaacucaacuaucacccgucaauauaugcacauuuaggggagacgucacacacauagcagguucacguaacuauacaaugaacuuagcaucacuuaacuggaauaauuacgacccuacagaagaaauaccugcaccccucggaacaccagauuucguagguaaaauacaaggaguacuaacacaaacuacuaaaggagacggauccacacgcggucauaaagcaacagucuauacaggcucagcuccauucacaccuaaacuaggcucaguacaauucucaaccgauacugaaaaugacuucgaaacacaccaaaacacaaaauuuacuccaguagguguaauacaagacggagggaccacccacagaaaugaaccucaacaauggguccugccuucauauucaggacgagauguacauaacguucauuuagcaccagcaguagcaccuacauuuccaggagaacaacuauuauuuuucagaucaacaaugccagguugcucuggauauccaaauauggauuuagacuguuuguuaccccaagaauggguucaacacuucuaccaagaagccgcaccagcacaaucagauguagcauuacuaagguuuguaaauccugauaccggaagaguacuauuugaauguaaacuuuauaaaucuggcuauguaaccguagcccacacaggccaacacgauuuaguuaucccaccuaacggauauuuuagauucgacucauggguaaaucaauucuauacacuagcccccaugggcaacgguacaggaagaagaagagcauuauaa

SEQ ID NO: 32852 - RNA, 1623 nt, Artificial Sequence
  derived and/or modified sequence opt6 from capsid_protein_VP1__Norovirus__AFX81160
augaaaauggccccuaaugacgcuaacccuuccgauggaagugccgcaaauuuaguuccagaagucucuaaugaaguaauggccuuagagccaguaguaggagccgcuauugcugcuccaguagcuggacaacaaaacgucauugaccccuggauaagaaauaauuucguacaagcaccaggaggagaauuuaccgucuccccaagaaaugcaccuggagaaauuuuauggggagccccacucgguccugaucuaaauccauaucuaucacaccuugcaagaauguacaauggauacgcuggcgguuucgaaguacaaguaaucuuagcaggaaacgccuuuacagccggaaaaauaauauucgcagcaguaccuccuaauuuuccaacugaaggacuaucaccaucacaaguaacaauguucccacacauaauaguagauguuagacaacucgaaccaguauuaaucccucuaccagauguaagaaacaauuucuaucauuacaaccaaaccaaugacucaacuauaaaacuuauagcuauguuauauacaccucuacgagcaaauaacgcaggcgaagauguuuucaccguauccugucgaguacucacaagaccaucuccagauuuugacuuuauuuuucuaguaccacccacagucgaaucacgaaccaaaccauucacaguaccaauacuaacaguggaagaaaugacuaauucucgauucccaaucccuuuagaaaaacuauucacagguccaucaggagcauucguuguccaaccacaaaacggaagauguacaacagacggaguauuacuaggaaccacucaauuaucaccaguaaauaucuguaccuucagaggagauguuacccauauugcuggaucacguaauuacaccaugaauuuagcuucauuaaacuggaacaacuaugacccaaccgaagaaauaccugcaccccuuggaacaccagacuuuguaggaaaaauacaaggaguauuaacucaaacaacuaaaggagacggaucuaccagaggacacaaagcaacagucuauacaggcucugcuccauucacuccaaaauuaggauccguacaauucuccacagacacagaaaacgauuucgaaacucaucaaaacaccaaauucacuccagucggaguuauacaagaugggggaacaacacauagaaaugaaccacaacaauggguccuaccaucuuauucagguagagauguacauaacguucauuuagcacccgccguagcaccaacuuuuccaggugaacaacuacuauucuuuagaucaacaaugccaggauguucagguuaccccaacauggaucuagauugccuuuuaccacaagaauggguccaacauuucuaucaggaagccgcuccagcacaaucagacguagcauuauuacgauucguaaauccagacacaggaagaguauuauuugaauguaaacuacacaaaucuggauacgucacagucgcacauaauggacaacaugaucuaguaauaccaccaaacggauauuuuagauucgauuccuggguaaaucaauuuuauacacuagcucccaugggcaauggaaccggaagaagaagagcacuuuaa

SEQ ID NO: 32853 - RNA, 1623 nt, Artificial Sequence
  derived and/or modified sequence opt6 from capsid_protein_VP1__Norovirus__AFX81175
augaaaauggcaucaaaugacgcaaacccauccgacggaucagccgcaaaccuaguaccagaaguuucaaaugaaguaauggcacuagaaccagucguaggugccgcaauagccgcaccaguagcaggacaacaaaauguaauagacccauggauacgcaauaacuuuguacaagccccaggaggugaauuuacugucucaccaagaaaugcacccggcgaaauuuuauggucagcaccacuuggaccagauuuaaacccauaccuaucacaccucgcaagaauguauaauggauacgcaggcggcuucgaaguucaaguaauucuagcaggaaaugccuuuacagcagguaaaauaauauuugcagcaguaccuccaaauuuuccaacagaaggucucucaccuucacaaguaacuauguucccacacauaauaguugacguucgacaacuagaaccaguccuaauaccauuaccagacguaagaaacaauuucuaucacuauaaccaaacaaaugauccaacaauaaaauuaauugcuauguuauauacaccucuaagagcaaacaacgcuggagaagauguauuuacaguaucaugucgcguucuuacacgaccaagcccugauuuugacuucauauuucuuguaccccccaccguugaaaguagaacaaaaccauuuacaguuccuauacuaacaguagaagaaaugaccaacucacgcuuuccaauaccacuagaaaaacuauucaccggaccaucaggagcauucguaguacaaccacaaaacggaagauguacuacagacggagucuuacuuggaacaacccaauuaucaccuguaaacauaugcaccuuucgaggagacguaacacauauagcuggauccagaaauuauacaaugaauuuagccucacuaaacuggaacaauuacgauccaaccgaagaaauaccugccccuuuaggaaccccagacuuugucggaaaaauacaaggcguucuaacacaaacaacaaaaggagacggaucaacaagaggacauaaagccacaguauacaccgguucugcuccguucacuccaaaauuagguucaguacaauucucaacagacacagaaaaugauuucgaaacacaccaaaauacaaaauuuacaccaguaggcguaauacaagauggaggaaccacccauagaaaugaaccacaacaauggguauuaccaucauacuccggccgagauguccauaauguucaccuagcaccugcagucgcaccaaccuuuccaggagaacaacucuuauuuuuuagaucuacaaugccaggauguucaggauauccaaauauggauuuagauugcuuacuaccucaagaauggguacaacauuuuuaucaagaagcugccccagcucaauccgacguagcacuccuaagauuuguaaauccagacacuggaagaguccucuucgaaugcaaacuacauaaaucuggauauguaacaguagcacacacaggacaacacgaucuaguuauaccuccaaauggauauuuucgauucgauuccuggguuaaucaauuuuauacauuagcacccaugggaaauggaaccggacgucgacgcgcacuauaa

SEQ ID NO: 32854 - RNA, 1623 nt, Artificial Sequence
  derived and/or modified sequence opt6 from capsid_protein_VP1__Norovirus__AFX81184
augaaaauggcaucuaacgaugcaaacccaucagauggaucagcugccaauuuaguaccagaaguauccaaugaaguaauggcccuagaaccaguuguuggugcagcaauagcugcaccaguagcaggacaacaaaacgucauagacccauggauccgaaauaacuuuguacaagcaccaggaggagaauucacaguauccccaagaaaugcaccaggagaaauauuauggagugcuccauuaggaccagaucuaaauccauaucuaucacacuuagcacgaauguacaacgguuaugcuggaggauucgaaguuagaguaauacucgccgguaacgcuuuuacagcuggaaaaauaaucuuugcagcaguaccaccaaacuuuccuacugaaggauuaucuccaucacaagucacaauguucccacauaucauugucgacgucagacaauuagaaccaguacuaauaccccuacccgauguacgaaacaauuucuaucauuauaaccaaacaaaugacucuaccauaaaacuaauagcuaugcuuuacacaccauuacgagcgaauaaugcaggugaagauguauuuacaguaucaugccgaguauuaacaagaccaucaccagacuuugacuucauauuucuuguacccccaacaguugaaucaagaacaaaaccauuuacaguaccaauacuaacaguugaagaaaugacuaauucaagauuuccaauaccacuugaaaaacucuuuacuggaccaucaggcgcauuuguaguacaaccacaaaauggacgcuguaccaccgacggaguuuuacuaggaaccacucaauuaucaccaguaaauaucugcacauucagaggagacguuacccauauagcuggaagcagaaauuacacaaugaaccuagccucuuuaaauuggaauaauuacgaucccacagaagaaauacccgcaccacuuggaaccccagauuuuguaggaaaaauucaagguguacuaacucaaacuacaaaaggagauggaucaacacgaggccauaaagcaacaguauacacaggaucagcaccauuuaccccaaaauuaggguccguacaauuuucaacagauacugaaaacgacuucgaaacucaccaaaauacgaaauucacacccguaggaguaauacaagacggaggaacaacccaccgaaaugaaccccaacaauggguacuaccuucauacucuggaagagauguacacaauguacacuuagccccggccguagcgccaacauuuccaggagaacaauuacuuuucuuccgaagcacaaugccagguuguucaggauaccccaauauggaucucgauuguuuauuaccucaagaauggguucaacauuucuaucaagaagccgcuccugcacaaucagauguagcauuacuaagauucguaaacccugacacuggaagaguauuauucgaauguaaacuacauaaaaguggauacguaacaguagcacauacaggacaacacgaccuaguaauaccaccaaaugguuauuucagauucgauucuuggguuaaucaauucuauacuuuagcccccaugggaaauggaaccggaagaagacgugcacuuuaa

SEQ ID NO: 32855 - RNA, 1623 nt, Artificial Sequence
  derived and/or modified sequence opt6 from capsid_protein_VP1__Norovirus__AFX81187
augaaaauggccuccaaugaugcaaaccccagcgacggaucagcagcuaaucuaguaccagaaguaucaaaugaaguuauggcccuagaaccaguaguaggugcagcaauagccgccccaguagcaggccaacaaaacguaauagauccauggaucagaaauaacuuuguacaagccccaggaggcgaauuuaccguuuccccuagaaaugcaccaggagaaauauuauggucagcaccacuaggaccagaucuaaacccauauuuaucacauuuagcccgaauguacaacgguuacgcaggaggcuucgaaguacaaguaauacuugcaggaaacgcauuuacagcugguaaaauaauauuugcagcaguaccaccuaacuucccaacagaaggccuaucaccuagucaaguaaccauguucccacacauuauaguagaugugcgacaauuagaaccaguucuaauaccacuuccagauguacgaaauaauuuuuaucacuacaaucaaacaaaugacucaacuauaaaacuaaucgccauguuauacacaccacuacgagcaaacaaugccggugaagauguauucaccguuuccugccgaguauuaacaagaccaucuccagauuuugauuuuauuuuccuaguaccaccaacuguagaaucuagaacaaaaccguucacaguuccuaucuuaacaguagaagaaaugacaaacucuagauucccaauaccccuagaaaaacuauuuacuggccccucaggagcauuuguaguacaaccacaaaacggaagauguacaacugauggcguauuauuaggaacaacccaacuaucacccguaaauaucugcgcauuuagaggagacguuacacauauagccggcucacgaaauuauacaaugaaucuagccucauuaaacuggaacaacuacgauccaacagaagaaauaccagcaccucuaggaacaccagacuuuguagguaaaauacaaggaguacuaacacaaaccacaaaaggagacggaucuacaagaggacauaaagcaaccguauauacaggaucagccccauucacuccuaaauuagguucaguucaauucagcaccgauacagaaaaugauuucgaaacacaccaaaauaccaaauuuacaccuguaggaguuauacaagauggaggaacaacacacagaaaugaaccccaacaauggguauuaccaucauauagcggaagagauguccauaacguacacuuagcuccagcaguggcuccuaccuucccaggagaacaauuacuuuucuucagaucaacaaugccagguuguucuggauacccaaacauggauuuagauugcuuacuaccucaagaauggguucaacauuucuaucaagaagccgcaccugcacaaucugacguagcauuauuaagauucguaaacccagacaccggaagaguauuauuugaaugcaaacuacauaaaucuggauaugucacaguagcacacacaggacagcaugaucuaguuauacccccaaauggauauuucagauucgauucuuggguaaaucaauuuuauacacuugcaccuaugggaaacggaacuggaagacgcagagcucuuuaa

SEQ ID NO: 32856 - RNA, 1623 nt, Artificial Sequence
  derived and/or modified sequence opt6 from capsid_protein_VP1__Norovirus__AFX81217
augaaaauggcuucaaaugacgcaaaccccacagauggaucagcagcaaacuuaguaccagaaguaucaaaugaaguaauggcauuagaaccuguaguaggagcagcaauugcugcaccaguagcaggacaacaaaauguaauagacccauggauaagaaacaauuuuguacaagcaccuggaggagaauuuaccguaucaccacguaacgcaccaggagaaaucuuauggucagcgccacucggcccagaucuaaacccauaucuaucacaucucgcuagaauguacaacgguuaugccggaggcuuugaaguacaaguaauauuagcaggaaaugccuuuacagccggaaaaauaauauuugcagcaguacccccaaauuucccaacugaagggcuaucuccaucacaaguuacaauguucccccacauaauaguagauguacgacaacuagaaccaguacuaauaccacuaccagacguaagaaauaauuucuaucauuacaaucaaacuaacgacucaacaauaaaacuaauugcaaugcuauauacacccuuaagagcaaauaaugccggagaagacguauuuacaguauccugccgcguacuaacaagaccaucaccagacuuugauuuuauuuuccuaguaccaccuacaguagaaucaagaacuaaaccauucacaguuccaauauuaaccguagaagaaaugacuaacuccagauuuccaauaccauuagaaaaacuauuuacaggaccuagcggagcauucguaguucaaccacaaaacggacguuguacaacugacgguguuuuacuaggaaccacacaacuaagcccaguuaacaucugcaccuuuagaggugacguaacacauauagcaggaucacgcaauuauacuaugaaucuagcaucauuaaacuggaacaacuaugauccaacagaagaaauaccagcaccacucggaacaccagacuucguaggaaaaauacaagguguccuaacacaaacaacuaaaggagacggaucuacaagaggucauaaagcuacaguauauaccgguagcgcuccauuuacaccaaaacuaggguccguacaauucucgacagauacagaaaaugauuucgaaacccaucaaaauacaaaauucacaccaguaggugucauacaagacggcggaacuacucaucgaaaugaaccacaacaauggguccuaccaucauauucuggaagggacguacauaacguacaucuugcaccagcaguugcaccaacauuuccaggagaacaacuacuauuuuuuagaaguacaaugccaggaugcucaggauauccaaacauggauuuagauugccuacuaccucaagaauggguucaacauuucuaccaagaagcagcaccagcacaaucagauguagcacuacuccgauucguuaacccagacacaggccgaguacucuucgaaugcaaacuacacaaaucaggauaugucacaguagcccauacaggacaacacgaucuaguaauaccuccaaauggauauuucagauucgauucaugggucaaucaauucuacacacuagcuccaaugggcaauggaacuggaagaagacgugcauuauaa

SEQ ID NO: 32857 - RNA, 1623 nt, Artificial Sequence
  derived and/or modified sequence opt6 from capsid_protein_VP1__Norovirus__AFX81220
augaaaauggcaucaaacgaugcaaauccuucagauggaucugcagcaaaccuaguaccugaaguaucaaacgaaguaauggcacuagaacccguugcaggugcagccauagccgcaccaguagcaggacaacaaaauguaauagacccauggauaagaaauaacuucguacaagcaccaggaggugaauuuacaguuuccccucguaaugcaccaggagagauacuuugguccgcaccgcuagguccagaccuuaaucccuaccuaucacacuuagcacgaauguacaacggauacgcaggcggauucgaaguucaaguaauuuuagcaggaaacgcauucacagcaggcaaaauaauauucgcagcaguuccaccaaacuuuccaacagaaggucuaucuccaucccaaguaacaauguuuccacauauuauaguagauguucgacaacuagaaccaguacuaauaccccuuccagacgucagaaauaauuucuaucauuauaaccaaacuaaugauucaacaauaaaauuaaucgcaauguuauacacaccauuaagagcaaacaaugcaggagaagaugucuuuacaguaucaugccgaguacuaacaagaccaucaccugacuuugacuuuauauuucuaguaccaccaacaguagaaucccgaacaaaaccuuucacaguaccaauacugacaguagaagaaaugacgaauucaagauuuccuauaccauuagaaaaacuauucacaggaccauccggagcauuuguaguacaaccucaaaacggacgaugcaccaccgacggcguccuacuagguacaacacaauuauccccaguaaauauauguacauuucgaggcgacguaacacauauagcuggaucaagaaauuacacuaugaacuuagcaucucuaaauuggaauaauuacgauccaacagaagaaauaccugcaccauuaggaacaccagacuucguaggaaaaauacaagguguauuaacacagacaacaaaaggugacggauccacacgcggacacaaagcaacagucuauacagguucagcacccuuuacaccaaaauuaggaucuguccaauucucuacagauacagaaaaugacuucgaaacacaucaaaacacaaaauucaccccaguaggaguaauacaagacggaggcacaacccauagaaaugaaccccaacaguggguuuuaccaaguuauuccggaagagacguacacaacguucaccuagcaccagcaguagcaccaacauuucccggcgaacaauuacuauucuucagauccacaaugccaggauguucuggauauccaaacauggacuuagauuguuuacucccacaagaauggguucaacacuuuuaucaagaagcagcaccagcucaaucagauguagcacuauuacgauucguaaauccagacacaggaagaguacucuucgaauguaaauuacauaaaucaggauauguaacaguagcacauacaggccaacacgauuuaguaauaccaccaaauggauacuuccguuuugacucauggguuaaucaauuuuacacacuagcucccaugggaaauggaacaggccgaagacgagcauuauaa

SEQ ID NO: 32858 - RNA, 1623 nt, Artificial Sequence
  derived and/or modified sequence opt6 from capsid_protein_VP1__Norovirus__AFX81223
augaaaauggcuuccaaugaugcaaacccaucugacggcucagcugcaaauuuaguacccgaaguuucaaacgaaguaauggcuuuagaaccagucguaggagcagcaaucgcagccccaguagcaggacaacagaauguaauugacccauggauaagaaauaacuuuguucaagcaccaggaggagaauucacagucucuccucgaaacgcacccggcgaaauauuauggucugcccccuuaggcccugaucuaaacccuuaucuaucccaucuagcccgcauguauaacggauacgccgguggauuugaaguacaaguaauacuagcaggaaaugcauucaccgcgggaaaaaucauauucgcugcagucccucccaauuucccaacugaaggauuaucacccucucaaguaacaauguucccacacauaauaguugacguaagacaauuagaaccagucuuaauaccacucccugauguaagaaacaauuucuaccacuauaaccaaaccaaugacuccacaauaaaauuaauagcaaugcuuuauacaccacuaagagcaaauaaugccggagaagacguauucacaguuuccugcagaguuuuaaccagaccaucaccagauuucgauuuuauuuuuuuaguaccaccuacaguagaaucucgaacuaaaccauucaccguaccuauauuaaccguagaagaaaugacaaacucaagauuuccaauuccuuuagaaaaacuauucacaggaccaucaggagcauucguaguacaaccucaaaauggaagaugcaccacagauggaguacuucuaggaacaacacaacuaucuccuguuaauauauguaccuuucgcggugacguaacacacauagcaggcucaagaaauuauacuaugaaucuagcaucauuaaauuggaacaacuacgauccaaccgaagaaaucccugccccacuaggaacaccagauuuuguugguaaaauacaaggagucuuaacacaaacaaccaaagaagacggcucaacucgaggucauaaagcuaccguauacacagguucagcuccuuuuacaccaaaacucggaucaguucaauuuaguacugauacagaaaaugauuucgaaacacaccaaaauacaaaauucacaccuguaggagucauucaagacggaggcacuacccacagaaaugaaccacaacaauggguuuuacccuccuauucaggaagagacguccauaacguccauuuagcaccugcagucgcaccuacauuuccaggagaacaaaucuuauucuuucgaaguacaaugccaggaugcucuggauaucccaauauggaucuagauuguuuacuaccacaagaauggguacaacauuuuuaucaagaagcagcacccgcacaaucugacgucgcacuccuaagauucguaaacccagauacaggcagaguuuuauucgaauguaaacuacacaaaucaggauauguaacaguagcacacacaggucaacaugauuuaguaauacccccaaauggguauuucagauuugauucuuggguaaaucaauuuuauacucuagcaccaaugggaaaugguacaggacgucgccgagcucucuaa

SEQ ID NO: 32859 - RNA, 1623 nt, Artificial Sequence
  derived and/or modified sequence opt6 from capsid_protein_VP1__Norovirus__AFX81235
augaaaauggcauccucagacgcaaacccauccgauggaucuacagcaaacuuaguaccagaaguaaacaaugaaguaauggcacuagaaccaguuguaggagcagcuaucgccgcaccaguagcaggacaacaaaacguuaucgauccuuggauaagaaauaacuucguacaagcaccuggaggcgaauuuacaguaucucccagaaacgcaccaggugaaauacuauggucagcaccucuagguccagauuuaaacccauauuuaucccacuuagcaagaauguauaacggauaugcaggaggcuuugaaguacaagucauacuagccggaaaugccuuuacagcagguaaaauaauauucgcagcaguaccaccaaacuuucccaccgaaggacuauccccuucacaaguaaccauguucccacacauaaucguagauguucgccaauuagaaccaguacuaauaccacuaccugacguccgaaauaacuuuuaucacuauaaucaaucaaacgauccaacaauaaaauuaauagcaaugcuauauacaccauuaagagcuaauaacgcaggagacgauguuuuuacuguuuccuguagaguauuaacaagaccaucaccagacuucgacuuuaucuuccuaguaccaccaacuguugaaucaagaacaaaaccauuuucaguaccaguauuaacaguugaagaaaugacaaauucccgcuuuccaauaccauuagaaaaauuauuuacaggaccauccuccgcauuuguaguacaaccacaaaauggucgauguacaacagauggaguacuccucggaacaacucaacuaucaccugucaauauauguacauuccguggagauguaacccauaucucaggaaguagaaauuacacaaugaauuuagcaucccaaaacuggaauuccuaugacccaacagaagaaauacccgcaccacuaggaacaccagacuucgucggaaaaauacaaggaguuuuaacacaaacaacuagaacaaaugggaguacacguggacacaaagcuaccguauauacaggaucagcagacuuuucaccaaaacuaggacgaguacaauucgcaacagauacugacaacgacuuugaaacaaaucaaaauacaaaauucacaccuguuggcguuauucaagacggcucaacaaccccucgcaacgaaccacaacaauggguucuacccucauacucaggaaggaacauucauaauguccacuuagcaccugccguugccccaaccuuuccaggagaacaauuacucuucuuccgaucaacuaugccaggaugcucaggauauccaaauauggaucuagauugucuccuaccacaagaauggguacaauauuuuuaucaagaagcagcuccagcacaauccgauguugcuuuacuacguuucguaaacccagauacaggucguguccuuuuugaauguaaacuacauaaaucaggauaugucacgguagcacacacaggucaacacgaucuaguaauuccaccuaauggauauuuucgauuugacucauggguaaaucaauuuuauacauuagcaccaaugggaaauggaacaggaagaagaagagcucuuuaa

SEQ ID NO: 32860 - RNA, 1623 nt, Artificial Sequence
  derived and/or modified sequence opt6 from capsid_protein_VP1__Norovirus__AFX81259
augaaaauggcaucaaaugacgcaaauccaucugauggauccgcugcaaaucuaguaccagaagucucaaacgaaguaauggccuuagaaccaguagucggugcagcgauugcugcaccaguagcaggacaacaaaacgucaucgacccauggauuagaaauaacuucguccaagcaccaggaggugaauuuacagugucaccaaggaaugcaccaggagaaauauuauggucagcaccuuuaggacccgaucuaaauccuuaucuaucacacuuagccagaauguauaacggauaugcuggagguuuugaaguccaaguaauacuugcaggaaaugcauuuaccgcaggaaaaauuauuuucgcagcaguaccaccaaauuuuccaacugaaggacuaucaccaagccaaguaacaauguuuccacacauaauagucgauguaagacaacuagaaccaguacuaaucccacuucccgaugucagaaacaacuucuaucacuauaaucaaaccaacgauuccacaauaaaauuaauagccaugcuauacacaccauuaagagcaaauaaugcaggagaagaugucuucaccgucucuugcagaguacuaacccgaccaucacccgacuuugacuucauauuucuaguaccaccaaccguagaaucaagaacaaaaccuuuuacugucccaaucuuaacagucgaagaaaugacaaauucacgcuuucccauaccacuugaaaaacuauucacaggaccaucaggagcauucguaguccaaccacaaaauggacgauguaccaccgauggaguauuacuagguacaacacaacuaucaccagucaauauuuguaccuuuagaggagauguaacucauauagccggaucaagaaauuacacaaugaaucuagcauccuuaaauuggaauaauuacgauccaaccgaagaaauaccagcgccauuaggcacaccagacuuuguagguaaaauacaaggaguauuaacucaaacaacaaagggagauggaucuacaagaggacacaaagccacaguauauacuggaucagcaccuuuuacuccaaaacucggaucaguacaauucucaacagacacagaaaacgacuucgaaacccaucaaaauacaaaauucacucccguaggcguaauacaagacggaggaacuacacaucgcaaugaaccacaacaauggguacucccaucauacucaggucgugacguccauaacguacaccuagcaccagcagucgcaccaacauuuccaggugaacaacuuuuauucuuuagauccacaaugccagguugcucaggcuauccuaacauggaucuagauugccuacucccacaagaauggguccaacauuucuaucaagaagcagcucccgcacaaucagaugucgcacuacuaagauucguuaacccagacacuggacgaguacucuucgaauguaaacuccauaaaccaggauacguaaccguagcacauacaggacaacaugaucuaguaauaccaccaaauggauacuucagauucgacucauggguaaaccaauuuuacacacucgcaccaaugggaaacgguacaggaagaagacgagcacucuaa

SEQ ID NO: 32861 - RNA, 1623 nt, Artificial Sequence
  derived and/or modified sequence opt6 from capsid_protein_VP1__Norovirus__AFX81280
augaaaauggcauccaaugaugcaaacccauccgauggaucagcagcaaaccuaguucccgaagucagcaacgaaguaauggcuuuagaaccaguaguaggagccgcaauagcagcaccuguagcaggacaacaaaauguaauagauccuuggauaagaaauaacuuuguccaagcaccaggaggugaauucacaguuuccccaagaaacgcaccuggagaaauuuuauggggagcccccuuaggaccagaucuuaauccauaucuaucacauuuagcacgcauguauaauggauacgcagguggauucgaaguacaaguuauccuagcaggaaaugccuuuacagcuggaaaaauaauauucgcagcaguaccaccaaacuuuccgacagaaggacuaucuccgucccaaguaacaauguuuccacauauaauaguagauguucgacaacuagaaccagucuuaauaccacuaccugacguaagaaacaauuuuuaccauuauaaccaaaccaacgauucuacaauuaaauuaauagccauguuauacacaccauuaagagcaaacaaugcaggagaagauguauuuacaguauccugcagaguacucacuagaccaucaccugacuucgauuuuauauucuuaguuccaccuacaguggaaucacgaacuaaacccuucacuguaccaauucuuacaguugaagaaaugacaaacuccagauucccaauuccacuagaaaaacuauucaccgguccaucuggagcuuucguaguucaaccacaaaacggcagauguacaacagacggaguucuauuaggaacuacacaauuauccccaguaaacauaugcacauuuagaggagacguaacacauauagcaggauccagaaacuacacaaugaaucuagcauccuuaaauuggaacaacuaugaucccacugaagaaauacccgcaccacuaggaacgccagauuuuguagguaaaauacaaggaguauuaacucaaacuacaaaaggcgacgguucuacaagaggacacaaagcaacagucuauacaggcucagcaccauuuacaccuaaauuaggaucaguacaauuuucuacagacacagaaaacgauuucgaaacacaucaaaacacaaaauuuacaccaguaggugugauacaagacggcggaacaacucacagaaacgaaccacaacaauggguacuaccaucauauuccggccgagauguacacaacguucauuuagccccagcaguagcaccaacauuccccggugaacaacuauuauuuuuccgaucaaccaugccagguuguucaggcuauccaaauauggaucuagauugucuccuaccccaagaauggguacaacacuuuuaccaagaagcagcaccagcacaaucagauguagccuuauuaagguucguuaaucccgacacaggacguguacuuuucgaaugcaaauuacacaaauccggcuacguaaccgucgcucauaauggacaacaugacuuagucaucccuccaaauggauauuuuagauuugacucauggguaaaucaauucuacacuuuagcuccaauggguaacggaacaggaagacgcagagcacuauaa

SEQ ID NO: 32862 - RNA, 1623 nt, Artificial Sequence
  derived and/or modified sequence opt6 from capsid_protein_VP1__Norovirus__AFX81286
augaaaauggcaucaaaugacgcaaacccaagugauggcucagcagcaaaucuagucccugaaguaaguaaugaaguuauggcacuagaaccaguaguaggagcagcaaucgccgcccccguugcuggacaacaaaauguaauagacccauggauaagaaacaauuucguacaagcuccaggaggagaauuuaccguuucaccuagaaaugccccaggugaaauacuaugguccgcaccauuaggaccagaccuaaauccauacuuaucacacuuagccagaauguauaacggauacgcaggagguuuugaaguucaaguaauacuagcaggaaaugcauuuacugcaggaaaaauaauauucgcagcaguaccaccaaacuuuccaacagaaggauuaagcccuagccaaguaaccauguucccccacauaauaguagacguacgacaacucgaaccaguauuaauaccacuuccagaugucagaaacaauuucuaccacuauaaucaaacaaaugacucaacaauuaaauuaaucgcuaugcuuuacacuccccucagagccaacaaugcaggugaagauguauucaccguuucaugcagaguacucacccgaccaucucccgacuuugauuuuauauuucuaguaccaccaacugucgaaucaagaacaaaaccuuuuacugucccuaucuuaacaguagaagaaaugacaaauucuagauuuccaauaccauuagaaaaacuauuuacuggaccaucuggagcauucguaguacaaccacaaaauggucgcuguacaacugauggaguacuauuaggaacaacacaauuaucacccguaaauauaugcaccuuuagaggagacguaacccauauagcagguucucgaaacuauacaaugaaucuugcuucucuaaacuggaauaacuaugauccgacagaagaaauaccugcaccuuuagguacaccagacuuuguaggaaaaauacaagguguucuaacacaaacaaccaaaggagauggaucaacucgaggucauaaagcaacuguauauacugguagcgcuccauuuacaccaaaacuaggaucuguccaauucuccacagauacugaaaacgauuucgaaacacaucaaaacacaaaauuuacuccaguaggaguuauacaagacggaggcacuacacauagaaacgaaccucaacaauggguuuuaccaucauauuccggucgagauguacacaacguucauuuagccccugcaguagcacccacauuccccggagaacaacuucuuuucuuuagaucuacaaugcccggaugcucaggauaccccaacauggaucuagauugccuucucccacaagaauggguacaacauuucuaucaagaagcagcuccagcacaaucagaugcugcucuauuaagauucguaaauccagauacuggaagaguccuauucgaaugcaaguuacauaaauccggauauguaacaguagcucacacaggacaacacgauuuaguaaucccaccaaauggauauuuccgcuuugacuccuggguaaaucaauuuuacacacuagcgccaaugggaaauggaacaggacgaagacgagcacucuaa

SEQ ID NO: 32863 - RNA, 1623 nt, Artificial Sequence
  derived and/or modified sequence opt6 from capsid_protein_VP1__Norovirus__AFX81310
augaaaauggcaucuaaugaugcaaauccaucagauggauccgccgcgaauuuaguaccugaagucucaaaugaaguaauggcacuugaaccaguaguaggagcagcuauagcagcaccuguagccggacaacaaaaugucauugauccauggauaagaaacaacuucguucaagccccuggaggugaauuuacaguaucaccaagaaaugccccaggagaaauacuuuggagugcaccccuaggaccagaucucaauccuuaccuaucacacuuagcuagaauguauaaugguuacgcaggagguuuugaaguacaaguaauacuagcuggaaacgcauuuacagcaggaaaaauaauauucgcagcaguaccuccuaacuucccaacugaaggacuaucaccuucacaaguuacaauguucccacauauaaucgucgacguacgacaacuugaaccaguuuuaauaccuuuaccagauguaagaaacaacuucuaucacuauaaccaaacaaaugauucaacaauaaaauuaauagcaaugcuuuauacacccuuaagagcuaacaacgcaggagaagauguauucacaguaucuugccgaguucuaaccagaccuucaccagauuuugauuucauauuuuuaguacccccuacaguagaaucacgaacaaaacccuuuacugucccuaucuuaacaguugaagaaaugacuaacucaagauuuccaauuccauuagaaaaauuauucacaggaccaucgggagcauucguaguacaaccccaaaauggaagauguacaacugacggcgucuuacuaggcacaacacaauuaucaccagucaauaucuguacauuuagaggugauguaacacacauagcagguucacgaaauuacacaaugaaucuagccucauuaaacuggaauaauuaugauccuacugaagaaauaccagcaccacuaggcacaccagauuuugucggaaaaauacaaggaguccuaacacaaaccaccaaagaagaugguucaacuagaggucacaaagcaacaguauauacagguucagcaccauuuacaccaaaauuaggaucaguacaauucucaacagauacagaaaacgauuucgagacucaucaaaauacuaaauucaccccugucgguguaauacaagauggaggaacaacacauagaaaugaaccacaacaauggguucuuccaucauauagcggaagagauguacauaacgugcacuuagcaccagcuguagcaccaaccuucccaggagaacaacuuuuauuuuuucgcucuaccaugccuggaugcucaggauacccaaauauggaccuagauuguuuguuaccacaagaauggguucaacacuucuaccaagaagcagccccagcucaaucagauguagcauuauuaagauuuguuaauccagauacuggaagaguacuauuugaauguaaacuacauaaauccggauacguaacaguugcacacacuggacaacaugaucucguuauaccucccaacggauacuuuagauuugauuccuggguaaaucaauuuuauacuuuagcaccaaugggaaaugguaccggacgaagaagagcauuauaa

SEQ ID NO: 32864 - RNA, 1623 nt, Artificial Sequence
  derived and/or modified sequence opt6 from capsid_protein_VP1__Norovirus__AGE89469
augaaaauggcaucaaacgacgcuaauccaucagauggaucugcugcuaaucucguuccagaaguauccaaugaagucauggcucucgaacccguugucggugccgcaauagcugcaccuguagcaggccaacaaaauguaauagauccuuggauaagaaauaauuuuguacaagcaccaggaggugaauucacaguauccccaagaaacgcaccuggugaaauacucugguccgcacccuuagguccagaucuaaauccguaucucagucacuuagcaagaauguauaacggauacgcaggcggauucgaaguacgcguaauauuagccggaaaugcauuuaccgcugguaaaauaauuuucgcugccguuccaccaaacuuuccaacagaaggacucucuccaucucaaguaacuauguucccacacauaauuguugacguuagacaacuagaaccaguacuuauacccuuacccgacguaagaaauaauuucuaccacuauaaucaaaccaaugacaguacaauuaaacuaauagcaauguuauauacaccauuaagggcuaauaaugcuggugaagacguauuuacaguuuccuguagaguacuuacuagaccaucaccagacuuugauuucaucuuuuuaguaccuccaacagucgaaucuagaacaaaaccauucaccguaccaauauuaacgguagaagaaaugacaaacucaagauuccccauacccuuagaaaaacuauucaccgguccaucaggagcauucguaguacaaccucaaaacgguagaugcacaacugacggaguucuacuagguacuacacaacuuuccccaguaaauauaugcacauuuagaggagauguaacacauauagcagguucaagaaacuacacaaugaaucuagcaucauuaaacuggaauaacuaugauccaacugaagaaauaccugccccacucggaacuccagauuucguaggaaaaauacaaggaguucuaacucaaacaacuaaaggagacggaucaacacgaggacacaaagccacuguauauacaggaucagcucccuuuacaccaaaacuaggaucaguccaauucucaacagauacagaaaaugauuuugaaauacaucaaaacacaaaauucacuccaguaggaguaauacaagacggaggaacaacacauagaaaugaaccacaacaaugggugcuacccucauauuccggacgagauguccauaauguacauuuagcaccugcaguagccccaaccuucccuggagaacaacuucuuuucuuuagaucaacaaugccaggauguucaggauauccaaauauggaucuugauugccuucuaccacaagaauggguucaacauuucuaucaagaagcagcaccagcacaaucagacguagcauuacuaagauucguaaacccagacacuggacgcgucuuauucgaauguaaacuacauagaagcggauauguuacaguagcacauacaggacaacaugaucuaguaauaccuccuaacggcuauuuuagauuugauucuuggguaaaucaauuuuauacacuagcaccaaugggaaauggaaccggaagaagaagagcucuauaa

SEQ ID NO: 32865 - RNA, 1623 nt, Artificial Sequence
  derived and/or modified sequence opt6 from capsid_protein_VP1__Norovirus__AGE89484
augaaaauggcaucaaaugaugcaaacccaucagauggaucagcugccaaccuaguaccugaaguaucaaaugaaguaauggcacuagagccugucguaggagcagcaauagcugcaccaguagcaggccaacaaaaugugauagauccauggauuagaaauaacuucguacaagccccaggaggugaauuuacagucuccccacgaaaugcaccaggugaaauauuauggucagcaccacuuggcccagaucuaaauccauaucuaagccaccuugcaagaauguacaauggauacgcaggaggcuucgaaguacaagucauacucgcaggaaaugccuucacugcaggaaaaauaauauuugcagcuguuccuccuaacuuuccaacagaaggacugucaccuucccaaguaacuauguuuccacauauaauagucgacgugcgacaauuagaaccuguauuaauuccauuaccagauguuagaaauaacuuuuaucacuauaaucaaaccaaugacucaacuauuaaauuaauagccaugcuuuacacaccacuaagagccaacaaugccggagaagauguuuuuacaguaucaugcagaguucucacaagaccuuccccagacuuugauuuuaucuuccucguuccuccuaccguugaaucaagaacaaaaccauuuacaguaccaauauuaacaguagaagaaaugacaaacucacgcuuuccaauaccccuugaaaaauuauuuacuggaccuucaggagcauucguuguccaaccacaaaauggaagauguacaacagauggaguacuauuaggcacaacacaauuaagcccuguaaauauauguacauuuagaggagauguaacacauauugcaggaucaagaaauuauacaaugaauuuagcauccauaaacuggaacaauuacgauccuaccgaagaaaucccagcaccucucgguacaccugauuucgucggaaaaauacaagguguauuaacccaaacaacaaaaggugauggaucaacuagaggccauaaagcaacaguauauaccggcagugccccauuuacaccuaaacuaggaucuguacaauucucaacagacacagaaaacgauuucgaaacccaccaaaacacaaaauuuacacccgucggugucauucaagauggcggaacuacacacagaaaugaaccacaacaauggguauuaccaucauauucaggaagagacguccauaacguccacuuagcuccugcaguagcuccaacuuuucccggagaacaacuacuauuuuuucguucuacaaugccagguuguuccggauauccaaauauggacuuagauuguuuacuaccacaagaauggguacaacauuuuuaucaagaagcagccccagcacaaucagacgcagcacuucuacgauucgucaauccagacacaggaagaguauuauucgaaugcaaguuacauaaaucuggauauguaacuguagcacacacaggccaacacgaccucguaauaccuccaaauggauauuucagauuugauucauggguaaaucaauuuuacacacuagcaccuauggguaauggaacagggagaagacgagcauuauaa

SEQ ID NO: 32866 - RNA, 1623 nt, Artificial Sequence
  derived and/or modified sequence opt6 from capsid_protein_VP1__Norovirus__AGE89487
augaaaauggcuucaaacgaugcaaacccaucagacggaucugccgcaaaucuaguaccagaaguaaacaaugaagucauggcuuuagaaccaguaguaggagcugccauagcugcaccaguagcaggacaacaaaauguaauugacccauggauacgaaauaauuuuguacaagcaccuggcggagaauuuacaguaucuccacguaacgcuccaggagaaauccucuggagcgccccacuuggaccagaucuaaacccuuaucuaucucaccuugcaagaauguacaacggauacgcaggagguuuugaaguacagguaauauuagccgguaaugcauuuacagcaggaaaaauaauauuugcagccguacccccuaacuuccccacagaaggacuuucaccaucccaaguaacaauguuuccucacauuauaguagacguaagacaacuagaaccaguuuuaaucccacuaccagacguuagaaauaacuuuuaucacuauaaucaaucuaaugacagcacaauuaaacucauagcaauguuauauacaccauuaagagcuaacaaugccggagaagauguauuuaccguaucauguagaguccuaacucgcccuuccccugacuuugacuucauauuccuuguaccaccaacaguugaauccagaacuaaaccauucacaguaccuauauuaacaguugaagaaaugacaaauucacgauucccaauaccauuagaaaaacuauucacugguccaucuggagcauucgucguacaaccacaaaacggacgauguacaacagacgguguacuacuaggaacaacacaacuaucaccuguaaauaucuguacauuucgcggagauguaacccauauagcaggaucaagaaacuauacaaugaaucuagcuucacuaaacuggaacaacuaugauccaacagaggaaauuccagcaccacucggaacuccugauuuuguuggcaaaauacaagguguauuaacacaaaccacaaaaggagaugguucaacuagaggacacaaagcaacaguauauacuggaagcgcuccauucaccccuaaauuaggaaguguacaauuuucaacagacacagaaaacgauuucgaagcacaccaaaauacuaaauuuacacccguuggcguaauacaagaugguggaaccacacacagaaacgaaccucaacaauggguacuaccuucuuacucaggcagagauguacacaacguucauuuagcuccagcagucgcuccuaccuucccaggagaacaacuauuauuuuuuagaucuacuaugcccggauguucuggauauccaaauauggaucuagauugucuacuaccacaagaauggguacaacacuuuuaccaagaagcagcaccagcacaaucggacguagcauuacuuagauuuguaaauccugacacaggaagaguauuauucgaaugcaaacuacauaaaagcggauauguaacaguagcacauacaggacaacacgaucuaguaaucccaccaaauggauacuuccguuucgacaguuggguaaaucaauuuuauacucucgcaccaauggguaauggaacuggaagacgaagagcauuauaa

SEQ ID NO: 32867 - RNA, 1623 nt, Artificial Sequence
  derived and/or modified sequence opt6 from capsid_protein_VP1__Norovirus__AGE89619
augaaaauggcaucgaaugacgcuaauccuucagaugguucugcagcaaacuuaguaccagaaguaucaaacgaaguuauggcauuagaaccaguuguaggagcagcaauagcagcaccuguagcuggacaacaaaauguaauagauccauggauaagaaauaauuuuguacaagcacccggaggcgaauuuacuguaucaccacguaaugccccaggugaaauauuauggucagcaccacuagguccagaucuaaacccuuaccuuucccaucuagcccgaauguauaacggauacgcaggaggguucgaaguacaagucaucuuagcaggaaaugcauuuacagcaggaaaaauaauauuugcagcagucccaccaaacuucccaacagaaggucuaaguccaucucaaguaacaauguuuccucacauaauaguagauguaagacaauuagaaccaguacuaauaccauuaccagacguuagaaauaauuuuuaccacuauaaccaaaccaacgauucaacuauaaaacuaauagcuauguuauacacaccauuaagggcuaauaacgcaggagaagaugucuuuacagucucaugucgagucuuaacaagaccaucaccagacuuugauuuuauuuucuuaguaccaccuacaguagaaucccgaacaaaaccauuuacaguaccaauauuaacaguggaagaaaugaccaacucgagauucccaauaccacuagaaaaacuuuucacuggaccaaguggagcauucguuguacaaccccaaaacggacgcugcacaacagacggcguacuacuuggaacaacucaacuuuccccaguaaauaucuguacauucagaggcgauguaacacacaucgcuggaaguagaaacuauacaaugaaccucgcaucauuaaauuggaacaacuaugauccaacagaagaaauacccgcaccacucgguaccccugacuuuguuggaaaaauacaaggcguacuaacacaaacuacaaaaggagacgguucuacacgaggacacaaagcaaccguuuacacaggaucugcaccauuuacacccaaacuaggaucaguccaauucucuaccgauacagaagacgauuucgaaacacaucaaaacacuaaauuuacaccaguuggugucauacaagauggagguacaacacaucgcaacgaaccacaacaauggguauuaccuucauacucagguagagauguacauaacguacaucuagcacccgcaguugcaccaacauuuccuggagagcaauuauuauucuuuagauccacaaugccaggaugcucuggcuauccaaacauggauuuagauugucuacuaccacaagaauggguacaacacuucuaccaagaagcagcaccagcacaaucagacguagcauuauuacgauucguaaacccagacacaggaagaguuuuauucgaauguaaauuacauaaaucuggauauguaacuguagcacauacaggacaacacgaucuaguaauuccaccaaauggauacuucagauucgacuccuggguaaaccaauucuauacacuagcaccaaugggaaacgguacaggaagacgcagagcacuauaa

SEQ ID NO: 32868 - RNA, 1623 nt, Artificial Sequence
  derived and/or modified sequence opt6 from capsid_protein_VP1__Norovirus__AGE89670
augaaaauggcaucaaacgaugcuaacccaucagacggaucugcagcuaacuuaguacccgaaguauccaaugaaguaauggcuuuagaacccguaguuggcgcagcuauagcagcaccugucgcaggacaacaaaacguuauugacccauggauuagaaauaacuuuguacaagccccaggaggagaauuuacaguaucaccaagaaaugcaccuggagaaauacucuggagugcaccauuagguccagaccuaaacccauaucuaucacaucuugcaagaauguauaacggauaugcagguggauucgaaguacaaguaauauuagccggaaacgcguuuacugcagguaaaauaaucuucgcagcaguacccccuaacuuuccaaccgaaggacuaucaccuucacaaguuacaauguucccccauauaauaguagauguucgucaacuagaaccaguauuaauuccuuuaccagauguaagaaacaacuuuuaccacuauaaccaaacaaaugacccaacaaucaaacuaauagcuauguuauacacaccacuccgugcaaauaaugcaggugaagacguauuuaccguaucauguagaguccuaaccaggccauccccagauuuugacuuuauauuucuaguuccuccuaccguagaaucccgaacaaaaccauucacuguuccuauauuaacaguagaagaaaugacaaauucaagauuuccaauuccccuagaaaaacuauuuacaggaccaucaggcgcauucguaguacaaccccaaaacggaagauguaccacugauggaguauuauuaggaaccacacaauuaucaccuguaaauauauguacauucagaggagacguaacacauauagcaggcucuagagauuauacaaugaaccuagcuucgcuaaauuggaauaauuacgacccaacagaagaaaucccagcaccacuaggcacaccagacuuuguagguaaaauacaaggcguacuuacacaaacuacccgcggagacggaucaacucgaggacacaaagcaaccguauauacagguucugccccauuugcaccaaaacuuggaucaguccaauuuuccacagauacagaaaaugacuuugaaacucaucaaaauacaaaauuuacuccaguaggugucauacaagacggaggaacaacacaucgaaacgaaccacaacaauggguacuaccuucauacucugguagagauguacauaacguucacuuagcaccagcaguugcaccaaccuuuccaggagaacaauuacuauucuuucgaucaacaaugccaggauguucaggauacccaaauauggauuuagacugucuauuaccucaagaauggguacaacacuuuuaucaagaagcagcaccagcacaaucagacguugcacuacuucgcuucgucaauccagacacaggaagaguauuauucgaaugcaaauuacauaaaucaggauauguaacaguagcccauacuggccaacaugaucuaguaauaccaccaaauggauauuuuagauucgacucauggguuaaucaauucuacacacuagcaccaaugggaaacgguacuggaagaagacgagcauuauaa

SEQ ID NO: 32869 - RNA, 1623 nt, Artificial Sequence
  derived and/or modified sequence opt6 from capsid_protein_VP1__Norovirus__AGE99596
augaaaauggcaucuaacgaugcaaauccuucugaugguucagcagcaaaucuaguaccugaaguaaacaaugaaguaauggcauuagaaccaguaguaggagcagccauagcugcaccaguagcaggacaacaaaauguaauagauccauggauaagaucaaauuuuguacaagcaccaggaggugaauuuacaguuucaccacgaaaugcuccaggagaaauauuauggucagcgccacucggaccagaccuaaauccauaccuuucacauuuagcacgaauguauaauggauacgcagguggauuugaaguccaaaugauucuagcaggaaaugcauuuacagcaggcaaaauuauauucgcagcuguaccaccaaauuuuccaacagaaggacuaaguccuucccaaguaacuauguucccucacauuauaguagacguaagacaacuagaaccaguauuaauaccacuccccgauguaagaaacaacuuuuaucauuauaaucaaucuaaugacccaaccaucaaacuaauagcaauguuauacacaccacuaagagcaaauaacgcaggagaugacguuuuuacaguaagcuguagaguuuuaacaagaccaagcccagauuuugacuucauuuuuuuaguaccaccaacagucgaaucacgaacaaaaccuuuuaccguaccuguauuaacaguagaagaaaugaccaauucuagauuuccaauaccucuagaaaaacuauucacaggucccucaucagcauucguaguacaaccacaaaacggacgaugcacaacagauggagucuuauuagguaccacucaacuauccccaguaaauauaugcacauuuagaggugauguaacacauaucgccggaucccgaaacuauacuaugaauuuagccucuuuaaauuggaacaacuacgacccaacggaagaaauacccgccccacucggaacaccagauuucguaggaaaaauucaagguguauuaacccaaacaacuaaaggugauggaucgacaagaggacauaaggcuacuguauacacaggcuccgcagauuuuacaccaaaauuaggaucuguccaauucggaaccgauacagauaacgauuucgaaacacaccaaaacacaagauuuacaccaguaggaguaauacaagauggagcaacuacacaccgaaaugaaccccaacaauggguacuuccuucauauagcggaaggaacguacauaauguccaccuugcaccagcgguugccccaaacuuccccggagaacaacuacuauuuuuuagaucaacaaugccaggaugcucaggauauccaaauauggauuuagauugucuauuaccucaagaauggguucaacacuuuuaucaagaagcagcaccagcacaauccgauguagcauuacuaagauucguaaauccagauacuggacgaguacuuuucgaaugcaaacuccauaaaagcggauauguaacaguagcacacaccggccaacacgaccuaguaauuccaccuaacggcuauuucagauuugauucauggguaaaucaauuuuacacauuagcaccaaugggaaaugguacaggaagaagacgagcauuauaa

SEQ ID NO: 32870 - RNA, 1653 nt, Artificial Sequence
  derived and/or modified sequence opt6 from capsid_protein_VP1__Norovirus__AGE99599
augaaaauggcuucaaaugaugcagcaccauccaaugauggcgcagcaaaucugguaccagaggcuaauaaugaaguaauggcacuagaaccaguaguaggagcuucuauagcagcuccaguaguaggucaacaaaauauaauagaccccuggauaagagaaaacuuuguacaagccccacaaggagaauuuacaguauccccacgaaacucaccuggagaaauguuacuuaaucuugaacucggaccagaacuaaacccauacuuaucacauuuaucaagaauguauaaugguuacgcuggaggaaugcaaguacaaguaguauuagccggaaaugcauuuacagccggaaaaauaauuuuugccgcaguacccccacacuuuccaguagaaaacauaagugcagcucaaauaacaauguguccacauguaauaguagauguacgacaacuagaaccaguauuacuaccauuaccagacauaagaaaccgauucuuucauuacaaucaagaaaguacuccaagaaugagacuaaucgcaaugcuauacacuccacuaagagcaaauucaggcgaagauguuuucacaguaucuugcagaguacuaacacgaccagccccggauuuugaauucacuuuucuaguuccuccaacagucgaaucaaaaacaaaaccuuuuacccuaccuauacuuacacuuggugaauuaucuaauucacgauucccagcagcuauagauauguuauauaccgacccaaaugaaucaauuguaguucaaccacaaaaugguagauguacacuugauggaacauuacaaggaacgacccaacucgucccaacucaaauaugcgcauucagaggaacgcuaauaucacaaaccgcaagagcagcagauucaacagauucuccacaaagagcuagagaccauccacuacacguccaaguaaaaaaucuugauggcacacaauaugaucccaccgaugauauaccagccguucuaggagccauugauuucaaaggaaccguuuucggaguagcaagucagagagacguaucaggacaacaagaacaaggacacuaugcaacacgagcucaugaagcacauauagauacuacagacccaaaauaugcaccaaaauuaggaacaauacuuauaaaaucagaaucuaaugauuuuacaacaaaucaaccuauaagauuuacaccagucgguaugggagacaauaauuggcgacaaugggaauuaccagacuauagcggacgauuaacauuaaacaugaaccuugccccagcaguaaguccaucuuuuccuggagaaagaauauuauuuuuccgcucaauaguacccucagcaggagguuucggaucaggauacauagacugucuuauaccacaagaguggguacaacacuucuaucaagaagcagcaccaucccaauccgcaguugcacuaguaagauacguaaacccugacacaggaagaaauauauucgaagcaaaacuacaucgugaagguuuuuuaacugucgcaaauucaggaaauaacccaauaguaguaccaccaaacggauauuuuagauucgaagcauggguaaaccaauuuuauacacuugcacccaugggcucugggcaaggacgaagacgagcacaauaa

SEQ ID NO: 32871 - RNA, 1620 nt, Artificial Sequence
  derived and/or modified sequence opt6 from capsid_protein_VP1__Norovirus__AGE99612
augaaaauggcaucaucagaugcuaauccuagugacggcucuucugcaaaccuaguaccugaaguuaauaaugaaguaauggcuuuagaaccaguuguaggugcagcaauagcagccccaguagcaggacaacaaaacauaauagaucccuggauaagaaacaauuuuguucaagcaccagguggugaauuuaccguaucucccagaaaugcuccaggagaaauccuauggucagccccccuaucuccagaccuaaauccauauuuaucacacuuauccagaauguacaaugguuaugcuggcggauuugaaguacaaguaauacucgcaggaaacgcauucaccgcagguaaaauaguauucgcagcugucccaccuaacuucccaacagaaggauuaucaccaagccaaguaacaauguuuccacacauuaucguagauguuagacaauuagaacccguauuaauaccccucccagacguacgaaauaauuuuuaccauuauaaucaagcaaaugauucuacacuaaaauuaaucgcaaugcucuauacaccacuaagagcaaacaacgcaggagaugauguauucacaguuagcuguagaguacuaaccagacccucuccagacuuugauuuuauauuucuagucccaccaacaguagaaucaagaacaaaacccuuuaccguuccaguacuaaccguagaagaaaugacaaauucaagauuuccaauaccacucgaaagacuauuuacaggaccuucaacagcauucgucguacaaccucaaaacggcagauguacuacagauggaguucuauuaggaacaacccaacucagugcaguaaauauaugcaauuuccgaggagaaguaaaccacauagcaggaacacaugacuauacaaugagacuaacaucacaaaauuggaauaauuaugauccaaccgaagaaaucccagcaccauuaggcacuccagauuuugucggaagaauacaagguguacuaacacaaaccacaagaucagauggaucaacucgaucacacaaagcaacaguauccacuggaucuguacauuuuacaccaaagcuaggaucaguacaauuuaccacagauacaacaaaugauuuaaaugcuggacaaaacacaaaauucaccccaguaggaguagaacaaacuagcggugaccaucaauccgaaccccaacaauggacacuacccaacuauuccggaacaccaaaccauaacguacaucuagcaccagcaguagcaccaacauucccaggugaacagcuauuauuuuucaggucaacacuuccaggaugcggagguuauccaaauaugaacuuagacugccuacuaccacaagaauggguacuacacuuuuaucaagaagccgcaccugcucaaucagauguagcauuacuucgauucguuaauccugauacaggacgaguacuauuugaaugcaaauuacauagaucagguuuuauaacuguugcacauucagguucacaugauuuagucauuccgcccaacggauauuuuagauucgacuccuggguuaaucaauucuacacacuagcaccaaugggaaauggaucaggaagacgaagaguaguauaa

SEQ ID NO: 32872 - RNA, 1647 nt, Artificial Sequence
  derived and/or modified sequence opt6 from capsid_protein_VP1__Norovirus__AGI17609
augaaaauggcaucuaaugacgcagcaccuuccaaugauggagcugcaggcuuaguaccugaaauaaauaaugaagcuauggcauuagaaccaguugugggugcagcaauagccgccccacuuacuggacaacaaaauaucauagacccauggauaaugaauaauuuuguacaagcuccagguggagaauuuacaguaucaccccgaaauucaccaggcgaaguacuacuaaauuuagaauuaggcccagaaaucaauccuuaccuugcacacuuagcuagaauguauaaugguuacgcugguggauucgaaguacaaguaguccucgcaggaaacgcauuuaccgcuggaaaaguuauauuugccgcaauaccaccuaacuuucccauagacaaucuaagugccgcucaaauuacuaugugcccacauguaauaguagauguaagacaauuagaaccaauuaauuuaccaaugccagacguacgcaacaauuucuuucacuauaaccaaggaucagauucacgacuucgauuaauugccaugcuauauacacccuuaagagcaaauaauucuggugacgacguguucacuguaucauguagagucuuaacaagaccuucuccagacuucucauuuaacuuucuaguaccuccaacaguagaaucaaaaauaaaaccauuuaccuuaccaauuuuaaccauuucagaaaugaguaauuccagauuuccaguaccaauugacucacuacacacuucaccaaccgaaaauaucgucguacaaugccaaaauggcagagucacucuugauggagaacuaauggguacgacacaacucuuaccaagucaaauuugugcuuuuagaggaaccuuaacccgaagcacuucaagagcuucugaucaagcagauacugcaacaccuagacuauucaauuauuacuggcauauacaacuagauaauuuaaaugguacaccauaugacccagcugaagacauaccagcaccacuaggaaccccagacuuucgcggaaaaguauuuggaguagcaagccaaagaaauccugauucaacuacaagagcacaugaagcuaaaguagacacaacaucaggaagauucacaccaaaacuaggcucacuugaaauaucaacagaaucaggugacuucgaucccaaccaaccaacaagauuuacaccuguaggaauaggaguugauaaugaagcagauuuucaacaauggagucuuccugacuauuccggacaauucacacauaauaugcauuuagcaccagcugucgcaccaaauuucccaggugaacaauuauuauucuucagaucacaacucccauccagcgguggcagaucaaacggaauauuagauuguuuaguuccacaagaauggguacaacauuuuuaccaagaaucagcaccagcacaaacacaaguagcauuaguacgauauguaaacccugauacaggacgaguauuauuugaagcaaaacuccacaaauuaggcuuuaugacuauagcuaaaaauggagauuccccaauuacaguaccuccaaauggauauuucagauuugaaucauggguaaauccauuuuauaccuuagcacccaugggcacuggaaauggacguagacguauacaauaa

SEQ ID NO: 32873 - RNA, 1593 nt, Artificial Sequence
  derived and/or modified sequence opt6 from capsid_protein_VP1__Norovirus__AGM33211
augaugauggcaucuaaagacgcaacauccucaguugauggugcauccggagcuggucaauuaguaccagaagucaacgccucagauccuuuagcaauggauccuguugcaggauccucaaccgcaguagcuaccgcaggccaaguaaaucccauagauccauggauaauuaauaacuucguucaagcuccucaaggagaauuuacgauaucaccaaacaacacaccaggugacguuuuauuugacuuaucauuagguccacaucuuaacccauuccuucuacauuuaucccaaauguauaauggauggguaggaaauaugagaguccgaaucaugcuugcaggaaaugcuuuuaccgcaggaaaaauaauaguaucaugcauaccuccagguuuuggaucacauaaccuaacuaucgcccaagcaacccuauucccucauguaauugcugauguaagaacacuagauccaauagaaguuccacuagaagacguacguaauguccuauuucauaauaaugauagaaaccaacagaccaugcgacuuguuuguauguuauauacuccccuaagaaccggaggagguacaggagauagcuuugucguagccggaagagucaugacaugcccaucuccagauuuuaauuuucuauuccucguaccaccaacaguagaacaaaaaacaagaccauuuacauuaccaaaucuaccacuaucuucccucucaaauucuagagcgcccuuaccuauaucaucuaugggaaucucaccugauaauguucaaucaguccaauuucaaaauggucgcuguacauuagacggaagacucguagguacaacacccguaucacuaucacaugucgccaaaauucgaggaacuuccaaugguacaguaauuaaucuaacagaacuagacggaacaccauuccauccauuugaaggucccgcaccaauaggauuuccagaucucggaggaugugauuggcauauaaacaugacacaauuugggcacuccagccaaacucaauaugauguaaauacaacaccugauacauucguaccccauuuaggauccauucaagcaaacggaaucggcucuggaaauuacguuggaguuuuaucauggauaucaccaccaucacacccaucaggaucucaaguagauuuauggaaaauaccuaacuauggaucuuccauaaccgaagcaacacaucuagcuccaucuguauauccccccggauuuggagaaguauuaguuuuuuuuaugaguaaaaugccagguccaggagccuacaaccuaccuuguuuacucccacaagaauauauaucacacuuagcaagugaacaagcuccaacuguaggcgaggcugcauuauuacauuauguagauccugauacugguagaaaucuaggagaauuuaaagcauacccagaugguuuucuaacauguguaccaaauggagcaaguucaggaccucaacaauuaccuauaaauggaguauuugucuuuguaucuuggguuucaagauuuuaucaacuaaaaccuguaggaacagcaucaucagcaagaggaagacuaggucuaagaagauaa

SEQ ID NO: 32874 - RNA, 1593 nt, Artificial Sequence
  derived and/or modified sequence opt6 from capsid_protein_VP1__Norovirus__AGM33223
augaugauggcaagcaaagacgcaacuaguuccguugauggagccucaggagcaggccaacuuguaccagaaguaaacgccucagacccauuagcaauggacccaguagcaggaucaucuacagcuguagcuaccgcaggacaaguaaaucccauagauccauggaucaucaauaacuucguucaagcaccacaaggugaauuuacaauuuccccaaauaauacaccuggugacgucuuauucgauuuaucacucggaccacaucuaaauccuuucuuacuucauuuaucacaaauguauaaugguuggguaggaaauaugagaguaagaauaaugcuagcaggcaaugcuuuuacagcuggaaaaaucaucguuucaugcauaccaccaggauucggcucucacaaccucacaauagcacaagcaacacuauucccacacguaauagcugauguaagaacacuugacccaauagaaguaccacuagaagaugucagaaacguauuauuucauaauaaugauagaaaucaacaaacaaugagacuaguaugcauguuauauacaccuuuaagaacuggaggaggaacuggagauucauuuguaguagcuggacggguaaugacaugcccaucuccagacuuuaauuuucucuuucuuguaccccccaccguagaacaaaaaaccagaccauucacauuaccaaacuuaccauuaucaucucuaucaaauucaagagcaccuuuaccuauaucaucaaugggaauaucuccagacaauguacaaucaguucaauuucaaaauggaagauguaccuuggacggacgccuaguuggaaccacuccaguaucccuaucacauguagcaaaaauuagaggaacuucaaacggaacaguaauaaaucuaacagaauuagauggcacaccauuccauccauuugaaggaccugcaccuauagguuuuccagaccucggaggaugugacuggcauauaaacaugacacaauucggccauucaucacaaacacaguaugaugucgacacaacacccgacacauuugucccccaucuaggcucuauacaagcaaacgguauaggcucaggaaauuacguugguguauuaucuuggauaucaccaccaucgagaccaucagguucacaaguugauuuauggaaaauaccaaacuauggauccucaauaaccgaagccacacaucucgcaccaucaguauacccaccaggauuuggagaaguauuaguauucuucauguccaaaaugccaggaccuggagcuuauaaccuaccauguuuauuaccacaagaauacauaucacaucuagcuucagaacaagcaccaacuguaggugaagcagcauuacuacauuauguugacccagacacuggaagaaacuuaggagaauucaaagcauauccagaugguuuccuuacaugcguuccaaauggcgcaucaucaggaccucaacaacuaccaauaaauggaguauucguauucguaucauggguauccagauuuuaccaacuaaaacccguaggaacagcaucauccgcaagaggaagauuaggauuaagacgauaa

SEQ ID NO: 32875 - RNA, 1623 nt, Artificial Sequence
  derived and/or modified sequence opt6 from capsid_protein_VP1__Norovirus__AGT17839
augaaaauggcaucaaacgacgcaaaccccucagauggaucagccgcaaacuuaguaccagaagucaacaaugaaguuauggcccuagaaccuguaguaggagcagcgauagcagcgccagucgccggacaacaaaauguaauagauccauggauaagaaacaacuucguacaagcaccaggaggcgaauuuacuguaucaccaagaaaugccccuggagaaauucuauggucugcaccccuaggcccagauuuaaauccauauuuaucacaccucgcaagaauguacaaugguuaugccggaggauucgaaguacaaguaauacuagccggcaacgccuuuaccgcugguaaaauaauauucgcugcaguacccccaaacuuuccaacagaaggacuaagcccuucacaaguaacaauguuuccacauauuauagucgacguaagacaacuagaaccaguccuaauuccuuuacccgauguccguaauaauuuuuaccacuacaaccaaaguaacgacucaacaauaaaguuaauagcaaugcuuuauacaccuuuaagagcuaacaacgcaggagaugauguauuuacuguaucauguagaguacucacacgaccaucuccagauuuugauuucauauuuuuaguaccaccaacaguagaaucaagaacaaaaccauucucaguaccgauauuaacaguagaagaaaugacuaauucuagauuuccaauaccucuagaaaaauuauuuacaggacccucaucaacauucguaguccaaccacaaaacggucgauguacaacagacggugucuuauuaggaacuacucaacuaucaccuguaaauauuuguacuuuccgcggagauguaacacacaucacaggauccagaaauuauacaaugaaucucgcuucacaaaacuggaacucuuaugacccaacugaagaaaucccagcaccacuaggaacaccagacuucgucgguaaaauacaaggaguauuaacacaaacaacaagaacagauggaucuacaagaggacacaaagcaacaguuuauacaggaucugcagacuuuucacccaaacuaggcagaguacaauucgcaaccgauacagacaacgacuucgauacaaaccaaaacacaaaauuuacaccaguaggugucauacaagacggaggcacaacacauagaaaugaaccccaacaaugggucuuaccaagcuacuccggaagaaauacacacaacguacaccuagccccugcuguagcacccacuuuuccuggugaacaauuauuauucuuuagaucaacaaugcccggaucaucaggauaccccaauauggacuuagacugcuuacuaccacaagaauggguccaauauuuuuaucaagaggccgcacccgcacaaucagauguggcucuacuaagauuuguaaacccagauaccggaagaguauuauuugaauguaaacuucauaaaagcggauauguaacaguagcacauacuggacaacaugaucuaguaaucccaccuaacggauauuucagauuugacucauggguaaaucaauuuuacacauuagcaccaaugggaaauggaacaggccguagaagagcaguauaa

SEQ ID NO: 32876 - RNA, 1617 nt, Artificial Sequence
  derived and/or modified sequence opt6 from capsid_protein_VP1__Norovirus__AGX85910
augaaaauggcaucaucagacgcaaacccuucugauggaucaacagccaacuuagucccagaagcuaacaaugaaguaauggcacuugaaccaguaguaggagcagccauagcugcaccaguagcaggccaacaaaauguaauagacccauggauaagaaauaauuuuguacaagcaccaggaggagaauucacagucucaccuagaaaugcaccuggagaaguauuaugguccgccccacucgguccugaucucaauccauauuugucccacuuagccagaauguacaaugguuaugcugguggauucgaaguacaaguaauacuagcuggaaacgcauuugccgccggaaaaauaauauuugcugcaguaccaccaaacuuuucaacagaaggacuaucaccaucgcaaguaacaauguucccucaccuaauaguagaugucagacaauuagaaccaguaaugaucccauuaccagauauaagaaacaacuucuaucauuauaaccaaucaaaugacccuacuauaaaauuaauugcaauguuauacacaccucuaagagcuaacaauguuggagacgauguauuuacaguaucauguagaguacuuacuagacccucaccagacuuugauuucaucuuuuuaguacccccaacaguagaauccaaaacaaacccauuuucuguaccaauccuaaccauagaagaaaugacuaacucacgauuuccuauaccauuagaaaaacuauuuacaggaccgucaagcgcauugguaguacaaccacaaaacggaagauguaccacagacggaguauuauuaggcacaacacaauuaucaccaguaaauauuuguacuuuucgaggagauguaacacauacaacaaaaacacauacuuaccaaaugaaccuagcagcacaaaauuggaacucauaugacccaacagaagaaauaccugcaccacuuggaacaccagacuuuguaggcaaaauccaaggaguucuuacacaaaccacaaaagaaaacggaagcacccgagcccauaaagcaacaguauauacugguacaguagaauuuaccccaaaacuaggucgaauucaauuauucacagauacugauaacgaucuugaagcaaaucaaaacacaaaauucacuccaguaggagucauccaagauggugaccaucaaaacgaaccucaacaauggguacuaccaaguuacucaggcagaaauaaccauaauguacaucuagcaccagcaguugcaccaaccuuuccaggugaacaauuacucuucuuuagaucaacaaugccaggauguuccggauauccaaauaugaaucuagauugccuauuaccucaagaauggguacaauauuucuaucaagaagcugcgccagcacaaucggauguagcccuauuacgcuuuguuaauccugauacaggaagaguauuauucgaaugcaaauuacacaaauccggauauguaacugucgcacacacuggucaucaugaccuaguaauaccuccaaacggcuauuucagauucgauucauggguaucacccuuuuacacuuuagcaccaaugggaaacggaacuggccguagaagagccuuauaa

SEQ ID NO: 32877 - RNA, 1623 nt, Artificial Sequence
  derived and/or modified sequence opt6 from capsid_protein_VP1__Norovirus__AHI59162
augaaaauggcaaguuccgaugcuaacccauccgauggcucgacugcaaacuuaguaccagagguaaauaacgaaguaauggcccuagaaccaguaguaggagcugccauagcagccccaguagcaggacaacaaaauguaauagauccauggaucagaaacaauuucguacaagcaccuggcggagaauuuacuguaucaccaagaaacgcaccaggagaaauucuuuggucagcuccuuuaggaccagauuuaaauccauaucuaucacacuuagcaagaauguauaacggauaugcaggagguuucgaaguacaaguaaucuuagcgggaaaugcauucaccgcaggcaaaauaauauucgcugcagucccacccaacuuuccuacagaaggauuaucucccucccaaguaacaauguucccacauaucauaguagauguaagacaacuagaaccagucuuaauaccauuaccagacguaagaaacaauuucuaccacuauaaccaauccaaugacucuaccaucaaauuaauugcgaugcuauauacuccccuaagagcaaacaaugcaggagacgauguauucacuguaagcuguagaguacuaacccgaccuaguccagauuuugacuuuauauuuuuaguuccuccaacagucgaaucacgaacaaaacccuuuucaguaccaauacugacaguagaagaaaugacaaacucccgauuuccaauaccacucgaaaaacuauucacugguccaaguucagcauucguaguacaaccacaaaacgguagauguacaacugacggcguauuacuuggaacaacacaauuaucaccagucaacaucugcaccuuuagaggggauguuacacacauuccaggaagucauaauuacacaaugaaucuugccucucaaaacuggaacucuuaugauccaacagaagaaauaccagcaccgcuaggcacaccugacuuugucggaaaaauacaagguguacuaacacaaacaacaucaacaaauggaucaacacgaggacacaaagcaacaguauauacagguuccgcugacuucucucccaaauuaggucgaguccaauucgcuacagacacaaacaaugauuuugaaaccaaccaaaauacaaaauucacaccaguagguguaauacaagauggaucaacaacaccuagaaaugaaccucaacaaugggucuuaccaucauacucaggcagaaacauacauaauguacauuuagcaccagccguagcaccgaccuuuccaggagaacaacuauuauuuuuuagaucaaccaugccgggauguuccgguuauccaaauauggaucuagauugccucuuaccucaagaauggguacaauauuucuaccaagaagcugcuccagcucaaucagacguagcacuccuuagauuuguuaacccagacaccggacgaguacuuuuugaaugcaaauuacauaaaucaggauauguaacugucgcacacacaggacaacacgaucuaguaauaccacccaauggauauuucagauucgauucauggguaaaucaauucuauacauuagcaccaaugggaaacggaaccggaagaagaagagcucuuuaa

SEQ ID NO: 32878 - RNA, 1620 nt, Artificial Sequence
  derived and/or modified sequence opt6 from capsid_protein_VP1__Norovirus__AHI59165
augaagauggcuucaaacgacgcaucccccagugaugguucuacagcaaaucuaguuccagaaguaaauaacgaaguuauggcacuagaaccaguaguaggugcagcuauagcagcaccaguagcuggacaacaaaauguaauugacccauggauuagaaacaauuuuguacaagccccaggaggagaauuuaccguuucaccacgaaacgccccaggugaaauccuuuggucugcaccccuaggaccagaucuaaauccauaccuaagucaccucgcaagaauguauaacggcuaugcagguggauucgaaguccaaguaauauuagccgguaaugcauucaccgcaggaaaaauaaucuucgcugcaguuccacccaacuuuccaacagaaggauuaucaccuucccaaguuacaauguucccccauauaauaguugauguaagacaacuagaaccaguacuaauaccccuaccagaugucagaaacaacuuuuaucacuauaaccaaucuaacgacucaacaauuaaacuuaucgcaauguuauacacacccuuaagagcuaauaaugcaggagacgauguauucaccguuucuugcagaguauuaacuagaccaucaccagacuuugacuucaucuuucuuguuccaccuacaguagaauccagaacaaaacccuucacuguuccaauauuaacaguagaagaaaugucaaacucaagauuuccaauaccccuagaaaaauuauauacaggcccaucuucagccuucguuguccaaccccaaaacggaagauguacaacugacggaguccuauuaggaaccacucaacuaucagcaguaaauaucugcacauuucgcggagacguaacacauaucgcaggaucacacgauuacacaaugaauuuagcaucacaaaauuggaacaauuaugauccaacagaagaaauaccugcaccauuaggcacuccugacuuugucggaaaaauacaagguaugcuaacacaaacuacaagagaagauggaucaacaagagcccauaaagcuacaguuucuacaggcucuguucacuucacaccaaaacuaggaucaguacaauauacaacugauacaaacaacgauuuccaaacuggacaaaauacaaaauucacaccaguagguguaauacaagauggaaauaaucaccaaaacgaaccacaacaauggguccuaccaaacuacucuggaagaacuggacacaauguacacuuagcaccagccguagcucccacuuuuccaggagaacaacuuuuauuuuuucgaucaaccaugccaggaugcucaggauauccaaacaugaaccuagauuguuuauuaccucaagaauggguccaacacuucuaccaagaagcagcaccugcacaaucagauguagcacuucuaagauucguaaaucccgauacagggagaguauuguuugaauguaaacuucauaaauccggauauguaacaguagcacauacuggaccacaugaccucguaauaccuccaaacggauacuuuagauucgacuccugggucaaccaauucuacacacuugcacccaugggcaacggugcagguagaagaagaguacuauaa

SEQ ID NO: 32879 - RNA, 1623 nt, Artificial Sequence
  derived and/or modified sequence opt6 from capsid_protein_VP1__Norovirus__AHX22044
augaaaauggcaucaucagacgcaaacccaucagauggaucaacagcaaaucuuguuccagaaguuaacaaugaaguuauggcuuuagaaccagucguaggugcagcaauagcagcaccagucgcuggucaacaaaauguaauagacccuuggauaagaaacaauuuuguucaagcuccaggaggugaauuuaccguaucccccagaaaugccccuggagaaauacuauggucagcaccuuuaggaccagaccuuaauccauauuuaucccauuuggcacgaauguauaauggcuaugcaggaggguuugaaguacaaguaaucuuagcaggaaaugccuucacugcaggaaaaauaauauuugcagcagucccaccuaacuuuccuacagaaggccucucaccaucacaaguaacaauguucccucacauuauaguugacguccgacaauuagaaccaguucucauaccacuacccgauguucgcaacaauuuuuaucacuauaaccaaucaaacgacucaaccauaaaacuaauagcaaugcuauauacaccauuacgagccaacaacgccggugaugacguauucacaguaucauguagaguacuuacaagaccaucaccugauuucgauuucauauuuuuaguaccaccaaccguagaaucccgaacaaaaccauuuucaguccccguacucacaguagaagaaaugacuaacucucgauuuccaauuccacuagaaaaacuauuuacuggaccuucaagcgcauucguuguacaaccacaaaacggaagaugcacaacagacggaguacuccucggaaccacacaacuaucuccaguaaacauauguacuuuuagaggagacgucauacauauuucagguucccguaauuacaccaugaacuuagcaucacaaaacuggaacuccuacgaucccaccgaagaaauaccagccccucuaggcacaccagacuucguagguaaaauacaaggugucuuaacccaaaccacaagaacugacggcuccacuagaggacacaaagcaacaguauacacaggauccgcagacuuuucaccaaaauuaggacgaguacaauuugccacugacacagauaacgauuuugucacaaaucaaaauacaaaauuuacaccuguaggcguuauacaagauggaucaacaacccccagaaaugaaccacaacaauggguacuaccuucauauagcggaagaaauacucauaacguucaucuagcaccagcaguagccccaacuuuuccuggagaacaacuauuguuuuucagaucaacaaugccaggaugcucaggauauccaaacauggaucuagauugccuucucccacaagaauggguacaauauuucuaccaagaagccgcaccagcacaaucagacguugcauuacuaagauuuguaaacccagacacaggaagaguuuuauucgaauguaaacuacacaaaucuggauacguaacuguugcacauacaggucaacacgacuuaguuauaccuccaaauggauauuucagauucgacucauggguaaaccaauuuuacacccucgcaccaaugggaaaugguaccggcagaagaagagcccuauaa

SEQ ID NO: 32880 - RNA, 1623 nt, Artificial Sequence
  derived and/or modified sequence opt6 from capsid_protein_VP1__Norovirus__AII02587
augaaaauggcaucaaacgacgcaaacccaucagacggauccgcagcuaaccuuguaccagaaguuaauaaugaaguaauggcauuagaaccaguuguaggugcagcaauagcugccccaguagcaggacaacaaaauguuaucgacccauggauacgaaauaauuuuguacaagccccaggaggugaauuuacaguaucaccuaggaaugcuccaggagaaauacuaugguccgcuccacuaggaccagaucuaaauccauacuuaucacaccuugcaagaauguacaauggauaugcaggaggauuugaaguacaagucauacuagcugguaaugcauuuaccgcagguaaaauaauauucgcagcugucccaccaaauuuuccgacugaaggacuaucaccaucacaaguaacuauguucccccauauaauaguagauguaagacaacuagaaccaguucuaauaccauuaccugauguaagaaacaauuucuaccauuauaaucaaucaaaugauucaaccauaaaacuaauagcaaugcuuuacacaccacuacgugcaaacaaugcaggagaagacgucuuuaccguaagcugccgaguacuuacuagaccaucacccgacuuugacuuuauauuuuuaguuccuccaacaguagaaucacgaaccaaaccauucacaguaccaauacuaacaguagaagaaaugacuaauuccagauuucccauuccauuagaaaaauuauucacaggcccaucuggagcguuuauaguacaaccccaaaauggaagauguacaacugacggcguauuauuaggaacaacacaauuaucaccuguuaauaucuguacguuuagaggcgacguaacacauauagcaggcucuagaaacuauacuaugaaucuugcaucacuaaacuggaacaauuacgauccaacugaagaaauaccagccccacuagguacaccagacuuuguaggcaaaauacaaggaguucuaacacaaacaacaaaaggagacggauccacuagaggccacaaagcaacagucuauacagguucugcuccauuuacaccaaaacuaggaucaguacaauucucaacagacacagaaaacgacuuugaagcccaucaaaauacuaaauucacuccaguagguguuauacaagacgguggaacaacacacagaaaugaaccccaacaauggguauuaccuucauauucaggacgugauguccauaacguccauuuagcaccagcaguagcaccaacuuuucccggugaacaacuauuauuuuuccgaucaacaaugcccgguuguucaggauauccaaacauggaucuagacuguuuauuaccccaagaauggguacaacauuucuaucaagaagccgcaccagcucagucugauguugcacuuuuaagauuuguuaacccagacaccggcagaguccuauucgaauguaaacuccauaaaucagguuauguaacuguagcucacaccggacaacacgauuuaguuauaccaccaaauggauauuucagauuugacucaugggucaaccaauuuuacacauuagcaccaaugggcaauggaacaggaagaagaagagcauuauaa

SEQ ID NO: 32881 - RNA, 1647 nt, Artificial Sequence
  derived and/or modified sequence opt6 from capsid_protein_VP1__Norovirus__AII02617
augaaaauggcaagcaacgacgcagcaccaucaaacgauggagcugcagguuuaguuccagaaauuaacagugaagcaauggcauuagaaccaguagcaggugcugccauagccgcaccacuaacaggucaacaaaacauaauagaccccuggauaaugaauaauuucguccaagcaccagguggagaauuuacgguaucuccacgaaauaguccaggcgaaguacuauuaaaucuagaacuaggaccagaaauaaauccauaccuagcccaucucgccagaauguacaauggauaugcaggaggauuugaaguacaaguugucuuagcugguaaugcauucacagcaggcaaaaucauauuugcagcuauaccaccaaauuucccaauagauaacuuaucagcugcccaaauaacaauguguccacacguaauaguagacguacgucaauuagaaccaguaaaucuuccuaugccagacguaagaaauaacuucuuccauuauaaucaaggaagugauucaagguuaagauuaauagccaugcuauacacacccuuacgagcaaauaacucaggcgaugauguuuucacaguauccugucguguacuaacccgaccaucuccagauuucucauucaauuucuuaguaccaccaacaguagaaucaaaaacaaaacccuucucacuacccaucuuaacaauaucggaaaugucaaauagccgauuucccgucccuauagauucacuucauacauccccuacagaaaacauaguaguucaaugucaaaauggaagaguaacacuagauggugaacuaaugggcacaacgcaacuauuaccuagucaaauaugcgcauuuagaggcaugcuuacacgaucuacaucacgcgcaucugaccaagccgacacagcaacuccaagauuauuuaauuauuauuggcauauacaacuagauaauuuaaacggaacuccauaugacccagcagaagauauaccaggaccauuaggaacaccugauuucagagguaaaguauuuggcguagcuucucaaagaaauccagacgcaaccacaagagcacacgaagcuaaaauagauacaacaucaggacgauuuaccccaaaauuaggcucuuuagaaauaucaacagaaucaggugauuuugaccaaaaucaaccaacaagauuuacuccaguaggaauaggaguugaucacgaagcugauuuccaacaauggacacuaccagauuacgcuggacaauucacacacaauaugaauuuagcuccagcaguagcaccgaauuucccaggagaacaauuacuauuuuucagaucacaauuaccaucaucuggaggucgaucaaacgguauacuagauuguuuaguaccacaagaauggguccaacauuuuuaucaagaaucagcaccuucacaaacacaaguugcauuaguaagauacguuaauccagauaccgggagaguacucuucgaagcaaaacuacacaaacuaggauucaugacuauagcaaaaucaggagacucaccaauaacaguuccaccuaacgguuauuuucgauuugaauccuggguaaacccuuuuuauacauuagccccuaugggcacaggcaacggaagaagaagaauucaauaa

SEQ ID NO: 32882 - RNA, 1647 nt, Artificial Sequence
  derived and/or modified sequence opt6 from capsid_protein_VP1__Norovirus__AIS24556
augaaaauggcuucaaaugacgcggcaccaucuaacgacggugcagcaggucuagucccagaaauaaauaaugaagcaauggcauuagauccaguagcaggugcagcaauagcagcaccacuaacuggacaacaaaacauaauagacccauggauaaugaauaauuuuguccaagcaccuggcggugaauuuacagugaguccaagaaacucaccuggagaaguuuuacuaaaucuagaacuuggaccagaaauuaauccuuaccuagcccauuuagcuagaauguauaacggauaugcaggaggcuucgaaguacaaguaguauuagcaggaaaugcauuuacagcaggaaaaguaauauucgcagcaauaccuccaaauuuuccaacugacaaucuaucagcagcacaaauaacuauguguccacacguaauagucgacguuagacaacuagaaccaauaaaucuaccaaugccugauguaagaaauaauuuuuuucauuacaaucaaggcucagacucuagacuaagauuaauagccaugcucuacacaccauuacgcgcuaauaauucaggugacgauguuuucacaguuucuuguagaguuuuaacuagaccauccccagacuuuucauuuaauuuucuagucccacccacaguagaaucuaaaacuaaaccauuuacacuuccaauauuaacaaucucugaaaugucaaauuccagauuuccaguaccaauagauucucuacauacuucuccuacagacaauaucgucguacaaugucaaaacggcagaguaacccuugacggugaacucauggguacaacacaacuacucccaucucaaauaugugcauucagagguguucucacaagaucuacuucacgcgcaucugaucaagccgaugcagcaaccccacgauuauuuaauuauuacuggcauauacaacuagauaaccuuaacgguacacccuaugacccugcugaagauauacccgcaccauuaggaacaccagacuuccgaggcaaaguauuuggugucgcuucacaacgaaauccagauucuacaacaagagcucaugaagcuaaaguagacacaacuucaggaagauucacccccaaauuagguucccuagaaauuaguaccgaaucaggagauuuugaucaaaaccaaccaacacgauuuacuccuguaggaauuggaguagacaaugaagcagacuuccaacaauggacauuaccagacuauucuggacaauucacccauaauaugaauuuggcaccagcaguagccccaaacuucccaggagaacaacuauuauucuucaggucucaauuaccaucaucuggaggucguucaaacggaaucuuagauugcuuagucccacaagaauggguacaacauuucuaccaagaaucagcaccagcccaaacacaaguagcacucgucagauauguaaauccugacacagguagaguuuuauuugaagcuaaauuacauaaauuaggcuacaugacaauagcaaaaucaggagauucaccaauaacaguaccuccaaaugguuacuuuagauuugaauccuggguuaauccauuuuauacacuagccccgauggguacaggaaauggccgaaggagaauacaauaa

SEQ ID NO: 32883 - RNA, 1623 nt, Artificial Sequence
  derived and/or modified sequence opt6 from capsid_protein_VP1__Norovirus__BAI49908
augaaaauggcuagcaacgaugcauccccuucagacggauccacugcaaauuuaguaccagaaguaaauaaugaaguaauggcuuuagaaccuguaguaggugccgcaauagcagccccuguagcaggccaacaaaauguaauugauccauggauaagaaauaauuucguccaagcaccaggcggagaauuuacaguaucaccacgaaacgcuccaggugaaauauuaugguccgcaccauuaggaccugaucuaaaucccuaucuaucccacuuagcaagaauguauaacggauacgcaggagguuucgaaguucaagucauucuagcuggaaaugcauucacagcaggaaaaauaauauucgcagcuguaccaccaaacuuuccaacagaaggauuaucaccaucacaaguuacaauguuuccacacauuaucguagauguaagacaacuagaaccaguacuaauaccacuaccagauguaagaaacaauuuuuaucacuauaaccaauccaacgacucuacaaucaaauuaauagcaauguuauauacucccuuaagagcaaacaaugcaggagaugauguauucaccguauccuguagaguucuaacacgcccuucaccagauuucgacuuuauuuucuuaguaccaccaaccguugaaagucgaaccaaaccauucacaguacccaucuuaaccguugaagaaaugaccaauucaagauuccccauaccucucgaaaaacuauuuacaggaccaaguucugcauucguaguacaaccacaaaacggcagauguacaacagauggaguauuauuaggaacuacccaauuaucaccagucaacauauguacauuuagaggugauguuacacacauaccuggaacaagaaccuaccgaaugaauuuagcuucccaaaauuggaacaauuacgauccaacagaagaaauaccagcaccauuaggaacaccagauuuugucggaaaaauacaaggcaugcuuacacaaaccacaaaaggugacggaucaacuagaggacacaaagccacuguaucaacaggaucaguugacuucacaccaaaacuuggaucaguacaauuugcuacagauaccgauaacgauuuugaaacaggccaaaauacaagauuuacuccaguuggaguaauacaagauggaucaucagcccauagaaacgaaccacaacaauggguacuaccagauuauaguggaagaaccguacauaacguucauuuagcaccagcaguagcaccaacauuuccaggagaacaacuauuauucuuuagaucuaccaugccagggugcucaggauauccuaacauggauuuagacugcuuauuaccccaagaauggguucaacauuucuaucaagaagccgcacccgcucaaucagauguugcccuucuuagguucguuaacccugacacaggaagaguuuuauucgaauguaaauuacauaaaacaggauauguaacaguagcacacaccggacaacacgaucuaguaauaccaccaaauggcuauuuuagauuugauucuugggucaaucaauuuuauacacuagcaccaaugggaaauggcgcaggaagaagaagagcuuuauaa

SEQ ID NO: 32884 - RNA, 1623 nt, Artificial Sequence
  derived and/or modified sequence opt6 from capsid_protein_VP1__Norovirus__BAI49913
augaaaauggcauccaacgacgcaucuccaucagacggauccacagcaaauuuaguaccagaaguaaauaacgaaguuauggcucuagaaccaguaguaggagccgcaaucgcagcaccaguagcuggacaacaaaauguaauugacccauggauaagaaauaauuuuguucaagccccaggaggugaauuuacaguaucuccaagaaacgcaccaggagaaauacuauggucagcaccacuaggaccagacuuaaauccauauuuaucccaccuagcuagaauguauaauggauacgcuggaggauucgaaguucaaguaauauuagcaggaaaugcauucaccgccggaaaaaucauuuucgccgcuguaccaccaaacuucccaacugaaggacucaguccaucucaaguaacuauguuuccacacauaauaguugauguucgccaauuagaacccguauuaauaccauuacccgacguaagaaauaauuucuaucacuauaaccaaagcaaugauuccacuauaaaacuuauagcaauguuauacacaccacuaagagcaaauaaugcaggugacgauguuuuuaccguaucaugucgaguucuaacacgccccaguccagacuuugacuuuauauuucuagucccaccuacaguagaaaguagaacaaaaccauuuacuguaccaauacuuacaguagaagaaaugacaaauaguagauuuccaauuccauuagaaaaacuauuuacaggcccaaguucugcauuuguaguacaaccccaaaaugguagauguacaacagauggaguacuauuaggaacuacacaacuuagcccaguaaacauauguacauuuagaggagauguuacccauauaccuggaacacgaaccuaccgcaugaaucuagcaucccaaaacuggaauaauuacgauccaacagaagaaauaccagcaccacuaggaacaccagauuuugucgguaaaauacaaggaauguuaacacaaacaacaaaaggagacggaucuacccguggucacaaagcuacaguaucaacagguucaguugauuuuaccccuaaauuaggaaguguacaauucgcaacagauacagauaacgacuucgaaacaggccaaaauacaagauucacacccguugguguaauacaagauggaucaucaacucacagaaaugaaccacaacaauggguacuaccugauuacucaggaagaacaguucauaauguacaucuagcaccugcagucgcaccuacauucccaggagaacaacuauuauuuuuucguucaaccaugccagguugcucaggauacccaaauauggacuuagauuguuuacuaccacaagaauggguacaacacuuuuaccaagaagcagccccaucucaaucagauguagcauuacuccgauucgucaauccagacacaggccgaguacucuuugaaugcaaacuacauaaagcaggauauguaacaguagcacacacaggccaacaugaucuuguaauaccaccaaauggauauuucagauuugauucauggguaaaccaauuuuauacccucgcuccaaugggaaauggcgcaggacgacgaagagcacuauaa

SEQ ID NO: 32885 - RNA, 1623 nt, Artificial Sequence
  derived and/or modified sequence opt6 from capsid_protein_VP1__Norovirus__BAI49922
augaaaauggcaucaaacgacgcaaacccaagugacggauccgcagcuaacuuaguuccagaaguuaauaaugaaguaauggcuuuagaacccguaguuggagcagcaauagcagcuccaguagccggccaaacaaauguaauugauccauggauaagaaauaacuucguccaagcaccaggaggagaauuuacaguaucaccuagaaaugccccaggugaaauacuaugguccgccccucuaggcccagauuuaaauccauauuuaucacaucucgcaaggauguauaauggauacgccggaggauucgaaguucaaguuauucuagcaggaaaugcauucacagcaggaaaaauaauauuugcugccguaccaccaaacuuucccacagaaggacuaucaccaucacaaguaacaauguucccacauauaauaguagacguuagacaacuagaaccaguacuaaucccauuaccagauguaagaaauaauuucuaccacuacaaccaaucaaaugacucaacaauuaaauuaauagcaaugcuauacacaccacuaagagcaaacaaugcaggugaagauguuuuuacaguaucaugccgaguacuaacaagacccucuccugauuucgacuuuauauucuuaguaccaccaacaguagaaucacgaacaaaaccuuucacagucccuauacuaacaguagaagaaaugacaaauuccagauuuccaauuccacuagaaaaauuauuuacugguccauccggagccuucguuguccaaccacaaaacggcagauguacaacagacggaguccuuuuaggaacaacacaacucuccccaguaaauauaugcacuuuucguggagaugucacacauauagccggaucaagaaauuacacaaugaauuuagcaucuuuaaauuggaacaauuacgauccaacagaagaaauaccagcaccacucgguacaccagacuucguagguaaaauucaaggaguauuaacacaaacaacaaaaggugacggaucaacucgaggucacaaagcuaccgucuacacaggaucagcuccauucacaccuaaacuuggaucuguacaauuuucaacugauacagaaaacgauuucgaaacacaucaaaauacaaaauuuacacccguaggaguaauacaagacggaucaacaacacauagaaaugaaccacaacaauggguacuaccauccuacuccggaagaaacguucauaauguacaccuagcaccagcaguagccccaaccuucccaggugaacaacuauuauucuucagaucaacaaugcccggaugcucugguuauccaaauauggaccucgacugccuauuaccacaagaauggguacaacacuuuuaucaagaagcagcccccgcacaaucagacgucgcacuucuacguuucguaaauccagacacuggacguguauuauucgaauguaaacuacauaaaaguggauacguaacaguugcacacacaggacaacacgaucuaguaauaccaccaaauggcuacuuuagauucgauucuugggucaaccaauucuauacauuagcaccaaugggcaacgguacuggcagacgacgcgcauuauaa

SEQ ID NO: 32886 - RNA, 1608 nt, Artificial Sequence
  derived and/or modified sequence opt6 from capsid_protein_VP1__Norovirus__BAJ25074
augaaaauggcaucaaacgaugccaaucccucauccgauggcucugccaaccuaguucccgaaauaucaaaugaaguaauggcacuagaacccguagcaggcgcagcuauugccgcaccaguagcaggacaacaaaauauaauagacccauggauacgaaacaacuuuguacaagcacccggaggagaguuuacagucucaccaagaaacgcaccuggcgaagucuuauuaaauuuaccucuaucaccagacauaaauccauauuuagcacaccuaucaagaauguacaacggauacgcaggaggugucgaaguagaaguaguacuugcaggaaacgcauucacagcuggcaaaauaauuuucgcagcaguaccaccaaacuuuccaccugaaaauuuaucaccaucucaaauuaccaugcucccacacauaauaguugauguacgacaacucgaaccaguccgaaucccacuaccagacguaagaaauaauuuuuaucauuacucaagagaaaaugacucaacauuaagauuaauagcuauguuauauacuccuuuaagagcuaacaaugccggcgacgacguauuuacaguuagcugcagaguauuaacaagaccaucaccagacuuugauuucauuuuuuuaguaccaccuacaguugaaucuaaauccaaaccauuuacaauaccuauguuaacaauagaagaaaugacuaauucuagauucccugcaccacuugaauuaaugacuacaggaccaucacacgacauaguuguucaaccacaaaacggacgaugcacaaucgacggaguacucuuaggaacaacucaauuaucuccagucaacauaugcucccuaagaggagucccaacaaaaagaaccaacggaaacgacaauugcuuuguacaauuagaaaacccuaacggaucagccuaugacccuacagaagacauaccagcaguacuagguucaccagauuucgucggagagcucuacggcacaauaacucaacgaucaucagauaauucaacuagagcccaccccuucacauuaaacaccggaucccccagauauacuccaaaaauaggaucagucgacauacgagucacagauguuucagauuuacaagaccaugacccgguaaaauuaacaccaguaggucuaucaggagacagaggaaguauacaccaauggcaacuaccaaacuauucugguguagcuacucauaauaugcacuuagcaccaucuguugcaccauuauucccaggagaacaaauacuauucuucagaagcacaguaccaggauguggaggcuacccaaauucaaauauagacugccuaauaccacaagaauggguccaacauuucuaccaagaaggugcaccagcacgaacugacguagcacuacuacgauucauaaacccagacacaggaagaguauuauuugaauguaaauuacacaagcauggauucaucacagucgcauauuccggaaaucacgacuuaguaaugcccccuaaugguuauuuccgauuugaaucauggguaaaucaauuccacacuuuagcuccaaugggaaccggauccggaagaagaagaauccaauaa

SEQ ID NO: 32887 - RNA, 1617 nt, Artificial Sequence
  derived and/or modified sequence opt6 from capsid_protein_VP1__Norovirus__BAP33934
augaaaauggcaucuaacgacgcagcaccuaguaacgauggagccgcaggccuaguaccagaaggcaauaaugaaacacuaccccucgaaccuguagcaggcgcugcaaucgcagcaccagucacaggccaaaauaauaucauagauccuuggauaagaacaaauuucguccaagcuccaaacggagaauucaccguaucaccaagaaauucuccuggugaaauucuacucaaucuagaacuaggacccgaucuaaauccauaccucgcacacuuaagccgaauguauaacgguuacgccggcgguguagaaguacaaguacuucuugcaggcaaugcauuuacagcaggcaaaaucuuauucgcagcaguaccuccaaauuucccugucgaauuucucucaccagcacaaauaacaaugcucccacacuuaauaguagauguacgcacuuuagaaccaaucaugauaccacuaccagauguaagaaacacauucuuucacuacaacaaccaaccaaacucaagaaugagacuuguagcaauguuauauacacccuuaagaucaaauggaucaggugaugauguauucacaguaaguugcagaguauuaacacgccccacaccagacuucgaauuuacauacuuaguaccaccauccgucgaauccaaaacaaaaccauucucauuaccaauacuaacauuauccgaacucacuaacagucgauuuccaguaccaauagacucauuauuuacagcucaaaacaauguacuccaaguacaaugucaaaaugguagaugcacauuagauggagaacuccaaggaacaacucaacuacuacccucuggaauaugugccuuucgcggucguguaacagcagaaacagaccacagagauaaauggcacaugcaauuacaaaaccuaaauggcaccacauaugaucccacugacgacgucccagcaccuuuaggcacaccagacuuuaaaggaguuguauuuggaguagcaucacaaagaaauguaggaaaugacgcaccagguaguaccagagcacacgaagcaguaauaucuacuuauuccccacaauucguaccaaaauuaggaucuguaaauuucagaucaaaugacaaugacuuucaacuacaaccuacaaaauucacaccaguaggaauuaacgacgacggcgaucaucccuuuagacaaugggaauuaccagauuauucuggacuacuaacccuaaacaugaaccuugcaccuccaguagcaccuaacuuuccaggugaacaacuuuuauucuucagauccuuuguaccuuguucaggaggauauaaucaaggaauaguagauugcuuaaucccacaagaauggauucaacauuucuaucaagaaucugcaccaucucaaucagauguagcucucauacgauacguaaacccugacaccggaagaacauuauuugaagcuaaacuacauagaagcggauacaucacaguagcacauuccggcgauuacccucuuguaguuccagcaaacggcuacuucagauuugauucauggguaaaucaauucuacucacuagcaccaaugggaacuggcaaugguagaagacgagcacaauaa

SEQ ID NO: 32888 - RNA, 1623 nt, Artificial Sequence
  derived and/or modified sequence opt6 from major_capsid_protein__Norovirus__ABQ63283
augaaaauggcaucaucagacgcaaacccuucagacggcucaacagcaaauuuaguaccugaaguuaacaaugaaguaauggcccuagaaccagucguaggagcagcuauagcagcaccuguagcaggacaacaaaauguaauagacccguggauacgaaacaacuucguacaagcaccaggcggagaauuuacagucucaccaagaaaugcaccuggcgaaaucuuauggucagcaccccuagguccugaucuaaauccauauuuaucacaucuagcacguauguauaauggcuacgcagguggauucgaaguccaaguaauauuagcuggaaacgcauuuacagcaggcaaaauaguauucgccgcaguuccaccuaauuuuccaacagaaggauuaucaccaucacaaguaacaauguuuccucacauuauaguagauguaagacaacucgaacccguauuaaucccucuucccgauguaagaaacaauuuuuaccacuauaaccaaucaaacgacccaacuauuaaauuaauagcaauguuauacacucccuuacgcgcaaacaacgcaggagaagauguauuuacaguaucuugucgaguacuaaccagaccaucaccagauuuugacuucauauuuuuaguaccaccaacuguagaaucuagaacaaaaccauucucaguaccuauacuaacuguugaagaaaugacaaacucacgauuuccaauaccacucgaaaaacucuuuacugguccauccucaacuauaguuguacaaccacaaaauggucgauguacaacugauggaguauuacuaggaacaacccaauuauccccuguaaauauauguacauuucgcggugacguaacacacaucgcaggcacacaagaauauaccaugaaucuugcuucucaaaauuggaacaauuaugauccaacagaagaaaucccagcaccacuuggaacaccugacuucguagguaaaauccaaggaguacuaacucaaacaaccagaagagacggcagcacacgaggacacaaagcaacaguauccaccggcuccgucaacuuuacaccaaaauuaggaagaauacaauucuccacagacaccucuaacgacuuugaaacuggacaaucaacacgauuuacaccuguuggagucguacaagacggaucaacaacacaucaaaaugaaccccaacaauggguauuaccagacuauucaggcagagauucucauaacguucauuuagcaccagcaguagcaccauccuuuccaggagagcaauuacucuucuuucgaucuacaaugccaggauguucaggauauccaaacaugaauuuagacugcuuauuaccacaagaauggguccaacauuucuaucaagaagcugcuccagcacaaucagauguagcauuacuccgauucguaaacccagauacaggucgcguacuauuugaaugcaaacuacauaaaaguggauaugucacuguggcacacacaggacaacaugaucuaguaauaccaccuaauggauauuucagauucgacucauggguaaaucaauuuuacacgcuagcucccaugggaaauggaacugguagaagacgagcacuuuaa

SEQ ID NO: 32889 - RNA, 1623 nt, Artificial Sequence
  derived and/or modified sequence opt6 from major_capsid_protein__Norovirus__ABV55634
augaaaauggcaucaaaugacgcaaauccaucagauggaucagcagcuaauuuaguuccagaagugaacaacgaaguaauggcucuagaaccuguaguaggagcagccauagcagcaccaguagcuggucaacaaaauguaauagacccguggauacguaauaacuuuguacaggcaccuggaggagaauuuaccguaucaccacgaaacgcaccaggagaaauacuuuggucugcaccuuuagguccagauuuaaaucccuacuuaucacacuuagcaagaauguauaacggauacgcaggaggauucgaaguucaaguaauauuagcaggaaaugcauuuacagcaggaaaaauaauuuuugcagcaguaccaccaaacuuuccaacagaaggucuaucaccaucccagguaacgauguucccacacauaaucguugauguacgacaacuagaaccuguauuaauaccacuaccagaugucagaaacaacuucuaucacuauaaccaauccaaugauucuacaauuaaauuaauagcaauguuauacacuccucucagagcaaacaacgcaggagaagauguauucacuguuucuuguagaguauuaacaagaccaucaccagacuucgacuucauauuuuuagucccaccaaccguagaaagcaggacaaaaccauucaccguacccauacuaacaguugaagaaaugacuaacucaagauucccuauacccuuagaaaaacuauuuacaggucccuccggagcauucgucguucaaccacaaaauggaagauguaccacagacggaguuuuacuaggaacaacucaacuaucaccaguaaauaucugcacauuuagaggugauguaacacacauagcuggaucaagaaacuacacuaugaauuuagcaucacuaaaauggaauaaauacgauccaacagaagaaauaccagcaccacuagguaccccagacuuuguaggaaagauucaaggcgucuuaacacaaacaaccaaaggggacggaucaaccagaggacauaaagccacaauuuauacaggauccgcaccuuuuacaccaaaauuagguaguguacaauucucaacagauaccgaaaacgacuuugaaacacaccaaaauacaaaauucacuccaguuggaguaacucaagacggaucuaccacacaucgaaaugaaccccaacaauggguacuaccaucauauuccggacgcaauguacauaauguacaucuagcaccagcuguagcaccaacauucccaggagaacaauuauuauucuucagauccaccaugccugguuguucuggauaucccaauauggaccucgauuguuuacucccacaagaauggguucaacauuucuaccaagaagcagcaccagcccaaagugacguagcauuacuuagauucguaaauccagauacaggaagaguauuauuugaauguaaacuacauaaaucuggauauguaacaguagcccauacuggccaacaugauuuaguaauaccaccaaauggauauuuucgauucgauuccugggucaaucaauucuauacucuugcaccaaugggcaacggaaccggaagaagaagagcacuauaa

SEQ ID NO: 32890 - RNA, 1623 nt, Artificial Sequence
  derived and/or modified sequence opt6 from major_capsid_protein__Norovirus__ACV41093
augaaaauggcaucaaaugaugcaaaccccucagauggcucuacagcaaacuuaguuccagaaguaaauaaugaaguuauggcccuugaaccugucguaggagcagcaaucgcagccccaguagcaggacaacaaaacgucauagauccauggauaagaaacaacuucguacaagcaccuggaggagaauuuaccguaucuccucgaaaugcaccuggagaaauccuauggucagcaccacuaggaccagaucuaaacccauauuuaucacacuuagcaagaauguauaauggauacgcaggaggauucgaaguucaaguaauacuagcagguaacgccuuuacugcuggcaaaauaauauuugcagcaguucccccaaauuuuccaacugaaggacucucuccaucucaaguaacaauguucccucauauaauaguagacguacgacaacuagaaccaguccuuauaccccuuccagauguacgaaauaacuuuuaucacuauaaccaaucaaaugacccaacaauaaaacuaauagcaauguuauauacaccauuaagagcuaauaaugcuggugaugaugucuuuacaguaucaugcagaguuuuaacuagaccauccccagacuuugacuuuauauuucuaguaccaccaacuguagaaucacgaacuaaaccauuuacagucccuauauuaacuguagaagaaaugacaaacucaagauuuccaauaccucuagaaagauuauauacaggaccaucaucagccuuuguuguacagccacaaaacgguagauguacuacagacggaguuuuacuagguacaacacaacuauccgcaguaaauauauguacauuccgcggagacgucacacauauagcaggcucaagaaauuacacaaugaauuuagcaucccaaaauuggucaaauuacgauccaacagaagaaauaccagcaccacuaggcacaccugacuucguuggaaaaauacaaggaauguuaacacaaacaacuggaagagacggaaguacaagaggccacaaagcaacaguauuaacagguucagcagauuucgccccaaaacuaggucgaguucaauucgcaacugauacagauaaugauuucgaaucaggagaaaauacaaaauuuacaccaguuggaguaauacaagacggaucaacaacacauagaaaugaaccacaacaauggguacucccaaauuauucaggaagaacaggucauaacguacauuuagcaccagcaguagcacccacuuaucccggagaacaacuuuuauucuucagaucaacuaugccuggauguucaggauauccaaauauggauuuagauugcuuauuaccacaagaauggguaagacauuuuuaucaagaagccgcuccagcacaauccgauguagccuuacuucguuucguaaacccagauaccggccgcguccuauuugagugcaaacuacauaaaccuggauaugucacuguagcucacacaggacaacaugaccuaguuauaccuccaaauggauauuuuagauucgauucauggguaaaccaauuuuauacucuagcccccaugggcaacggcacaggaagacgacgugcauuauag

SEQ ID NO: 32891 - RNA, 1635 nt, Artificial Sequence
  derived and/or modified sequence opt6 from major_capsid_protein__Norovirus__ACV41096
augaugauggcauccaaagaugcuacaccuucagcugacggagcaacaggagcaggacaacuaguaccugaaguaaauacagcagacccaauaccaauagauccaguagccggcucaucaacagcacuugcaacugcuggucaaguuaaucucauagauccauggauaauaaacaauuuuguacaagcaccacaaggagaauuuacuauauccccaaacaauacuccuggagacguauuauuugaccuccaacuagguccucaccuaaacccuuucuuaucacaucuaucacaaauguacaauggcuggguaggaaauaugcgaguacgcguagugcucgcaggcaaugcauuuacagcaggaaaaguaauaauaugcugcguaccaccaggauuucaaucucguacacuuuccauagcacaagcaacauuauuuccacauguaauagcugauguacgaacccuagaucccguagaaguaccacuagaagauguuagaaacguauuauaucauaacaaugauacucaacccacaaugagacuauuaugcaugcuuuauaccccacuuagaacaggaggagcaucuggaggaacagacucauuuguagucgcaggaagaguacuaacauguccaggacccgauuuuaauuuucuuuuucuuguaccacccacaguugaacaaaaaacuagaccuuuuacaguaccaaauaucccacuaaaauaucuuucaaacaguagaauacccaauccaauagaaggcaugucuuuaucaccagaucaaacacaaaacgugcaauuucaaaauggaagaugcaccauugacggccaaccucucggcacaacaccuguuucuguaucgcaacuaugcaaauucagaggacguauaacaucaggacaaagaguacugaacuuaacagaauuagauggaucacccuuuauggccuuugcagcaccagcuccagcagguuucccagaucuuggaucaugugacuggcauaucgaaaugucaaaaauaccuaacucaucaacccaaaauaauccaauaguaguaaacucaguaaaaccuaauucacaacaauucguaccucaucuaucauccauaacucuagacgacaauguaucaucagguggagauuauaucggaaccauacaauggacaucaccccccucugacagugguggagcaaauaccaauuuuuggaaaauaccagacuacgguuccucacuugcagaagcaucacaacucgccccugcuguuuauccaccuggauuuaaugaaguaauaguauauuuuauggcaucaauaccagguccuaaccaaucagguucaccaaaccuaguuccauguuuauuaccacaagaauauauuacucauuuuauaucagaacaagcaccuauacaaggagaagcagcacuacuucacuacguagauccagauacuaaccgaaaccuaggcgaauuuaaacuuuauccuggcggauacuuaacaugcguaccaaauagcucuucuacaggaccacaacaauuaccuuuagauggcgucuuuguauuugcauccugggucuccagauuuuaccaauuaaaaccaguugguacagccggaccugcaagaggucgucuugguguacguagauaa

SEQ ID NO: 32892 - RNA, 1743 nt, Artificial Sequence
  derived and/or modified sequence opt6 from major_capsid_protein__Norovirus__ACV88130
augaaaauggcaaguaaugaugcaacagcacccucacaagauggcgccgcaaacuuaguacccgaaagucaacacgaaguguuagcauuagaacccguagcuggcgcugcauuagcagcuccuguagcaggucaauuuaaugcaaucgaucccuggauuaaacaaaauuuuguacaagcaccugcaggagaauuuacaguaucaccaagaaaugcuccaggagaaauauuaauggauuuagaauuagguccugaacuaaguccauuuuuagcucacuuagcccaaauguauaaugcauacgcuggaggaauggaaguucaaauaauuuuagcagguaaugcguuuacagcaggaaagauaauaguuugugcuguuccacccaauuuuccuccagauagacuaagcgcaucccaagcaacuaauuuuccucauguuauaauggauguaagaacucuagaacccguuauauuaccauuaccagauguacgagcaggauucuuccacuacaaccaauuacgagaaccaagaaugagacuaauggcccuuuuauacacaccuuuaagagcaaauggcacaggagaugaugcuuuuacaguauccugccgaguauuaacaagaccaaugcaagauuuugaguuuauguuucuaguuccuccaacaguugaaagcagaguaacaccuuuuucaguaccaacuuauccaguaguagaaaugacaaauucuagauggccagcuagaauuucuggaaugcauguaaaugcaaaucaaacauuagcaguucaauuccaaaaugguagauguacguuagauggacaauuaaugggaacaacccaacuaugugccgccgacguauguagaaugagaggucgauacacuuccacuagagcagaucuagcuggaguugaucacacagaucaagguccaucauuaggagcaggucccaguaaugauccaguaucagucccagaagcaagaucacaaacacguacaagcgugagugcacauuuacaauuagaagagcuaaauggacaaccuuacgaaguauauggagaacaacccgcaccacuagguacaccagauuuuugcugcagacuuaugggagaauuaguaagacuaccaucaacuucaccagccgcacaaucaagauuuagagacgcauuuuucgauacauauggagcuuuauuugcaccagcagucggaucaacaacauuuacaguaaauaacucaucuacaucagauuuugcaaauggacaaccauuugaguuccuuccaauuggcguagaaauuggaaauucugcucaauaugacgaauucgcauuaccaucauauaacggagcuauaggagaaaauagacaucuagcgcccguugcagcaccaggcuuucccggagaaaauauaguuuuuuuuagcucuaaucucccaguuugggauucaacuucagcacaaaacaauagaagaauuucaugucuauugcccaacgaauuuguacaacauuuuuaugacuuacaagcaccuagucaauccgauguagcccuacuuagauacguacauccagaaagcggaagaguauuauuugaauguaaauuauacagagacggauuccuaaccguaaauggagcaucacucgcagaauuuccaguaaauggauauuuccguuuugauucauggguaaaccaauuuuucacauuaucucccguaggaacgggaucuggaagaaguggaagaucaagaaaugcacaauaa

SEQ ID NO: 32893 - RNA, 1623 nt, Artificial Sequence
  derived and/or modified sequence opt6 from major_capsid_protein__Norovirus__ACW19927
augaaaauggcaagcaaugaugcuaacccaucagauggaucugcagcaaauuuaguuccagaaguaaacaaugaaguuauggcacuagaaccugucguaggagcagcaauagcagcuccagucgccggacaacaaaauguaauugauccauggauaagaaacaacuucguucaagccccaggcggugaauuuacaguaucacccagaaaugcaccaggggaaauccuuuggucagcucccuuaggaccagaucuuaaucccuaccucucccaccucgcaagaauguacaauggauacgcaggaggauucgaaguacaaguaauacuagcaggaaaugcauucacagcaggaaaaauaauauucgcagccguucccccaaacuucccuacagaaggucuaucacccucacaagucaccauguuuccacacauaauuguagauguacgacaacucgaaccagucuuaauaccuuuaccagaugucagaaauaacuucuaccacuauaaccaaaguaaugauucaaccauaaaauuaauagcaauguuauauacuccacuaagagcaaacaacgcaggagaagauguuuuuacuguaucauguagaguucuaacacgaccaaguccugacuucgacuuuauauuucuaguacccccaacaguagaaucaagaacuaaacccuuuacaguuccaaucuuaacaguugaagaaaugacuaauucucgauuuccuauacccuuagaaaaacucuucacugguccaucaggugcauuugucguacaaccacaaaacggaagauguacaacagacggaguauuacuuggaacaacacaauuaucgccaguaaacauauguacauuucgaggagaugucacacauauugcaggaaguagaaauuacacaaugaauuuagcugcgcuaaauuggaauaauuacgacccaacagaagaaauccccgcaccacuaggaacaccagauuuuguagguaaaauacaagguguacuaacacaaacuacaaaaggagauggaucuacaagaggacauaaagcaacaguauacacuggaucagccgauuucacaccuaaauugggauccguucaauuuaguacagauaccgaaaaugauuuugaaacccaucaaaauacuaaauucacuccagucggaguaauucaagacggaucaacaacacauagaaacgaaccacaacaauggguauuaccuagcuauucaggucgaaauguacauaauguacacuuagcaccagcaguagcaccaacauucccuggagaacaacuauuauucuuccgaaguacaaugccaggauguaguggauauccaaauauggaucuagauugcuuauuaccacaagaauggguucaacauuuuuaucaagaagcagccccagcccaaucagaugucgcacuacuacgcuucgugaacccagacacaggccgaguacuauucgaauguaaauuacauaaaucaggauauguaacaguagcacauacaggacaacaugauuuaguuauaccaccaaacggauauuuccguuuugauucuuggguaaaccaauuuuauacuuuagcaccaaugggcaauggcacaggaagaagaagagcauuauaa

SEQ ID NO: 32894 - RNA, 1623 nt, Artificial Sequence
  derived and/or modified sequence opt6 from major_capsid_protein__Norovirus__ACX31885
augaaaauggcauccaacgaugccaacccaucagacggaucaacagcaaauuuaguacccgaaguaaauaaugaagugauggcucuagaaccagucgucggagcugcaauagcagcaccuguagcaggucaacaaaauguaaucgauccauggauacgaaauaacuuuguacaagcaccaggaggagaauuuacaguaucaccaagaaaugccccaggagagauauuaugguccgcaccauuaggaccagauuugaauccauaucuuucacacuuagcaagaauguauaacggauacgcaggaggauuugaaguacaaguaauacuagcagguaacgcauucacagcaggaaaaaucauuuuugcagccguaccaccaaacuuuccuacagaagguuuaucuccaucacaaguuacaauguuuccacauauaauaguagacguaagacaacuugaaccaguucuaauaccccuaccagauguaagaaauaauuucuaccacuauaaccaauccaaugacccaacaauaaaacuuauagcuauguuauacacaccauuacgagcaaacaacgcaggagacgauguauuuacuguaucaugccgaguacuaacucgaccaucaccagacuuugauuucauuuuuuuaguaccuccuacaguagaaucaagaacaaaaccauucacaguaccaauuuuaacaguagaagaaaugacaaacucaagauuuccaauaccauuagaaagacuauauaccggacccaguucugcuuuuguaguacaaccacaaaacggacgauguacaacagaugguguauuacuaggaacaacacaauuaagcgcaguaaacaucuguacauuucgcggagauguaacacacauagcaggaagcagaaacuacacuaugaaucuagcaagccaaaacuggaacaauuacgauccuacugaagaaauaccagcaccauuagguacuccagauuuuguaggaaaaauccaaggaauguuaacacaaacaacucguucagaugguucaacuagaggacacaaagcaacuguacuuacugguucagcagacuuugcaccaaaacuaggcagaguacaauucgcuaccgauacugacaacgacuucgaaaguggacaaaauacaaaauucacuccaguaggcguaauacaagacggauccacuacacacagaaacgaaccacaacaauggguacuaccaaacuauagugguagaacaggccauaacguccaccuagccccagcaguagccccaacauacccaggagaacaacuacucuucuucagaucaacaaugcccggaugcucaggauauccaaacauggauuuagacugcuuacuaccacaagaauggguacaacauuucuaccaagaagcagcaccugcucaaucagacguagcacuauuaagauuuguaaauccagacaccggcagaguccuauuugaauguaaacuccauaaauccgguuauguuacuguagcucacacaggacaacaugacuuaguaauuccaccaaacgguuauuuuagauucgauucaugggucaaucaauuuuacacacuagcacccaugggaaacggaacaggaagaagacgugcacuuuga

SEQ ID NO: 32895 - RNA, 1623 nt, Artificial Sequence
  derived and/or modified sequence opt6 from major_capsid_protein__Norovirus__ACX31887
augaaaauggcaucaaaugaugcaaauccaucagauggaucagcagcuaaccuaguaccagaaguaaacaaugaaguaauggcacuugaaccaguuguaggagcagcaaucgcugcaccaguagcaggacaacaaaauguaauagacccauggauccgcaauaauuuuguacaagcccccggcggagaauuuacaguaucaccaagaaaugcaccaggagaaauacuauggucugcaccauuagguccagauuuaaacccauaccuaucccacuuagcaagaauguacaauggcuaugcuggaggauuugaaguccaaguuauauuagcagguaaugcauucaccgcaggaaagauaauauuugcagcaguuccaccuaauuuuccaacugaaggauuaucucccucacaaguuacaauguucccucauauaaucguagacguaagacaauuagaaccaguauuaauaccauuaccugauguacgcaacaauuucuaccacuauaaccaaucaaaugauucgacaauuaaacuaauagcuaugcuauacacacccuuaagagccaauaaugcaggugaagacguauuuacaguaucaugccgaguacuaacuagaccaucacccgacuuugacuuuaucuuucuagucccaccaacaguugaaucacgaacuaaaccauucacagucccuauacuaaccguugaagaaaugacuaauucaagauucccuauaccacucgaaaagcuauuuaccgguccuucaucugcauucguaguacaaccccaaaacggaagaugcacuacugauggaguacuacuaggaacaacacaauuaucgccagucaauauaugcacauucagaggagaugucacacauauagcuggcucacgaaacuacaccaugaaucucgcuagcuuaaacuggaauaacuaugacccaacugaagaaauaccagcaccacuaggcacaccagauuucguaggcaaaauacaaggaguauuaacacaaacaacaaaaggugauggcucaacucgaggacacaaagcaacaguauauacaggaucugcaccauucacuccaaaauuaggcucaguacaauucucaacagauacugaaaaugauuuugaaacacaucaaaacacaaaauucaccccagucggaguaauacaagauggaggaacuacucacagaaacgaaccacaacaauggguacuaccaaacuauucaggccguaacgucccaaauguccaucuugcaccagcagucgcaccaacauucccaggagaacaauuauuauuuuuccgaucaacuaugccaggaugcuccggauaucccaauauggaccuugauugcuuacuaccacaagaauggguacaacauuucuaccaagaagccgcacccgcacaaucugacguugcacuacuaagauucguaaacccagacacaggacgaguacuuuuugaaugcaaauuacauaaaucuggcuauguaaccguagcucauacuggacaacacgaucuuguaauaccaucaaacggcuacuuucgauucgacucauggguuaaucaauuuuacacacuagcaccaauggguaauggaacuggacgaagaagagcuuuauag

SEQ ID NO: 32896 - RNA, 1623 nt, Artificial Sequence
  derived and/or modified sequence opt6 from major_capsid_protein__Norovirus__ACX31891
augaaaauggcaucaucugaugccucaccaucagaugguucagcagcaaauuuaguaccagaaguuaacaaugaaguaauggcauuagaaccaguaguuggagcggcaauagccgcaccuguugcaggccaacaaaauauaaucgaccccuggauuagaaacaauuuuguacaagcaccaggaggagaauuuacuguaucaccacgaaaugccccuggagaaauuuuaugguccgcaccacuaggcccugauuuaaacccauaucuaucucaccuaucacgaauguacaauggauaugcaggaggauucgaaguucaaguaauacuugccggcaaugcuuuuacagcaggaaaaguaauauuugcagcaguaccgccaaauuuuccaaccgaaggacuaagcccaucacaagucaccauguuuccacauauaauaguagacguacgacaacucgaaccaguauuaauacccuuacccgauguucgaaauaacuucuaucacuauaaccaaacaaacgaccccacaaucaaacuaauagcuaugcuauacacaccacuaagagcuaauaacgcaggagacgacguauuuacaguaucaugucgaguacuaacacgaccaucacccgacuuugacuucaucuuccuaguaccaccaacuguagaaucaagaacaaaaccauucacaguaccaauacuaacaguagaagaaaugacaaauucacgcuucccaauaccccuugaaagacuuuauacaggacccucuucagcauuuguaguacaaccacaaaacggacgaugcacaacagacgguguccuacucggaacaacacaacuaucagcaguaaacauaugcacauuccgcggugacguaacacauaucacuggaucaagaaauuauaccaugaaucuagcuucucaaaacuggaacaauuacgacccuacagaagaaauaccggcaccucuaggaacuccugacuuuguagguaaaauacaaggaauguuaacacaaacaacaagaggugacggaucaacacgaggacauaaagcaacaguauauaccggaucugcagauuuugcaccuaaauuaggaagaguacaauuugcuacugacaccgauaaugauuuugaaagcaaucaaaauacaaaauucacaccagucggaguaauccaagacggcaauacaacacaccaaaaugaaccacaacaauggguacuuccaggauauaguggaagagauggacauaacguacauuuagcaccagcagucgcaccgacuuauccaggagaacaauuacuauucuucagaucaacuaugccuggaugcucaggauaccccaauaugaaccuagauugcuuacuaccacaagaauggguacaacauuucuaucaagaagcagccccagcccaauccgaagucgcucuucucagauucguaaacccugauaccggucgaguauuauucgaaugcaaacuccauaaaucuggauauguaacaguagcacacacaggacaacacgacuuagucaucccaccaaauggauacuuccgauucgacagcuggguaaaccaauucuacaccuuagcaccaaugggaaacggcgcaggaagaagaagagcacuuuaa

SEQ ID NO: 32897 - RNA, 1623 nt, Artificial Sequence
  derived and/or modified sequence opt6 from major_capsid_protein__Norovirus__ACZ37232
augaaaauggcaaguaacgacgcagccccaucaaacgacggagcugcaggacuaguaccagaaauaaacaacgaaguaaugccauuagaaccaguagcaggugcaucauuagcaacaccagucguuggacaacaaaauaucaucgaccccuggauaagaaauaauuuuguccaagcaccagcaggagaauucacagugucaccuagaaauaguccaggagaaauauuacuagaccucgaacuaggaccagaauuaaacccuuaccucgcccaucuagcacgaauguacaacggucaugcagguggaauggaaguacaaauuguucuagcaggaaaugcauucacggcagguaaaauaauauuugccgcaauaccuccaggcuuuccauaugaaaaccuaucuccaucacaaauaacaaugugcccacacguuauaauugacguacgucaauuagaaccaguacuucuaccaaugcccgauauaagaaauaauuuuuuccacuauaaccaaggaaacgauccaaaacuaagauuaguagcaauguuauacacuccucuaagagcuaauaauucaggagacgaugucuuuacaguaucaugccgaguccucacaaaaccaucaccugacuucgaauucacauuccucgucccaccaacuguagaaucaaaaacaaaacaauucacacuaccaauauuaaaaauuucagaaaugacaaacucucguuucccaguaccugucgaaaugauguacacagcuagaaacgaaaaccaaguaguacaaccacaaaacggucgaguaacucucgauggagaauuauuaggaacaacaccauuacuagcuguuaauauauguaaauuuaaaggagaaguaauagccaaaaauggagauguaagaucauauagaauggacauggaaauaacuaauacugauggaacaccuauagacccaacagaagauacacccggacccauaggaucaccagauuuucaaggaauacucuuuggaguagcuucacaaagaaacacaaacgaacccaauccagcaacacgagcacaugaagcaaacauuaauacaggaggagaucaauaugcaccaaaacuugcacaaguuaaauuuuucucagaaucacaagauuuugaaguacaucaaccuacaguauucacaccaguuggaguagcaggagauacgucucacccauuucgacaauggguacuaccaagauacggcggucaccuaaccaauaacacacauuuagcaccagcugucgcaccacuauucccuggagaacaaauauuauuuuuucgaucacaaauaccaucuucagguggacaugaauuaggcuacauggauuguuuaguaccgcaagaauggguacaacauuucuaucaagaagccgccacagcacaaagcgaaguagcccuaauacgauucauaaaucccgauaccggccguguacuauucgaagcuaaauuacauaaacaaggauuuauuacaguagcacacacgggagauaaccccaucguuaugccuccaaauggauacuucagauuugaagccuggguaaaucaauucuacucucuagcuccaguaggaacaggaaauggaagaagacgaauacaauaa

SEQ ID NO: 32898 - RNA, 1623 nt, Artificial Sequence
  derived and/or modified sequence opt6 from major_capsid_protein__Norovirus__ADD10375
augaaaauggcaucauccgacgcaaacccaucugacggauccacagcaaaccuuguaccagaaguaaacaaugaaguaauggcucuagaaccaguaguaggagcagcaauagccgcaccaguagcaggccaacaaaacguaauagacccauggauaagaaauaacuuuguacaagcaccaggaggagaauuuacagucucaccaagaaaugcaccuggagaaauacuuuggucagcaccacuagguccugauuuaaacccauauuuaucacacuuagcacgaauguauaacggcuaugcaggcggcuucgaaguucaaguaauacucgcuggcaaugcuuuuacugcaggaaaaauaauauuugcagcaguaccucccaacuuuccaacagaaggacuaucucccucccaaguaacaauguuuccacauauaauaguagaugucagacaacuggaacccguauuaauaccauuaccagacguaagaaauaacuucuaucacuauaaccaauccaaugacucaacaauaaaacuaauagccaugcucuacaccccauuaagagcaaacaaugccggagaugacguuuucaccgucucauguagaguuuuaacacgaccaucacccgauuucgacuucaucuuucucguaccacccacuguagaaucaagaacaaaaccauucucaguacccguacuaacuguagaagaaaugacaaauucccgauuccccauuccacuagaaaaauuauucacugguccaucaucagcauuuguaguucaaccacaaaacggacgaugcacuacugauggcguauuacuagggaccacacaacuaucaccaguaaauaucugcacauucagaggagauguuacccauauaccaggcucacguaacuacacuaugaauuuagcaucacaaaacuggaacuccuacgauccaacugaagaaauaccagcaccacuaggaacaccagacuuugucggaaaaauacaaggaguuuuaacacaaacuacaagaacuaacggaagcaccagaggccacaaagcaacuguauauaccggauccgcugauuuuuccccuaaauuaggaagaguacaauucgccacagacacagauaacgacuuugaaacuaaccaaaauacaaaauucaccccuguagguguuauucaagacggaucaaccacaccacgaaaugaaccacaacaauggguauuaccauccuacucaggaagaaauauacacaauguacaccuagcaccagcuguagcaccaaccuuuccaggugaacaauuacuauucuuuagaucaacaaugccaggauguucuggcuauccaaauauggaucuugauuguuuacuuccucaagaaugggugcaauacuucuaucaagaagcagcuccggcacaauccgauguugcacuacuaagauuuguaaauccagacacuggacguguauuauucgaaugcaaauuacauaaaagcggauauguuacugucgcacacacaggccaacaugaucuaguuauaccgccaaauggcuauuuuagauuugauaguugggucaaccaauucuacacucuagcacccaugggaaauggaacugguagaagaagagccuuauaa

SEQ ID NO: 32899 - RNA, 1623 nt, Artificial Sequence
  derived and/or modified sequence opt6 from major_capsid_protein__Norovirus__ADO85552
augaaaauggcaaguucagacgcaaacccaucagacggaucaaccgcaaaucucgucccugaaguaaacaaugaagucauggcacuagaacccguuguuggugcagccucagcagcuccuguagcaggucaacaaaauguaauagacccauggauacgaaauaauuucguacaagcucccggcggagaauuuacagaaucuccuacaaaugcuccaggagaaauauuaugguccgcaccacuagguccagauuuaaauccauaccuaucucacuuagcccgcauguauaaugguuacgcuggaggauuugaaguacaaguuauauuagccggaaacgccuuuacggcaggaaaaauaauauuugccgcagugccaccaaacuuuccaacagaaggucuuuccccaucccaaguaacaauguucccucacauaaucguugauguucgucaacucgaaccaguacuuauuccacuaccagauguacgaaacaauuuuuaucauuauaaccaaucaaaugacccuacaauaaaauuaauagcuauguuauacacuccauuaagagcaaacaaugcaggcgacgacguauuuacaguaucauguagaguacuuacucgaccaucccccgauuucgacuuuauauuuuuaguaccagcaacaguagaaucacgaacaaaaccuuuuucaguaccaguauuaacaguagaagaaaugacaaacucaagauuuccaaucccacucgaaaaauuauuuacaggaccaucaagcgcauucgucguacaaccucaaaacgguagaugcacaacugacggaguuuuacuagguacaacacaauuaucaccuguaaauauauguacauuuagaggagauguuacccauauacccggaucaagaaauuauacaaugaacuuagcaagucaaaauuggaacucuuaugauccaaccgaagaaauuccugcaccuguaggaaccccagacuuuguaggcaaaauacaaggcguccuaacccaaacaacaagaacaaacggcuccacucgcggucauaaagcuacaguauauacaggauccgcagauuuuucacccaaacuaggcagaguacaauuugccacagauacagacaacgauuuugaaacaaaucaaaauacuaaauucacaccaguugguguaauacaagacgguucaacaaccccacgaaaugaaccacaacaauggguucuucccuccuacuccggcagaaauauacacaacguccaccuugcaccugccguagccccuacuuuuccaggcgaacaacuacuuuucuuucgaucaacaaugccaggaugcucagguuacccaaauauggaucuagauugccuucuaccccaagaauggguucaauauuuuuaccaagaagcagcaccagcgcaaucugacguagcacuacuaagauucguaaauccagauacaggaagagucuuauucgaauguaaacuacacaaaucuggauacguaacagucgcacacacaggucaacacgaccuaguaauucccccaaacggcuauuucagauucgacucaugggucaaucaauuuuacacucuagccccaauggguaauggaacuggaagacgaagagcauuauaa

SEQ ID NO: 32900 - RNA, 1623 nt, Artificial Sequence
  derived and/or modified sequence opt6 from major_capsid_protein__Norovirus__ADQ43779
augaaaauggcaucaaaugacgcauccccuucagauggaucugcagcaaaucuaguaccagaaguaaauaaugaaguaauggcccuagaaccaguaguaggagcagcaauagccgcucccguagcaggacaacaaaauguaauagauccauggauucgaaauaacuucguccaagcaccugguggugaauucacaguaagcccacgaaaugcaccaggagaaauauuauggucugcaccacuaggaccugacuuaaauccauacuuaucucaccuagcccgcauguauaacggauacgcugguggcuucgaaguacaaguaauauuagcaggaaaugcauucacagcaggcaaaauaauauuugcugcaguaccaccaaauuuuccaacagaaggacuuucacccucacaagugaccauguuuccucacauaaucgucgacguacgacaacuagaaccaguucuaauaccucuaccagacguacgaaacaauuuuuaucacuacaaucaauccaaugauucuacaaucaaacuuauagccaugcucuauacaccccuacgagcuaacaacgcaggagaagacguauuuacuguaucauguagaguucucacccguccauccccagauuuugacuuuauauuucuugucccuccaacaguagaaucacgaaccaaaccauuuacaguuccaauacuaacaguagaagaaaugacaaauucaagauuccccauuccacucgaaaaacuauucacaggcccaucauccgcuuucguaguacaaccacaaaacgguagauguacaacagauggcguguuauuaggaacuacacaauuaucuccaguaaacauuuguacauuccggggagauguaacacauaucgcaggcucaagaaauuauacaaugaaucuagcaucuuuaaauuggaacaacuaugacccaacagaagaaauaccagccccguuaggaacaccagacuucguaggcaaaauacaaggaguauuaacacaaacaacaaaaggagacggaucaacacgaggucauaaagcuacuguauauacaggaucagcaccauucacaccaaaauuaggaucaguacaauuuucuaccgauacugaaaaugauuuugaaacucaucaaaauaccaaauuuacaccaguaggaguaauucaagacggaggaacaacgcauagaaaugaaccacaacaaugggcacuaccaucauauucaggacgaaauguacaaaacguacaccuugcaccagccguagcacccacauuuccaggcgaacaacuacuauucuuuagaaguacuaugccuggcugcucuggauacccaaauauggaucuagacugcuuauuaccacaagaauggguacaacacuucuaccaagaagcagcaccagcucaaucugauguagcauuacuaagauucguaaacccagacacuggcagaguuuuauucgaaugcaaacuacauaaaucaggauacguaacaguagcacauacaggucaacacgaucuaguaauaccucccaauggauauuuccguuucgacucuuggguaaaccaauuuuacaccuuagcaccaauggggaauggcacaggucgacgaagagccuuauaa

SEQ ID NO: 32901 - RNA, 1623 nt, Artificial Sequence
  derived and/or modified sequence opt6 from major_capsid_protein__Norovirus__ADQ43781
augaaaauggcaucaucagacgcaaauccuucagacgguucuacagcaaaucugguuccagaagucaacaacgaaguuauggcacuagaaccagucgucggagcagcaauagcagcaccuguagccggucaacaaaaugucauagauccuuggauaagaaauaauuuuguacaagcaccaggcggugaauucacaguaucaccacgaaacgccccuggagagauccuauggucagcuccauuaggacccgauuuaaaucccuacuuaucacaccuagcacgcauguauaacggauacgcaggaggauuugaaguccaaguaauacuagcaggcaaugcuuuuaccgcaggcaaaauaauauuugcagcaguaccaccuaacuuuccaacagaaggauuaucaccaucccaaguaacaauguuuccacauauaauaguagauguaagacaacucgaaccaguauuaauacccuuacccgacguacgaaacaacuucuaccacuauaaccaaucaaacgauccaacuauuaaauuaauagcaaugcuauacacuccauuacgugcaaauaaugcaggagaugauguauucacaguauccuguagaguacucacaagaccuuccccagacuuugauuuuauauuucucguacccccuaccguagaaucacguacaaagccauucucaguaccaguuuuaacuguagaagaaaugacaaauucacguuuuccaauaccuuuagaaaaauuauucacaggaccuucaucagcauucguuguacaaccacaaaacggacgauguacaacagacgguguucuauuaggaacaacacaauuaucuccaguaaacauauguacauuuagaggagaugucacccauauaccaggauccagaaauuauacaaugaacuuagcuucgcaaaauuggaauucauacgauccuacagaagaaauaccagcaccauuagguacucccgauuuuguaggcaaaauacaaggaguauuaacucaaacaacacgaacaaacggaucaacaagaggucacaaagcaacaguauauacagguucagccgauuucucaccaaaauuagguagaguacaauucgcuacugauacugauaacgacuucgaaacaaaucaaaacacaaaauucacaccuguaggagucauccaagauggaucaacaacaccacgcaaugaaccacaacaauggguacuaccuucauauucuggaagaaacauacacaauguacacuuagcuccagcaguagcaccaacauucccuggagaacaauuacuauucuuucggucuacaaugccaggauguucaggauauccaaauauggacuuagacugccuacuaccacaagaauggguccaauacuucuaccaagaagcugcuccagcucaaagugacguugcacuacuaagauucguaaauccagauacaggacgaguacuauucgaaugcaaacuccacaaauccggauauguaaccguagcacacacaggacaacacgaucucguuauccccccaaauggauacuucagauucgacucuuggguuaaucaauuuuauacucuugcacccaugggaaauggaacaggcagaagacgugcacuguaa

SEQ ID NO: 32902 - RNA, 1623 nt, Artificial Sequence
  derived and/or modified sequence opt6 from major_capsid_protein__Norovirus__ADQ43783
augaaaauggcaucaucagacgcaaauccaucagauggaucuacagcaaaccuaguaccugaaguaaauaaugaagugauggcuuuagaaccuguagucggagcagccauagccgcaccagucgcuggacaacaaaauguuaucgacccauggauaagaaauaauuuuguacaagcaccaggcggugaauucacaguaucuccuagaaaugccccuggagaaauacuauggucagcaccacuagguccagaccuaaauccauauuuaucacauuuagccagaauguacaauggauacgcaggcggauucgaaguacaaguuauauuagcaggaaaugcuuuuacagcaggaaaaaucaucuucgcagcaguaccaccuaauuuuccaacagaaggauugucaccuucacaaguuacaauguucccucacauaauaguagauguacgucaacuagaaccaguacuuauaccauuaccagacguaagaaauaacuucuaucauuacaaccaaucgaaugaucccacuaucaaauuaauagcaaugcuauauacaccauuacgcgccaauaaugcaggugacgauguauucacaguuucuugucgaguauuaacacguccaagucccgacuuugauuuuauauuucuuguucccccaacaguugaauccagaacuaaaccauucucaguaccaauacuuacaguagaagaaaugacaaauucaagauuuccaauaccauuagaaaaauuauuuacagguccauccucagcuuucguuguacaaccccaaaacggaagguguacaacagacggaguacuuuuaggaacaacccaacuaucccccguaaacauaugcacauuucgaggagacguaacacacauuacugguucucgaaauuauacaaugaaucuagcaacacaaaacuggaauucauacgauccuaccgaagaaauaccagcaccacuaggcacaccagauuuuguaggaaaaauucaaggaguuuuaacacaaacaacacgagcagaugguagcacgagaggacacaaagcaacaguuuauacugguuccgcugacuucgcuccuaaauuaggaagaguacaauucgcuacagauacagauaacgauuucgacgccaaucaaaacacuaaauuuacaccagucggcguaauacaagacggagacacugcccauagaaacgaaccacaacaauggguuuuaccaucuuacucaggucgaaauagccauaauguacacuuagcacccgcaguagcaccaacauucccaggagaacaauuacuauucuuucgaucuacaaugcccggaugcagcgguuauccaaacauggaucuugacugccuucuaccucaggaauggguccaauauuucuaucaagaagcagcaccagcccaaucugaugucgcccuccuacgauuuguaaaucccgauacuggaagaguacuuuucgaaugcaaacuacauaaaucuggauacguaaccgucgcucacacuggacaacacgauuuaguaauaccaccaaacggauacuucagauucgauucauggguaaaccaauucuauacacuugcaccaaugggaaauggaacagguagaagaagagcauuauaa

SEQ ID NO: 32903 - RNA, 1623 nt, Artificial Sequence
  derived and/or modified sequence opt6 from major_capsid_protein__Norovirus__ADV37805
augaaaauggcaagcucagaugcuaauccaucagacgguucuacagcuaaccuaguaccagaaguaaauaaugaaguaauggcacuagaaccaguaguaggagcagcaauugcugcuccaguagccggacaacaaaauguuauugauccuuggauaagaaauaacuuuguacaagcaccaggaggagaauuuacagucucaccaagaaaugcaccuggagaaauacuuugguccgcaccacuaggaccugaucuuaacccauacuuaucacaccuagcaagaauguacaacggauaugccggaggauuugaaguacaagucauacuagccggaaaugcauuuacagcaggaaaaauaauauucgccgcaguaccaccaaauuucccaacugaaggauuauccccaucacaagucacuauguucccacacauaaucguagauguuaggcaacuagaaccaguucuaauaccacuaccagauguaagaaauaacuucuaucauuauaaccaaucuaaugacccuacaauaaaacuaauagccauguuauacacaccacuaagagcaaacaaugccggagacgacguauucacaguaucauguagaguucuaacaagaccaucaccugacuuugacuuuauauuucuaguacccccaacaguagaaucacggacaaaaccuuucucaguuccuaucuuaacaguagaagaaaugacaaauucuagauucccaauaccacuugaaaaacucuuuacuggacccucaucagcauucguaguacaaccacaaaacggacgaugcacaacagacggaguacuucuagguacuacacaacucucuccaguaaacauaugcaccuuuagaggugacgucacacauauaacaggaucacguaacuacacaaugaaucuagcaacucaaaacuggaauucauacgauccuacagaagaaauaccagcaccuuuaggaacaccagauuucguaggaaagauacaaggaguauuaacccaaacaacucgagccgacggaucaacucgaggccacaaagcaacuguauauacaggaucagcagacuuugcuccuaaauuaggacgaguacaauucgcaacagauacagacaacgacuuugacgccaaucaaaauacuaaauucacuccaguuggaguuauacaagacggagauacagcacaccgcaaugaaccacaacaauggguauuaccauccuauucagguagaaacucccacaacguccacuuagcaccagcaguagcaccuacguuuccaggagaacaacuauuauuuuucagaucaacuaugcccggaugcucuggcuacccuaauauggaucuagauugccuacucccacaagaauggguacaauauuucuaucaagaagcagcaccagcccaaucagauguagcacuuuuaagauucguaaacccugauaccggaagaguacuauuugaauguaaacuccauaaaucagguuauguaacuguagcucauacuggacaacacgaucuugucauaccaccaaacgguuauuucagauucgauucauggguuaaccaauuuuacacacuagcaccaaugggcaauggaaccggaagacguagagcauuauaa

SEQ ID NO: 32904 - RNA, 1623 nt, Artificial Sequence
  derived and/or modified sequence opt6 from major_capsid_protein__Norovirus__ADV37807
augaaaauggcaucuucugacgccaacccuagcgauggaucaacagcaaauuuaguuccagaaguaaacaaugaagugauggcccuagaaccuguaguaggagccgcaauagcagcaccagucgcaggccaacaaaauguaauagauccuuggauucgaaauaacuuuguacaagcaccaggaggagaauucacaguuucaccaagaaaugcaccuggagaaauacucugguccgcaccacuaggaccugaucuaaauccauaucuaucucauuuagcaagaauguacaauggauaugcaggaggcuucgaaguacaaguaauucuagcaggaaacgcauucacggcuggaaaaauaauauucgccgcaguaccaccaaauuuuccaaccgaaggauuaucacccucacaaguaaccauguuuccacauauuauuguagacguuagacaacuagaaccaguauuaauaccauuaccugauguccgaaacaauuuuuaucauuauaaccaaagcaaugauccuacaauaaaacuuauagcaauguuauacacaccuuuaagagcaaacaacgcaggagacgacguauuuaccgucucauguagaguauuaacacgaccaucuccugauuuugacuucauauucuuaguacccccaacaguagaaucucgcacaaaaccauucuccguaccuauacuaaccguagaagaaaugacaaacaguagauucccaauaccacucgaaaaacuauuuacaggaccuuccuccgcuuuuguuguccaaccacaaaauggacgauguacaacagauggagugcuacuaggaacaacucaauuaucaccaguuaacauauguacuuuucgaggagacguaacacauauaacaggcagucgcaauuacacaaugaacuuagccacacaaaauuggaacucauacgauccaacagaagaaauuccagcaccacuaggcacaccagacuuuguaggaaaaauacaaggaguacuaacacaaacaacaagagcagauggaucaacacgaggacacaaagcaaccguauauacuggauccgcagacuuugcaccuaaacuaggaaggguacaauucgcaacagacacagauaacgacuucgacgcaaaccaaaauaccaaauuuacaccaguaggcguuauacaagauggagauaccgcccaccgaaacgaaccacaacaauggguacucccaucauauucugguagaaauagccauaacguacaucuagcacccgcaguagccccaaccuuuccaggcgaacaacuacuauucuuccgaucgacgaugccaggcugcuccggauauccuaauauggauuuagauugcuuacuuccacaagaauggguacaauacuuuuaucaagaagcagcaccagcacaauccgacguagcacuauuaagauucguaaacccagauacuggaagaguacuuuucgaaugcaaauuacauaaaucgggauauguaacaguagcacauacuggucaacacgaucuaguaauaccaccaaacgguuacuuucgauucgauucuugggucaaccaauuuuauacacuagcaccaaugggaaauggaacuggaagaagacgugcauuauaa

SEQ ID NO: 32905 - RNA, 1623 nt, Artificial Sequence
  derived and/or modified sequence opt6 from major_capsid_protein__Norovirus__ADV37809
augaagauggcaucaagcgaugcuaacccuucagaugguucaaccgcaaaucuaguaccagaaguaaacaaugaaguuauggcacuagaaccaguaguaggagcagcaauugcagcucccgucgcaggacaacaaaauguaauagauccuuggauaagaaauaauuucguucaagcuccuggaggugaauuuacagucucaccaagaaaugcaccaggagaaauauuauggucagcaccccuagguccagaucuaaauccauacuuaucacauuuagcacgaauguacaacggauacgcaggaggguucgaaguucaaguuauauuagcaggaaaugcauuuacugcaggaaaaauaauauucgcagccguacccccaaacuuucccacugaaggauuaucuccaucacaagucacaauguuuccacauauaauaguugacguuagacaacuagaaccaguacucauaccauuaccagauguaagaaauaauuuuuaucacuacaaccaaucuaaugauccaacaauaaaacuaauagcaaugcuuuacacaccuuuaagagcaaauaaugcaggugacgauguauuuacuguuucauguagaguuuuaacaagacccucaccagacuuugauuucauauucuuaguaccgccaacagucgaaucucgaaccaaaccuuucagcgucccaaucuuaacaguagaagaaaugacuaacucuagauucccaauaccccuugaaaaacuauuuacaggaccaaguucagcauucguaguacaaccacaaaacggacgauguacaacagacgguguucuucuagguacuacucaacuaucaccagucaauauauguacauuuagaggcgauguaacucauauaacaggaucccgaaacuacacaaugaaccuagcaacccaaaacuggaacagcuaugauccaacagaagaaauaccagcuccacuaggaacacccgauuuuguaggaaaaauacaaggaguauuaacacaaaccacaagagccgacggaucuacaagaggacauaaagcaacagucuauacagguucagcagacuucgcaccaaaacuaggccgaguacaauucgcaacagauacagauaaugacuucgacgcaaaccaaaauacaaaauuuaccccaguaggaguaauccaagauggcgauacagcacauagaaaugaaccacaacaauggguccucccaaguuacagcggacgcaauucacauaauguacauuuagcaccugccguagcuccaacauuucccggagaacaacuauuauucuuuagaucaacaaugcccggauguucaggauaucccaauauggaucuagacugcuuacuaccacaagaauggguucaauauuuuuaucaagaagcagcaccagcucaaucagacguugccuuauuaagauuuguaaacccugauacaggaagaguacuauucgaaugcaaauuacauaaaucuggauauguaacaguagcucauacaggacaacaugaucuaguaauaccaccaaacggauacuuuagauuugauucauggguaaaucaauuuuacaccuuagcuccaaugggaaacggaacaggaagacgaagagccuuauaa

SEQ ID NO: 32906 - RNA, 1623 nt, Artificial Sequence
  derived and/or modified sequence opt6 from major_capsid_protein__Norovirus__ADV37813
augaaaauggcaucaucugaugcuaacccaucagacggaucaacagcaaauuuagucccagaaguaaacaacgaaguaauggcacucgaaccaguaguaggugcagcaauagccgcaccuguagcaggacaacaaaauguaauagacccauggauacgcaauaacuucguccaagcaccaggaggagaauuuacaguuucaccaagaaaugcucccggagaaauauuauggucagcaccacuaggucccgauuuaaauccuuacuuaucucaccuagccagaauguauaacgguuaugcuggagguuucgaaguacaaguaauacuagcaggcaacgcauucacagcaggaaaaauaauauuugccgcaguaccaccuaacuuucccacugaaggauuaucaccaucacaaguaacaauguucccccacaucauugucgauguaagacaauuagaaccaguucucauuccacuaccagauguccgaaacaacuucuaccacuauaaucaaucaaacgacccaaccaucaaacuaauagcaauguuauacaccccauuaagagcaaacaaugccggagacgacguauuuacuguaucauguagaguacuaacaagacccucacccgacuuugauuuuauauuuuuaguccccccaaccguagaaucaagaacuaaaccauucucaguaccagucuuaacuguagaagaaaugacaaauuccagauucccaauuccauuagaaaaauuauuuacaggaccaucuucagcauucguaguacaaccccaaaauggaagauguacaacagacgguguacuucuaggaacaacucaauugucaccaguaaauauaugcacauuuagaggagauguaacccauaucccaggcaguagaaauuacacuaugaaucuggcuucccaaaacuggaacucauacgacccuacagaagaaaucccugcaccauuaggaaccccugacuuugucggcaaaauucaaggaguauuaacacaaaccacaagaacuaacggcagcacuagaggccacaaagccacagucuauacaggauccgccgauuuuucacccaaauuaggcagaguccaauuugccacagauacagacaacgaucuagaaacaaaucaaaauacaaaauucacaccuguugguguaauacaagacggaucaaccaccccccgcaacgaaccucaacaaugggucuuaccauccuauucaggaagaaauauacauaacguacaucucgcacccgcagucgcuccaacauuuccaggugaacagcuauuauuuuuucgaucaaccaugccaggcugcucaggauauccaaauauggacuuagacuguuuacucccacaagaauggguacaauauuucuaucaagaagcagcaccagcacaaucugacgucgcucuucucagauuuguaaacccagauacagguagagucuuauucgaauguaaauuacauaaaucaggauaugucacagucgcacauacaggacaacacgacuuagucauaccaccuaacggauauuucagauuugacucuugggucaaccaauuuuauacacuagcaccaaugggaaauggaacuggacgaagaagagcacuauaa

SEQ ID NO: 32907 - RNA, 1623 nt, Artificial Sequence
  derived and/or modified sequence opt6 from major_capsid_protein__Norovirus__ADV37917
augaaaauggccucaucugauacaaaaacaucagauggcaguacagcaaaccuaguuccagaagucaauaacgaaguuauggcacuagaaccaguugucggagccgcuauagcagcaccuguagcuggacaacaaaaugucaucgacccauggauacguaauaacuuuguacaagcaccaggcggagaauucacaguaucaccuagaaacgcaccuggagaaauacuauggucagcuccacuaggcccagauuuaaacccuuaucuaucgcaccuagcaagaauguauaacggauacgcugguggauuugaaguucaagucauacuagcagguaaugcauuuacagcaggcaaaauaauuuucgcagcaguuccaccaaauuuucccaccgaaggauuaucaccaucacaaguaaccauguucccucacauaaucguugacguaagacaauuagaaccaguuuuaauaccucuuccagauguacguaacaauuuuuaucacuacaaucaaucaaacgacccaacaauaaaacuuauagcaauguuauacacuccauuaagagcaaacaacgcaggugacgacguauucaccgucuccuguagaguauuaacucgacccucaccugacuuugacuuuauauuuuuaguaccaccaacuguugaaucaagaacaaaaccuuucucgguaccaauauuaacaguagaagaaaugacaaacucacgauuuccaauaccauuagaaaaacuauuuacagguccaaguuccgcguucguaguacaaccacaaaacggaagauguacaauugacgguguucuauuaggaacaacccaacuaucccccgucaauauauguacauuuagaggcgacguaacccacauaaccggaucaagaaauuauacaaugaacuuagcaacacaaaacuggaauucuuacgauccaacugaagaaaucccagccccucuaggaacaccagauuuugucggaaaaauacaaggaguacuaacccaaaccacaagagcggacggcucaaccagaggacauaaagcaacagucuauaccggauccgcagauuucgcacccaaauuaggaagaguccaauucgccacagauacagauaacgauuucgaugcaaaccaaaauacaaaauucacaccaguuggaguaauacaagauggaaacacagcucauagaaacgaaccacaacaaugggucuuaccuucauauucaggcagaaauucucauaacguccacuuagcccccgcuguagcaccaaccuuuccuggugaacaacuccuauuuuuucgaucaaccaugccuggauguucaggauauccaaacauggacuuagacugcuuauuaccacaagaauggguucaauauuucuaccaagaagcagcaccagcacaaucagacguagcauuacuacguuuuguuaacccugauacaggaagaguacuuuuugaaugcaaauuacauaaauccggcuauguaacuguagcacauacaggacaacacgaccuuguaaucccaccaaauggauauuuuagauuugauucauggguuaaucaauucuauacauuagcaccaaugggaaaugguacuggcagaagaagagcuuuauaa

SEQ ID NO: 32908 - RNA, 1623 nt, Artificial Sequence
  derived and/or modified sequence opt6 from major_capsid_protein__Norovirus__ADV37919
augaaaauggcaucauccgaugcgaauccaucugauggcucuacugcuaacuuagucccagaaguaaauaaugaaguaauggcucuagaaccaguaguaggagcugcaaucgcagcgccaguagccggacaacaaaauguuauagacccuuggauccguaacaacuucguacaggcacccgguggugaauucacaguuagccccagaaaugcaccaggagaaauauuauggucagcaccuuuaggaccagaucuaaauccauauuuaucacaccuugcuagaauguacaacggcuaugccggaggauucgaaguucaaguaauacuagcagguaacgccuuuacagcaggaaaaauaauauuugcugcaguuccuccaaauuucccaacagaaggauuaucacccucucaaguuaccauguuuccacauauaauuguagacguuagacaacuagaaccaguacuuauaccauuaccugacguaagaaacaauuucuaucauuacaaccaaucaaacgacccaacaauaaaauuaauagcaaugcuauacacaccauuacgagcuaauaaugcaggagaugauguauucacaguaucauguagaguacuuacaagaccaucaccagacuuugacuuuauauuucuuguaccaccaaccguagaaucuagaacuaaaccauucagcguaccaauauuaaccguagaagaaaugacaaauucuagauuuccaauacccuuagaaaaacuauuuaccgguccaucaucagcauuuguaguucaaccucaaaauggucgauguacuauagacgguguacuauugggcaccacucaauuaaguccaguaaacauauguaccuuuagaggagacguuacacacauaacuggaucaagaaauuauaccaugaauuuagcaacacaaaacuggaacaguuacgauccaacagaagaaauaccagcaccauuagguacaccagacuuugucggaaaaauacaaggaguauuaacacaaacaacacgagcagauggcucaacccgaggacauaaagcuacuguauauacaggcucagcagacuucgccccuaaacuaggucgaguacaauucgcuacagauacagauaaugauuuugaugccaaucaaaauacuaaauuuaccccaguaggaguuauacaagauggaaacacugcacaccgaaaugaaccacaacaauggguuuuaccaaguuacucaggacgaaauucucauaauguacaucuagcuccagcuguagcuccaacauuuccuggugaacaacuacuuuucuucagaucaacuaugccaggcuguaguggauacccaaacauggacuuagauugucucuuaccucaagaauggguacaauacuuuuaucaagaagcagcucccgcacaaagugacguagcccuauuaagauucguaaaccccgacaccgguagaguuuuauucgaaugcaaauuacauaaauccggauaugucacaguugcucacacaggacaacacgauuuaguaauaccaccaaauggcuauuucagauuugauuccugggucaaccaauuuuacacacuagcaccaaugggaaacggaacaggacguagaagagccuuauaa

SEQ ID NO: 32909 - RNA, 1608 nt, Artificial Sequence
  derived and/or modified sequence opt6 from major_capsid_protein__Norovirus__AEI83469
augaaaauggcaucaaacgacgcagcuccuuccaaugauggagcagcaggacucguaccagaaguaaauaacgaaacaauggcauuagaaccuguagcaggagcauccauugcagcaccauuaacaggacaaaauaacguaaucgauccauggauacgucuaaauuuuguacaagcaccaaacggcgaauucaccguaucaccuagaaacuccccaggcgaaguauuacuaaaccuugaauuagguccagaacuaaauccauaucucgcacaucuaucacgaauguauaauggauaugccggaggaguagaaguacaaguauuacuagcaggcaacgcuuuuacagcugguaaacuuguguuugcagcaguacccccccacuucccauuagaaaacaucuccccaggacaaauaacaauguuuccacauguuaucaucgauguacgaacuuuagaaccaguccuauuaccacuaccagacguaagaaacaacuuuuuccauuacaaucaacaaaaugaaccaagaaugcgacuaguagcaaugcuauauacaccucuaagaucaaacggcuccggagacgacgucuucacaguaucaugucgaguccuaacaagaccaucaccagacuucgauuucaauuacuuaguaccaccuacaguggaaaguaaaaccaaaccauuuacauuaccaauuuuaaccaucggcgaauuaacaaacucacguuuuccaguaccaauagacgaauuauacacaucaccaaaugaaucacuuguaguacaaccucaaaauggcagaugcgcacucgauggagaacuacaaggaacuacacaacuauuaccaacagccauaugcucauuucggggaagaauaaaucaaaaagucuccggagaaaaucacguauggaauaugcaaguuaccaauauaaauggaacacccuucgauccaacagaagauguuccagcaccuuuaggaacuccagacuuuucaggaaaauuauucgguguuuuaucacaacgagaucacgauaaugcuugccgaucacaugacgcaguuauagcaacuaauucugcaaaauucacaccaaaacuaggagcaauacaaauuggaacaugggaagaagaugauguacauauuaaucaaccuacaaaauucacuccaguaggacuauucgaaucugaaggcuuuaaucaauggacccuaccaaacuacucaggagcacuaacauugaacaugggacuugcaccuccaguagcuccaacuuuuccaggugaacaaauauuauuuuucagaucacacauuucauuaaaaggagggguagcugacccuguaaucgacugccuacuuccacaggaauggauacaacacuuauaucaagaaucagcaccaagccaaacugauguagcacuaauaagauucaccaauccagauacuggaagaguccuauuugaagcaaaacuccacagaucaggauauauaacagucgcuaacacaggauccagaccaauaguaguacccgcaaauggauauuuucguuucgauucuuggguaaaucaauuuuauucacuagcaccuaugggaaccggaaacggaagaagaagaguccaauaa

SEQ ID NO: 32910 - RNA, 1644 nt, Artificial Sequence
  derived and/or modified sequence opt6 from major_capsid_protein__Norovirus__AEP04093
augaaaauggcuucaaaugaugcagcuccaucaacagauggaucagcaggucuaguaccagaaguaaauaaugaaacuauggcccuagaaccuguaguaggagcucccuuggcagcacccgucgcaggacaacauaauauuauagauccauggauaaaaaugaacuucguacaagcaccaaauggagaauuuaccgucuccccacgcaacgcacccggagaaauacuacuagaucuagaacuaggaccagauuuaaacccauaucuaucacacuuagcccgaauguauaacggcuaugcaggcggcauggaaguccaagucguacucgcuggaaacgcauuuacagcaggaaaaauaauauuugcagcaguucccccaaauuucccugcagaaaauuuaagugcagcacaagucacuauguguccacacguaauagucgauguaagacaauuagaaccuguaauguuaccaaugccugauauuagaaauaaauuauuccauuacaaucaaguugaugauccuaaacuaagauuauuagcauaucucuauacaccauuacgagccaauaaugcaggagaugauguuuuuacaguaaguuguagaguauuaacaagaccuacucccgauuuugaauuuauguuucuaguaccaccaacuguagaaucaaaaacaaaacccuuuucauuaccaucuuuaacacuagaugaacuaaguaauucccgauuucccgcaccaauaguacaauuauacacaaacccucacgauaauuuaguuguacaaccucaaaacggacgauguacaauagacggauuauuacaaggaacaacacaauuaguuaguugcaauguauguucauucagagguacuauuggagauggacaacccgccucucacagugaagaagaaauaaugccuauggccuuuaauauucagagagaauuaaugcuugaaaaucucgauggaucaccauaugauccaacugaugauauaccagcaguacuuggaucacccgacuuucaaggugucauauuuggcauauuaucucaaagaaauggagauggacaaacaagagcacaugaagcaaaaguagauacccgagcagcuagauucgccccaaagcuuggcuuugucguagcaacuguagaaucuacagauuuucaugcaaaccaaccauccagauuuacaccaguaggccuaggaggagauggaaaccaagauuuugcucaauggaaucuucccacuuacggaggagcacuaacaaauaauacaaacuuagcaccuccaguaaugccaguuuacccaggugaacaauuacuuuucuuucgaucucaauuaccaucaucaggaggaguuguagguggcuggcuagauugucucuuaccccaagaauggguacaacacuucuuucaagaaucagcaacaagucaaucagauguugcacucguacgauauauaaaucccacaacaggacguguacuauuugaagcaaagcuacauaaacaagguuuuuuaacuguagcagccucaggaucuuacccauuaguaguaccagcagauggcuauuuuagauuugaaucaugggucaaucaauucuauacauuagcaccaaugggaaauggaucagggagaagaagaacaagauaa

SEQ ID NO: 32911 - RNA, 1620 nt, Artificial Sequence
  derived and/or modified sequence opt6 from major_capsid_protein__Norovirus__AEQ77282
augaugauggcaucaaaagaugcaccaucaaauauggacggaacaucaggagccggucaacuaguaccugaaguaaaugccgcagaaccauuaccauuggaaccaguaguaggagccgcaaccgcagcagcaacagcaggacaaguaaaucuaauugauccauggauuaugaacaauuuuguacaagcuccagaaggugaauucacaauaaguccaaacaauacacccggagacaucuuauucgaucuacauuuaggaccacauuuaaacccauuucuacaacaucuaucacaaauguacaauggauggguaggaaacaugagagucaggguaaugcuagcuggcaaugcauuuacagcagguaaaauaauuauauguuguguaccaccaggauuugcuucucaaaauauuucuauuggacaagcaacaauguucccacauguaauagcagauguucgaguacucgaaccaauagaaauaccauuagaugauguaagaaauguauuauuccacacaaaugaaaauagaccaacaaugagacuucucugcauguuauauacccccuuaagagcaggaggagcaucaucuggaacagauccauuuguaauagcaggaagaguauuaacauguccaaguccugauuuuaauuuuuuauuccuaguaccaccauccguugaacaaaagaccagacagcucacaguacccaacauaccucuuaauaaucuagcaaacucccguguaccagcaaugauaaauaaaaugacuguauccaccgaucaaaaccaagucguucaauuccaaaauggccgauguacauuagaaggacaauuacuaggaaccacaccuguuucagcuucacaaguagcaagaauaagaggaaaaguauuuucaacagccucaggaaaaggauuaaauuuaacagaauuagauggaacuccauaucaugcauuugaaaguccagcaccacuaggauuuccugacaucggagcaugugauuggcauguaaguaccuuuaagguagaucaaaauuuaucaggagacccaaugucaagacuagauguaaaacaaaaugcaccauuugcuccccaucuuggaucaauagaauuuacaucggaucaagacccaacaggagaucaacuuggaacucuagccuggguaucuccaucuacaucaggugccagaguugaucccuggaaaauaccaucauacggcucaacaguuacagaaucaacacaucuugcaccaccaauuuuuccuccagguuucggagaagcaauaguauauuuuaugucagacuuuccaauaguaucagguaacacagcacaaguaccauguacacuuccacaagaauuugucucacacuuugucgaacaacaagcaccaguacgaggugaggcagcacuacuacacuacguagauccagauacucacagaaaucucggcgaauuuaaauuauaccccgacggauuuauaacauguguaccaaauaccggaggaggaccacaaaaucuaccuacuaacggaguuuuuguauuuucuucauggguaucucgauacuaucaauuaaaaccagucggaacagcaggacccgccagaagacuuggaguccguagaguauaa

SEQ ID NO: 32912 - RNA, 1608 nt, Artificial Sequence
  derived and/or modified sequence opt6 from major_capsid_protein__Norovirus__AFA55174
augaaaauggcuucuaacgaugcagcaccaaguaacgauggagcagccggacuuguaccagaaguuaauaacgaaacaauggcucuugaaccaguagccggugcaucaauugcagcaccacuaacaggccagaauaacguaaucgauccuuggaucagaaugaauuuuguacaggcuccaaacggagaauuuacuguaaguccgagaaauucaccaggcgaaguucuacuaaaucuagaauuaggcccagaauuaaauccauuucuugcccaucuaaguagaauguauaauggguaugcagguggaguagaaguacaaguuuuauuagccggaaaugcauuuacugcuggaaaauuaguauuugcagcuauaccaccacacuucccucuagaaaaucuuucaccaggacaaauuacaauguucccacaugucauaauagauguaagaacacuagaacccguuuuauuaccauuaccagacguacgaaacaauuuuuuucacuacaaucaacaacccgaaccuagaaugcgacuaguagccauguuguauacaccauuaagaucaaauggaaguggagaugacguauuuacaguaucauguagagucuuaacaagaccaucuccagauuucgacuucaauuaucuuguaccuccaacaguagaaucaaaaacaaaaccauuuacauuaccaauacuuacaauaggugaauuaucaaacucaagauuuccuguaccaauagaugaacuauacacaucuccaaacgaagguguaguaguacaaccacaaaauggaagaucaacuuuagauggcgaauuauuagguacaacucaauuaguaccaucuaauauuugugcccuaagaggcagaauaaacgcucaaguaccggaugaccaccaccaguggaacuuacaaguaacaaaugcuaacggaacaucauucgacccaacagaagauguaccagcacccuuagguacucccgauuuuuuagcaaacauauaugguguaacaucacaaagaaacccagauaauacauguagagcucacgauggaguuuuagcaaccuggucaccuaaauucacucccaaauuaggaucaguaguacuaggcacaugggaagaaucagacuuagaccuaaaucaaccaacaagauuuaccccaguaggacuauaugauacaggccauuucgaccaauggguucuuccuaauuacagcggcagacucacucucaauaugaauuuagcaccuucaguagcaccacuuuucccaggagaacaaauucuuuucuuucgaucccauauuccacuaaaaggaggaaccuccaauggagcaauagauugccuucuaccacaagaauggauacaacacuucuaucaggaaucagcaccuucaccaacugauguagcacucauuagauauacuaauccagacacaggaagaguacuuuuugaagcuaaauuacauagacaaggcuuuauuaccguagcaaauuccggaucaagaccaauaguugucccaccaaauggauauuuccgauuugauucauggguaaaucaauuuuauagcuuagcuccaaugggaacaggaaauggaagaagacgaguacaauaa

SEQ ID NO: 32913 - RNA, 1629 nt, Artificial Sequence
  derived and/or modified sequence opt6 from major_capsid_protein__Norovirus__AFC89656
augaaaauggcaucaaacgaugcugcaccauccaaugauggagccgcuucacugguacccgaagcaauaaaugaaacuaugccauuagaaccaguugcaggagcaucaauagcagcaccugucgcaggacaaacaaacauuauagacccauggaucagaacaaauuuuguacaagcuccaaacggagaauucacaguuucaccaagaaauuccccaggugaaauacuauuaaacuuagaauuaggaccagauuugaauccuuacuuagcacaccuaucaagaauguauaacggauaugcuggaggcguagaaguccagguauuacuugcagguaaugccuucaccgcagguaaaaucuuauucgcugcaaucccuccaaauuucccuguagauaugauuuccccagcacaaauaaccaugcuaccacacuuaauugucgauguacguacccuagaacccauaaugauaccacucccagauguaagaaauguuuuuuaucacuuuaauaaucaaccacaaccacguaugagacuaguagcaaugcucuacacaccacuucguuccaacggcucaggagaugauguuuucacaguaucuugcagaguauuaacaagaccaacaccagacuuugaauucauauauuuaguuccaccaaguguugaaucuaaaacaaaaccuuuuacacucccuauacucacaaucucagaauuaacaaauucaagauucccuauauccauagaacaauuauacacagcaccaaacgaaaauaauguuguacaaugccaaaauggaagaugcaccuuagauggagaacuacaaggaacaacccaacuuuuaucaucagcaguuugcucuuacagaggaagaaccguagccaauuccggcgauaacugggaccaaaauguauuacaauuaacauacccaucaggagcuucuuacgauccaacagacgaaguaccagcaccacuuggcacccaagauuucucugguauauuauauggcguuuuaacacaagacaauguacgagaaaauacaggagaagcaaagaaugcaaaaggaguuuacauaucuaccacaucuggaaaauucacaccaaaaauaggaucaauaggauuacauagcauaacagaagacguaagaccaaaccaacaaucaagauuuacaccuguuggaguagcacaaaacgaaaacacaccauuucaacaauggguacuuccccacuacgcaggugcauuagcauuaaauaccaaccuagcccccgcagucgccccaaccuuuccaggagaacaauuauuauuuuuuagaucaagaguaccauguguacaaggacuucaaggccaagacgcuuucauagauugccucuuaccucaagaauggguuaaccacuuuuaccaagaggcagcuccaucucaagccgacguugcuuuaauuagauauguaaauccagacacaggacgcacacuauucgaagcaaaauuacacagaagcggcuuuauaacuguaucacauacaggagccuauccacucguaguuccaccaaacggacacuucagauucgauucaugggucaaccaauuuuauucauuagcaccuauggguacgggaaacggaagaagaagaguacaauaa

SEQ ID NO: 32914 - RNA, 1617 nt, Artificial Sequence
  derived and/or modified sequence opt6 from major_capsid_protein__Norovirus__AFC89659
augaugauggcaucaaaagaugcaccaucaaauauggaugguacuucaggagcaggacaacuaguaccggaaguaaauacugcugaaccucuaccucuagaaccaguuguaggagcagcaacagcagcagcaacugccggacaaguaaacuuaauagaucccuggauuaugaauaauuuuguacaagcacccgaaggcgaauuuacuaucagcccaaauaauacuccaggggacauucuauuugaucuccgacuagguccucauuuaaacccauuccuauuacauuuaucccaaauguauaauggcuggguaggaaacaugagaauaagaguuaugcuagcagguaaugcauuuucagcaggcaaaauaauuauauguuguguaccaccuggauuugaaucucaaaacauaucgauaggucaagcuacaauguucccacauguaauagcagacguuagaguauuagaaccaauugaaauaccauuagacgacguaagaaauguauuauaccacacaaaugaaaacagaccaaccaugagacuacuauguauguuauauacuccauuaagagcuggcggagcaucuucaggaacagauccauucguaauagcagguagaguucuaacauguccagcaccagauuuuaauuucuuauuucuaguaccaccaaguguagaacaaaaaacaagacaauuaacaauacccaacauaccauuaaacaauuuagcaaauaguagaguccccgcaaugauuaauaaaauggcaguaagcgcagaccaaaaucaaguaguacaauuucaaaauggaagauguacauuagaaggccaauuauuaggaacaacaccaguuucagcuaaccaaguagcaaggauucgaggaaaaguuuuuucuacaaacucaggaacaggacuaaaucuaacagaaacagacggaaccccauaucacgcuuuugaauccccugcaccacuaggauuuccagauauaggagacugugauuggcauguauacgcuuuuaaaguuaaucaaaauacuggugauccaauguacagguuagauauaacacaagguaauucuuuugcaccccauuugggaucaauagaauuuacgagugaccaacaucccucuggcgaucaacuagguacacuuacauggauauccccuuuaaauaaugcaucuagaguagaucccuggaaaauaccuucauacgguucgacauuaacagaaucaacaaacuuagcaccaccuauauuuccaccaggauuuggagaggcaauagucuacuuuaugucagauuuuccaauuguauccggaaacacaacacaaauuccaugcacacuaccucaagaauuuauaucauccuuuguugaacaacaagcuccuauaagaggugaagcagcacuguuacauuauguugaucccgacacacauagaaacuugggagaauuuaaauuauacccagauggcuuuauaacauguguaccaaauacagguggcggaccacaaaaucucccuucaaauggagucuuuauauucucuaguuggguaucaagauacuaucaacuaaaaccuguaggcacagcugguccagcccgacgauuaggaguacguagaauauaa

SEQ ID NO: 32915 - RNA, 1647 nt, Artificial Sequence
  derived and/or modified sequence opt6 from major_capsid_protein__Norovirus__AFC89662
augaaaauggcaaguaacgacgcaacaccuuccaacgacggagcugccggauuaguaccagaaauuaacaacgaagcaauggccuuagauccaguagcaggagcagcaauagcggcaccauuaacaggacaacaaaauauaauugaccccuggauaaugaauaauuuuguacaagcaccuggaggagaauuuaccguaucaccaagaaauucaccaggcgaaguauuacuaaaucuagaauuagguccagaaaucaauccauaucuagcacaccuagcaagaauguauaacggauacgcaggaggauuugaaguacaaguagucuuagccgguaacgcuuuuacagcaggaaaaauaauauuugcugccaucccaccaaacuuucccacagacaauuuauccgcagcacaaaucacuaugugcccacacgucauaguagauguacgacaauuagaaccaguaaauuuaccaaugccagaugucagaaacaauuuuuuucacuauaaccaaggaucagacaguagauuacguuugauagcuaugcuauauacaccauuacgcgccaauaacuccggcgacgauguauuuacaguaucuugucguguuuuaacacgaccaagcccagacuuuucauuuaauuuucuaguuccuccaacaguagaaucaaaaacaaaaccuuucacacuacccauacucacaauaucagaaauguccaacucacgauuuccaguaccaauagacucacuucacacaucaccuacugaaaacauaguaguccaaugucaaaauggacgaguaacauuagauggugaauuaaugggaacaacucaauuauuaccaucacaaauaugcgcuuuccgaggaguauuaacaagaaguacuaguagagcaucagaccaggccgauacagcaacaccacgauuauucaacuauuacuggcacauacaacuagauaaccuaaacggaacuccauacgauccagcagaagacauaccaggaccuuuaggaacacccgacuuccgaggaaaaauauucggagucgcaucucaacgcaauccagauuccacaacaagagcucacgaagcaaaagucgauacuacugcuggacgauuuacaccuaaacuaggaucacucgaaauaucuacagaaucaggagauuuugaccaaaaccaaccaaccagauucacuccaguagguauagguguagacaaugaagcagauuuucaacaauggucuuuaccugauuauaguggucaauucacccacaacaugaaccuagccccagcuguagcccccaauuuuccaggagaacaacuauuauucuuucgaucacaacuaccaucauccggcggaagaucaaauggcauacuagacuguuuaguuccacaagaauggguacaacacuucuaucaagaaagugcuccagcacaaacccaaguagcacuaguaagauacguaaauccagauacugguagaguauuauucgaagccaaacuacauaaacuaggcuuuaugacaaucgcaaaaaauggagauucaccaauuacaguaccaccaaacggguauuucagauuugaaucauggguaaauccauuuuacacucuagcaccaaugggcacuggcaauggaagaagaagaauacaguaa

SEQ ID NO: 32916 - RNA, 1620 nt, Artificial Sequence
  derived and/or modified sequence opt6 from major_capsid_protein__Norovirus__AFC89665
augaaaauggcaucaaaugaugcagcaccaaguaacgacggagccaccgguuuaguaccagaaauaaacacggaaacucuaccacuagaaccuguugcaggagcagcaauagcagcaccaguaacaggacaaaacaacauuauagacccauggauaagaaauaacuuuguacaagcaccaaauggagaauucaccguauccccucguaacucacccggugaaauuuuaaugaaccuagaauuaggaccagaccuaaacccuuacuuagcacaucuaucacguauguacaacggauacgcaggcgguguagaaguacaaguauuauuagcaggcaacgcuuucacagcaggaaaaauacuuuucgcagcagugccaccaaacuucccagucgacaugcuaucaccagcacaaauaacaauguuaccucaccuaaucguugacguaagaacacuagaaccaauaaugauaccacucccagacguacgaaacguauucuaccacuucaacaaucaaccugccccaagaaugagacuaguagcaauguuauacacucccuuacgaucaaacggaucuggagaugacguauucacuguaucaugcagaguccuaacuagaccaacaccagauuuugaauuuacauaucucguaccaccuucaguagaaucaaaaacaaaacccuuuacguuaccaauauuaacuaucggagaacuaacaaacucaagauuucccgcacccauugaucaacuuuauacgucaccaaaugcugacguaguuguucagccacaaaacggacgcugcacccuagacggcgaauuacaaggaacaacacaacuacuuacaacagcaauauguucuuauagaggcaugacaucaaauccaacaucagauuacugggacgaucacuuauuacacuuaguacacccaaacggagcaacuuaugauccaacagaagauguaccggcaccauuuggaacacaagacuucagaggaauacuauacggaauguuaacacagaaccccagaacauccggagacgaggcggcaaacucucacggaauauacauaucaaguacaucagaaaaauucaccccaaaacuagguacuaucggccuacaucaaguacaaggggauauagcuucaaaccaacaaucuaaauucacaccaguaggcauagcugucaacggaaauacaccauuuagacaaugggaacuaccaaacuacucaggagcacucacauuaaacacaaacuuagcacccgcuguaggaccuaauuucccaggagaacaaauauuauucuuccgcucaaauguaccuucaguacaaggaggucaacccauagaaauagauugucuuauaccucaagaauggguaucacacuucuaucaagaaucagcaccaucucaaucagauguagccuuaguaagauacguaaauccagacacaggacgcacaaucuuugaagcaaaacuacacagacaagguuucaucacaauagcugcaacaggauccaauccagucguagugccaccaaauggauacuuucgcuuugacucauggguaaaccaauucuacgcacuagcucccaugggaacaggaaacggacgaagaagaguacaauaa

SEQ ID NO: 32917 - RNA, 1623 nt, Artificial Sequence
  derived and/or modified sequence opt6 from major_capsid_protein__Norovirus__AFC89667
augaaaauggcaucaaaugacgcaaaucccucagauggcucugcagcuaaccuaguuccagaaguaaacaaugaaguaauggccuuagaaccaguaguaggagcagcaauagccgcaccuguugcuggacaacaaaacguaauugauccauggauaagaaacaacuuuguacaagcuccaggaggagaauuuacaguaucaccaagaaacgcaccuggagaaauucuuuggucagcaccauuagguccagacuuaaauccauaucuuucacacuuagcuagaauguacaauggauaugcuggaggauucgaaguacaaguaauacuugcaggaaacgccuuuaccgcuggaaaaauaauauuugcagcuguaccuccuaauuucccaacugaaggccuaucaccuucucaaguaacaauguucccccauauaauaguagacguaaggcaauuagaaccaguauuaauaccauuacccgaugucagaaacaacuucuaucacuauaaucaaucuaacgauuccaccaucaaauuaaucgcaauguuauauacuccacuaagagcaaauaaugccggagaagauguauucacaguuucaugcagaguauuaaccagaccaucucccgauuucgacuuuauuuuucucguaccaccuacaguggaaucaagaacuaaaccauuuacugucccuauacuaacaguagaagaaaugaccaauucaagauuccccauaccauuagaaaaauuauuuacaggacccucuggugcuuuugucguacaaccccaaaauggacguuguacuaccgauggaguacuacucggcacaacacaauuaucaccagucaacauaugcacuuucagaggagacguuacacauauagccggaucccgcaacuauacuaugaauuuagcuucacuaaauuggaacaacuacgaccccacugaagaaaucccugccccucuagguacacccgacuucguagguaaaauacaaggaguauuaacccaaacaacaaaaggcgacggcucuacuagaggacauaaagcaacgguauacacaggcucugccccauuuacuccaaaacuaggaucaguacaauucuccacagauaccgaaaaugauuucgaaacccaccaaaauacaaaauuuacuccugucgguguuauacaagacgguucuacaacacacagaaacgaaccucaacaauggguacuaccaucauauucaggucgcaauguacauaacguucauuuagcaccagcaguagcaccaacuuucccaggagagcaauuauuauucuucagaucuaccaugccaggaugcucaggauacccaaauauggaucuagauugucuacuaccccaagaauggguacaacauuuuuaucaagaagcugcacccgcccaaucagaugucgcacuuuuaagguucguaaacccugauacaggccgaguccuauuugaaugcaaacuacauaaaucaggauauguaaccguagcacacacaggucaacacgacuuaguuauaccaccaaacggauauuucagauuugauucuuggguaaaucaauuuuacacucuagcaccaaugggaaauggaacaggccgcagaagagcacuauaa

SEQ ID NO: 32918 - RNA, 1626 nt, Artificial Sequence
  derived and/or modified sequence opt6 from major_capsid_protein__Norovirus__AFD62272
augcguauguccgacggugcugcaccaaaagcaaauggcucagaagcaaguggucaagaccuaguuccaacagcaguugaacaagcaguuccaauacaaccaguagcaggagcugcauuagcagccccagcagcuggccaaauaaaucaaauugacccuuggauauuucaaaacuuuguccaaugcccuuuaggagaauucucaauaucaccccgaaauacaccaggcgaaauucuuuuugacuuagcacuaggaccaggauuaaacccauaucuggcacauuuauccgcaauguauacaggauggguaggaaauauggaagugcaacuaguuuuagcagguaaugcuuucacagcuggaaaaguuguaguagcccuaguacccccuuauuucccaaaaggaucacuaacaacagcacaaauaacauguuuuccacauguuaugugugauguacguacauuagaaccaauacaauuaccauuauuagacguuagacgaguuuuauggcaugccacccaagaucaagaagaaucuaugagacuuguaugcauguuauauacaccccuaagaacuaauucuccaggagaugaaucauuuguuguaucuggucgauuacucucuaaaccugccgcagacuucaauuuuguauacuuaacuccaccuauagaaagaacuauuuaccgaaugguugacuuacccgucuuacaaccuagauuaugcacacaugcaagauggcccgcaccaguauauggacuacuagucgacccaucauuaccaucaaauccacaauggcaaaacggacguguacauguagauggaacauuauuaggaacaacuccuguaucuggaucauggguaaguugcuuugcagcagaagcugccuacgaauuucaaucuggaaccggacaaguagcaacauuuacaaugauagaacaagauggaucagcuuauguuccuggugauagagcagcaccacuaggauauccugauuauuccggacaauuagaaauagaaguucaaacagaaacuacuaaagcaggagacaaacucaaaguaacaacauucgaaaugauuuuaggaccuacaacaaauguagaucaagcaccauaucaaggacgagcuuacgcaucacuaacagcagcagcaagcuuagauuuaguagacgguagagucagagccguuccaagaucaauauauucauuccaagacguauuaccagaauauaaugauggucuuuuaguacccuuagcaccaccacuaggacccuuccuaccuggcgaaguacucuuacgauuucgaacauacaugcgacaauuagacacagccgacgccgccgcacaaccuauagauugugccuuaccucaagaauuuguuuccugguuugcaucaaacucauucacuguccaaucggacgcacuccuagugagauauagaaauacucuaacaggacaauuauuauucgaagcuaaauuauauuccgaaggcuacauugcaguaucauauaguggcucaggaccauuaacauucccagcagauggauuuuuugaaguuguaucuuggguaccaagauuauuucaauuagcaucuguagguucacuagcaacaggucgaacauuaaaacaauaa

SEQ ID NO: 32919 - RNA, 1620 nt, Artificial Sequence
  derived and/or modified sequence opt6 from major_capsid_protein__Norovirus__AFJ04707
augaaaauggcuucaaaugacgcauccccuagugauggaucaacagcaaaucuaguaccagaaguaaacaaugaagucauggcauuagaaccuguaguaggugccgccauagcugcuccaguagcaggccaacaaaauguaaucgacccauggauaagaaacaauuucguccaagcaccuggaggagaauucacuguuucaccaagaaaugcaccaggcgaaauacuauggagcgcaccauuaggcccagaccuaaaucccuaucuaucacaccuagccagaauguacaauggcuacgcaggaggcuuugaaguacaaguaauauuagcuggaaaugcauucacagcaggaaaaauaauauucgcagcaguuccaccuaauuucccaacagaaggauuaucacccucucaaguaacaauguucccacacauaauaguagacguuagacaauuagaaccuguacugauaccauuacccgauguacgaaauaauuucuaccauuacaaccaaucaaaugacucaacaauaaaauuaauagcuaugcucuacaccccacucagagcaaacaaugccggagacgacguauuuacaguaagcugucgaguucuaacuagaccuucaccugauuucgacuuuauauucuuaguuccaccaacaguagaaagucgaacaaaaccauucacuguccccauauuaacaguagaagaaaugucaaacucaagauuuccaauaccauuagaaaaauuauauacaggaccaucaucagcauucguaguacaaccacaaaauggaagauguacuacagacgguguacuauuagguacaacacaacuaucugcaguaaauauauguacauuuagaggagacauaacacacauagcaggaagucaugauuacacaaugaaucucgcaucacaaaauuggucaaauuacgauccaacagaagaaauaccagcaccauuaggaacacccgacuuuguaggcaaaauacaaggaaugcuaacacaaacuacaagagaagauggcucaacacgagcacacaaagcaacuguaucaacagguucaguacacuuuacgccaaaauuaggcucuguucaauauacuacagacacaaacaacgauuuccaaacaggccaaaauacaaaguucacaccaguagguguaauacaagacgguggaaaucaucaaaacgaaccacaacaauggguacuaccaaauuauuccggacgaacaggucauaacguccaccuugcucccgcaguugcaccaacuuuuccuggcgaacaacuacuauucuuccgcagcacuaugcccggauguucagguuacccaaacaugaaccuagacugccuccuuccacaagaauggguacaacauuucuaccaagaagcagcaccugcucaaucagauguagcacuauuaagauucguaaauccagauacaggaagaguucuauuugaauguaaauuacauaaauccgguuacguaacaguagcacacacagguccacaugacuuaguaauacccccuaaugguuacuucagauuugacucuuggguaaaucaauuuuacacuuuagcaccaaugggaaauggagcagguagaagaagagcacucuaa

SEQ ID NO: 32920 - RNA, 1623 nt, Artificial Sequence
  derived and/or modified sequence opt6 from major_capsid_protein__Norovirus__AFJ04708
augaaaauggcaucaaacgacgcaaauccaucagacggaucgacugcuaauuuaguuccagaaguaaauaaugaaguaauggcauuagaaccaguuguaggagcagcaauagcagcuccaguagcaggacaacaaaacgucauugaccccuggauaagaaauaauuuuguucaagcuccaggcggagaguucaccguaagcccaagaaaugcuccuggagaaaucuuauggucagcuccacuaggacccgaucucaauccauacuuaucacaucuugcuagaauguauaauggauacgcaggaggauuugaaguacaaguaauauuagcuggaaaugcauuuaccgcaggaaaaauaauuuucgcagcagucccgccuaauuuuccaacagaaggauuaucuccuucacaaguaacuauguucccacacauaaucgucgacguacgucaauuagaacccguacuuauaccacuaccagauguaagaaauaauuucuaucacuacaaccaaucaaacgauccaacaauaaaauuaauagcaauguuauacacaccauugcgugcuaauaaugcuggagaagauguauucaccgucucaugcagaguccucacaagaccaucucccgauuuugauuuuauuuuuuuaguaccaccaacaguugaaucuagaacaaaaccauuuacuguaccaauacuaacaguagaagaaaugacuaacucccgauuuccaauaccacuagaaaaacuauuuacuggaccuucuggagcauucguuguacaaccacaaaauggacgauguaccaccgacggaguauuauuaggaacaacacaacuaucccccguaaauauaugcacauuuagaggagacguaacacacauagcuggaacacauaacuauacuaugaauuuagcaucacaaaauuggaacaauuaugauccaacagaagaaauaccagcacccuuaggaacaccagauuucguaggaagaauucaaggaaugcuaacacaaacaacacgaggagauggaucaacacgaggucacaaagcaacaguaucaacaggagacgugcauuucacaccaaaacuaggaucaauacaauucaauaccgacacuaacaacgacuucgaaacuggacaaaauacaaaauucacaccaguaggaguaguacaagacggcaacggagcacaucaaaaugaaccacaacaauggguacuuccuagcuauucaggaagaacaggucauaauguacacuuagcaccagcaguugcuccuaccuuuccaggagaacaacucuuauuuuucagaucaacaaugccaggauguucgggguauccaaacaugaauuuagauuguuuacugccacaagaauggguacaacacuucuaucaagaagccgcgcccgcacaaucagacguagcauuacuaagauucguaaauccagauacagguagaguuuuauucgaaugcaaacuacacaaauccgguuacgucaccguagcacacacaggacaacaugaucuaguaauuccacccaauggauauuucagauuugacucaugggucaaucaauuuuacacauuagcaccuaugggcaaugguacaggcagaaggagagcacuuuaa

SEQ ID NO: 32921 - RNA, 1623 nt, Artificial Sequence
  derived and/or modified sequence opt6 from major_capsid_protein__Norovirus__AFJ04709
augaaaauggcuucaaaugacgcaaaccccucagacggcagugcggcaaaccuaguaccugaaguuaauaaugaaguaauggcucuugaacccguagucggugcagcaaucgcagcuccuguagcaggucaacaaaauguaaucgacccauggauacgaaauaacuuuguacaagcaccaggcggagaauuuacaguaagcccuagaaaugcuccuggagaaauauuauggucagcuccacuagguccagaucuaaauccuuacuuaucacaucuagccagaauguacaacgguuacgcaggaggauucgaaguacaaguaauauuagcaggaaaugcauuuacagcaggaaaaauaauauuugccgcugucccacccaacuuuccaacagaaggacucucacccagucaaguaacuauguuuccccacauuauaguagacguccgacaacuagaaccaguacuaauuccacuacccgauguaagaaacaauuucuaucauuauaaccaaaguaaugacuccacaauaaaauuaaucgcuauguuauacacaccacuuagagcuaacaacgcaggagaagauguauuuaccguuaguugcagaguucuaacacgaccaucaccagauuuugauuuuauauucuuaguacccccaacaguagaaucaagaacaaaaccauuuacuguaccaauacuaacagucgaagaaaugacaaacagccgauucccaauaccucuagaaaaauuauuuaccggacccuccggagcauuuguaguucaaccccaaaacggaagguguacaacagauggaguuuuacuuggaacaacacaauuaucuccaguaaacauauguacauuucgaggugacguaacucauauagcaggaucucgaaauuacacuaugaaccucgcaagucucaauuggaacaauuacgauccaacagaagaaauaccagcuccacucggaacucccgacuuuguaggaaaaauacaaggugucuuaacacaaacaacaaaaggggauggaucaacucguggacacaaagcaacuguauauacaggcagugcuccauucacuccaaaacuaggaucaguacaauucuccaccgauacagaaaacgacuucgaaacacaccaaaacaccaaauuuacaccaguagguguaauacaagauggaucaacuacacauagaaacgaaccccaacaauggguacuaccuucuuauucaggccguaauguucauaauguacaccuugcaccagcaguagccccaacauuuccaggugaacaacuacuauucuucagaucaacaaugccaggaugcucaggcuauccuaauauggaccuagauugucucuuaccucaagaauggguucaacacuuuuaucaagaagccgcaccagcacaaucugauguagcauuacuaagauucguuaacccugacacaggaagaguacuauucgaaugcaaauuacauaaaucaggcuauguaacuguagcacacacaggccaacacgaccuaguaauaccaccuaauggauauuucagauuugacagcuggguaaaucaauuuuauacccuagcccccaugggaaacgguacaggaggacgaagagcacuuuaa

SEQ ID NO: 32922 - RNA, 1623 nt, Artificial Sequence
  derived and/or modified sequence opt6 from major_capsid_protein__Norovirus__AFP89593
augaaaauggcuucaaaugaugcaaaccccucagacggaucuaccgcuaaucuaguuccagaaguuaauaaugaaguaauggcauuagaaccaguaguaggagcagcuauagcagcaccaguagcaggacaacaaaacguaauagacccauggauaagaaauaauuucguccaagcaccaggaggagaauuuacaguuagcccaagaaaugcuccuggagagaucuuauggagcgcaccuuuaggccccgauuuaaauccauaucucucucacuuagccagaauguauaacucauacgcaggagguuucgaaguacaaguaauacuugcagguaaugccuuuacagcaggaaaaauaauauucgccgccgucccaccaaacuuucccacagaaggacuaucaccaucucaaguaacuauguucccccacauaauaguugacguaagacaauuagaaccaguuuuaauaccacuaccagacguaagaaacaacuucuaucauuauaaccaauccaaugauccuacaauuaaacuaauugcaaugcuuuauacaccccuaagagcaaauaacgcaggagaagauguauucacaguaucaugucgaguucuaacucgaccaucaccagacuuugacuucauauuccucgucccaccuaccguagaaucacgaacaaaaccauuuacagucccaauacuaacuguagaagaaaugacuaacucaagauuccccauacccuuagaaaaacucuuuacaggaccaucuggagcuuuuguaguacaaccccaaaacggaagauguacaacagacggaguauuacuaggaacaacucaauuaucuccuguaaacauaugcacauuucguggagaugucacacauauagcagguacacacaacuacacaaugaaucuugcuucacaaaacuggaacaacuacgaucccacagaagaaauaccagcaccacuaggaacaccugauuuuguaggaagaauacaaggaaugcuuacucaaaccacaagaggcgacggaucaacucgaggccacaaagcuacaguaucuacaggagauguacauuuuaccccuaaacuaggaucuauacaauuuaauacagacacaaacaaugauuucgaaacaggucaaaauaccaaauucacaccaguuggaguaauacaagaugguaauggaacacaccaaaacgaaccacaacaauggguccuacccucuuauucaggaagaacaggacauaacguucaccuagccccugcaguugccccuacuuuuccaggugaacaauuauuauucuuucgaucuacaaugccagguugcucugguuauccaaacaugaauuuagauugcuuauuaccacaagaauggguacaacacuucuaucaagaagcagcuccagcacaaucagacguugcacuauuacgauucguaaacccugauacuggaagaguauuauucgaauguaaacuccacaaaucaggauacgucacuguagcucacacuggacaacacgauuuaguaauaccuccaaauggauauuucagauucgauucuugggucaaucaauuuuacacauuagcccccaugggaaacggaaccggcagacgaagaguacuauaa

SEQ ID NO: 32923 - RNA, 1623 nt, Artificial Sequence
  derived and/or modified sequence opt6 from major_capsid_protein__Norovirus__AFU55686
augaaaauggcaucaaacgaugcaaauccuucagacggcucaacagccaacuuaguaccagaagugaauaaugaaguaauggcacuagaaccuguaguaggagcagcuaucgcugccccagucgcgggacaacagaaugucauagauccuuggauccgaaacaauuuuguacaagcacccggaggugaauuuaccguuucaccaagaaacgcaccuggugaaaucuuauggucagcaccacuugguccagaucuaaauccauaccuaucccauuuagcacgaauguauaacgguuacgcaggaggauucgaaguacaaguaauauuagcuggaaacgcauuuacagcaggaaaaauaauauuugcagcaguccccccaaacuuuccaacagaaggacuaucaccaucgcaaguuacaauguuuccacauauaauaguagacgucagacaacuagaacccguacucauaccauuaccugacguccgaaauaauuucuaucauuacaaucaauccaaugacccaaccauuaaauuaaucgcuaugcuauacacaccucuaagagcuaauaaugcuggagaagacguauuuacaguuagcuguagaguccuaacaagaccauccccagauuuugacuucaucuuuuuaguuccaccuaccguagaaagucgaacuaaaccuuuuacaguaccaauucuaacaguagaagaaaugacuaauucacgauucccaauaccuuuagaaaaacuauuuacaggucccagcggagcauuuguuguccaaccacaaaacgguagaugcaccacagaugguguauuauuagguaccacacaacucucaccaguaaauauauguacauuucgaggcgacguaacacauauagcaggcacucauaauuacacaaugaauuuagcaucacaaaacuggaacaacuaugacccaacagaagaaauaccugcuccacuagguaccccagacuucguuggaagaauacaaggaaugcuuacacaaacaacaagaggagacggaucaaccagaggacacaaagcaacaguaucaacaggagauguacauuuuacaccaaaauuagguucaauccaauuuaauacugauacaaauaaugauuuugaagcaggacaaaauacaaaauucacaccagacggcguaguacaagacggaaauggaacccaucaaaacgaaccacaacaauggguccuaccauccuacucugguagaaccggacauaacguacacuuagcaccagcuauagcacccacauuuccaggugaacaacuacuuuucuucagaucaacaaugccaggauguucagguuacccaaauaugaacuuagacugcuuacuaccucaagaauggguucaacauuucuaccaagaagcagcacccgcacaaucagauguugcauuacuaagauucguaaacccggacacaggaagaguucuauuugaauguaaauuacauaaaucaggcuauguaacaguagcacacacaggccaacaugauuuaguaauaccaccaaauggauauuuccgcuuugauuccugggucaaucaauucuauacauuagcuccaaugggcaauggaacuggacgacgaagagccuuauaa

SEQ ID NO: 32924 - RNA, 1623 nt, Artificial Sequence
  derived and/or modified sequence opt6 from major_capsid_protein__Norovirus__AFU55689
augaaaauggcaaguaacgaugcuacaccaucagacggaucuacagcaaacuuaguaccagaaguuaauaaugaaguuauggcauuagaaccaguuguuggagccgccauagccgcccccgucgccggacaacaaaacguaauagauccguggauuagaaauaacuuuguacaagcaccaggaggagaauuuacaguaucaccacgcaaugcaccaggagaaauauuaugguccgcuccucuaggcccagacuuaaauccguaucucagucaucuagcacgaauguacaacggauaugcaggcggauucgaaguccaaguaaucuuagcaggaaacgcauuuacagccggcaaaauaauuuuugcagcaguaccaccaaauuucccaaccgaaggucuaucaccaucucaagucacuauguuuccucauauaauaguagacguaagacaauuagaaccagucuuaauaccacuuccugauguaagaaacaacuucuaucauuauaaccaaucaaaugauccaaccauaaaacuuauagcaauguuauacacaccauuaagagcuaauaaugcaggagacgaugucuuuaccguaucaugccgcguuuuaaccagacccuccccagauuuugauuuuauauuccucguacccccaacagucgaaucuagaaccaaaccauucucuguaccaauauuaacaguagaagaaaugacaaauucacgauucccaauaccucuagaaaaacucuucacaggaccauccuccgcauucguaguacaaccacaaaacggcagauguacaacagauggaguccuacuaggaacaacacaacuuuccccuguaaacauuuguacauucagaggagacguaacccacauagcaggaacccaaaacuauacaaugaaccuagcuagucaaaacuggaacaacuaugacccaaccgaagaaauaccagcaccacuuggugcaccagauuuuguagguaaaauacaaggcguauuaacacaaacuacuagaggagaugguucuacuagaggucacaaagcuaccgugucaacagguucaguccauuuuacaccaaaacuaggaaguguacaauuuucaaccgauacuucaaaugauuuagaaacaggacaaaauacacgauucaccccaguaggaguaguacaagacgguucaacaacacaucaaaaugaaccccaacaauggguucuaccaaauuauucaggacgagauucacauaauguucaccuagccccagcagucgcaccaacguuucccggagaacaacuacuuuucuuucgaucaacaaugcccggaugcucuggauacccuaacaugaacuuagacugccuauuaccacaagaauggguccaacacuucuaucaagaauccgcaccagcacaaucagauguagcauuauuaagauucgucaauccugauaccggacgcguacuauucgaaugcaaauuacauaaauccggauauguaacaguagcacauaccggacaacacgaucuagucaucccaccuaauggauauuuucgauuugauucguggguaaaucaauuuuauacacuagcaccaaugggaaauggagcaggacgacgaagggcacuauaa

SEQ ID NO: 32925 - RNA, 1623 nt, Artificial Sequence
  derived and/or modified sequence opt6 from major_capsid_protein__Norovirus__AFU55692
augaaaauggccucaaaugacgcaacaccuucagauggaucgacagcuaauuuagucccugaagucaauaaugaaguaauggcacuugaaccaguaguuggagccgcaauagcagcaccaguagcaggccaacaaaauguuauugacccuuggauaagaaauaauuuuguacaagccccaggaggagaauuuacaguaagcccacgcaaugcaccaggcgaaauauuauggucagcaccauuaggcccagacuuaaaucccuauuuaucucaccuagcgagaauguacaauggauaugcaggaggauucgaaguucaaguuauacuagccggaaacgcauuuacugcuggcaaaauuauauucgcagcagucccuccaaacuucccaacagaaggacuaucuccaagccaaguaacaauguuuccacauauuauaguagaugucagacaauuagaacccguacuaauuccauugccagauguaagaaacaauuuuuaccacuauaaccaaucaaaugacccuacaauaaaacuuauugcaaugcuauauacaccacuacgcgcaaacaacgcaggcgacgauguguuuacuguaucauguagaguucuaacacgaccaagcccugauuuugacuuuauauuucuaguaccaccaaccguagaaucacgcacuaaaccauucuccguaccaaucuuaacaguagaagaaaugacaaacucaagauuuccaauuccacuagaaaaauuauucacaggaccaucaucagcauucguaguacaaccacaaaacggaagauguacaaccgauggaguccuucuaggaacaacacaacuaaguccaguaaauauauguacauucagaggagacguuacacauauagcaggaacacaaaacuacacaaugaacuuagcaucucaaaauuggaacaauuacgauccaacagaagaaauaccagccccacucggaacacccgacuuuguugguaaaauacaaggcguacuuacacaaacaaccagacgugacggaucaacaagaggacauaaagcaacaguaagcacagguucaguacauuucacaccaaaacuaggaucaguccaauucucuacggacacaucuaaugauuuugaaaccggacaaaauacaagauuuacaccaguaggaguaguccaagacggaucaacaacacaucaaaacgaaccacaacaauggguucuaccagacuacucaggacgagauucacauaacguacaccuagcccccgcagucgcuccuaccuuuccaggagaacaacuacuauuuuuuagaagcacaaugccaggaugcucuggauauccaaauaugaauuuagauugccuucucccacaagaauggguucaacauuuuuaccaagaaucagcuccagcacaaucagacguagcgcuauuaagauucguaaauccugauacaggacgaguacuauucgaauguaaauuacacaaaccagguuauguaaccguagcccacacaggacaacaugaucuaguaaucccaccuaauggcuauuuuagauucgauucauggguaaaucaauucuacacuuuagcaccaaugggaaacggagcaggaagacguagagcacuuuaa

SEQ ID NO: 32926 - RNA, 1623 nt, Artificial Sequence
  derived and/or modified sequence opt6 from major_capsid_protein__Norovirus__AFU55695
augaaaauggcaucaaaugacgcaaauccaucugauggaucagcugcaaaccuaguccccgaaguaaacaaugaaguuauggcccuagaaccagucgucggugcagcaauagccgcaccaguagcaggacaacaaaauguuauugacccauggaucagaaauaauuuuguacaagcuccaggaggagaauucacaguaucaccuagaaaugccccuggagaaauacuauggucagcaccauuaggcccagaucuaaauccauauuuaucacacuuagccagaauguauaacggauacgcuggcgguuuugaaguucaaguaauucuugcagguaaugcauucacagccggaaaaauaauuuucgcugcaguucccccaaauuuucccacagaaggacuaucaccuucacaaguaacaauguucccucauauaauaguugacguacgccaacuagaaccagucuuaauaccauuaccagauguaagaaacaauuucuaucacuacaaucaaucuaaugacucaaccauaaaacuaauagcaaugcuauauacaccacuaagagcaaacaacgcuggagaagauguauucaccgugucaugucgaguacuaacaagaccuuccccagacuucgauuucauauuccuaguaccucccacaguagaaagucgaacuaaacccuuuacaguaccuauuuuaacaguagaagaaaugacuaacucacgauuucccauuccacuagaaaaacuuuuuaccgguccaucaucagcuuuuguagugcaaccacaaaacgguagauguacaacagauggaguacuacuaggaacuacacaauuaucaccaguaaacauauguacauuuagaggagaugucacacauauagcaggaucuagaaauuacaccaugaauuuagcaucguuaaacuggaacaacuacgauccaacugaagaaauaccagcacccuuaggcacaccagacuuugucgguaaaauacaaggugucuuaacacaaacaacuaaaggugacggcucaacaagaggacacaaagcaacaguuuauacugguucagcaccauuuacaccaaaacuaggaucaguucaauucucaacagauaccgaaaaugauuuugaaacucaccaaaauaccaaauucacucccguuggaguaauacaagauggcucaacuacacaucggaacgaaccacaacaauggguauuaccaucauacucugguagaaauguacauaauguacacuuagccccugcaguagcaccaacuuucccaggugaacaauuauuauucuuccgaucaacuaugccaggauguucaggauauccaaauauggaccuagacugccuauuaccacaagaauggguacaacauuuuuaucaagaagcagcaccagcccaauccgacguugcacuauuaagauucguuaaucccgauacuggaagaguccuauucgaaugcaaauuacauaaauccggauauguuacugucgcacauacuggacaacacgauuuaguaauaccacccaauggauacuuuagauucgacucauggguaaaucaauuuuacacauuagcaccaaugggaaaugguacaggaagaagacgugcauuauaa

SEQ ID NO: 32927 - RNA, 1623 nt, Artificial Sequence
  derived and/or modified sequence opt6 from major_capsid_protein__Norovirus__AFU55698
augaaaauggcaucuucugacgcaaauccaucagauggaucaacugcaaaucuaguuccagaaguaaauaacgaaguuauggcacucgaaccaguuguaggagcagccauugcagcaccaguugcuggccaacaaaauguaauagauccauggauacgaaauaauuuuguccaagcaccaggcggagaauuuacuguauccccacgaaaugccccaggagaaaucuuauggagcgcuccacucggaccagauuuaaaucccuaucuuucacaccuagcaagaauguauaacucuuaugcaggaggcuuugaaguucaaguaauacuagcagguaacgcauuuacagccggaaaaauaauauuugcugcuguuccaccuaacuucccuacagaaggucucucaccaucucaaguaaccauguuuccccacauaauagucgacguuagacaauuagaaccaguacucauaccacuaccagacguaagaaauaauuuuuaucauuauaaccaaucuaacgacccaaccauaaaacuaauagcaaugcuauauacaccccuaggugcaaauaacgccggggacgauguauucacaguaucuugucgcguacuuacucgaccaucaccagauuuugauuucauauuuuuaguaccaccaaccguagaauccagaacaaaacccuuuucaguaccaauacuuacuguagaagaaaugacaaacucacgauucccaauaccacuugaaaaauuauucacaggaccaaguucagcauucguuguacaaccacaaaaugguagauguacaacagauggaguacuucucggaacaacacaauuauccccaguaaauauuuguaccuuccgaggagaugucacacacauagcuggaacacaagaauacacuaugaauuuagcaucacaaaauuggaauaauuacgacccaacagaagaaauaccagcaccguuagguacuccugacuucguaggaaaaauacaagguguccuuacacaaacaacaagaagagacggaucuacacgaggucauaaagcaacagucucaacaggaucaguucauuuuacacccaaauuaggaagaauacaauuuucaacagauacauccaaugauuuugaaacaggucaaaacaccagauuuaccccaguagguguaguccaagacggauccacaacccaucaaaaugaaccccaacaauggguacuucccaauuauucaggacgagauucacauaacguacaucucgcaccagcaguagcaccaagcuuuccaggagaacaacuacuauuuuuuagaucaacuaugccugguugcucaggauauccaaauaugaaccuugacugccuucucccacaagaauggguucaacauuuuuaucaagaagccgcaccagcacaaucagauguugcauuacucagauucgucaauccagauacaggcagaguacucuucgaaugcaaauuacauaaaucaggauacguuacuguagcacauacaggucaacacgaucuuguaauaccaccaaacggauauuucagguuugacucauggguaaaucaauucuauacacuagcaccuaugggaaacggaacuggacgaagaagagcauuauaa

SEQ ID NO: 32928 - RNA, 1623 nt, Artificial Sequence
  derived and/or modified sequence opt6 from major_capsid_protein__Norovirus__AFU55701
augaaaauggcaucaucugaugcaaacccaucagauggcucaaccgcaaacuuaguaccagaaguuaauaaugaaguaauggcauuagaacccguaguaggugccgcaauagcagcaccaguagcaggacaacaaaauguaauagacccuuggauuagaaauaauuuuguacaagcaccaggaggagaauuuaccguaucaccacgaaaugcaccuggcgaaauauuaugguccgcccccuuaggaccagaucuaaauccauacuuaucccaccucgcaagaauguauaauucauacgcuggagguuuugaaguacaaguaauacucgcaggaaaugccuuuacugcaggaaaaauuauuuucgcugcaguuccaccaaacuucccaacagaaggacucucucccucacaaguaacaauguucccccacauaauaguagacguaagacaacuagaaccaguacucaucccauuaccagauguaagaaacaauuucuaucauuacaaucaguccaaugacccuacaauuaaguuaauagcaaugcuauacacuccacuaagagcuaacaacgcaggagaugauguauuuacaguauccuguagaguacucaccagacccucaccagacuuugauuuuaucuuccuuguuccacccacaguugaaucaagaacaaaaccauuuucaguacccaucuuaaccguagaagaaaugacaaauucucguuucccaauaccacuagaaaaacucuucacuggaccauccucagcuuuuguaguacaaccacaaaauggaagauguacuacagauggaguccuccuuggaacaacucaauuauccccaguaaauauaugcacauuucguggagacguaacacauaucgccggaacacaagaauacacaaugaaucuagcaucacagaauuggaacaauuaugauccaacagaagaaauaccugcaccucuagguacuccagacuuuguaggaaaaauacaaggcgucuuaacacaaacaacacgaagagacggaucaacaagaggacacaaagcaacaguaucaacaggaagcguucauuuuacaccaaaacuaggacgaauacaauuuucaacugacacaucuaacgauuucgaaacaggacaaaauacuagauucacaccaguuggaguaguacaagauggcuccacaacacaccaaaaugaaccccaacaauggguauuaccaaacuacagcggaagagacucacauaacguucacuuagcaccagcaguagcaccaucuuuuccaggagaacaauuauuauucuuuagauccacaaugccuggauguucuggauauccuaauaugaaucuagauugucuacuaccacaagaauggguucaacauuuuuaucaagaagccgcuccagcacaaucagauguagcucuacuuagauuuguuaacccagacacuggaagaguacuauuugaaugcaaacuccauaaaucaggauauguaacagucgcacacacaggucaacacgaucuagugauuccaccaaacggcuauuuuagauuugauuccugggucaaucaauuuuacacccuagcaccaaugggaaauggaacaggccgccgcagagcauuauaa

SEQ ID NO: 32929 - RNA, 1623 nt, Artificial Sequence
  derived and/or modified sequence opt6 from major_capsid_protein__Norovirus__AFU55704
augaaaauggcaucaaacgaugcaaauccaucagauggaucagccgcaaauuuaguaccagaaguaaauaaugaaguaauggcacuagaaccaguaguaggagcugcgaucgcugcaccaguagcaggucaacaaaacguuauagacccauggauaaggaacaacuuuguacaagcaccuggcggagaauucacaguauccccacgaaacgccccuggcgaaauacucuggucagcccccuuagguccugaccuuaacccauauuuaucacaucuagcaagaauguauaacggauaugcaggagguuucgaaguacaaguaauuuuagcaggaaacgcauuuaccgcugguaaaauuauauuugcagcuguuccucccaauuucccuacagaaggauuaucaccaucacaaguaacaauguucccacauauuaucgucgacguaagacaauuagaaccaguacuaauaccacuaccagauguccgaaacaauuuuuaucauuauaaccaaucaaaugacucuacaauaaaacuaauagcuaugcuauauaccccuuuaagagcuaacaacgccggagaagauguauuuaccguaucuugccgaguacuaacaagaccaucuccagacuuugauuuuauauuuuuaguuccuccaacagucgaaucuagaacuaaaccauucacaguuccuauauuaacuguagaagaaaugacuaacucaagauuuccaauaccacucgaaaaacuauuuaccggucccucuuccgcauucguaguccaaccccaaaauggacguugcacaaccgauggaguccuauuaggaaccacacaacuaucaccagucaauauauguacauucagaggugauguaacacauauagccggaucaagaaauuauacaaugaaccuagcuucacuaaacuggaacaacuaugauccuacugaggaaauaccugcaccacuaggaacaccagacuuugucgguaaaauucaaggagucuuaacacaaaccacaaaaggagauggaucaacacgaggacacaaagcaaccguauacacaggcucagcaccauucacaccuaaauuaggaucaguacaauucucaacugauacagaaaaugacuucgaaacccaucagaacacaaaauucaccccaguuggcguaauucaagauggugguacaacacacagaaacgaaccacaacaauggguuuuaccaucauauuccggaagaaauguacauaauguacaccucgcaccugcaguagcccccacuuuuccaggugaacaacuacuauuuuuuagauccacaaugccaggauguucuggauauccaaauauggaccuugacugccuauuaccacaagaauggguacaacauuuuuaucaagaagccgcaccagcacaaucugacguagcuuuauuacgauuugucaauccagacacaggacguguccuuuucgaaugcaaacuccauaaaucugguuauguaaccguagcucauacaggccaacacgaucucguaauaccuccaaauggauauuuucgauuugacucauggguaaaucaauuuuacacauuggcaccaauggguaauggaacaggacgacgaagagcauuauaa

SEQ ID NO: 32930 - RNA, 1623 nt, Artificial Sequence
  derived and/or modified sequence opt6 from major_capsid_protein__Norovirus__AFU55707
augaaaauggcuagcaaugacgcaaauccuuccgauggaucugcagcuaauuuaguuccagaagucaacaacgaaguuauggccuuagaaccaguuguaggagcagcaaucgccgcuccaguagccggacaacaaaauguaauagauccauggauacgaaacaacuucguacaagcaccaggaggagaauuuaccguauccccaagaaaugcaccuggagaaauacuuuggagugcaccacuaggaccagaucuaaauccauacuuaucacacuuagcacgaauguauaacggauaugcaggagguuucgaaguacaaguaauacuagcaggaaaugcauuuacugcaggaaaaauaauuuucgcugcuguaccaccaaacuuuccaacagaaggauuaucaccaucacaaguaacaauguucccucacauaauaguugacguacgacaauuagaaccuguauuaauaccacuaccagauguaagaaacaauuucuaccacuacaaucaauccaaugacagcacaauaaaacucauagcaauguuauacacuccauuaagagcaaauaaugcuggagaagacguuuuuacuguaucauguagaguucuaacaagaccuucacccgacuuugacuucauauuucuaguuccaccaaccguagaaucuagaacuaaaccauucacggucccaauacucacugucgaagaaaugacaaauucaagauuuccaauuccucuagaaaaauuauuuaccggaccaucaucagcauucgucguacaaccccaaaauggaagauguacaacagacggaguacugcucggcacaacacaauuaucacccguaaauauauguacuuucagaggugauguuacacacauagcaggaucacgaaauuacacuaugaauuuagccucacuaaauuggaauaacuaugauccaacugaagaaauucccgcaccauuaggaacuccagacuuuguaggaaaaauccaaggaguacuuacacaaacaacagaaggagauggaucaacccgaggucacaaagcaacaguauauacagguucugcuccauucacuccaaaauuaggaaguguacaauucuccacagauacagaaaacgauuuugaaacccaucaaaauacaaaauucacaccuguagguguaauucaagauggaucaacuacacauagaaacgaaccacaacaauggguuuuaccuucuuauucagguagaaacguacacaacguacacuuagcaccagcaguagcacccaccuuuccaggagaacaacuuuuauucuucagauccaccaugccagggugcucuggauauccaaauauggaccuagauugccuacuaccacaagaauggguacaacacuucuaucaagaagcagcaccagcacaaagugacguagcuuuacucagauucguaaauccugauacaggucgaguucuuuuugaaugcaaauuacauaaaucaggauacguuacagucgcacauacuggacaacacgaucuuguaauaccaccaaaugguuauuuuagauucgauucuuggguuaaccaauuuuacacgcuagcaccaaugggaaaugguacaggaagacgucgagcacuauaa

SEQ ID NO: 32931 - RNA, 1623 nt, Artificial Sequence
  derived and/or modified sequence opt6 from major_capsid_protein__Norovirus__AFU55710
augaaaauggcuucaaaugacgcaaauccauccgacggaucagcagcuaacuuaguaccugaaguaaauaaugaaguaauggcauuagaaccuguaguaggugcagcaauugcugcaccaguagcaggacaacaaaauguaauagacccuuggauaagaaauaauuuuguucaggcuccuggaggagaauuuacaguuucccccagaaaugcucccggagaaauauuaugguccgcaccucuuggaccagaccuaaacccauaccuuucacaucuugcaagaauguauaacggauacgcaggcggauuugaaguacaagucauauuagccggaaaugcauuuacugccggcaaaauaaucuucgcagccgucccaccaaacuucccaacugaaggauuaucacccucacaaguaaccauguuuccacacauuauaguagauguuagacagcuagaacccguacuaauaccauuacccgaugucagaaauaauuucuaucacuauaaccaauccaacgacucaacaauuaaacuuauagcaauguuauacacuccacuccgagcaaauaaugcaggagaugacguauucacaguuagcugccguguauuaacaagaccaucaccagacuuugacuuuauauuuuuaguaccuccaacagucgaaucucgcacaaaaccauuuacaguuccaauacuaacuguagaagaaaugacaaacucacgauuucccauaccacucgaaaaacuauuuaccggaccaucauccgcauuuguaguccaaccacaaaauggaagauguacuacugacggaguauuacuagguacaacccaauuauccccagucaauauuugcaccuucagaggagacguaacacauauagcaggaucacgaaauuacacaaugaaccuagcaucauuaaauuggaauaauuacgauccuacugaagaaauaccagcaccauuaggcacaccugauuuuguaggaaaaauacaaggaguacucacccaaaccacaaaaggagacggaucuacaagaggacacaaagcaacuguauauacaggcucagccgauuuuacaccaaaacuaggaucaguacaauuugcuaccgacacagaaaacgauuuugaaacacaucaaaauaccaaauucacaccaguaggcgucauacaagauggaucaacaacccaucgaaaugaaccacaacaauggguacucccaucauauucaggacgcaauguccacaacguucaccuugcaccagcuguagccccuaacuuuccaggagaacaauuauuauucuucagaagcacaaugccaggaugcaguggauauccaaauauggaucuagacugucuauuaccucaagaauggguacaacauuucuaucaagaagcagcuccagcacaaucagacgucgcacucuuaagauuuguuaaccccgacacaggacgcguccucuucgaaugcaaauuacacaaaucaggcuauguaacaguugcccacacagggcaacacgaucuaguaaucccaccaaauggauauuucagauuugauucaugggucaaccaauuuuauacauuagcaccaaugggaaauggaacugguagaagacgcgcccuauaa

SEQ ID NO: 32932 - RNA, 1623 nt, Artificial Sequence
  derived and/or modified sequence opt6 from major_capsid_protein__Norovirus__AFU55713
augaaaauggcuucuaaugacgccacaccuucagacggaucuacagcaaaucuaguaccagaaguuaauaaugaaguuauggcacuugaaccaguagucggagcagcaauagcugcaccaguagcaggacaacaaaacgucauagacccauggaucagaaauaauuucguccaagcaccaggaggugaauuuacuguaucuccccgcaaugcaccaggcgaaauucuauggucagcaccuuuagguccugauuuaaacccauacuuaucucacuuagcaagaauguacaauggauacgcaggaggauucgaaguacaaguuauauuagcaggcaaugcauucacagccgguaaaaucauuuuugccgcuguuccccccaauuuuccaacagaaggacuuagcccuucacaagucacaauguucccacacauaauaguugacgugcgacaacuagaacccguccuaauaccuuuaccagauguaagaaauaauuuuuaucacuacaaucaaucaaaugaucccacaauaaaacuaaucgcaauguuauauacaccacuacgagcaaauaaugcaggugaugacguauucacuguaucaugcagagucuuaacaagaccaucgccagauuucgacuuuauauuucuaguaccacccacaguagaaucacgaacaaaaccuuuuucuguacccauacuaaccguagaagaaaugacuaacuccagauuuccaauaccauuagaaaaacuauuuacaggucccuccuccgcauucguaguacaaccacaaaacggaagauguacaacagacgguguacuuuuaggaacuacacaacuaucaccaguaaauauuuguacauucagaggagacguaacacauauaacaggaucucgcaacuacacaaugaaucuagcaacacagaacuggaauucuuacgauccaacagaagaaauaccagcaccacucggaacaccugacuucguaggaaaaauacaagguguacuaacacaaacaacccgagcagaugguucuacaagaggacacaaagcaacaguauauacaggaucagcugauuucgcuccaaaacuaggaagaguccaauuugcaacugauaccgauaaugauuuugacgcaaaucaaaacacaaaauuuacaccuguuggcguaauacaagacggcgacacugcacauagaaaugaaccacaacaauggguccucccaucauauucuggaagaaauagccacaauguacaucuagcucccgccguagcaccaacauucccaggcgaacaacucuuauuuuuuagauccacuaugcccgguuguuccggauacccaaauauggaucuagauugcuuauuaccccaagaauggguccaauauuuuuaccaagaagcugcuccagcccaaucagauguagcauuacuaagauucguuaaccccgacacaggacgaguauuauuugagugcaaguuacacaaaucuggcuacguaacagucgcacauaccggucaacacgaucuaguuauacccccaaacggauauuucagauucgauuccuggguaaaucaauucuauacacucgcaccaaugggcaacggcacaggaagaagaagagcacuuuaa

SEQ ID NO: 32933 - RNA, 1623 nt, Artificial Sequence
  derived and/or modified sequence opt6 from major_capsid_protein__Norovirus__AFU55716
augaaaauggcaucaaacgacgcaaacccuucagauggaucugccgcaaacuuaguaccagaaguaaacaaugaaguaauggcauuagaaccugucguaggagcugcaauagcagcaccaguugcaggacaacaaaacgucauagacccuuggauaagaaacaacuuuguacaagcaccuggaggagaauuuacaguauccccccgaaaugcuccaggcgaaauacucuggucugcaccuuuaggucccgaccucaauccauaucuaucacaucucgcaagaauguauaauggauacgcuggaggauuugaagugcaaguuauacucgcaggaaacgcauuuacagcuggaaaaaucauuuucgcugcaguaccaccaaacuuuccaacugaaggccuaucuccaucacaaguaacaauguucccacauauaauaguugacguaaggcaauuagaaccaguacucauaccacuacccgauguccgaaauaauuucuaucacuauaaccaaucuaacgauaguacaauaaaacuaauagcaaugcuauacacaccauuacgagcaaacaaugcaggagaagacguauuuacaguuucauguagaguacucacucgcccaucacccgacuuugacuuuauauucuuaguaccacccacaguagaaucacgaacaaaaccuuucacaguaccaauacuaacaguagaagaaaugacaaacucccgauuuccaauaccauuagaaaaauuauucacaggaccuucuucagccuuuguaguacaaccucaaaauggccgauguacaacagacggaguacuauuagguacaacccaauugucaccaguaaacaucuguacuuuucgcggugacguuacacauauagcaggaucaagaaauuauaccaugaaucuugccagcuuaaacuggaacaauuaugaccccacagaagaaaucccagccccauuagguacucccgacuucguaggaaaaauacaaggaguccucacccaaacaaccaaaggagauggaucuaccagaggccacaaagccacaguauacacagguagugcaccauuuacaccaaaauuaggaucaguccaauuuucaacagauaccgaaaaugacuuugaaacacaccaaaauacaaaauucacacccguuggaguaauacaagauggaggaacaacacauagaaacgaaccccaacaauggguccucccaaguuauucuggcagaaauguucaaaauguccaucuagcaccagcaguagcaccaacauuuccaggugaacaauuauuauuuuuuagauccacaaugccagguugcucagguuacccaaacauggaucuagauugccuucuaccacaagaauggguacaacauuucuaucaagaagcugcucccgcucaaucagacgucgcauuauuaagauucguaaacccugacacaggucgaguacuauucgaauguaaacuccauaaaucaggauauguaaccgucgcccacacaggccaacaugaucuaauaauuccaccaaacggauauuucagauuugauucauggguaaaucaauucuacacauuagcgccuaugggaaauggaacaggaagaagaagagcauuauaa

SEQ ID NO: 32934 - RNA, 1623 nt, Artificial Sequence
  derived and/or modified sequence opt6 from major_capsid_protein__Norovirus__AFU55719
augaaaauggcaucaaaugaugcuaacccuucagaugguucagcagcaaaucuaguaccagaaguaaacaaugaaguaauggcauuagaaccaguaguaggagcagcuauugcagccccaguagcuggucaacaaaauguaauagauccauggauacgcaauaauuuuguccaagcaccuggaggagaauuuaccguuucaccaagaaaugcaccaggugaaauucuaugguccgccccauuaggaccagaucucaaucccuauuuaucacacuuagcacgcauguacaauggauacgcaggaggauucgaaguacaaguuauacuagcaggaaaugcauucacagcggguaaaauaaucuucgcagcaguaccaccaaauuuuccaacagaaggauuaucaccaucucaagucacaauguucccacacauuauaguugacguaagacaauuagagccaguacuaauuccucucccagauguacgcaacaauuucuaucauuauaaucaauccaacgauucaacaauaaaauuaaucgcaauguuauacacacccuuacgagccaacaaugcaggagacgauguauucacaguaucuuguagagugcucacuagaccauccccagauuucgauuucaucuuuuuaguaccuccuacaguagaauccagaacuaaaccauucacaguaccaauuuuaacaguagaagaaaugacaaauucacgauucccuauuccacuugaaaaauuauuuacuggacccucuucagcauucguaguacaaccucaaaacgguagauguacaacagacgguguacuucuuggaaccacacaacuaucaccaguaaauauaugcacauucagaggagauguuacccauauagcagguucaagaaauuauacaaugaaucuagcauccuuaaauuggaauaacuacgauccaacugaagaaaucccagcaccacuaggcacaccagauuucguaggaaaaauacaaggaguauuaacacaaacuacaaaaggagacggcagcacacgaggucacaaagcaacaguauauacaggaucugcagacuuuacaccuaaacuaggaucaguccaauuuggaacagacacugaaaacgauuuugaaacucaccaaaauaccaaauuuacaccaguaggaguaauacaagacggcucaacaacccacagaaaugaaccacaacaauggguacuacccucauacagcggaagaaauguucacaacguacaucuugcaccagcaguugccccaaacuuuccaggugaacaauuacuauucuuucgaucaacaaugccaggaugcucuggcuacccaaauauggaucucgauugcuuauuaccucaagaauggguacaacauuucuaucaagaagcagcaccagcacaaucagauguagccuuacuaagauuuguaaauccagacacaggaagaguuuuauucgaauguaaacuacauaaaucugguuauguaacaguagcacacacaggacagcaugaucuaguuaucccaccuaauggcuacuuuagauuugauucuuggguaaaccaauuuuauacucuagcaccaaugggaaacggaacaggaagacgaagagcacuauaa

SEQ ID NO: 32935 - RNA, 1623 nt, Artificial Sequence
  derived and/or modified sequence opt6 from major_capsid_protein__Norovirus__AFU55722
augaaaauggcaucaagcgaugcaaacccaucagaugguuccacagcuaaucucguaccagaaguaaacaaugaggucauggcacuagaaccaguaguaggagcagcuauagcugcaccagucgcaggccaacaaaauguaauagacccauggauuagaaauaacuuuguacaagcaccaggaggagaauucacaguuucaccuagaaacgcuccaggcgaaauauuauggucagccccuuuaggaccagauuuaaauccauaccuaucacaccucgcacgaauguauaacggauacgcaggaggauucgaaguacaaguuauacuagcaggaaaugcauucaccgcaggaaaaauaauauucgcagcaguuccaccaaacuuuccaacagaaggcuuaucuccaucacaaguaacaauguucccucacauaauuguugauguaagacaacucgaaccaguacuuauuccacuaccagaugugcguaauaauuucuaucauuauaaucaaucaaacgacucaacuauaaaacuaauagcuaugcuuuauacaccauuacgagccaacaaugcaggagacgacgucuuuacaguaucauguagaguccuaacaagaccaucuccagauuuugacuuuauauuucuaguaccaccaacaguagaaucaagaacaaaaccuuucuccgucccaguauuaacaguugaagaaaugacaaacucacgauucccuaucccacuagaaaagcucuuuaccggaccuucaucagcuuucguuguacaaccacaaaauggaagaugcacuacugauggaguauuacuagguacaacacaacuaucaccaguaaauauauguacuuuuagaggagacguaacacacauuccaggaaguagaaauuauacaaugaacuuagcaagucaaaacuggaacucauaugacccuacagaggaaauaccagcuccauuagguacaccagacuuuguagguaaaauucaaggaguauuaacacaaacaacacgcacaaauggaucuacaagaggucacaaagcuacagucuauacaggaucugcugacuuuucaccaaaauuaggaagaguccaauuugcaacagauacagauaacgauuucgaaacuaaucaaaacacaaaauuuacaccgguaggaguaauccaagacggaucaacaacaccaagaaaugaaccccaacaauggguuuuaccaaguuacucaggaagaaacauacauaacguacaucuugcaccagcaguagcuccaacauuuccuggugaacaacuacuauuuuuuagaucuacaaugccaggaugcucuggcuaccccaauauggauuuagauugcuuauuaccacaagaauggguacaauauuucuaucaagaagcggcaccagcccaauccgacgucgcauuacuacgauuuguuaacccagacacaggacgaguauuauucgaaugcaaacuccauaaauccggcuauguaacuguagcacacacaggacaacaugaucucguaauaccuccaaauggauauuuuagauucgauuccuggguaaaucaauuuuacacacuagcacccaugggaaauggaacagguagaagacgugcccuauaa

SEQ ID NO: 32936 - RNA, 1623 nt, Artificial Sequence
  derived and/or modified sequence opt6 from major_capsid_protein__Norovirus__AFU55725
augaaaauggcaucaucagacgcuaauccuucugacgguucuacggcuaauuuaguacccgaaguuaauaaugaagucauggcuuuagaacccguaguaggagccgcaauagcugcaccaguugcaggucaacaaaacguaauagauccuuggaucagaaauaauuuuguacaagcuccuggaggagaguucacuguaucaccaaggaaugcacccggagaaauauuauggucugcuccucuaggacccgaucuaaacccauauuuaucacaucuagcaagaauguauaacggauaugcaggagguuucgaaguacaagucauauuggcaggaaacgcauuuacagcaggaaagauaauauucuccgcaguaccuccaaacuuuccaacugaaggacuaucaccaucacagguaacaauguucccacacauaauaguugacguuagacaauuagaaccuguacuuauaccacuaccagacgucagaaacaauuuuuaucacuauaaucaauccaaugauccaaccauaaaacuaauugcaauguuauauaccccauuacgggcaaauaaugcaggugacgauguauucacaguaucuuguagaguauuaacaagaccaucaccagacuucgauuuuauauuucucguaccaccuacagucgaauccagaacaaaaccauucucugucccuauacuaacaguagaagaaaugacaaauuccagauucccaaucccacuagaaaaacuauucacuggcccuucaucaacauucguaguacaaccucaaaacggaagauguacaacagauggaguauuacuaggcacaacacaacucucucccguuaauauauguacauuuagaggcgacguaacucauaucacaggaucaagaaacuacacaaugaaucuugcaucucaaaacuggaauucuuacgaucccaccgaagaaauaccagcaccauugggcacuccagauuuugucggcaaaauucaaggaguacuuacucaaacaacaagaacagacggaucaaccagaggacauaaagcaacaguauacacaggaucugccgaauuuucaccaaaauuaggaagaguccaauuugcaacugauacagacaaugauuuugacgcaaaccaaaauaccaaauuuaccccagucggaguaauacaagacggaggaacuacacaucgaaaugaaccacaacaauggguuuuaccuucauauuccggaagaaacacucacaacguucacuuagcccccgcaguugcaccaacauuuccaggagaacaacuucuauucuucagauccacaaugccuggauguucaggauauccuaauauggacuuagauugccuuuuaccacaagaauggguucaacauuuuuaccaagaagcugcaccagcucaaagcgacguagcauuauuacgcuucguaaauccagacacaggacgaguucucuuugaaugcaaacuacacaaaucaggauaugucacuguagcacauacaggacaacaugauuuaguaauuccaccuaauggauauuuuagauucgauucauggguaaaucaauuuuacacuuuggcaccaaugggaaaugguacaggaagaagaagagcauuauaa

SEQ ID NO: 32937 - RNA, 1623 nt, Artificial Sequence
  derived and/or modified sequence opt6 from major_capsid_protein__Norovirus__AFU55728
augaaaauggcuucaagugacgcaaacccaucagacggaucgacagcaaacuuaguaccagaaguaaacaaugaaguaauggcucuagaaccaguuguaggagccgcaauagcugcaccaguagcuggacaacaaaauguaauugaccccuggauucgaaacaacuuuguacaagcacccggaggcgaauucaccguauccccaagaaaugcaccaggugaaauauuauggucagcuccucuugguccagaccuaaauccuuauuuaucacacuuagcacgaauguacaacggcuaugcuggaggauuugaaguccaaguaauccuagccggcaacgcauuuacugcaggcaaaauaaucuuugcagcuguaccaccuaauuuucccaccgaaggauuauccccaucacaagucacaauguucccucacauaauaguagacguucgacaauuagaaccaguccuaauucccuuaccagacguacgcaacaauuucuaucacuacaaccaaucaaaugauccaacaauaaaauuaauagcaauguuauacacaccauuaagagcaaacaaugcaggagacgauguauuuacaguuucaugucgaguacucacaagaccaucuccugauuucgacuuuauauuucuaguacccccuacuguagaaucaagaacuaaaccauucucaguaccaguucuaacaguugaagaaaugacaaauucacgauuuccuauacccuuagaaaaacuauuuacaggaccuucaucagccuucguaguacaaccacaaaacggaagaugcacaacagauggaguauuguuaggcacaacacaacuaucaccaguaaauauuuguacuuucagaggagauguaacacauauaccaggcucacacaauuacacaaugaauuuagccagucaaaacuggaacucauacgauccaacagaagaaauaccagcaccacuaggaacaccagacuuuguaggaaaaauacaaggaguauuaacucaaacaaccagaacuaacgguucaacacgaggacauaaagcaacaguauacacagguucugcagacuucucaccaaaacucggaagaguacaauucgcaacagauacuaauaaugauuucgaaacaaaucaaaauacaaaauucacuccaguuggcguaauucaagacggaucaaccacuccaagaaaugaaccacaacaauggguauuaccaucauacagcggcagaaacacccauaacguccacuuagcaccagcugucgcuccaacauuuccaggagaacaauuacucuuuuuccgaucuacaaugcccgguuguucuggauacccaaauauggaccuugacuguuuacucccccaagaauggguacaauauuuuuaucaagaagcagcaccagcacaaucugauguugcacuacuaagauucguaaauccugauacagguagaguauuauucgaaugcaaacuacauaaaucuggauauguaacaguagcacauacuggacaacaugaucuaguuauaccuccaaacggauacuuucguuucgauucauggguaaaccaauuuuauacacuagcaccaaugggaaacggcacuggaagaagaagagcuuuauaa

SEQ ID NO: 32938 - RNA, 1623 nt, Artificial Sequence
  derived and/or modified sequence opt6 from major_capsid_protein__Norovirus__AFU55731
augaaaauggccucaucagacgcaaaccccucagauggaucaacagcaaacuuaguuccagaaguaaauaaugaaguuauggcucucgaaccagucguuggcgcagccauugccgcaccaguugccggacaacaaaacgucauugacccauggauaagaaauaauuucguucaagcaccugguggugaauuuacaguaucaccaagaaaugcuccaggagaaauacuauggucagcaccauuaggaccagauuuaaaccccuaucucucacacuuagccagaauguauaacgguuaugcaggagguuuugaaguacaaguaauacuagcaggaaaugcauucacagcaggcaaaauuauauucgcagcaguucccccaaacuuuccaacagaaggucuaucuccaucccaagucacaauguucccacauauaauaguugauguaagacaacuagaaccaguuuuaauaccauuaccagacguaagaaacaacuucuaucacuauaaccaauccaaugaucccacaauaaaauuaauagcaauguuauacacaccacuuagagcaaauaaugccggcgaugacguuuucaccguaucauguagaguucuaacucgaccuucacccgacuuugacuucauauuucuaguuccaccaacaguagaaucaagaacaaaaccauucucagucccaguacuaacaguagaagaaaugacaaacucaagauuucccauaccauuagaaaaacuauuuacaggaccaucuucagcauucguaguacaaccucaaaauggccgaugcaccacagauggcguauuacuagguaccacucaauuaucaccaguaaauauauguacauuuagaggggacguaacacacauaccaggaucacacaauuacacaaugaaucuagcaagccaaaauuggaauucauacgauccaacagaagaaguaccugcaccacuagguacaccagacuucguaggcaaaauacagggaguacuaacucaaacaacucgcacaaauggcucuacccgaggucauaaagcaacugucuacacugguuccgcagauuucucuccaaaacuaggaagaguucaauuugcaacagauaccaauaacgauuucgaaaccaaucaaaauacaaaauucaccccaguaggaguaauccaagauggcucaacuacucccagaaaugaaccacaacaauggguacuaccauccuauucaggacgaaauacacauaacguacacuuagcaccagcaguagcaccaacauuuccaggggaacaacucuuauucuuucgcucaacaaugccaggcuguucaggcuauccaaauauggaucuugauugccuauuaccacaagaauggguacaauauuucuaucaagaagcagcacccgcacaaucagauguagcauuauuaagauucguaaacccugacacaggaagaguauuauucgaauguaaguuacauaaaucaggauauguaacaguagcucacacuggucaacaugauuuaguaaucccaccaaauggauauuucagauuugacucauggguaaaucaauuuuacaccuuagccccaaugggcaauggaacuggaagaagaagagcauuauaa

SEQ ID NO: 32939 - RNA, 1623 nt, Artificial Sequence
  derived and/or modified sequence opt6 from major_capsid_protein__Norovirus__AFU55734
augaaaauggcaucaucagacgcaaauccuucugauggcucuacagcaaauuuagucccugaaguaaauaaugaaguaauggcacuagaaccagucguaggagcagcaauagccgcaccaguagcaggacaacaaaacgucauagauccauggauaagaaauaacuuuguacaagcaccaggaggagaauucacaguauccccacgaaacgcaccaggagaaauauuauggucugcuccacuagguccugaccuaaacccauauuuaucccaccuagcacgaauguauaacggauaugcaggaggauuugaaguucagguaauacuagcaggaaaugcauuuacagcaggaaaaauaauuuucgcugcaguaccuccaaauuuuccuacugaaggacuaucaccuucacaaguaacuauguucccacacauaauuguagacguaagacaacuagaaccaguacuaauaccauuaccugacgucagaaauaauuucuaucacuacaaccaaucuaaugaccccacaauuaaauuaauagcuaugcuuuacacaccauuaagagccaauaaugccggugacgauguauucacaguauccugucgaguacuuaccagaccaucaccagacuucgacuuuauauucuuaguaccaccuacaguagaaucaagaacaaaaccauucucuguaccaguuuuaaccguugaagaaaugacaaacucaagauuuccaaucccacuugaaaagcuauuuacaggaccaucaucugcuuucguaguacaaccccaaaacggaagaugcaccacagacggaguacuucuaggaacaacucaacuaucacccgucaauauuuguacauucagaggugauguaacacauaucccaggaucaagaaauuauacaaugaauuuagcaucgcaaaacuggaauucauaugauccaacagaagaaauaccagcaccacuaggcacaccugacuuuguaggaaaaauacaaggaguacuaacacaaacaaccagaacuaauggaucaacaagaggucacaaagcaacuguauauacaggaagcgcugacuuuuccccaaaauuaggacgaguacaauucgcaacagauacagauaaugauuucgaaacaaaucaaaauaccaaauucaccccaguaggaguaauacaggacggaaguacaacaccacgaaaugaaccacaacaauggguucuaccaucauauagcggaagaaauauacauaacguacaccuggcaccagcaguagcaccaacauucccaggugaacaacuuuuauucuuuagaucaaccaugcccggcugcucuggcuauccuaauauggaccuagacugucuucuaccucaagaauggguccaauacuucuaucaagaggccgcaccagcacaaucagauguagcacuucuaagauucguaaacccagauacaggacguguacuauucgaauguaaauuacauaaauccggauaugucacaguagcacacacuggucaacaugaucuaguaaucccuccaaauggcuauuucagauuugauuccuggguaaaucaauuuuacacacuugcuccaauggguaacggaacaggacgacguagagcuuuauga

SEQ ID NO: 32940 - RNA, 1623 nt, Artificial Sequence
  derived and/or modified sequence opt6 from major_capsid_protein__Norovirus__AFU55737
augaaaauggcaucaucagaugccaacccaucagacggaucaacugcaaauuuaguccccgaaguuaauaaugaagucauggcauuagaaccaguuguaggcgcugcuauagcugcaccaguagcaggacaacaaaauguaauagacccauggauaagaaauaacuuuguccaagcaccagguggugaauuuacaguaagucccagaaacgccccaggagaaauauuauggucagcaccacuagguccagaucuaaacccauaucuuucacauuuagcaagaauguacaacggauaugcaggagguuucgaaguacaaguaauauuagcaggaaaugcauuuacugcuggaaaaauaauauuugcagcaguuccuccaaauuuucccacagaaggccuuucaccaucacaagucaccauguucccacacauuauaguagauguuagacaacuagaaccaguacuaauuccucucccagacgucagaaacaauuucuaucauuauaaccaauccaacgaccccaccaucaaacuaaucgcuauguuauauacuccauuaagagcaaacaacgcaggagacgauguauuuacaguaucaugccgaguauuaacaagaccaucaccagauuuugacuucaucuuuuuaguuccacccaccguagaaucacgaacaaaaccauucuccgucccaguacuuacaguagaggaaaugacaaauucaagauuucccauaccacucgaaaaacuauuuacagguccaucaucagcuuucguuguacaaccacaaaauggucgauguacaacagauggaguauuacuaggcacaacacaauuauccccuguaaauauaugcacuuuucgcggcgacguaacacauauacccggcucaagaaauuauacaaugaaccuagcaucacaaaauuggaacuccuacgauccaacugaagaaauaccagcaccacuaggaaccccugacuucguaggaaaaauacagggcguucuaacucaaacaacucgaacaaacggcucaacaagaggacacaaagccacaguauacaccgguucugcagauuuuucaccuaaacuaggccgcguacaauuugcaacagacaccgacaaugacuucgaaacaaaucaaaauacaaaauucacacccgucggcguaauacaagacgguucaacuacccccagaaaugaaccccaacaauggguacuaccaaguuauuccgguagaaacauacauaauguacaucuagcaccugcuguugcaccaacuuuuccaggugaacaacuacuauuuuucagaucuacaaugccaggaugcucaggcuaccccaauauggauuuagauugccuuuuaccacaagaauggguucaguauuucuaucaagaagcagccccagcucaaucagacguugccuuauuaagauuuguuaauccagacacaggacgaguacuuuuugaaugcaaacuacauaaaucagguuauguaacaguagcucacacaggacaacacgauuuagucauucccccuaauggcuauuuuagauucgauucauggguuaaucaauuuuauacauuagcaccaaugggaaauggcacaggucgacgaagagccuuauaa

SEQ ID NO: 32941 - RNA, 1623 nt, Artificial Sequence
  derived and/or modified sequence opt6 from major_capsid_protein__Norovirus__AFU92659
augaaaauggcaucuaacgacgcaacuccaucagauggaucaacugcuaacuuagucccagaaguuaauaaugaaguaauggcccuagaaccagucguuggagccgcaauugcugcaccuguagcaggccaacaaaauguaauugauccuuggauucgaaauaacuuuguacaagcacccggaggcgaauuuacaguaucaccaagaaaugcaccaggugaaauauuauggucagcgccucuaggaccagaucuaaauccauauuuaucucauuuagcacguauguauaacggauaugcaggugguuucgaaguacaaguaauacucgcaggaaacgcauuuaccgcuggaaaaaucauauuugcagccguaccaccuaauuuuccuaccgaaggcuuaucaccuucacaaguaacuauguucccacacauaauaguugacguacggcaauuagaaccaguacucauaccuuuaccagauguaagaaacaacuucuaucauuauaaccaaaguaaugacuccacaaucaaacuuauuccaauguuauacacaccccuccgagcuaacaaugcaggugacgacguauuuacaguuucaugucgaguacuaacuagaccaucacccgacuuugacuuuauauuucuuguuccaccuaccgucgaaucaagaacaaaaccauucucuguaccuauauuaacaguagaagaaaugaccaauucaagauuuccaauuccacucgaaaaauuauuuacaggaccaucaucagcuuucguaguucaaccccaaaacggaagauguacaacagacggaguacuacucgguaccacccaauuaaguccaguuaauauauguacauuucgcggugacguaacacacauugcaggaacucaaucauacacaaugaauuuagcaucccaaaacuggaacaauuaugacccaacagaagaaauaccugcaccucucgguaccccagauuuuguaggaaaaauacaaggaguauuaacacaaacaacaagaggagacggaucaacuagaggucacaaagcaacuguaucaacagguucuguucauuucaccccuaaacuuggaucaguccaauucucaacugauacaaguaacgauuucgaaacaggacaaaauacaagauucacaccagucggagucguccaagacggcuccacaacacaucaaaaugaaccacaacaauggguucuaccaaacuacucaggaagagauucacacaauguacacuuagcacccgcaguugcaccuaccuuuccaggagaacaacuacucuuuuuccgaucuacaaugccaggauguucaggauacccaaacaugaaccuagauugccuacuaccacaagaauggguacaacauuucuaccaagagucugcuccagcucaaucugacguugcacuauuaagauuuguaaauccugacacaggacgcguacuuuuugaaugcaaauuacauaaaaguggauauguaacaguagcccacaccggacaacacgaccuaguuauaccacccaauggauacuucagauuugacucaugggucaaccaauucuauacauuagccccaaugggaaacggcgcuggacgaagacgcgcacuauaa

SEQ ID NO: 32942 - RNA, 1623 nt, Artificial Sequence
  derived and/or modified sequence opt6 from major_capsid_protein__Norovirus__AFU92660
augaaaauggcuucaaaugaugcgcacccuucagauggaucaacagcaaauuuaguaccagaagugaauaaugaaguaauggcacuagaaccaguuguaggagcagcaauagcagcaccuguugccggacaacaaaacguaauagaccccuggauacgcaauaacuuuguccaagcacccggaggagaauuuacaguaucaccaagaaaugcaccaggagagauauuauggucagcaccccucggaccagaucuuaauccauaucuaucacauuuagcaagaauguauaacgguuacgcaggagguuuugaaguacaaacaauuuuagcaggcaaugcauuuaccgcuggaaaaauaauauucgcugccguaccaccuaacuucccaacagaaggauuaaguccaucacaaguaacaauguucccacacauaauaguugauguaagacaacuagaacccguacucauaccauuacccgacguuagaaauaauuucuaucacuauaaccaaagcaaugauccaacaaucaaacuuauagcaauguuauacaccccacuccgagccaacaacgcaggagacgacguauucacugucucaugccgaguauuaacuagacccucucccgacuuugacuuuauauuucuaguuccaccuacagucgaaaguagaacaaaaccuuuuacaguaccuauuuuaacaguagaagaaaugacaaauucaagauuuccuauaccacuugaaaaauuauuuacagguccauccucagcauucguaguacaaccacaaaacggcagauguacaacugaugguguccuauuaggaacaacacaacuaucaccagucaauaucuguacauuccgaggagacgucacccauauagcuggaacucacaauuacaccaugaauuuagcaucacaaaauuggaacaauuacgauccaacagaagaaauacccgcaccauuagguacaccugacuuuguaggcagaauccaaggaaugcuuacacaaacuacacgcggagacggaaguacuagaggucacaaagcaacaguaagcacaggagacguccacuucacaccaaaacuuggaaguauccaauucaauacagacacaaacaacgacuucgaaacaggccaaaauacaaaauucacaccaguuggaguaguacaagacggaaacggaacacaccaaaaugaaccacaacaauggguacucccaucauauucaggacgaacaggacauaacguacaucuagcaccugcaguagcaccuacauucccaggagaacaauuacuuuuuuuuagaucaacaaugccaggaugcaguggauauccaaacaugaaucucgauugcuuacuaccacaagaauggguacaacauuuuuaccaagaagcagcaccagcccaauccgacguagcauuacucagauucguuaauccagacacaggaagaguauuauucgaauguaaacuacacaaaucuggauauguaacaguagcucacacaggucaacacgauuuaguuauuccacccaacggauauuucagauuugauucauggguuaaccaauucuacacacuugcuccuaugggcaacggaacaggacgaagaagagcacuuuaa

SEQ ID NO: 32943 - RNA, 1623 nt, Artificial Sequence
  derived and/or modified sequence opt6 from major_capsid_protein__Norovirus__AFU92661
augaaaauggcuucaaacgaugcuacaccaucugacggaucaacagcaaauuuaguaccugaaguaaauaaugaaguaauggcuuuagaaccaguaguuggagcagccauagcagcaccuguagccggacaacaaaauguaauagauccauggauaagaaauaauuuuguacaagcaccaggaggagaauuuacaguaucacccagaaaugcaccaggagaaauacuuugucacgcaccuuuaggaccagaccucaauccauauuuaucacacuuagcaagaauguauaacggauacgcaggaggauuugaaguacaaguaauacuagcuggaaaugcauuuacagcaggcaaaauaauauucgcagcuguucccccuaacuucccuaccgagggauuaucaccuagccaaguuacaauguuuccucacauaaucguagacguccgccaacucgaaccaguauuaauaccuuuaccagauguuagaaacaauuucuaucauuauaaucaaucaaaugacccaacaauaaaauuaauagcaauguuauacacucccuuacgagcaaacaacgcaggagaugaugucuucaccguuucauguagaguauuaacaagacccucuccagauuuugacuuuaucuuucucguaccaccuacaguugagucaagaacaaaaccauucucagucccuauauuaacaguugaagaaaugacaaacagcagauuuccuauaccacuagaaaaacuauuuacuggaccuucaucugcauucguuguacaaccacaaaauggaagaugcacaaccgacgguguacuucuaggaacaacacaauuaucaccaguaaauauuugcacauuuagaggagacguaacucauauugccggaacacaaaauuacaccaugaaucuagcaucccaaaacuggaauaacuacgauccaaccgaagaaaucccugcaccacuagguacgcccgacuucguuggaagaauacaaggcguauuaacacaaacuacaagacgugacggauccacacgcggucauaaagcaacauuaucuacuggauccguacauuuuacacccaaauuaggaaguguacaauucucaaccgauaccucaaaugauuuugaaacuggucagaacaccagauuuacgcccguagggguaguacaagauggaucaacaacacaccaaaaugaaccacaacaauggguuuuaccaaauuauucuggacgagauucucauaacguacacuuagcaccugccguagcaccaacauucccaggugaacaauuauuauuuuuuagaucuacuaugccagguuguucaggauauccaaauaugaaucuugacugucuucucccacaagaauggguacaacauuucuaucaagaaucagcuccagcacaaucugacguagcauuauuacguuuuguaaaucccgauacagguagaguauuauucgaaugcaaauuacacaaaucuggauauguaacaguagcacauacaggacaacacgaccuugucauaccuccaaaugguuacuuuagauucgacucauggguaaaucaauuuuacacucuagcuccaaugggaaauggcgcaggaagaagaagagcacuauaa

SEQ ID NO: 32944 - RNA, 1623 nt, Artificial Sequence
  derived and/or modified sequence opt6 from major_capsid_protein__Norovirus__AFU92662
augaaaauggcaucaaacgacgcaacucccagugacgguucaaccgcaaaucuaguacccgaaguaaacaaugaaguaauggcuuuagagcccguaguaggagccgcaauugcugcaccaguagcaggccaacaaaauguaauagacccauggauaagaaacaacuuuguccaagcuccaggaggagaauuuacaguaucaccacgaaaugccccaggcgaaauacuauggcacgcaccacuuggcccagacuuaaauccauauuuaucccaccuagcaagaauguacaacgguuaugcuggagguuuugaaguacaagucauucucgccggaaaugcauuuacagcaggaaaaauaauauucgcagcaguuccacccaacuucccaacagaaggacuaucacccucacaaguaacaauguucccacacauaauaguugauguaagacaacuagaacccguucucauaccccuaccagauguaagaaacaauuuuuaccauuauaaucaaucaaaugauccaacaauuaaauuaauugcuaugcuuuacacuccauuaagagcaaauaaugcaggagacgacguauuuacaguaucaugucgaguucuuacaagacccuccccagacuuugacuuuauuuuccuagucccuccaaccguagaaucacgaacuaaaccauucucaguccccauauuaacaguagaagaaaugacaaacucuagauuuccaauuccauuagaaaaauuauuuacaggaccauccucagcauuuguaguacaaccacaaaauggacgauguacaacugacggaguauuauuaggaacaacucaacuaucuccuguaaacauuuguacuuucagaggugauguuacacauauagcuggaacacaaaauuauacaaugaaucucgcaucacaaaauuggaacaauuacgauccuacagaagaaauacccgcaccccuuggaaccccugauuuuguaggaaaaauacaagguguucuaacacaaacaacacgaagagauggauccacaagaggucauaaagccacaguuucaacaggaucaauacacuuuacuccaaaacuaggaucaguacaauucucaacugauaccucuaaugauuuugaaacaggacaaaacacccgauucacaccaguaggaguaguacaagacggaucaaccacacaccaaaacgaaccccaacaauggguacucccaaauuauucuggaagagacucccacaauguacaucuagcucccgcugucgcaccaacauuuccaggugaacaacuauuauucuucaggucaacaaugccaggauguucugguuacccuaauaugaaucuagauugcuuauuaccacaagaauggguacaacauuucuaucaagaauccgccccagcucaaucagauguagcacuccuaagauucguaaacccagauacaggcagaguacuauuugaauguaaacuacacaaaaguggauauguaaccguagcacauacuggacaacaugaccuaguaauaccaccaaaugguuauuucagauucgauucauggguuaaucaauucuacacauuagccccaaugggaaauggcgccggaagacgaagagcauuauaa

SEQ ID NO: 32945 - RNA, 1623 nt, Artificial Sequence
  derived and/or modified sequence opt6 from major_capsid_protein__Norovirus__AFU92663
augaaaauggcaucaaaugacgcaaccccauccgacggaucaacagcuaaucuaguucccgaaguuaacaaugaaguaauggcauuagaacccguuguaggcgcugccauagcagcaccagucgcaggacaacaaaauguaaucgacccguggauucgaaauaacuucguacaagcaccaggaggcgaauuuaccguaucaccuagaaaugcaccuggugaaauacuuuggucagcaccuuuaggaccagacuuaaacccauaucugucacaccuaucaagaauguacaaugguuaugcuggcggauucgaaguacaagucauacuagcaggcaaugcauucacugcaggaaaaauaauauucgcugcaguaccaccaaauuucccaacugaagguuugagcccuucacaaguaacaauguucccacacauaauagucgacguuagacaacuagaaccaguacuaauaccacuaccagacguaagaaacaacuuuuaucacuacaaucaaucaaaugacccaacaauaaaauuaauagcaaugcuuuacaccccauuaagagcaaacaaugcaggugaugacguauucacagucucaugucgcguauuaacacgaccaucacccgacuuugacuuuaucuuuuuaguuccaccaacagucgaauccagaacaaaaccuuucucaguaccaauauuaacuguugaagaaaugacaaauucaagauucccaauaccacuagaaaaauuauucacaggaccguccucagccuuuguaguacaaccucaaaauggcagauguacaacagaugguguauuacuaggaaccacacaacucucaccuguaaauaucuguacauuuagaggcaacguaacaaauauugcaggaucacaaacauauacaaugaaucuagcaucacaaaacuggaauaacuaugacccaacagaagaaauccccgcacccuuaggaacuccagacuuuguaggacgaauacaaggaguacuaacacaaacaacacgaggagauggcucuacaagaggucacaaagccaccguaucaacaggaucugcauacuucacaccaaaacuaggaucuguucaauucuccacagauacaaguaccgauuuugaaacaggacaaaacaccagauucacuccaguuggagucguacaagacgguucaacuacacacaaaaaugaaccacaacaauggguauuacccucauauucugggagagauucacauaacguacaccuagcaccugcaguagcaccuaccuuucccggugaacaaauucuauuuuuuagaucaacaaugccagguugcucuggauauccaaauauggacuuagacugcuuacuaccucaagaauggguacaacauuuuuaucaagaauccgcaccagcccaaucugacguagcauuacuaagauuuguaaacccagauacaggcagaguacuauucgaaugcaaauuacacaaaucuggauaugucacuguagcucauacaggacaacacgauuuaguaauuccuccaaauggauacuuccgauucgauucauggguaaaucaauucuauacccuagcuccaaugggaaacggugcaggaagaagaagagcauuauaa

SEQ ID NO: 32946 - RNA, 1623 nt, Artificial Sequence
  derived and/or modified sequence opt6 from major_capsid_protein__Norovirus__AFU92664
augaaaauggcuucaaaugaugcaaauccaagcgauggaucugcagcucaucuaguaccagaagucaauaaugaagucauggcuuuagaaccuguaguaggcgcugcuauagcagcaccaguagccggacaacaaaauguaauagauccauggauaagaaauaacuucguacaagcaccaggaggagaauuuacaguaucaccaagaaacgccccaggagaaauauuauggucagcaccacuuggaccagaccuaaacccauaccucucucaccuagcaagaauguauaacgguuaugcaggaggauucgaaguacaaguaauucuagcuggaaaugcuuuuacugccgguaaaaucauuuucgcugcaguuccaccaaacuuccccacagaaggacuuucaccaucacaaguaacaauguuuccccauauaauaguugacguucgacaauuagaaccaguuuuaauaccauugccagauguacgaaacaauuuuuaccacuauaaccaaucaaaugauucaacaauaaaacugauugcuaugcuauauacaccauuaagggccaacaacgcuggugaagaugucuuuaccguauccugucgaguauuaacacgaccaaguccagacuucgacuuuauauuuuuagucccaccuacuguagaauccagaacaaaaccauucaccguaccuauauuaaccguagaagagaugacaaauucaagauucccaauaccacuagaaaaacuauuuacagguccauccggagcauuuguuguacaaccacaaaacgguagauguacaaccgauggaguauuacuagguaccacucaacuaucaccuguaaauauauguacauuuagaggugauguaacacauauagccggaucuagaaacuauacuaugaaucuugcaagcuuaaauuggaacaauuaugauccaacagaagaaauaccagccccucuaggcacacccgacuuugucggaaaaauacaagguguacuaacacagacaacaaaaggagacggaucaacacgaggucauaaagcaacaguauacacaggcuccgcuccauucacaccuaaauuaggcucaguccaauucucaacugacaccgaaaaugauuucgaaacacaucaaaauacaaaauucacaccaguugggguaauacaagauggcagcacaacccauagaaaugaaccacaacaauggguccuacccuccuauagcggaagaaauguccauaacguucaucuagcuccagccguagcaccaacauuuccaggagaacaauuacucuucuucagaucuacaaugccaggaugcucaggauauccaaacauggauuuagauuguuuacuuccacaagaauggguucaacacuuuuaucaagaagcagcaccagcacaaucugauguagcauuacuaagauucguaaauccagacacaggcagaguacuauuugaaugcaaauuacacaaaucaggauauguaacaguagcucauacaggacaacacgaucuaguuauaccucccaauggauacuucagauuugacuccuggguaaaucaauuuuacacauuagccccaauggguaacggaacaggaagaagaagagcccuauaa

SEQ ID NO: 32947 - RNA, 1623 nt, Artificial Sequence
  derived and/or modified sequence opt6 from major_capsid_protein__Norovirus__AFU92666
augaaaauggcaucuaaugacgcaaacccaagugauggauccgcagccaaucuaguaccugaaguuaauaaugaagucauggcacucgaaccaguuguaggagcagcuauagcugcaccaguagccggccaacaaaaugucauugacccauggauaagaaacaauuuuguucaagcaccaggcggcgaauuuacuguuucaccaagaaaugcaccaggagaaauacuaugguccgcacccuuaggaccagacuuaaaucccuaccuaucccauuuagcuagaauguacaauggauacgcuggaggcuuugaaguucaaguaauauuagcaggaaaugcuuuuacagcaggaaaaauaauuuuugcagcaguaccaccaaacuuucccacugaaggacuuaguccaucacaaguuacaauguucccccauauaauaguagacguaagacaacuagaaccaguauuaaucccacuaccagauguacggaauaauuuuuaucauuauaaccaaucaaaugacucgacaauaaaacuaauagcuaugcucuacacaccauugcgcgcuaauaaugcaggagaagacguauuuacaguaucaugcagaguccuaacacgaccaucacuagacuuugacuuuauauuccuaguaccaccaaccgucgaaucaagaacaaaaccauuuacaguaccaauacuuacaguugaagaaaugacaaacucuagauucccaauaccauuagaaaaacuauuuacugguccaucuggagcauucguaguacaaccucaaaacggaagauguacaacugauggaguacuacuaggaacaacacaauuaucgcccguaaacauaugcacauuuagaggagauguaacacacauagcaggaucacgaaauuacacaaugaauuuagcaucauuaaacuggaacaacuaugauccaacagaagaaacaccagcaccauuaggcacaccagacuuuguaggcaaaauccaaggaguauuaacacaaacaacuaaaggagacggaucaacuagaggacauaaagcaacaguauacacaggaucagcaccauucacaccaaaauuaggaucaguacaguuuuccacagauaccgaaaacgauuuugaaacacaucaaaauacaaaauuuacacccguaggaguaauacaagauggaggcacuacccaccgcaaugaaccucaacaauggguguuaccaucauauagcggacgaaauguccauaacguacacuuagcccccgcaguagcaccuaccuuuccaggagaacaacuucucuucuuuagaucaacaaugccaggcuguuccggauauccaaauauggaucuagacugccuccuaccacaagaauggguacaacauuucuaccaagaagcagcccccgcacaaucagacguagcuuuacuacguuuuguaaauccagacacuggaagaguacuuuuugagugcaaacuacauaaaucuggauaugucacuguagcacacacaggccaacacgauuugguuauaccaccaaauggauauuuucguuucgauucauggguaaaucaauuuuacacacuagcaccaaugggaaaugguacaggaagacgacgcgcauuauaa

SEQ ID NO: 32948 - RNA, 1623 nt, Artificial Sequence
  derived and/or modified sequence opt6 from major_capsid_protein__Norovirus__AFU92667
augaaaauggcaucaaaugaugcuacaccaucagauggaguagcagcucaucuaguaccugaaguaaauaaugaaguaauggcuuuagaaccaguaguuggagccgcaauagcagccccuguagcaggacaacaaaaugucauagaccccuggauccgaaauaacuuuguccaagcuccaggcggagaauucacuguaagcccacgaaacgcaccaggugaaauacuauggucagcaccccuaggaccagaucuaaauccuuaccucucacacuuagcacgcauguacaacggauacgcaggaggcuuugaaguccaaguuauuuuagcuggaaaugcauuuaccgccggaaaaauaauuuuugcagcuguaccaccaaauuuucccacagaaggacuaucacccucacaaguuacaauguuuccacacaucaucgucgauguccgacaacuagaacccguuuuaauaccacuacccgauguaagaaacaauuuuuaucacuauaaucaauccaaugacuccacaauaaaauuaauagcuaugcuauacacaccuuuacgagcuaauaacgccggagaagacguauuuacaguaucaugcagagucuuaacacgaccuucaccugauuucgauuucaucuuuuuaguuccaccaaccguagaaucaagaacuaaacccuuuacaguaccaauucuaacagucgaagaaaugaccaauucucgauuuccaauuccucuagaaaaauuauucaccggcccaucaggagcuuuuguaguacaaccccaaaacggucgauguacaacagacggaguacuuuuaggaacaacacaauuaucaccagucaacauauguaccuucagaggcgacguaacacacauagcaggaucuagaaauuauacaaugaauuuagccucacuaaauuggaacaauuacgacccaaccgaagaaaucccagcaccucuaggaacaccugacuucguagguaaaauacaaggaguauuaacccaaacaacuaaaggcgauggaucaacaagaggacacaaagcaacaguauauacuggaucagcaccauuuacaccuaaauuaggaucaguacaauucucuacagacacugaaaaugauuucgaaacacaccaaaauacuaaauucaccccaguaggcguuauucaagacggagguaccacccauagaaaugaaccacaacaauggguacucccaucuuacucuggaagaaacguucauaacguucauuuagccccugcaguagcaccaaccuuccccggugaacaacuuuuauuuuuuagaucaacaaugcccggauguuccggauauccuaauauggaucuugauugucuuuuaccacaagaauggguacaacauuucuaucaagaagcagcaccagcacaaucugauguagcauuacuacgauuuguuaacccagauacuggaagaguacuuuucgaauguaaauuacauaaaucuggauauguaacagucgcacauacaggacaacaugaccuaguaauaccaccuaacggauauuuuagauuugauagcuggguaaaucaauuuuauacacuagcuccaaugggaaaugguacuggaagacgacgagcucucuaa

SEQ ID NO: 32949 - RNA, 1623 nt, Artificial Sequence
  derived and/or modified sequence opt6 from major_capsid_protein__Norovirus__AFU92668
augaaaauggcuuccaaugauguuacaccaucagacggaucagccgcuaaucuaguaccagaaguaaauaacgaagucauggcauuagaaccaguaguuggagcagcaauagcugcaccagucgcaggucaacaaaacguaaucgacccuuggauaagaaauaacuuuguccaagccccaggcggcgaauucacaguaucaccacguaaugcaccaggagaaauauuaugguccgcaccauuaggaccagaucuaaauccauaucuaagccaucuagcacgaauguauaaugguuaugcuggaggauuugaaguacaaguuauacuagcagguaacgcauuuaccgcaggcaaaaucauauucgcagcuguuccuccaaacuucccgacugaaggcuuauccccaagucaaguaacaauguucccacauauuauaguagacguacgccaauuagaaccaguauuaauaccuuuaccagauguaagaaacaauuucuaccauuauaaccaaucuaaugauaguaccauuaaacuuauagcaauguuauauacaccacuaagagcaaacaaugcuggugaagauguauucacaguaucauguagaguuuuaaccagacccucuccagauuuugacuuuaucuuuuuaguucccccaacaguagaauccagaacaaaaccauuuacuguuccaauccuaacaguagaagaaaugacuaacaguagauuuccaaucccacuagaaaaauuauuuaccggaccaucaggagcauuuguaguacaaccccaaaacgguagauguacaacagacggaguccuccuagguacaacacaauuaucuccaguaaacauaugcacuuuucgaggcgacgucacacauauugcuggaucaagaaauuauacuaugaaucuagccucauuaaauuggaacaauuaugacccaacagaagaaauaccagcaccccuuggaaccccagauuuuguuggaaaaauacaaggagucuuaacucaaacuaccaaaggagauggaucaacuagaggucauaaagcaacaguauauacaggauccgccccauuuacacccaaacuaggaaguguacaauuuucaacugacacagaaaaugacuuugaaacacaccaaaauacaaaauucacccccguuggagucauccaagauggcggaacaacacaucgaaaugaaccacaacaauggguacuaccaucauacucuggaagaaauguacauaauguacauuuagcucccgcuguagccccaacauuuccaggagaacaauuauuauucuuuagaucuacuaugccaggauguagcggcuacccaaauauggauuuagacugucuacuaccacaagaauggguacaacauuuuuaccaagaagcggcuccagcacaaagcgacguugcuuuauuacgauuuguuaacccugauacaggacgaguacuauucgaauguaaauuacauaaaucaggauauguaacaguagcacauacaggacaacacgauuuaguaauacccccaaauggauauuuccgauuugacucgugggucaaucaauuuuauacucuagcaccaaugggaaauggaacaggaagaagaagagcauuauaa

SEQ ID NO: 32950 - RNA, 1623 nt, Artificial Sequence
  derived and/or modified sequence opt6 from major_capsid_protein__Norovirus__AFU92669
augaaaauggcaucaaaugacgcaaauccaucagacggaucagcagcuaacuuaguaccugaaguaaauaaugaaguaauggcauuagaaccaguuguaggagcagcaaucgccgcaccagucgcaggacaacaaaauguuauugaccccuggauacgaaacaauuuuguucaagcaccaggcggugaauucacaguaagcccacgaaaugcaccaggagaaauauuauggucagcaccacuaggucccgaccuaaacccauaccuaucucaccuagcuagaauguauaauggauacgcaggaggguucgaaguacaaguaauacuagcaggaaacgccuuuacagcaggcaaaauuaucuucgcagcaguaccaccuaacuuuccuacugaagguuuaucuccaucacaaguaacaauguucccucauauaauaguagacguacgacaauuagaaccaguuuuaauuccacugccagacgucagaaauaauuuuuaucacuacaaucaaagcaaugacucaacaauuaaauuaauagcaauguuauacacuccauuaagagcaaauaaugcaggagaagacguuuuuacaguaucauguaggguccuuacaagaccuucaccugauuuugauuucauauucuuagucccaccaacaguagaaucaagaacuaaaccuuucacaguacccauauuaacaguagaagaaaugaccaacucucgcuuuccaauaccacuggaaaaacuauuuaccggaccaucaggagcauucguaguacaaccacaaaacggaagaugcacaacagacggaguacucuuaggaaccacucaacuuuccccagucaauauaugcacauucaggggagacgucacacacauugcagguuccagaaauuacacaaugaaccucgccuccuuaaauuggaauaauuacgaccccacugaagaaaucccagcgccacuaggaacaccagacuucguaggaaaaauucaaggaguacucacacaaaccacaaaaggugacggaucaacaagaggucauaaagcaacuguauauacaggaucagcuccuuuuacaccaaaacuagguucaguccaauuuuccacagauacagaaaaugauuucgaaacccaccaaaacacuaaauucacaccaguaggaguaauccaagacggaggaacuacacaucgaaaugaaccucaacaauggguauuaccaucuuauucaggccguaauguacacaacguucaucuagcaccagccguugcacccaccuuuccaggugaacaacuacuuuuuuuucgcucaaccaugccaggaugcucaggcuacccaaauauggaucuagauugcuuauuaccacaagaauggguccaacauuuuuaucaagaagcagcacccgcucaauccgacguagcauuauuaagauucguuaauccagacaccggcagaguacuuuucgaaugcaaacuacauaaauccggcuauguaacaguagcacauacaggucaacaugaccuaguaauaccaccaaacggauacuucagauuugauucauggguaaaucaauuuuacacacucgccccaaugggaaacggaacuggcagaagaagagcacuauaa

SEQ ID NO: 32951 - RNA, 1623 nt, Artificial Sequence
  derived and/or modified sequence opt6 from major_capsid_protein__Norovirus__AFU92670
augaaaauggcaagcaacgacgcaaacccaucagauggaagugccgccaauuuaguuccugaaguaaacaaugaaguaauggcccuagaacccgucguaggagccgcaaucgcagcaccaguugcaggacaacaaaauguaauagacccauggauaagaaauaacuuuguucaagcaccuggcggugaauucacuguaaguccucgaaaugcacccggagaaauauuauggagagcaccacuagguccagauuuaaauccauaccuuagucacuuagccagaauguauaauggauaugcaggaggauucgaaguucaaguaauauuagcaggaaacgcauuuacagccggaaaaauuauuuucgcagcaguucccccaaauuuuccaacagaaggccugucacccagucaaguaacgauguuuccacacauaauuguugacgugagacaacuagaacccguucuaauaccacuuccagauguaagaaacaauuuuuaucacuauaaccaaucaaaugauucaacaauaaaacuaauugcaaugcuauauacaccacuaagagcaaacaaugcaggagaagaugucuuuaccguaagcuguagaguauuaacuagaccauccccagauuuugauuuuauuuucuuaguaccacccaccguagaaucuagaacaaaacccuuuacaguaccuauacuaacagucgaagaaaugacaaacucaagauuuccaauuccacucgaaaaacuauucacuggaccaucaucugcauuuguaguacagccccaaaauggaagaugcacaacagacgguguuuuauuagguacaacucaacuaucuccuguuaauauauguacguucagaggcgacguuacacauauagcaggaucaagaaauuacacuaugaacuuagcaucauuaaauuggaacaauuaugacccaacugaagaaguaccagcaccacugggaacacccgauuucguuggaaaaauacaagguguacuaacacaaacaacuaaaggagauggaucaacaagaggucacaaagcaacuguauacacagguuccgccccauuuacuccaaaauuaggaucaguacaauuuucaacagacacugaaaacgauuuugaaacacaucaaaacacaaaauucacaccaguuggaguaauacaagaugguaguacuacacaucguaaugaaccacaacaauggguacucccaucauauuccggccgaaauguacauaacguacaccuagcaccagcuguagcaccaacauuuccaggugaacaauuauuauucuuuagaucuacaaugccaggaugcagugguuauccaaauauggaucuugacugccuauugccacaagaauggguacaacacuucuaucaagaagcagcaccagcacaaucagacguagcacuacuaagauuuguaaacccugacacuggaagaguauuauucgaaugcaaauuacauaaaucagguuauguaacaguagcacauacuggacaacaugauuuaguaauaccuccaaacgguuauuuuagauuugauucauggguaaaucaauuuuacacuuuagcaccaauggguaacggaacaggcagaagaagagcacuauaa

SEQ ID NO: 32952 - RNA, 1623 nt, Artificial Sequence
  derived and/or modified sequence opt6 from major_capsid_protein__Norovirus__AFU92671
augaaaauggccucuucagacgcaaaucccagcgauggaucuacagcaaaccuagucccagaaguuaacaaugaaguuauggcauuagaacccgucguaggagcagcaauugcagccccaguagcuggucagcaaaauguaauagaccccuggauacgaaacaauuuuguacaagcaccaggaggcgaauuuacuguuucaccucgaaacgcaccuggagaaauacuauggucagcaccauuagguccagauuuaaauccauauuuaucacauuuagcacgaauguacaauggcuaugcaggagguuucgaaguacaaguaauauuagcuggaaaugcuuucacagcuggaaaaauaauauucgcagcaguaccaccaaacuuuccaacugaaggauuaucacccagucaaguuacaauguuuccccauauaauaguugacguuagacaauuagaacccguauuaaucccauuaccagacguuagaaauaauuuuuaucacuauaaucaaucaaaugauccaacuauaaaauuaauagcuauguuauauacaccucuaagagcaaacaaugcaggagacgauguauuuaccguaucauguagaguauuaacucgcccaucaccagacuuugacuuuauauucuuaguaccaccaacaguagaaagccggacuaaaccauuuucaguaccuauacuaacaguagaagaaaugacaaauucaagauuucccauaccauuagaacgccuauuuacaggcccaucuuccgcauucguuguacaaccucaaaacggaagauguaccacagacggaguacuacuaggcaccacacaauugucaccagucaauauuuguacauuuagaggagacguaacacauauagcugguacacaggaauacacaaugaaccuagcaucacaaaauuggaauaauuaugauccuacagaagaaauuccagcaccauuagguacaccagacuuuguaggaaaaauucaaggaguacuaacccaaacaacaagaagagacggaucaacacguggucacaaagcuacagucucaacaggaagcguacacuuuacuccuaaauuaggaagaauccaauuuucaacagauacaucaaacgacuucgaaaccggccaaaauacuagauuuacaccaguaggcguaguccaagacgguucaacaacacaccaaaacgaaccacaacaauggguucuaccugauuauuccggaagagauucacauaauguacacuuagcaccugccguagcacccucuuuuccaggagaacaacuccuauuuuuuagaucaacaaugccuggcuguucuggauaucccaacaugaaccuagacugcuuacuaccacaggaauggguucaacacuuuuaucaagaagcagcaccagcacaauccgauguagcauuacucagauucguuaauccagauacuggacgcguauuauucgaauguaaauuacacaaaucaggauacguaacaguagcacacacaggacaacacgaucuaguaauaccaccaaauggauacuuuagauuugauucauggguuaaucaauuuuacacuuuagcaccaaugggaaaugguacuggaagaagacgagcucuauaa

SEQ ID NO: 32953 - RNA, 1623 nt, Artificial Sequence
  derived and/or modified sequence opt6 from major_capsid_protein__Norovirus__AFU92672
augaaaauggcaaguaacgacgccaauccaucagacgguucagcagcaaauuuaguaccagaaguuaacaaugaagucauggcccuagagccaguaguaggcgcugccauagcagcuccuguagcuggccaacaaaauguaauugacccauggauaagaaauaacuucguucaagcuccaggaggagaauucaccguaucaccaagaaaugcacccggugaaauuuuaugguccgcacccuuaggaccagaucuaaauccauaccuaucacaucuagcccgaauguauaacggauacgcaggaggauucgaaguacaaguaauccuagcuggaaaugccuucacagccggaaaaauaauuuuugcagcaguaccaccaaacuucccaacagaaggucuaucuccaucacaaguaacaauguuuccucacaucauuguagauguacgacaauuagaaccaguacuaauaccauuaccugauguacguaacaacuucuaucacuauaaccaaucaaacgacucaaccauuaaacuaauagcaauguuauauacaccacuacgugcaaacaaugcaggagaagaugucuuuacuguuuccuguagaguauuaacccgcccauccccagacuuugacuuuauauuuuuaguuccuccuacaguagaaagccgaacuaaaccauucacaguuccuauauuaacaguugaagaaaugacuaauucucgauucccaaucccauuagaaaaauuauuuacagguccuucuggagccuuuguaguacaaccacaaaauggucgauguacaacagacggaguauuacuaggcacaacacaacuaucacccguaaauaucugcacauuuagaggugacguuacacauauagcaggaucucgaaacuacaccaugaaccuagcuucccuaaacuggaacaauuaugacccaacugaagaaacuccagcaccuuuagguacaccagacuuugucggaaaaauacaagguguacuaacacaaacuacgaaaggagauggaucaacucgaggacauaaagcuacuguauacacaggcucagcaccauuuacuccaaaauuaggcucuguccaauuuucaacagauacagaaaaugauuuugaaacacaucaaaauacaaaauuuacaccaguuggaguaauacaagacggaggcaccacacacagaaaugaaccacaacaauggguacuuccuucauacucagguagaaauguacacaauguacaccuugccccugcaguagcaccaacuuuucccggagaacaauuauuauucuuucgcuccacuaugccaggaugcucaggauauccaaacauggaucuagauugcuuacuaccacaagaauggguacaacacuucuaucaagaagcagcaccagcccaaagugacgucgcacuacuaagguuugucaaucccgacacaggaagaguacuauucgaaugcaaauuacauaaaucaggauauguaacaguagcacacacaggccaacacgacuuaguaaucccaccaaaugguuacuucagauuugauucauggguaaaucaauucuacacacuagcuccaaugggaaacggaacuggaagacgacgagcauuauaa

SEQ ID NO: 32954 - RNA, 1623 nt, Artificial Sequence
  derived and/or modified sequence opt6 from major_capsid_protein__Norovirus__AFU92673
augaaaauggcaucaaaugacgcaaauccaucagauggcucagccgcaaacuuaguuccagaaguuaacaaugaaguaauggcauuagaaccgguaguaggagcagcaaucgcagcaccaguagcaggacaacaaaauguaaucgacccauggauacguaauaauuucguacaagcaccagguggcgaauuuacaguaucuccacgaaaugcuccaggagaaauacuauggagcgcaccacuaggaccugacuuaaaucccuaucuuucacacuuagcaagaauguauaacgguuacgcaggaggauuugaaguacaaguaauuuuagcugguaacgccuuuacagcaggaaaaauaauauuugcagcagucccaccaaauuuuccaacagaaggauuaucgcccucucaaguaacaauguuuccacauauaauaguugauguaagacaacucgaaccaguauuaauaccacuaccagacguaagaaacaacuucuaucauuacaaucaaaguaaugauucaacaauaaaacuuauagcaaugcucuauacuccauuacgagcuaauaaugcaggagaagauguauucacugucucuugcagaguauuaacaagaccaaguccugacuucgauuucauauuucuagugccaccaacaguagaaucaagaacuaaacccuucacagucccaauucuaacaguagaagaaaugacaaacucuagauuucccauaccacucgaaaaacuuuuuacaggacccucaggugcauucgccguacaaccacaaaacggcagaugcacaacugacggaguacuauuaggaacaacacaauuauccccagucaauauuuguacauuucgaggagauguaacucacauagccggaucuagaaacuacacuaugaaccuagcaucacuaaauuggaacaauuacgauccaacagaagaaaucccagcaccauuaggcacgccagacuucguaggaaaaauucaaggcguccuuacucaaacuacaaaaggugacgguucaacacgaggacacaaagcaacgguuuauaccggauccgcacccuuuacuccaaaauuaggaucaguacaauucucaaccgauaccgaaaaugauuucgaaacccaucaaaacaccaaauucacaccaguuggcgucauacaagacggcggaacaacucauagaaaugaaccacaacaauggguacuaccaaguuauucuggaagaaauguacacaauguacacuuagcaccugcuguagcaccaaccuuuccaggagaacaauuauuauucuuucgcucaaccaugcccggaugcuccgguuauccaaacauggaucucgauuguuuacuuccacaagaauggguacaacacuuuuaucaagaagcagcaccugcacaaucagacguagcacuacuuagauucguaaacccagacacaggaagaguacuauuugaauguaaauuacauaaaucgggcuaugccaccguugcacauacaggacaacacgacuuaguaauaccaccaaauggauacuuuagauucgauucauggguaaaucaauuuuacacacuagcacccaugggaaacggaacaggaagacgaagagcccuuuga

SEQ ID NO: 32955 - RNA, 1623 nt, Artificial Sequence
  derived and/or modified sequence opt6 from major_capsid_protein__Norovirus__AFU92674
augaaaauggcgucaaaugacgcacauccaagugauggcucugcagccaacuuaguucccgaaguaaacaaugaaguaauggccuuagaaccuguaguuggagcagcaauagcugcuccaguagcaggacaacaaaauguuauagaccccuggauaagaaauaacuuuguacaagcucccgguggcgaauucacaguaucaccaagaaaugcacccggagaaauccuaugguccgccccacuaggaccagauuuaaacccauauuuaagucacuuagcaaggauguacaacgguuacgcaggcgguuucgaaguacaaguaauauuagccgguaaugcuuuuacagcagguaaaauuauauucgcagccguuccaccaaacuucccaacagaaggccuuaguccuucucaaguuacaauguucccucacauaauaguagacguacgacaacuagaaccaguacuaauacccuuaccugauguaagaaacaauuucuaccauuauaaccaaucaaaugacucaacaauaaaacuaauagcaauguuauacacaccauuaagagcaaacaaugcaggcgaagauguauuuaccguuucauguagaguacuaacacgaccaagcccagauuuugauuuuauauucuuaguaccuccaacagucgaaucuagaacuaaacccuuuacaguaccaauacuaacagucgaagaaaugacaaacucaagauuuccaauaccacuagaaaaauuauuuacaggaccaucuggagcuuucguaguacaaccucaaaauggucgauguacaacugacgguguccuauuagguaccacacaauuaucaccaguaaauauaugcaccuuuaggggcgacguaacucauauagcaggcucaagaaacuauacaaugaaucucgccucacuuaacuggaccaacuacgauccaacagaagaaauaccagccccacuagguacacccgacuucgucgguaaaauacaaggaguccuaacacaaacaaccaaaggagaugguucaacaagaggucauaaagccacaguauauacagguucagcuccauuuacaccaaaauuaggaucuguacaauucucaacagauacagaaaacgacuucgaaacacaccaaaauacaaaauuuacaccaguaggagucauacaagauggaggaacaacccauagaaacgaaccccaacaauggguucuacccucauacucaggaagaaauguacacaacguacacuuagcaccugcaguagccccuacauuuccuggagaacaacucuuauucuuuagaucaacaaugccaggauguuccggauauccaaauauggaccuagauugcuuacuaccccaagaauggguacaacauuuuuaucaagaagccgcuccagcucaaucagauguagcacuucuacgauucgucaauccagacacuggaagaguauuauucgaaugcaaauuacauaaaucuggauauguaacaguagcacauacaggacaacacgaucuaguaaucccuccaaauggauauuucagauuugauucauggguaaaucaauucuacacacuagcaccuaugggcaauggaacaggccgacgacgugcauuauaa

SEQ ID NO: 32956 - RNA, 1623 nt, Artificial Sequence
  derived and/or modified sequence opt6 from major_capsid_protein__Norovirus__AFU92676
augaaaauggcuucaucagaugcucaccccucagacggaucaacagcaaaccuaguuccagaaguuaauaaugaaguaauggcauuagaaccaguagucggugcagcaauugcagcaccaguugcaggacaacaaaacgucauagacccauggauuagaaauaacuucguccaagcaccaggaggugaauuuacugucucacccagaaacgcaccaggcgaaaucuuauggagugcacccuuaggaccagauuuaaauccauauuuaucacaucucgcaagaauguauaacucauacgcaggagguuuugaaguucaaguaauccuugcaggaaaugcauuuacugcaggaaaaaucauauuugcugcaguuccaccaaauuuuccaacagaaggacuaucaccaucacaagucacaauguucccccacauaauaguugauguaagacagcuagaacccguacuaauuccacuuccagacguuagaaacaauuucuaucacuauaaccaaucaaacgacccuaccauaaaauuaauagcuaugcuauauacuccauuacgagcaaauaaugcaggagacgauguauuuacaguaucuugucgaguucuaacacgaccaucaccugauuuugauuuuauauuucucguaccacccacaguagaaucaagaacaaaaccauuuucaguaccaauacuuaccguagaagaaaugacaaacucaagauuucccauaccauuagaaaaauuauucacaggaccauccucagcauucguaguucagccucagaacggcagaugcacaacagauggaguccuacuaggcaccacacaauuaucuccaguuaauauauguaccuucagaggagauguuacucauauagcuggaacacaagaguacacaaugaacuuagcaucacaaaacuggaacaacuacgauccuacagaagaaauaccugcuccucuaggaacacccgacuucguaggaaaaauacaaggaguacucacacaaaccacaucuagagacgggucaacaagaggucauaaagcaacaguauccacaggaucaguacacuuuacuccaaaauuaggacgaguucaauucaguaccgacacauccaaugauuucgaaacaggucaaaacacacguuuuacaccuguagguguaguucaagauggaucuacaacacaucaaaacgaaccacaacaauggguccuaccaaauuauucuggaagagacucacauaauguucauuuagcaccugcgguagcaccuucuuuuccaggggaacaacuucuauuuuucagaucaacaaugcccggaugcucaggcuacccuaacaugaacuuagacugcuuacuaccccaagaauggguacaacacuuuuaucaagaagcagcaccagcacaaucagacguugcauuacuaagguucguaaaucccgauacaggaagaguacuauucgaaugcaaacuacauaaaucaggauacguaacagucgcacauacaggacaacacgaccuaguuauacccccgaacggauauuucagauuugauucaugggucaaccaauuuuacacacuagcaccaaugggcaauggaacaggucgacgcagagccuuauaa

SEQ ID NO: 32957 - RNA, 1623 nt, Artificial Sequence
  derived and/or modified sequence opt6 from major_capsid_protein__Norovirus__AFU92677
augaaaauggcauccaaugacgcccauccuuccgacggaucagcagcaaacuuaguaccagaaguuaauaaugaagucauggcuuuagaaccagugguaggagcagcaauagcagcaccagucgcuggucaacaaaacguaauagaucccuggauaagaaauaacuuuguacaagccccuggaggagaguuuacaguaucaccuagaaacgcaccuggcgaaauccuuuggagugcaccauuaggaccagaucuaaaucccuaucuaucucaccuagcaagaauguauaacgguuacgcaggaggauucgaaguacaaguaauauuagccggaaaugcuuucacagcaggcaaaauaauuuucgcagcuguccccccaaauuucccaacugaaggauuaucacccucucaaguaacaauguucccacacauuauaguagauguacgacaacucgaaccaguccuaauaccauuaccagauguaagaaauaauuuuuaucauuacaaucaauccaaugacagcacaauaaaauuaauagcaaugcuauacacuccacuaagagcaaacaaugcaggugaagauguauuuaccguaucaugcagaguacuaacacgaccaucacccgauuucgacuucauauuccuaguaccaccaacaguagaaucaagaacaaaaccauucacagucccaauacucacaguggaagaaaugacaaacagccguuuucccauaccacucgaaaaacuauucacaggaccaucaggagcauuuguuguacaaccacaaaacggaagaugcaccacagacggaguuuuauuaggaacaacacaacuuaguccaguaaauaucuguacauuucgaggagacguaacccauauagcagguucuagaaacuauacaaugaauuuagcaucauuaaacuggaauaacuacgauccuacagaagaaaucccugccccucuagguacuccugauuuuguaggaaaaauacaaggaguauuaacucaaacaacuaaaggagacggaagcacacgaggccauaaagcaacaguauauacagguucagcuccauucacaccaaaacuuggaucaguccaauucaguacagauacagaaaacgauuuugaaacacaucaaaauacaaaauuuacaccaguuggagucauacaagauggaggcacaacacauaggaacgaaccacaacaauggguacucccuuccuauucagguagaaacguacauaacguacauuuagcaccagcaguagcaccaacauucccaggagaacaacuacuauucuuuagaucaacaaugccagguugcucuggauauccaaacauggaucuugacuguuuacuaccucaagaauggguacaacacuucuaucaagaagcagcaccagcacaaucagacguagcacuacuccguuucgucaaccccgacaccgguagaguccuauuugaauguaaauuacauaaaucagguuauguuaccguugcacacacuggacaacaugacuuagucauacccccuaauggauauuuuagauuugacucaugggucaaccaauuuuauacacuagcaccaauggguaacggaacaggaagaagaagagcacuuuaa

SEQ ID NO: 32958 - RNA, 1623 nt, Artificial Sequence
  derived and/or modified sequence opt6 from major_capsid_protein__Norovirus__AFU92678
augaaaauggcaucaaaugaugcgaacccaucagauggcuccgcagcuaacuuaguaccagaaguaaacaaugaaguaauggcucuugaaccugucguaggcgcagcgauagcagcaccaguagcaggccaacaaaaugucauagacccauggauccguaacaacuuuguacaagcaccaggcggugaauuuacaguauccccacgaaaugcaccaggagaaauucucuggucagcaccucuaggaccagauuuaaacccauaccuuucacaccucgcaagaauguauaaugguuaugccggugguuucgaaguccaaguaauacuagcaggaaaugcauucacagcagguaaaaucauauuugcagcuguaccaccaaauuuuccaacagaaggauuaaguccaagccaagucacaauguuuccacacauaauuguugauguucgacaauuagaaccuguacuaauaccuuuaccagauguacgaaacaauuucuaucauuauaaccaaaguaacgauucaacaaucaaacuuauagcuauguuauauacaccacuaagagcaaauaaugcuggcgaagacguauucacugucucauguagaguuuuaacacguccuucaccagacuuugacuucauauuccuaguaccccccacaguagaaucacgaacaaaaccauuuacaguaccaauacuaacaguggaagaaaugacaaacucaagauuuccaauaccacuagaaaaauuauuuacaggaccaucaggagcauuuguaguacaaccacaaaacggaagauguacuacugacgguguucuacuugguacaacgcaauuaucaccaguaaauauaugcacauuuagaggugauguaacacauauagcaggaucaagaaacuauacaaugaauuuagcaucacuaaacuggaauaauuacgauccaacugaagaaauaccugccccucuaggaacccccgacuucguaggcaagauucaagguguauuaacucaaacuacuaaaggagauggaucaacacgcggacauaaagcaacaguauacacaggaucagcuccauuuacaccuaaauuaggaucuguacaauucucaacagauacagaaaacgauuucgaaacacaccaaaauacaaaauucacuccaguaggaguuauacaagacggaggaacaacacaucgaaaugaaccacaacaauggguacuaccaucauauucaggacgaaacguccauaauguacauuuagccccagccguagcaccuacauuuccaggagaacaauuauuauucuuuagauccacuaugccaggcugcucaggauaucccaauauggauuuagacugccuucuaccucaagaauggguccaacauuucuaucaagaagcagcaccagcccaauaugacgucgcucuauuacgauuuguuaauccagacacuggaagaguauuauucgaauguaaacuacauaaauccggauauguaacaguagcacacacaggccaacaugaucuagucauuccaccaaauggauauuucagauuugacucauggguaaaucaauuuuacacuuuagcaccuaugggaaauggaacuggaagaagaagagccuuauaa

SEQ ID NO: 32959 - RNA, 1623 nt, Artificial Sequence
  derived and/or modified sequence opt6 from major_capsid_protein__Norovirus__AFU92679
augaaaauggcaucaaacgaugcaaacccauccgauggcucugcugcuaacuuaguaccugaagucaauaacgaaguaauggcacuagaaccaguuguaggagccgcaauagcagcaccagucgcuggacaacaaaauguaauagauccauggauaagaaacaacuucguacaagcaccuggaggagaauuuacaguuucaccaagaaaugcaccaggagaaaucuuauggucagcaccauuagguccagaccuuaaucccuaccuaucacauuuagcacguauguacaacggcuacgcaggaggauuugaaguacaaguaauucuagcaggaaaugcauuuacagccggaaaaauuauauuugccgcaguaccaccaaauuuuccuacagaaggucucucaccaucacaagucacuauguucccacacauuauaguagauguaagacaacuagaaccaguacuaauaccauuaccagauguuagaaacaacuucuaucacuauaaccaaucaaaugacucaacaauuaaauuaauagcuaugcuauacacccccuuaagagcuaacaaugcaggagaagauguauucaccguaucauguagaguacuaacaagaccaucuccugaauuugacuuuauauuucuagucccucccacaguagaaucccgcacaaaaccauuuaccguaccaauacuaaccguagaagaaaugacaaauuccagauuuccaaucccauuagaaaaacucuuuacaggaccaucuggagcauuuguaguccaaccccaaaacggcagauguacaaccgacggaguauuacuaggaacaacacaauuaucaccaguaaacauauguaccuucagaggagacguaacacauauagccggaucaagaaauuauacaaugaauuuagccucuuuaaacuggaauaauuaugauccaacagaagaaauaccggcaccccuagguacucccgacuuuguaggaaaaauacaagguguauuaacccaaacaacaaaaggagauggaucaacaagaggucauaaagccaccgucuauacuggaagcgcucccuuuacaccaaaauuaggaucaguccaauuuucaacagauaccgaaaacgauuucgaaacccaucaaaauaccaaauucacuccaguuggaguaauucaagacggugggacaacacauagaaaugaaccacaacaguggguacuaccaucauacagcgguagaaauguacauaauguacaucuagcaccagcagucgccccaaccuuuccaggugaacaauuacucuucuuuagaucuaccaugccagguugcucaggauauccaaauauggaucuagauugcuuacucccacaagaauggguacaacauuucuaccaagaagcagcucccgcacaaucagauguagcauuacuacgauucguuaacccagauacuggaagaguucuauucgaauguaaacuacacaaauccggcuauguaacaguagcacauacuggacaacaugauuuaguaauaccuccaaacggcuacuucagauucgauucuuggguaaaucaauuuuacaccuuagcuccaaugggaaauggaacaggccgaagaagagcuuuauaa

SEQ ID NO: 32960 - RNA, 1623 nt, Artificial Sequence
  derived and/or modified sequence opt6 from major_capsid_protein__Norovirus__AFU92680
augaaaauggcaucaaaugacgcaaauccgucagauggaucagcagcuaauuuaguaccagaagucaauaaugaaguaauggcauuagaacccguuguaggugcagcuauagcagcaccaguagcaggccaacaaaauguaauugaccccuggauaagaaacaacuuuguacaagccccgggaggagaauuuacaguauccccgagaaaugcaccaggagaaauauuguggucagcaccguuagguccagaucuaaauccuuaucucucacaucucgcaagaauguauaauggauacgcaggaggauucgaaguacaaguaauuuuagcaggaaacgcauuuacagccggaaaaauaauauuugccgcuguaccaccaaacuuuccaacagaaggauuaucgccaucucaaguaaccauguucccacacauaauaguagauguaagacaacuagaacccguacuaauaccauuaccagacguacguaauaauuucuaucacuauaaccaaucaaacgauaguacaauuaaacuaauagcuaugcuauacacaccauuaagagcaaacaaugcaggagaggauguauuuacaguuagcugcagaguacuaacacgaccuucuccugauuuugacuucauauuucuuguaccaccaacagucgaaucaagaacuaaaccauucaccguaccaauauuaacaguugaagaaaugacaaacucaagguuuccaauaccacuagaaaaauuauuuaccggaccaucaggagcuuucguaguccaaccacaaaacgguagauguacaaccgacggcguacuuuuagguacaacacaauuaagcccuguaaauauauguacauucagaggagaugucacacauauugcaggcucaagaaauuacacaaugaaucuugcaucacucaacuggaacaauuacgauccaacagaagagauaccagcaccucuaggaacaccagauuuuguaggcaaaauucaaggcgucuuaacacaaacaacaaaaggagauggauccacuagaggacacaaagcaacaguuuauacaggcucagcuccauucacaccaaaauuaggaucaguacaauuuucaacagauacagaaaacgacuuugaaacacaccaaaauacaaaauuuacaccuguaggagucauacaagauggcggaacaacacaucgaaacgaaccacaacaauggguacuucccagcuauucaggaagaaaugugcacaacguccaccuagcaccagccguagccccaacauuuccaggagaacaacuauuauuuuuuagaucaacaaugccaggaugcucaggcuaucccaauauggauuuagauugucuuuuaccacaagaauggguacaacauuucuaucaagaagcagcacccgcacaaucagacgucgcauuacuaagauuuguaaauccagacacaggccgugucuuauuugaauguaaacuacauaaaucaggauauguaacagucgcacacacaggacaacacgacuuaguaauaccacccaauggauauuuucguuucgauucauggguaaaucaauuuuauacacuagcaccaaugggaaauggaacaggacguagaagagcuuuauaa

SEQ ID NO: 32961 - RNA, 1623 nt, Artificial Sequence
  derived and/or modified sequence opt6 from major_capsid_protein__Norovirus__AFU92681
augaaaauggcuucaaaugacgcaaauccaucagauggaucagcagcaaauuuaguacccgaaguaaauaaugaaguaauggcacuagagccaguaguuggcgcagcuaucgcugccccaguagcaggacaacaaaauguaauugauccauggauaagaaauaauuucguacaagcaccaggaggagaauucacugucucacccagaaacgccccaggagaaauauuauggucugccccacuaggaccagaucuaaacccauaccuaucucacuuagcaagaauguacaacggauacgcgggaggauucgaaguacaaguaauucuagcaggaaacgcauuuacagcaggaaaaauaauauuugcagccguaccaccaaacuuucccacagaagguuuaagcccaucacaagucacaauguucccacauauaauaguagauguuagacaacucgaaccaguauuaauaccacuaccagauguuagaaacaauuucuaucauuacaaucaaucaaaugacucaacuauaaaacuuauagccaugcuauauacaccccuaagagcaaauaaugcaggagaagauguuuucaccguaucuuguagaguacuaacaagaccauccccugauuuugacuucauauuucuaguuccaccaacuguagaaucaagaacaaaaccauuuacaguaccaauauuaacuguagaagaaaugacuaacucuagauuuccaauaccauuagaaaaacuauuuacaggucccaguuccgcauuuguagugcaaccacaaaacggucgauguacaacagacggaguauuacucggaacaacacaacuaucuccuguaaauauaugcacguuuagaggagacguuacacauauagcaggcucaagaaauuauacaaugaaccuagcuagucuuaacuggaauaacuacgaucccacugaagaaauacccgccccacuaggaacaccugacuucguagguaaaauucaaggaguacuaacacaaacaacaaaaggcgauggcucaacuagaggccacaaagcaacagucuauacuggauccgcaccauucaccccaaaauuaggauccguacaauucucaacugauaccgaaaacgauuucgaaacacaccaaaacacaaaauucacaccaguuggaguaauacaagacggauccacaacacauagaaaugaaccucaacaauggguacuaccaucauacuccggcagaaacguacacaauguacauuuagcaccugcaguagcacccacuuucccuggagaacaacuucucuuuuuuagauccacaaugccaggaugcucuggauacccaaauauggauuuagacugcuuauuaccacaagaauggguacaacacuucuaucaagaagcugcaccagcacaaucagacguagcgcuacugagauuuguaaaccccgauacaggaagaguauuauucgaaugcaaacuacacaaaaguggcuauguaacagucgcucauacaggacagcaugauuuaguaauaccaccaaauggauauuuuagauucgauaguugggucaaccaauuuuacacauuagcaccaaugggaaacggaacuggaagacgacgcgcacuauaa

SEQ ID NO: 32962 - RNA, 1623 nt, Artificial Sequence
  derived and/or modified sequence opt6 from major_capsid_protein__Norovirus__AFU92682
augaaaauggccucaaaugacgcuaacccuucagauggauccgcagcaaacuuaguuccagaaguaaauaaugaaguaauggcauuagaaccaguuguaggugcugccauugcagcaccaguagcaggccaacaaaauguaauagacccauggauaagaaacaauuuuguucaagcacccggaggagaauuuacaguaucaccacgaaaugcaccuggagagauacuauggucugcaccacuuggaccagauuuaaacccauaucuaucacaccuugcaagaauguacaauggauaugccggcggauuugaaguacaaguaauccuugcuggaaaugcauuuacagcagguaaaauaauauucgcagccguaccaccaaacuuucccaccgaaggacuuucaccaucacagguaacaauguucccacacauaaucguagacguccgacaacuagaaccaguuuuaauucccuuaccagacguuagaaauaauuucuaccauuacaaccaauccaaugacuccacaauaaaacucauagcuaugcuauacacaccacuuagagcaaacaacgcaggcgaagauguauucacaguuucaugccgaguacuaacaagaccaucaccagacuuugauuucauauuuuuaguaccuccaaccguugaaucaagaacaaaacccuucacuguccccauauuaacaguagaagaaaugacaaacuccagauucccaauaccauuagaaaaacuauuuacaggcccaucaagugcauucguaguacaaccgcaaaacgguagaugcacaacagacggcguauuacuagguacgacacaauuaucaccaguaaauauauguacauuuagaggugauguaacacauauagcagggagcagaaauuauacaaugaacuuagcaucauuaaacuggaacaauuacgauccuacagaagaaauaccagccccauuaggaacaccagacuucguaggaaaaauucaagguguccuaacccaaacaacaaaaggagacggaucaacuagaggacauaaagcaacuguauauacaggaucagcacccuucacaccuaaacucgguucaguacaauucaguacagacacagaaaaugauuuugaaacacaucaaaacacuaaauucacaccaguaggaguaauacaagacggauccacgacacauagaaaugaaccucaacaauggguacucccaucauacucaggaagaaacguccauaauguacacuuagcaccagcaguagcaccaaccuuuccaggagaacaacuuuuauuuuuccgcucaacaaugccagguuguucuggauaucccaauauggaucuagauugucucuuaccacaggaauggguacaacauuuuuaccaagaagcagccccagcacaaucagauguagcacuacuaagauuuguaaaccccgacacaggaagaguucuauucgaauguaaacuacauaaaucaggauauguaacaguagcacauacaggacaacaugauuugguaauaccucccaacggauauuuucgcuucgauuccuggguaaaccaauuuuauacccuagcaccaaugggaaacggaacaggaagaagaagagcuuuauaa

SEQ ID NO: 32963 - RNA, 1623 nt, Artificial Sequence
  derived and/or modified sequence opt6 from major_capsid_protein__Norovirus__AFU92684
augaaaauggcaucaaaugaugccaacccuuccgauggaucugcagcuaaccuaguaccagaagugaacaaugaggucauggcacuagaaccaguaguuggcgcugcaauagcagcaccaguugcaggacaacaaaacguaauagaucccuggauacguaauaacuuuguacaagcccccggaggagaauuuacagucucccccagaaaugccccaggagaaauauuauggucggcaccgcucggaccagauuuaaauccauacuuaucucacuuagcaagaauguauaacggauacgccgguggauucgaaguccaaguaauacuagcaggaaacgccuucacugcaggaaaaauuauuuucgcagcaguaccuccaaauuucccaacugaaggauuaucaccaagccaaguaacuauguuuccacauauuauuguagacguuagacaacuagaaccaguucuaauaccuuuaccagaugucagaaacaacuuuuaccauuacaaucaaucaaaugacucuacaauuaaacuaauagcaaugcuuuauaccccucuaagagccaacaaugcaggagaagauguauucacaguuucuuguagaguauuaacacgcccauccccagauuuugacuuuauauuccuaguaccaccaacuguagaaucacgaacaaaaccauuuacaguaccaauacuuacuguagaagaaaugacaaacuccagauuuccaauaccauuagaaaaauuauuuacagguccaucaggugcuuuuguaguacaaccacaaaauggacgauguacaacagacggaguauuauuaggaacuacacaauuaucuccagucaauauauguacuuucagaggagacguaacacauaucgcaggaucucgaaauuauacaaugaacuuagcugccuuaaacuggaacaauuacgauccaaccgaagaaaucccagcaccucuuggcacaccagacuucguuggaaaaauacaaggaguucuaacacaaaccacaaaaggagauggaucaacaagaggacauaaagcaacaguuuauacaggaucagcagacuucacucccaaauuaggcucaguucaguucucaacugauacagaaaaugauuucgaaacacaccaaaauacaaaauuuaccccagucgguguaauacaagauggcucaacaacucaccgaaacgaaccacaacaauggguauuaccgucauacucaggcagaaauguccacaauguccacuuagcaccugcaguagcaccaacauuuccuggagaacaacuacuauucuuuagaucaacaaugccaggauguucaggauaucccaauauggaccuagacugcuuauuaccacaagaauggguacaacauuucuaccaagaagcagcaccugcacaaucugaugucgcauuacuacguuucguuaacccagacaccggaagaguauuauuugaauguaaacuacauaaaaguggcuauguaacaguagcacacacaggacaacaugauuuaguaauaccaccuaacggauauuuucguuuugauucuuggguaaaccaauuuuacacacuugcacccauggggaauggcacaggaagacgccgagcacuauaa

SEQ ID NO: 32964 - RNA, 1623 nt, Artificial Sequence
  derived and/or modified sequence opt6 from major_capsid_protein__Norovirus__AFU92685
augaaaauggcaucaucagacgcgaacccauccgauggaucuaccgcaaacuuaguuccugaaguaaacaaugaaguaauggcucuagaaccaguaguaggagccgcaaucgcagcaccaguagcaggacaacaaaaugucauagacccuuggauuagaaauaacuuuguacaagcucccggaggagaauuuacaguaucuccucgaaacgcaccaggagaaauccuauggucagcaccauuaggaccagauuuaaauccauaucuaucacacuuagcaagaauguauaacgguuacgcaggcggauuugaaguucaaguaauauuagcaggaaacgcuuucacagcuggaaaaaucauauuugcagccguucccccuaauuuucccacagaaggauuaagccccucacaaguaacuauguucccacauauuauaguugauguaagacaauuagaaccaguauuaaucccauuaccagauguaagaaauaauuuuuaucauuauaaccaauccaacgauccaacaauuaaauuaauagcaaugcuauacacaccauuaagagcuaacaaugcaggagaugauguauuuacaguaucaugcagaguauuaacaagacccucaccagacuuugauuuuaucuucuuaguaccacccacaguagaaucaagaacaaaacccuuuucuguaccaauccucacaguagaagaaaugacaaacucuagauuuccaauaccuuuagaaagacuauuuacaggaccaucuucagccuucguaguacaaccucaaaauggacguuguaccacagacggaguuuuauuaggcacaacucaauuaucaccaguaaacaucuguaccuuuagaggagauguagcacauauagcaggcacgcaagaauacacaaugaacuuagcuucacaaaacuggaacaauuaugauccaacagaagaaauaccagcaccauuagguaccccagauuucguaggaaaaauacaaggaguauuaacacaaacuacucgacgagacgguucaacaagaggacacaaagccaccguaucgacaggauccguucauuuuacaccaaaauuaggacgaauacaauucucaacagauacaucaaacgacuuugaaacaggacaaaacacaagauuuacaccaguaggaguuguacaagaugguggaacuacacaccaaaaugaaccacaacaauggguauuaccugauuacucagguagagauucucauaauguccacuuagcaccagcaguagccccuagcuuuccaggagaacaauuacuauucuuuagauccacuaugccaggauguucaggauauccaaacaugaaucuagacugucuauuaccucaagaauggguucaacacuucuaccaagaagcagcuccagcacaaucagacguugcacuauuaagauuugucaacccagauacuggaagaguacuauuugaaugcaaacuccauaaaucaggguauguaacuguagcucacaccggccaacaugaucuaguaauaccuccaaauggcuauuuccgauucgacucuuggguaaaccaauucuauacacuagcaccaaugggaaauggaacaggaagaagaagagcacuauaa

SEQ ID NO: 32965 - RNA, 1623 nt, Artificial Sequence
  derived and/or modified sequence opt6 from major_capsid_protein__Norovirus__AFU92686
augaaaauggcaucuaaugaugcacacccauccgauggaucagcagcaacccuaguaccuaaagucaacaacgaaguaauggcauuagaacccguuguaggagccgcaauagccgcaccaguagcaggccaacaaaacguaauagacccuuggauaagaaauaacuuuguacaagcaccaggaggagaauuuacaguuucgccuagaaacgcacccggugaaauauuaugguccgcaccacuaggaccagaucuaaauccauaucuaucccaucuagccagaauguauaacggauacgcuggaggauuugaacuacacgucuuacuagcagguaacgcauuuacagcaggaaaaauaauuauagcagcaguaccaccuaauuucccaacagaaggucucaguccaucacaaguuacaauguuuccacacauaauaguagacguuagacaauuagaaccaguucuaauaccccuaccagauguuagaaauaacuucuaccacuauaaccaaucaaacgauucuaccauaaaacucauagcaaugcuauacaccccacuaagagcaaacaaugcaggagaagauguauucacuguaucaugucgaguccuaacccgcccuucuccugacuucgauuuuauauuuuuaguaccuccuaccguugaaucccgaacaaaaccauucacaguaccuauauuaacaguugaagaaaugacuaacucaagauuuccaauaccauuagaaaaauuauuuacagguccaucaggugccuucgucguacaaccccaaaacggaagauguacuacagacggaguacuacuuggaacaacacaacuaaguccuguaaacauauguauauuucgaggugacguuacccauauagcaggaucaagaaauuacacaaugaauuuagccgcacuaaauuggaacaauuaugaccccacagaagaaauaccugcaccacuuggcacccccgacuuuguaggaaaaauacaagguguauuaacccaaacaacaaaaggugacgguucaacuagaggacacaaagcaacagucuacacgggaucagcagacuucacaccuaaauuaggaucaguccaauuuucaacagacacagaaaaugauuuugaaacacaucaaaauacaaaauucacaccaguaggaguaauucaagacggcucaacaacacacagaaaugaaccucaacaaugggugcuaccaucuuauucagguagaaauguacacaacguucaccuagcuccagcaguagcaccaaccuucccaggagaacaacuauuauuuuucagauccacaaugcccggaugcuccggauaucccaauauggaccuagacugccugcuaccucaagaauggguccaacauuucuaccaagaagccgcucccgcacaaucugauguagcacuacuaagauucguuaauccugauacaggaagaguuuuauucgaaugcaaauuacacaaauccggauauguaacaguagcucauacaggacaacaugaucuugucaucccuccaaauggcuacuuucgauucgauucaugggugaaccaauucuacaccuuagcuccaaugggaaacggcacuggaagaagacgagcccuauaa

SEQ ID NO: 32966 - RNA, 1623 nt, Artificial Sequence
  derived and/or modified sequence opt6 from major_capsid_protein__Norovirus__AFU92687
augaaaauggcaucaaaugauccaaacccuuccgauggauccgcagcaaaccucguaccagaaguaaacaacgaaguaauggcccuagaaccaguaguaggagcugccauagcugcuccaguagcuggacaacaaaacgucauugacccauggauaagaaauaacuuuguacaagcaccagggggagaauuuacaguuucaccuagaaaugcaccaggugaaauucuauggagcgcaccuuuaggacccgaccuaaaccccuaucuaucacaccucgcuagaauguauaacggauacgcagguggcuucgaaguacaaguaauacuagcagguaaugcauucacagcuggaaaaauaauauucgccgccguuccaccuaacuuuccuacugaaggcuuaucucccucacaaguuacuauguuuccacacauuauaguagauguaagacaauuagaacccguauuaauuccauuaccagacguaagaaauaacuuuuaucauuacaaccaaagcaacgauucuaccauuaaauuaauagcaaugcuauacacaccauuacgugcuaauaaugccggagaagacgucuuuacaguaucuugcagaguacuaacaagaccaucacccgacuucgacuuuauauuuuuaguaccaccaacaguagaaucaagaacaaaaccauucaccguaccaauauuaacagucgaagaaaugacaaauucaagauuucccauaccauuagaaaaguuauuuaccggccccucaggcgcauucguaguccaaccucaaaaugguagaugcaccacugacggaguauuacucggaacuacucaacuaucaccagucaacauauguacauuucgaggugacgucacacauauagcaggaacacgaaacuacacuaugaaucuagcuaguuuaaacuggaacaauuacgacccaaccgaagaaauaccagcaccuuuagguacuccagacuuuguaggcaaaauacaaggaguauuaacacaaacaacuaaaggagauggaucuacuagaggucacaaagcaacaguauacacaggaucagcaccauuuacaccuaaauuaggaucaguacaauucucaacagacacagaaaaugauuuugaaacacaccaaaacaccaaauuuacacccguaggaguaauucaagacggcggaacaacccacagaaacgaaccacaacaaugggucuuaccaucauauucuggcagaaauguacacaacguacacuuagcuccagcaguugcuccaacuuuuccuggagaacaacuauuauucuuuagauccacaaugccaggaugcuccggauaccccaauauggaucuugacugccuccuaccacaagaauggguacaacacuucuaccaagaagcagccccagcucaaucugacguagcuuuaaugagauuugucaacccugacacuggcagagucuuauuugaaugcaaauuacauaaaucaggauauguaacaguagcucauacaggacaacacgaucuaguaauaccuccaaacggcuacuuucgauuugacuccugggugaaccaauuuuacacauuagcaccaaugggaaauggaacuggacgaagacgcgcuuuauaa

SEQ ID NO: 32967 - RNA, 1623 nt, Artificial Sequence
  derived and/or modified sequence opt6 from major_capsid_protein__Norovirus__AFU92688
augaaaauggcaucuaaugaugcacacccaucagacggaucagcugccaaccucgucccugaagucaauaaugaaguaauggcauuagaaccaguuguuggagcagcuauagcagccccaguagcaggacaacaaaacguaauagacccauggauaagaaauaauuuuguacaagcaccaggcggagaauuuaccguaucaccacgaaaugccccaggagaaauauuauggagugcaccuuuaggaccugaucuaaaucccuaccuaucucaccucgcuagaauguacaacggauaugcagguggauucgaaguucaaguaauucuagcaggaaacgccuuuacugcuggaaaaauuauuuucgcagcaguuccuccaaauuucccaaccgaaggauuaucuccaucacagguaacaauguuuccacacauaauaguagacguaagacaauuagaaccuguucuaauaccacuaccagauguuagaaacaauuuuuaucacuauaaucaaucaaaugacucaacaauaaaacuaauagcaauguuauauacaccauuacgagccaauaaugccggagaagauguauuuacaguaucaugcagaguauuaacaagaccuagcccugacuuugauuuuauuuuucucguaccuccuacaguagaaucaagaacaaaaccuuucacaguaccaauacuaacaguugaagaaaugacaaacucacgauuucccauuccacucgaaaaauuauuuacaggaccuucaggagcauucgugguacaaccucaaaauggaagauguaccacugacggaguauuauuagguacaacucaacuuucuccagucaacauaugcacauuuagaggagacguaacacauauagcggguacccgaaauuacacuaugaacuuagccuccuuaaauuggaauaauuacgauccuaccgaagaaaucccagccccauuaggaccuccagacuuuguugggaaaauacaaggcguuuuaacacaaacaacaaaaggagauggauccacaagaggucacaaagccacuguauauacaggaucagcaccauuuacaccaaaauuaggcucaguucaauucucaacagauaccgaaaaugauuuugaaacacaccaaaacaccaaauucacaccaguaggaguaauccaagacggaggaacaacucacagaaaugaaccacaacaguggguauuaccuucauauuccggucgaaauguacauaacguucaccuugccccugcaguagcaccaacauuuccuggugaacaacuucuauucuuccgaucaacaaugcccggaugcuccgguuauccaaauauggaccuagauugccuauuaccccaagaauggguacaacacuucuaccaagaagcagcacccgcccaaucagacgucgcacuaaugagauucguaaauccugacacaggucgaguauuauucgaauguaaauuacauaaaucaggauauguaaccguagcacauacuggacaacaugaccuaguaaucccaccaaacgguuauuucagauuugacuccugggucaaucaauucuauacacucgcucccauggguaauggaacaggaagaagacgugcacucuaa

SEQ ID NO: 32968 - RNA, 1623 nt, Artificial Sequence
  derived and/or modified sequence opt6 from major_capsid_protein__Norovirus__AFU92689
augaaaauggccucuaaugaugccaaccccucagacggaagugcagcaaacuuaguuccagaaguaaacaaugaaguuauggcauuagaaccaguagucggagccgcaauugcagccccuguagcaggucaacaaaauguaauagacccauggauuagaaauaacuuuguucaagcucccggaggagaauuuacaguauccccuagaaaugcaccaggugaaauuuuauggucugccccucucggaccugaucuaaauccauaucuaucccacuuagcaagaauguauaauggauacgcugguggauucgaaguccaaguuauacuagccggcaaugcauucacagcgggaaaaauaauauucgccgcaguccccccuaacuuuccaacagaaggacuaaguccaucacaggugacuauguucccacauauaauaguagacguaagacaauuagaaccagucuuaauaccacuuccugacguaagaaauaauuucuaucauuauaaucaaucaaacgacucaacaauaaaauuaauagccauguuauacacuccauuaagagcuaacaaugcaggugaagauguuuuuacaguaucauguagaguauuaacuagaccaucuccagacuucgauuuuauauuuuuaguccccccaacagucgaaucaagaacuaaaccauuuacaguaccaauccuaacuguagaagaaaugacaaacuccagauuuccaauuccacuugaaaaacuauuuacuggacccucaggagcauucguaguucaaccacaaaacgguagauguaccacugacgguguacuacuaggaacaacacaauuaucaccugucaauauauguacauucagaggagacgugacacauaucgcuggaacgagaaauuacaccaugaauuuagccucucuaaacuggaacaauuaugacccuacagaagaaauaccagcaccucuaggaacaccagacuuuguaggaaaaauccaaggaguauugacccaaacgacuaaaggagauggaucaacucguggacacaaagcaacugucuauacagguucagcaccauuuacacccaaacuaggauccguacaauucucaacugauacagaaaaugauuuugaaacacaucaaaauaccaaauuuacacccguagguguuauacaagacggaggaacaacccaccgaaaugaaccacaacaauggguacuaccaucuuauucaggaagaaauguacacaacguacacuuagcuccagcaguagcaccaacguuuccaggugaacaauuauuauucuucagaucuacuaugccaggaugcucaggauauccaaauauggauuuagauugccuacuaccacaagaauggguacaacauuuuuaucaagaagcagccccagcacaauccgauguagcacuuaugcgauucguaaacccagacaccggaagaguacuauucgaauguaaauuacacaaaucuggauauguaacugucgcacauacaggacaacacgauuuaguaaucccaccaaauggauacuucagauucgauucauggguaaaucaauuuuacacuuuagcuccaaugggcaacggaacagguagaagacgagcacuauaa

SEQ ID NO: 32969 - RNA, 1623 nt, Artificial Sequence
  derived and/or modified sequence opt6 from major_capsid_protein__Norovirus__AFU92690
augaaaauggcaucaaaugaugcaaauccaucagauggaucugccgcaaacuuaguaccagaaguaaauaacgaaguaauggcccuagaaccaguaguaggagcagcaauugcagcaccuguagcuggacaacaaaacguaauugauccuuggauacgaaacaacuucguacaagcaccaggcggugaauuuacuguaucuccuagaaacgccccaggagaaauauuauggucagcaccauuagguccagaucuaaauccauauuuaucccaucuagcaagaauguauaauggauaugcaggagguuucgaaguccaaguuauacuagcagguaaugcuuucacagcugguaaaauaauauucgcagcaguuccacccaacuuucccaccgaaggauuauccccaucccaaguaacuauguuuccucacauaauaguugauguuagacaacuagaaccaguucuaauaccuuuaccagaugucagaaacaacuuuuaucacuauaaccaaucuaacgacagcacaauuaaacuaauagcaaugcucuauacaccacucagagcuaacaaugcaggagaagauguauuuaccguaucauguagaguauuaacucguccaucuccagacuucgauuucauauucuuaguacccccuacuguagaaaguagaacuaaaccuuuuacuguaccaauuuuaaccguugaagaaaugacaaacucucgcuuuccaauaccauuagaaaaacuauuuaccggacccucaggugcuuucguaguccaaccacagaacggcagauguacaacagacggaguccuauuagguacaacgcaauuaucaccaguaaacauuuguacauuuagaggagauguaacccacauagcuggaacaagaaacuauacaaugaaucuagcaucauuaaauuggaauaacuacgaucccacagaagaaauaccagccccucuuggaaccccagauuuuguaggaaaaauacaaggcguauuaacacaaacaacaaaaggggacggauccacaagaggacacaaagcaacagucuacacuggcuccgcaccauuuacaccaaaacuaggcucaguacaauuuucuacagauaccgaaaacgauuuugaaacacaucaaaacacaaaauucacaccagucggaguuauacaagacggaggcacaacucacagaaacgaaccucaacaauggguucuuccaucauauucaggaagaaauguacauaacguacaucuagcaccagcaguagcaccuacuuucccuggcgaacaacuauuauuuuuuagaucuacuaugccagguuguucuggauaccccaacauggauuuagauuguuuacuaccccaagaauggguucaacauuucuaucaagaagcagcucccgcacaaucugauguagcacuaaugagauuuguaaauccagauacagguagaguacuauucgaauguaaacuacauaaaucaggauauguaacagucgcacacacaggacaacacgacuuaguaaucccaccuaaugguuauuucagauucgacucauggguaaaucaauuuuauacauuagcaccuaugggaaauggaacaggacgaagaagagcacucuaa

SEQ ID NO: 32970 - RNA, 1623 nt, Artificial Sequence
  derived and/or modified sequence opt6 from major_capsid_protein__Norovirus__AFU92691
augaaaauggcuucaaaugaugccaacccauccgacggaucagcagcaaauuuagucccagaaguaaacaaugaagucauggcccuagaaccgguaguaggagcagccauagccgcaccaguagcaggucaacaaaaugucauagacccuuggauaagaaacaauuuuguucaagcaccaggaggagaauuuacaguuucacccagaaaugccccaggagaaauauuauggucagcaccauuaggaccugaccuaaauccauacuuaucacauuuagcucgaauguauaauggauaugcaggagguuuugaaguacaaguaauauuagcagguaacgcuuucacagccggaaaaauaauauucgcagcaguaccaccuaacuucccaaccgaaggauuaucaccaucccaaguaacaauguuuccacauauuauaguugacguacgacaacuagaaccaguacuaauuccauuaccagauguccguaacaauuuuuaucauuacaaucaaucaaaugauucuacuaucaaauuaauagcaaugcuauacaccccacuacgagcaaauaaugcaggggaagaugucuucacaguuuccuguagaguccuaaccagacccuccccagauuuugauuuuauauucuuaguaccaccaaccguagagucacgaacaaaaccauuuaccguaccuauacuaacagucgaagaaaugacaaauucacgauuccccauaccacuagaaaaauuauuuacgggaccuucaggagcuuuuguaguccaaccacaaaacggccgauguacuacagauggaguauuacuaggaaccacacaacuaucaccuguuaauauauguacauuuagaggagauguaacccacaucgcuggaacaagaaauuauacaaugaaucuagcaucacuuaacuggaauaauuacgauccuacagaagaaauaccugcaccuuuaggaacuccagacuuuguaggaaaaauacaagguguauuaacacaaacaacuaaaggagaugguaguacaagaggacacaaagcaacugucuauacaggaucagcaccauucacaccaaaacuuggaucaguccaauucucaaccgauaccgaaaaugauuuugaaacacaucaaaacacaaaauucacaccugucggaguaauacaagauggagguacaacacaucgaaacgaaccucaacaauggguacuaccaucauauucagguagaaacguucauaauguccacuuagcacccgcuguugcacccacauuuccaggagaacaacuuuuauuuuuccguucaacaaugccaggauguucugguuauccaaacauggaucuagauuguuuauuaccacaagaauggguucaacauuuuuaucaagaagccgcaccagcacaaucugacguagcauuaaugagauucguuaauccagacacaggcagaguacucuuugaaugcaaauuacacaaaucagguuacgucaccguugcccacacaggccaacaugaucuaguaauacccccaaauggauauuuuagauuugacucuuggguaaaccaauucuauacuuuagcuccaaugggcaauggcacuggacgaagacgagcacuauaa

SEQ ID NO: 32971 - RNA, 1623 nt, Artificial Sequence
  derived and/or modified sequence opt6 from major_capsid_protein__Norovirus__AFU92692
augaaaauggcaucaaaugacgcuaacccaucagauggaucagcagcaaacuuaguaccugaaguaaauaaugaaguuauggcauuagaaccaguaguaggagcagccaucgcagcaccuguagcaggacaacaaaaugucauagauccauggauacguaacaacuucguacaagcaccaggaggugaauuuaccguaaguccacgaaacgccccaggagaaauacucuggagugcaccacuaggaccagacuuaaauccauauuuaucacacuuagcaagaauguauaacggauaugccggagguuucgaaguacaaguaauacuagcagguaaugcauuuacagcuggcaaaauaauuuucgcagcaguaccaccuaacuucccaacagaagguuuaucaccaucacaaguaacaauguucccacauauaauaguagacguaagacaacucgaaccaguacuaauaccacuucccgacguacgcaacaauuuuuaccacuacaaucagucaaaugauucaaccauaaaacuaauagcaauguuauacaccccacuaagagcuaauaaugccggugaagauguauuuacugucucuugucgaguauuaacacgaccuucuccugacuuugauuuuauauuucuaguuccaccaacaguagaaucaaggaccaaaccauucacaguaccaauauuaaccgucgaagaaaugacaaacucaagauuuccaauaccacuagaaaaacuauuuacagguccaagcggagcauucgucguccaaccacaaaacggaagauguacaacagaugguguauuacuaggaacaacucaacuaucaccaguaaauauaugcacuuuccgaggagauguuacccauauagcagguucaagaaauuacacaaugaauuuagcugcauuaaacuggaacaauuacgauccaacagaagaaauaccagccccauuagguacaccagacuuuguaggaaagauacaaggagucuuaacacaaacaacuaaaggugacgguucaacccgaggccauaaagcaacaguauauacaggaucagcagacuuuacuccaaaacuaggaucuguacaauuuucaacagacacugaaaacgauuucgaaacacaucaaaacacaaaauuuaccccaguaggcguaauacaagacggaucaaccacacauagaaacgaaccacaacaauggguucuuccaucauacucaggccgcaauguacauaauguacauuuagccccugcaguagcaccuaccuuuccaggagaacaauuacuauuuuucagauccacaaugccaggcugcucugguuacccaaauauggauuuagacugucuuuuaccgcaagaauggguacaacacuucuaucaagaagcugcaccagcucaaucagauguagccuuguuaagauuuguaaauccagacacuggccgaguacuauucgaaugcaaauuacauaaauccggauauguaacaguugcacauacaggucaacacgauuuaguaauacccccaaauggauauuuccgauuugacaguuggguaaaccaauucuacacauuagcuccaaugggaaacggaaccggaagaagacgagcacuauaa

SEQ ID NO: 32972 - RNA, 1623 nt, Artificial Sequence
  derived and/or modified sequence opt6 from major_capsid_protein__Norovirus__AFU92693
augaaaauggcuucaaacgaugcuaacccaucagauggaucugcagcaaaccuuguaccugaaguaaacaaugaaguaauggcuuuagagccagucguaggagcugcaauagcagcaccaguagcaggacaacaaaauguaauagauccauggauaagaucaaacuuuguucaagcaccaggcggagaauuuacagucucaccuagaaaugccccaggagaaauauuauggucagcaccacuaggaccugacuuaaacccauaucuaucccauuuagcaagaauguauaauggauacgcuggcggauuugaaguacaaguuauccuagcagguaacgcuuuuacagccggaaaaauaauauuugccgcagucccccccaauuuuccaacagaaggccuaucuccaucacaaguaacaauguucccacauauaauugucgauguaagacaacuagaaccaguauuaauaccucuaccagacguccgcaacaauuucuaccacuauaaucaaucaaacgauucuaccauaaaacucaucgcaauguuauauacaccccuucgagcaaacaaugcaggagaagacguauuuacaguuucaugucguguucuaacaagaccuucaccagauuuugacuucauauucuuaguacccccuacuguagaaucaagaacaaaaccuuucacaguaccaauauuaacaguagaagaaaugacuaacaguagauuuccuaucccauuagaaaaauuauuuacaggacccucaucggcauucguuguacaaccucaaaacggaagaugcaccacugauggaguuuuacuuggaacaacacaauuaucacccguaaauauaugcacuuucagaggggacguaacccacauagcaggaaguagaaacuacacuaugaauuuagcaucgcuuaauuggaacaauuaugauccaacagaagaaauaccagcaccauuaggaacuccagauuuuguaggaaaaauccaaggaguacuuacacaaacaacuaaaggagauggaucaacaagaggacauaaagcaacuguauacacaggaucagcacccuuuacuccuaaacuaggaucuguccaauuuucaacagacacagaaaaugacuuugaaacccaccaaaauacaaaauuuacacccguagguguuauacaagaugggggaacaacacaucgcaaugaaccucaacaauggguacuaccaagcuauuccggucgaaacguaccaaacguacaccuagcaccugcaguugccccaacuuucccaggugaacaacuguuauucuucagaucaacaaugccagguuguucaggauauccuaauauggacuuagauuguuuacuaccccaagaauggguacaacacuuuuaucaagaagcagcuccagcacaaucagacguugccuuacuaagauuuguuaaccccgacacuggcagaguauuauuugaaugcaaacuacauaaaucaggauauguaacagucgcacacacaggccaacaugaucuagucauaccaccaaacggauauuucagguuugauucguggguuaaucaauuuuacacauuagcaccaaugggaaauggaaccggucgaagaagagcacuuuaa

SEQ ID NO: 32973 - RNA, 1623 nt, Artificial Sequence
  derived and/or modified sequence opt6 from major_capsid_protein__Norovirus__AFU92694
augaaaauggcuucuucagacgcaaacccaucagauggaucaacagcaaaccuagucccagaaguaaacaacgaaguaauggcccuugaaccaguugucggcgccgcaaucgcagccccaguagcaggacaacaaaacguaauugacccauggauuagaaauaacuuuguacaagccccuggaggagaauuuacaguauccccacgcaacgcaccuggagaaauacuauggucagcuccacuuggaccagaccuaaauccauaccuaucacaccuagccagaauguauaacggguacgcaggugguuucgaaguacaaguaauucuagcaggaaaugcauuuacagcaggcaaaaucauauucgcagcagucccaccuaacuucccaacagaaggacucucaccaucacaagugaccauguucccacacauaauaguugacguuagacaauuagaaccaguacuaaucccauuaccagauguucgaaauaauuuuuaucauuacaaccaaucaaaugacccaacaaucaaauuaauagcaaugcuuuauacuccauuaagagcaaacaacgcaggugacgacguauuuacaguuucuuguagaguauuaacaagacccucuccagacuuugacuucauauuucuaguaccaccaacugucgagucacgaacaaaaccauuuuccgucccaauacuuaccguagaagaaaugacaaacucaagauuuccaauaccucuugaaaaacuauuuacagguccaucuucagcuuucguaguacaaccacaaaacgguagauguacaacagauggaguacuuuuagguacaacacaacuaagcccugucaacaucuguacauuuagaggcgauguaacacauaucacaggaucaagaaauuauacaaugaauuuagcaacacaaaacuggaauucauacgaucccaccgaagaaauaccagcuccauuaggaacacccgacuuuguuggcaaaauucaaggaguacucacacaaacaaccagagccgacggaucuacucgaggacauaaagcaacaguuuauacaggaucagccgacuucgccccuaaacuugguagaguucaauucgcaaccgauaccgauaaugauuucgaugcaaaccaaaauacgaaauuuacaccaguaggcguaauacaagacggugacacggcccauagaaaugaaccacaacaauggguacuaccaucauacuccgguagaaauagccacaacguccaccuugccccagcaguagcaccaacauuucccggcgaacaauuacuauucuucagaucaacuaugccaggaugcucagguuauccaaauauggaucuagacugucuuuuaccccaagaauggguacaauacuucuaccaagaagccgcaccagcacaaucagacguagcucuauuaagauuuguaaauccagacacaggaagaguccuauuugaaugcaaauuacauaaaucaggauauguaacaguagcucacacaggacaacacgaucuaguaauaccaccaaauggauauuuuagauucgauucuuggguaaaucaauuuuacacauuagccccaaugggcaacggcacuggacgccgaagagccuuauaa

SEQ ID NO: 32974 - RNA, 1623 nt, Artificial Sequence
  derived and/or modified sequence opt6 from major_capsid_protein__Norovirus__AFU92695
augaaaauggcuucaaacgacgccaaccccucagacggcucagccgcaaaucuaguaccagaaguaaacaacgaaguaauggcacuagagccaguuguaggcgcugcuauagccgcacccguugcaggacaacaaaauguaaucgauccauggauaagaaauaacuucguacaagcacccgguggagaauuuacaguaagcccaaggaaugcaccaggggaaauacucuggucagccccacuuggaccagaccuaaauccauaucuaucucacuuagcacguauguauaacggauacgcaggagguuuugaaguccaaguaauacuagcaggaaacgccuucacagcaggaaaaaucauauuugcagcaguaccaccaaacuuuccaacugaaggacuaucuccaucucagguaacaauguuuccucacauaauaguagauguaagacaacuagaaccaguacucauaccauuaccagauguucguaauaauuucuaucauuauaaucaaucuaaugauucaacaauaaaacuaauagcaauguuauacacuccuuuaagagcaaacaacgcaggagaagauguauucacaguuucaugccgaguacuuacccguccaagcccagauuuugacuuuauuuuucuaguuccaccaacaguugaaucaagaacaaaaccauuuacuguaccaaucuuaacaguagaagaaaugaccaacagucgauuuccaauuccacuagaaaaauuauucacaggaccaucaagugcuuuuguaguacaaccacaaaacggaagaugcaccacagacggaguacuacuaggcacaacacaacuaucgccaguaaauauaugcacauucagaggagauguaacccacauagcuggaucaagaaauuauacuaugaaucuagcuagccuaaacuggaauaauuacgauccuacagaagaaauaccagcaccacuaggaacaccagacuucgucggaaaaauacaaggaguacuaacgcaaacaacuaaaggagacggaucuacacgcggucacaaagcaacagucuacacaggauccgcuccauuuacacccaaacuaggaucaguacaauucucuaccgauacggaaaacgauuucgaaacucaucaaaauacaaaauucacaccuguuggcguaauacaagacggagguacaacacauagaaacgaaccacaacaauggguuuuaccaucuuauucaggaagaaaugucccaaacguccauuuagcacccgcaguugcacccacauuuccuggagaacaacuauuauucuuuagaucuacaaugccaggaugcucuggcuauccaaacauggacuuagauuguuuacuaccacaagaauggguccagcacuuuuaccaagaagcagcucccgcacaaucagacgucgcuuuacuaagauucguaaacccagacacaggacgaguacuauucgaaugcaaauuacauaaaucaggauaugucacuguagcacauacaggacagcacgacuuaguuaucccaccaaacggauauuuccguuucgauucauggguaaaucaauuuuacacacuagcaccaaugggaaaugguacagguagaagaagagcacucuaa

SEQ ID NO: 32975 - RNA, 1623 nt, Artificial Sequence
  derived and/or modified sequence opt6 from major_capsid_protein__Norovirus__AFU92696
augaaaauggcaucaaacgacgcaaacccaucagauggaucugcagcuaaccuaguuccugaaguaaauaaugaagucauggcauuagaaccaguagucggagcagcuauugcagccccagucgcaggacaacaaaauguuauagauccauggauuagaaauaauuucguccaagcaccaggaggugaauucacuguaucaccacgaaaugcgccaggagaaauacuauggucugcaccucuuggaccagacuuaaacccauaucuaucacaucuagcaagaauguauaauggauacgcugguggauuugaaguccaaguaauauuagcaggaaaugcuuuuacagcaggaaaaauuaucuucgcugccguaccaccaaauuucccuacagaaggacucucuccaucacaaguaacuauguucccccauauaaucguugacguaagacaauuagaacccguucuaauaccacuacccgauguuagaaauaacuucuaccacuauaaccaaaguaacgacucaacaauuaaauuaauagcaauguuauauacaccuuuaagagcuaacaaugcaggagaagauguuuucaccguuucaugcagaguauuaacaagaccaucaccagauuucgacuuuauauuucucguaccaccaacaguugaaucaagaacaaaaccauucaccguaccaauacucacaguagaagaaaugacuaacucaagauuuccaaucccacuagaaaaauuauuuacaggacccucuagcgcauucguaguacaaccacaaaacggaagauguacaaccgacggaguauuacuaggaacaacacaauuaucucccguuaacauauguaccuucagaggugauguuacucacauagcaggaucacgaaauuacacuaugaauuuagccucacuaaacuggaauaauuacgacccaacugaagaaauaccagcaccucucggaacaccagacuuuguaggaaaaauacaaggaguacuuacucaaaccacaaaaggugacggcucaacacgaggccacaaagcaacaguauauacagguuccgcuccuuuuacaccaaaauuaggaucuguacaauucucuacugacacugaaaaugauuucgagacacaucaaaauaccaaauuuacaccagucggugucauacaagauggaggaacaacacauagaaaugaaccccaacaauggguacuaccaucuuauucaggaagaaauguacaaaauguacaccuagcaccugcaguagcaccaacauuucccggagaacaauuacuuuuuuuuagaucaacaaugccaggcugcucagguuauccgaauauggacuuagauugcuuacuaccucaagaauggguacaacauuucuaucaagaggcagcaccugcucaaucugacguagcauuauuaagauucguuaaccccgauacuggaagagucuuauuugaaugcaaauuacauaaauccggauauguuacugucgcucacacuggacaacacgauuuaguaauaccaccaaauggguauuuccgcuucgauuccuggguaaaucaauucuacacucuagcaccaaugggaaauggaaccggaagaagaagagcguuauaa

SEQ ID NO: 32976 - RNA, 1623 nt, Artificial Sequence
  derived and/or modified sequence opt6 from major_capsid_protein__Norovirus__AFU92697
augaaaauggcuuccaacgacgccaacccaucugauggaucugcagcuaauuuaguacccgaaguaaauaacgaaguaauggcacuagaaccaguuguaggcgcagcaaucgcugcaccaguagcaggccaacaaaauguaauagacccauggauaagaaacaacuucguacaagcaccaggaggugaauuuacaguuucaccucgcaacgcaccaggagaaauacuaugguccgccccuuuaggucccgauuuaaaccccuaucuaagucaucuagcacguauguauaauggauacgcaggaggauuugaaguccaaguaauccuagcaggcaaugcuuuuacagcaggaaaaauaauauuugcagcaguuccuccuaauuuucccacugaaggacucucaccaucucaaguaacaauguucccacacauaauuguugauguuagacaauuagaaccaguacuaauaccauuaccugauguaagaaacaauuucuaccauuacaaccaaucuaaugacucaacaauaaaacuuauagcaaugcuuuacaccccauuaagagcaaacaaugcaggagaagauguauuuacaguaagcuguagaguccucacucgcccaucaccugauuuugacuucauauuucuuguuccaccaacuguagaaucuagaacuaaaccauuuaccguaccaauauuaacaguagaagaaaugacaaacucuagauuuccuauacccuuagaaaaacuauuuacaggaccaucaucugccuuuguaguacaaccacaaaauggaagauguacaacugauggugucuuacuagguaccacacaauuaagucccguaaauauauguaccuuuagaggugaugucacacauauagcaggcaguagaaacuacaccaugaaucuagccucccuaaacuggaacaacuacgacccuacagaagaaaucccagcaccauuaggaacaccagauuuuguaggaaaaauacaaggaguauuaacacaaacaacaaaaggagacggauccacaagaggacacaaagcaacaguauauacagggucagcgccauuuacuccaaaacuaggaaguguacaauucucaacugauacagaaaaugauuucgaaacacaccaaaacacuaaauucaccccaguugguguaauucaagauggcggaacaacacaccgaaaugaaccucaacaauggguucuacccucauacuccggaagaaauguaccuaauguacaucucgcuccagccguagcaccaacauuuccaggagaacaauuauuauucuuuagaucaacaaugccagguuguuccgguuaucccaacauggacuuagauugucuauuaccucaagaauggguacaacauuuuuaccaagaagccgcacccgcacaaucagacguugcccuacuacguuuuguaaaucccgacacaggaagaguauuauuugaguguaaauuacauaaaaguggauauguaacagucgcacauacaggacaacacgaccuaguaauaccaccaaaugguuauuuccgauuugauucuuggguaaaucaauuuuacacacuugcaccaaugggaaauggaacuggcagaagacgugcauuauaa

SEQ ID NO: 32977 - RNA, 1623 nt, Artificial Sequence
  derived and/or modified sequence opt6 from major_capsid_protein__Norovirus__AFU92698
augaaaauggcaucaaaugacgcaaacccauccgauggaagugcagcaaauuuaguacccgaaguuaacaaugaaguaauggcacuugaaccaguaguaggugcugcaauagcagcaccuguagcaggacaacaaaaugugauagacccauggauaagaaauaacuuuguccaagcaccaggaggagaauuuaccguauccccaagaaacgcaccaggagaaauucuauggucagcuccccuaggaccugacuuaaacccauaucucucacacuuagccagaauguacaauggauacgccggaggauucgaaguacaaguaauacuagcaggaaaugcauuuaccgcuggcaaaauaauuuucgcagcaguaccaccaaauuuuccaacagaaggauuaucaccaucacaaguuacuauguucccacacauaaucgucgacguaagacaacucgaaccaguucuaauuccuuuaccagauguaagaaacaauuuuuaucauuauaaccaaucaaacgauucuacuauaaaacuuauagcaaugcuuuauacaccauuaagagcaaacaacgccggagaagauguauucacaguuuccugcagaguacuuacacgacccuccccugacuuugauuuuauauuccucguaccaccuacuguagaaucaagaacaaaaccuuuuacaguaccaauauuaacuguagaagaaaugacaaacucuagauuccccaucccacuagaaaaacuauuuacaggaccaucaggagcauucguuguccaaccacagaacggacgaugcacaacugacggaguacuauuaggaacaacacaacuaucaccagucaauaucuguacauucagaggcgauguaacacauauagccggaucuagaaauuacacuaugaacuuagcauccuuaaacuggaacaauuaugauccaacugaagaaaucccagcaccucucggaacgccagacuuuguaggaaaaauccaaggaguucuaacacaaacaacaaagggugacggaucaacaagaggucacaaagcaacaguauauacugguagcgcuccauucacaccaaaacuaggaaguguacaauuuucaacagauacagaaaacgauuucgaaacacaucaaaacacuaaauuuaccccaguaggcguaauacaagauggaucuaccacccauagaaaugaaccacaacaauggguacuaccaucuuauucaggaagaaauguacacaacguacauuuagcaccagccgucgcaccaacauuuccuggugaacaacuacuauucuuuagaucaacaaugccaggaugcucaggauacccuaacauggaucuugacuguuuauuaccucaagaauggguacaacauuuuuaucaagaagcagccccagcucaaucugacguagcauuacuacgauuuguaaaccccgacacaggaagaguauuguuugaaugcaaacuccauaagucaggauauguaacaguagcucauaccggacaacacgauuuagucaucccaccaaauggauauuucagauuugauuccuggguaaaccaauuuuauacacucgcaccaaugggaaacggaaccggaagaagaagagcucuauaa

SEQ ID NO: 32978 - RNA, 1623 nt, Artificial Sequence
  derived and/or modified sequence opt6 from major_capsid_protein__Norovirus__AFU92699
augaaaauggcuuccaacgacgcaaauccuagugacggaucugcagcaaacuuaguaccagaaguaaacaaugaaguaauggcacuagaaccgguuguuggagcagcuauagccgcaccaguagcaggucaacaaaaugucauagacccauggauccgcaauaacuuuguucaagcaccaggaggugaauuuacaguauccccuagaaacgcacccggagaaauacucuggucagcaccauuaggacccgauuuaaauccauacuuaucacacuuagcuagaauguauaacggcuaugcaggaggauucgaaguucaagucauacuugcaggaaacgcauuuacagcuggaaaaauaauauucgcagcaguacccccaaacuucccuacugaaggacucucaccaucucaaguaacuauguucccccacauaauauuagacgucagacaauuagaacccguacuaaucccacuaccagauguaagaaauaauuucuaucacuauaaucaaucaaaugacucaacaauaaaauuaauagccaugcucuacacaccacuaagagcaaacaaugcaggugaagauguauuuaccgucucuugcagaguauuaacccgaccaucaccagauuuugauuucauuuuucuaguuccaccaacaguagaauccagaacaaaaccuuuuacaguaccuauauuaacaguagaagaaaugacaaacucaagauuuccaauaccauuagaaaaacuauuuacaggacccuccggagcauucguaguacaaccacaaaacggaagauguacaacugacggaguauuacuuggcacgacccaauuaaguccaguaaacauaugcacuuuuaggggugauguaacacacauagcuggauccagaaauuacacaaugaaucuagcuagccuaaauuggaacaauuacgaucccacugaagaaauacccgccccucuaggaacaccagauuuuguaggaaaaauacaagguguacuaacacaaacaacaaaaggagacggauccacacgaggacacaaagcaacagucuacacaggcucagcaccauuuacuccaaaauuaggaucgguacaauucuccacagauacagaaaaugauuuugaaacacaucaaaauacaaaauucacaccaguaggaguaauccaagacgguucaacaacccgaagaaaugaaccacaacaauggguucuaccuuccuacagcggcaggaaugcacauaauguacacuuagcaccagcaguagcaccaacauuccccggugaacaauuauuauuuuuuagaaguacaaugccuggcugcucaggauauccaaauauggauuuagauugucuacuaccacaagaauggguucaacauuuuuaccaagaagcugcaccagcacaaucagacguagcacuacuacgauuuguaaauccugacacaggucgcguacuauucgaaugcaaacuacauaaaucaggauacguaacagucgcucacacaggacagcaugaucucguaauaccccccaauggcuauuuuagauucgauucauggguaaaucaauuuuacacacuagcucccaugggaaauggaacaggaagaagaagagcacuauaa

SEQ ID NO: 32979 - RNA, 1623 nt, Artificial Sequence
  derived and/or modified sequence opt6 from major_capsid_protein__Norovirus__AFU92700
augaaaauggcaucaaacgacgcauccccauccgauggaucagcagcuaacuugguaccugaaguuaacaaugaaguaauggcccucgaaccaguaguaggagcagccauagcugccccuguagcaggacaacaaaacguaauagacccauggauaagaaacaauuuuguacaagcaccaggaggugaauuuaccguaucaccuagaaaugcaccuggcgaaauacucuggucagccccucuaggaccagaucuaaauccauaucuuucucaccucgccagaauguauaacggauaugccggaggauuugaaguacaaguaauacuagcaggaaaugccuucacagcagguaaaauaauauucgcagcaguacccccaaacuucccaacagaaggacuaucccccucacaagucacuauguuuccacacauaauuguagacguaagacaacuagaaccaguacuaauuccacuaccagauguacgaaacaacuuuuaccauuauaaccaaucaaacgacucaacaauaaaauuaauagcaaugcucuacacaccacuacgagcuaacaacgcaggagaagacguauuuacaguaagcugcagaguacuaacccgaccaucaccagauuuugacuuuauauuucuaguuccaccuacuguagaaucacguacaaaaccauucaccguaccaauacuaacaguugaagaaaugacaaacuccagauuccccauaccucuagaaaaacuuuucacagguccaucaucagcauuuguaguucaaccacaaaacggaagauguacaacagacggagucuuacuaggaacaacucaauuaucucccguaaacauauguacauuuagaggugacguaacacacauagcuggaucacgagacuacacaaugaauuuagcaucauuaaacuggaauaauuacgauccaacagaagaaauaccagcaccucuaggaacaccagauuuuguaggaaaaauacaaggagucuuaacacaaacaacaaaaggagacggauccacucgaggacacaaagcuacuguauauacaggaucagcucccuucaccccaaaauuagguucaguacaauucucaacagauacagaaaaugacuuugaaacacaucaaaauacaaaauuuaccccaguagguguaauacaagacggaaguacaacacauagaaacgaaccacaacaauggguucuaccuucuuauucuggaagaaauguucaaaauguacaccuagcaccagcaguggcaccaacauuucccggugaacaauuacuauuuuucagaucaacaaugccuggaugcagcggauauccaaacauggacuuagauugcuuauuaccacaggaauggguucaacauuucuaucaagaagccgcuccagcccaauccgauguagcauuacuuagauucguaaacccagacacaggacgcguacuauucgaauguaaauuacacaaaucaggauauguaacgguagcacacacaggacaacacgaucuaguaauaccaccaaauggauauuucagauucgauucauggguaaaucaauuuuauacacucgcaccaaugggaaacggaacuggacgaagaagagcacuuuaa

SEQ ID NO: 32980 - RNA, 1623 nt, Artificial Sequence
  derived and/or modified sequence opt6 from major_capsid_protein__Norovirus__AFU92701
augaaaauggcuuccaaugacgccaaucccucagacgguucagccgcaaaccuaguuccugaagucaacaaugaaguuauggcacuugaaccaguuguaggagcagcaauugcagccccagucgcaggacaacaaaauguaauagacccauggauaagaaauaauuuuguacaagcaccuggcggugaauucaccguaucaccaagaaacgcaccaggagaaauauuauggucagcaccauuaggaccugaucuaaauccauaucucucccaccuagcacgcauguauaacgguuaugcuggaggauucgaaguacaaguaauacuagcaggaaacgcauuuacagcaggcaaaauaauauuugcagccguaccaccuaacuuccccacagaagguuuauccccaucccaaguaacaauguucccucacauaauaguagauguaagacaauuagaacccguacugauuccauuaccugauguaagaaacaauuuuuaucauuauaaucaaucaaaugauucuacaauaaaguuaauagcaauguuauacacaccauuaagagcaaacaacgcaggagaagauguauuuacaguuucaugcagagucuuaacacgucccucaccagauuuugauuucauuuucuuaguuccacccacaguagagucacgaacaaaaccauucacuguaccaauauuaacaguagaagaaaugacaaacucaagauuuccaaucccccuagagaaacuauuuacaggaccaucaucugcauucguaguacaaccacaaaauggaagauguaccacugauggaguccuacuagguacaacacaauuaagcccagucaauauauguacauuccgaggagacguaacacauauagcaggaucaagaaauuauacaaugaaucuagccucuuuaaauuggaauaauuaugauccuacagaagaaauaccugcaccucuaggaacaccugacuucgucggaaaaauacaagguguacuaacacaaacaacaaaaggagacgguuccacuagaggccauaaagcuacaguauauacaggaucagcaccauucacaccaaaauuagguuccguacaauuuaguacagauaccgaaaaugacuucgaaacccaucaaaacaccaaauucacaccaguaggaguaauacaagacggcggcacuacacauagaaaugaaccucaacaauggguuuuaccaucauacucaggacgaaacguaccaaauguccaccuugcuccagcuguugcaccuacauuucccggagaacaauuauuauuuuuccgaaguacaaugccaggauguuccggauacccaaauauggaccuagauugccuucucccacaagaaugggugcaacauuucuaucaagaagcagcuccagcacaaucagacguugcacuccucagauucguaaacccagacaccggaagaguuuuauucgaaugcaaauuacacaaaucaggauauguaacuguagcacacaccggacaacaugaucucguaauaccaccaaacggauauuuuagauucgauucauggguaaaucaauuuuauacauuagcaccuaugggcaacggaaccggaagaagacgugcacuauaa

SEQ ID NO: 32981 - RNA, 1623 nt, Artificial Sequence
  derived and/or modified sequence opt6 from major_capsid_protein__Norovirus__AFU92702
augaaaauggcaucuagugacgcaaacccaucagauggaaguacagcuaaucuaguaccagaaguuaauaacgaaguuauggcacuugaacccguaguaggagccgcuauagcagcuccuguagccggacaacaaaacguaauagacccauggauacgaaacaauuucguacaagcacccggaggagaauucaccguaucaccuagaaacgcaccaggagaaauacuauggucagccccacuaggaccagauuuaaauccauaucuaucccauuuagcacguauguauaauggauaugcaggagguuucgaaguacaaguaauacuagcaggcaacgcauuuacugccggaaaaauaauauucgcagcaguaccaccaaauuuucccacagaaggccuaucaccaucucaaguaacaauguucccacauauuauaguugauguacggcaauuagaaccaguacuaaucccauuaccagacguaagaaauaacuucuaucacuacaaccaaucaaaugaccccacaauaaaauuaauagcaauguuauauaccccccuaagggcuaauaaugcuggagacgauguauucacaguaucuuguagaguucuaacucgaccuucaccagacuuugauuucauuuuuuuaguuccaccaacaguagaaagccgaaccaaaccauuuucaguaccuauacuaacaguagaagaaaugacaaacucaagauuccccauucccuuagaaaaauuauuuacuggaccuucaucagcauuuguuguucaaccccaaaacggcagaugcacaacagacggcgucuuacuuggaacuacucaacuaucacccguaaauauaugcacauucagaggugaugucacacauauaacaggaucacgaaauuacaccaugaacuuagcuacacaaaauuggaauuccuacgacccaacagaagaaauaccugccccacuaggaacaccagauuuuguaggaaaaauacaagguguacuaacacaaacaacuagagcugacggaucaacaagaggacauaaagcaacaguauauaccggaagugcugacuucgcaccaaaauuagguagaguacaauuugcaacagauacugauaacgauuuugaugccaaucaaaauacaaaauucacaccaguaggaguaauacaagauggagacaccgcccacagaaaugaaccacaacaauggguacucccauccuauucaggaagaaauucacacaauguacaccuagcaccugcaguugcaccuacauuucccggagaacaacuuuuauuuuucagaucuacaaugccaggaugcucagguuacccaaauauggacuuagauugcuuauuaccacaagaauggguacaguacuucuaucaagaagcagcucccgcacaauccgaugucgcccucuuaagauuuguaaaucccgacacaggaagaguuuuauucgaaugcaaauuacauaaaucagguuacguuacaguagcacauacaggacaacaugaccuaguaaucccaccuaacgguuauuuuagauuugauucuugggucaaucaauucuauacuuuagccccuaugggaaauggaaccggacgcagacgagcauuauaa

SEQ ID NO: 32982 - RNA, 1623 nt, Artificial Sequence
  derived and/or modified sequence opt6 from major_capsid_protein__Norovirus__AFU92703
augaaaauggcaucaaacgacgcaaacccaucagauggaucagcagcaaacuuaguaccugaaguaaauaaugaaguaauggcccuugaaccaguaguaggagcugcuauagccgccccaguagcaggucaacaaaauguaaucgacccauggauaagaaauaacuucguacaagcacccggcggcgaauuuacuguauccccucgaaacgcaccaggagagauauuaugguccgcaccauuaggaccagaccuaaauccauaccucucccauuuagcaagaauguacaauggcuaugcaggaggauuugaaguccaaguaauauuagcaggaaaugccuuuacugcagggaaaauuauauucgcagcaguuccaccaaauuuuccaacugaaggccuaucaccaucucaaguaacaauguuuccccacauaauaguagauguaagacaauuagaaccaguauuaauaccauuaccagauguaagaaacaauuucuaucacuauaaccaaucaaaugacagcacaauaaaauuaauagcuauguuauacacaccacuaagagcaaauaaugcaggagaagauguauuuacaguaucauguagaguccuaacccgaccaucaccugauuuugacuucauauuuuuaguaccuccaacagucgaaucaagaacaaaaccauuuacaguacccaucuuaacagucgaagaaaugacaaacagcagauuuccaauccccuuagaaaaauuauucacaggacccucuucugcauucguaguacaaccucaaaauggaagauguaccacagauggaguauuauuaggcacaacacaauuaucuccaguuaauauauguaccuuuagaggagauguaacacacauagcugguucacgaaauuacacaaugaauuuagcaucccucaauuggaauaauuacgacccaacugaagaaauuccugcaccacuaggaacacccgacuucgucggaaaaauacaaggaaugcuaacucaaacaacaaaaggugacggaucaacaagaggacacaaagcuacaguauacacaggcucugcucccuuuaccccaaaauuaggaucaguucaauucucaacagacaccgaaaaugauuuugaaacacaccaaaauacuaaauucacacccguaggaguaauacaagauggauccacuacccauagaaaugaaccacagcaauggguacuacccucuuauucaggaagaaauguacaaaauguccaucuagcaccagcaguugcaccuacauuuccuggagaacaacuacuauuuuuuagauccacaaugccaggaugcagcggauacccuaauauggaucuagauugucuccucccccaagaauggguccaacauuucuaucaagaagcugcucccgcucaaucagacguugcauuacuucgcuuugucaacccagauaccggaagaguucuauucgaaugcaaauuacauaaaaguggcuauguaacaguugcacacacuggacaacacgaucuaguuauaccacccaauggauauuucagauucgauucauggguaaaucaauuuuauacucuagcaccaaugggaaauggcacugguagaagacgagcacuauaa

SEQ ID NO: 32983 - RNA, 1623 nt, Artificial Sequence
  derived and/or modified sequence opt6 from major_capsid_protein__Norovirus__AFU92704
augaaaauggcuagcucagaugccaacccauccgauggaucuaccgcccacuuaguaccagaaguaaacaaugaaguaauggccuuagaaccaguaguaggagcagcaauagcugccccaguugcaggccaacaaaacguaaucgacccauggauaagaaauaacuuuguacaagcaccuggaggcgaauuuacaguuucaccaagaaaugcaccaggagaaauauuauggucagccccacuaggcccagauuuaaauccauaccuaucacacuuagcaagaauguauaaugguuaugcaggaggcuuugaaguacaaguaauucuugcaggaaacgccuuuaccgcaggaaaaauaauauucgcugccguaccaccuaacuuucccacagaagguuuaaguccuucacaaguaacuauguuuccccacauaauaguagacguaagacaacuagaaccuguacuaauaccauuaccagacguaagaaacaauuucuaucacuauaaccaaucaaaugacccaaccauuaaacuuauagcuaugcuauacacucccuuacgcgcaaauaaugcaggcgacgacguuuuuacaguuucaugucguguauuaacucgaccuagcccagacuuugacuuuauauuucuaguaccaccuacuguagaaagcagaacuaaacccuucuccguacccgucuuaacaguugaagaaaugacaaauucaagauuucccauaccacuagaaaaacuauucacaggacccuccucagccuuuguuguccaaccacaaaacggucgcuguacaacagacggagucuuauuaggaacaacacaacuaucaccuguaaauauaugcacauuuagaggagacguaacacauaucccuggaagccgaaauuacacaaugaaucuugccagccaaaacuggaauucauaugacccaacagaagaaauaccugcaccacuuggaacaccugauuucguaggaaaaauacaaggaguauuaacacaaacaacacgaacaaauggaucaacuagaggacauaaagcaacuguauauacaggaagugccgacuucaguccaaaauuaggaagaguacaauuugcaacugauacagauaacgauuucgaaacaaaucaaaauacaaaauucacaccaguaggaguuauacaagauggaaguacgaccccaagaaaugaaccacaacaauggguacucccaucuuauucaggaagaaauauccauaacguacauuuagcaccagcaguagcacccacauuuccaggagaacaauuacuauucuuuagaucaacaaugccagguuguucaggauacccaaacauggauuuagauugccuauuaccacaagaauggguccaauauuuuuaucaagaagcugcaccagcacaaucagauguagcauuacuacgcuuuguuaauccagauacuggaagaguccuauuugaauguaaacuucacaaaucuggauacgucacaguagcacauaccggacaacaugauuuaguaaucccaccaaauggcuauuuucgauucgauucauggguaaaucaauucuacacacuagcaccaaugggaaaugguacaggacgaagacgagcauuauaa

SEQ ID NO: 32984 - RNA, 1623 nt, Artificial Sequence
  derived and/or modified sequence opt6 from major_capsid_protein__Norovirus__AFU92705
augaaaauggcaucaaaugacgcaaauccaucagauggaucagcagcaaacuuaguaccagagguaaacaacgaaguaauggcucuagaaccaguuguaggcgcagcuauagcugcaccagucgcaggucaacaaaauguaauagacccauggauaagaaauaauuuuguacaagcaccaggaggagaauuuacaguaagcccaagaaaugccccaggugaaauacuuugguccgcaccucuaggaccagacuuaaauccuuaucucucacacuuagccagaauguacaacggauacgcaggagguuuugaaguucaaguaauacuagcaggaaaugcauuuacagccggaaaaauaauuuucgcagcaguaccuccaaacuuuccaacagaaggauuaucaccaucacaaguaacaauguucccacacaucauaguagacgucagacaacuagaaccaguucuaauaccacuacccgauguaagaaauaauuucuaucauuacaaucaaucaaacgacucaaccauuaaauuaauagcuaugcuauacacaccacuuagagcaaauaaugcuggugaagacguauuuacaguaagcugcagaguacuaacaagaccaucaccagauuucgacuucauauuucuaguaccaccaacaguagaauccaggacaaaaccauuuacaguaccaauacuaacaguagaagaaaugacaaacucaagauuuccaauaccauuagaaaaacuauuuacuggacccucaggcgcuuucguuguccaaccucaaaacggaagauguacaacagauggaguauuacuaggcacaacacagcuaucaccuguaaacauauguacuuuuagaggagacguuacucauauagcaggaaguagaaacuacacuaugaauuuagcuucguuaaacuggaacaacuacgauccaaccgaagaaauaccggcuccacuaggaacuccagauuucguaggaaaaauacaaggaguauuaacacaaacaacuaaaggagacggaucaacaagaggacacaaagcaacuguauauacagguagcgcacccuucacuccaaaacucggaucuguucaauucucaacagauaccgaaaaugauuucgaaacacaccaaaauacaaaauucaccccaguaggaguaauacaagacgguuccacuacacaucgaaacgaaccacaacaauggguauuaccaucauauucuggaagaaacguccauaauguucacuuagcacccgcaguagcuccaaccuuccccggagagcaacuacuuuuuuuuagaucuacaaugccuggaugcucaggauacccuaauauggaucuugacugcuuacuuccacaagaauggguucaacacuucuaucaagaagccgcaccagcucaaucagacguagcacuacuuagauucguuaaccccgauacuggaagaguacuauucgaaugcaaauuacauaaaucagguuauguaacuguagcacauacuggacaacaugauuuaguaauuccuccaaacggcuacuuccguuuugacaguuggguaaaucaauuuuauacauuagcuccaaugggcaaugguacaggacguagaagagcauuauaa

SEQ ID NO: 32985 - RNA, 1623 nt, Artificial Sequence
  derived and/or modified sequence opt6 from major_capsid_protein__Norovirus__AFU92706
augaaaauggcuuccucagaugcaaacccaucagauggaagcacagcuaacuuaguaccugaaguaaacaaugaagucauggcguuagaaccaguaguaggcgcagcaauagcagcaccaguagcuggccaacaaaauguaauagacccauggauaagaaauaauuuuguacaagcuccaggcggugaauuuacaguauccccuagaaaugcaccaggggaaauauuauggucugcaccacucggaccagaccuaaauccuuaccuaucacaccuagcacguauguauaacggauaugcuggaggauucgaaguccaaguaauauuagcugguaaugcuuuuacagcaggcaaaaucaucuuugccgcaguaccaccuaauuuuccaacugaaggacuauccccaucacaagucacaauguucccacacauaauaguagacguacgacaauuagaacccguacuaauaccccuaccagauguacgcaauaacuuuuaucauuauaaccaaucuaaugacccaaccauuaaauuaauagcaaugcucuauacacccuugagagccaacaaugccggagacgauguauuuacaguuucuugccgaguucuaacgagaccuuccccagauuuugacuucauauuucuaguaccaccuacuguagaaucacgaacaaaaccauucucaguaccaguacuaaccgucgaagaaaugacaaauucaagauuuccaauaccacuagaaaaauuauucacagguccuucuagcgcauuuguagugcaaccacaaaacggaagauguacaacagauggagucuuacuagguaccacacaacuaaguccaguaaacauaugcacauucagaggagauguuacucacauaccaggaucacgaaauuauacaaugaaccuagcaucucaaaauuggaauucauaugauccaacagaagaaauacccgcaccauuaggaacaccagacuuuguaggaaaaauucaaggaguacuaacacaaaccacaagaacaaacggaucaacaagaggacacaaagccacaguauauaccggaagugcagauuuuaguccuaaauuaggaagaguacaauucgcaacagauacagacaacgauuucgaaacaaaccaaaacacaaaauuuaccccaguuggaguaauccaagacggaucaacuaccccaagaaaugaaccccaacaguggguacuaccaucauacucagguagaaauauacauaauguacaccuagcacccgcaguagcaccaacuuuuccaggagaacaauuauuauucuucagaucaacaaugccaggauguucaggauaucccaacauggaucuagacugccuauuaccacaagaauggguacaauacuucuaccaagaagcagcaccagcccaaucagacguagcuuuauuaagauucguaaacccagauacugguagaguacucuucgaaugcaaacuacauaaaucagguuauguaacagucgcacacacaggacaacacgaucuaguaauacccccaaacggcuauuuuagauuugacucuuggguaaaccaauuuuacacuuuagcaccaaugggaaauggcacuggacgacgaagagcacuuuaa

SEQ ID NO: 32986 - RNA, 1623 nt, Artificial Sequence
  derived and/or modified sequence opt6 from major_capsid_protein__Norovirus__AFU92707
augaaaauggcauccucugacgcaaacccauccgauggaucaacagcuaaccuaguuccugaaguuaauaaugaaguaauggcauuagaaccaguaguaggugcagcaaucgcugccccaguugcaggacaacagaauguaauugacccuuggauucgaaacaacuuuguacaagcuccagguggagaauucacaguaucaccuagaaacgccccaggagaaauacuaugguccgcaccauuaggacccgaucuaaauccauacuuaucucacuuagcaagaauguauaacggauaugcaggcggauuugaaguacaagucauacuagcuggaaaugcauuuacagcagguaaaauaauauuugccgcuguaccaccaaacuucccuacagaagguuuauccccaucccaaguuaccauguucccacauauaaucguugacguuagacaacuugaaccaguacugauaccguuaccagauguacgaaacaacuucuaucauuacaaccagucuaaugauccaacaauuaaauuaauagcaauguuauacacaccucuuagagcuaacaacgcaggagacgauguuuuuacaguaucuugccgaguacuaacccgcccaucuccagacuuugauuucauauuucuaguuccaccaacaguagaaucuagaacaaaaccauuuucuguaccuguauuaacaguagaagaaaugacaaauucaagauuuccaauaccauuagaaaaacucuuuacuggaccaucaucagcguucgucguccaaccccaaaaugguagaugcacaacagacggaguacuauuaggcacaacacaacuuuccccaguaaauauauguacauuccguggagacguaacacauauuccugguucaagaaauuauacaaugaaucucgccucacaaaacuggaauucauaugaucccacagaagaaauaccagcaccacuaggaacacccgacuucguuggaaaaauucaaggaguacuaacccaaaccacaagaacuaacggauccacaagaggacauaaagcaaccguauacacaggaucagcagacuuuagcccaaaauuaggacgcguagaauuugccacagacacagauaacgauuuugaaacaaaccaaaauacaaaauucacacccguaggaguaauacaagaugguucuacaacaccaagaaacgaaccacaacaauggguucuaccuucauauagcggcagaaacauacauaauguacaucucgccccagcuguagcaccaacauucccaggagaacaauuauuguucuuuagaucaacaaugccaggauguucaggauaccccaauauggaucuugauuguuuauuaccacaagaauggguucaauauuuuuaucaagaagcagcaccagcacaauccgacguagcacuacuacgauuugucaacccagauacaggacgaguuuuauuugaauguaaauuacauaaaucaggcuacguuacuguugcccauacuggacaacacgacuuaguaauaccucccaacggauacuuuagauucgauuccuggguaaaccaauucuacacucuagccccaaugggaaauggaaccggacgaaggagagcacuauaa

SEQ ID NO: 32987 - RNA, 1623 nt, Artificial Sequence
  derived and/or modified sequence opt6 from major_capsid_protein__Norovirus__AFU92708
augaaaauggccucuaaugacgcaaauccaagugauggcucagcagcaaauuuaguaccugaaguaaauaacgaaguaauggccuuagaaccaguagugggagcagcaauagcagcaccaguagcaggacaacaaaacguaauagauccauggauucgaaauaacuuuguacaagcuccaggcggagaauuuacaguaucaccaagaaaugcuccaggagaaauacuuuggucugcaccgcuaggacccgaucuaaauccauaccuaucacaccuagcacgaauguauaacggauaugcaggaggauucgaaguacaaguuauacuagcaggaaacgcauucaccgcuggcaaaauaaucuuugcagccguuccuccaaauuucccaacagaaggucucucaccaucccaaguaacaauguucccacauauaauuguagacguucgacaacuagaaccuguacuaauuccauuaccagaugucaggaacaauuuuuaucauuauaaccaaucaaaugacucaacaauaaaacucauagcaauguuauacacaccauuaagagccaacaaugcaggagaagacguauucaccguaucaugucgaguauuaacucgaccaucuccagauuuugauuucaucuuuuuaguaccaccaacaguagaaucuagaacuaaaccuuuuacaguaccuauacuuacaguugaagaaaugacaaauucaagauuucccauaccauuagaaaaacuauuuacagguccauccggagccuucgucguacaaccucaaaacgguagauguacaacggacggaguacuuuuaggcacaacacaacuaucaccagucaauauaugcacauuuagaggagacgucacucauauagcugguucaagaaauuacacaaugaaucuagccgcccuaaacuggaacaauuacgauccaacagaagaaauaccagcaccccuuggaaccccagacuucguuggaaaaauacagggaguauuaacacaaacuacaaaaggagacggcuccacacgaggacacaaagccaccguauauacaggaucagcagauuuuaccccaaaauuaggcucaguacaauucuccacagauacugaaaacgauuucgaaacacaucaaaauaccaaauucaccccaguaggaguaauacaagacggaucaacaacacacagaaacgaaccccaacaauggguucuaccaucauauucaggaagaaacguacauaacguacaccucgcaccugcaguugcuccaacauuuccaggcgaacaacuacuauucuuuaggucaacaaugccagguuguucaggauaucccaauaugaaucuagauugcuuaauaccucaagaauggguacaacacuuuuaucaagaagcagccccagcucaaagugacgucgcucuacuacguuucgucaauccagacacaggaagaguacuuuucgaauguaaauuacauaaaucaggauaugucacaguagcacacacaggacaacacgauuuaguaauuccaccaaacggcuauuuccgauucgacagcuggguaaaucaauuuuacacauuagcaccaauggguaacggagcuggaagaagaagagcauuauaa

SEQ ID NO: 32988 - RNA, 1623 nt, Artificial Sequence
  derived and/or modified sequence opt6 from major_capsid_protein__Norovirus__AFU92709
augaaaauggcaucuagcgacgcaaaccccuccgauggaucuaccgcaaaccucgucccagaaguaaacaacgaaguaauggcacuagaaccaguagucggugcagcaauugccgcaccaguagcaggacaacaaaacguaauagacccauggauaagaaauaauuucguacaagcaccaggcggagaauuuacaguaucacccagaaaugcuccaggagaaaucuuauggagcgcaccacuuggaccagaucuaaauccauaccuaucacaccuugccagaauguauaauggcuacgcuggaggauuugaaguacaaguaauacuagcaggaaaugcuuuuaccgccggaaaaauaauauuugcugcaguaccaccaaacuuuccuacugaaggauuauccccgucacaaguaaccauguucccacacauaaucguagacguaagacaauuagaaccuguuuuaauuccuuuaccagacguccguaauaauuuuuaucauuauaaccaauccaaugacccaacaaucaaacuaaucgccauguuauauacaccauuaagagcuaauaacgccggcgacgauguauucacaguaucaugcagaguacuaacacgacccucaccugauuucgacuuuaucuuuuuaguaccaccaacuguugaaucuagaacaaaacccuucucaguaccuguacuaacuguagaagaaaugacaaacucaagauuuccaauuccguuagaaaaacuauuuaccggaccuucaucagcauucguaguacaaccacaaaacggaagaugcacaaccgacggcguauuacuaggaacaacucaauuaaguccaguaaauauauguaccuuucgaggagacguaacacacaucccugguucaagaaauuacacuaugaauuuagcaucacaaaauuggaacucauaugauccuacugaagaaauacccgccccucuaggcacccccgacuucguaggaaaaauacaaggaguauuaacacaaacaacaagaaccaacggauccacaagaggacacaaagcuaccguuuauacaggaucagcagacuuuucaccaaaacuuggaagaguacaguuugcuacagauacagacaacgacuucgaaacaaaccaaaacacaaaauuuaccccuguaggaguaauccaagauggaucuacaacuccucgaaaugaaccccaacaauggguacuaccuucauacagcggaagaaacauucacaauguacaucuagcaccagcaguggcaccaacauuccccggagaacaauuacuuuucuuucgaucgacaaugccaggaugcagcggauauccaaauauggauuuagauugucuuuuaccucaagaauggguucaauacuucuaccaagaagcagcaccagcccaaagcgaugucgcacuacucagauucguaaauccagacacuggacgaguccuauucgaaugcaaauuacauaaaucaggauauguaacaguagcacacacaggacaacacgauuuaguaauaccaccaaauggauacuuccgauuugauucauggguaaaucaauucuauacauuagcaccaaugggaaauggaaccggcagaagaagagcgcuauaa

SEQ ID NO: 32989 - RNA, 1623 nt, Artificial Sequence
  derived and/or modified sequence opt6 from major_capsid_protein__Norovirus__AFU92710
augaaaauggcauccucagacgcaaacccaucagauggaucaacagcaaacuuaguaccagaaguaaauaaugaaguaauggcacuugaaccaguuguaggagcagcaauagcagccccaguggcaggucagcaaaacguaauugacccauggauaagaaauaacuuuguccaagcaccagguggagaauuuacaguauccccaagaaacgccccaggagaaauauuauggucugcuccacucgguccugauuuaaauccuuauuuaucacacuuggcccgaauguauaacggauacgccggaggauucgaaguacaaguaauauuagcagguaaugcauuuacugcaggaaaaauaauuuucgcagcaguacccccuaauuuccccacagaaggucuuuccccaucacaagucacaauguucccacauauuauagucgauguuagacaacuagaacccguacuaauaccacuuccagauguccgaaauaauuucuaucacuauaaccaaagcaacgacccaacuauaaaauuaauagcaauguuauauacaccacuucgugcuaauaaugcaggagacgacguauuuacaguaucauguagaguucucacaagaccaucacccgacuuugacuucauauuucuaguaccucccacaguagaaucaagaacaaaaccauuuucaguaccaguacuaacagucgaagaaaugacaaauucacgauucccaauuccuuuagaaaaauuauucaccggaccaucuucagcuuucguaguucaaccucaaaacggaagauguaccacagacggaguccuacuagguacaacacaauuaucaccagucaauaucuguacauuuagaggagauguaacacauauaccaggcucuagaaacuauaccaugaauuuagcuucacaaaacuggaacucauacgacccaacagaagaaauaccagccccccuaggaaccccugauuucgucggaaaaauacaaggaguucuuacccaaacuacacgaacaaacgguuccacacgaggacacaaagcaacaguauauacuggcucagcagacuuuagcccaaaauuaggaagaguacaauucgcaacagauacagacaacgacuucgaaacaaaucaaaacacaaaauuuacuccuguuggugucauccaagauggaucuacaacaccacguaaugaaccacaacaauggguacuaccuucuuauucuggaagaaauauacauaacguacaccuagcuccagcaguagcuccaacauuucccggggaacaacuauuauucuucagaucaacuaugccagguugcucaggauaucccaauauggacuuagauugccuacuaccucaagaauggguacaauauuuuuaccaagaagcagcaccagcacaauccgauguagcauuauuaagauuuguaaacccagacaccggaagaguauuauucgaaugcaaacuacacaaaucuggcuacguaacaguagcucacacaggccaacacgaucuaguaauaccuccaaauggauauuucagauuugauucuuggguaaaucaauuuuauacacuagcacccaugggcaacggaacagguagaagaagagcacuuuaa

SEQ ID NO: 32990 - RNA, 1623 nt, Artificial Sequence
  derived and/or modified sequence opt6 from major_capsid_protein__Norovirus__AFU92711
augaaaauggcaaguucagaugcuaauccauccgacggcucuacagcaaaccuugucccagaaguaaacaacgaagucauggcucuagagccuguaguuggagcugcaauagcugcaccagucgcuggacaacaaaauguaaucgacccauggauuagaaauaacuucguacaagcacccggaggagaauuuacagucucacccagaaacgcuccaggagaaauauuauggucagccccccucggaccagacuuaaauccauauuuaucacaccuugcuagaauguauaacggauaugcaggagguuucgaaguacaaguaauuuuagccggaaaugcauuuacagcaggaaaaauaauuuuugcugcaguaccaccuaauuucccaacagaaggacuaucaccaucacaagucacuauguucccacacauaauuguagacguacgccaacuagaaccaguacuuauaccacuacccgauguaaggaauaacuuuuaccacuauaaucaaucaaacgacccaacuauaaaacuuauagcaauguuauauacaccccuaagagcaaacaacgcaggcgacgauguauuuacaguaucaugcagaguacuaacacgaccaucaccagacuuugauuuuauauuccuaguuccacccacaguagaaagccgaacaaaaccauuuucagucccugucuuaacaguagaagaaaugacaaauagucgauucccaaucccauuagaaaaacuuuucaccggacccagcucugcauucgucguucaaccacaaaauggcagaugcacaacagacgguguuuuacuagguacuacucaauuaucaccagucaauauauguacauuuagaggagacguaacacauauuccaggaucaagaaacuacaccaugaacuuagcuucacaaaacuggaacucauaugacccaacagaagaaauaccagcacccuuaggaaccccugacuuuguaggaaaaauacaaggagucuuaacacaaacaacuagaaccaauggaucaacucgcggccacaaagcaaccguuuacacagguuccgcugacuucucaccaaaauuaggaagaguucaauucgcuacagauacagauaacgauuucgaaaccaaucaaaauacuaaauuuacaccaguaggagucauacaagacggauccacuacaccuagaaaugaaccacaacaauggguauuaccauccuacagcggaagaaauauacacaacguacaucucgccccagccguagcuccaacauuucccggagaacaauuauuauuuuuuagaucaacaaugccuggauguucugguuauccaaacauggauuuagauugccucuuaccacaagaauggguucaauauuuuuaucaagaagccgcaccagcacaaucagacguugcauuauuacgauucguaaauccagauacugguagaguauuauuugaauguaaauuacauaaauccggauauguaacaguagcacauaccggucaacacgauuuaguaauaccacccaacggauauuucagauuugauuccuggguaaaucaauucuacacacuagcaccaaugggcaauggaacaggcagacgaagagcucuauaa

SEQ ID NO: 32991 - RNA, 1623 nt, Artificial Sequence
  derived and/or modified sequence opt6 from major_capsid_protein__Norovirus__AFU92712
augaaaauggcaaguaaugacgcaaacccaucagaagguucugcagcaaauuuaguaccugaaguaaauaaugaaguaauggcucuagaaccaguaguuggugcagcuauagcagcaccuguugccggacaacaaaauguaauagacccauggauaagaaacaauuucguacaagcaccaggaggagaauucacuguauccccaagaaaugcaccuggaacaauaagaugguccgcaccuuuagguccagaucuaaauccuuaccuaucacaucuagcaagaauguauaauggauaugcaggcggauucgaaguucaagucauauuagcagggaacgcauucaccgccggaaaaauaauauucgcugcaguaccaccuaacuuuccaacagaaggacuaucaccaucccaaguaacuauguucccacacaucauaguagauguaagacaacuagaacccguauuaauaccacuacccgacguaagaaacaauuucuaucauuacaaccagucaaaugauagcaccauaaaauuaauagcaaugcuauauacuccacuacgcgcaaauaaugcuggagaagauguauucacuguaagcuguagaguccuaacuagaccaucacccgacuuugacuuuaucuuccuaguaccaccaacuguagaaaguagaacaaaaccauuuacuguacccauacuaacaguugaagaaaugacaaacucaagauuuucaauuccacuagaaaaauuauuuacaggaccaucaggcgcuuucguaguacaaccacaaaauggcagaugcacaacagacggaguauuauuaggaacaacucaacuaaguccaguaaauauauguaccuuuagaggugauguaacacacauagcaggaagcagaaauuacacuaugaauuuagcagcauuaaauuggaacaauuacgauccaacagaagaaauaccagccccauuaggaacuccugauuuuguagguaaaauacaaggaguauuaacacaaacaacaaaaggagacgguucaacuagaggacacaaagcuacaguauauacaggauccgcagauuuuacaccaaaacuaggaucuguacaauucucuacugauacagaaaacgauuuugaaucucaucaaaauacuaaauucacaccaguaggcguaauccaagacggaucaacaacacauagaaaugaaccacaacaauggguacugccaucauauucugguagaaauguacacaauguacacuuagcaccagcuguagcacccacauucccuggagaacaacuauuauuuuuucgaucuacaaugccaggauguucugguuauccaaauauggaucuagauuguuuaauaccccaagaguggguacaacauuucuaucaagaagcagcaccagcucaaucagacguugcacuauuaagauuuguuaacccagauacuggaagaguuuuauucgaaugcaaacuucauaaaucaggauauguaacuguagcacacacaggacaacaugacuuaguaauaccaccaaacggcuauuucagauuugacucuuggguuaaucaauuuuacacucuagcucccauggguaauggagcaggacguaggagagcacuauaa

SEQ ID NO: 32992 - RNA, 1623 nt, Artificial Sequence
  derived and/or modified sequence opt6 from major_capsid_protein__Norovirus__AFU92713
augaaaauggcaucaucagacgcaaauccaucagauggcuccacugcaaauuuaguuccagaaguaaacaaugaaguuauggcauuagaaccaguaguaggagcggcuauagcagccccagucgcaggacaacaaaauguuauugauccuuggauuagauccaacuuuguacaagcuccagguggugaauucacuguaucaccaagaaaugcuccaggagaaauauuauggucagcaccauuagguccagaucuuaauccauauuuaucccacuuagcucgaauguauaacgguuacgcaggaggcuuugaaguccaaguaaucuuagcugguaaugcauucacagcagguaaaauaaucuucgcagcagucccaccaaacuucccaacagaaggacuaucaccaucccaaguuacaauguucccacacauuaucguagauguuagacaacuagaaccaguauuaauuccacuaccugauguuagaaacaauuuuuaucacuauaaccaaucuaaugacccuacaauaaaacuaauagcaaugcuuuacaccccauuaagagcuaauaaugcaggagacgacguauuuacaguaucauguagaguacuaacuagaccgucaccagauuucgauuuuauauuucuaguaccuccaacaguagaaucaagaaccaaaccauucucaguccccguauuaacaguagaagaaaugacuaacucuagauuuuccauaccauuagaaaaacuauuuacaggcccaucaucugcuuuuguuguacaaccacaaaacggacgaugcacuacagacggaguacucuuaggaacaacccaauuaucaccaguaaauauauguaccuuucgaggagacguuacacacauaccaggauccagaaauuauacaaugaaccuagcaucccaaaacuggaauucauacgacccaacagaagaaaucccagccccauuaggcacuccagauuuuguagguaaaauucaaggaguacuaacucaaacaacacgaacaaacggaucaacuagaggccauaaagcuacaguauauacuggaucugcagauuucuccccaaaacuuggaagaguccaauucgcaacagacaccgauaacgauuuugaaacaaaucaaaacacaaaauucacaccaguaggugucauacaagaugguucaacaacaccaagaaaugaaccacaacaauggguccuaccaagcuacucagguagaaauauacauaauguccaucuugcaccagcaguugcaccaaccuuuccaggagaacaacuauuauucuuuagaucuacaaugcccgguuguucaggauauccuaacauggauuuagauugucuauuaccccaagaauggguacaauauuuuuaucaagaagcagcuccagcacaaucagaugucgcauuauuaagauucguuaacccagacacaggaagaguauuauuugaaugcaaauuacacaaaucuggauauguaacugucgcacauacaggccaacaugaccugguaauaccuccaaauggauauuucagauucgauucauggguaaaccaauucuauacacuagcaccaaugggaaauggaacaggcagaagaagagcauuauaa

SEQ ID NO: 32993 - RNA, 1623 nt, Artificial Sequence
  derived and/or modified sequence opt6 from major_capsid_protein__Norovirus__AFU92714
augaaaauggcaucuucagacgcaaauccuucagacggaucaacagcaaaccuaguaccugaaguuaacaacgaagucauggccuuagaacccguaguuggagcugcaaucgcagcaccgguugcaggacaacaaaauguaaucgacccauggauucgcaauaauuuuguacaagcacccggcggagaauuuacaguaucaccaagaaaugcucccggagaaauauuauggucagcaccauuaggucccgauuuaaacccauaucuaucacacuuagcaagaauguauaacggauaugcaggaggauuugaaguacaaguaauauuagcaggaaaugcauuuacagcaggcaaaauaauauuugcagcaguaccaccaaauuuuccuacagaaggucuaucaccaucucaaguaaccauguucccacacauuauaguagacguaagacaacuagaaccuguacuaauuccacucccggauguacgaaauaacuucuaccacuauaaucaaagcaaugacccaacaauaaaauuaauagcuaugcuuuacacaccauuaagagccaacaaugcaggagacgauguauucacuguaucaugcagaguucuaacuagaccauccccugacuuugacuuuauauuucuaguaccaccuacaguagaaucaagaacuaaaccuuuuucagucccaguauuaacugucgaagaaaugacaaacucuagauuuccaauaccauuagagaaauuauuuacaggaccaucuucagcauuugucguacaaccucaaaacggaagaugcacaaccgacggaguacuuuuaggcacaacccaauuaucaccaguaaacauauguaccuuuagaggagauguaacacacauaccuggaucaagaaacuacacaaugaaucuagccucacaaaacuggaauucauaugauccaacagaagaaaucccugcuccacuaggaacaccugauuuuguaggaaaaauacaaggaguauuaacacaaaccacacgcacaaacgguucaacaagaggacacaaagccacaguauacacuggcagcgcugacuuuagucccaaacucggaagaguacaauucgcaacagacacagauaaugacuucgaaacaaaccaaaauacaaaauuuacaccuguaggcguaauacaagacggaucuacaacacccagaaaugaaccacaacaauggguauuaccauccuauucuggcagaaacauacauaauguccaucuagcucccgcagucgcaccaacuuucccuggagaacaauuacuauuuuuccgaucaacaaugccaggcugcucaggauacccuaauauggacuuagacugcuuacuaccccaagaauggguacaauacuuuuaucaagaagccgcaccagcgcaaucagacguagcauuauuaagauucguuaacccugauacuggcagagucuuauucgaauguaaacuccacaaaucaggauacguaacagucgcacacacaggacaacacgauuuaguaauccccccaaauggauauuuucgcuuugacucaugggucaaucaauuuuacacacucgccccaaugggaaaugguaccggcagaagacgugcacuauaa

SEQ ID NO: 32994 - RNA, 1623 nt, Artificial Sequence
  derived and/or modified sequence opt6 from major_capsid_protein__Norovirus__AFU92715
augaaaauggcuucaucagacgcaaauccaucagauggcaguaccgcaaaccuuguaccugaaguaaacaaugaagucauggcuuuagaaccgguaguaggugcagcaauagcugccccaguagcaggacaacaaaacguuauagauccuuggauaagaaacaauuucguacaagcuccaggaggcgaauuuacaguaucacccagaaaugcaccaggagaaaucuuguggucagcuccacucggaccagaccuaaauccauauuuaucucaccuagccagaauguacaacgguuaugcaggaggcuucgaaguacaagucauauuagcuggaaacgcauuuacagcaggcaaaauaauauuugcagcaguaccuccaaauuuuccuacagaaggauuaucaccaucacaagucacaauguuuccucacauaauaguagaugucaggcaacuagaaccaguauuaauaccauuaccagauguaagaaacaacuuuuaucacuauaaucaauccaacgacccaacaauaaaacuaauagcaaugcucuacacaccacuaagagcaaacaaugcaggagacgauguauucacaguaucaugccgagucuuaaccagaccgucaccagacuucgauuuuauuuuucuaguaccgccuacugucgaaucucguacaaaaccuuucucuguaccaguuuuaaccguagaagaaaugacaaacucaagauucucaauaccauuagaaaaacuauuuacuggucccucuucagccuucguaguacaaccacaaaauggaagauguacaacagacgguguucuauuagguaccacacaauuaucuccagucaauauauguaccuuucgaggcgacguuacccacauuccaggaucaagaaauuacacaaugaaccuagcaucacaaaacuggaacucuuacgacccuacugaagaaaucccagcuccacuagguaccccagacuuuguaggaaaaauucaaggagucuuaacacaaaccacaagaaccaauggcaguacaagaggacacaaagcaacuguuuauaccggaucagcagauuuuucuccuaaauuaggaagaguacaauucgcaacagauacagauaacgauuuugaaaccaaucaaaauacuaaguuuacucccguagguguaauacaggauggaaguacuacuccaagaaacgaaccucaacaauggguacuaccaucauacuccgguagaaauauccauaacguacaccuagccccagcaguagcaccaacauucccuggugaacaacuccuauucuucagauccacuaugccaggaugcucaggauauccuaauauggauuuagauugccuacucccucaagaauggguucaauauuuuuaccaagaagcagcaccagcacaauccgacguagcucuauuaagauucguuaacccagauacaggccgaguccuauucgaaugcaaauuacauaaaagcggauauguaacuguugcacacacaggccaacaugaucuaguaauaccaccaaauggauacuucagauucgauucauggguuaaucaauuuuauacacuagccccaaugggcaauggaacaggacgacguagagcuuuauaa

SEQ ID NO: 32995 - RNA, 1623 nt, Artificial Sequence
  derived and/or modified sequence opt6 from major_capsid_protein__Norovirus__AFU92717
augaaaauggcuagcucagauccaaauccaucagauggaucuacugccaauuuaguaccagaaguuaacaaugaaguuauggccuuagaacccguaguaggagcagccauagccgcaccugucgcaggacaacaaaaugucauugacccuuggauaagaaauaacuuuguacaagcaccaggaggagaauucacagugucaccaagaaacgccccaggagaaaucuuauggucagccccuuuaggcccugauuuaaauccauaucuaucacaucucgcccguauguauaauggcuacgcaggaggauuugaaguucagguaauacuagcaggaaaugcauuuacagcaggcaaaauaauauucgcagcaguaccaccaaauuuuccaacugaagguuuaucaccaucacaaguaacaauguuuccacauauuauaguagauguaagacaacucgaacccguauuaauuccacuuccagacguacguaauaauuucuaccacuauaaucaaucaaaugauucuaaacuuaaauuaagaccaauguuauacacaccacuaagagccaauaaugcaggagacgaugucuuuacugucucuugucgaguacuaaccagaccaucaccugacuuugacuuuaucuuucuaguaccaccuaccguagaaucuagaacaaaaccauuuucaguaccagucuuaacaguagaagaaaugacaaauucucgauuucccauacccuuagaaaaacuauuuacagggcccucaucagcauucguuguacaaccacaaaacggucgauguaccacugacggcgucuuauuaggaaccacccaacuuucaccagucaacauauguacauuuagaggcgacguaacacacauacccggaucaagaaauuauacaaugaaucuagcaagucaaaauuggaauuccuaugacccaacagaagaaauaccagccccacucggaacaccagacuuuguaggaaaaauacaaggaguauuaacucaaacaacaagaacaaacggaucaacaagaggacacaaagcuacaguauauacgggauccgccgacuucucaccaaaacuaggacguguacaauucgcaacagauaccgauaaugacuucgaaacaaaccagaauaccaaauuuacaccaguuggaguaauacaagacggaagcacuacuccacguaacgaaccacaacaauggguacuaccaagcuauaguggaagaaacauucauaacguucaucuagccccugcuguugcaccuacuuuuccuggagaacaacuacuauucuuuagaucaaccaugccagguugcaguggauauccaaacauggauuuagacugcuuauuaccacaagaauggguccaauauuucuaucaagaagcagcaccagcacaaucagacgucgcuuuacuacgcuucguaaauccagacacaggaaggguucuauucgaaugcaaauuacauaaaucuggauacguaacaguagcacauacaggacaacacgauuuaguaauaccaccaaauggcuauuucagauucgauuccuggguaaaccaauuuuacacacuagcaccaaugggaaacggcacaggaagaagacgagcacuuuaa

SEQ ID NO: 32996 - RNA, 1623 nt, Artificial Sequence
  derived and/or modified sequence opt6 from major_capsid_protein__Norovirus__AFU92718
augaaaauggcauccaacgacgcaaacccuucugauggaucuacagcaaacuuaguaccugaaguaaacaaugaaguaauggcacucgaaccaguaguaggagcagcaauagcugcaccaguagcuggucaacaaaauguaauagauccuuggauuagaaauaauuuuguacaagcaccuggcggagaauuuaccgucucaccuagaaacgccccaggagaaauauuauggucugcaccauuaggaccagacuuaaauccauauuuaucucaccuagcacgaauguacaacggauaugcaggaggcuucgaaguacaaguaauacuagcaggaaaugcuuuuacagcuggaaaaauaauauuugcagcaguaccacccaauuuuccaaccgaaggccuuucacccucacaaguuaccauguucccacacauaauaguagacguaagacaacuagaaccuguuuuaauaccauuaccagauguucgaaauaauuucuaucauuauaaccaauccaaugauccaacaauuaaacuaauagcaauguuauauacaccacuuagagcaaacaacgccggagaugacguuuuuacuguaaguuguagaguuuuaacuagaccaucacuagacuuugauuuuauauuuuuaguuccaccaacaguugaaagcagaacaaaaccauucucagucccuguauuaacagucgaagaaaugacaaauucuagauuuccaauucccuuagagaaacuauucacaggaccaucaagcgcauucguuguacagccacaaaauggaagauguaccacugacggaguacuauuaggaacaacccaacuaucacccgucaacauaugcacauucagaggagacguaauacauauaccaggaagcagaaacuauacaaugaauuuagcaucucaaaacuggaacucauaugauccuacugaagaaauaccugcaccauuaggaacaccagacuuuguugguaaaauacaaggaguauuaacccagaccacccgaacuaacggaucaacuagaggacauaaagcaacaguauacaccggaagcgccgauuucucacccaaauuagguagaguccaauucgcuacagacacugauaaugauuucgaaacaaaucaaaauacuaaauucacgccaguuggaguuauacaagauggaucaacaacaccacgaaaugaaccucaacaauggguuuuaccuucauauuccggaagaaauauacauaacguacaucucgcaccagcaguagcaccuacuuuuccaggagaacaauuauuauucuuucgcucuacaaugcccgguuguucaggauauccaaauauggacuuagacugcuuacuaccucaagaauggguacaauauuuuuaucaagaagcagcuccugcacaaucagauguagcauuacuaagauuuguaaacccagauaccggaagaguacuuuucgaaugcaaacuacacaaaagugguuaugucacaguagcacacacuggacaacacgaccucguaaucccuccaaauggauauuucagauucgauucauggguaaaccaauuuuauacuuuagcuccaaugggaaaugguacgggccgacgacgagcauuauaa

SEQ ID NO: 32997 - RNA, 1623 nt, Artificial Sequence
  derived and/or modified sequence opt6 from major_capsid_protein__Norovirus__AFU92719
augaaaauggcaucaaaugaugccaauccaucagauggcucagccgcaaaucuaguuccagaaguuaacaaugaaguaauggcccuugaaccaguuguaggagcagcaauagcagcacccguagcaggacaacaaaacgucauagauccuuggauaagaaauaacuucguccaagcuccaggcggagaauucaccguaagcccaagaaaugcaccaggcgaaaucuuauggagugcaccucuuggaccagaucuaaacccauacuuaucacaucucgcacguauguacaauggauaugcaggagguuucgaaguacaaguaauuuuagcaggaaacgcauuuacagcaggaaaaaucauuuuugcagccguaccaccaaacuuuccuacagaaggucuuuccccaucacaaguaacuauguuuccacacauaauaguagacguccgacaacuugaaccaguacuaauaccauuacccgaugucagaaacaacuuuuaccacuauaaccaaucaaaugacucaacaauaaaauuaauagcaaugcuauauacaccacuacgagcaaauaacgcaggugaagacguauuuacgguaucuugccgaguacuaacacgaccaagcccagacuuugauuuuauauuucuaguuccaccaaccgucgaaucucgaacuaaaccauuuacuguacccauacuaacaguagaagaaaugacaaacucaagauuuccgauaccucucgaaaaacuuuuuaccggaccuucaucugcauucguaguacaaccacaaaauggaagauguacaacagacgguguuuuauugggaacaacucaacuaucuccagucaauaucuguacauuucguggcgacguaacacacauagcuggauccagaaauuacacaaugaaucuagcuucuuuaaacuggaacaauuacgacccaacugaagaaauaccagcaccauuaggcacaccagacuucgucggaaaaauccaaggaguauuaacacaaacaaccaaaggcgacgguucaaccagaggacauaaagccacaguauacacagguucagcacccuuuacacccaaacuaggaucaguucaauucucaaccgauacagaaaaugacuucgaaacacaccaaaacacaaaauucaccccuguagguguaauacaagacggaggaacaacacaucgaaaugaaccacaacaauggguauuaccaucauauucaggaaggaauguaccaaacguacaccuagcaccugcaguagcaccaacauucccuggcgaacaacuacuauucuuucguucuacuaugccaggaugcucaggauaucccaacauggauuuagacugucuacugccacaagaauggguccaacauuucuaucaagaagcagcuccagcacaaucagauguagcuuuacuaagguuugucaacccagacacaggaagaguauuauuugaaugcaaacuccacaaaucaggauacgucacaguugcacacacaggacaacacgauuuagucauaccacccaacggcuauuucagauucgacucaugggucaaccaauuuuauacauuagcaccaaugggaaauggaacuggccgacgaagagcauuauaa

SEQ ID NO: 32998 - RNA, 1623 nt, Artificial Sequence
  derived and/or modified sequence opt6 from major_capsid_protein__Norovirus__AFU92720
augaaaauggcaucaucugaugcacaucccucagauggaucaacagcuaacuuagucccagaaguaaacaaugaaguaauggcauuagaaccagucguaggagcagcaauagccgcaccugucgcaggacaacaaaauguaauagauccauggauaagaaauaauuuuguccaagcaccaggaggagaauuuacaguuuccccaagaaaugcaccuggagaaauauuauggucagcuccucuuggaccagauuuaaauccauaccuaucucaccucgcacguauguacaauggcuacgccggaggauucgaaguucaaguaauacucgcagguaacgcauucaccgcaggaaaaauaauuuuugcagcuguuccaccaaauuuuccaaccgaaggacucucaccgucgcaaguaacaauguuuccacauauuauaguagacguacgacaacuagaacccguacuuaucccauuaccagauguaagaaauaauuuuuaucauuauaaccaauccaacgacccaacaauaaaauuaauagcaauguuauacacaccauuaagagcuaacaaugcaggugaugacguauuuacaguaucaugccgaguccuaacacgaccuuccccagauuuugacuucauauuccuagucccaccuaccguagaaucacgaaccaaaccauuuucuguaccuguauuaacaguagaagaaaugacaaacucacgcuuuccgauaccacuagaaaaacuauuuaccgguccauccucagcuuucguaguacaaccacaaaauggaagaugcacaacugaugguguacuauuagguacaacacaauuaucaccaguuaauauauguaccuucagaggagacguuacacauauacccgguucucgaaauuauacaaugaauuuagcaucgcaaaauuggaacucuuacgauccaaccgaagaaauaccagcuccacuugguacacccgacuucguaggaaaaauacaaggaguauuaacacaaacgaccagaacuaacggcucaacaagaggccacaaagcuacugucuauacagguucagccgacuuuucacccaaacuuggcagaguucaauuugcaacagauaccgacaaugauuucgaaacaaaccaaaauacaaaauucaccccagucggaguaauacaagacggauccacuaccccaagaaaugaaccacaacaauggguucuaccuucuuauucaggaagaaacauacauaauguccacuuagcaccagcaguugcaccaacauucccaggugaacaauuacuauuuuucagauccacaaugcccggcugcuccggauauccaaacauggaccuagacugucuacuaccccaagaauggguccaguacuucuaucaagaagcugcuccagcccaaucagauguugcacuauuaagauucguaaacccugauacaggaagagucuuauucgaauguaaauuacacaaaucuggauauguaacaguugcucauacaggccaacacgacuuaguaauaccuccaaauggauauuucagauucgacucaugggucaaucaauucuauacauuagcuccaaugggaaaugguacaggacguagaagagcacuauaa

SEQ ID NO: 32999 - RNA, 1623 nt, Artificial Sequence
  derived and/or modified sequence opt6 from major_capsid_protein__Norovirus__AFU92721
augaagauggcaucaucugacgcacauccaucagacggcucuacagcaaacuuagucccugaaguuaauaaugaaguaauggcauuagaaccaguaguaggugccgcuauagcagccccagucgcuggccaacaaaauguaauagacccauggauuagaaauaacuuuguccaagcuccagguggagaauuuacaguaucuccaagaaaugcaccaggagaaauuuuaugguccgccccacucggacccgaucuaaauccauaucuaucacaccuugcaagaauguauaauggcuaugcaggaggauucgaaguacaaguaauauuagccgguaaugcuuuuacagcuggcaaaauaauauucgcagcaguuccuccaaauuuuccaacugaaggacuaucaccaucucaaguuaccauguuuccacacauagucguagacguacgacaacuagaacccguacuaauaccauuaccagacguucguaauaauuuuuaucauuauaaucaaucaaaugacccaacuauaaaauuaaucgcaaugcuuuacacaccucuucgagcuaacaaugcaggagaugacguauuuacuguuucuugcagaguauuaacaagaccaucaccagacuuugacuuuauuuuuuuaguccccccaacaguugaaucacgaacaaaaccauucucaguuccaguauuaacuguagaagaaaugacaaacucaagauuuccaauuccauuagaaaaauuauucacaggaccaucaucagcauuugucguacaaccacaaaacggucguugcaccacugacggaguacuuuuaggaacaacacaacuaucucccguaaauaucuguaccuuuaggggagacguaacucauauaucagguucacgcaauuauacuaugaaccuagcuucacaaaauuggaauucuuacgacccaacugaagaaauaccugcaccauuagguacaccagacuuuguaggaaaaauucaagguguauuaacucaaacaacacguaccgauggaucaacaagaggacacaaagccacaguuuauacaggauccgcugacuuuuccccaaaauuaggaagaguucaauucgcaacagauacagauaaugauuucguuacaaaccaaaauacaaaauuuacuccuguuggugucauacaagauggaucuacuacaccacgcaaugaaccacaacaauggguucuaccuagcuauaguggaagaaacacacauaacguucaccucgcucccgcuguagcaccaacauucccaggagaacaauuauuauucuuuagaucaacaaugccagguugcucaggauauccaaauauggauuuagauugucuacuaccucaagaauggguacaauacuucuaucaagaagcagcaccagcacaaagugacguagcucuacuuagauuuguuaacccagacacaggacgaguacuuuucgaauguaaauuacacaaaucaggauauguuacuguagcacacacaggacaacaugaucuaguaauaccaccaaacggauauuucagauucgauuccugggucaaccaauucuacacuuuagcuccaaugggaaauggaacaggucguagaagagcauuauaa

SEQ ID NO: 33000 - RNA, 1623 nt, Artificial Sequence
  derived and/or modified sequence opt6 from major_capsid_protein__Norovirus__AFU92722
augaaaauggcuucauccgaugcaaauccaucugacggaucuacagcuaacuuaguaccagaaguuaacaaugaaguuauggcacuagaacccguaguaggugcugcaauugcagcaccaguugcaggacaacaaaauguaauagacccauggauuagaaauaacuucguccaagcaccugguggugaauuuacagucucaccacgaaaugcaccaggagaaauacuuuggucagccccauuaggaccagacuuaaaucccuauuuaucucauuuagcaagaauguauaacggauacgcaggugguuucgaaguacaaguaauucuagcaggaaaugcauucacagcuggcaaaauaauuuuugcagcuguacccccaaacuucccaaccgaaggauuaucucccucacaaguuaccauguucccacauauuauaguagauguuagacaacuagaaccaguacuaauaccauuaccagacguaagaaacaauuuuuaucauuacaaccaaucuaaugaucccacaaucaaacuaauagccauguuauacacaccuuuaagagcaaacaaugcaggagacgauguauucacuguaucauguagaguacucacaagaccuucaccagacuuugacuucauauucuuaguaccccccaccguagaauccagaaccaaaccauucucaguuccuguauuaacaguagaagaaaugacaaacagucguuuuccuauuccauuagaaaaacucuucaccgguccaucauccgcauuuauuguacaaccacaaaacggaagauguacaacagauggaguccuauuaggaacaacacaacuaucaccuguaaauauuugcacauuucgaggagauguaacucacauaucagguucaagaaauuacacaaugaaucucgcaucacaaaauuggaacucuuaugauccaacugaagaaauuccagcaccauuaggaaccccugauuuuguagguaaaauucaaggcguauuaacacaaacaacaagaacugacggaucaacacguggacauaaagcuacagucuauacaggaucagcagacuuuucuccuaaauuaggacgaguacaauucgccaccgauaccgauaacgacuuuguuacgaaucaaaauacuaaauucacaccagucggaguaauacaagauggcucaaccaccccaagaaaugaaccacaacaauggguuuugccuucuuauucagguagaaacacacauaauguacacuuagcaccagcagucgcuccuacauuucccggugaacaacuacuuuuuuuucgaucuacaaugccagguuguucaggauacccaaauauggaccuagacugcuuauuaccacaagaauggguacaauacuucuaccaagaagcagcaccagcacaaucagauguugcuuuacuaagguuuguaaacccagacacaggacgaguccuuuucgaaugcaaauuacacaaauccggauauguuacuguagcucacacaggucaacaugauuuagucauaccucccaauggauauuucagauuugacucaugggucaaucaauuuuauacuuuagcacccauggguaacggaacaggacgacgacgugcacuuuaa

SEQ ID NO: 33001 - RNA, 1623 nt, Artificial Sequence
  derived and/or modified sequence opt6 from major_capsid_protein__Norovirus__AFU92723
augaaaauggcaucaucagacgcaaauccaucugauggaucuacugccaaucuagucccugaagucaauaacgaaguaauggcauuagaaccaguaguaggagccgcaauagcagcaccagucgccggccaacaaaauguaauugacccuuggauuagaaauaacuuuguacaagcuccaggaggggaauuuacaguaucuccaagaaacgcaccuggugaaauucuauggagcgcaccucuagguccagauuuaaauccauacuuaucucaccuagcaagaauguauaauggauaugcaggcggauucgaaguucaagucauacucgcaggaaaugcauucacagccggaaaaaucauauucgcagcaguaccuccuaacuucccuacagaagguuuaucuccaagucagguuacaauguucccacauauagucguagacgucagacaacuagaacccguacuaauuccacuaccagauguucgaaauaauuuuuaucacuauaaucaaucuaaugaccccacaauaaaacuuauagcaauguuauauacaccacuaagagcaaauaaugcaggcgaugauguauuuacaguaucaugcagaguucucacaaggccaaguccugauuucgauuuuauuuucuuaguaccaccuaccguagaaagccgaaccaaaccauucucaguaccaguacuaacaguagaagaaaugacaaacucaagauucccaauacccuuagaaaaauuauucacgggaccaucaagugccuuuguaguacaaccacaaaauggucgaugcacaacugacgguguuuuacuaggaacuacacaacuaucuccaguuaacauaugcacauucagaggcgauguuacacacauuucaggaucaagaaauuauacuaugaaccuugcuucacaaaauuggaacuccuacgauccaacagaagaaauaccagcccccuuaggcacaccagacuucgucggaaaaauacaaggaguuuuaacacaaacuacaagaacagacggaucaacaagaggacauaaagcaacuguauacacaggaucagcagacuucuccccaaaacuaggacgaguccaauuugcuacagacacugacaaugauuucguaacaaaucaaaauacaaaauucacuccaguaggaguuauacaagacggaucuacaacacccagaaaugaaccccaacaauggguucuuccauccuacucaggacguaauacccauaacguacauuuagcacccgcaguagccccaacauuuccgggagaacaauuauuauucuucagauccacaaugcccgguuguagugguuauccuaauauggaucucgauugccuacuaccacaagaauggguacaauacuuuuaucaagaagcagcuccagcacaaucugacguugcauuacucagauuuguaaauccagacaccggaagaguauuauuugaauguaaacuucacaaaucagguuacguuacaguagcacacacaggucaacacgaucuaguaauaccacccaaugguuauuuccgauuugacucauggguaaaucaauuuuauacauuagcaccaaugggaaauggcacaggacgaagaagagcccuauaa

SEQ ID NO: 33002 - RNA, 1647 nt, Artificial Sequence
  derived and/or modified sequence opt6 from major_capsid_protein__Norovirus__AGD79474
augaaaauggcaaguaaugaugccaccccaucaaaugacggagcagcaggacuagucccagaaauaaauaacgaagcaauggcacuugauccaguagccggagccgcaauugcagcuccucuuaccggacaacaaaacauaauugaucccuggauaaugaauaauuuuguacaagcaccaggaggagaauuuaccguaagcccccgaaauuccccaggugaaguacuacucaacuuagaacucggaccagaaauaaauccauaucuagcacaccuagcaagaauguacaauggcuacgccggcggguuugaaguccaagucguucuugcuggaaacgcuuuuacagcaggcaaaauaauauuugccgcaauacccccaaauuuuccaaucgauaaucuaagcgcugcacaaauaaccaugugcccacauguaauaguagauguccgccaauuagaaccaguuaauuuaccaaugccagauguaagaaauaauuuuuuucauuacaaccaaggaucagauucaagauuaagacuaauagcaauguuauauacaccacuaagagcuaauaacucaggggacgauguauucacaguaucauguagaguacuuacacgaccaucaccagauuuuuccuuuaauuucuuagucccaccaacaguagaauccaaaacaaaaccauuuacauuaccaaucuuaacaauauccgaaaugucaaacucuagauuuccuguaccuauagacucucuacacacuucaccaacagaaaauauagucguacaaugucaaaauggaagagucacccuagauggugaacuaauggguacaacccaauuacuuccaucccaaaucugcgcauuuaggggaguccuaacaagaucaacaucacgcgcauccgaucaagcagacaccgcaacacccagauuauucaacuauuauuggcauauacaacuagauaaccuuaaugguacacccuaugacccagcagaagacauaccuggaccacuaggaacgccagacuuccgaggcaaaguauucggcguagcaucucaaagaaauccagauucaacuacaagagcucaugaagcuaaaguagauacaacagccggaagauuuacaccaaaacuaggaucauuagaaauaucaacagaaucagacgauuucgaccaaaaucaaccaacuagauuuacaccaguagguauaggaguagaccgcgaagcagacuuccaacaauggucacuaccagacuacuccggacaauucacacacaauaugaaucuagcaccugcaguugcuccaaacuuuccaggcgaacaauuacucuuuuuuagaucucaacuaccuucaagcggaggaagaucaaaugguguuuuagacugccuagucccccaagaauggguacaacacuuuuaucaagaaucugcaccagcacaaacacaagucgcauuaguaagauauguaaacccagauacagguagaguucuauuugaagcuaaacuccacaaauuaggcuuuaugacuauagcaaaaaacggagacuccccuauaacaguccccccuaaugguuauuucagauucgaaucuuggguaaauccuuuuuauacauuagccccaaugggaacaggcaauggccgacgaagaguccaauaa

SEQ ID NO: 33003 - RNA, 1647 nt, Artificial Sequence
  derived and/or modified sequence opt6 from major_capsid_protein__Norovirus__AGD79475
augaaaauggcaucaaacgacgcuaccccaagcaacgacggugccgcaggacuaguaccggaaauaaacaaugaagcaauggcguuagauccuguagccggagcagcaauagcagcaccauuaacaggucaacaaaauauaauagacccauggauaaugaacaauuucguucaagccccuggcggagaauucacaguaucccccagaaacucucccggagaaguccuacuaaaucuugaauuaggaccagaaauaaacccauaucuugcucaccuugccagaauguacaacggcuaugcaggaggauucgaaguucaaguuguacuagcaggcaacgcauucacugcaggcaaaauuauauuugcagccauaccaccuaacuuccccauagauaaucuaucugcagcccaaauaacaauguguccacauguaauagucgauguaagacaauuagaaccaguaauccuaccaaugccugacgucagaaacaacuuuuuccauuacaaccaaggauccgacucacgacuuagauuaauagcaaugcuauacacaccuuuacgagcaaauaauucaggcgaugacguauuuacuguuucauguagaguucuaacacgaccaucaccagacuucucauuuaacuuucuaguacccccaacaguugaaucaaaaacaaaacccuuuacauuaccuauacuaaccauaucagagaugucuaauucaagauuuccagucccuauagacucauuacauacuagcccuacagaaaauaucguaguacaaugucaaaauggacguguaacacuagauggagaauuaaugggaacaacucaacuacucccaucacaaauuugugcauucagaggagucuuaaccagaucuacaucuagggcaucagaucaagcagacacaguaacacccagacucuuuaacuauuauuggcacauacaacuagauaaccuaaacgguacaccauaugauccagcagaagauauaccuggaccacucggaacaccagauuucagaggaaaaguauuugguguagcaucacaacgaaauccagacuccaccacaagagcacaugaagcaaaaguagacacuacagcaggacgauucacaccaaaauuaggaucacuagaaauaucuaccgaaucagacgauuucgaucaaaaucaaccaacuagauucacaccuguaggaauaggaguagacagagaagcagacuuucaacaauggucacuaccugauuauuccggacaauucacacauaauaugaacuuagcaccagcaguugcaccaaauuuuccaggagaacaauuacuauuuuuccgaucacaauuaccaucaucaggaggaagaucaaauggaauauuagacugucuaguuccacaagaauggguacaacacuucuaucaagaauccgcacccgcccaaacacaaguagccuuaguucgauaugucaacccagauacaggccgaguacuauucgaagcaaaacuccacaaauuagguuuuaugacaauugcuaaaaauggagauucucccauaacaguuccaccuaauggauacuuccguuuugaaaguuggguaaaucccuucuacacauuagcaccaaugggaacaggaaacggcagacgaagaauacaauaa

SEQ ID NO: 33004 - RNA, 1647 nt, Artificial Sequence
  derived and/or modified sequence opt6 from major_capsid_protein__Norovirus__AGD79476
augaaaauggcuucuaaugacgcugcaccauccaacgacggagcagcaggacuaguacccgaaauaaacaacgaagcaauggcauuagaaccaguagcaggcgcagccauagcugcacccuuaacaggacaacaaaacauaauagauccauggauaaugaauaacuucguacaagcaccaggcggagaauuuacaguaucaccaaggaacucacccggagaaguauuauuaaacuuagaacuaggaccagaaauaaauccauaccuagcacauuuagcuagaauguauaacggauacgccggcggcuuugaaguacaaguaguacuagcaggaaacgcauucacagcaggaaaaauaauauuugcagcaaucccaccuaauuuuccaauagacaauuuaucagccgcacaaauaacaauguguccacauguaauuguagacguaagacagcuagaaccaguaaacuuaccaaugccagauguacgaaauaacuucuuucacuacaaccaaggcucagacucuagacuaagacuaaucgcaauguuauauacaccuuuacgagcaaauaauucuggugacgaugucuuuacagucucaugcagaguacuaacuagaccaucaccagacuucucuuucaacuucuuaguaccaccuacaguagaaucaaagacaaaacccuuuucacuaccaauuuuaacaauaucggaaaugagcaauucacgauuuccaguaccuaucgauucauuacacacaucaccaaccgaaaacauuguaguacaaugccaaaacggaagaguaacacucgacggagaacucaugggaacaacacaacuacuaccuucucaaauaugugcauuccguggaguauuaacaagaucuacaucuagagcaagcgaccaagcagacacugcuacaccaagauuauuuaacuauuacuggcauauacaacuagacaaucuaaauggaacuccauacgauccugcagaagacauaccugguccacuaggcacaccagauuuucguggaaaaguauucggugucgcaagucaaagaaacccugauacaaccacacgugcacaugaagcaaaaguagauacaacuucuggccgauuuacccccaaacucggaucccuagaaauaucaacugaauccgacgacuucgaccaaaacaaaccaacacgcuucacaccaguaggaauaggagucgaccacgaagcagauuuccaacaauggacacuaccagauuacgcaggccaauucacacacaauaugaacuuagcaccagcaguagugccaaauuuuccaggagaacaauuauuauucuuccgaagccaacuuccuucaucagguggaagaucaaacggaauuuuagauugcuuaguuccacaggaauggguacaacacuuuuaucaagaaucagcaccaucacaaucccaaguagcauuaguuagauacauuaacccagauaccggucgaguacuauucgaagcaaaacuacacaaacuagguuucaugacaauagcaaaaaacggagauucaccaauaacaguaccacccaacgguuacuucagauucgaaucuuggguaaauccauucuacacccucgccccuaugggaacaggaaauggcagaagaagaauacaauaa

SEQ ID NO: 33005 - RNA, 1647 nt, Artificial Sequence
  derived and/or modified sequence opt6 from major_capsid_protein__Norovirus__AGD79477
augaaaauggcaucaaacgacgcagcaccauccaacgacggugccgcaggcuuaguaccagaaauuaacaacgaagccauggcauuagaaccaguagcaggagccgcaaucgcggcaccacuaaccggacaacaaaauauuauagacccauggauuaugaauaauuucguacaagcaccuggcggcgaauucacaguuucacccagaaacucuccaggagaagucuuacuaaauuuagaacuaggcccagaaauaaaccccuaucucgcccaccuugcaagaauguacaacggauacgcuggaggauucgaaguacaaguaguacucgcagguaaugcauuuacagccgguaaaauaaucuuugcagcaaucccaccaaauuuuccaauugacaaccucagcgcagcucaaauaacaauguguccacacguuaucguagauguaagacaacuagaaccaguuaacuuacccaugcccgauguaagaaacaacuucuuucacuacaaucaaggauccgacucaagacucagacuaauugcaaugcuauacacaccauuaagagcaaacaacaguggugacgauguauucacuguaaguugccgaguucuuacaagaccauccccagacuuuucauucaacuuuuuaguaccccccaccguagaaucuaaaacuaaaccauucucccuaccaauauuaacaaucucagaaaugucaaacucccgauucccaguaccaauagacucacuacacacaucaccaacugaaaacauagucguacaaugucaaaaugguaggguaacccucgacggagaauuaaugggaacaacccaauuacuuccaucacaaauuugcgcauucagaggaguacuaacacgaucaacaucaagagcaucugaucaagcagacacagcuaccccaagacuauucaauuacuauuggcacauacaauuagacaacuuaaauggaacccccuaugacccagccgaagacauaccaggaccacuaggaacaccagacuucagaggcaaagucuucgguguagccucacaacgaaauccagauacuucuacgagagcacacgaagcaaaaauagacacaaccucaggacgcuuuacaccaaaacucggauccuuagagauaucuacagaaucugacgauuuugaccaaaauaaaccaacaagauuuacacccguuggaauaggaguagaucaugaaacagacuuucaacaauggacauuaccagauuaugcaggacaacuaacucauaacaugaauuuagcaccugcuguagcaccaaauuuuccaggcgaacaacuauuauucuuuagaucacaauuaccaucaucaggaggacgauccaauggaauucuagacugucuuguaccccaagaauggguacaacauuucuaccaagaaagcgcuccuucacaaucucaaguagcccuaguaagauauauaaacccagacacuggacgaguucuauucgaagcaaaacuacauaaacuaggauucaugacaauagcuaaaaauggagacucacccauuacaguuccuccaaacggcuauuucagauucgaaucauggguaaaucccuuuuauaccuuagcuccaaugggaacaggaaauggccgaagacgaauacaauaa

SEQ ID NO: 33006 - RNA, 1647 nt, Artificial Sequence
  derived and/or modified sequence opt6 from major_capsid_protein__Norovirus__AGD79478
augaaaauggccaguaacgacgcagccccuaguaaugauggugcagcaggcuuaguuccugaaaucaacaacgaagcaauggcucuagaaccugucgcaggagcugcaauagcagcaccauuaaccggucaacaaaauauaauagauccauggauaaugaauaacuucguacaagcaccaggaggugaauucacaguaucaccacguaacucaccaggcgaaguauuauuaaaccuagaauuagguccagaaauaaacccuuaccuagcacacuuggcacgaauguacaacggauacgccggaggauucgaaguucaaguaguauuagcaggcaacgcauucacggccgguaaaauaauauuugccgcaauaccaccaaauuucccaauagacaacuuaucagcagcacaaauaaccaugugcccacaugucauuguugauguucgucaacuagaaccaguaaaccuccccaugcccgacguccgcaauaauuuuuuucauuauaaccaaggaucagauucuagguuaagacuaauagcaauguuauacacaccacuaagagcaaacaacucaggcgacgacguauuuacaguauccugccgaguauuaacaagaccaaguccagacuucucauucaacuuucuuguaccuccaacagucgaauccaaaaccaaaccauuuucauuaccuauacucacaauuucagaaauguccaauuccagauuucccguacccauugauucacuacauacaucaccaacagagaacauaguaguacaaugccaaaacggacgaguaacacuagauggagagcucauggggacaacacaacuauuaccaucacaaauaugugcauuuagaggcguauuaacacguucuacaucacgugcaucugaucaagcagauacugcaacccccagacuauucaauuacuacuggcauauccaacuagauaaccuaaaugaaacaccuuaugacccagccgaaggaauaccaggaccacuaggcacaccugacuuccgagguaaaguauuuggaguugcaucccaacgcaaucccgacaccacuacaagagcacacgaagcaaaaguagacacaacuucaggaagauuuacaccaaaauuaggaucacuugaaaucucaaccgaauccgaugauuuugaucaaaauaaaccaacacguuucacacccgucggaauaggcguagaucaugaagcagacuuccaacaauggacccuaccagauuaugcaggacaauucacccauaauaugaacuuagcaccagcaguagcuccaaauuuccccggagaacaauuauuauucuuuagaucucaauuaccuaguucaggaggaagaucuaacggcauauuagacugcuuaguaccacaagaauggguacaacauuucuaucaagaaucagcacccucacaaucacaagucgcccuugucagauauauaaauccugacacaggaagaguacuauucgaagcuaaacuacacaaauuaggcuucauaacaauagcaaaaaacggagauucaccaauaacagucccuccuaacggauauuucagauucgaaucaugggucaauccauucuauacauuagcaccaaugggaacaggaaauggaagaagaagaauacaauaa

SEQ ID NO: 33007 - RNA, 1647 nt, Artificial Sequence
  derived and/or modified sequence opt6 from major_capsid_protein__Norovirus__AGD79479
augaaaauggccucuaacgacgcagcaccauccaacgacggagcagcaggucuaguaccagaaauaaacaaugaagcaauggcucuagaacccgucgcaggagccgcaauagcugcaccauuaacuggccaacaaaauauuaucgacccauggauuaugaauaauuucguucaagcaccaggaggagaauuuacaguaucaccaagaaauagcccaggagaaguacuccuaaauuuagaacucggaccagaaauuaauccuuauuuagcacauuuagcaagaauguauaauggauaugcuggagguuuugaaguacaaguaguauuagcaggcaacgcauucacagcagguaaaauaauauucgccgcaaucccuccuaacuuuccaauagacaaccuaucugcagcccaaauaaccaugugcccccacguuauaguagauguaagacaacuagaaccaguaaacuuaccuaugccagacguaagaaauaauuucuuucacuacaaccaagguucagacucaagacucagacuaauagcaaugcuauacacaccauugagagcaaauaauucuggagacgauguauuuacaguaucauguagaguauuaacacgaccuucaccagacuuuucuuuuaauuuuuuaguaccaccaacagucgaauccaaaaccaaaccauucucacuaccaauauuaacaauuucagaaaugucaaauucucgauuuccaguaccaauagacucucuacacacuucaccuaccgaaaauaucguaguacaaugucaaaauggcagaguaacacuugacggcgaauuaauggguacaacacaauuauugccuucccaaauaugcgcuuuucgaggaguauuaacaagaucaacaucaagagcaucagaucaagcagacaccgcaacaccaagacuauucaacuauuacuggcauauccaacuagacaacuuaaacgguaccccauaugacccagcugaagacauaccaggcccacuuggaacaccagacuucagaggaaaaguuuucgguguagcaucucaaagaaauccagauaccacgacuagagcucaugaagcuaaaguugacacaaccuccggaagauucacaccaaaauuaggaucauuagaaauaucuaccgaaucagaugauuucgaucaaaauaaaccaacacgauucacaccaguaggaauaggcguagaucacgaagcagacuuccaacaauggaccuuaccagauuacgcaggacaauuuacacacaacaugaauuuagcaccugcaguagcaccaaauuuuccaggcgagcaacuucuuuucuuucgcucccaacuucccucaucaggaggacgaacaaacggaauucuugauugcuuaguaccacaagaauggguccaacacuuuuaucaagaaucagcaccaucccaaucucaaguagcacuaguaagauauauaaaccccgauacaggaagaguacuauucgaagcuaaacuacacaaacuaggcuuuauaacuauagcgaaaaauggcgacucuccuauaacuguacccccaaauggauauuucagauuugaaucauggguaaauccauucuauacauuagcaccaaugggaaccggaaauggaagacggagaauacaauaa

SEQ ID NO: 33008 - RNA, 1620 nt, Artificial Sequence
  derived and/or modified sequence opt6 from major_capsid_protein__Norovirus__AGH24750
augaaaauggcuucaaaugauacaauaccaucugauggaucaacagcaaaucuaguacccgaaguaaauaacgaaguaauggcauuagaaccaguaguuggggcagcaauugccgcuccaguagcaggacaacaaaacguaauagacccauggauucgaaauaauuucguacaagcaccaggaggagaauuuaccgucaguccaagaaaugcaccuggagaaauuuuauggucaaugccauuaucaccagacuuaaauccauacuuaagucacuuaagcagaauguauaacggauaugcagguggauucgaaguucaaguuauauuagcaggaaaugcauuuacagcaggaaaaauaauauucgcugcaauaccaccaaacuuuccaacagacggacuauccccaucccaaguuacaauguucccacauauaauaguagacguaagacaauuagaaccuguauuaauaccacuaccagauguaagaaacaacuuuuaccauuauaaucaaguaaacgauagcaccuuaaaacuuauagcaaugcuauacacaccacuacgagcuaacaacgcaggcgacgauguauuuacagucuccuguagaguacuaacaagaccaucaccagauuucgacuuuauuuuuuuaguaccaccaacaguugaaucucgaacaaaaccuuuuacaguacccauauuaacuguagaugaaaugacaaauucaagauuuccaacaccacuagaaagacuacacacaggcccaaacaacucauuaguaguacaaccacaaaaugguagauguacaaucgacggcguucuauuaggcacuacacaacuaucugcuguuaauauauguucauuuaggggagauucaacaacaagagaaggacaaucccaugcuuacaccaugaauuuagcuucacaaaacuggacaaauuacgauccuacagaagauauacccgcaccacuaggaacaccagacuucguaggaaaaauaguagguauguuaucacaaacaacaagagaaaacagcuccacaagagcucacaaagcaacaguaucuaccggagaugcgcacuuuaugccaaaacuagguucuguucuuuucacaacagacacugaagaucuacaaaauggacaaaauacacgauucaccccaguaggaguagcucaagacggagaaccacaucaaaaugaaccucaacaauggagauuaccuaauuauucaggaacaccaggucauaacguucacuuagcacccccaguugcuccuacauuuccaggagaacaacuacuuuucuucagaucaacaaugccuggauguggaggauauccaaauauggauuuagacugucuauuaccacaagaauggguaagacacuucuaucaagaagccgcuccagcacaaucagacguagcuuuacuuagauucguaaauccagacacagguagaguacuauucgaaugcaaauuacauaaagccggauauauuacuguaucucauacaggucccuaugaccucguaauaccaccuaaugguuacuuccgauucgacagcugggucaaccaauuuuacgcacuagcuccaaugggcacaggaacaggaagaagaagagcacuauaa

SEQ ID NO: 33009 - RNA, 1623 nt, Artificial Sequence
  derived and/or modified sequence opt6 from major_capsid_protein__Norovirus__AGI37922
augaaaauggcaucaucugacgcaaacccaucagaugguucaacagcaaaucucgugccagaaguaaacaaugaaguuauggcauuagaaccaguaguaggagccgcaaucgcagcaccaguagcaggacaacaaaauguaauagacccuuggauaagaaauaacuucguacaagcacccggaggugaauuuacuguaucaccaagaaaugcaccuggagaaauacuauggagcgcaccauuaggaccagacuuaaauccauaccuaucucacuuagcucgaauguauaauggauaugcuggaggauucgaaguacaaguaauuuuagcaggaaaugcuuuuacagccggaaaaauaauauucgccgcaguaccaccaaauuuuccuacagaaggacuuucuccuucucaaguaacaauguucccacauauaauaguagauguaagacaacuagaaccaguauuaauaccucuacccgaugucagaaauaacuucuaucauuauaaucaaucaaaugacccaacaauaaaauuaauugcaaugcucuauacaccauuacgagcaaauaacgcaggagacgacguauucacaguuucuuguagaguccuaacacgacccucaccugacuuugacuucauauuucuuguaccacccacagucgaaucuagaacaaaaccuuucucaguaccaauacuuacaguagaagaaaugaccaacucacgauuuccuauaccauuagaaaaacuauucacaggaccaucaucagcuuucguaguccaaccacaaaauggaagauguacaacagacgguguauuacuaggaacuacacaacucucaccagucaauauauguaccuuucgaggugacguaacucauauaacuggaucucgaaauuacacaaugaaucuagcuacacaaaauuggaauucuuacgacccaacagaagaaaucccagcaccauuaggaacaccugauuucguaggaaaaauacaaggaguuuuaacacaaacuacuagagcugacgguuccacaagaggacacaaagccacugucuauacaggauccgcagacuucgcaccaaaacuuggucgaguacaauucgcuacagacaccgauaacgauuuugacgcaaaccaaaauacaaaauucacaccaguaggaguuauccaagacggagacacagcacauagaaaugaaccccaacaauggguauuaccuucauauagcggaagaaauucucauaacguacauuuagcacccgcagucgcacccacauucccaggagaacaauuacuauuuuuucgaaguacaaugccagguugcucuggauauccaaauauggauuuagacugucuauuaccacaagaauggguacaauauuucuaucaagaagcagcaccagcccaaucagauguagcuuuacugagauucguuaacccagacacuggacgaguacuauucgaauguaaacuucauaaaucaggauacguaacuguagcacauacaggacaacaugacuuaguuauaccaccaaauggauacuuccgauuugauucuuggguaaaucaauuuuacacauuagccccaauggguaacggaacaggacgaagacgcgcauuauaa

SEQ ID NO: 33010 - RNA, 1623 nt, Artificial Sequence
  derived and/or modified sequence opt6 from major_capsid_protein__Norovirus__AGM46344
augaagauggcuucaaaugacgcaaacccauccgauggaucaacagcaaaucuaguaccagaaguaaauaacgaaguuauggcauuagaaccaguagucggagcagccauagcagcucccguagccggacagcaaaauguaauagacccauggauaagaaauaauuucguacaagcacccggaggugaauuuacaguaucaccucgcaaugcuccuggcgaaauacuuuggucagcaccauuaggaccagacuuaaauccauaccuuucccaccuagcaagaauguauaauggauacgcaggcggauucgaaguccaaguuauauuagcagguaaugcauuuacagcagggaaaauaauuuucgcagccguuccuccaaauuuuccaacagaagguuuaucaccaucacaaguaaccauguuuccacacaucauagucgaugugagacaauuagaaccuguucuaauuccacuuccagauguacgaaacaauuucuaccacuauaaccaaucaaacgacccuaccaucaaacuaauagcuauguuauacacaccacuaagagcuaacaacgccggagacgauguauuuaccguaucauguagaguacuuaccagaccuucaccugauuuugacuuuauuuuuuuaguuccaccaacuguagaaucucgaacaaaaccauucucaguaccuauauuaacagucgaagaaaugacuaacucaagauuuccuauaccauuagaaaaauuauuuacaggaccaucaucagcuuuuguuguccaaccacaaaacggacgauguacaacagauggcguucuacuaggaaccacacaacucucacccguuaauauaugcacuuuuagaggcgauguaacucauauaacuggcucucgcaauuacaccaugaaucuagccacacaaaacuggaauucauacgauccaacagaagaaauaccagcaccacuugguacaccagauuucgucggcaaaauacaaggaguuuuaacccaaacaacuagagccgacggaucaacucgaggacauaaagcaacaguauauacaggaucagcugacuuugcacccaaacuuggacgaguacaauuugcuacagauacagacaacgauuuugaugcuaaucaaaacacaaaauuuacccccguuggaguaauacaagacggagacacugcacaucgaaaugaaccucaacaauggguauuaccuucauauucaggaagaaauucacauaacguucacuuagcaccugcaguagcuccaacauucccaggagaacaguuauuauucuuccgaucuacaaugcccgguugcucuggauauccuaauauggaucuagauugucuccuaccucaagaauggguacaauauuucuaccaggaagcagcucccgcacaaucugacguagcauuauuaagauucguaaacccagacacaggaagaguacuauucgaaugcaaacuacauaaaucaggauauguaacaguugcacauaccggacaacacgauuuaguaauuccaccuaacggauauuuuagauucgacagcuggguaaaucaauuuuauacauuagcaccaaugggaaaugguacuggacgaagacgcgcacuauaa

SEQ ID NO: 33011 - RNA, 1623 nt, Artificial Sequence
  derived and/or modified sequence opt6 from major_capsid_protein__Norovirus__AGM46347
augaaaauggcuucaucagaugcaaacccaucagauggaucaacagcaaaucuaguuccugaaguaaauaaugaaguaauggcauuagaacccguaguaggagcagcaauagcagccccaguagcaggacaacaaaauguaauagaucccuggauuagaaacaauuuuguacaagcaccaggaggcgaauuuacaguauccccgagaaaugcaccaggagaaauucuauggucugcaccacuuggaccagaucuaaauccauacuuaucacauuuagcaagaauguauaacgguuaugcagguggcuucgaaguccaaguaauacuagcaggcaaugcauucacagcagguaaaauaauuuucgcagcaguaccaccaaacuuuccaacagaaggauuaucaccaucacaaguuacaauguuuccacacauaauaguagacguuagacaacuagaaccaguacucauaccauuaccagacguacgcaacaacuucuaucacuauaaucaaucaaacgauccuacaauuaaacuaauagcaauguuauacacaccauuaagagcaaauaaugcaggugaugaugucuuuacaguaucauguagaguauuaacaagaccaucaccagacuuugacuuuauauuucuaguaccuccaaccguagaauccaggacaaaaccuuuuuccguaccaauucugacaguagaagaaaugacaaauucaagauuucccauuccccuagaaaaacuauuuacaggaccaucauccgcauuuguuguacaaccucaaaacggacgauguacaacugacggaguacuacuaggaaccacacaacuuucaccugucaauauauguaccuucagaggggauguaacacacauaacaggaucaagaaauuauaccaugaaucuagccacacaaaacuggaacucuuacgauccaacagaagaaauaccugcuccauuaggaacaccugacuuuguuggaaaaauucaaggaguauuaacacagacaacuagagcugacgguaguacaagaggucacaaagcaacaguauauaccggaucugcagauuucucuccaaaacuaggaagaguacaauuugcuacagauacagacaaugauuucgaugcaaaccaaaauaccaaauuuacaccaguuggugucauacaagauggcgacacagcacauagaaaugaaccacaacaauggguauuaccauccuauucagguagaaauucacauaauguacacuuagccccagcuguugcaccaacauuuccuggugaacaauuacucuucuuuagaucaaccaugccuggauguucaggguacccgaauauggaucuugacugcuuauuaccacaagaauggguacaauauuuuuaccaagaagcagcuccagcacaaucagacguagcacuacuacguuucguuaaucccgauacuggcagaguacuauuugaauguaaacuccacaaaucagguuacguuacuguagcacauacaggacaacaugaucuaguaauuccaccaaacggauauuuccgauucgauucauggguaaaucaauuuuauacacuagcaccaauggguaacggaaccgguagaagaagagccuuauaa

SEQ ID NO: 33012 - RNA, 1623 nt, Artificial Sequence
  derived and/or modified sequence opt6 from major_capsid_protein__Norovirus__AGM46349
augaaaauggcauccucagacgcaaacccauccgacggauccaccgccaaucucgucccugaaguaaacaaugaaguaauggcacuagaacccguagucggcgcugcuaucgcugccccaguagcuggucaacaaaauguuauagauccauggauaagaaauaacuuuguucaagcaccaggaggagaauuuacaguauccccaagaaaugccccaggagaaauuuuauggucagcccccuuaggaccugaccuaaacccauaccuaucacacuuagcucgaauguauaacggauacgcuggcggauucgaaguccaaguaauacuagcaggaaacgcauuuacagcaggaaaaauaauauuugcagcagucccuccaaauuuucccacagaaggacuuucaccaucacaggucacaauguucccacacauaauaguagacguaagacaacuagaacccgucuuaauaccauuaccagauguacguaauaauuuuuaucauuauaaccaaucaaaugauccuacaaucaaacuaaucgcaaugcuuuacaccccauugagagcuaacaaugcaggagaugauguauuuacgguuucauguagaguauuaacaagaccaucaccagacuuugacuuuauauuucuaguuccaccaacaguagaaucaagaacaaaaccuuucucaguaccagucuuaacaguagaagaaaugacaaacucaagauuuccaauaccccuagaaaaauuauucacaggaccaagcucggcauucguuguacaaccacaaaauggaagaugcacaacagaugguguacucuuaggaacuacacaacuaucuccuguuaacauauguacauuucgaggugauguaacacauauaccaggaucacgaaacuacacuaugaaucuugcaagucaaaacuggaacucauaugacccaacagaagaaauaccagcaccccuaggaacaccugauuuuguaggaaaaauacaagguguauuaacccaaaccacaagaacaaauggcucaacaagaggacauaaagcaacugucuauacaggaagcgccgacuuuucaccaaaauuaggacguguacaauucgcuacagacacagauaacgauuucgaaacaaaucaaaacacuaaauuuacuccaguaggaguaauccaagacgguucuacaacaccuagaaaugaaccccaacaaugggucuuaccaucauacucaggaagaaacauccacaacguacaccuugccccugcaguagcaccaacauuuccaggagaacaacuauuauucuuuagaucuacaaugccaggaugcucuggcuauccaaauauggaucuagauugcuuacuaccacaagaauggguucaauacuuuuaccaagaagcagcaccagcacaauccgacguugcacuacuaagauuuguaaaccccgacacaggacgaguacuauuugaauguaaauuacauaaaucaggauacguaacuguagcccacacuggacaacacgaccuaguaauucccccuaauggauacuucagauuugacagcuggguaaaccaauucuacacauuagcaccaauggguaauggaacugguagacgacgagcauuauaa

SEQ ID NO: 33013 - RNA, 1623 nt, Artificial Sequence
  derived and/or modified sequence opt6 from major_capsid_protein__Norovirus__AGM46355
augaaaauggcaucaucagacgcaaacccaucagacggauccacagcuaaccuaguaccagaaguuaauaacgaaguaauggcacuagaaccuguaguaggagccgcaauugcugcaccaguugcuggacaacaaaauguuauagacccuuggauaagaaauaauuuuguccaagcaccaggaggagaauuuacaguaaguccacgaaacgcaccuggagaaauauuauggucagcaccacuuggaccagaucuaaauccauauuuaucucacuuagcaagaauguacaacgguuacgcuggaggauucgaaguccaaguaauacuagcaggcaaugcauuuaccgcaggaaaaauaaucuuugcugccguuccaccaaacuucccuacagaaggacucucaccaucucaaguaaccauguucccacacauaauagucgauguaagacaacuagaacccguauuaauuccauuaccagacguacgaaacaauuucuaucauuauaaccaaaguaaugaucccacaauaaaacuaauagcaaugcuauacacaccauuaagagcaaacaaugcaggagaugauguauucacaguaucauguagaguauuaacaagaccaucaccagauuuugauuucauuuucuuaguaccaccaaccguagaaucccguacaaaaccauuuuccguaccaguuuuaacaguugaagaaaugacaaauucaagauuucccauaccauuagaaaaacuauucacuggaccuuccuccgcauuuguuguccaaccacaaaacggccgauguaccacagacggaguacuuuuagguacaacacaauuauccccagucaauauauguaccuucagaggagacguaacucacauaccaggaagcaggaauuacacaaugaaccuagcaucccaaaacuggaacucuuacgaucccaccgaagaaauuccagcaccucuugguaccccagacuuuguaggaaaaauacaaggcguacuuacacaaacaacacgaacaaacggaucaacaagaggucauaaagcaacugucuauacaggaucagcagacuuuuccccaaaacuagggcgaguccaauucgccacagauacagacaacgauuucgaaaccaaccaaaacacaaaauucacaccuguuggaguaauucaagacggaucaacaacuccacgaaaugaaccacaacaauggguacuaccaucuuauucaggacgaaauauacauaacguucaucuugccccagcaguagcaccaacauuuccaggcgaacaauuauuauucuuuagaucaacaaugcccggcuguucagguuauccaaacauggaucuagauugucuauuaccacaagaaugggugcaauacuucuaccaagaagcugcaccagcacaaucagauguagcacuacuaagauucguaaauccagacacaggcagaguauuguuugaaugcaaacuacauaaaucaggauacguuacuguagcacauacaggacaacacgaucuaguuauaccaccuaauggauacuuccgauucgauuccuggguaaaucaauucuacacauuagcaccuaugggcaauggaacaggaagacgaagagcucuauaa

SEQ ID NO: 33014 - RNA, 1623 nt, Artificial Sequence
  derived and/or modified sequence opt6 from major_capsid_protein__Norovirus__AGM46359
augaaaauggccucaaacgaugcaaacccaucagauggaucaacagcaaaucuaguaccagaaguaaacaaugaaguaauggcauuagaaccagucguuggggccgcaauagcagcuccagucgcaggacaacaaaacguaauagacccauggauaaggaauaacuuuguacaagcaccuggcggagaauucacaguaucuccucgaaaugcaccaggagagauacucuggucagcaccauuaggaccugaccucaauccauaucuaucacaucuagcaagaauguacaauggauaugcaggaggauucgaaguacaagucauacuagccggaaacgcauuuacagccggaaaaauaauauucgcagcaguaccaccaaacuuuccuacugaagguuuaucaccaucacaaguaacuauguucccucauauaauaguagauguacgacaauuagaaccaguccuaauaccauuacccgacguaagaaacaauuuuuaucauuauaaccaaucaaaugacccaacuauaaaacuaauagcaaugcuauauacuccauuacgugcaaacaaugcaggugacgacguauuuaccguaucaugucguguccucacacgaccgucaccagacuuugauuucauauuucuaguacccccaaccguagaaucaagaacuaaacccuuuucuguaccaguauuaacaguagaagaaaugacuaacucaagauuuccgauaccacuagaaaaacucuuuacuggacccucuagcgcauucguaguacaaccacaaaacggaagauguacaacagauggaguauuauuaggaacuacacaacuaucaccaguaaauaucuguacauucagaggagacguaacacacauaucaucaucaagaaacuacacaaugaaccuagcaucacaaaauuggucaucuuacgacccuacagaagaaauuccagcuccccucggaacaccagauuuugucggaaaaauacaagguguauuaacucaaacuacaagaacagacggaucaacaagaggucacaaagcaaccguauauacaggaagugcugacuuuucaccaaaguuaggucgaguacaauuugauaccgacacugauaacgacuucgaaacaaaucaaaauacaaaauucacuccaguaggaguuauacaagauggcucaacaacauacagaaaugaaccacaacaauggguccuaccuucuuauuccggaagaaauacccauaacguucauuuagcuccagcaguagccccaacauuuccuggagaacaauuacuauuuuucagaucaacaaugccaggcuguagcggauauccaaauauggauuuagauugccuacuaccucaagaauggguacaauauuuuuaucaagaagcagcaccagcacaaucagacguagcauuacuaagauucguaaaucccgacacaggaagaguauuauuugaauguaaacuacacaaaucuggauauguuacaguagcacauacaggccaacaugauuuaguuauucccccaaauggcuauuuccgauucgacagcuggguaaaccaauuuuacacacuugcaccaaugggaaauggcacaggaagaagaagagcacuauaa

SEQ ID NO: 33015 - RNA, 1623 nt, Artificial Sequence
  derived and/or modified sequence opt6 from major_capsid_protein__Norovirus__AGM46362
augaaaauggcaucaucagacgccaacccaucagauggcucuacugcaaauuuaguaccugaaguaaauaacgaaguaauggcauuagaaccaguaguaggagccgcuauagcugcaccuguagcaggacaacaaaauguaauagacccauggauaagaaacaauuuuguacaagcaccaggaggugaauuuacaguaucuccaaggaaugcaccuggagaaauauuaugguccgcaccauuagguccagaucuaaauccauaccucucucacuuagcccgaauguauaacggcuaugcaggagguuuugaaguacaagucauacuugcuggaaaugcuuuuacagcaggaaaaauaauuuuugccgcuguucccccaaacuuucccacagaaggacuauccccaucacaagucacaauguuuccucauauaauaguagacguaagacaauuagaaccaguucuaauaccccuaccagauguaagaaacaauuuuuaucacuacaaccaaucuaaugacccaacaauaaaauuaauagcaaugcuauauaccccacuaagagcuaacaacgcaggagacgauguauuuacaguaucuuguagaguauuaacucgaccuucaccagauuuugacuuuauauuucuagucccaccaacaguagaaucuagaacaaaaccauucucaguaccaguacuaacaguagaagaaaugacaaacucuagauucccaauccccuuagaaaaacuuuucacaggaccaucaucagcauuuguaguacaaccccaaaacggaagauguacaacagauggaguacuucuaggaacaacucaacuaucaccaguaaacaucugcacuuuuagaggagacguuacacacauaaguucaagcagaaacuauaccaugaauuuagcuucacaaaauuggucaucauacgaccccacugaagaaauaccggcaccacuaggaacaccugacuucguugguaaaauucaaggaguauuaacccaaacaacacggacugacgguucaacaagaggccacaaagccacaguauauacaggaucagcugauuucucaccuaaacuuggacgaguacaauucgacacagauacagacaacgauuucgaaacaaaccaaaacacaaaauucacaccugucgguguaauacaagauggcuccacaaccuauagaaaugaaccucaacaaugggucuuaccauccuacuccggaagaaauacccauaauguacaccuagcaccagcaguugcaccaacauuuccaggagaacaacuacuauuuuuuagaucaacaaugccaggaugcucagguuauccaaacauggaucuagauugccuacuaccacaagaauggguacaauauuucuaucaagaagcagcaccagcacaauccgauguagcacuacuaagauuuguaaauccagacaccggaagaguauuauucgaauguaaauuacauaaaucaggauauguaacaguagcucauacaggccaacacgaccuaguaauaccacccaacggcuacuuucgcuuugacucauggguaaaucaauucuacacucuagcaccaauggguaauggcaccggcagaagacgagcauuauaa

SEQ ID NO: 33016 - RNA, 1623 nt, Artificial Sequence
  derived and/or modified sequence opt6 from major_capsid_protein__Norovirus__AGM46366
augaaaauggcaucuuccgaugccaauccaucagacggaaguacagcaaaccuaguaccagaaguaaacaacgaagucauggcauuagaaccaguuguaggugcugcaauagcagcuccaguagcaggacaacaaaauguuauugauccuuggauaagaaauaauuuuguacaagcaccaggaggagaauuuaccguaucuccuagaaacgcacccggcgaaauacuauggucugcaccacuuggaccagacuuaaacccauauuuaagccacuuagcacgaauguauaacggcuacgcaggaggauucgaaguccaaguaauacuagcaggaaaugcauuuaccgcaggaaaaauaauuuuugcagcaguaccaccaaacuuuccaacagaaggcuuaucuccuucacaaguaacaauguuuccacauauuauugucgauguaagacaauuagaaccaguccuaauaccauuacccgauguaagaaacaacuuuuaucacuauaaccaaucaaaugacccuaccaucaaacuaauugcuauguuauauacaccacucagagcaaacaacgcuggugaugauguauuuacaguuaguuguagaguacuaaccagaccuucuccagauuucgauuuuauauuucuaguuccaccaacaguagaaucacguacaaaaccauuuucagucccaguauuaacaguagaggaaaugaccaacucaagauuuccaauaccauuagaaaaauuauuuacaggcccaucuucagcuuuuguuguacaaccacaaaauggacgaugcacaacagauggcguccuacuaggaacaacucaauuauccccaguaaauauauguacauuuagaggcgaugucacucacauaccaggaucaagaaacuauacaaugaaucuagcaucucaaaauuggaauaguuaugacccaacagaagaaauuccagcaccacuagguacacccgauuuuguaggaaaaauacaaggaguacucacacaaaccaccagaacaaaugguagcacaagaggacacaaagcaacagucuacacagguucagcugacuuuucaccaaaauuaggaagaguacaauuugcaacugauacugauaaugacuucgaaacaaaucaaaacacuaaauucacaccaguaggcguaauacaagauggaucuacuacaccccguaacgaaccacaacaauggguauuaccaucauauaguggaagaaauauccauaauguccacuuagcaccagccguagcuccuacauuuccuggugaacaacuacuuuucuuuagaaguacuaugccugguuguucaggauauccaaauauggauuuagauugccuucuaccccaagaauggguacaauacuuuuaucaagaagcagcaccagcacaauccgauguagcacuauuacguuuuguuaacccagacacuggaagaguauuauuugaaugcaaacuucauaaaucaggcuauguaacaguagcacacacuggacaacacgauuuaguaauaccaccaaauggcuauuuuagauuugauucauggguaaaccaguuuuacacauuagcaccaaugggaaauggcacuggaucaagaagagcauuauaa

SEQ ID NO: 33017 - RNA, 1623 nt, Artificial Sequence
  derived and/or modified sequence opt6 from major_capsid_protein__Norovirus__AGM46367
augaaaauggcaucuucugaugcaaacccauccgacggaucuacugcaaacuuaguaccagaaguaaacaaugaaguaauggcacucgaacccguaguaggagcagcuauagcagcaccaguagcuggacaacaaaauguaauagauccauggauuagaaauaacuucguacaagcaccaggaggagaauuuacaguaucaccaagaaacgcaccaggagaaauacucuggucagccccacuaggaccagaucuuaauccauauuuaucacacuuagcaagaauguauaacggauacgccgguggauucgaaguacaaguaauauuagcagguaaugcauuuaccgcaggaaaaauaauauucgcagcaguacccccuaauuuucccacagaaggucuuucaccaucacaagucaccauguucccacauauaaucgucgaugucagacaauuagaaccaguacuaauaccucuuccagauguuagaaacaacuuuuaccacuacaaccaaucaaaugauccuacaauuaaauuaauagcaaugcuauacacuccauuacgagcaaauaacgccggcgaugauguauuuacuguauccuguagaguucuaacaagacccucaccugacuuugacuucauauucuuaguuccaccaacgguagaauccagaaccaaaccauucucaguaccuguauuaaccguagaagaaaugacaaauucacgauuuccaaucccucucgaaaaacuuuucacaggacccucaagugcauucguuguacaaccacaaaacggaagaugcaccacagacggagucuuauuaggcacaacacaauuaucacccguaaauauauguacauuucgcggagacgucacacauauacccggauccagaaauuauacuaugaaucuagcaagucaaaauuggaacucauacgaucccacagaagaaaucccagcacccuuagguacucccgacuuugucggaaaaauucaagguguauuaacacaaacaacucgaacuaacggaucaacaagaggacacaaagccacugucuauacuggauccgcugacuuuuccccaaaacuaggaagaguacaauucgccaccgauacagauaaugauuucgaaacaaaucaaaauacaaaauuuacucccguuggaguaauacaagacggcucaacuacacccagaaacgaaccucaacaauggguuuuaccuucauauucaggaagaaacauacacaauguacaccuagccccagcaguugccccaacauuccccggugaacaacuccuauuuuuuagauccacaaugccuggaugcucaggauauccaaauauggaccuagauugucuacuaccacaagaauggguacaauauuucuaucaagaagcugcccccgcacaaucugacguagcauuauuacgauucguaaacccagacacaggucguguuuuauuugaaugcaaacuacacaaaucaggcuauguaacaguagcccacacaggacaacaugaucuaguuauaccaccuaacggauauuuccgauucgauucuuggguuaaucaauucuauacauuagcucccaugggaaauggaaccggaagaagaagagcacucuaa

SEQ ID NO: 33018 - RNA, 1623 nt, Artificial Sequence
  derived and/or modified sequence opt6 from major_capsid_protein__Norovirus__AGM46370
augaaaauggcaucaucagaugcuaauccaucagaugggucaacagcaaaucuuguaccagaaguuaauaaugaaguaauggcuuuagaaccaguaguaggcgcagcuaucgcagccccagucgcuggacaacaaaauguaauugauccuuggauaagaaauaauuucguacaagccccuggaggagaauuuacuguaucaccuagaaaugcaccaggcgaaauuuuauggucagcuccacuagguccagauuuaaauccauaucuaucacaucuagcuagaauguauaacggauacgcaggaggauucgaaguacaaguaguacucgcuggcaaugcauuuacugccggaaaaauaauauuugcagcagucccaccaaacuucccuacugaaggauuaucaccaucccaaguaacaauguucccucacaucauaguagacguaagacaauuagaaccuguccuaaucccccuaccagauguaagaaacaacuuuuaucacuauaaucaaucaaaugauccaacaaucaaacuaauagcaauguuauacacaccccuacgagcuaacaacgccggagaugacgucuucacaguuuccugcagaguucuuacaagaccuuccccagauuuugauuuuauauuccuuguaccaccaacagucgaaucaagaaccaaacccuuuucaguaccaauccuuacaguugaagaaaugacaaacucacguuuuccaauuccccuagaaaaacuauuuacaggaccaucauccgcauuugucguccaaccacaaaacggucgauguacaaccgacggaguauuauuagguacuacacaauuaucaccuguaaauauauguacauucagaggagacguuacacauauaacaggaucccgcaauuauacaaugaauuuagccacacaaaauuggaacaguuacgacccaacagaagaaauuccugcuccuuuagguacaccagauuuuguuggcaaaauacaaggagucuuaacacaaacaaccagagcagauggaucuaccagaggacauaaagcgacaguauauaccggaucugcagauuuugccccuaaacuuggaagaguccaauucgcaacagacaccgauaacgauuucgaugcaaaucaaaauacuaaauucacuccaguagguguaauucaagauggagacacugcucauagaaaugaaccacaacaauggguacuaccuucauauucaggacgcaauucacacaacguacauuuagcaccagcaguagcccccacauuuccaggcgaacaacuauuauuuuuccgauccacuaugccaggaugcucaggauacccaaauauggaucuagacuguuuacuaccacaagaauggguccaauauuucuaccaagaagcagcucccgcacaaucagauguagccuuacuacgauucguuaacccagauaccggacgaguauuauucgaaugcaaauuacauaaaucaggauauguaaccguagcacacacuggacaacacgaucuaguaauaccaccuaauggcuauuuucgauucgacucauggguaaaccaauuuuacacucuagcuccaaugggaaauggaaccggaagacgcagagcacuauaa

SEQ ID NO: 33019 - RNA, 1623 nt, Artificial Sequence
  derived and/or modified sequence opt6 from major_capsid_protein__Norovirus__AGM46375
augaaaauggcaucuucugacgcaaauccauccgacggauccacagcaaauuuaguaccugaagucaacaaugaaguaauggcacuugaaccaguuguaggcgcagcuauagcagcuccuguagcaggccaacaaaauguaauagacccauggauaagaaauaacuuuguucaagcacccggaggugaauuuacaguaucaccccgaaacgcaccaggagaaauauuauggucagcuccucuuggcccagaucuaaacccauaucuaucacaucuagcacgaauguauaacggauaugcuggaggcuucgaaguacaaguaguacucgcuggaaaugcuuucaccgcaggaaaaauuauuuucgcagcaguaccaccaaacuuuccuacagaaggauuauccccaucacaaguaacaauguuuccucacauaauaguagacgucagacaacuagaaccaguccuaauaccauuaccugaugucagaaacaauuucuaccacuauaaucaaucaaacgacccuacaauuaaacuaaucgccauguuauacacuccacucagggcaaacaaugcaggagacgacguauuuacaguaucauguagaguauuaacaagaccaucaccagacuuugauuuuauauuuuuaguaccaccaacaguggaaucaaggacuaaaccauuuucaguaccaauauuaacuguagaagaaaugacaaauucacgauucccaauacccuuagaaaaauuauuuacaggaccaucuuccgcauucguuguccaaccccaaaacggaagauguacaacagacggaguuuuacuagggacaacucaguuaucaccaguaaacauauguacauuuagaggagacguaacacacauaacaggaucaagaaacuacacaaugaaucuugcgacacaaaacuggaacucauacgauccaaccgaagaaauaccugcaccccuaggaacuccugacuuuguaggaaaaauacaaggaguauuaacucaaacuacaagagcagauggaucaacacgaggacacaaagcaacaguauauacagguucagccgacuuugcuccaaaauuaggucgaguccaauuugcaaccgacacagauaaugauuucgacgcaaaucaaaauacaaaauuuacaccaguugguguaauccaagacggcgauacagcacacagaaacgaaccucaacaauggguauuaccaucauauucaggucguaacucacauaacguacacuuagcacccgcuguagcaccuacauuuccaggcgaacaauuacuuuucuuccguucaacuaugccagguugcucuggauauccuaauauggauuuagacugccuauuaccacaagaauggguacaauacuucuaucaagaagcagcuccagcacaaucagacguagcauuacuaagauuuguaaacccagauacaggaagaguauuauucgaaugcaaacuacauaaaucaggcuacgucacaguagcccauacuggucaacacgauuuaguaauacccccaaauggauauuucagauuugauucauggguuaaccaguuuuauacucuagcccccaugggaaauggaacuggucgccgacgagccuuauaa

SEQ ID NO: 33020 - RNA, 1623 nt, Artificial Sequence
  derived and/or modified sequence opt6 from major_capsid_protein__Norovirus__AGM46377
augaaaauggcauccucagaugcaaacccaucagauggaucagccgcaaaccuaguaccagaaguaaacaacgaaguaauggcauuagaaccuguaguaggagcagccauugcagccccuguugcaggacaacaaaauguaauagaucccuggauuaggaacaauuucguacaagccccaggaggagaauuuacaguaucaccuagaaacgcaccaggagaaauuuuauggucagcaccacuaggcccagaucuaaauccauaucuaagccaucuagccagaauguauaauggauaugcagguggauucgaaguucaagucauauuagccggaaacgcauucacugcuggaaaaauaauauuugcagcaguacccccuaacuuuccaacugaaggucuaucuccaagucaaguaacaauguucccacauauaaucguugacguacgacaauuagaaccaguacuaauaccauuaccagauguuagaaacaauuucuaccacuauaaccaauccaacgacccuaccauaaaacuaauagcuauguuauacacacccuuaagagcaaacaaugcaggagaugacgucuuuaccgucucaugccgcguauuaacgagaccaucuccagauuucgacuucaucuuucuaguaccucccacuguugaaucaagaacaaaaccauuuucuguaccaauacuaacaguagaagaaaugacaaauucaagauuuccaauacccuuagaaaaacuauucacaggaccaucaucagcauuuguaguucaaccacaaaauggcagauguacaacagacggaguauuacuaggaacaacucaauuaagcccagucaacaucugcaccuuuagaggugauguaacacauaucacaggaagcagaaauuacacuaugaaucucgcuacacaaaacuggaauucuuaugauccuacugaagaaauaccugcaccacuaggaacaccugacuuugucgguaaaauacaaggagucuuaacccaaacaacacgagcagauggaaguacaagaggacauaaagcaacaguauauacuggaucagccgauuucgcaccaaaacucggaagaguacaauuugccacagauaccgauaacgauuuugaugcaaaucaaaauacaaaauucacaccaguaggaguaauccaagauggagacaccgcacaucgaaacgaaccacaacaauggguauuaccaucauauuccggaagaaacucacauaauguucaucuagcacccgcaguagccccaacauucccaggagaacaauuacuauucuucagaucuaccaugccuggaugcuccggauacccaaacauggaucucgauugucuacuaccccaagaauggguccaauacuucuaucaagaagcagcaccagcacaaagugaugucgcccuacuaagauuuguaaacccagauacaggaagaguucuauucgaauguaaauuacauaaaucuggauaugucacuguugcucauacuggccaacacgaucuaguaauaccaccaaauggauacuucagauucgacucuuggguaaaucaauuuuauacauuagcccccaugggaaauggcacaggacgacgacgcgcacuuuaa

SEQ ID NO: 33021 - RNA, 1623 nt, Artificial Sequence
  derived and/or modified sequence opt6 from major_capsid_protein__Norovirus__AGM46379
augaaaauggcaucaucagaugcuaauccaagcgacgguucuacagcaaacuuaguucccgaagucaacaaugaaguaauggcuuuagagccaguagucggagcagcaauagcagcaccuguagcaggccaacaaaauguaauagauccauggauacgaaauaauuuuguacaagccccaggaggagaauuuacaguaucuccaagaaaugcaccgggcgaaaucuuaugguccgcaccacuaggacccgaucuaaauccauauuuaucucaccuugcaagaauguacaaugguuaugcaggcggguuugaaguacaagucguacuugcaggaaaugcauucacugcaggaaaaauaauauuugcagcuguaccaccuaacuuuccaacagaaggauuaucaccaucacaagucacaauguucccacacauuauaguagacguaagacaauuagaaccuguacucauaccuuuaccugacguaagaaacaacuuuuaucacuauaaccaaucaaacgauccaaccaucaaacuaaucgcaauguuauauacuccauuaagagcuaacaaugccggcgaugaugucuucacaguauccugccguguacuaacucgaccaucaccagauuuugacuucauauuucucguaccaccaaccgucgaaucuagaacaaaaccauucucaguaccaauacuuacuguagaagaaaugacuaauucaagauucccaauaccacuagaaaaacuauuuacaggcccauccagcgcauucguuguacaaccacaaaacggaagaugcacaacugauggaguauuauuaggaacaacacaguuaaguccuguaaauaucuguacauuucguggugauguaacccacauaacuggaaguagaaacuacacaaugaaccuagcuacacaaaauuggaacucguacgauccaaccgaagaaauccccgcaccacuugguacaccagacuucguagguaaaauacaaggaguauuaacacaaaccaccagagccgacggaucaacuagaggacauaaagcaacaguauauacagguucagcagacuuugcaccaaaauuaggaagaguucaauucgcaacagauacagauaacgauuucgaugcaaaucaaaauacaaaauuuacucccguuggaguaauccaagacggcgacacagcacacagaaaugaaccccaacaaugggucuuaccauccuacucaggaagaaauucacacaauguacacuuagcacccgcaguagcaccuacauuuccaggagaacaacucuuauucuuuagaucaacaaugccaggaugcagcggcuacccaaacauggaucuagacugcuuacuaccacaagaauggguccaauacuucuaccaagaagcagcaccagcucaaucugacguagcccuucuuagauucguuaauccagacacaggacgagucuuauuugaaugcaaacuacacaaauccggauauguaacgguagcacauacaggacaacacgauuuaguaauaccaccaaauggauacuucagauucgauucauggguaaaucaauuuuacacuuuagcaccaauggguaacggcacaggacgaagacgagcacuauaa

SEQ ID NO: 33022 - RNA, 1623 nt, Artificial Sequence
  derived and/or modified sequence opt6 from major_capsid_protein__Norovirus__AGM46384
augaaaauggcaucaucugaugcuaauccaucagauggaucuaccgccaacuuaguucccgaaguuaauaacgaaguaauggcccuagaaccaguagucggagcagcaauugcugccccaguagcaggacaacaaaauguaauagauccauggauacgaaauaauuuuguacaagccccaggaggagaauuuacuguauccccuagaaaugcaccuggagaaauucuauggucagccccauuagguccagauuuaaaucccuaucuaucccacuuagcaagaauguacaacggcuaugcgggaggcuuugaaguccaaguaguacuagcaggcaacgcuuucacagcaggaaaaauaauauuugcagcaguaccaccuaauuucccaacugaaggauuauccccuucacaaguuacaauguuuccacauaucauaguagacguaagacaacuugagccaguuuuaauuccacuacccgauguaaggaacaauuucuaucacuauaaccaaagcaaugauccuacaauuaaacuaauagccaugcuauacacaccucucagagcaaauaaugcaggagaugacguauuuacaguuucauguagaguccuuacacgacccagcccagauuuugacuuuaucuuucucgugccaccaacaguagaaaguagaacaaaaccuuucuccgucccaauacucaccguagaagaaaugacaaacucaagauucccaauaccauuagaaaaacuauucacaggaccauccucggcauuugucguccaaccacaaaauggaagaugcacaaccgauggaguccuucuaggaaccacacaauuaucaccuguaaacauauguacauuucgaggcgacguaacucacauuacuggaucaagaaacuauacuaugaauuuagcaacacaaaacuggaacucauacgauccuacagaagaaauaccugcaccacucggaacuccagauuuugucggaaaaauacaagggguacuuacccaaacaacuagagcugauggcucaacaagaggucauaaagcaacaguauauacaggauccgcagauuucgcuccuaaauuaggucgaguucaauucgcuacagauacagauaaugauuuugaugcuaaucaaaacacaaaauucacaccagucggaguuauacaagacggagacaccgcacacagaaaugaaccacaacaauggguauuaccauccuacagcggaagaaauucccauaauguacaccuugcuccagcaguugcaccaacauuuccuggugaacaauuacuauuuuuuagaucuacaaugccaggauguaguggcuauccaaauauggauuuagauugcuuacuuccucaagaauggguucaauauuucuaccaagaagcagccccugcccaaucugacguagcccuacuaagauucguuaauccagacacaggcagaguccuguucgaaugcaaauuacacaaaucaggauaugucaccguagcacacacaggacaacacgauuuagucauaccaccaaauggcuauuuuagauucgauuccuggguuaaucaauuuuauacacuagcaccaaugggcaaugguacugguagaagaagagcauuauaa

SEQ ID NO: 33023 - RNA, 1623 nt, Artificial Sequence
  derived and/or modified sequence opt6 from major_capsid_protein__Norovirus__AGM46386
augaaaaugggaucaaacgaugcaaacccauccgauggaucaaccgcaaacuuagucccagaaguaaauaacgaaguuauggcuuuagaaccaguaguaggagccgcaauagcagcaccagucgcaggacaacaaaauguaauagacccuuggauaagaaauaauuuuguacaagcuccaggaggagaauucacaguaucaccaagaaaugcuccuggugaaauacuauggagugcaccacuaggaccagacuuaaauccauaucucucacaucuagcacguauguauaauggauaugcaggcgguuucgaaguacaagucauacuagcagguaaugcauuuaccgcagguaaaaucauuuucgcagcaguaccaccaaauuuuccaacagaaggauuaucaccaucacaaguaaccauguucccucauauaauaguagacguacgucaauuagagcccguauuaauaccacuaccagauguaagaaacaacuucuaccauuauaaccaauccaaugacccuacaauaaaauuaauagccauguuauauacuccacuaagagcaaauaaugcuggagacgauguauuuacaguaucuuguagaguuuuaaccagaccaucacccgacuucgacuuuaucuuuuuaguaccacccaccguagaaucucgaacaaaacccuuuucaguaccaguccuaacaguagaagaaaugacaaauucucguuuuccaauaccauuagaaaaacuauucacaggaccaucauccgcauuugucguacaaccacaaaauggaagaugcacaaccgacggaguauuauuaggcacaacacaauuaagcccaguuaauauauguacauuuagaggagaugucacccauaucccuggcucuagaaacuauacaaugaaucuagcaucccaaaauuggaauucauaugauccaacagaagaaaucccagcuccuuuaggaacacccgacuuuguuggaaaaauacaagguguauuaacucaaacuacaagaacuaacgguaguacuagaggacacaaagcaacaguauacaccggaucugcugacuuuucuccuaaauuaggaagaguacaauuugcuacagacaccgauaacgacuuugaaacaaaucaaaauacaaaauucacaccaguagguguuauacaagacggcucaacaacaccaagaaacgaaccacaacaauggguuuuaccaucuuauagcggaagaaacauucauaauguacacuuagccccugcaguagcucccacuuuucccggagaacaacuacuauuuuuccgauccacaaugcccggauguucaggauaucccaauauggaccucgacugcuuacucccacaagaauggguccaauauuuuuaucaagaagcugccccugcacaaucagacguagcucuacuacgauucguaaauccagauacaggaagaguacuuuucgaaugcaaacuucauaaaucagguuacguaacgguagcucauacaggacaacacgaucuaguaauaccaccuaauggauacuuuagauucgauucuuggguuaaucaauucuauacauuagcaccaaugggcaacggcacaggcagacgaagagcauuauaa

SEQ ID NO: 33024 - RNA, 1623 nt, Artificial Sequence
  derived and/or modified sequence opt6 from major_capsid_protein__Norovirus__AGM46388
augaaaaugggaucaaaugaugcaaacccaagugauggauccacagcaaaucuaguaccagaaguaaacaaugaagucauggcauuagaacccguuguaggagcagcaauagcagcaccugucgcuggacaacaaaauguuauugaucccuggauaagaaacaauuuuguacaagcuccaggcggugaauuuaccguaagucccagaaaugcaccaggagaaauacuauggucagcaccucucggaccagaucuaaacccauauuuaucacaucucgcccgaauguauaauggcuacgccggaggauuugaaguacaaguaauacuagccggaaacgcauuuacagcuggcaaaauaauauuugcagcuguuccaccuaacuuuccaacugaaggacuaucucccagucaaguaacaauguucccacacauaauugucgacguaagacaacuagaaccaguucuaauaccacuacccgauguaagaaacaauuucuaucauuacaaucaaucaaacgaccccacaaucaaacuaaucgcuauguuauacacaccacuacgcgcuaacaaugcuggugacgauguauucacaguaucuugcagaguauuaacacgucccucuccagauuuugauuucauauuuuuagugccaccaacaguagaauccagaacuaaaccuuucucaguccccauauuaacaguagaagaaaugacaaacucaagauucccuauaccccuugaaaaacuauuuacagguccaucaucugcauuuguaguacaaccacaaaaugguagaugcacaacugauggcguacuacucggaacuacacaauuaucuccaguuaacauauguacuuuuagaggugacguuacacauauaaccgguucuagaaacuauacaaugaaucuugccacacaaaacuggaauucauaugacccaacagaagaaauaccagcaccacuaggaacaccagauuucguaggaaaaauucaaggaguauuaacacagacaacaagagcugaugguucaacaagaggccauaaagcaaccguauauacaggcuccgcagauuuugcaccaaaacuuggaagaguacaauucgcaaccgauacugauaacgauuucgaugcaaaucaaaauacaaaauuuacaccuguaggcguaauacaagacggagacacagcucaucgaaaugaaccucaacaauggguacuaccaaguuauaguggaagaaacucacacaauguacacuuagcaccugcaguagcaccuacauuuccaggagaacaauuauuauuuuuuagaucaacaaugccaggauguucagguuacccuaauauggaucuagauugucuauuaccacaagaauggguacaauacuucuaucaagaagcagcaccagcacaauccgauguagcucuacuaagauucguaaauccagauacaggaagaguacuauucgaaugcaaauuacauaaauccggauauguaacaguugcacacacaggacaacacgaccuaguaauaccaccaaauggauauuucagauucgauucauggguaaaucaauuuuauacuuuagcuccaaugggaaauggaacaggaagacgaagagccuuauaa

SEQ ID NO: 33025 - RNA, 1623 nt, Artificial Sequence
  derived and/or modified sequence opt6 from major_capsid_protein__Norovirus__AGM46392
augaaaauggcaucauccgacgccaacccauccgauggcucaacagcuaaccuaguacccgaagucaauaaugaagucauggcgcuagaaccuguaguaggagcagcuaucgcagcaccagucgcuggacaacaaaacgucauugacccuuggauuagaaacaacuuuguacaagcucccggaggugaauuuacaguaagcccaagaaacgcacccggagaaauacuauggucagcaccacuagguccagaccuaaauccauauuuaucccauuuagcacguauguauaacggauaugcaggaggcuucgaaguacaaguuauccuagcagguaaugccuuuacagcaggcaaaauaauauucgcagccguacccccaaacuucccaacagaaggauuaucuccaucacaaguaacaauguucccacacauaauuguagacguaagacaauuagaaccaguauuaauaccacuaccagacguaagaaacaauuucuaccacuauaaccaaucaaaugaccccacaauaaaacuuaucgcaaugcuuuauacaccacuacgagcaaacaaugcuggagacgauguauuuacaguaucauguagagucuuaacaagaccuaguccugauuuugacuuuauauuuuuaguaccaccaacaguagaaucacgaacuaaaccauucucuguaccaauauuaacaguugaagaaaugacaaauucucgauucccaauuccauuagaaaaacuauuuacagguccuucauccgcauucguaguacaaccccaaaacggaagguguacuauugacggcguacuccuaggaaccacacaauuaucaccagucaauauauguacuuuccguggugacguaacacauauaacaggaaguagaaacuacacuaugaauuuagcaacacaaaauuggaauaguuaugauccaacugaagaaauaccagcaccccuaggaacaccugauuuuguaggaaaaauacaagguguccuaacgcaaaccacucgugcagacggauccacaagaggccacaaagcaaccguuuauacagguucagcagacuuugcaccaaaacuaggacgaguucaauucgcaacagauacagauaaugauuucgaugccaaccaaaauacaaaauucacaccugugggaguuauccaagacgguaacacagcacaucguaaugaaccacaacaauggguucuaccuucuuauaguggacgaaauucccauaauguacaccuagcaccugcaguugcaccaacuuuuccuggcgaacaauuuuuauucuuuagaucaacaaugccaggauguucaggauacccaaauauggaccuagauugccuacuaccacaagaauggguacaauauuuuuaucaagaagcugcgcccgcacaaucagauguugcacuuuuaagauucguaaacccagacacaggacgcguacuuuucgaauguaaauuacacaaaucaggauauguaacuguugcucacacaggccaacacgaccucguaauaccaccaaaugguuauuuucgauucgacucauggguaaaucaauucuauacccucgcacccaugggaaauggaacaggaagaagacgagcacuauaa

SEQ ID NO: 33026 - RNA, 1623 nt, Artificial Sequence
  derived and/or modified sequence opt6 from major_capsid_protein__Norovirus__AGM46395
augaaaauggcaucaucugacgcuaacccaucugauggaucaaccgccaaccuaguaccagaaguaaacaaugaaguaauggcauuagaaccuguaguaggugcugcaauagcagccccaguagcaggucaacaaaauguaauugacccauggauaagaaauaacuuuguucaagcacccggcggagaauucaccguaucacccagaaaugcaccaggugaaaucuuauggucagcaccuuuagguccagacuuaaauccauaccuuagccaucuagcaagaauguauaacggauacgcuggaggauuugaaguacaaguaauucuagcaggaaacgcuuuuaccgcaggaaaaauaauuuuugcugcagucccacccaacuucccaaccgaaggauuaucaccaucacaaguaacaauguuuccccauauuauaguagacguaaggcaauuagaaccaguacucauacccuuaccagaugucagaaacaacuucuaccauuauaaucaaucaaaugaccccacaauaaaauuaauugccaugcuauacacaccuuuaagagcuaacaaugcaggagacgacguauuuaccgucucauguagaguucuaacaagaccauccccagacuucgauuuuauauucuuaguuccaccaacaguagaaucaagaacaaaacccuucucugucccaauacuaaccgucgaagaaaugacuaacucaagauucccaauaccacuugaaaaauuauuuaccggccccucaucagcauuuguaguacaaccucaaaacgguagauguacaacugauggaguauugcuuggcacuacacaacuaucuccagucaauauaugcacauuucgaggagauguaacacacaucacaggaucacgaaacuauacaaugaacuuagcaacucaaaacuggaacucuuacgauccaacagaagaaauaccugcuccauuaggcacaccagauuuugucggaaaaauacaaggcguauuaacacaaacaacuagagcagauggaucaacuagaggucacaaagcaacaguauauacaggcagcgcagacuucgcaccaaaauuaggacgaguucaauucgcaacagauacagauaacgauuucgaugccaaccaaaacacaaaauuuacuccaguaggaguaauacaagacggagauacagcacaccgaaaugaaccucaacaauggguucucccaucauauucaggaagaaauucacacaacguacaccuagcuccagcuguagcaccaacauucccaggagaacaauuauuauucuucagaucuacaaugccuggaugcucaggauacccuaacauggaccuagauugcuuauuaccacaagaguggguucaauauuuuuaucaagaagcugcaccagcacaaagcgacguagcuuuauuacgauucguuaacccagacacaggcagaguccuauucgaaugcaaacuacacaaaucaggguaugucacuguagcacauacaggucaacaugaccuaguaaucccuccaaauggauauuuccgauucgauucauggguaaaucaauuuuacacacuagcaccaaugggaaaugguacaggaagaagacgagcacuauaa

SEQ ID NO: 33027 - RNA, 1623 nt, Artificial Sequence
  derived and/or modified sequence opt6 from major_capsid_protein__Norovirus__AGM46398
augaaaauggcaagcucugacgcaaauccaucagacggcucaaaagcaaacuuaguuccagaaguuaauaacgaaguuauggcacuagaacccguaguaggagcagcuauagcagcacccguugcaggucaacaaaauguuauugacccuuggauaagaaacaauuucguacaagcaccuggaggagaauuuacaguaucaccaagaaacgcaccuggagaaauauuauggucugcacccuuaggaccagauuuaaauccauaucuaucucacuuagcaagaauguacaauggauacgcaggaggauuugaaguccaaguaauauuagccggaaaugcauuuacagcaggaaaaauaauauucgcagcuguuccuccaaacuucccaacugaaggauuaucaccaucacaaguaacaauguucccacauauuauaguagauguaagacaauuagaacccguacuaauaccauuaccagauguccgaaacaacuucuaucauuacaaccaaucaaaugacccaacaaucaaauuaauagccaugcuuuacacuccacuuagagcaaacaaugcaggagacgauguauucacaguaucaugucgaguacuaacuagaccaucaccugacuucgacuucauauuucuaguaccaccaacaguagaaucaagaacuaaaccauuuucuguaccuguacucacaguugaagaaaugacaaacucaagauuucccauaccacuagaaaaacuauucacaggaccaucaucagcauucguaguacaaccucaaaauggaagauguacaacagauggaguguuauuaggaacaacacaacucaguccaguaaacauauguacauucagaggugauguaacacauaucccggguucuagaaauuacacaaugaaucuagcuucacaaaacuggaacuccuaugauccaaccgaagaaauaccugcaccauuaggaacuccagauuuuguagguaaaauacaaggaguacuaacucaaacuacccgaacuaacggcucaacaagaggccauaaagcaacaguauacacuggaucugcagauuuuucuccaaaacuaggaagaguacaauucgcaaccgauacagauaacgauuucgaaacaaaucaaaacacuaaauucacaccaguaggaguaauacaagacggauccacaacaccacgcaaugaaccacaacaauggguacuacccucuuauuccgguagaaacauacauaauguacaccuagcaccagcaguugcaccaaccuuuccaggagaacaacuauuauuuuuccgaucaacaaugcccggauguuccggauaccccaauauggauuuagacugucuucucccucaagaauggguucaauauuucuaucaagaagcugcaccagcacaauccgauguagcccuacuuagauucguaaacccagauacaggccgaguccuauucgaaugcaaauuacauaaaucaggauacguaacugucgcacauacaggucaacacgaucuaguaauuccaccaaauggcuauuucagauucgacucaugggucaaccaauuuuacacacucgcaccaaugggaaaugggacaggaucaagaagagcuuuauaa

SEQ ID NO: 33028 - RNA, 1623 nt, Artificial Sequence
  derived and/or modified sequence opt6 from major_capsid_protein__Norovirus__AGM46401
augaaaauggccucaucugacgcaaacccuucagauggaucaacagcaaauuuagucccagaaguaaacaaugaaguaauggcacuagaaccugucgucggugcagccauagcugcacccguagcuggucaacaaaauguaauagacccuuggauacgaaauaauuucguccaagccccaggaggagaauuuacaguuucaccuagaaaugcaccuggagaaauacuauggucagcaccucuugguccagaucuaaaucccuacuuaucccacuuagcacguauguacaacggauacgcaggaggauucgaaguccaagucauauuagcaggcaacgcuuuuacagcagguaaaauaauauuugcagcaguuccaccuaacuuuccaaccgaaggucuaucaccaucucaaguuacaauguucccacauauaaucguagacguccgacaacuagaaccaguacuaauaccucuaccagacgucagaaacaauuuuuaucacuauaaccaaagcaacgacccuacaauaaaacuuauagcuauguuauacacuccauuaagagcaaauaaugcuggugacgauguuuuuacaguuucuugcagaguauuaacccgacccucaccugacuuugacuucauauuccucgucccuccaaccguagaaucuagaacaaaacccuucagcguaccaguacuaaccguagaagaaaugacaaauucacgauuuccaauuccauuagaaaaacuauuuacaggcccauccuccgcauucguaguacaaccacaaaacggaagauguaccacugacggaguauuauuaggaacaacacaacuaucaccaguuaauauauguacauuccgaggagauguaacacacauaccaggcucacgaaauuacaccaugaaucucgcaucacaaaacuggaauucauacgauccuaccgaagaaauaccugcaccauuaggaaccccugauuuuguagguaaaauacaaggaguacuaacucaaacaaccagaaccaacggaucaacaagaggacacaaagcaacuguauauacaggaucagcugauuucucaccaaaacucggaagaguacaauuugcaacagacacagacaaugauuucgaaacaaaucaaaacaccaaauucacaccaguuggaguaauacaagacggaucuacaacaccacgcaacgaaccacaacaauggguuuuaccaagcuauaguggaagaaauauacacaacguccaucuagccccugcagucgcacccacauuuccaggagaacaacuucuauucuuuagaagcacaaugccaggauguucagguuacccaaauauggaucuagauugccuacuaccacaagaauggguucaauacuucuaucaagaagcugcaccagcccaaucagacguagcauuacuaagauuugucaacccugacacagggagaguacuauuugaaugcaaauuacacaaaucaggguauguaacuguugcucauacaggacaacacgaccuagucauaccaccaaacggcuacuuuagauuugacucuuggguaaaucaauuuuacacacuagcuccaaugggaaauggaacuggacguagaagagcacuuuga

SEQ ID NO: 33029 - RNA, 1623 nt, Artificial Sequence
  derived and/or modified sequence opt6 from major_capsid_protein__Norovirus__AGM46403
augaaaauggcauccucagaugcuaauccauccgaugguucaacugcaaaccuaguaccugaaguaaauaacgaaguaauggcacuugaaccaguaguaggcgcagcaauagcugcaccaguagcaggacaacaaaauguaauagaccccuggauaagaaauaacuucguacaagcaccugguggugaauucacagucucgccaagaaaugcacccggagaaauacuuuggucagcaccuuuaggaccagacuuaaaucccuaucuaucccacuuagcacgaauguauaauggauaugcuggaggauuugaaguacaaguaauacuagcaggcaacgcauuuacagcaggaaaaauaauauucgcagccguaccaccaaauuuuccaacugaaggacucuccccaucucaagucacaauguuuccacauauaauaguagacguuagacaauuagaaccaguucuaauaccauuaccagauguaagaaacaauuucuaucauuauaaccaaucuaaugauccaacaauuaaauuaauagcaauguuauacacaccgcucagagcaaauaaugccggagacgauguauucacuguuagcuguagaguccuaacacgcccaucaccagacuuugauuucauauuucuuguaccaccaacaguagaaaguagaacaaaaccauuuucaguaccaguacuaacaguagaagaaaugacaaacuccagauuuccuauaccucuagaaaaacuuuucacagguccaucaucagcauucguaguacaaccacaaaauggaagauguacaacugacggaguacuauuaggaaccacacaacuuuccccaguuaauaucuguaccuucagaggugacguaacacauauuccagguucuagaaauuacacuaugaaucuagcuucacaaaauuggaauucauaugauccaacagaagaaauucccgcaccacuaggaacaccagacuuugucggaaaaauucaaggaguacuaacccaaaccacaagaacuaacggaucaacaagaggacauaaagccacaguuuauacaggaagcgcagacuucucgccaaaacucggaagaguacaauuugcaacagauaccgacaacgacuucgaaacuaaucaaaacaccaaauucacuccaguaggcguaauccaagacgguucaacaacuccccgcaacgaaccacaacaguggguacuaccaagcuauucuggaagaaauauucauaauguacauuuagccccagccguagccccaacauuccccggugaacaacuacuauuuuuucgauccacaaugccugguugcuccggauauccuaauauggaucuagauugcuuacuaccucaagaauggguacaauacuucuaccaagaagcagcaccagcacaaucagauguagcauuacuacgauuuguuaacccugacacaggacgaguauuauuugaauguaaacuacauaaaucaggauauguaacaguugcacauacaggacaacaugacuuaguaauaccccccaauggauacuuucgcuucgacucuuggguuaaucaauucuacacacuugcacccaugggaaauggaacaggaagacgaagagcauuauaa

SEQ ID NO: 33030 - RNA, 1623 nt, Artificial Sequence
  derived and/or modified sequence opt6 from major_capsid_protein__Norovirus__AGM46407
augaaaauggcaucaagugaugcaaacccauccgauggcaguacagccaaucucguaccagaagucaacaaugaaguaauggcuuuagaaccaguuguaggugccgcaaucgcagccccuguagcaggacaacaaaauguaauugaucccuggauaagaaauaacuuuguccaagcaccaggaggagaauuuaccguaucaccccgaaaugcaccuggagaaauacuauggucagcaagccucgguccagacuuaaauccauaucuaucacaucuagcaagaauguacaacggauacgcaggugguuucgaaguacaagucauacucgcugguaaugccuuuacagcaggaaaaauaauauuugcagcaguacccccaaauuucccaacagaagguuuaaguccaucacaaguaacuauguucccucacauaauaguagauguuagacaacuagaaccaguacucauaccacucccugauguaagaaauaauuuuuaccacuauaaucaaucaaacgacccaaccauaaaacuaauugcaaugcuuuacaccccacuaagagccaacaaugccggagacgaugucuucaccguuucaugucgaguacucacccgaccuaguccugauuuugacuuuauauuucuaguacccccaacaguagaaaguagaacaaaaccauuuucuguaccagucuuaacaguugaagaaaugaccaacucaagauuccccauaccacucgaaaaauuauucacaggaccaucaucagcauuuguuguacaaccacaaaacggucgauguacaacagauggaguauuacucgguacuacccaacuaucaccaguaaauaucuguacauuuagaggagauguaacacauauaccuggaucaaggaauuacacaaugaauuuagcaagccaaaauuggaacaguuaugaccccacagaagaaauuccagcaccacucggaacacccgauuuuguagguaaaauccaaggaguuuuaacacaaacaacaagaaccaacggaucaacuagaggucauaaagcaacaguuuauacaggaucagcagauuuuuccccaaaauuaggaagaguucaauucgcaacagauacagauaaugacuucgaaacaaaucaaaauacaaaauucacaccaguuggcguaauacaagacggaucaacuacuccaagaaaugaaccucaacaauggguacuaccauccuauucaggucgaaacauacauaacguccauuuagcaccagcagucgcacccaccuuuccaggugaacaacuauuauuuuucagaucuacaaugccaggauguucagguuauccaaauauggaucuagauuguuuacuuccacaagaguggguacaauauuuuuaucaagaagcagcaccagcucaaucagauguagcauuacucagauuuguaaacccggacacaggacggguacucuucgaaugcaaacuacauaaaucagguuauguaaccguagcucacacaggccaacaugaccuaguaauaccaccaaauggcuauuucagauuugauagcuggguaaaccaauuuuacacacuugcuccaaugggaaauggaacaggacgcagaagagcacuauaa

SEQ ID NO: 33031 - RNA, 1623 nt, Artificial Sequence
  derived and/or modified sequence opt6 from major_capsid_protein__Norovirus__AGM46409
augaaaauggcaucaaaugacgcuaacccaucagacggaucaacagcaaauuuagucccugaaguaaauaaugaaguuauggcccuagaaccaguuguuggagcagcaaucgcagcaccaguagccggacaacaaaacguaauagacccauggauacgaaauaacuuuguacaagcaccaggaggagaauuuacaguaaguccaagaaacgcaccuggugaaauauuauggucagcaccauuagguccagauuuaaauccauaucuaucucacuuagcacgaauguacaacggauacgcaggaggcuuugaaguacaaguaauauuagcaggcaaugcauucacagccgguaaaauaauauucgccgcaguaccaccaaacuuuccuacagaaggauuaucaccaucacaaguaaccauguucccacauauaaucguagacguaagacaacuagaaccagucuuaauaccacuaccagaugucagaaacaacuuuuaccacuauaaccaaucaaaugacucaaccauaaaacugauagcaauguuauacacaccuuuaagagccaauaacgcaggagaagauguauuuacaguuaguuguagaguuuuaaccagaccaucaccagauuuugauuuuauauuucuaguaccaccaacaguugaaucccgcacaaaaccauucaccguccccauauuaacuguagaagaaaugacaaauucaagauuuccaauaccacuagaaaaauuauucacaggacccuccuccgcauuuguuguacaaccacaaaauggaagaugcaccacagacggcguauuacucggaacuacccaauuaucuccaguaaauauauguacauuuaggggagacguaacacauauugccggaucucgaaauuacacuaugaaucuagccucacuaaacuggaauaauuaugacccaacggaagaaauaccagcacccuuaggcacaccugacuuuguaggaaaaauacaagguguauuaacccaaacaacaaaaggugacggaucuacaagaggacacaaagcaacaguauauacuggaucagcaccauuuaccccaaaacuaggauccguacaauuuucaacagauacagaaaaugauuuugaaacacaccaaaacacaaaauucacucccguaggaguaauccaagacggaggaacaacacauagaaaugaaccacaacaauggguacuaccuucauacuccggaagaaauguccaaaauguacaccuagcaccagcaguugcaccaacauuucccggugaacaacuacuauucuuuagaucuacaaugcccggaugcucaggcuauccaaacauggacuuagacugcuuauuaccacaagaauggguacaacauuucuaccaagaagcagcaccagcacaaucugacgucgcacuucuaagauucguaaaucccgacacaggacgaguucuauucgaaugcaaauuacacaaaucgggauacguaacaguagcccauaccggacaacacgacuuaguaaucccaccaaauggauauuucagauuugauucauggguaaaucaauuuuauaccuuagcaccaaugggaaauggaacaggcagacgaagagcacuauaa

SEQ ID NO: 33032 - RNA, 1623 nt, Artificial Sequence
  derived and/or modified sequence opt6 from major_capsid_protein__Norovirus__AGM46413
augaaaauggcuucuaaugacgcaucaccuucagauggauccgcagccaauuuaguaccagaaguuaauaaugaaguaauggcauuagaaccaguugucggagcagcaauagcagcaccaguagcaggacaacaaaauguaaucgacccauggauaagaaauaauuucguccaagcaccuggaggagaauucacaguaucaccacgaaaugcaccaggagaaauacuauggucugcaccauuaggucccgaucuaaacccauauuuaucucaccucgcaaggauguauaaugguuacgcuggcggauuugaaguacaaguuauauuagcaggaaaugcuuucaccgcaggcaaaauaauauucgcagcaguaccaccaaacuuuccaaccgaagguuuauccccuucacaagucacaauguucccacauauaauaguagacguaagacaacuagaaccaguacuaauaccauuaccagauguuagaaacaauuuuuaucauuauaaccaaucaaaugacuccaccauaaaauuaauagcaaugcuauacacuccacucagagcaaauaaugcuggagaagacgucuuuacaguaucaugccgcguacuaacuagaccaucaccugauuuugauuuuauauuucuagucccaccaaccguagaaucaagaacaaaaccauucacaguucccauauuaacagucgaagaaaugacaaacagccgauucccaauuccacuagaaaaauuauuuacuggaccaucaucugcauuuguaguacaaccccaaaauggaagaugcacuacagauggaguauuacuagguacaacacaacuauccccaguaaauauuuguacauuccgcggcgacgucacucauauagcuggauccagaaacuauacaaugaaucuagcaucuuuaaacuggaacaauuacgauccaacagaagaaauaccugccccacuaggaacaccugauuuugucggaaaaauacaaggaguauuaacucaaacgaccaaaggagacggaucuacaagaggacacaaagcaacuguuuauacaggcucagcuccuuuuacacccaaauuaggaucaguucaauucaguacagacaccgaaaaugauuuugaaacccaucaaaacacaaaauucacaccaguaggaguaauucaagauggaggaacaacacacagaaaugaaccccaacaauggguucuaccaucauauaguggucgaaacguacaaaacguacacuuagcaccagccgucgccccaaccuuuccaggugaacaacuacuauuuuucagaucuacuaugccugguugcagcggauauccaaacauggaucucgauugucuucuaccacaagaauggguacaacauuuuuaucaagaagcagcaccagcacaaucagauguagcucuacuuagauucguuaauccagacacaggaagaguccuauuugaaugcaaauuacauaaaucaggauauguuacuguagcucacaccggacaacaugaucuagucaucccccccaauggauauuuucguuuugacucaugggucaaucaauuuuacacccucgccccaaugggcaacgguaccggaagaagaagagcucuauaa

SEQ ID NO: 33033 - RNA, 1623 nt, Artificial Sequence
  derived and/or modified sequence opt6 from major_capsid_protein__Norovirus__AGM46415
augaaaauggcaucaagcgaugcuaacccaucagacggaucagcagcaaauuuaguacccgaaguaaacaaugaaguaauggcauuagaaccaguaguuggagcugcuauagcagcacccguagcaggacaacaaaauguuauagacccauggauacgaaauaacuuuguacaagcaccagguggagaauucacuguaucaccaagaaaugcaccaggagaaauauuauggucagccccacuaggacccgauuuaaacccauaucuaagucacuuagcaagaauguacaauggcuacgcaggcggcuuugaaguucaaguaaucuuagcaggaaaugcuuucacagcaggaaaaauaauauuugcagcaguaccacccaacuuuccaacagaaggcuuaucaccaucucaaguaacaauguucccacacauaaucguagauguucgacaauuagaacccguauuaauaccauuaccagacguacguaacaauuucuaccacuauaaucaauccaaugacucaacaauaaaacuaaucgcaaugcuauauacaccauuaagagcuaauaaugcuggagaagaugucuuuacagucucuuguagaguucuaacaagaccaucucccgacuuugacuucauauuccuaguaccaccaacuguagaaucaagaacaaaaccauucacaguaccaauccuaacaguagaagaaaugacaaacucaagauuuccuauuccacuugaaaaacuauucaccggcccaucaucagcuuuuguuguacaaccacaaaacggaagaugcacaacagacgguguauuauuaggcaccacucaacuaaguccaguaaacauauguacauuuagaggggauguaacacauauagcaggcucucacaauuacacaaugaauuuagcaucauuaaacuggaacaacuaugauccaacagaagaaauacccgcuccucuaggaacaccagacuuuguuggaaaaauccaaggaguuuuaacacaaacuacuaaaggagauggcucaacuagaggacauaaagcaacuguauauacaggaucagcaccauuuacaccaaaauuaggaaguguccaauuuaguacugacacugaaaaugauuucgaaacucaucaaaacaccaaauuuacccccguaggaguaauacaagacggaggaacaacacaucguaacgaaccacaacaauggguucuuccuaguuauucaggaagaaacgucccaaacguacauuuagcaccagcaguagcaccaacauuuccaggcgaacaacuacuuuucuuucgaucaacaaugcccggauguucugguuauccaaacauggaucuagacugccuacuaccacaagaauggguacaacauuucuaucaagaagcugcacccgcacaaucagauguagcauuauuaagauucguaaauccagacacaggaagaguccuauucgaauguaaauuacauaaaucagguuauguaacaguagcccacaccggacaacaugaucuuguuauacccccaaauggcuacuuucgcuucgacagcugggucaaucaauuuuacacacuugcacccaugggaaacggcacuggcagaagaagagcauuauaa

SEQ ID NO: 33034 - RNA, 1623 nt, Artificial Sequence
  derived and/or modified sequence opt6 from major_capsid_protein__Norovirus__AGM46419
augaaaauggcaucaaaugacgcaucuccaucugauggaucagcagcaaaccuaguuccagaagucaauaacgaaguaauggcacuagaaccaguaguaggagcugcaauagcagcaccagucgcaggacaacaaaauguuauagacccauggauaagaaauaauuucguacaagcacccggcggagaauucacaguaucaccaagaaaugcccccggagaaauucuguggucagccccacucgguccugaucuaaacccauaccuaucacaccuagcccgcauguauaauggauacgcaggcggauucgaaguccaagucauacuagcaggaaaugcuuucaccgcaggaaaaauaauuuuugcagcuguaccuccuaauuuucccacagaaggauuaucaccaucucaagucacaauguucccccauauaauaguagacguacgccaacuugaaccaguauuaauacccuuaccagauguuaggaacaauuuuuaucacuauaaucaaucuaaugauucuacaauuaaacuaauagcaaugcuauacacacccuuacgugcaaauaaugcuggagaagauguauucacaguaucaugucgaguauuaacaagaccauccccagacuuugacuucauauuucuaguuccaccuacaguagaaucuagaacaaaaccauucacaguuccaaucuuaaccguagaagaaaugacaaacaguagauuuccaauaccacuugaaaaauuauuuacuggaccaucuggcgcauucguaguacaaccacaaaacggucgaugcacaacagacggaguauuacuaggaacuacacaacuuucaccaguaaacauauguacauuuagaggugauguuacucauaucgcaggcucaagaaauuacacaaugaauuuagcaagccucaacuggaacaauuacgauccaacagaagaaauaccagcaccacuaggaauaccagauuuuguugguaaaauacaaggaguacuuacacaaacaacaaaaggagacggaucaacacgaggacauaaagcaacugucuauacuggaucagccccauuuacucccaaauuaggaucaguacaauucucaacugacacagaaaacgauuucgaaacacaucaaaacacaaaauucacuccaguugguguuauacaagaugguggaacaacacauagaaacgaaccccaacaauggguucuaccuucauacucaggaagaaauguacaaaauguucacuuagcaccugcaguagcaccaacuuuuccuggagaacaacuauuauuuuuuagaucaacuaugccagguuguucaggcuauccaaauauggaucuagauugcuuacuuccacaagaauggguccaacauuucuaucaagaagcagcuccugcacaaucagauguagcacuacuaagauuuguaaacccagauacugguagaguauuauuugaauguaaauuacauaaaucuggauaugucaccgucgcucacacaggacaacaugaucuuguaauuccacccaacgguuauuuuagauucgauucuuggguuaaucaauuuuauacauuagcuccaaugggaaauggaacagguagacgaagagcauuauaa

SEQ ID NO: 33035 - RNA, 1623 nt, Artificial Sequence
  derived and/or modified sequence opt6 from major_capsid_protein__Norovirus__AGM46421
augaaaauggcuucaaacgaugcaucaccaucagaugguucugccgcaaaccuugucccagaaguaaauaaugaaguaauggcacucgaaccaguaguaggagcagccauagcugcaccaguagcaggacaacaaaacguaauugacccauggauaagaaauaacuuuguacaagcaccaggaggugaauucacaguaaguccaagaaaugcaccuggcgaaauuuuauggucagcaccuuuaggaccagaccuaaacccauacuuaucacacuuagcacgcauguauaaugguuacgcaggcggcuucgaaguacaaguaauuuuagcaggaaaugcauuuacagcaggaaaaauaauauucgcagcugucccaccaaauuuccccacagaaggacucuccccaucacaagucaccauguuuccccauauaauaguugauguaagacaauuagaaccaguucuaauacccuuaccagaugucagaaauaacuucuaccacuauaaucaaaguaacgacucuaccauaaaauuaauagccauguuauauacaccacuacgagcaaacaaugcuggagaagacgucuuuacaguaucauguagaguauuaacacgacccucuccugauuuugacuuuauauuucucguuccaccaacaguugaaucuagaacaaaaccauucaccgucccaauacuaacaguagaagaaaugacuaauucacgauucccuauaccauuagaaaaacuuuucacaggucccucauccgccuucguaguacaaccucaaaauggucgcuguacaacagacggaguuuuauuagguacaacucaacuaucccccguuaauauaugcacauucagaggugauguaacacauauagcaggcucaagagauuauacaaugaaucuagcaucauuaaacuggaacaauuacgacccaacagaagaaauaccagcuccacuaggaacaccagauuuuguuggaaaaauacaagguguauuaacccaaaccacaaaaggagauggaucuacacgcggacacaaagccacaguauauacagguuccacaccauuuacaccaaaacuaggaucaguacaauuuucaacagauacagaaaacgacuucgaaacacaucaaaauacaaaauuuacaccaguaggaguaauacaagauggaggaacaacacacagaaaugaaccacaacaauggguacuaccaucuuacuccggccgaaacguacaaaacguucaccuugcaccugcaguagcuccaacauuucccggagaacaacuucuauuuuuucguucaacuaugccaggauguucuggauauccaaauauggaucucgauuguuuauuaccucaagaauggguacaacauuucuaucaagaagcugcuccagcacaaucugacguagcacuauuaagguuuguaaaccccgacacaggaagaguacucuucgaauguaaacuccacaaaucuggauauguaacaguugcacauacaggccagcacgauuuaguaauaccuccaaauggauacuucagauucgacaguuggguaaaccaauuuuacacuuuagcaccaaugggaaauggaacaggaagacguagagcauuauaa

SEQ ID NO: 33036 - RNA, 1623 nt, Artificial Sequence
  derived and/or modified sequence opt6 from major_capsid_protein__Norovirus__AGM46425
augaaaauggcaucuucagacgcaaauccaucagaugguagugcagcuaaucucguccccgaaguaaacaaugaaguaauggcucuagaacccguaguaggugcugcaauagcagccccaguugcuggccaacaaaacgucauugacccuuggauaagaaauaacuuuguacaagcaccuggcggagaauuuacaguauccccaagaaaugcaccaggagagauauuauggucagcaccauuaggaccugaucuaaauccauauuuaucccaccucgcccgaauguauaacggauaugcaggaggauucgaaguacaaguaauacuugcuggaaaugcauuuacagcaggaaaaauaauauuugcagcaguuccaccaaacuuuccaaccgaaggucuaucaccaucacaaguuacaauguucccacauaucaucguagacguaagacaacuagagcccguacuaauaccacuaccagauguacguaacaauuuuuaccacuacaaucaauccaaugauucaacuauaaaacuaauagcaauguuauacacaccuuuaagagcaaauaaugccggagaagauguauuuaccguaucauguagaguuuuaacaagaccaaguccagauuuugauuucauauucuuagucccaccaacaguagaaucaagaaccaaaccauuuacuguaccaauuuuaacagucgaagaaaugacaaacucucgauuuccuaucccccucgaaaaacuauuuacaggcccaucaucagcuuuuguaguacaaccccaaaacggaagauguacaacagacggaguauuacuaggcacaacacaacugucaccuguaaauauauguacauuuagaggagauguaacccacauagcaggaucuagaguauacacaaugaauuuagcuucucuaaacuggaauaauuacgauccaacagaagaaauaccagcaccacuagguacacccgacuucguagguaaaauacaagguguucuaacacaaaccaccaaagaagacggauccacucgaggacauaaagcaacaguauauacagguucagcacccuucacaccuaaacuagguucuguccaauuuucaaccgauacagaaaaugauuucgaaacacaccaaaauacuaaauucaccccugucggaguaauucaagacggaggaacaacacauagaaaugaaccucaacaauggguccuaccaucauauucaggaagaaaugcaccaaauguacauuuagcuccugcuguagcaccaacauuuccaggagaacaacuacuuuucuuuagaucaacaaugccggguuguucaggauacccaaauauggaucucgauugucuucuaccacaagaauggguccaacacuuuuaccaagaagcagcacccgcacaaucugaugucgcauuauuaagauuuguuaaucccgauaccggccgagucuuauucgaauguaaauuacauaaaucaggauauguaacuguugcacauacaggacaacacgaucuagucauaccaccaaauggauauuucagauucgacucauggguaaaucaguuuuacacauuagcaccaaugggaaacggaacaggaagacgaagagcuuuauaa

SEQ ID NO: 33037 - RNA, 1623 nt, Artificial Sequence
  derived and/or modified sequence opt6 from major_capsid_protein__Norovirus__AGM46427
augaaaauggcaucaaacgacgccucaccuucagauggcuccgccgcaaaucuuguaccagaaguuaacaacgaaguaauggcccuagaaccaguuguaggagcagcaauagcagcaccaguugcaggacaacaaaauguaauugacccauggauaagaaauaacuuuguucaagcaccaggaggcgaguucacaguaucaccaagaaaugcuccaggagaaauacuauggucagcuccauuaggaccagaucuaaauccauacuuaucccacuuagcccgaauguauaacggauaugcugguggauucgaaguacaaguuauacuagcaggaaacgcuuuuaccgcaggcaaaauaauauuugccgcaguacccccaaauuuuccuacagaaggauuauccccuucacaaguaacaauguucccacacauuauuguagauguaagacaacuagaaccaguucuaauaccgcuacccgacguacguaacaacuucuaucacuauaaucaaucaaaugacucaacaauaaaacuaauagcuaugcuauacacaccacuaagagcaaacaaugcaggagaagacguauuuacagucagcugucgaguauuaacacgcccaucaccugauuuugauuuuauauuccucguccccccaaccguagaauccagaacuaaaccauucaccguaccaauuuuaacaguagaagaaaugacaaauucaagauuucccauaccauuagaaaaauuauucacaggaccuucaagcgcauuuguugugcaaccacaaaauggaagauguacaacagauggcguauuauuaggaacaacacaauuacccccuguaaauauaugcacauuuagaggcgacguuacacacauagcaggaucucgaguuuacacaaugaaccuagcaucauuaaacuggaacaauuacgacccaacagaagaaauuccagcaccccuaggaacaccagauuucguaggaaaaauucaagguguacuaacacaaacaacuaaagaagauggaucuacacgaggucacaaagcaacugucuacaccgguucugccccauuuacaccaaaauuaggaaguguucaauucucuacagauacagaaaacgauuucgaaacacaccaaaauacaaaauucacacccguaggaguaauacaagacggaggaacuacccauagaaacgaaccacaacaauggguacuaccuucauacucaggaagaaaugcacccaauguacauuuagccccagcaguugcaccaacauucccaggcgaacaacuauuauucuuuagauccacaaugccugguugcucaggcuacccaaauauggauuuagauuguuuacuuccacaagaauggguucaacacuucuaccaagaagcagcaccagcacaaucugaugucgccuuacuacgauucguaaauccugauacaggaagaguacuauucgaauguaaacuacacaaaagcggauacguuacaguagcccauacaggacaacaugauuuaguaauaccaccaaauggauauuuuagauucgauucaugggucaaccaauucuacacauuagcuccaaugggaaauggaacaggucguagacgagcauuauaa

SEQ ID NO: 33038 - RNA, 1623 nt, Artificial Sequence
  derived and/or modified sequence opt6 from major_capsid_protein__Norovirus__AGM46431
augaaaauggcaucaaaugacgcuaacccaucagacgguucagcagcaaaucucguccccgaaguuaauaaugaaguuauggcauuagaacccgucguuggagcagcaaucgcagccccuguagccggucaacaaaauguuauugaccccuggauaagaaauaauuucguacaagcacccggcggagaauuuacaguaucaccacgaaaugcaccaggugaaauacuauggucugcuccacuaggacccgauuuaaauccauaccuaagucaucuagcuaggauguacaacgguuacgcagguggauuugaaguacaaguaauacuagcaggaaacgcauucacugccggcaaaauaauuuuugcagcaguaccaccuaauuuuccaaccgaaggucuaucuccaucacaaguuacaauguucccucauaucaucguugacguaagacaacucgaacccgucuuaauaccuuuacccgacguacgcaacaauuucuaucauuauaaucaauccaaugacucuacuauaaaacuaauagcuaugcuuuauacaccauuaagagcaaacaaugccggagaagauguauuuacaguaucauguagaguacuaacuagacccucaccugacuuugacuuuauauuucuaguuccaccuaccguagaaucaagaacaaaaccauucacaguuccaauauuaacagucgaagaaaugaccaauucaagauuuccaauaccacuagaaaaauuauucacaggaccaucaucagcauuuguaguacaaccacaaaauggacgcuguaccacagacggagugcuacuaggcacaacccaauuauccccaguaaauauauguacauuucgaggagacguaacacauauagcaggcucaagaaauuacacaaugaacuuagcaucacuaaacuggaacaauuacgauccaaccgaagaaauaccagcaccauuagguacaccagauuuuguaggaaaaauacaaggaguacuaacccaaacaacuaaaggugacgggucaacaagaggacacaaagcaaccguauauacaggauccgcaccauuuacaccaaaacuagguuccguucaauuuucuacugauacagaaaacgauuuugaaacacaccaaaacacaaaauucacaccaguuggaguaauccaagauggaggcacaacacauagaaaugaaccacaacaauggguacucccaucauacucuggucgugauguaccuaacguacaccuugcuccugcaguagccccuaccuuuccaggagaacaauuauuauucuuuagauccacaaugccaggcuguucaggauacccaaauauggauuuagacugucuacucccgcaagaauggguacaacacuuuuaccaagaagcggcacccgcacaaucugauguagcccuucucagauucguuaauccugacacaggaagaguccuauucgaauguaaauuacacaaaucaggauauguaaccgucgcacacacaggacaacacgauuuaguaaucccuccaaauggauacuucagauuugauucauggguaaaucaauuuuacacacuagcaccaaugggaaauggaacaggaagaagacgagcucuauaa

SEQ ID NO: 33039 - RNA, 1671 nt, Artificial Sequence
  derived and/or modified sequence opt6 from major_capsid_protein__Norovirus__AGN11430
augaaaauggcaucauccgaugcagcaccuuccaccgacggagcaggcaauuuaguaccagagagccaacaagaaguacuaccauuagcuccaguugcaggugcagcauuagccgccccaguuguaggacaaaccaacauaauagacccuuggauaaaagaaaacuucguucaagcaccacaaggcgaauuuacaguaucacccaaaaacaguccaggagaaauuuuaguaaauuuagaacuuggcccaaaauuaaauccauauuuagaucauuuaucacguauguauaauucauaugccgguggaauagauguaaugguaguacuagccggaaaugcauucacugccggaaaaguauuaauagcagcaauucccccaaacuuuccuguagaaguuguaucagcaagccaagcaacacaauucccucauguuauaaucgauguacgaacacuagauccagucagacuaccucuaccagauguaagaucaacauuuuuucauuauacaaacgauaccgaaccaaaaaugagacuuguaauauggcuuuauaccccuuuacguacaaauggaucaggugaugauucauuuacaguuucaggacguauauuaacaagacccucacaagacuucgaauuugcauuuuuaauaccacccacaguugaaacaaaaacaacuccauuuucaguaccuggcuuuucaguacaagaaaugucaaacucuagauggccagccgcaauuucugcuaugguagucagagguaaugaaccucaagucguacaauuucaaaauggacgagcacaucuagaugguauguuauuaggaacaaccccgguauccccuaacuauauagcuaguuacaggggcauaaguacuggaaacuccagaagugcuuccccagaagccgaugaaagagcaguaggaucauuugacguauggguuagacuucaagaaccugauggacaaccauacgauauuuucggcaaacaacccgcaccaauaggaacaccagauuuuaaagcuguaaucguuggauuugcugcacgcccauuaacaagcggcucauaugcaaaugaagcuuacguaaauacaacugccucaaauuacgccccagcaacaggaaauaugagauuuacaguacgcaaugguggaacaggccacacaucugcaaauaaauauugggaauuuaaaaguuuuggaguagaaggcgaaaggcauacaggaauacaauaucaagaauaugaacuaccagauuauucaggacaaguagcaucaaaucauaaucuagcaccuccaguugcaccaagaaugcccggagaaucacuacuuuuauuucaaaguaacaugccagucugggaugauggucauggugaaagcacaccaaaaaaaauucacuguuuauugccucaagaauuuauaggacauuucuuugauaaacaagcaccaucacuaggagaugcagcauuacuaagauaugucaaccaagaaaccaauagaguucuauuugaaugcaaacuauauagagacggauacauaacaguagcugcaaguucuggauuauuagauuuuccacuugauggauuuuuuagauucgacaguuggguuucaaguuuuuauauauuauccccaguaggauccggucaagguagaagaggucgaguacgauuucaauaa

SEQ ID NO: 33040 - RNA, 1647 nt, Artificial Sequence
  derived and/or modified sequence opt6 from major_capsid_protein__Norovirus__AGO64038
augaaaauggccaguaacgacgcaacacccucaaaugacggagcagcuggauuagucccugaaauuaacaacgaagcaauggcccuagacccaguagccggcgcagcaauugcagcaccauuaacaggacaacagaauauaauagaucccuggauaaugaauaacuuuguacaagcaccaggaggagaauucacaguaucaccacguaauucaccaggagaaguacuacuaaaccucgaauuaggaccagaaaucaauccauaucuugcucacuuagcaagaauguauaacgguuaugcaggaggcuuugaaguacaaguaguacuagcaggaaaugcuuucaccgcaggaaaaaucauauuugcugcaauaccaccuaauuuuccaauagauaaccuaucagcagcacaaauaaccauguguccccacguaauaguagauguacgacaacuagaaccaguuaaucuacccaugccagacguacgaaacaauuuuuuccauuauaaccaaggaagugacccaaaauuaagacuaauagcuaugcuauauacaccauuaagagcaaacaauucaggagaugaugucuuuacaguauccugccguguacucacucgacccucaccagacuucuccuuuaauuucuuagucccaccuacaguagaaucaaaaacaaaaccauucacccuaccuauauuaacaauuuccgaaaugucaaauagcagauuuccaguaccaauagauucauuacauaccagcccaacagaaaauauaguaguccaaugucaaaacggacgaguuacauuagacggagaauuaauggguacaacacaauuauuaccuucacaaauaugcgcauucagagguguuuuaacacgaucaacuucccguacaucagaccaagcugacacagcaacaccuagacucuuuaauuauuauuggcauauacaacuagacaauuuaaauggcacaccuuaugauccugcagaagacauaccaggaccacuaggaaccccagauuuuagaggcaaaguauuuggaguagccucacaacguaauccagauucaaccacacgagcccacgaagccaaaguugauacaaccgcaggaagauuuacaccuaaacuugguucauuagaaauaucaaccgaaucagacgauuucgaucaaaaucagccaacacgauuuaccccagucggaauaggcguagacaaugaagcagauuuucaacaauggucuuuaccagauuacucaggacaauuuacacacaacaugaaccuugcgccagcuguagcacccaacuuucccggagaacaacuacuuuuuuuccggucccaacuuccaucaucaggaggacgauccaauggaauacuagacugucuaguaccucaagaguggguccaacauuucuaccaagaaucagcuccagcacaaacacaaguagcacuaguaagauacguaaacccagacacuggaagaguuuuauuugaagcaaaauuacauaaacuuggauuuaugaccauugcaaaaaacggagauagcccuauaacaguacccccaaauggauauuucagauucgaaucauggguaaauccauuuuauacacuagcaccaauggguacaggaaauggaagacgaagaauacaauaa

SEQ ID NO: 33041 - RNA, 1623 nt, Artificial Sequence
  derived and/or modified sequence opt6 from major_capsid_protein__Norovirus__AGO64040
augaaaauggcaucaaaugacgccgcaccaucaaacgacggagccgcaggcuuaguuccagaaaucaacaacgaagucaugccacuagaaccuguagcaggugccucaccagcaacacccguaguuggacaacaaaauauuauagacccuuggaucagaaacaacuuuguacaagcacccgcaggagaauuuacaguaucaccaagaaacagccccggugaaauccuacuagacuuagaauuaggacccgaacuaaauccauaccuugcccacuuagcacgaauguacaacggucacgcaggaggaauggaaguacaaauaguacuugccggaaacgcauucaccgcaggaaaaauaauauucgcagccauaccaccaggauuuccacacgaaaauuuaucaccaagucaaauaacaauguguccacacguaauaauagacguuagacaguuagaaccaguauuacuuccaaugccagauaucagaaacaauuucuuucacuauaaucaaggaaaugaucccaaacuacguuuaauagcaaugcuauauacaccuuuaagagcuaauaacucuggagacgauguauuuacagucuccuguagaguauuaacaaaaccaagucccgauuucgaauuuacauucuuaguaccaccuacaguagaaucuaaaacuaaacaauuuacuuuaccaauucuaaaaauaucugaaaugacaaauuccagauucccaguaccaguagaaaugauguauacagcucgcaacgaaaaucaaguaguccaaccacaaaacggcagaguuacacuagauggagaauuacuagguacaacacccuuacuaggcauagauauuuguaaauucaaaggagaagugauagcaaaaaacagagacgacagaucauauagaauggauauggaaauaacaaauacugacggcacacccaucgacccaacagaagauacaccaggaccaauaggaucaccagauuucagaggaauccuauucggagucgccucacaaagaaauaaaaaugaacaaaaccccgccacaagaggacaugaagcuaauauaaacacuggcggaaaucaauaugcaccaaaacucgcacaaguaaaauuuuucucagaaucagacgauuucgaugaacaucaaccaacaguauucacaccuguaggaguagcaggugacgacagccauccuuucagacaauggguauuaccaagauauggaggacacuuaacaaauaacacacaccuagcccccgcuguagcaccacuauuuccuggagaacaaauuuuauuuuuuagaucacaaauaccaagcucaggaggauuugaauuaggauauauggacuguuuaguaccacaagaauggguacaacauuuuuaccaagaagcagcaacagcccaaucagacguagcccuaauacguuucauuaauccugauacaggaaggguacuauuugaagcaaaauuacauaaacaagguuuuauaacagucgcacacacaggagacaauccaauaguaaugcccccaaauggauacuuuagauucgaagcaugggucaaucaauuuuacucuuuagcaccuguaggcacaggaaauggaagaagaagaguacaauaa

SEQ ID NO: 33042 - RNA, 1608 nt, Artificial Sequence
  derived and/or modified sequence opt6 from major_capsid_protein__Norovirus__AGO64042
augaaaauggcaucaaacgaugccgcaccuucuaacgauggagcagcaggauuagucccagaagccaacaaugaaacaauggcauuagaaccaguugccggagcaucaauagccgcccccuuaacuggacaaaacaauguaauagauccauggauaagacuaaauuucguucaagcaccaaacggagaauuuacagucucaccuagaaauucaccaggagagauacuacuaaaucuugaauuaggaccagaacuaaauccauacuuagcacacuuauccagaauguauaauggauacgcaggaggaguagaaguucaaguccuauuagcaggaaacgccuuuacugcuggaaaauuaguauucgcagcuguacccccucacuucccacuagaaaacauauccccaggacaaauaacuauguucccucacguuauaauagauguaagaacacucgaacccguacuacuaccauuaccagauguaagaaauucauuuuuucacuacaaccaacaaaaugaaccaagaaugagauuaguagcaaugcuauauacaccauuaagaucaaacggaucuggagaugacguauuuacaguaucaugccgcguacucacacgcccaucuccagauuuugacuucaauuaucuaguacccccaacaguagaaucuaaaacaaaaccauucacucuaccaauauuaacaaugggcgaacuaacaaacucaagauuucccgucccaauagacgaacuauauacaucuccaaaugaaaauuuagucguacaaccacaaaacggccgaugugcacuagauggagaacuccaaggaacaacacaauuacuccccacagcaauauguuccuuuagaggacgaguaaaccaaaaaguaaguggagaaaaccacguauggaauaugcagguaacuaacauaaauggaacuccauucgauccaacagaagacguaccagcucccuuaggcacaccagauuuuucaggcagauuauucggcgucuuaucacaaagagaccacgauaacgccugcagaucccacgacgcaguaauugcaacuaacucuacaaaauucacacccaaauuaggcgcaauacaaauaggaacaugggaagaagaugacguacacauaaaccaaccaacaaaauucacaccaguaggcuuauucgauaccgaugauuucaaucaaugggcccucccaaauuauucuggagccuuaacacuuaacaugggauuagcuccaccuguagcaccaacauuccccggagaacaaauccuauucuucaggucacacauaccacuaaaaggaggaguagcagaccccguaauagacuguuuauuaccacaagaauggauccaacaucuuuaccaagaaucagcaccaucacaauccgacguagcauuaauccgauuuaccaauccugauacaggaagaguacuauuugaagcaaaacuacacagaaguggcuauauaacuguagcaaacacaggaaaucgucccauaguaguaccagcaaauggauauuucagauuugacuccuggguaaaucaauucuauucacuagcaccaaugggaacaggcaacggaagacgaagaguucaauaa

SEQ ID NO: 33043 - RNA, 1623 nt, Artificial Sequence
  derived and/or modified sequence opt6 from major_capsid_protein__Norovirus__AGS41450
augaaaauggcuucaaaugacgcuaauccaucagacggaucagcagcaaauuuaguuccagaaguaaauaaugaaguuauggcacucgaacccguagucggagcagcaauagcugcaccaguagcaggacaacaaaauguaauagauccauggaucagaaauaacuuuguccaagcaccaggaggagaauuuacaguaucgccacgcaaugcaccaggcgaaauucuauggucagcaccauuaggaccugaucuaaacccauaucuaucacaucuagcacgaauguauaacggauacgcaggaggauucgaaguacaaguaaucuuagcuggcaacgcuuucacagccggaaaaauaauauucgcagcaguuccaccaaacuuuccuacugaaggacuaucuccaucucaaguaacaauguucccucacauaauuguagacguaagacaacuugaacccguacuaauaccucuaccagauguuagaaauaacuuuuaucacuauaaccaaucaaacgacagcacaauaaaacuuauagcaaugcuguauacuccuuuaagagcaaacaacgcaggagaugauguauuuaccguaagcuguagaguucuaacuagaccuucacccgauuuugacuuuaucuuuuuaguaccacccacgguugaaucaagaacaaaacccuuuacaguccccauuuuaacuguagaagaaaugacaaauucucgauuuccuauaccauuagaaaagcuauuuacaggccccucuuccgcauuuguaguacaaccacaaaacgguagauguacuacugacggaguauuacuaggaacaacucaacuauccccaguaaauaucuguaccuuuagaggugacguuacacauauagcaggauccagaaacuacacaaugaaucuagcaucacuuaacuggaauaauuaugauccaacugaagaaauaccagcaccucuaggaacaccagauuucguaggcaaaauucaaggaguucuuacucaaaccacaaaaggugacgguucaacaagaggucauaaagcaacuguauauacaggcucagcagacuuuacaccuaaacuaggcucaguacaauucgcuacagacacagaaaaugauuucgaaacacaucaaaauacaaaauuuacaccaguagggguaauacaagacggaucaaccacgcaucgcaacgaaccucaacaauggguuuuaccaagcuauucaggacgcaacguacacaacguacacuuagccccugccguagcccccaacuucccaggcgaacaacuauuguuuuuuagauccacaaugccaggaugcuccggcuauccaaauacagaccuagacugcuuauuaccacaagaauggguacaacauuuuuaucaagaagccgcaccugcacaaucugauguagcacuauuaagauucguaaaucccgacacaggaagaguacuauucgaauguaaauuacacaaaucuggauauguuacaguagcacacacaggacaacacgauuuaguaaucccaccaaauggauauuuucgauuugauucuuggguaaaccaauucuacacauuagcaccaaugggcaacggcacaggaagacgcagagcauuauaa

SEQ ID NO: 33044 - RNA, 1623 nt, Artificial Sequence
  derived and/or modified sequence opt6 from major_capsid_protein__Norovirus__AGT62521
augaugauggcaucaaaagacgcaccuacaucuccagacggagcaucaggagcaggacaacuaguaccagaagcaaacacagcugaacaaaucucaauggaucccguugcuggagcuucaacagcaguugcuacagcaggacaaguaaauaugauugacccauggauauuuaacaauuucguacaagcaccacaaggugaauuuacaauaucaccaaauaacacaccaggagauauacuguuugauuuacaacucggaccacauuuaaauccauuucuugcacaucuaucccaaauguauaacggauggguaggaaauaugcgaguucgaauauuauuagccggcaacgcauuuacagcaggcaaaauaauaauuuguugcguaccaccagguuuugaugccagaauauuaacaauagcacaagcuacacuauucccacaucuaaucgcagacguuagaacacuagaaccuguagaacuuccuuuagaagauguucgaaacguauuauaccauaacucaucacaaccacaaccuacaaugagauuaguugcaauguuauauacaccauuacgaacaggaggagguucaggaggaacugaugcauucguaguugcaggaagaguauuaaccuguccagcaccagauuuuucuuuucuauuuuuaguaccuccaaguguugaacaaaaaacuagaguuuuuuccguaccaaacauaccccuaaaagaucuuucaaauucuagaguaccuguuccaguacaaggaauguuuaugucaccagacguaaaucaaucaguucaauuccaaaacggccguugucaaauagauggacaauuacaaggcacuacaccuguauccuuaucacaauuauguaaaauuagaggaaaaaccucauccaaugcccgaguauuaaauuuaucugaaguagauggcacacccuuuauacccuuggagucaccugcaccaguaggauucccagaucuugguggaugcgauuggcauguaaauuuuacauuucaagcacaagaucaagacccaucccaaucaguuacauuugcaacaaaugaugccucauuugucccauacuuggguucuauaucuccacacaaugguggggauuuucaugccggagauaucauaggaucuuuaggauggaucucagcaccaagcggcaauucucaauuaaacguaugggcaauaccaaaauauggaucaucauugcccgacguuacacaucuagccccugcgguauuucccccaggauuuggagaagucauauuauauuuuuacucaacauuuccagguucaggacaaccuucccaacuacaaguucccugccuauuaccucaagaauuuauaacucauuucugcaaugaacaagcaccuauagcaggagaagcagcccuuuuacauuaugucgauccagacacugguagaaaucuaggagaauucaaacuauacccugacggauuuaugacaugcgucccuaauucaguuucuucaggaccccaaaccuuaccaauuaacggaguauuuguauucguaaguuggguaucaagauuuuaccaacuaaaaccugucggaacagcaucagcagcaagacgucuuggucucagaagaaucuaa

SEQ ID NO: 33045 - RNA, 1629 nt, Artificial Sequence
  derived and/or modified sequence opt6 from major_capsid_protein__Norovirus__AGT62523
augaaaauggcuagcaaugacgcagcaccuucaacagacggagcagccggcuuagucccagaaucaaacaacgaagucauggcacuagaaccaguugcaggugccgccuuagcagccccaguaacuggacaaacuaauauaauagacccauggauaagaacaaauuuuguacaagcaccaaauggagaauuuacagucucaccaagaaaugcuccaggagaaguacuuuuaaacuuagaacuaggaccugaauuaaacccauacuuagcacaccuagcacgaauguauaacggauacgccggagguauggaaguccaaguaaugcuagcugguaaugcauuuacagcaggaaaauuaguauucgcagccguaccaccacauuuuccaguagaaaaucuuucaccacaacaaaucaccauguucccacauguaaucauagauguacgcacccuagaaccaguucuauuaccacuuccagacguacgaaacaauuuuuuucacuauaaucaaaaagacgacccaaaaaugagaauaguagcaaugcucuacacaccucuacgauccaacggaucuggcgacgauguauucacaguaaguuguagaguauuaacuagaccauccccagauuuugacuuuacauauuuaguaccuccaacagucgaaucuaaaacaaaacccuuuacguuaccuauccucacauuaggagaaaugucaaacucucgauucccaguucccauugaccaaauguacacaucaccaaaugaagucauuucaguacaaugucaaaacggacgcuguacacuugacggugaacuacaagguacaacccaacuacaaguaucaggcauaugcgccuucaaaggucaaguaacagcacacuuacaagauaacgaacauuuauacaacgucacaauaaccaaccuaaacgguucaccauuugauccaagugaagauauaccagcaccauuagguguaccugauuucgaaggaagaguauuuggaguaauuucacaaagggauaacuacaauuccggcggucaaaaucaaccagcaaauagaucccaugaugcaguaguaccaacauauacagcacaauauacaccaaaauuaggucaaauacaaauagguacauggcaaaccgacgauaucacaguagaucaaccagcaaaauucaccccaguaggauuaucagacaccgaucauuucaaccaauggguaguaccacguuaugcaggcgcauuaaaccuaaauacaaaccuugccccauccguugcuccaguauucccaggagaaagacuacuuuucuuccgaucauacauaccauuaaaaggcggauuuggaaauccugcaauagauugccuagucccacaagaauggauucaacacuucuaucaagaagcagcaccaucccuuucagaaguugcacuaguaagauauauaaacccagacacaggaagagccuuauucgaagcaaaauuacacagagcaggauucaugacaguuucuucaaacacaagugcaccuguuguuguacccgcaaacggauauuuuagauucgauuccuggguaaaccaauucuauucauuagcaccaaugggcacuggaaauggaagaagaagaauccaauaa

SEQ ID NO: 33046 - RNA, 1623 nt, Artificial Sequence
  derived and/or modified sequence opt6 from major_capsid_protein__Norovirus__AGV40221
augaaaauggcaucuucugacgcaaauccuucugauggcuccgcagcaaacuuagucccagaaguaaauaacgaaguuauggcauuagaacccgucgugggagcagcaauagcugccccaguagccggucaacaaaaugucauagauccauggauacgaaauaacuuuguucaggcaccaggaggagaauuuacaguaucaccacgaaaugcaccaggagaaauauuauggucagcaccauuaggaccagauuuaaacccauauuuaucccaucuugcacgaauguauaacggauaugcaggcggauuugaaguacaaguaaucuuagcaggaaaugcuuuuacagcaggcaaagucauauuugcagcaguaccaccaaacuucccaacugaaggacuuucacccucacaaguaaccauguuuccucacaucauaguugacguaagacaacuagaaccuguacuaauaccacuaccagacguacgcaacaauuuuuaucacuacaaucaauccaacgauucaacaauaaaacugauugcuauguuauacacuccccuacgcgcaaauaaugcaggagacgacguauuuacaguaucauguagaguuuuaacaagaccaucuccagacuucgauuuuauuuuucuuguaccuccuacaguugaaucuagaacuaaacccuuuucuguuccuguacuaaccguagaagaaaugacuaauucuagauuuccaauccccuuagaaaaacuauuuaccggaccaucaucagcauucguuguacaaccucaaaacgguagauguacaacagacggcguauuacuaggaacuacacaacuaucaccaguaaacauauguacauuuagaggagaugucacacauauaacaggaucacguaauuauacaaugaaucuagcaucucaaaauuggaacaauuacgacccaacagaagaaaucccagccccacuagguaccccagauuucguaggaaaaauucaaggaauguuaacacaaacaacucguacagauggaucaacucguggacauaaagccacaguauauaccgguucagcagauuucgcaccaaaauuaggaagaguacaauucgaaacugacacagaccacgacuucgaagcaaaucaaaacacaaaauucacaccaguuggaguaauacaagaugguuccacuacucaucgaaaugagccucaacaauggguacuccccucauauucuggaagaaauacacauaauguacaucuagcaccagcaguagcaccuaccuuuccuggagaacaauuacuauucuuucgauccacaaugccaggaugcucaggauauccaaauauggacuuagacugccuauuaccacaagaauggguacaauauuuuuaucaagaagcagcaccagcacaaucagacgucgcauuacuaagauucguaaauccugauacaggaagaguuuuauuugaaugcaaauuacacaaaucaggauauguaacaguagcacacacuggacaacaugaucuaguaauaccuccuaacggcuauuucagauucgacaguuggguaaaucaauuuuacacauuagcuccaaugggaaauggaacuggaagaaggagaguaguuuaa

SEQ ID NO: 33047 - RNA, 1623 nt, Artificial Sequence
  derived and/or modified sequence opt6 from major_capsid_protein__Norovirus__AGV76553
augaaaauggcuucaucagacgcaaauccaucagacggauccgccgcaaauuuagucccagaaguuaacaacgaagucauggcacuugaaccuguaguaggagcugcaaucgcagcaccagucgcaggacaacaaaacgucauagauccuuggauaagaaacaacuucguacaagcaccaggaggagaauuuacaguaucuccucguaaugcucccggugaaauucuuuggucugcaccauuagggcccgacuuaaaucccuauuuaucucacuuagcuagaauguacaauggauacgcuggaggauuugaaguacaaguaauauuagcaggaaaugccuucaccgcaggaaaagucauauucgcagcaguaccaccaaacuucccuaccgaaggccuaucuccaucucaaguaacaauguuuccucacaucgucguagacgucagacaacucgaaccaguauuaauaccacuacccgauguaagaaacaauuuuuaucacuacaaccaaucaaaugacccuaccaucaaacuuauugcaauguuauauacaccacuaagagcaaacaaugcaggagaugauguauuuacagucucaugcagagucuuaaccagaccaucaccagauuucgacuuuauauuccuaguacccccaacaguagaaucaagaacuaaaccauuuucaguaccaguauuaaccguagaagaaaugacuaauucacgguuuccaauaccccuagaaaaacuauucacaggaccaaguucagcauuuguaguacaaccacaaaacggacgauguaccacagacggaguauuauuaggaaccacccaacuaucaccaguuaauauaugcaccuuuagaggagacguaacucacaucacugguucaagaaacuauacaaugaacuuagcaucacaaaacuggaauaauuaugauccaacagaagaaauaccugcaccacuaggaacuccagacuuuguaggaaaaauacaaggaguacuaacccaaacaacaagaacagauggcucaacaagaggacacaaagcaacaguuuauacaggauccgcagauuucgccccaaaauuaggcagaguucaauuugaaacugauacagaucaugauuuugaagcaaaccaaaauacuaaauuuacuccuguaggaguaauacaagauggaggaacaacccauagaaaugaaccucaacaauggguacucccuucuuauucuggaagaaauacaccaaauguacaccuagcacccgcagucgcaccaacauucccaggugaacaacucuuauucuuuagaucaacuaugccuggaugcucaggauacccaaauauggaccuagacugucuuuuaccacaagaauggguucaauauuucuaucaagaagcugcuccugcucaaucagacguagcacuacuaagauuuguuaauccagacacaggaagagucuuauucgaaugcaaacuacacaaauccggauacguaacaguagcucacucaggacaacacgacuuaguaauaccaccaaacggauauuuuagauucgacucuuggguaaaucaauucuauacauuagcccccaugggcaacggaacaggacgaagaagagcauuauaa

SEQ ID NO: 33048 - RNA, 1623 nt, Artificial Sequence
  derived and/or modified sequence opt6 from major_capsid_protein__Norovirus__AGV76554
augaaaauggcaucaucagaugcgaauccaucagaugguucagcugcaaaucuaguucccgaagucaacaaugaaguaauggcccuagaacccgucgucggagcugcaauagcagcaccaguagcaggacaacagaacguuauagacccauggauacgcaacaacuuuguacaagcaccaggcggagaauuuacuguuuccccaagaaacgcaccuggagaaauacuauggucagcaccauuagguccagaccuuaauccauacuuaucacaccuagcaagaauguacaacggauaugcagguggauuugaaguacaaguaauauuagcaggaaaugcauuuaccgcagguaaaguaaucuuugcagcugucccuccaaacuuuccuacagaaggauuaucaccuucucaaguaacuauguucccacacauaguaguagauguaagacaacuugaaccaguacuuauaccuuuacccgacguaagaaacaauuucuaccauuauaaucaaucuaaugauccaacuauaaaauuaauugcaaugcuuuauaccccauuacgcgcaaauaaugcaggagacgauguauucacuguauccuguagaguacuaacacgacccagcccugacuucgacuuuauuuuucuaguaccaccaacuguagaaucacgcacaaagccauuuuccguucccguacuaacaguugaagaaaugacaaauucacgauuuccuauaccauuagaaaaauuauuuacagguccaucaucagcauucguaguacaaccccaaaauggacgauguacaacugacggaguauuauuaggcaccacacaauuauccccuguuaauauuuguacauuccgaggagauguuacacauauuacaggaucaagaaauuacacaaugaacuuagcaucacaaaauuggaauaauuaugauccaacagaagaaauuccagcuccucuuggaacaccagacuuuguagguaaaauacaaggcguauuaacccaaacaaccagaacugaugguucaacccgaggacauaaagcaaccguauauaccggaucagcagauuuugcaccaaaauuaggaagaguacaauucgaaacagacacagaucaugacuucgaagcaaaucaaaacacaaaauucacaccuguugguguaauucaagauggaggaacaacacauagaaaugaaccucaacaauggguacuaccaucuuauucaggaaggaauacaccuaauguacauuuagcaccagcaguagcuccaaccuuuccaggagaacaacuauuauuuuuucgaagcacaaugccagguugcucaggcuauccaaauauggacuuagacuguuuacuuccacaagaauggguucaauacuuuuaccaagaagcugcaccggcccaaucugauguagcucuacuacgauuuguaaauccagauacuggaagaguauuauucgaauguaaacuucauaaaucaggauacguaacaguugcacacacuggacaacaugauuuaguaauuccaccuaauggauauuuucgauucgauucauggguaaaucaauuuuauacacuagccccaaugggcaauggaacagguagaagaagagcccuuuaa

SEQ ID NO: 33049 - RNA, 1623 nt, Artificial Sequence
  derived and/or modified sequence opt6 from major_capsid_protein__Norovirus__AGV76555
augaaaauggcaucaucugacgcuaacccaucagacggaucagcagcaaaccuaguaccagaaguaaauaacgaaguaauggcauuagaaccaguuguaggcgccgcaauagcagcaccaguugcuggacaacaaaauguaauagacccuuggauaagaaauaauuuuguacaagcuccuggaggugaauuuacaguuaguccaagaaacgcaccaggagaaauucuuuggucagcaccauuaggaccagauuuaaauccauaccuaucacacuuagcaagaauguauaacgguuaugcaggcggauuugaaguacagguuauacuagccggaaacgcauuuacagcaggaaaaguaauauuugcagccguaccacccaauuuuccaacagaaggauuaucuccaucacaaguaacaauguucccacauauaguaguagacguacgacaacuugaaccaguccucauaccauuaccagauguaagaaauaacuuuuaccacuauaaccaaucaaaugauccaacaauaaaacuaaucgcaaugcuauauacaccauuacgcgcaaauaaugccggagaugauguguuuacaguauccuguagaguuuuaacuagaccaucaccugacuuugauuucauauuuuuagucccaccaacaguagaaucaagaacaaaaccauuuucaguaccuguacucacaguagaagaaaugaccaauucccgauuuccaauaccuuuagaaaaauuauuuacaggaccaucauccgcauuuguuguacaaccacaaaauggacgauguacaacagaugguguucuacuaggaaccacccaauuaucaccaguaaacauaugcacauuucggggagauguaacacacauuaccgguucaagaaacuacacuaugaaccuagcaucacaaaacuggaacaauuacgacccaacagaagaaaucccagccccacuaggaacaccagacuucguuggaaaaauacaagguguauuaacacaaacaacucgaacagacgguuccaccagaggucauaaagccacagucuauacaggaucagcugauuucgcaccaaaauuaggccgcguccaauucgaaacagacacagaucacgauuucgaagccaaucaaaauacaaaauucacacccguuggagucauacaagacggcggcacaacucauagaaaugaaccacaacaauggguccuaccaucuuacucaggacguaauaccccaaauguacacuuagccccagccguagcaccuacuuuuccaggagaacaauuacuauucuucagaucaaccaugccaggcugcucaggauauccaaauauggaucuagauugccuacuaccacaagaauggguucaauauuuuuaucaagaagccgccccagcacaaagugacguugcacuauuacgauuuguaaauccugacaccggaagaguacuauucgaaugcaaacuucacaaaucaggauauguaacaguagcacacacaggacaacaugaucuuguaauaccaccaaauggauauuuuagauuugacucauggguaaaucaauuuuacacacuagcaccaaugggaaauggcacaggaagaagacgagcacuauaa

SEQ ID NO: 33050 - RNA, 1623 nt, Artificial Sequence
  derived and/or modified sequence opt6 from major_capsid_protein__Norovirus__AGV76556
augaaaauggcauccucagaugcuaacccaucagauggaucugcagcaaaccuagucccagaaguaaauaacgaaguaauggcuuuagaaccaguagucggagcagcaaucgcugccccaguagcaggacaacaaaaugucauagacccauggauacguaauaacuucguacaagcaccaggaggcgaauucacaguauccccuagaaaugcaccaggagaaauuuuauggucagcaccacucggaccugauuuaaauccauauuuaagccauuuagcaagaauguauaacggauaugcaggaggauucgaaguacaaguuauucucgcuggaaaugcauucacugcaggcaaagucaucuucgcagccguacccccaaacuuuccaacagaaggacuaucacccucacaagucaccauguuuccacacauuguagucgacguucgacaauuagaaccaguauuaauaccauuaccggacguaagaaauaauuucuaccauuauaaccaaucaaaugacccuacaauaaaacuaauagcaaugcuuuauacaccacuacgagcuaauaaugcaggugaugauguauuuacagucucauguagaguucuaacaagaccaucuccagauuucgacuuuaucuuuuuaguuccaccaacaguagaauccagaaccaaacccuuuuccguuccaguacuaacuguagaagaaaugacaaauucaagauuuccaauuccacuugaaaaacucuuuacaggaccauccucugcuuuuguaguacaaccacaaaauggaagauguaccacagacggaguacuauuaggaacuacacaacuaucccccguaaauauauguacauuuagaggagaugugacacauauaacaggaucaagaaauuauacuaugaacuuagcaucucaaaauuggaacaacuaugaccccacagaagaaauaccugcaccucuugguacuccugauuucguaggaaaaauucaaggaguuuuaacacagacaacaagaacagauggaucuacaagaggacacaaagccacaguauauacagguucagcagauuuugcuccuaaacuuggacgcguccaauuugaaacagauacugaucaugauuuugaagcaaaccaaaauaccaaauucacacccguaggaguaauacaagacggaggaacaacacauagaaaugaaccacaacaauggguauuaccaucauacucagguagaaauacaccuaacguccaccucgcuccugccguagcaccuacauucccuggagaacaauuauuauucuuuagaucuacaaugccaggauguucuggcuacccaaacauggauuuagacugucuacuaccacaagaauggguacaauauuuuuaucaagaagcagcaccagcucaaucagaugucgcauuacucagauuugucaauccagauacuggaagaguuuuauucgaaugcaaacuccacaaauccggauacguaacaguagcacauacaggacaacaugaucuugucauuccaccuaauggauacuucagauuugauucauggguaaaccaauucuauacacuugccccaaugggaaacggaacaggucgaagaagagcacuauaa

SEQ ID NO: 33051 - RNA, 1623 nt, Artificial Sequence
  derived and/or modified sequence opt6 from major_capsid_protein__Norovirus__AGV76557
augaaaauggcuucaagugaugcaaacccaucagauggaagugcugcuaaccucguuccagaaguaaauaacgaaguaauggcacuagaaccuguaguaggagcagcuauugccgcaccuguagccggacaacaaaauguaauagaccccuggauaagaaauaauuuuguacaagcacccggaggugaauucacaguuucacccagaaaugccccaggagaaauauuaugguccgcaccauuaggcccagaccuuaauccauaucuaagucaccuugcuagaauguauaauggauaugcaggaggauuugaaguacaaguuauucuagcaggaaaugcauuuaccgcaggaaaagucauuuucgcagccguuccaccaaacuuuccuacagaaggacuauccccaucacaaguaacaauguucccccauauaguaguagacguccgccaacuagaaccaguccuuauaccccuaccagacguacgaaacaauuucuaucacuacaaccaaucaaacgaucccacaauaaaauuaauagcaaugcucuacacaccacuaagagcaaauaaugcuggagacgauguauuuaccguuucauguagaguuuuaacucgcccuucaccagauuuugacuuuauauuuuuaguaccaccaaccguagaaucaagaacaaaaccauuuuccguaccaguauuaaccguugaagaaaugaccaacagccgcuucccaauaccacucgaaaaacuauucacagguccaucaucugccuucguaguucagccacaaaauggccgcuguacuacugacggaguuuuauuaggaacaacacaauuaucaccuguaaacauauguaccuucagaggagacguaacccacauaacuggaucucgaaauuauacaaugaauuuagcaucucaaaauuggaacaacuaugacccaacagaggaaauaccagcaccacucgguacaccugacuuuguaggcaaaauacaaggaguccuaacucaaacaacuagaacagauggcaguacaagaggucauaaagcaacuguauauacuggaucagccgacuucgcaccaaaacuagguagaguacaauucgaaacagauacagaccaugacuuugaagcaaaucaaaauacaaaauucacaccaguuggaguaauacaagacgguggaacuacacaccgaaacgaaccacaacaauggguacuaccaucauauucaggacgaaacacaccaaacguucaccuagcaccugccgucgcuccuacauuucccggagaacaacuauuauuuuuuagaucuacuaugccagguuguucuggcuauccaaauauggacuuagauugcuuacuaccacaagaauggguacaauauuuuuaucaagaagcagcaccugcucaaucugauguagcacuucuuagauuuguaaaccccgacacaggaagaguauuauuugaauguaaacuacacaaauccggcuacguaacagucgcacauacuggucaacaugacuuaguaaucccacccaaugguuauuuccgauucgauucauggguuaaccaauucuacacacuagcaccaaugggaaacgguacaggaagacgaagagcauuauaa

SEQ ID NO: 33052 - RNA, 1623 nt, Artificial Sequence
  derived and/or modified sequence opt6 from major_capsid_protein__Norovirus__AGV76558
augaaaauggcaucaagugacgcaaauccaucagacggaucagcagcaaacuuaguaccagaaguaaacaaugaaguuauggcacuagaaccaguagucggagcagcuauugcagcaccaguggccggacaacagaauguuauagauccauggauaagaaacaacuuuguacaagcaccaggaggugaauuuacaguuaguccaagaaaugccccaggcgaaauacuguggucagccccacucggacccgauuuaaauccuuauuuaucacaucuagcaagaauguauaacggauaugcuggagguuucgaaguacaaguuauauuagccggaaaugcauuuaccgcagguaaagucauauuugcugcugucccaccuaacuucccaacagaaggauuaucacccucucaaguaacaauguuuccacauauuguagucgacguaagacaauuagaacccguuuuaauaccauuaccagauguaagaaauaauuuuuaccacuauaaucaauccaaugacccaacaauaaaauuaauagcaaugcuauauacaccacuacgugcaaauaacgcuggugacgauguauucacuguuucauguagaguccuaacuagaccaucacccgauuuugauuuuauauuucuaguaccaccaaccguagaaucacgaacaaagccauuuucaguaccaguacuaacaguagaagaaaugacaaauucccgauuuccaauuccucucgaaaaacuauuuacaggaccauccucagcauucguaguucaaccacaaaacggaagauguacaacagacggaguacuacuaggcacaacccaauuauccccaguaaacauuugcacauuuagaggagaugucacacacauaacaggaucaagaaauuacacaaugaaccucgcaucacaaaacuggaauaacuaugacccaacagaagaaauaccugcaccuuuaggcacuccagauuuugucggaaaaauacaaggaguuuuaacacaaaccacacgaacagacggaucaacacgaggucauaaagcaacaguauauacaggaucagcagauuucgcaccaaaauuaggaagaguucaauucgaaacagauacagaccacgauuucgaagccaaucaaaauacgaaauucacaccaguaggaguaauccaagauggaggaacuacacauagaaaugaaccacaacaaugggucuuaccaucauauucaggacgaaauacacccaauguacauuuagcaccagcugucgcaccaacauuuccaggugaacaauuauuauucuuuagaucuacaaugccaggaugcucagguuaucccaauauggaucuagauugcuuacuaccgcaagaauggguacaauauuucuaucaagaagcagccccagcucaaucagacguugcacuacucagauucguaaaccccgauacuggaagaguauuauuugaaugcaagcuacauaaaucuggcuacguaacaguagcacauacuggccaacacgauuuaguaauuccaccaaauggauauuucagauuugacucuuggguaaaucaauucuauacacuagcuccaaugggcaaugguacaggaagacgcagagcacuauaa

SEQ ID NO: 33053 - RNA, 1623 nt, Artificial Sequence
  derived and/or modified sequence opt6 from major_capsid_protein__Norovirus__AGV76559
augaaaauggcaagcucagaugcaaauccaucagauggaucugcagcgaauuuagucccagaaguaaauaaugaaguaauggcauuagaaccaguaguaggugcagcaauugccgcuccuguagcaggacaacaaaauguuauagauccauggauaagaaauaacuucguacaagcaccuggcggagaauucacuguaucaccaagaaaugcaccaggcgaaauccuauggucagcaccacucggaccugacuuaaauccauaccuaucccaucuagcaagaauguauaacggauaugcaggaggcuuugaaguucaaguuauauuagccggaaaugcauuuacagcagguaaagucauauuugcagcaguuccaccaaacuuuccuacagaaggcuuauccccaucacaagucacaauguucccacacauaguuguagauguccgccagcuugaaccaguauuaauaccacuaccugauguaagaaacaauuucuaucauuauaaccaaucuaaugacccaaccauaaaacuaauagcaaugcuauacacaccucuacgugcaaauaaugcaggagaugauguuuucacuguaucuuguagaguucuaaccagacccucaccugauuuugauuuuauuuuucuaguaccuccuacaguagaaucaagaacaaaaccauucucugucccagucuuaacuguugaagaaaugacaaauucacgauucccaauaccuuuagaaaaacuuuucacgggaccaagcuccgcauucgucguccaaccacaaaauggccgaugcacuacagacggcguacuacuaggaacaacacaauuaucuccaguaaauauaugcacauuuagaggagauguuacacauauaacaggaucccgaaauuauacaaugaacuuagcuucacaaaacuggaacaacuaugauccaacagaagaaauuccugccccauuaggaacaccagauuucguaggaaaaauacaaggagucuuaacacaaacaacccgaacugauggcucaacaagaggacauaaagcaaccguauauaccggaucugcagauuuugccccaaaauuaggcagaguucaauuugaaacagacacagaucaugacuucgaagcaaaucaaaacaccaaauuuacaccaguaggaguaauucaagauggaggcacuacacaccgaaaugaaccacaacaaugggucuuaccaucuuacucaggacgcaauacaccaaauguucauuuagcuccugcaguugcuccaacauuuccaggagaacaauuacuauuuuuucgaucuaccaugccaggauguagcggauauccaaacauggauuuagacugucuauuaccgcaagaauggguccaauacuucuaucaagaagcagcaccagcacaaucugauguugcauuacuccgauuuguaaacccagacaccggaagaguucuuuucgaauguaaauuacacaaaucaggauauguaacugucgcacauacaggacaacaugaucuugucauaccucccaacggauauuuuagauucgauucuuggguaaaucaauuuuacacccuagcccccaugggaaacggaacugguagaagaagagcauuauaa

SEQ ID NO: 33054 - RNA, 1623 nt, Artificial Sequence
  derived and/or modified sequence opt6 from major_capsid_protein__Norovirus__AGV76560
augaaaauggcuagcucagacgcuaacccaagugauggaucagcagcaaacuuaguuccggaagucaacaacgaagucauggcauuagaacccgucguaggagcagcuauagcagcuccaguagccggacaacaaaauguaauagauccuuggaucagaaauaacuuuguacaagcacccggaggagaauuuacaguuucaccacgaaaugcaccaggagaaauacucuggagugcaccauuaggacccgacuuaaacccauauuuaucacauuuagcaagaauguauaacggauacgcaggagguuuugaaguucaaguaauauuagcaggcaacgcauucacugcuggaaaaguaauauucgcagcaguaccaccaaauuuuccaacagaaggacuaucaccaucacaaguuaccauguuuccucacauaguuguugacguuagacaacuagaaccaguuuuaauaccacuuccagacguaagaaauaauuuuuaucacuauaaucaaucaaaugacccaacuaucaaauuaauagcaaugcuauauacaccacuaagagcaaacaaugcaggugaugauguuuuuaccguaucaugcagaguacuaacaagaccuuccccagacuuugauuuuauauuucuagucccuccaacagucgaaucuagaaccaaaccuuucaguguaccaguauuaacaguagaagaaaugacuaacucacgauuuccuaucccauuagaaaaauuauucacaggaccaucauccgcauuuguuguacaaccacaaaacggaagauguacaacagacggaguauuauuaggaacgacacaacucucaccugucaacauauguacauuucguggagacguaacacauaucaccgguuccagaaacuauacuaugaaucuagcuucacaaaauuggaacaauuacgacccaacagaggaaauaccugcaccccuaggaacaccagauuuuguagguaaaauacaagguguacuaacacaaacaacaagaaccgacggcucaaccagaggacacaaagcaacuguauauacaggaucagcagacuucgccccaaaauuaggacgaguucaauuugaaacugauaccgaccaugauuuugaagcaaaucaaaacacuaaauucacaccagucggaguaauacaagacggaggaacaacacacagaaacgaaccccaacaauggguacuaccuucauauucuggcagaaauacaccaaauguucacuuagcaccagcaguagcaccaacauuuccaggagaacaacuacuauucuuuagaucaaccaugccaggauguucagguuauccaaauauggaucuagauugcuuauuaccacaagaauggguacaauauuuuuaucaagaagcugcaccagcacaaucagacgucgcacuacuaagauuuguaaacccagauaccggaagaguauuauucgaaugcaaauuacacaaaucaggcuauguuacaguugcacauacaggacaacaugauuuaguaauacccccuaauggauauuucagauucgacucuuggguaaaucaauuuuauacuuuagcaccaaugggaaauggcacagguagaaggcgugcacuauaa

SEQ ID NO: 33055 - RNA, 1623 nt, Artificial Sequence
  derived and/or modified sequence opt6 from major_capsid_protein__Norovirus__AGV76561
augaaaauggcuucaucagaugcaaauccauccgauggaucggcagcgaauuuaguaccagaaguaaacaaugaaguaauggcacucgaaccaguaguaggugcggcuauagcagcaccaguagcuggacaacaaaauguuauagauccuuggauaagaaauaauuuuguacaagcaccuggaggagaauuuacaguaucaccuagaaaugcaccaggugaaauauuauggucagcuccucuaggaccagauuuaaauccuuauuuaucacaucuagcaagaauguauaauggauaugcaggaggauuugaaguucaaguaauauuagcuggaaaugcauuuacagcaggaaaagucaucuucgcagcaguccccccaaauuuuccaacagaaggacuuucaccuagucaaguaacuauguuuccucauauuguuguagauguaagacaauuagaaccaguccuuauacccuuaccagacguccgaaacaauuuuuaucauuauaaucaaucuaaugauccuacaauaaaacuaauugcuauguuauauacacccuuaagagccaauaaugcaggugaugacgucuuuacaguaucaugcagaguucuaacaaggccuucuccagauuuugauuuuauauuccuaguuccaccuacuguagaauccagaacaaaaccauuuucuguaccuguauuaacuguagaagaaaugacuaacucuagauuccccauaccacuugaaaaauuauuuacaggaccuucuuccgcauuuguuguucaaccacaaaacggacgaugcacaacagacgguguuuuauuaggcacaacccaauuaucuccuguaaauauauguacauucagaggagacguaacacauauaacaggaaguagaaacuauacuaugaaucuagcaucacaaaacuggaauaauuacgauccaacugaagaaauaccugccccacuaggaacaccagauuuugucggaaaaauacaagguguucuaacacaaaccacuagaacagauggaucaacaagaggacacaaagcaacaguuuauacugguucugcagauuuugcaccaaaauuaggcagaguacaauuugaaacagauacugaucacgacuuugaagcaaaccaaaacacuaaauucacuccaguaggcguaauacaagauggaggaacuacacauagaaaugaaccccaacaauggguucuaccaucauauucuggaagaaacacaccaaauguccauuuagcuccugcagucgcaccaacauucccaggagaacaauuauuauuuuuuagaucaacaaugcccgguuguucagguuaccccaacauggauuuagauugucuauuaccacaagaauggguacaauauuucuaccaagaagcagcuccugcccagucagauguagcuuuacucagauuuguaaauccagauacaggaagaguacuauucgaaugcaaacuacacaaaucagguuacguuacaguagcucauacaggucaacaugauuuaguaauaccaccuaauggcuauuuucgauuugacucguggguaaaccaauucuauacacucgcuccaaugggaaacgguacaggcagaagacgagcacuuuag

SEQ ID NO: 33056 - RNA, 1623 nt, Artificial Sequence
  derived and/or modified sequence opt6 from major_capsid_protein__Norovirus__AGV76562
augaaaauggcaucaucagacgcaaacccaucugacggauccgcagcaaaucuuguaccagaaguaaacaaugaaguuauggcacuagaaccaguaguaggcgcugcuauagcagcaccaguagccggucaacaaaauguaauagauccauggauacguaacaauuuuguacaagcaccagguggagaauuuacugucucuccaagaaaugcaccaggagaaauauuauggucagcaccacuaggaccagauuuaaacccauaccucucccacuuagcucguauguauaacggauacgcagguggauuugaaguacaaguaauauuagcaggaaaugcauuuacagcuggaaaaguaauauucgcagcaguuccaccaaauuuuccuacugaaggacuuucaccaucucaaguaacuauguucccccacaucguaguagacguuagacaauuagaaccaguacuuauaccuuuaccagacguuagaaauaauuuuuaccauuacaaccaaucaaaugacccaacaauaaaauuaaucgcaauguuauauacaccucucagagcaaacaacgcaggcgacgacguauuuacagucucaugucguguccuaacaagacccucaccugacuucgacuuuauauuccuaguaccaccaacaguugaaucuagaacaaaaccauucucaguaccaguacuaacaguagaagaaaugacaaacucaagauuccccauaccucuagaaaaacuauuuacagguccuuccagugcuuucguaguacaaccacaaaauggacgcuguacaacugaugguguucuacuaggaaccacucaacuuucuccaguaaauauaugcaccuuucgaggugacguaacccacauaacaggcucuagaaauuauacaaugaacuuagcaucacaaaacuggaacaauuaugauccaacagaagaaauaccugcaccccucgguacaccugacuuugucggaaaaauacaaggaguacuuacacaaacaacuagaacagauggcaguacacgaggacacaaagccacaguauacacaggaucagcagauuuugcuccuaaacuagguaggguacaauucgaaacagauacagaucaugauuucgaagcaaaucaaaauacuaaauucaccccaguaggagucauucaagauggaggaacaacucauagaaacgaaccucaacaauggguuuuaccaaguuacucugguagaaauacgccaaacguccacuuagccccagcaguagcacccacauuuccaggagaacaacuauuauuuuucagaucuacaaugccaggauguucaggauauccaaauauggauuuagauugcuuauuaccucaagaauggguacaauauuucuaucaagaagcagcuccagcacaaucagauguagcauuauuaagauucguaaacccugacacaggacguguauuauuugaaugcaaauuacauaaauccgguuauguaacagucgcacacacaggucaacaugauuuaguuauaccuccuaacggcuacuuuagauucgauucaugggucaaucaauuuuacacucuagcuccaaugggcaauggcaccggcagaagacgagcauuauaa

SEQ ID NO: 33057 - RNA, 1623 nt, Artificial Sequence
  derived and/or modified sequence opt6 from major_capsid_protein__Norovirus__AGV76563
augaaaauggcgucaagugaugcaaacccaucagauggaagugcagccaacuuagucccagaaguaaacaaugaagucauggcacucgaacccguaguuggugcugcaauagcagcuccagucgcaggucaacaaaauguaaucgacccauggauucgaaauaauuuuguucaagcaccaggaggagaauuuacaguaucaccuagaaaugcaccaggagaaauauuauggucagcaccuuuaggaccagaucuaaauccuuauuuaucacacuuagcaagaauguauaauggauaugcaggaggauuugaaguacaaguaauucuagcaggaaaugcauuuacagccggaaaaguaauauuugccgcaguaccaccuaacuuuccaacagaagggcuaucuccaagucaaguaacaauguuuccccacauuguaguagauguaagacaacuagaaccaguuuuaauucccuuaccagauguaagaaauaauuuuuaucauuauaaccaaucaaaugauccaacaauaaaacucauagcuaugcuuuacacuccauuaagagcuaacaacgccggagaugaugucuuuacaguaucaugucgaguccuaacuagaccaucaccagacuuugacuucauauuccuaguuccuccaacaguagaaucaagaacuaaaccauucucuguaccaguacucacaguugaagaaaugacaaacucaagauuuccaauaccucucgaaaaauuauuuacagguccauccagugcauuuguuguacaaccacaaaacggaagaugcacaaccgaugguguacuucuaggaacaacacaacuuucucccguaaauauaugcacauucagaggagacguaacucacauaacuggaucaagaaacuauacuaugaaccuagcaucacaaaauuggaacaauuaugacccaacugaagaaauaccugcuccccuaggaacuccugacuucguaggaaaaauccaaggaguauuaacacaaaccacaagaacugacggaucaacaagaggacauaaagccaccguauauacaggcucagcagacuucgcaccaaaacuuggccgcguacaauuugaaacagacacugaucaugauuuugaagcuaaccaaaauaccaaauucacaccaguaggcguaauacaggauggaggaacaacacaccgaaaugaaccacaacaauggguacuaccaucuuauagcggaagaaacacaccaaauguacaucuagccccagcaguagccccaacauuuccaggugaacaacuuuuauucuuucgaucaaccaugccaggaugcuccggguauccaaauauggaucuagacugcuuauuaccacaagaauggguacaauacuucuaucaagaagcagcuccagcacaaucugacguugcauuauuacgauucgugaaucccgacacaggacguguauuauuugagugcaaacuccauaagucaggauacguaacaguagcucacacaggacaacaugauuuaguaauaccaccaaauggauauuuuagauuugacuccugggucaaccaauuuuacacccuagcacccaugggaaauggaacaggacgucguagagcacucuaa

SEQ ID NO: 33058 - RNA, 1623 nt, Artificial Sequence
  derived and/or modified sequence opt6 from major_capsid_protein__Norovirus__AGV76564
augaaaauggccagcucagaugcaaauccaucagauggcucagcagcuaauuuaguaccugaaguaaacaacgaaguaauggcuuuagaaccaguaguaggagcagcuauagcagcccccguagcaggacaacaaaaugucaucgauccauggauaagaaacaauuuuguacaggcaccaggaggugaauucaccguuucaccaagaaaugcaccaggagaaauauuauggucugcaccauuaggcccugauuuaaauccuuacuuaucacacuuagcaagaauguauaacgguuacgcaggcggauucgaaguucaaguaauacuagcaggaaacgcauuuacagcagguaaaguaaucuuugcagccgucccaccaaauuucccaacagaaggacuuaguccaucucaaguaacuauguuuccucacauaguaguagacguaagacaacuagaaccaguuuuaauaccacuaccagauguacgaaauaauuucuaucauuauaaucaaucuaaugauccaaccauaaaauuaauugcaaugcuauacacuccuuuacgagcaaacaaugccggagaugacguauuuacaguuucuugccgcguauuaacuagaccaucaccagauuuugauuuuauauuucuaguuccucccacaguugaaucaagaaccaaaccauuuucaguuccuguacuaacaguagaggaaaugacaaauucaagauuuccuauucccuuagaaaaacuuuucacaggaccaucaucugcauuuguuguucaaccacaaaauggaagauguacaacagacgguguacuauuaggaacaacacaauugagcccaguaaauaucuguacauuccgcggugaugucacucauauaacaggaucccgaaauuauacuaugaaucuagcaagucaaaacuggaauaauuaugacccaaccgaagaaaucccagcaccacuaggaacaccagauuuuguugguaaaauacaaggaguacucacacaaacaacucgaacugacggcuccacaagaggccacaaggcaacuguauacaccggcucagcagauuucgcuccaaaacuaggaagaguccaauucgaaacagauacugaccacgauuuugaagcaaaccaaaacacaaaauuuacaccuguaggaguuauacaagacggaggaacuacacaccgaaaugaaccucaacaauggguccucccauccuauucaggaagaaauacaccaaacguacaccuagcacccgcaguggcaccaacauucccaggagaacaacuacucuuuuuccgcucgacaaugccaggauguuccggauaucccucuauggaucuugauugcuuauuaccccaagaauggguacaauauuuuuaucaagaagcagcuccugcacaaucagauguugcauuauuaagauucguaaacccagacacaggaagaguacuuuuugaaugcaaacuacauaaaucaggauauguaacuguagcucauacuggucaacaugacuuaguuauuccaccuaacggauauuuucgauuugacucaugggucaaucaauuuuauacccuagccccaauggguaauggaacuggaagacguagagcacuauaa

SEQ ID NO: 33059 - RNA, 1623 nt, Artificial Sequence
  derived and/or modified sequence opt6 from major_capsid_protein__Norovirus__AGV76565
augaaaauggcaucaucagacgcaaacccuucugauggcagcgcugccaacuuaguaccagaagucaauaaugaaguuauggcauuagaaccuguagucggagcugcaauagcugcaccugucgccggacaacaaaaugucauagacccauggauuagaaauaacuuuguacaagcuccaggaggugaauuuacaguaaguccacgaaaugcaccuggagaaauacuauggucagcaccacucgguccugacuuaaauccauauuuaucccaccuagcuagaauguauaaugguuacgcuggcgguuuugaaguacaaguuaucuuagcugguaaugcauuuacagcaggaaaaguaauauucgcagcagucccaccaaacuuucccacagaaggauuaucaccaucucaaguaacaauguucccccauauuguaguagacguacgacaacucgaaccaguucuaauaccauuacccgauguucguaauaauuuuuaucauuauaaccaaucaaaugauccuacaauaaaacucauagcaauguuauauacaccauuaagagcaaacaacgcaggcgaugauguauuuacaguuucaugucgaguacuaacacgaccaucaccagauuucgacuuuauauuucuaguaccaccaacuguagaaucccgaacaaaaccauuuucaguaccuguccuaacaguagaagaaaugacaaauucuagauuuccuaucccacuagaaaaauuauuuacuggcccaucaucagccuucguuguacaaccacaaaacggacgcugcacaacagacggcguacuccuagguacaacacaauuaucacccguuaauauaugcacauuccgaggagacgucacccauaucacuggcuccagaaauuauacaaugaaucucgcaucucaaaauuggaauaauuaugauccaacagaagaaauaccugcaccccuaggaacuccagauuuuguaggaaaaauacaaggaguauuaacacaaacaaccagaacugauggcucaacacgaggacacaaagcaacuguauauacagguuccgcagacuuugcacccaaacuaggaagaguacaauucgaaaccgauaccgaucaugacuuugaagcaaaucaaaauacaaaauucacaccagucggagucauacaagacggugguacuacacauagaaacgaaccacaacaauggguucuuccuucuuauucgggucgaaauaccccaaacguccacuuagcaccagcagucgcaccgacuuucccaggagaacaauuauuauucuucagauccacuaugccaggauguucaggauauccaaacauggauuuagauugccuucuaccacaagaauggguacaauauuucuaccaagaagcagcaccagcccaaucagacgucgccuuauuaagauuuguaaacccagauacaggaagaguauuauucgaaugcaaauuacauaaaucaggauaugucacagucgcccauacaggacaacacgaucucgucauaccuccaaauggauauuuccguuucgauuccuggguaaaucaauucuacacauuagcucccaugggaaacggaacuggccgaagacgugcacuauaa

SEQ ID NO: 33060 - RNA, 1623 nt, Artificial Sequence
  derived and/or modified sequence opt6 from major_capsid_protein__Norovirus__AGV76566
augaaaauggcuagcucagaugcaaauccaucagacggaucagcagcaaacuuaguaccugaaguaaacaaugaaguaauggcucuagaaccaguaguaggagcagcaauagcagcucccguagccggacaacaaaauguaauagacccauggauaagaaauaauuucguacaagcaccaggaggagaauuuacaguaucaccaagaaacgcacccggagaaauauuauggagugcuccuuuaggaccagauuuaaaucccuaccuaucccacuuagcacguauguauaacggauaugcaggagguuucgaaguccaaguuaucuuagcuggcaacgcauucacagcaggaaaagucauuuuugcagcaguaccgccaaauuuuccaacagaaggauuaucuccaucacaaguaacaauguuuccccacauaguuguagauguaagacaauuagaaccagugcucauuccauuacccgaugucagaaauaacuucuaucauuauaaccaaucaaacgacccuaccauaaaacuuauagcuaugcuuuauacaccacuacgugcaaauaaugcaggagaugauguauuuacuguaucaugucgugucuuaacaagaccaucaccagauuucgauuuuauuuuuuuaguaccaccaacaguagaaucaagaacaaaaccauucucaguaccuguccuaaccguagaagaaaugacaaacucacgauuccccaucccucuagaaaaacuuuuuacaggaccuucaagugcauucguaguacaaccacaaaacggaagaugcaccacagauggagucuuauuaggaacaacacaauuaucuccagucaauauauguacauuuagaggugacguaacacacauaacaggaucaagaaauuauacaaugaauuuagcuucacaaaacuggaacaauuaugauccaaccgaagaaauaccagccccuuuaggcacuccagacuuuguuggaaaaauucaagguguacuaacacaaaccacaagaacugacgguucuacaagaggacauaaagccacaguauacacaggauccgcggacuucgcaccuaaauuaggacgaguacaauucgaaacagacacagaucaugacuucgaagcaaaccaaaacacaaaauucacacccguaggaguaauucaagacggaggaacaacccacagaaaugaaccacaacaauggguucuaccaagcuauuccggccguaauaccccaaacguacacuuagcaccagcaguagcaccaacauuuccaggcgaacaacuuuuauucuuucgaucuacaaugccaggauguucaggcuauccaaauauggaucuugauugucuacuuccacaagaauggguacaauauuuuuaucaagaggcagcaccagcacaaucagacguggcccuauuaagauucguuaacccagacacaggccguguauuauucgaauguaaauuacacaaaucaggauauguaacaguagcacacacaggacaacacgaucuagucauaccaccaaauggauacuucagauuugauagcuggguaaaccaauucuauacauuagccccaauggguaaugggacuggucgucgaagagcauuauaa

SEQ ID NO: 33061 - RNA, 1623 nt, Artificial Sequence
  derived and/or modified sequence opt6 from major_capsid_protein__Norovirus__AGV76567
augaaaauggcaucuuccgacgcuaauccaucagaugguagugcagcaaauuuaguucccgaagucaauaaugaaguuauggcacuggaaccuguuguaggagcagcaauugcagcacccguagcaggacaacaaaacguuauagacccauggauaagaaauaauuuuguccaagcuccuggaggggaauucacaguaucaccaagaaaugcaccaggagaaauacuauggucagccccucuaggacccgacuuaaaucccuaucuaagucaccuugcuagaauguauaauggauaugccggaggauuugaaguacaaguaauacuugcagguaaugcuuucacagcaggaaaaguuauauucgcugccguaccaccaaauuuuccaacagaaggauuaucaccaucacaaguaacuauguuuccucauauaguaguagacguacgucaacuugaaccaguucuaauaccacuuccagacguccgaaacaacuuuuaucauuacaaucaaucaaaugacccuacaauaaaacuaauagcaauguuauacacuccacuacgagcuaauaaugcuggagaugauguauuuacaguaucuugucgaguauuaacaagaccaucaccagauuuugauuucaucuuuuuaguaccaccaacaguagaaucucgaacaaaaccuuucucaguuccugugcuaacaguagaagaaaugacaaauucuagauucccgauaccacuagaaaaacuuuuuacaggaccaucauccgcauucguaguccaaccacaaaaugguagauguacaaccgacggaguacuacucggaacaacucaauuauccccaguaaauauauguaccuuuagaggagauguaacacauauaaccgguucaagaaacuauacuaugaauuuagcaucacaaaauuggaacaauuaugauccaacugaagaaauuccagcaccacuuggaacaccugauuuuguaggaaaaauacaagguguucuuacacaaacaacaagaacagauggaucaacacguggccauaaagcuaccguauacacaggaucagcugauuuugcaccuaaauuagguagaguacaauuuggaacagacacagaucacgauuuugaagccaaucaaaacacaaaauucacaccaguaggaguuauacaagauggaucaacuacacauagaaaugaaccacaacaauggguauuaccaucauacucaggcagaaacacaccaaauguccaucuagcuccagcuguagcccccacauucccaggugaacaauuacuauuuuuuagauccacuaugccaggauguucaggauaccccaacauggauuuagauugccuacuaccacaagaauggguccaguauuuuuaucaagaagcagcaccagcucaaucagauguagcauuacuuagauuuguuaacccugacacuggacgaguacuuuuugaaugcaaauuacauaaaucaggguacguaacaguagcacacacaggacaacaugacuuaguaaucccuccaaacggauauuucagauuugauucauggguaaaccaauuuuacacacuagcaccaaugggaaaugguacaggacgaagaagagcauuauaa

SEQ ID NO: 33062 - RNA, 1623 nt, Artificial Sequence
  derived and/or modified sequence opt6 from major_capsid_protein__Norovirus__AGV76568
augaaaauggcuuccuccgaugcuaaucccucagauggaucagcagcauccuuaguaccagaaguaaauaacgaaguaauggccuuagaaccuguaguuggagcagcaaucgcagccccaguugcaggucaacaaaauguaauagauccuuggauaagaaauaacuuuguucaagcuccaggaggcgaauuuacaguaucaccuagaaaugccccaggugaaauauuauggucagcaccucuaggcccagauuuaaacccuuaucuaucucauuuggcacgaauguauaacgguuaugcagguggauuugaaguccaagucauauuagcuggaaacgcauuuacugcaggaaaaguaauuuuugcagcaguacccccaaauuuuccaacugaaggacuaucaccaucacaaguaacaauguuuccacacauagucauagaugucagacaauuagaaccgguauuaauaccucuacccgauguaagaaacaacuuuuaccacuauaaccaaucgaaugauccuacuauaaaauuaauagcaauguuauauacaccacucagagcuaacaacgcaggcgacgauguauucacuguuucaugucgcguuuuaacacgaccaucaccagacuucgauuuuauauuuuuaguaccaccaacaguagaaucuagaacuaaaccauucucuguaccuguauuaacuguagaagaaaugaccaacucucgauucccaauaccccuagaaaaacuauuuacaggaccaaguucagcauucguaguacaaccacaaaacggccgauguaccacagauggaguauuacuaggcaccacacaauuaagcccagucaauaucuguacauuccgaggagaugucacucauauuacaggaucaagaaauuacacaaugaaucuagcuucacaaaauuggaauaauuacgacccaacagaagaaauucccgcaccucuaggaacaccugacuucguaggcaaaauacaaggaguccuaacccaaacaacuagaacugauggaagcacucgaggacauaaagcaacaguauauaccgguuccgcagauuuugcaccuaaacuagguaggguacaauuugaaacagauacagaucacgauuuugaagcaaaccaaaauacaaaauucacaccagucggcguaauacaagacgguucuacuacucaucgaaacgaaccccaacaauggguuuuaccaucauauaguggacgaaauacuccaaauguucaccuugcaccugccguagcaccaacauuuccaggagaacaauuauuauuuuucagaucaaccaugccuggauguucuggauauccuaauauggaucuagauugucuacuaccacaagaauggguacaauauuuuuaucaagaagcagcuccagcacaaucugacguagcacuauuaagauucguaaaucccgauaccggucgaguacuuuuugaaugcaaacuacacaaaucaggauauguaacuguagcacacacaggucaacacgaccuaguaauaccaccaaacgguuauuuuagauuugauucauggguaaaccaauuuuacacauuagccccaaugggaaauggaacagguagacgaagagcacuauaa

SEQ ID NO: 33063 - RNA, 1623 nt, Artificial Sequence
  derived and/or modified sequence opt6 from major_capsid_protein__Norovirus__AGV76569
augaaaauggccucaucagaugcaaauccaucagacggauccgcagcaaacuuaguucccgaaguaaacaaugaaguaauggcauuagaaccaguaguaggugcagcaauagcagcaccaguugccggacaacaaaacguaauagauccauggauacguaauaauuuuguacaagcaccaggaggugaauuuacaguaucaccaagaaaugcaccaggagaaauauuaugguccgccccccucggaccugauuuaaauccauacuuaagucaucuagcaagaauguauaauggauaugcaggcggcuuugaaguacaaguaauacuagcaggaaacgcuuucacagcaggaaaaguaauauucgcagcaguuccaccaaauuuuccaacugaaggacucuccccaucacaaguaacaauguuuccacacauaguuguugacguuagacaauuagaaccaguacucauaccccuaccagaugucagaaacaauuuuuaucauuauaaccaaucuaaugacccaacaauaaaacuaauagccaugcuauacacaccucuaagagccaauaaugccggcgaugauguauuuacugucucgugccguguacuaacacgaccauccccagacuuugauuucauuuuuuuaguaccaccaacuguugaaucaagaacaaaacccuuuucaguaccaguacuaacaguagaagaaaugacaaauagcagguuuccaauaccuuuagaaaaacuauuuacuggcccauccucagcauuuguugugcaaccucaaaauggacguugcacaacugauggaguuuuacuugguacaacucaacuaucaccuguaaacauaugcacauucagaggugauguuacacauauaacagguucuagaaauuacacaaugaaccuugcaucacaaaauuggaauaacuaugaccccacagaagaaauaccagccccacuuggaacuccagacuuuguaggaaaaauacaaggaguauuaacacaaacaacacggacagacggaucaacacgaggccacaaagcaacuguauauacaggaucugccgacuucgcaccuaaacuaggaaggguacaauuugaaacugauacugaccaugauuuugaagcaaaccaaaacaccaaauuuacaccaguaggaguaauacaagauggaggcacaacacauagaaaugaaccacaacaauggguuuuaccaucuuauucuggaagaaauacaccaaauguucauuuagcacccgcaguagcaccuacauucccuggagaacaguuauuauuuuuuagaagcacaaugcccggauguucaggauauccuaauauggaccuagacugccuauuaccacaagaauggguacaauacuuuuaucaagaagccgcaccggcucaaucagauguagccuuauuaagauucguaaauccagacacagguagaguauuauuugaaugcaaauuacacaaaucaggauaugucacaguagcacauaccggacaacaugaucuagucauaccaccaaacggauauuuuagauucgauucauggguaaaucaauuuuauacauuagcaccaaugggaaacggaacagguagacgaagggcuuuauaa

SEQ ID NO: 33064 - RNA, 1623 nt, Artificial Sequence
  derived and/or modified sequence opt6 from major_capsid_protein__Norovirus__AGV76570
augaaaauggcuucaucagacgcaaacccaucagacggaucagcagcaaacuuaguaccugaaguaaacaaugaaguaauggcacuagaaccaguugucggagcagcaauagcagcaccaguagcaggacaacaaaauguaauagaucccuggauaagaaauaauuuuguacaagccccagguggagaauuuacaguaagcccaagaaaugcaccuggugaaaucuuauggucugcuccauuaggaccagaucuaaauccauaucuuucucaucuugccagaauguacaacgguuacgcuggaggauucgaaguacaagucauacuagcaggaaacgcauuuaccgcaggaaaaguuauauuugcagcaguaccaccaaauuuuccaacggaaggauuaucaccaucgcaaguuaccauguucccucacauagucguagauguaagacaacuagaaccugugcuaauaccacuaccagaugucagaaauaauuucuaucacuauaaccaaagcaaugacccuacaauaaaacuaauugcaaugcucuacacaccacuaagagccaauaaugcaggagacgacguauucacaguaucaugccgaguacuaacaagaccuaguccugauuuugauuuuauauuuuuaguacccccuaccguagaauccagaacaaaaccauucuccgucccuguacuaacaguagaagaaaugacaaacucaagauuuccaauuccauuagaaaaacuauuuacaggaccaucaagcgcauuuguaguacaaccucaaaacggacgauguaccacagacggaguccuuuuagguacaacacaacuaucaccaguuaauauuugcacauucagaggugacguaacccauauaacugguucuagaaauuacacuaugaauuuagcaagccaaaacuggaauaauuacgaucccacagaagaaaucccagcccccuuaggaacaccagauuuuguaggaaaaauccaaggggugcuuacacaaacaacacgaacugacggaucuacaagaggacacaaagcaacaguauacacaggaucagcagacuucgcacccaaacuuggacgaguacaauuugaaacagauacagaucaugauuucgaagcaaaucaaaacacaaaauucacacccguaggaguuauacaagauggaggaacaacacauagaaacgaaccacaacaauggguauuaccaaguuauuccggacgcaauacaccaaacguacaccuugccccagcagucgcaccuacuuuuccaggagaacaauuacuuuucuuccgaucuacuaugccaggaugcucaggcuauccaaauauggauuuagacuguuuacuuccacaagaauggguacaauacuucuaccaagaggccgcaccagcgcaaucagacguagcacuccuaagauucguaaaucccgacacuggaaggguacuauuugaauguaaacuccauaaaucaggcuacguaacaguagcacacacaggacaacacgaucuaguaauaccaccuaauggcuauuuuagauucgauucauggguuaaccaauuuuacacacuugcaccaaugggaaauggaacaggcagacgcagagcauuauaa

SEQ ID NO: 33065 - RNA, 1623 nt, Artificial Sequence
  derived and/or modified sequence opt6 from major_capsid_protein__Norovirus__AGV76571
augaaaauggcaaguucagacgcaaauccuucagauggaucagccgcuaauuuaguaccagaagucaauaaugaaguaauggcucuugaaccagucguaggugccgcuauagcugcuccuguugcaggacaacaaaauguaauagacccuuggauacgcaauaacuucguacaagcaccaggaggugaauuuacaguaucuccucgaaaugcccccggagaaauauuauggucugcaccacuaggaccagacuuaaauccauauuuaucacaucuagcaagaauguauaacggcuaugcagguggcuuugaaguucaaguaaucuuagcaggaaacgccuuuacagcaggaaaaguaauuuuugcagcuguacccccaaauuuuccaaccgaaggacuaaguccaucccaaguaacaauguuuccacauauaguaguagacguaagacaacuagaaccaguauuaauucccuugccagacguuagaaauaauuuuuaucauuauaaucaaucaaaugaccccacaauuaaauuaauugcaaugcuauauacuccacugcgagcaaauaaugcaggagaugauguauucacgguaucaugccgaguauuaacucguccaucuccagacuuugauuuuauauuucuaguaccaccaacuguugaaucacgaacaaaaccauuuucaguaccaguacuaacaguagaagaaaugacaaacucacgauuuccaauaccacuugaaaaauuauuuacuggacccucuucugcauucguaguacaaccucaaaauggcagauguacaacagacggaguacuauugggaacaacacaacuaucaccaguaaauauauguacauuuagaggcgaugucacccacauaaccggaagcagaaauuauauaaugaaccucgcaucacaaaauuggucuaacuaugauccaacagaagaaauuccagcaccccuaggaacuccagauuucguugguaaaauacaaggaguauugacccaaacaacaagaacagauggaucaacaagaggacauaaagcaacaguuuauacaggaucagcagacuucgcaccaaaacuaggucguguccaauucgaaacagauacugaucaugacuucgaagccaaucaaaauacaaaauucacaccuguaggagucauacaagacggaucaacaacccacagaaaugaaccucaacaauggguauuaccaaguuacuccggccgaaacacaccaaacguacaccucgcaccagcaguagcuccaacguuuccaggagaacaauuauuauucuuuagauccacuaugccuggaugcucaggauauccaaacauggaucuugauugccucuuaccacaagaauggguacaauauuuuuaucaagaagcagcacccgcccaaucagacguugcacuauuaagauucguaaauccugauacaggaagaguacuguuugaaugcaaacuacacaaaucagguuauguuacuguagcacauacaggacaacacgauuuaguaauacccccaaacggcuauuucagauuugacucuuggguaaaucaauuuuauacacuagcaccuaugggaaauggaacaggcagacgaagagcauuauaa

SEQ ID NO: 33066 - RNA, 1623 nt, Artificial Sequence
  derived and/or modified sequence opt6 from major_capsid_protein__Norovirus__AGV76572
augaaaauggcaucaucagaugcaaacccaucagauggaucugcagcaaauuuaguaccagaaguaaauaaugaaguaauggcucuagaaccaguaguaggcgcagcaauugccgccccuguagcaggacaacaaaauguaaucgacccauggauaagaaauaacuuuguucaagcaccaggaggugaauucaccguaucuccacgaaaugcaccuggugaaauacuuuggucagcaccacuaggccccgaucuaaauccauaucuaucacaccuagcuagaauguauaauggauacgcaggcggauucgaaguacaaguaauauuagcaggaaacgcauuuacagcaggcaaaguaauauuugcagccguuccaccaaauuuuccaacugaaggauuaagccccucccaaguaacaauguuuccccacauuguaguagauguucgacaauuagaaccaguacuaauaccacuaccagacguuagaaauaauuuuuaucauuacaaccaaucaucugaccccacaauaaagcuaauagcaaugcuauauacaccacuuagagcaaauaaugcaggugacgaugucuuuacuguaucaugcagaguacuuacaagacccucaccugacuuugauuuuauauuuuuaguuccaccuacgguagaaucuaggacuaaaccauucagcguaccaguucuaacagucgaagaaaugacaaacucaagauucccaauaccccuagaaaaauuauucacaggaccaucguccgcauuugucguucaaccacaaaacggaagaugcacaacugauggaguauuauuagguaccacacaauuaucaccagucaauauaugcacauuuagaggugacgucacacacaucacaggaucaagaaauuacaccaugaauuuagcaucacaaaacuggaauaacuaugauccaacugaagaaauucccgcuccauuaggaacaccagacuuuguuggcaaaauacaaggaguccuaacacaaaccaccagaacagacggaucuacaagaggacacaaagcaacaguauacacaggauccgcagacuuugcaccaaaauuaggacgaguacaauucgaaacugauaccgaccacgauuuugaagcaaaucaaaauacuaaauucacacccguaggaguuauacaagacggaucaacaacccacagaaaugaaccucaacaauggguauugccaucauacuccggaagaaacacccauaauguacacuuagcaccugcaguugcaccgaccuuccccggagaacaacuauuauucuucagaucaacaaugccaggaugcucagguuauccaaauauggaucuagauugcuuacuaccccaagaauggguucaauauuucuaccaagaagcagcaccugcccaaucugacguagcauuacuccgauucguuaaucccgauacuggacgaguauuauuugaauguaaacuacauaaaucuggauauguaacaguagcucauacuggucaacaugaccuuguaauuccaccaaauggcuauuucagauuugauucauggguuaaucaauuuuauacuuuagcaccaaugggaaauggaacaggcagaagaagagcaguauaa

SEQ ID NO: 33067 - RNA, 1623 nt, Artificial Sequence
  derived and/or modified sequence opt6 from major_capsid_protein__Norovirus__AGV76573
augaaaauggcaucaucagaugcaaauccgucagauggaucagcagcaaaucuaguaccagaaguaaauaacgaaguaauggcccuugaaccaguaguuggagcugcaauagcugcaccuguagcaggccaacaaaauguaaucgacccauggauaagaaauaauuuuguacaagcaccaggaggugaauuuacaguaucaccaagaaaugcaccaggcgaaauccuauggucagccccucucggaccagauuuaaacccuuaucuaucacaccuagcucgaauguauaacggauaugcaggagguuucgaaguacaaguuauucuagcaggaaaugcauucacagcagguaaaguaauauucgcagcaguacccccaaauuucccaacagaaggacuaucuccaucacaaguaacaauguucccucauaucguaguagacguuagacaacuagaaccaguacuaauaccuuuacccgaugucaggaacaauuucuaucacuacaaucaaucaaaugacccaacaauaaaauuaauagcaaugcuauacacaccucucagagcuaauaaugcaggagaugauguauuuacaguaucauguagaguacucacccguccaucacccgacuuugacuucauauuccuuguucccccaacaguagaaucaagaacaaaaccauucuccguuccaguacuuacugucgaagaaaugacuaacucacgauuuccaauuccauuagaaaaauuauuuacaggaccaaguucagcauuuguaguacaaccucaaaauggaagauguacaacggacggaguacuauuaggaacuacucaauuaaguccagucaauaucugcacuuuccgaggagacgucacacauauaacaggauccagaaauuacacaaugaaucucgcuucucaaaauuggaacaacuaugauccaacagaagaaauaccugcaccuuuaggaaccccagauuuuguagguaaaauccaaggaguauuaacucaaacaacucguacugaugguaguacacguggacacaaagcaacaguauauacaggauccgcagacuuugcuccaaaacuaggacgaguacaauucgaaacagauacagaucacgacuuugaagcuaaucaaaauacaaaauuuacaccuguaggagucauccaagacggaggcacaacacacagaaaugaaccacaacaauggguuuuaccuagcuacucuggaagaaauacucauaacgugcacuuagcaccagcagucgcuccaacauuuccaggagaacaacuauuauuuuuucgaucaacaaugccaggaugcuccggauauccaaauauggacuuagauugccuucuaccacaagaauggguacaauacuucuaucaagaagcagcaccagcacaaucagauguagcauuacuacgauuuguaaacccagauaccgguagaguacuauuugaaugcaaacuccauaaauccggauauguaacaguagcacauacaggccagcaugauuuaguaauaccuccaaacggauacuucagauucgacucauggguaaaccaauucuacacucucgcacccauggguaauggaacuggaagacgaagagcaguauaa

SEQ ID NO: 33068 - RNA, 1623 nt, Artificial Sequence
  derived and/or modified sequence opt6 from major_capsid_protein__Norovirus__AGV76574
augaaaauggcuucuucagacgcuaacccuucagauggaucugcagcuaaccuaguaccugaaguaaacaacgaaguaauggcacuagaaccaguagugggugcagcaauagcagcaccuguagcaggacaacaaaauguuauagacccauggauaagaaauaacuucgugcaagcaccaggaggagaauuuacaguaucaccaagaaacgcuccuggagaaauucuauggagugccccauuaggaccagaucuaaauccauauuuaucccaccuugcaagaauguacaacggauacgcaggcggauucgaaguacaaguaauacucgcaggcaaugcauuuacugcuggaaaaguaauauucgcagccguacccccaaacuuuccaacagaaggccucucacccucacaaguaacaauguuuccgcauauuguaguagauguaagacaauuagaaccaguuuuaauuccacucccagauguaagaaauaauuucuaccauuacaaccaauccaacgacccaacaauaaaacuuauagcaaugcuauauacaccauugagagcuaacaaugcaggagaugauguauucacaguauccugcagaguucuaacuagaccaucaccagacuucgacuuuaucuuccuaguaccaccaacuguagaaucaagaacaaaaccuuucucaguuccaguccuaacaguagaagaaaugacuaacucacgcuucccuauaccauuagagaaauuauuuacaggaccaucaucagcauuuguaguacaaccucaaaacggaagauguacuacagaugguguuuuauuaggaacaacccaauuauccccaguuaacauauguacauuuagaggagauguaacacacauaacaggaucaagaaauuacacaaugaauuuagcaucacaaaauuggaauaacuaugauccuacugaagaaauaccagcaccauuaggaacaccagacuuuguaggaaaaauacaaggaguucuaacccaaacaacaagaacugacgguucaacacgaggacauaaagcaaccguauacacagguagugccgacuuugccccaaaauuaggcagaguacaauucgaaacagacacugaccacgauuuugaagcaaaucaaaacacaaaauucacaccaguaggaguaauccaagauggagguacaacacauagaaaugaaccucaacaauggguauuaccaucauauucaggaagaaauacacauaauguacacuuagcuccugccguagcaccuaccuuuccaggcgaacaacuucuauuuuuuagaucaacaaugccagguugcucaggauauccaaacauggaccuagacugucucauuccacaggaauggguacaauauuucuaucaagaagcagcaccagcucaaucugauguagcacuauuaagauucgucaacccagauacaggcagaguucuuuucgaaugcaaauuacauaaaucaggauauguaacuguagcucacaccggacaacaugauuuaguaauaccaccaaaugguuauuuccgauucgauucauggguaaaucaauuuuacacacuugcaccaauggguaauggaaccggucgaagaagagcaguauaa

SEQ ID NO: 33069 - RNA, 1623 nt, Artificial Sequence
  derived and/or modified sequence opt6 from major_capsid_protein__Norovirus__AGV76575
augaaaauggccagcagugacgcaaacccauccgacggaucugcagcaaaucuaguaccagaaguaaacaacgaaguaauggcacuugaaccaguaguaggagccgcaauagcagcaccgguugcaggacaacaaaacguaauugauccauggauucguaauaacuuuguucaagcaccaggcggugaauucacuguuuccccuagaaaugcuccaggugaaauacuuuggucagcaccauuaggaccugaccuaaauccauauuuaucucaucuagcaagaauguauaacggauaugcaggaggauuugaaguccaaguuauuuuagcaggaaacgcauuuacagcagguaaaguaauauuugcagcaguaccuccuaauuucccaacagaaggauuaucaccaucgcaagucacuauguuuccacauauaguaguugaugucagacaauuagaaccuguacuaauaccccuuccagauguaagaaauaauuuuuaucauuauaaucaaucaaaugauccaacuauaaaacuaauagccaugcuauauacuccauuaagagcaaacaacgcaggagacgauguauuuaccguaucuuguagaguucuuacccgcccaucaccugacuucgauuuuauauuucuuguaccaccuacaguagaaucacgaaccaaacccuucagcguacccguguuaacaguugaagaaaugacaaauucaagauuuccaauuccacuagaaaaacuauuuacagguccaaguucagcuuuuguaguacaaccucaaaauggaagauguacaacagacggcguauuauuggguacuacacaacuaucacccgucaauauuugcacauuuagaggagacguaacacacaucacuggaucaagaaacuauacuaugaacuuagcuucacaaaauuggaacaauuacgauccaacagaagaaauaccugcuccacucggaacaccagauuuuguugguaaaauacaaggaguacuaacucaaacuacaagaaccgaugguaguacccgaggucauaaagccacagucuacacaggcucugcagauuuugccccaaaacuuggaagaguacaauucgaaacagauacugauaacgauuuugaagccaaccaaaauacgaaauuuacaccaguaggaguaauacaagauggagguacaacacauagaaaugaaccacaacaguggguacuaccaucauacucaggcagaaauacucacaauguucaucuagcaccagcagucgcaccaacauucccaggagaacaauuauuauuuuuuagaaguacaaugcccggcuguucaggauauccaaacauggauuuagauuguuuaauaccacaagaauggguacaauauuuuuaucaagaagcagcaccagcucaaucagauguugcuuuauuaagauuuguuaauccugauacaggaagaguacuauucgaauguaaauuacauaaauccggauauguaacaguugcacacacaggacaacaugauuuaguaauaccaccaaauggguauuucagauuugauagcuggguaaaucaauuuuauacauuagcaccaaugggaaauggcacaggcagacgaagagcaguauaa

SEQ ID NO: 33070 - RNA, 1623 nt, Artificial Sequence
  derived and/or modified sequence opt6 from major_capsid_protein__Norovirus__AHA44844
augaaaauggcaucaucagaugcaaacccaucagacggaucagcagcaaaucuaguaccugaagucaauaaugaaguaauggcauuagaaccaguuguaggugcagcaauagcagcaccaguagcaggccaacaaaauguaauugacccuuggauaagaaauaauuuuguucaagcaccaggcggugaauuuacaguaucucccagaaaugcuccaggagaaauuuuauggucagcaccacuaggaccagaccuaaauccauauuuaucacauuuagccagaauguauaacggauaugcaggcggauuugaaguccaaguaauauuagccgguaaugcuuucacagcagguaaaguaauauuugccgcuguucccccuaacuuccccacagaaggacuaucaccuucacaaguuacuauguuuccacauauaguuguagauguaagacaauuagaaccaguacuuauacccuuaccagauguucgaaauaauuuuuaccauuauaaucaaucaaaugauccuacaauuaaauuaaucgcaauguuauacacaccacuacgagcaaauaaugcuggagaugauguuuuuacaguaucuuguagaguucuuacaagaccaucuccugauuuugauuuuauuuuccuaguuccaccuacaguagaaucuagaaccaaaccauuuuccguucccguguuaaccgucgaagaaaugacaaacucuagauuuccuauuccccuugaaaaauuauucacuggccccagcucugcauuuguaguacaaccacaaaacggcagauguacuacagauggcguuuuauuaggaacaacccaauuaucaccaguaaacauaugcacauuuagaggcgacguuacacauauaacaggaucacgcaacuauacaaugaaccuagcaucacaaaauuggaauaacuacgauccaacugaagaaauuccugcaccuuuaggaacaccagacuuuguaggaaaaauucaaggaguacuaacucaaacuacaagaacagacggauccacaagaggucauaaagccacaguauauacaggaucugcagacuuugcaccaaaguuaggaagaguacaauuugaaacagauacagaccacgauuucgaagcaaaucaaaauaccaaauuuacaccaguaggcguaauacaagauggaggaacaacacauagaaaugaaccacaacaauggguuuuaccuucauauagugguagaaauacccacaacguucaucuugcaccagcuguagcuccaaccuuccccggugaacaacuacuauuuuuuagaucuaccaugccaggcuguucuggauacccuaauauggaccuugacugucuauuaccacaagaauggguacaauauuucuaucaagaagcugcaccggcccaaucagacguagcauuacuacgauuugucaauccagauacuggaagaguauuauucgaauguaaacuacauaaaucuggauacguuaccguugcucauacaggccaacacgacuuagucauuccuccaaauggauacuuuagauuugacucaugggucaaucaauuuuauacccuagcaccuaugggaaauggcacgggaagacgcagagcaguuuaa

SEQ ID NO: 33071 - RNA, 1623 nt, Artificial Sequence
  derived and/or modified sequence opt6 from major_capsid_protein__Norovirus__AHA44847
augaaaauggcauccucugaugcaaauccaagugacgguucagccgcaaaucuagucccagaaguaaacaacgaaguuauggcacuggaaccuguaguaggagccgcgauagcagcaccuguagcaggccaacaaaacguaauagacccauggauaagaaacaauuuuguucaagcuccaggaggagaauuuacaguuagccccagaaacgcacccggagaaauccuuuggucagcaccauuaggcccagauuuaaaucccuauuuaucacaccuagcccguauguacaacgguuaugcaggaggauuugaaguacaagucauacuagccggcaaugcauuuacagcaggaaaaauaauauuugcagcaguuccacccaacuucccaacagaaggauuaucaccaucccaaguaacuauguucccacauauaauaguugauguuagacaauuagaacccguccuaauaccauuaccagauguacgaaacaacuucuaucacuauaaccaaaguaaugauccaacaauuaaacuaauugcuauguuauauacucccuuaagagcaaauaaugccggagaugauguauuuacaguauccugucgaguacucacaagaccaucaccugacuucgacuucauauuuuuagucccaccaacaguagaaucucgaacaaaaccuuuuucuguaccaaucuuaacagucgaagaaaugacaaacucuagauucccaauaccacuagaaaaacuuuucacagguccaucauccgcauucguaguacaaccacaaaacggaagauguacgacugauggaguacuucuaggcacaacacaauuaagcccaguuaauauauguacauuuagaggugacauuacccacauaacaggaucaagaaauuacacaaugaauuuagcuagccaaaauuggaacaacuacgauccaacugaagaaauaccagcaccauuaggaacaccagacuuuguaggaaaaauacaagguguacuaacacaaacaacacgagcagauggaaguacaagaggacacaaagccauaguauacacuggaagugcugacuucgcaccaaaacuaggacguguacaauucgaaacagauacagaucacgauuuugaagcuaaucaaaauacuaaauucacaccaguaggaguaacccaagacggaucaacaacgcauagaaacgaaccucaacaauggguacuaccuuccuauucaggaagaaacacccauaauguacacuuagcuccagcuguagcaccaacauuuccaggugaacaacuacuauucuuucgaucaacaaugccaggcugcucaggcuauccaaauauggauuuagacugccuacuuccacaagaauggguacaauauuucuaucaagaagcagcaccagcacaaucagauguagcuuuacuaagauucguaaauccagacacaggaagaguucuguuugaauguaaacuccauaaaagcggcuacguaacaguagcacacaccggacaacaugaucuaguaauaccaccaaauggauacuucagauucgacucauggguaaaucaauuuuacacauuagcacccaugggaaaugguacaggaagaagacgaguaguauaa

SEQ ID NO: 33072 - RNA, 1623 nt, Artificial Sequence
  derived and/or modified sequence opt6 from major_capsid_protein__Norovirus__AHB62404
augaaaauggccuccucagaugcaaacccaucugauggcucaacagcaaacuuaguacccgaaguaaauaacgaaguaauggcauuagaaccagucguaggagcagcaaucgcugcuccagucgcaggacaacaaaacgucauugacccauggauaagaaacaauuucguccaagcucccggaggagaauuuacaguuucaccucgaaaugcaccuggagaaauucuauggucagcaccacuuggacccgauuuaaaucccuaucucucacauuuggcaagaauguauaacggauacgcuggaggauuugaaguacaaguaauacuagccggaaaugccuuuacugcugguaaaauaauuuuugcagcaguaccaccuaacuuucccacagaaggacuaucaccaucacaaguaacaauguucccacauauaauuguugacguaagacaauuagaaccuguucuuauuccauuaccagacguacgaaauaauuucuaccacuauaaucaaucaaaugauucaaccauaaaauuaauagccaugcuguacaccccauuaagagcuaauaaugcaggagaugauguuuuuacaguauccugcagaguauuaacaagaccuuccccagauuuugacuuuauauuucuaguacccccuacaguagaaucuagaacuaaaccauuuucagucccuguuuuaacagucgaagaaaugacaaauucuagauuccccauaccauuagaaaaacucuuuacaggaccaucauccgccuucguaguacaaccacaaaauggacgcugcacuacagacggcguacuacucggaacaacacaauuaaguccaguaaacaucuguacauuuagaggagacguuacacacaucucaggaucaagcaacuauacuaugaaucuagcuucccaaaauuggaauucauacgacccaaccgaagaaauaccagcaccacucggaacaccugacuucgucgguaaaauacaaggaguacuaacccaaacaaccagaacugauggaucaacaagaggacauaaagccacaguauacacuggaucagcagauuuuaguccuaaacuaggaagaguccaauuugccacugacacagauaacgauuuugaaacuaaucaaaacacuaaauuuacaccaguaggcguaauacaagauggugcuacuacccaucgcaacgaaccacaacaauggguacuaccaucauauucagggcgaaauacacacaacguacacuuagcucccgccguagcaccuacauuuccaggagaacaauuauuauucuucagaucaacaaugccagguuguucagguuauccaaacauggaccuagauugccuauuaccacaagaauggguacaauauuuuuaccaagaagcagcaccugcccaaucugaugucgcauuauuaagauucguuaauccugauacaggaagaguuuuauucgaaugcaaacuacauaaauccgguuauguaacugucgcccauacaggucaacacgauuuagucauaccacccaauggauauuuucgauuugacuccuggguuaaccaauuuuacacuuuagcaccaaugggaaauggaacuggaagaagaagagcauuauaa

SEQ ID NO: 33073 - RNA, 1623 nt, Artificial Sequence
  derived and/or modified sequence opt6 from major_capsid_protein__Norovirus__AHB62406
augaaaauggcaucaucugaugcaaauccaucagacggaucagccgccaacuuaguaccagaaguuaacaaugaaguaauggcacuagaaccagucguaggagcagcaauagcagcaccaguugcaggacaacaaaaugucaucgacccauggauuagaaauaacuuuguacaagcaccaggaggugaauuuacaguaucaccgagaaaugcaccaggagaaauauuauggucugcaccacuuggacccgaccuaaacccauaucuaucacauuuagcacgaauguauaacggauacgcaggaggauucgaaguacaaguaauacuagcuggaaaugcauuuacagcaggaaaaguuauauuugcagcaguuccaccaaacuuucccacugaaggccuaucaccaucacaaguuacaauguucccacacauaguagucgauguaagacaauuagaaccaguauuaauaccauuaccugauguuagaaauaauuucuaucauuauaaucaaucuaaugaucccacaauaaaacuaauagcuaugcuauacaccccauuaagagcaaacaacgcuggagacgauguauuuacuguaucaugcagaguauuaacucguccaucaccagacuucgauuuuauauucuuaguaccaccaacaguugaaucucgaacaaaaccuuucucaguuccuguucuaacuguagaagaaaugacaaacucaagauuccccauuccauuagaaaaacuauuuacaggaccuucuuccgcauucguaguacaaccacaaaacggaagaugcacaacagacggaguauuauuaggaacaacccaauuaagccccguuaauauauguacauucagaggugacgucacacauauaacaggaucccgaaauuacacuaugaauuuagcaagccaaaacuggaacaauuacgacccuacagaagaaauaccagcaccauuaggaacaccagauuucgugggaaaaauucaaggcgucuuaacacaaacaacaagaacagacggaucuacaagaggacacaaagcaacaguauacacuggaucagccgacuuugcaccaaaacuaggacgaguacaauucgaaacugacacagaucaugauuucgaagccaaucaaaauacaaaauucacaccuguuggaguaauacaagacggaggaaccacccauagaaaugaaccucaacaauggguacucccauccuacucaggcagaaacacacccaacguucacuuagcaccagcaguugcaccaacauucccaggagaacaacuccuauucuuuagaucaacuaugccaggaugcucagguuacccaaacauggaucuagauugccuauuaccacaagaauggguacaauauuucuaucaagaagcagcaccagcucaauccgauguagcauuacuaagauucguaaacccugauacaggaagaguccucuucgaaugcaaauuacacaaaucuggauauguaacaguugcacacacaggacaacaugaccuaguaauaccacccaauggauacuuccgauuugacucaugggucaaucaauuuuauacacuagcacccaugggaaacggcaccggucguagacgugcacucuaa

SEQ ID NO: 33074 - RNA, 1623 nt, Artificial Sequence
  derived and/or modified sequence opt6 from major_capsid_protein__Norovirus__AID51515
augaaaauggcuucaucagaugccaauccuuccgauggaucagcagcaaauuuaguaccagaaguuaacaaugaaguaauggcccucgaaccaguaguaggagcagcaauagcagcaccaguagccggacaacaaaacguaauagauccauggaucagaaauaacuuuguccaagcacccggaggagaguucacuguaagcccaagaaaugccccaggagaaauacuauggucugcaccccuagguccagaucuaaaucccuaccuuucacaucucgcaagaauguauaacggauaugccggugguuucgaaguacaaguaauauuagcaggaaaugccuucacagcaggaaaaguuauauucgcagcuguuccaccuaacuuuccaacagaaggacuaucaccaucacaaguuaccauguuuccacacauuguaguagauguaagacaauuagaaccaguacuaauaccauugccagacguaagaaacaauuuuuaucauuauaaccaaucuaacgaucccacaauaaaauuaauagcuauguuauauaccccauuacgugcaaacaaugcaggugacgacguuuuuacaguaagcugccgaguauuaacaagacccucaccugacuuugauuucauauuuuuaguaccaccaacaguagaaucccgaacaaaaccuuuuucuguuccaguacuaaccguagaagaaaugacaaauucaagauuuccaauaccauuagaaaaacuauucaccggaccaucuucagccuucguuguccaaccacaaaauggaagauguacaacagauggcguauuacccggcaccacacaauuauccccagucaacauauguacauuccgaggagacguuacucauauaacuggaucaagaaacuauacaaugaaucuagccucccaaaauuggaauaauuacgacccaacagaagaaauaccagcaccccuaggcacuccagacuuuguaggaaaaauucaaggaguauuaacacaaaccacuagaucagacggaucaacaagaggacauaaagccacaguauauaccggaucugcagacuucgcuccaaaacuaggacgaguacaauucgaaacagacaccgauagagacuuugaagcaaaucaaaauacaaaauucacaccugucgguguaauucaagauggaggcacaacacacagaaacgaaccucaacaguggguacuaccauccuauucaggaagaaacacaccuaauguacacuuagcaccagcuguugcaccaaccuuuccaggagaacaacuacucuuuuuucgcagcacaaugccaggauguucaggcuacccaaacauggaucuagauugcuuauuaccacaagaauggguccaauacuuuuaucaagaagccgcaccagcacaauccgacgucgcauuacuaagauuugucaacccugacacuggacgcguacuauucgaaugcaaauuacauaaauccgguuauguaacagucgcacauacaggacaacaugacuuaguuauaccacccaacgguuacuucagauuugauucuuggguaaaucaauuuuacacacuagcucccaugggaaauggaacaggaagaagacgugcacuauaa

SEQ ID NO: 33075 - RNA, 1623 nt, Artificial Sequence
  derived and/or modified sequence opt6 from major_capsid_protein__Norovirus__AID51517
augaaaauggcaucaagcgaugcuaaccccuccgauggauccgcagcuaauuuaguaccagaaguaaauaaugaaguaauggcgcuagaaccaguuguaggagcagcaauagcagcaccaguagcaggacaacaaaauguuauagacccauggauuagaaacaauuuuguacaagcuccagguggagaauuuacuguaucaccaagaaaugcaccaggagaaauccuauggucugcaccauuaggaccagaucucaauccauaucuaucacauuuagcuagaauguauaacggauaugcaggaggauuugaaguacaaguaauacuagcaggcaaugccuucacagcaggaaaaguuauauuugcagcaguaccuccaaauuuuccaacagaaggacuaucaccaucucaaguuacuauguucccacacauagucgucgauguccgacaacuagaaccaguucuuauucccuuaccagacguuagaaacaacuucuaccacuauaaccaaucaaaugacccaacaauaaaacucaucgcuaugcuuuacacuccccuacgagcaaauaaugcaggcgacgacguauuuacuguuucaugcagaguauuaacaagaccauccccagauuuugauuuuauauuucuaguaccacccacaguagaaucaagaacuaaaccauuuucaguaccaguuuuaacaguagaagaaaugaccaacagcagauucccaauuccauuagaaaaauuauuuacuggaccaucaucugcauuuguaguucaaccacaaaauggaagauguacaacagacggaguacuauuaggaacaacacaacuaucuccaguaaauauuugcacauuucgaggagauguaacucauauaacuggaucaagaaacuauacuaugaauuuagcuagccaaaauuggaguaauuacgacccaaccgaagaaauaccagcaccacuaggaacacccgauuuugucggaaaaauacaaggaguauuaacacaaacuacaagaaccgauggaucaacacgaggacacaaagcuacuguauauacaggaucagccgauuuugccccaaaacucggucgaguccaauucgaaacugauacagaucaugacuuugaagcuaaucaaaacacaaaauucacaccaguaggaguaauccaagauggaucaacuacacaccgaaaugaaccacaacaauggguccuaccaaguuauucuggaagaaauaccccuaacguacauuuagcaccagcaguagccccaaccuuucccggagaacaacugcuuuucuuuagaaguacaaugccaggauguucaggauaucccaauauggauuuagacuguuuacuaccucaagaauggguacaauauuucuaccaagaagcagcuccagcacaaucagauguagccuuacuacguuuuguaaaucccgauaccggaagaguacuauucgaauguaaacuccacaaaucaggauauguaacuguagcacacacaggacaacacgaucucguaauaccacccaaugguuauuucagauucgauuccugggucaaucaauuuuacacacuagcuccaaugggaaauggaacaggaagacgacgugcauuauaa

SEQ ID NO: 33076 - RNA, 1623 nt, Artificial Sequence
  derived and/or modified sequence opt6 from major_capsid_protein__Norovirus__AID51519
augaaaauggcaucaucagacgcaaacccaucagacggcagcgcugcaaauuuagucccagaagucaacaaugaagucauggccuuagaacccguagucggugcagcaauagcugcccccguagcaggacaacaaaauguaauagacccauggauaagaaacaauuuuguacaagcaccaggaggcgaauuuacaguuagcccaagaaaugcaccuggcgaaauuuuauggagcgcacccuuaggcccugaccuaaacccuuaucuaagucauuuagcaagaauguauaauggauaugcaggcggguuugaaguacaagucauucuagcaggaaacgcauucacugcaggaaaaguaauauucgcagccguacccccuaacuucccuaccgaaggacuaucaccaucucaaguaacaauguuuccucauauaguagucgauguaagacaauuagaaccaguucuaauaccauuacccgauguacgaaauaauuuuuaccauuauaaucaaucaaaugauccaacaauaaaacuuauagcaauguuauacacaccacuacgagcuaacaacgcaggagaugauguauucacaguaucaugucgaguacuaacccgcccuucaccagacuuugacuucauauucuuaguaccaccuacaguugaaucucgaacuaaaccauucucuguaccaguacuuacuguugaagaaaugacaaauucaagauuucccauaccacuagaaaaacuauucacaggaccaucuucugcauuuguuguacaaccacaaaacgguagauguacaacagacgguguacuauuaggcacaacccaacuauccccaguuaauauauguacauucagaggcgauguaacccacauaacaggaucaagaaauuauacaaugaauuuagcaucccaaaauuggucaaacuacgauccaacagaagaaauacccgcaccacuugguacaccugauuucguaggaaaaauacaggguguucuuacacaaaccacccgaacagaugguucuacaagaggacauaaagcuaccguauacacaggaucugcagauuucgcaccuaaacuuggaagaguacaauucgaaaccgauacagaccaugauuuugaagcaaaucaaaauacuaaauucaccccaguuggaguaauccaagacggaucaacaacacaucgaaaugaaccacaacaauggguacuaccauccuauucuggacgaaacaccccaaacguacauuuagccccagcugucgcaccuacauuuccuggagaacaacuacuauuuuuucgaucaacuaugccaggauguagcggauauccaaacauggaucuagacugucugcuaccacaggaauggguacaauacuuuuaccaagaagcagccccugcacaauccgauguagcuuuacuaagauuuguaaacccagauacaggaagaguccuauucgaauguaaauuacauaaaucacguuacgugacaguugcccacacaggacaacacgaucuaguaauaccaccaaauggcuauuucagauuugauucauggguaaaucaauuuuauacauuagcgccaaugggaaauggaacaggaagacgaagagccuuauaa

SEQ ID NO: 33077 - RNA, 1623 nt, Artificial Sequence
  derived and/or modified sequence opt6 from major_capsid_protein__Norovirus__AID51522
augaaaauggcaucaagugacgccucaccauccgauggauccgccgcaaaccuaguaccugaaguuaacaaugaaguuauggcacuagaaccagucguaggagcagcuauugcagcaccagucgcaggacagcaaaauguaauagaucccuggauaagaaacaauuucguacaagcaccaggaggagaauuuacagucucaccacgaaaugcaccuggagaaauacuauggucugcaccauuaggaccagauuuaaacccauaccuaucacacuuagcuagaauguauaacgguuaugccggaggauucgaaguacaagucauacucgcaggaaacgccuuuacagcaggaaaaguaauuuuugcagcaguuccaccaaauuuucccacugaaggccuaucaccaucacaaguaacaauguucccacacauaguaguugacguacgacaacuagaaccaguauuaauuccauuacccgauguacgaaacaacuucuaucauuauaaccaaucaaaugaccccacuauaaaauuaaucgcaauguuauacacaccacuaagagcaaauaacgcuggagaugacguauuuacaguaucaugucgcguacuaacaagacccaguccugauuuugacuuuauauucuuaguuccucccacaguugaguccagaacaaaaccauuuucaguaccuguauuaacaguugaagaaaugacaaacucuagauuuccaauaccuuuagaaaaauuauuuacaggacccucaucagcauuuguuguccaaccacaaaauggacguuguacaacugacggagucuuacuggguacaacacaauuaucaccaguaaauaucugcacauuuagaggagacguaacacauauaacaggaucacgaaacuacacgaugaaccuagcaucacaaaauugguccaacuaugauccuacagaagaaauuccugcaccauuaggaacaccagacuuuguaggaaaaauacaaggaguucuaacacaaacaacaagaacagaugguucuaccagaggacacaaagccacuguauauacagggucugcagauuuugcacccaaauuaggacgaguccaauucgaaaccgacacugauagagauuuugaagcaaaucaaaauacaaaauucacaccaguuggaguuauacaagacgguucaacuacccauagaaaugaaccacaacaauggguacuuccaucauauucagguagaaauacaccaaacguucacuuagccccugccguagccccuacuuuuccaggagaacaacuacuuuucuuuagauccacuaugccagguugcucaggauaccccaacauggauuuagacugucuauuaccacaagaauggguacaauauuuuuaucaagaagcagcuccugcacaaucagauguagcauuauuacgcuuuguuaauccagauacagguaggguauuauucgaaugcaaauuacauaaaucuggauauguaacugucgcccacacuggacaacaugaccuaguaauaccuccaaauggauauuucagauucgauucauggguaaaucaauuuuacacuuuagcaccaaugggaaacggaaccggaagaagaagagcacuuuaa

SEQ ID NO: 33078 - RNA, 1623 nt, Artificial Sequence
  derived and/or modified sequence opt6 from major_capsid_protein__Norovirus__AID51531
augaaaauggcaucaucagaugcaaauccaucugauggaucagccgcaaaucuuguaccugaaguuaauaaugaaguaauggcauuagaacccguaguaggugccgcaauugcagcaccaguugcaggacaacaaaauguaauagauccauggauuagaaauaauuuuguacaagcuccaggaggagaauucacaguauccccaagaaaugcaccaggagaaauacuaugguccgcaccacuaggaccagauuuaaauccauaccuaucacauuuagcacgaauguacaauggauacgccgguggauucgaaguacaaguaauacuagcaggaaaugcauucaccgccggaaaaguaauauuugcagcgguaccaccaaacuuuccaacagaaggauuaucaccaucucaagucacaauguuuccacauauaguugucgauguaagacaacuagaaccuguauuaauaccauuaccagaugucagaaacaauuuuuaucauuauaaccaauccaaugaucccaccauaaaacuaauagcuaugcuauacacaccacuaagagcuaauaacgcaggagaugaugucuucaccguuucaugcagaguauuaacccgaccaucuccagauuuugacuucauuuuccuaguccccccaacaguagaaucccggacaaaaccuuuuucaguacccguauuaaccguagaagaaaugacaaacucuagauucccaauaccauuagaaaaacuauuuacaggaccaaguucagcauucguaguacaaccccaaaauggaagauguaccacagaugguguucuacuaggaaccacacaacuuucaccuguaaacaucuguacuuuucgcggggacguaacacauauaacagguucaagaaauuacacaaugaacuuagcaucccaaaacuggaauaauuaugauccaacagaagaaauacccgccccucuuggaaccccagacuuuguagguaaaauucaaggaguacuaacucaaacaacuagaacagacggcucaacccgaggacauaaagcgacaguuuacacaggaucugcagacuuugcaccaaaauuaggaagaguacaauuugaaacugauacugaucaugauuuugaagcaaaucaaaauacaaaauucacaccaguuggagucauacaagauggaggcacaacacauagaaaugaaccacaacaauggguacuaccaucauauuccggaagaaauacccauaauguacaucuugcaccugcuguagcaccaacauuuccuggagaacaauuacuuuuuuuuagauccaccaugccaggaugcucaggauacccaaauauggaccucgacugcuuauuaccucaagaauggguacaauauuuuuaucaagaagccgcuccagcacaaucagauguagcauuauuacguuucguaaauccagacacuggaagaguucuauuugaaugcaaacuacacaaaucaggauauguaacaguugcacacacaggacaacaugauuuaguaauaccaccaaaugguuauuuuagauucgauucauggguaaaucaauucuauacccuagcgccaaugggcaauggaacaggacgaagaagagcagucuaa

SEQ ID NO: 33079 - RNA, 1623 nt, Artificial Sequence
  derived and/or modified sequence opt6 from major_capsid_protein__Norovirus__AID51534
augaaaauggccucaucggacgcaaacccauccgauggaucagcagccaacuuaguuccagaaguuaauaaugaaguaauggcauuagaaccugucgucggagcagcaauagcagcuccuguagcaggacaacaaaaugucaucgacccuuggaucagaaauaauuucguacaagcucccggaggagaauuuacaguaucuccaagaaaugcaccaggagaaaucuuaugguccgcaccauuaggcccugaccuuaauccauauuuaucacauuuagcccgaauguacaacgguuacgcaggaggauuugaaguucaaguaauacuagccggaaacgcauucacagcaggaaaaguaauuuucgccgccguaccaccaaauuuuccaacagaaggauuaucuccaucacaaguuacaauguucccacauauaguaguagacguaagacaauuagaaccaguucuaauaccuuuacccgacguaagaaauaauuuuuaccauuauaaccaaucaaaugaucccacaauaaaauuaaucgccauguuauauacaccacuaagagcaaacaaugcaggugacgauguauucaccguaucaugucguguauuaacaagaccaucaccagacuucgauuuuaucuuucuaguaccaccaacaguagaaucacguacaaaaccuuucuccguaccaguauuaacaguagaagaaaugacaaacucaagauuuccuauuccacuugaaaaauuauuuacuggaccuucaucugcauucguaguacaaccccaaaauggacgcugcacaacugauggaguauuacuagguacaacucaauuaucaccaguuaacauuuguacauuuagaggagauguaacacacauaacagguucaagaaauuauacaaugaaccuagcaucacaaaacuggucaaacuaugaccccacugaagaaauaccugcaccguuaggcacaccagacuuugucggaaaaauacaaggaguauuaacccaaacuacacgaacagacggaucuacaagaggacacaaagcaacuguuuauacuggauccgcagacuuugcaccaaaacuuggucguguucaauucgaaacggauacagaccgcgauuuugaagcuaaucaaaacaccaaauucacuccaguagguguuauucaagacgguucuacuacacacagaaacgaaccccaacaauggguauuaccaucauacuccgguagaaacacaccuaacguacaucuugcgccagcaguagcuccaaccuucccaggagaacaacuauuauuuuuccgcucuaccaugccaggauguucaggauauccaaauauggaucuagauugucuacuaccacaagaauggguacaauauuucuaucaagaagcagcaccagcucaaucugacguagcauuauuaagauucguaaauccagacacuggaagaguauuauucgaaugcaaauuacauaaaucaggcuauguaaccguagcacauacaggacaacaugauuuaguuauaccucccaacggauauuucagauuugauucauggguaaaccaauuuuacaccuuagcaccuaugggcaauggaacuggaagaagacgagcauuauaa

SEQ ID NO: 33080 - RNA, 1623 nt, Artificial Sequence
  derived and/or modified sequence opt6 from major_capsid_protein__Norovirus__AIL49840
augaaaauggcauccucagacgcuaacccuucugacgguuccgcagcaaauuuagucccugaaguaaauaaugaagucauggccuuagaaccaguaguaggagcagcaaucgcagcaccaguugcaggucaacaaaauguaauagacccauggauaagaaacaacuuuguacaagcucccggaggagaauucacaguaucaccaagaaaugcaccuggcgaaauacuauggucagcaccacucggaccagauuuaaaucccuauuuaucacaucuagcaagaauguauaauggauacgcaggcgguuuugaaguccaaguaauacuagcaggaaacgccuucacagcaggaaaaguaauuuucgcagccguacccccaaacuuuccaacagaaggacuaucuccaucacaaguaaccauguucccacauauuguaguagacguaagacaacucgaaccaguuuuaauaccauuaccagauguacgaaacaacuucuaccacuauaaccaaucaaaugacccaacaauuaaauuaauugcaaugcuauacaccccccuaagagcaaauaacgcaggagacgauguauucacaguuuccuguagaguucuaacuagaccaagcccugacuuugauuuuauauuuuuaguaccacccaccgucgaaucaagaacuaaaccauuuucuguaccaguacuuacagucgaagaaaugacuaauucaagauuuccuauaccucuagaaaaauuauuuacaggucccucaucagcauuuguaguccaaccucaaaauggaagauguacuacagacggaguacuccuaggaacuacacaacuaucaccaguuaacaucuguacauucagaggagauguaacacauauaacagguucacgaaauuauacuaugaaccuagcaucacaaaauuggagcaauuacgacccaacagaagaaauuccagcuccacuaggaacaccagacuuugucggaaaaauacaagguguauuaacacaaacaacccgaacagacggaagcacucgaggacacaaagccacaguauacacaggaucagcagauuuugcuccaaaauuaggaagaguacaauuugaaacagauacagaucgagauuucgaagcuaaucaaaacacuaaauucacacccguagguguaauacaagacggaaguacaacccacagaaacgagccacaacaauggguacuaccaucauauucagguagaaauacaccaaacguacaucuugcuccagcuguagcuccaacuuuccccggagaacaauuacuauuuuuuagauccacaaugccuggcuguucaggauauccaaacauggaccuagacugccuuuuaccacaagaauggguacaauauuuuuaucaagaagcagcuccagcacaaucagauguagccuuacuccgcuuugucaacccugauacaggaagaguacuauucgaauguaaauuacacaaaucuggauacguaacaguugcacacacaggacaacacgacuuagucauaccaccaaacggcuauuuccgauucgauuccuggguaaaucaauuuuauaccuuagcaccaaugggaaauggaacugguagacgaagagcacuauaa

SEQ ID NO: 33081 - RNA, 1623 nt, Artificial Sequence
  derived and/or modified sequence opt6 from major_capsid_protein__Norovirus__AIL49843
augaaaauggccuccucugacgccaacccauccgauggaucagccgcuaauuuaguaccagaagucaacaacgaaguaauggcauuagaaccauuugucggagcagcaauagcagcacccguugcaggacaacaaaauguaauugauccuuggauaagaaauaacuuuguucaagccccuggaggagaauuuacaguuucaccaagaaaugcuccaggcgaaauuuuaugguccgcaccucuagggcccgauuuaaacccauaucuaagucacuuagccagaauguauaacggauacgccggaggcuucgaaguacaaguaauccuagcaggcaacgcauuuacagcuggcaaaguaaucuuugcugcaguaccaccaaauuuuccaacagaaggauuaucaccaucacaaguaacaauguucccucauauaguaguugacguaagacaauuagaaccaguucucauaccauuaccagacguaagaaauaauuuuuaucacuauaaucagucaaaugacccaacaauaaaacuuaucgcaaugcuuuauacaccacuaagagcaaacaaugcaggugacgauguuuuuacaguaucaugucguguacuaacuagaccuucaccagauuuugauuuuauauuuuuagucccacccacaguagaaucucgaacuaaaccauuuucaguaccaguccuaacaguagaagaaaugacaaauucaagauuucccaucccuuuagaaaaacuauucaccgguccauccucugcauucguuguacaaccacaaaacgguagauguacaacagacggaguacuacuagguacaacucaacuaucaccaguaaauauaugcacauuuagaggugauguaacacauauuacaggaaguagaaauuauacaaugaaccuagcaucacaaaacuggaacaacuacgaucuaacagaagaaaucccagcaccacuugguacaccugauuuuguagguaaaauucaaggcguccuaacacaaacaacuagaacagacggaaguacucguggacacaaagcaacaguauauacagguucagcagauuuugcucccaaauuaggaagaguacaauucgaaacugacaccgaucacgauuuugaagcaaaucaaaauacaaaauuuacaccagucggaguaauacaagauggcggaacuacccaucgaucggaaccacaacaauggguucuuccaucauacuccggacgaaauacaccaaauguacaucuagcaccugccguagccccaacuuucccuggagaacagcuacucuucuucagaucaacgaugccuggaugcucaggauauccuaauauggaucuagauugccucuuaccccaagaauggguacaauacuucuaucaagaagcagcaccagcacaaucagauguagcacuacuaagauuuguaaacccugacacaggaagaguacuuuuugaguguaaauuacacaaaucuggauauguuacagucgcacacacaggucaacacgaucuaguaauaccuccaaauggauauuuucguuuugauagcuggguaaaccaauuuuacacucuagcaccaaugggaaacggcacaggaagaagaagagcauuauaa

SEQ ID NO: 33082 - RNA, 1623 nt, Artificial Sequence
  derived and/or modified sequence opt6 from major_capsid_protein__Norovirus__AIV99914
augaaaauggcuuccucagaugcaaauccaagcgacggauccgcagcaaauuugguaccagaaguaaacaacgaaguaauggccuuagaaccagucgucggagcagcuauagcugcaccaguagccggacaacaaaacguaauagacccauggauaagaaauaauuucguacaagcaccagguggagaauuuacaguaucaccuagaaaugcaccuggagaaauauuaugguccgcaccacuaggaccagaucucaacccauauuuaucacauuuagcaagaacauacaacgguuaugcugguggauucgaagugcaagucauucuagcuggaaacgcauucacagcaggaaaaguaauuuucgcagcaguaccaccaaauuucccaaccgaaggacuuucacccucacaaguaacaauguuuccacauauaguaguugacgcaagacaacucgaaccaguacuaauaccacuuccagaugucagaaacaauuuuuaucacuacaaucaaagcaaugauccuaccauuaaauuaauagcaaugcucuauacuccacucagagcuaauaacgccggugacgauguauuuaccgucucauguagaguacuaacaagaccuagcccagacuucgacuuuauauucuuaguaccccccacagucgaaucuagaacaaaacccuucuccguaccaguacugaccguagaagaaaugacaaauucaagauuuccaauaccauuagaaaaacuauucacaggaccaucaucagcauucguaguacaaccgcaaaacagccgauguacaacagacggcguuuuauuaggaacaacucaacuuuccccuguaaauauaugcacauuucgaggugauguuacccauaucacaggcuccagaaauuacacaaugaaucuugcuucacaaaacuggaacaauuaugauccaacagaagaaaucccuguaccccuaggaaccccagacuuugucggaaaaauacaaggaguauuaacacaaaccacaagaacugacggaucuacacgaggacauaaagcaacuguauauacagguucugccgauuuugcaccaaaauuaggaagaguccaauucgaaacagacacagaucacgacuucgaagccaaucaaaauacaaaauuuacaccaguuggaguuauacaagauggaggaacaacacauagaaacgaaccacaacaauggguucuaccaucauauucaggacgcaauacccauaauguacaucuagcaccagccguagcaccaacauuuccaggagaacaauuauuauucuuuagaucuacaaugccaggauguagcgguuauccaaauauggaucuagauuguuuacuaccacaagaauggguacaauauuucuaucaaggugcagcaccagcucaaucagauguagcacuacuuagauuuguuaauccagacacuggaagaguauuauucgaaugcaaacuacauaaaucuggauacguaacuguagcucacacaggucaacacgauuuaguaauaccuccuaauggauauuuuagauucgacucuuggguaaaucaauucuauacauuagcuccaaugggaaacggaaccgguagacgaagagcuguauaa

SEQ ID NO: 33083 - RNA, 1635 nt, Artificial Sequence
  derived and/or modified sequence opt6 from major_capsid_protein__Norovirus__AJP13619
auggcaucuaaagacgcaccacaauccgcagacggcgcaagcggagcaggacaacuaguaccagaaguaaauaccgcugauccacuaccaauggaaccaguugccggaccaacaaccgcaguagcaacagcuggacaaguaaauaugauagauccauggauaguaaacaauuucguacaaucuccacaaggagaauucacaauauccccaaacaauacacccggagauauacuuuuugaccuacaauuagguccucacuuaaauccauucuuaucacauuuaucacaaauguacaacggauggguaggaaauaugagaguaagaauauuacuagcuggcaaugcuuucuccgcuggaaaaauaauaguaugcuguguuccuccaggauucacauccaguucccucacaauagcacaagccacuuuauuuccccaugucauagccgacguuagaacauuagaaccuauagaaaugccacuugaagauguaagaaacguauuauaucauacuaaugauaaccaaccaacuaugcguuuaguauguauguuauauacaccuuuacguacagguggaggaucaggaaauucagauucuuuuguaguagcaggaagaguauuaacagccccuucaucagacuucuccuucuuauuuuuagucccgcccacuauagaacaaaaaacuagagcauuuacaguaccaaacauaccauuacaaacauuaucuaacaguagauuuccuucacucauacaagguaugauacuauccccagaugccucacaaguaguacaauuccaaaacggacguugccuaauagauggucaauuauuaggaacaacaccagcgacuuccggacaacuauuucgaguaagaggcaaaauaaaccaaggagcaagaacauuaaauuuaaccgaaguagaugguaaaccuuucauggcauuugauucgcccgcaccagucggauuucccgauuucgguaaaugcgauuggcauaugagaaucagcaaaacuccuaauaacaccucauccggagacccaaugagauccguuucuguacaaacaaacguucaaggauucguaccccaccuaggaagcauacaauuugaugaaguauuuaaccauccuacaggagacuacauuggaacaauagaauggauaucacaaccaucaacuccacccggaacagauauuaaucucugggaaauaccugauuacggaagcucacuaucacaagcagcuaaccucgcaccaccaguauuuccuccuggauuuggagaagcacuaguauauuuuguaucagcauuuccaggaccaaauaauagauccgcaccaaaugauguaccauguuuacuaccacaagaauauauaacacauuuuguaagugaacaagcaccuacuaugggugaugcagccuuauuacauuacguagauccugacacaaaccgaaacuuaggagaauuuaaacuauauccaggaggauaucuuacuuguguaccaaauggaguaggugcuggaccacaacaacuaccuuuaaauggaguauucuuauuuguaucauggguaucucgauucuaccaauuaaaaccaguagguacagcuucaacagcaagaggccgacucggaguaagaagaaucuaa

SEQ ID NO: 33084 - RNA, 1632 nt, Artificial Sequence
  derived and/or modified sequence opt6 from major_capsid_protein__Norovirus__AJP13620
auggcuuccaaagacgcucccacaaauauggauggaaccucaggugcuggacaacuaguaccagaagcaaauacagcagaaccaauaucaauggaaccaguagcuggcgcagucacagcagcagcaacagccggccaagucaauaugauagacccauggauaaugaauaauuauguacaagcaccacaaggagaauuuacuauaagcccaaauaauacaccuggagauauacuauuugacuuacaauuaggaccacaccuaaauccauucuuaucacaucuagcucaaauguauaacggauggguuggaaacaugaaaguaagaguucuacuagcaggaaacgcuuuuacagcaggaaaaauaauuauuuccugcaucccacccggauucguugcacagaacauaucuauagcucaagccacaauguucccacaugucauagcagauguaagaguucuagaaccaauagaaguaccacuagaagauguaagaaauguauuauuucauaauaaugauaauacaccaacaaugagauuaguauguauauuauacacaccauuacgagcaucaggaucaucuucagguacugauccauucguuauagcaggucgaguauuaaccugucccucaccagacuuuucauuuuuauuucuaguacccccaaauguagaacaaaaaacuaaaccauucucaguaccuaaucucccuuuaaacacacuaucaaauucaagagucccaucccuuauaaaaagcaugaugguaucuagagaucacggccaaaugguucaauuucaaaauggaagaguuacacuagauggacaacuucaagguacaacgccaacaucugcaucacaacuauguaaaauaagaggaucaguauuucaugcaaauggaggaaacgguuauaauuuaaccgaacuugacggaucaccauaccacgcauucgaauccccagcaccaauuggauuuccagaccuaggugaaugcgacuggcacauggaagcuuccccaacaacucaauuuaauacuggggacguuaucaaacaaauaaauguuaaacaagaaucagcauuugcaccacaucuaggaacaauucaagcugauggacuuucugacguaaguguuaauacaaauaugauagcuaaacuggguugggucucuccuguaucagacggacauaaaagagauguagauccauggguuauaccaagauacggaucaacacuuacagaagcagcacaacuugcaccacccauauacccuccaggauuuggagaagcaauaguauuuuuuaugucugacuucccaauagcacacggcacaaauggacuaucagucccaugcacaaucccacaagaauucguaacucauuucguaaaugaacaagcccccacaagaggagaagcagcucuacuccacuaucucgauccagauacacauagaaacuuaggagaauuuaaacuauauccagacggauuuaugacaugcguaccuaauacuucaggaaccggaccucaaacauuaccuauuaauggaguauuuguauuugucucuuggguaucaagauuuuaccaacuaaaaccuguaggaacugcaggcccagcaagaagauuaggaauacgaagaucguaa

SEQ ID NO: 33085 - RNA, 1647 nt, Artificial Sequence
  derived and/or modified sequence opt6 from major_capsid_protein__Norovirus__AJP13621
augaaaauggcaucaaaugaugccgcuccaucuaaugacggagcagccggucuaguaccagaaauaaauaaugaagcuauggcacuugaaccagucgccggagcagccauagcagcaccucuaacaggccaacaaaauauuauagauccauggauaaugaacaauuucguacaagccccagguggcgaguucacuguauccccccgaaacucucccggugaaguuuuauuaaaucuugaacuugggccugaaauaaauccauauuuagcacaucuagcucgaauguacaacggauaugcaggaggguuugaaguucaagugguauuagcaggaaacgcauucacugccggaaagaucauauucgcagcaauaccaccaaauuuuccaauagauaacuuaucugcagcacaaauaacaaugugcccacauguaauuguagacgucagacaauuagaaccuguaaaucuacccaugccagauguaagaaacaauuuuuuccauuacaaucaaggaucagacucuagauuaagacuuauugcuaugcuauauacaccauuaagagccaauaauucaggcgacgacguauuuacaguaucuuguagaguauuaaccagaccuucaccagauuuuucauucaauuucuuaguuccuccgacaguagaauccaaaaccaaaccauuuucauuaccaauacuaacuauaucagaaaugucaaacucaagauucccaguaccaauagauucuuuacauacaaguccaacagaaaacauaguaguucaaugucaaaauggaagagucacacuagacggagaauuaaugggaacaacacaacuauuaccaucccaaauaugcacauuuagaggaguccuaaccagaucaacaucucgagcaucagaccaagcugacacagcaacaccaagauuauucaacuauuauuggcacauucaauuagacaaccuuaauggaacaccauacgauccugcagaagauauacccggcccacuugguacuccagauuuuagaggaaaaguauuuggaguugcaucacaaagaaacccugauucuacaacaagagcacacgaagcaaaaauugauacaacaucagguagauuuacaccaaaacuaggaucccuagaaauaucaacagaaucugaugauuuugaccaaaauaaaccaacucgauucacaccaguagguauagguguagaucaugaagcugauuuucaacaaugggcauuaccugacuacgccggacaauuuacacauaauaugaaccuugcaccugcuguugcuccuaacuucccaggagaacaacuacuauuuuucagaucacaauuaccauccuccggaggaagaucuaacgguauccuagauugccuagucccacaagaauggguucaacacuuuuaucaagaaucagcaccuucccaaucacaaguagcuuuaguccgauauauaaauccagacacaggaagaguucuauucgaagcuaaauuacauaaauuaggcuuuauaacaauagcaaaaaacggagauucuccaauuaccgucccaccuaacgguuacuuucgcuuugaaucaugggucaauccauuuuacacauuagcuccuauggggacaggcaacggaagacgcagaauacaauaa

SEQ ID NO: 33086 - RNA, 1653 nt, Artificial Sequence
  derived and/or modified sequence opt6 from major_capsid_protein__Norovirus__AJP13622
augaaaauggcaaguaacgaugccgcaccuucaaaugacggagcugcaaaucuaguccccgaagcaaauaaugaaguaauggcucucgaaccaguaguaggagcaucuaucgcagcaccugucgucggccaacaaaacauuauagacccauggauacgagaaaauuuuguacaagcaccccaaggcgaauuuaccguuucaccaagaaauaguccaggagaaaugcuacuaaaucucgaauuaggaccagaacuaaacccauaucuaucucaccuaucaagaauguauaacggauaugcuggaggaaugcaaguacaaguaguuuuagcaggaaaugcauuuacagcuggaaaaaucauauuugcagcaguuccaccucacuuuccuguugacaacauuuccgcagcucaaauaacaauguguccacacguaauaguagauguaagacaacuagaaccaguacuacuaccccuacccgauauccgaaaucgauucuuucacuauaaucaagaaaauacaccaagaaugagauuaguagcaaugcuuuauacacccuuaagagcaaacucaggagaagacguauucacaguaucuugcagaguucuaaccagaccagcuccagauuucgaauucacauuucuaguacccccaacagucgaaucaaaaacaaaaccauucacccuaccaauacucacauuaggugaauuauccaauucacgauucccagcagcaauagacaugcuauacacugacccaaaugaaagcauaguaguucaaccacaaaacggcagaugcacacuagaugguacacuccagggaacgacacaacuaguacccacucaaauaugugcauuuagaggcacacuaauaucacaaacagcaagagcagcagauuccacugacucaccccaacgagcacgcgaucacccauuacauguucaaguaaaaaacuuagacggaacacaauacgacccaacagaugauauaccagcaguucuaggcgccauugacuucaaaggaacuguauucggaguugcaucucaacgagauguaucaggaacucaagaacaaggacacuaugcuaccagagcucacgaagcucacauagauacaacagacccaaaauacgccccgaaauuaggaacaauacuaauaaaauccgaaagcacagacuuuacaacaaaucaaccuauaagauuuacucccgucggaaugggggacaacaauuggagacaaugggaauugccagacuauucuggaagauuaacauuaaacaugaaucuagccccagcagucucaccaaguuuucccggagaaaggauacuauucuucagaucaauaguaccaucagcaggaggauuuggaucaggauauaucgauuguuuaauaccgcaagaauggguacaacacuucuaucaagaagcagcaccaucacaauccgcaguagcauuaguuagauacgucaacccagacacaggaaggaauauauuugaagcaaaacuacaucgagaaggauuuuuaacaguagcaaacucuggaaacaacccaauuguaguuccuccaaauggauauuucagguuugaagcauggguaaaccaauucuacacccucgcaccaaugggauccggacaaggcagacgaagagcacaauaa

SEQ ID NO: 33087 - RNA, 1614 nt, Artificial Sequence
  derived and/or modified sequence opt6 from major_capsid_protein__Norovirus__AJP13623
augaaaauggcaucaaacgacgcugcaccaucaaacgacggagcagcaggauuaguacccgaaguaaacaacgaaaccauggcauuagaaccaguagccggagcuucaauagcagccccacuaacaggacaaaauaauguaauagacccuuggauacgauuaaacuucguacaagcccccaauggagaauuuacaguaagcccuagaaacucucccggugaaguauuacuaaaucuagaacuaggaccagaacuaaauccauauuuagcacacuuauccagaauguacaacggauaugcaggaggcguagaaguucaaguauuauuagcgggaaaugcauucacagcggguaaacuaguauuugcagcaguaccuccacauuucccauuagaaaauauaagcccaggccaaaucacaauguucccucauguaaucauagauguaagaacucuagaaccaguauuacuacccuuaccagacguaagaaauaacuuuuuccauuauaaccaacaaaacgaaccuagaaugagauuaguugccaugcuuuauacaccacuucgaucaaacggcucaggagaugacguauucacaguauccuguagagugcuaaccaggccuucacccgauuuugauuuuaauuaucuaguaccaccaacuguagaaucaaaaacaaaaccauuuacacuaccaauauuaaccauaggagaacuaacaaacaguagauuuccagucccaauagaugaauuauauaccagcccaaaugaaucacuaguaguacagccacaaaauggacgaugcgcauuagauggugaacuccaaggaacaacacaauuauuaccaaccgcaauuuguucauuuagagguagaaucaaucaaaaagucucuggcgauaaccauguauggaauaugcaagucaccaauauaaacggaacaccuuuugacccaacagaagacguuccagcaccacuaggaacacccgauuucuccggcaaauuauuuggaguauuaucucaacgagaccaugacaaugcaugucgaucucacgaugcuguaauagccacugauagcgcaaaauuuacaccuaaauuaggagcuauacaaauuggcacaugggaagaagaugacguccauauaaaucaaccuacaaaauuuacaccaguaggauuauuugaaagagagggauucaaucaauggacauuaccaaauuauucaggugcuuuaacacuaaauaugggauuagcuccaccuguagcaccaacauuuccaggugaacaaauacuauuuuucagaucacacauaccacucaaaggaggaguagcagaccccguaauagauugucuauuaccacaagaauggauacaacacuuauaccaagaaucagccccgucccaaacugacguagcacuaauucgauucacaaaccccgacacuggccgaguauuauucgaagcaaaauuacauagaucaggauauaucacaguagcaaacacuggcucaagaccuauaguuguaccagcaaacggauacuucagauucgacucauggguaaaccaauucuacucccucgccccaaugggcacagguaauggaagacgaagaguucaaaaaggauaa

SEQ ID NO: 33088 - RNA, 1623 nt, Artificial Sequence
  derived and/or modified sequence opt6 from major_capsid_protein__Norovirus__AJW67354
augaugauggcaucaaaagaugcacccacaucucccgauggagcuucaggugcaggucaacuuguaccugaagcuaauaccgcagaacaaauuucaauggauccaguagcaggagcuucuaccgcaguagcaaccgcaggacaaguaaauaugauagauccauggauauuuaauaacuuuguucaagcaccgcaaggcgaauuuacaauaucuccuaauaacacaccuggagauauauuauucgacuuacaacuaggaccacacuuaaacccuuuccuugcucaccuuagccaaauguacaacggauggguugguaauaugagaguaagaauauuacuagcaggaaacgcuuucaccgcagguaagauaauaaucugcuguguuccaccaggauuugaugcacgaauauuaacaauagcucaagcaacauuauucccacauuuaauugcagacguacgaacucuagaaccgguugaacuuccauuagaagauguaagaaacguacuauaccauaauuccucacaaccacaacccacaaugcgauuaguugcuauguuauauacuccacucagaacaggcggaggaucuggagguacagaugccuuuguuguagcaggaagaguuuuaacuugcccagcuccagacuuuucauucuuauuccuaguuccaccaucaguagaacaaaaaacacgaguauuuucugucccaaauauaccacucaaagauuuaucuaauucaagaguacccguaccuguacaaggaauguucguauccccagauguaaaucaaucaguacaauuucaaaacggaagaugucaaauagauggucaacuacaaggaacaacaccaguuucauuaucccaauuaugcaaaauaagaggaaaaacaucaucaaaugcacgaguauuaaauuuauccgaaguugaugguacacccuuuauaccauuagaaucucccgcacccguugguuuuccugaucuuggagguugugauuggcauguaaacuucacauuucaaacucaagacagagauccaucccaaucaguaacauuugcaacaaaugaugcaucauuuguaccuuauuuagguucuguaagcccacauaauggagaagguuuucaagcuggcgacauuauaggaucucuuggauggauauccgcuccuagcgauaacucacaauucaacguaugggcaauaccgaaauacggaucuucauuaccagacgucacacaucuugcaccugcaguauuuccaccaggcuuuggugaaguaauauuauacuuuuauucaacauuuccuggaucaggacaaccaucacaacuacaagucccuuguuuauuaccccaagaauuuauaacacacuuuuguaaugaacaagcaccaauugcaggagaagcagcacuacuacauuaugucgacccagacaccggcagaaacuuaggagaauuuaagcuauacccagaugguuuuaugacauguguacccaauuccguaucauccggaccacaaacccuaccuauaaauggaguauuugucuuuguaucuuggguaucacgauuuuaccaacuaaaaccuguagguacagcaucugcugcacgacgacuaggucuacguagaauauaa

SEQ ID NO: 33089 - RNA, 1644 nt, Artificial Sequence
  derived and/or modified sequence opt6 from major_capsid_protein__Norovirus__AJW67357
augaaaauggcaucaaaugacgccgcaccuucaaaugacggagcagcaaauuuaguaccagaagccacaaacgaaguaauggcacuagaaccuguaguaggagcaucaauugcagcaccagucguaggacaacaaaacauuauagauccauggauaagagaaaauuuugugcaagcuccacaaggugaauucacaguuucaccuagaaauucaccaggagaaauguuacuaaauuuagaauuaggaccugaacucaacccauaccuaucacauuugagccgaauguauaauggauaugccggaggaaugcaaguacaaguaguauuagcagguaacgcuuuuacagcaggaaaaaucauauuugcagcaguaccaccacacuuuccuguagaaaacauaagugcagcacaaauaacuauguguccacaugucauaguagauguucgucaacuagaaccuguacuauuaccacuaccagauauacgaaauagauuuuuccauuauaaucaagaaaauacaccccgaaugagacuaguagcuaugcuauauacucccuuaagagcaaauucaggagaagauguauucacuguaucaugcagaguuuuaacuagaccugcaccagacuuugaauuuaccuuucuaguaccaccaacaguugaaucuaaaacaaaaccauuuacacuaccaauacuaacauuaggagaacuauccaauucuagauuuccagcaccuauagauaugcuauauacagaucccaaugaagccauaguuguacaaccacaaaacggacgcugcacauuagaugguacauuacaaggaacaacucaacucguaccaacacaaauauguuccuucagaggaacacuaauuucacaaaccucacgaucagcagacaguacagauucagcuccacgcguccgcaaucauccacuacauguacaacucaaaaauuuagauggcacaccuuaugauccaacugaugaaguucccgcugucuuaggagcaauagauuuuaaaggaaccguauuuggcguagcaucucaacgaaauacaacaggcaacucaauaggagcaacccgagcacaugaaguucauauagacacaacuaauccacgauauacaccuaaacuuggcuccguucuaauguauucagaaucgucagauuucgacgauggacaaccaacaagauuuaccccaauaggaaugggcgccgacgauuggcaucaaugggaauuaccagaauauucaggacaucuaacacuuaacaugaaccuagcacccgcugucgcaccagcauuuccaggagaacgaauccuauuuuuucgaucaguaguaccgagcgcaggcggcuacggaucaggacauauagauugcuuaauaccccaagaauggguacaacacuucuaucaagaagcagcaccaucucaaagcgcagucgcccuaaucagauacguaaauccagauaccggaagaaauauauuugaagcaaaacuacacagagaaggauuugucacagucgcaaacuccgguaacaacccaauaguaguaccaccaaaugguuauuuccgcuuugaagcauggguaaaucaauuuuauacacuaacaccaaugggaacaggacaaggacgaagaagaauucaauaa

SEQ ID NO: 33090 - RNA, 1644 nt, Artificial Sequence
  derived and/or modified sequence opt6 from major_capsid_protein__Norovirus__AJW67359
augaaaauggcaucaaaugacgcagcccccucaaaugacggagcagcaaaccuaguacccgaagcaacaaaugaaguuauggccuuagaaccaguuguaggugcaucaauagcagcaccaguaguuggucaacaaaacaucauagacccauggauaagagaaaauuucguacaagcgccacaaggugaauucaccguaagcccaagaaauucuccaggagaaauguuauuaaacuuagaacuagguccugaacucaacccuuacuuaagucaucuauccagaauguauaacggauaugcaggaggaaugcaaguacaaguaguacuagcaggaaaugccuucacugcaggaaaaauuauuuuugcagcaguuccaccacauuuuccaguagaaaacauaagcgcagcacaaauaacaauguguccacacgucauaguagauguuagacaacuagaacccguauuauuaccccuaccugauauucgaaauagauucuuucauuauaaucaagaaaacacacccagaaugcgauuaguagcaaugcuuuauacaccauuaagagcuaacucaggcgaagauguauuuacaguaucauguagagucuuaacacguccugcuccagauuuugaauuuacauucuuaguaccaccaacuguagaaucuaaaacaaaaccauucacacuacccauauuaacauuaggagaacuaucuaacucaagauuccccgcaccuauagauauguuauauacugaucccaacgaagcaauaguaguacaaccacaaaacgguagauguacacuagacggaacauuacaagguacgacacaacuaguaccaacccaaauauguucauuucguggaacauuaauaucacaagcauccagaucagcugacucaacagauagcgcaccccgaguuagaaaucauccacuacacguacaauuaaaaaaucucgauggaacaccauaugacccuacagacgaaguuccagcuguucuuggagcaauagauuuuaaaggaacuguauuugguguagcaucacaaagaaacaccaccggcaacucuauuggcgcuacuagagcacacgaagcucauauagauacaacaaacccgagauacacaccaaaacuaggauccguauuaauguauucggaaucaucugacuucgacgacggacaaccaaccagauucacaccaauagguaugggcgcugacgauuggcaucaaugggaauuaccagaauauucuggacacuuaacuuuaaauaugaacuuagccccagcaguugccccagcauuuccaggagaaagaauauuauuuuuccgaucaguaguaccaucugcuggaggauacggaucaggucauauagacugucuaauaccucaagaauggguucagcauuucuaucaagaagcagcucccucacaaucugcuguugcacuaauaagauauguuaacccagacaccggaagaaauauuuucgaagcaaaauuacauagagaaggauuuauuaccguagccaauucaggaaauaauccaauaguaguaccaccaaauggauauuuucgauuugaagcaugggucaaccaauuuuauacuuuaacaccgaugggaacaggucaaggaagacgaagaguucaauaa

SEQ ID NO: 33091 - RNA, 1644 nt, Artificial Sequence
  derived and/or modified sequence opt6 from major_capsid_protein__Norovirus__AJW67362
augaaaauggcaucaaacgacgccgcuccaucaaaugauggagcagccaauuuaguaccagaagcaacuaacgaaguaauggcacucgaacccguugucggagccuccauagcagcaccuguugucggacaacaaaacauaauagacccauggauacgagaaaauuuuguacaagcaccccaaggcgaauucaccguaucaccccguaauucuccaggagaaaugcuuuuaaacuuagaacucggacccgaauuaaauccuuauuuaucacauuuaucaagaauguauaauggauaugccgguggaaugcaaguacaaguaguucucgccggaaaugccuucacugcagguaaaauuauauuugccgcaguaccaccacauuuucccguagaaaauauauccgcagcacaaauaaccaugugcccacauguaauuguagacguuagacaacucgaaccaguacuucuaccacuaccagauauuagaaauagauuuuuccauuauaaccaggaaaauacaccaagaaugagacuuguagccaugcuauauacaccauuaagagccaauucaggagaagacguauucacaguauccuguagaguacuaacaagaccagcaccagauuucgaauucacuuuuuuaguuccaccaacaguagaaucaaaaacuaaaccauucacacuaccaauacuaacauuaggugaauuaucaaauucaagauuuccagcaccaauagacaugcuuuauacagauccaaaugaagcuaucguaguacaaccccaaaauggcagaugcacucucgaugguacucuacaaggaacuacacaacuaguaccuacucagauuuguucauucagaggaacacuaauaucccaaaccucaagaucagccgacucuacagauucagcaccuagaguaagaaaccauccacuucacguacaauuaaaaaaccuagacggaacaccauaugacccaacagaugaaguaccugcuguauuaggagcuauugacuucaaaggaacaguauuuggaguagcuagccaaagaaauaccaccggaaacucaauaggagcaacacgagcacacgaaguacauauagauaccacuaauccuagauacacacccaaacuuggaucaguauuaauguacagugaauccacagacuucgacgauggacaaccaacuagauuuacaccaauaggaaugggagcagaugacuggcaucaaugggagcuaccagaauacucaggacaccuaacacuuaauaugaacuuagccccagccguagcaccagcauuccccggagaacguauacuauucuuuagaagugucguaccauccgcaggugguuaugguucaggacauauagauugucuaauuccccaagaauggguucaacauuuuuaucaagaagcagcaccaucacaauccgcaguugcauuaauccgauacguaaacccagacaccggaagaaauauauucgaagcaaaacuucaucgagaaggauuuauaacaguagcaaauucagguaacaacccaauaguuguaccuccaaauggauauuucagauuugaagcauggguaaaucaauuuuacacccuaacuccaaugggcacaggccaaggacguagacgaguacaauaa

SEQ ID NO: 33092 - RNA, 1617 nt, Artificial Sequence
  derived and/or modified sequence opt6 from major_capsid_protein__Norovirus__AJW67368
auggcaaguaaugacgcaacaccaucaaacgauggagccgcaggguuaguaccagaauccaacaaugaagcuauggcauuagaaccaguuguaggugcauccuuagcagcacccguaacaggacaaacuaauauuauugacccauggauaagaacaaauuuuguacaagcaccaaacggagaauucacaguaucuccuagaaacucaccuggagagauauuaguaaaucuggaacuugguccagaacuaaaucccuaucuugcacacuuagcaagaauguauaauggauacgcaggaggaauggaaguacaagucauguuagcagguaacgcauucacagcuggcaaaauaauauucgcagcaguaccacccuauuuuccuguagaaaauuuaucuccaagucaaauuacaauguucccacacguaauaauagacguaagaacucuagaaccaguccuacuaccaaugcccgauguaagaucuacacuauuccacuucaaucaaaaagaugaaccuaaaaugcgccuagucgcaauguuauacacuccauuaagaaguaacggaucaggagaugacguauuuacaguaucuugucgaauccuuacacguccaucuccugaauuugauuuuacauauuuaguaccacccacuguugaaucuaaaacaaaaccauuuacccuaccaguccuuacuuuaggagaauuaucaaacucuagauuuccauuaucaauagacgaaaugguaacaucucccaaugaauccauaguaguacaaccacaaaauggaagaguuacacuagacggagaauuacuaggcacaacucaauuacaagcuuguaauauaugcucaauaagagguaaaguuacaggucaaguaccaaaugaacaacauauguggaaucucgaaaucacuaauuuaaauggaacacaauucgaucccacagaugauguaccagccccuuuaggaguacccgauuuugcaggagaaguauucggaguuuuaucccaaagaaaucgaggcgaauccaacccugcuaacagagcacacgaugcaguuguagcuaccuauagcgauaaauauaccccuaaacuuggacuaguacaaauagguacauggaacaccaaugauguagaaaaccaaccaacaaaauuuacuccuauaggacucaaugaaguagcaaacggacauagauucgaacaauggacacuuccccgauauuccggagcucuaacuuuaaauaugaauuuagcccccgcagucgcuccguuauuucccggugaacgacuauuauucuuucguucauauguaccauuaaaaggagguuuuggaaauccagcaauugauugcuuagucccacaagaauggguacaacauuucuaccaagaaucagcacccuccuuaggagauguugcacuaguaagauacguaaauccagauacaggacgagucuuauucgaagcaaaauuacauaaaggaggauuucuuacaguaucuagcacaagcacaggaccaguaguaguacccgcaaauggauauuuucguuuugauucauggguaaaucaauuuuacucacucgcaccuaugggaacaggaaauggcagaagaagauuucaauaa

SEQ ID NO: 33093 - RNA, 1617 nt, Artificial Sequence
  derived and/or modified sequence opt6 from major_capsid_protein__Norovirus__AJW67371
auggcauccaacgaugccacaccaucuaaugacggagcagcuggauuagucccagaaucaaauaaugaagcaauggcacuagaaccagucguaggagccucacuagcagcaccaguaacaggacaaacaaacauaauagacccauggauaagaacaaacuuuguucaggcaccaaacggagaauuuacaguaucaccaagaaauucacccggcgaaauauuagucaauuuagaacuaggucccgaauuaaaucccuaucucgcucaucuugccagaauguauaaugguuaugcuggaggaauggaaguacaaguaaugcucgcagguaaugcguuuaccgccggaaaaaucauauucgcagcaguaccaccuuauuuccccgucgaaaacuuaucucccucucaaauaacaauguuuccacacguuauaauagauguacgcacccucgaaccagucuuauuaccaaugcccgauguuagaucaacacuauuccacuuuaaccaaaaagaugaaccaaaaaugagauuaguagcaaugcuuuacaccccacuacgaucaaauggaucaggugacgacguauuuacagucucuuguagaauauuaaccagaccuucacccgaauuugauuuuaccuacuuaguuccaccaacaguagaaucaaaaacaaaaccauuuacucuaccaguauuaacacucggagaauugucuaauucaagauuuccacuaucaaucgaugaaaugguuacaagucccaaugaaucaauugucguucaaccacaaaacggacgcguaacccuagauggugaacuuuuaggcacaacacaauuacaagccugcaacaucuguucuauaagaggaaaaguaacaggacaaguuccaaacgaacaacauauguggaaucuagaaauaacuaaucuaaacggaacacaauuugauccuacagacgacguaccugcaccguuagguguaccugauuuugcuggagaaguauucggcguauuaucucaaagaaauagaggugaaucuaacccagcaaaccgagcacaugacgccguaguagcaaccuauucagauaaauacacaccaaaacuuggacuaguacaaauuggaacauggaacacuaaugauguagaaaaucaaccuacaaaauuuacacccauaggucuaaaugaaguagcuaauggucaucgauucgaacaauggacucuaccaagauauagcggugcauuaacauuaaacaugaauuuagcuccagcuguugcuccacuauuuccaggagaaagacuauuauucuuuagauccuauguaccauuaaaaggaggauuuggcaauccugcaaucgauugcuuaguaccacaagaauggguacaacauuuuuaucaagaaagugcucccuccuuaggugacguagcccuaguuagauaugucaacccagacacaggaagaguucuauuugaggcaaaauuacauaaaggcggauucuuaacagucaguucaaccucaacaggcccaguugucgucccugcaaauggauauuuuagauucgauucauggguaaaccaauucuacucacuugcaccaauggguacaggaaauggacgaagacguuuccaauaa

SEQ ID NO: 33094 - RNA, 1623 nt, Artificial Sequence
  derived and/or modified sequence opt6 from major_capsid_protein__Norovirus__AJW67374
auggccucaaacgacgccgccccgucuaacgauggcgccgccucauuagucccagaagcaauaaaugaaaccaugccccuagaaccaguagcaggagcaagcauagccgcaccaguagcaggacaaacaaacauaauagacccauggauaagaacaaacuuuguacaagcuccaaacggagaauucacaguuucaccacgaaacucacccggagaaauacuacuuaaccuagaacucggaccugaucuaaacccauaucucgcacauuuaucaagaauguauaacggauacgcuggaggcguagaaguccaagucuuauuagcaggaaacgcauucacagcaggaaaaauuuuauucgcagcaaucccucccaacuucccaguugauaugauaucuccugcacaaauaacaauguuaccacauuuaauaguagauguaagaacauuagaacccauuaugaucccccuuccagacguaagaaacguauucuaucauuucaacaaccaaccacaaccaagaaugagacuaguagcaaugcuauacacaccauuacgcucaaauggaucaggcgaugauguauuuacaguauccugucgaguucuaacaagaccuacaccagacuuugaauuuauauaccucgucccaccaucaguagaauccaaaacuaaaccauuuacacucccaauucugacaauaagugaacuaaccaacucacguuucccaauacccauugaacaacuauauacagcuccaaaugaaaauaaugucguacaaugucaaaacggacgaugcacacuugacggcgaauuacaagguaccacacaauuacuaucaucagcaguauguucauauagaggucgaaccguagcaaacaguggagauaacugggaccaaaauuuacuacaacuuacuuaucccucgggugcaucauacgauccaacagacgaaguaccagcaccauuaggaacacaagacuuuuccgguauauuauacggaguacuaacucaagacaauguuuccgaaggaacaggugaagcaaaaaacgccaagggaguauacauuuccacaacuuccggacgauucacaccaaaaauagguacaauaggauuacauucaauaacagaaaauguacacccaaaccaacaaucacgauucacaccaguaggagucgcacaaaacgaaaauacuccuuuucaacaauggguccuaccacacuaugcaggagcauuagcauuaaauacaaacuuagcaccagcaguagcacccacauuuccaggcgaacaauuauuauucuucagaucuagagucccaugcguacaaggauuaagaggacaagacgcauucauagacugccuccuaccucaagaauggguaaaccauuucuaccaagaagcagcuccaucucaagcugacguagcauuaauacgauacgucaauccagacacuggaagaacacuuuuugaagcaaaacuccauagaucaggauuuauaacuguaucacacacagguaacuacccucuaguugucccaccaaauggacauuuuagauucgacucauggguaaaccaauucuauucacuagcaccaaugggaacaggaaacggcagaagacgaguacaauaa

SEQ ID NO: 33095 - RNA, 1635 nt, Artificial Sequence
  derived and/or modified sequence opt6 from major_capsid_protein__Norovirus__AJW67377
augaugauggccucaaaagaugccacaccauccgcagacggagcaaccggagcuggacaacuaguaccugaaguaaauacugcagauccaaucccuauugauccaguagcuggaucaucuacagcauuagcaaccgcaggccaaguaaaucuaauagauccauggauaauaaauaauuuuguccaagcaccacaaggagaauuuacaauaucacccaauaauacacccggagauguacuauuugaucuacaauuaggaccacauuuaaauccauucuuaucccaucuaucucaaauguauaacggauggguaggaaauaugagagucagaguaguauuagcuggaaaugcuuuuacagcaggaaaagucauaauauguuguguaccaccaggcuuccaaucaagaaccuuaucuauugcacaagcaacauuauucccucauguaauagcugauguacgaacuuuagacccaguagaaguaccauuagaagauguaagaaauguuuuauaccacaauaacgauacacaaccaacaaugaggcuacuuuguaugcuuuauacaccacuaaggacagguggagcauccggagguacugauucauuuguaguagccgguagaguuuuaaccuguccuggaccugauuuuaauuuucuauuuuuagucccuccaacagucgaacagaaaacacgaccauuuacaguuccaaauauuccacuaaaauauuuaucaaacucacgaauaccuaauccaauugaaggaaugucucuaagccccgaucaaacacaaaauguacaauuccaaaauggacgauguacuauugacggucaaccucuaggaaccacaccagucucuguaucacaauuaugcaaauuuagaggacgaauuacaucaggucaaaaaguuuuaaaucuaacagaauuagauggaucacccuucauggcauucgcugcgccagcaccagcaggcuucccagaccuaggaucaugugauuggcacaucgaaaugucaaaaauuccaaacucaucuacugaaaguaauccaauaguaguaaauucugugaaaccuaauucacagcaauuuguaccacauuuaucaucuauaacacuagaugacaauguaaguucugguggugacuauauaggaacaauacaauggaccucaccacccagugauucaggaggcgcaaauacuaacuuuuggaaaauuccuaacuauggcucaagucuagcagaagcaucucaacuagcaccagcaguauauccacccgguuuuaaugaagucauugucuacuucauggcuucaauaccaggaccaaaccaaucaggaucaccaaauuuagucccaugcuuacuuccucaagaauacauaacucacuuuauaucagaacaagcaccgauacaaggagaagcugcauuacuucacuacguagacccugauacaaacagaaaucuaggagaauucaaauuauaccccgguggguaccuaacauguguaccaaauuccaguuccacaggaccacaacaacuaccacuugaugguguauuuguauuugccucuugggugucacgauuuuaucaauuaaaaccaguaggaacagcuggucccgcgagaggaagacuuggcguaagaagguaa

SEQ ID NO: 33096 - RNA, 1617 nt, Artificial Sequence
  derived and/or modified sequence opt6 from major_capsid_protein__Norovirus__AJX18190
auggccucuaaugaugcaacucccucaaaugauggagcagcuggucucgucccagaauccaacaaugaagcaauggcacuagaaccuguaguuggugcaucauuagcugcaccagucaccggacaaacaaauauaauagauccguggaucagaacuaauuucguacaagcccccaacggcgaauuuaccguuucaccuagaaacucacccggugaaauacuaguaaaucuagaauuagguccagaacuaaauccauaucucgcacauuuagcaagaauguauaauggauacgcaggaggaauggaaguacaagucauguuagcaggaaacgcauucacagcaggaaaaauaauauuugcugcgguaccaccauacuuucccguagaaaaucuaucucccccucaaauuaccauguuuccucacguaaucauagauguacgaacauuagaaccaguucuauuaccaaugcccgacguaagaucaacauuauuucacuuuaaucaaaaagacgaaccuaaaaugagauuaguagcuauguuauacacuccacuaagaucuaaugguuccggugaugacguauuuacaguaucaugccgaauacuaacuagaccaucaccugaauuugauuuuacauaucuaguacccccuaccgucgaauccaaaaccaaaccauucacucuaccaguauuaacauuaggagaacuauccaacucaagauucccuuuaucaauugaugaaaugguuaccuccccaaaugaaucuauaguaguacaaccacaaaauggaagagucacauuagacggagaauuauuaggcacuacacaauuacaagcaugcaauauauguagcauaagaggaaaaguaacaggacaaguuccaaacgaacaacauauguggaaucuagaaauuaccaacuuaaacggcacacaauucgauccaacagacgauguaccagcacccuuagguguuccugacuucgccggagaaguauuuggaguuuuaucacaacgaaauagaggagaaucuaacccagccaauagagcccaugaugcaguaguagcaacauauucugauaaauacacaccaaaacuaggauuaguacaaaucggaacauggaauacaaacgauguugaaaaccaaccaacaaaauuuacaccaauaggacuaaacgaaguagcaaacggacauagauuugaacaauggacucucccuagauacucaggugcuuuaacauuaaauaugaaccuagcacccgcaguagcuccacuauuuccaggcgaaagacuauuauucuuccgaucuuauguaccacuaaaaggaggauucggaaacccagcaauagauugucuuguuccacaagaauggguucaacacuucuaccaagaaucagccccuucauuaggagauguagcacucguaagauauguaaauccagacacagguagaguacuauucgaagcaaaguuacacaaaggugguuuccuaacaguaagcucaacuucuacaggaccaguaguugucccagccaauggauauuucagauuugauucauggguaaaccaauucuacagccuagcaccaaugggcacaggaaacggaagaagaagauuccaauaa

SEQ ID NO: 33097 - RNA, 1617 nt, Artificial Sequence
  derived and/or modified sequence opt6 from major_capsid_protein__Norovirus__AJX18193
auggccucaaaugaugcaacaccauccaaugauggugcugcaggucuaguaccugaaucuaauaaugaagcaauggccuuagaaccaguaguaggagcaucccuagcagcacccguuaccggacaaacaaauauaauagauccauggauaagaacaaauuuuguacaagcaccaaauggagaauuuacagucuccccacguaacucaccaggagaaauauuaguaaaccuugaauuagguccugaacuuaauccauauuuagcacaccuagcaagaauguauaacgguuaugcagggggaauggaaguacaaguaaugcuagccggaaaugcuuuuaccgcaggcaaaauaauuuuugccgcaguaccacccuacuuccccguagaaaaccuaagcccaagccagauaacuauguuuccucacguuauaaucgacguacgaacccuagaaccuguuuuacucccaaugcccgauguaagaucuacuuuauuucacuuuaaucaaaaagaugaaccaaaaaugagauuaguggcuauguuauauacaccacuacgaucaaauggaucgggagaugauguauucacaguauccuguagaauucuaacacguccaucuccagaguuugauuucacauaucuaguaccuccaacaguagaaucaaaaacaaaaccguuuacucuacccguuuuaacauuaggagaauuaucaaauucaagauucccauuaucaaucgaugaaaugguaacaucaccaaaugaaagcauuguaguacaaccucaaaauggaagaguaacuuuagauggcgaacuuuuaggaacaacacaauuacaagcaugcaauauauguuccauaagaggcaaaguaacaggucaaguaccaaaugaacaacacauguggaaucucgaaauaacuaauuuaaacggaacacaauuugauccaacagaugaugugccagcaccauuaggcguaccagacuucgcuggagaagucuuuggaguucucucacaaagaaauagaggugaaucaaacccagcaaauagagcacaugaugcaguaguagcaacuuauucugauaaauauacaccaaaacucggacuaguacaaaucgguacauggaacacuaaugaugucgaaaaucaaccaacaaaauuuacaccuauaggacuaaaugaaguagcaaacggacauagauuugaacaauggacacuuccaagauauucaggagcucuaacacuaaauaugaauuuagcaccagcuguagcaccauuauuuccaggagaacgauuauuauucuuuagaagcuauguaccacuaaaaggaggauuugguaauccagcaauugacugucuuguaccacaagaauggguacaacacuuuuaucaagaauccgcuccaaguuuaggagaugucgcacuaguuagauauguaaauccagauaccggacgcguauuauuugaagcaaaacuacacaaaggugguuucuuaacaguuaguucaacuucaaccggaccuguuguaguacccgcaaauggauacuuuagauucgauuccuggguaaaucaauuuuauaguuuagcaccaaugggaaccggaaauggaagaagaagauuucaauaa

SEQ ID NO: 33098 - RNA, 1623 nt, Artificial Sequence
  derived and/or modified sequence opt6 from major_capsid_protein__Norovirus__AJZ77004
augaaaauggccucaagugacgccaacccuagcgauggaucaacagccaaccuaguaccagaaguuaacaacgaagucauggcacuagaacccguagucggagcugcaauugcugcuccaguagcaggacaacaaaauguaauagaccccuggauucguaacaacuuuguacaagcaccaggaggcgaauuuacuguuuccccaagaaacgcacccggagaaauuuuauggucugcaccccuagguccagauuuaaauccauaccuaucucaccucgcgcgaauguauaauaguuacgcaggaggauuugaaguacaaguaauacuagcaggcaacgcauuuacagcaggaaaaauaauauuugcagccguuccaccaaacuuuccaacagaaggucuuucaccaucucaaguuacaauguucccacacauaauaguagaugucagacaacuagaaccaguacuaauaccacuaccagauguaagaaacaauuucuaucacuauaaccaaucaaaugacccaacaauaaaacuaauugcaauguuauauacuccucuccgagcuaauaaugcaggagaugacguauucacaguauccuguagaguauuaacaagaccaucuccugauuucgauuucaucuuucuagucccuccaaccguugaaucacgcacuaaaccauucucuguaccaauccucaccguagaagaaaugacaaacucaagauuuccaauaccacuagaaaaacuauuuacaggaccaucauccgccuuuguaguacaaccccaaaacgguagauguacaacagacggaguauuauuaggaacaacacaauuauccccaguuaauauauguacauuucguggugacguaacacacauagcaucaacucaagaauauacaaugaauuuagcaucacaaaacuggaauaauuacgacccaacagaagaaaucccagcaccacuuggaacaccagauuuuguaggaaagauccaaggaguauuaacacaaacaacaagaagagauggaagcacaagaggacacaaagcaacaguuucaaccggaucaguacauuucacaccaaaauuggguagaauacaauucucaacagacacaucaaacgauuuugaaacaggacaaaauaccagauucacaccuguaggaguuguucaagauggaucaacaacucaccaaaaugaaccccaacaauggguccuaccuaacuacucuggaagagacucacacaauguacaucuugcaccagccguugcaccaucauuuccaggagaacaacucuuauuuuuuagaucaacaaugccaggaugcucugguuaucccaauaugaacuuagacugccuucuaccacaagaauggguacaacacuuuuaccaagaagcagcacccgcucaaucagacguagcucuacuccgauuuguaaacccagauacugguagaguucuuuucgaauguaaauuacacaagucuggauacguaacuguagcacacacaggacaacacgaccuuguuauaccaccaaauggauacuuuagauuugauucaugggucaaccaauucuacacauuagcacccaugggaaauggaacaggaagaagaagagcucuuuaa

SEQ ID NO: 33099 - RNA, 1623 nt, Artificial Sequence
  derived and/or modified sequence opt6 from major_capsid_protein__Norovirus__AJZ77010
augaaaauggcaucaaaugaugcaucuccaagugacggauccgccgccaaccuaguaccugaaguaaacaacgaaguaauggcauuagaaccuguaguaggcgcagccauagcagcaccuguagcaggacaacaaaauguuauagaccccuggauacgaaacaauuuuguccaagcaccaggaggagaauuuacuguaucaccuagaaacgcaccaggugaaaucuuauggucagcaccacuaggaccagauuuaaauccauaccuaucccauuuagcacgaauguacaacggauaugcaggaggauuugaaguacaaguaauacuagcaggaaaugcauucacugcaggaaaaauaauauucgcagcaguaccaccaaacuucccaacagaaggacuaucuccaucacaaguaacaauguuuccacauauuauaguagacguacgucaauuagaaccaguacuaauaccacuaccagacguaaggaacaauuucuaccacuacaaccaaucaaaugacucaacaauaaaauuaaucgcaauguuauauacaccacuaagagcaaauaaugccggugaggacguauuuacagucuccuguagaguacuaacuagaccauccccagauuucgacuuuauauuccuaguacccccaacaguagaaucuagaaccaaaccuuuuaccguaccaauauuaacaguagaagaaaugacuaacucaagauuuccuauaccacuagaaaaacuauucaccggcccgucaggagcauucgucguccaaccacaaaacggccgauguacaacagacggaguuuuacuaggaacaacccaauuaucaccaguaaauauauguacauuuagaggugauguaacccauauugcaggaucccgaaacuauacuaugaacuuagcagcacuaaauuggaauaauuacgaucccacugaagaaaucccagcuccacuaggcacucccgacuuuguaggaaaaauacaaggaguauuaacacaaacuacaaaagcugaugguucaacaagaggacauaaagcaacugucuacacaggaucugcagacuuuacucccaaauuaggcucuguucaauucaguacagacacugaaaaugauuucgaaacacaucaaaacacuaaauuuacaccaguaggagucauacaagacggaucaacaacccauagaaacgaaccucaacaauggguacuaccaucauacucaggaagaaauguacauaacguccauuuagcaccugcaguugccccaacauucccuggagaacaacuauuauucuuuagaagcacaaugccugguuguucaggcuauccaaauauggaucucgauugccuacugccacaagaauggguucaacacuucuaucaagaagccgcaccagcucaaucugacguagcauuacuacguuucguaaauccagauacuggaagaguacuauucgaauguaaacuacacaaaaguggcuauguaacaguagcacacacaggacaacaugacuuaguaauccccccaaauggcuauuuccgauuugacuccuggguaaaccaauucuacacacuagcaccaaugggaaauggcacaggaagaagaagagcuuuauaa

SEQ ID NO: 33100 - RNA, 1623 nt, Artificial Sequence
  derived and/or modified sequence opt6 from major_capsid_protein__Norovirus__AJZ77013
augaaaauggcaucaucugacgcaaacccaucagacggaucaacugcuaaucuaguuccagaaguaaacaaugaaguaauggcccuagaaccaguagucggagccgcuauugccgccccaguagccggacaacaaaauguaauagacccauggauuagaucaaacuuuguucaagccccaggaggcgaauuuacaguauccccaagaaacgcacccggugaaauauuaugguccgccccauuaggaccagauuuaaacccauaccuaucucacuuagcuaggauguauaacgguuaugcaggaggauucgaaguacaaguaauacucgcugguaaugcauuuaccgcaggaaaaauaauauucgcugcaguaccaccgaauuuuccuacagaaggacuaucaccaucacaaguaacaauguucccacacauuauaguugacguaagacaacuugaacccguuuuaauaccuuuaccagauguuagaaauaauuucuaucacuauaaucaaucuaaugacccaacaauaaaauuaauagcaaugcuguauacaccauuaagagcuaacaaugcaggagacgauguauuuaccguauccugucgcguauuaacaagaccaucaccugacuuugacuucauauuucuaguaccaccaacaguagaaucaagaacaaaaccauuuucuguaccuauauuaacagucgaagaaaugacaaacucccguuuccccauuccguuagaaaaacuauuuacaggaccaucaucagcuuucguaguccagccacaaaacggaagaugcacaaccgacgguguauuauuaggaacuacacaacucucaccaguaaauauauguacauucagaggagacguaacacauaucacaggaucaagaaacuauacaaugaacuuagcaacacaaaacuggaauucauacgauccaacagaagaaauaccagcaccacuaggcacaccagauuucguuggaaaaauacaaggaguauuaacacaaacaacaagagcagacggaucaacuagaggacauaaagcaacaguauauacaggaucagcugacuuugcaccaaaauuaggaagaguacaauucgccacagacacagauaacgauuuugaugcaaaucaaaauacuaaauucacaccuguugguguaauacaagauggagauacugcccauagaaaugaaccacaacaauggguuuuaccuucauacucaggacgcaauucacauaacguucaccucgcaccagcaguugcaccaacauuuccaggagaacaacuauuauuuuucaggucaaccaugccaggcuguucuggauauccaaacauggaucuugauuguuuacuaccccaagaauggguacaauacuucuaucaagaagcagcaccagcucaaagugacguugcacuauuaagauucguaaacccagacacaggucgcguuuuauucgaaugcaaacuacauaaaagcgguuaugugacaguugcucacacaggucaacacgaucucguaauaccaccaaauggcuauuuuagauucgacucauggguuaaucaauuuuauacacuagcaccaaugggaaauggaaccggcagacgucgagcauuauaa

SEQ ID NO: 33101 - RNA, 1623 nt, Artificial Sequence
  derived and/or modified sequence opt6 from major_capsid_protein__Norovirus__AJZ77015
augaaaauggcaucuucagacgcuaacccaagugauggaucaaccgcaaaccuaguuccagaaguuaacaaugaagucauggcucuagaaccaguaguaggcgcagcaauagcagccccagucgcaggacaacaaaauguaauagauccauggauccgaaacaacuuuguacaagcaccuggaggugaauuuaccguaagcccacgaaaugcaccuggugaaauauuauggucagccccacuaggaccagauuuaaauccauaucuaucacaucuagcacgaauguauaacgguuacgcuggcggauuugaaguccaaguaauauuagcaggaaaugcauuuacagcaggaaaaauaauauuugccgcaguuccaccaaacuuuccaacagaaggauuaagcccaucacaaguaacaauguuuccccacuuaauaguagauguaagacaauuagaacccguacuaauuccucuaccagauguaagaaacaacuuuuaucacuacaaccaaucuaacgacucaacaauaaaauuaauagcuaugcuuuacacaccauuacgagcaaacaacgccggagaugauguauuuacaguuucauguagagugcuuacucgaccuuccccugauuuugauuucauauuccucguaccuccaaccguagaaucaagaacaaaaccauucucuguaccagucuuaacaguagaagagaugacaaauagcagauuuccaauacccuuagagaaacuauuuacaggaccaucaucagcauuuguaguacaaccgcaaaacggcagauguacaacagacggaguacuacuaggaacuacucaauuaucaccugucaacauuugcacauuuagaggugacgucacacauauaccagguucacgaaauuauacaaugaaucucgccucacaaaacuggaacucauacgauccaacugaagaaauuccagcuccacuaggcacaccugacuuuguaggaaagauacaaggaguacuuacacaaacaacaagaacaaacgguagcacaagaggucacaaagcaacagucuauacaggaucugcagauuuuucaccaaaauuaggaagaguacaauuugccacagacacugauaacgacuucgaaacuaaucaaaauacuaaauucacacccguaggcguaauacaagaugguucaacaacaccaagaaacgaaccucaacaauggguacuaccuaguuauucuggucgcaauauacauaacguacaucuugcaccugcaguagcaccaacauuuccaggugaacaauuauuauucuuucgaucuacaaugccagguuguucuggcuauccaaauauggaucuagacugucuacuuccucaagaauggguacaauacuuuuaucaagaagccgccccagcucaaagcgauguagcccuuuuacgauucguaaacccugacacaggaagaguccuauucgaauguaaauuacauaaauccggcuauguaacaguagcacacacaggacagcaugaucucguaauaccaccuaacgguuauuuccgauuugacucauggguaaaucaauucuacacacucgcaccaaugggaaauggaacuggccgcagaagagcauuauaa

SEQ ID NO: 33102 - RNA, 1623 nt, Artificial Sequence
  derived and/or modified sequence opt6 from major_capsid_protein__Norovirus__AJZ77019
augaaaauggcauccaaugaugcaaauccaucugauggaucagcagcaaaccuaguaccagaagucaacaacgaaguaauggcucuugaaccagucguaggagcagcaauagcugcaccagucgcuggccaacaaaauguuauagacccauggauaaggaauaacuuuguccaagcaccugguggagaauucaccguuucaccacgaaaugcuccuggugaaauacuaugguccgcuccacucggaccagaucugaacccuuaucuaucacacuuagcucgaauguauaacgguuaugccggcgguuucgaaguacaagucauacuagcaggaaaugccuuuacugcuggaaaaauaauauuugcagcagucccaccaaauuuuccaacugaaggcuuaucaccuucacaaguaacaauguuuccucauauaauuguugacguaagacaacuagaaccaguacuuauuccucuaccagauguaagaaauaacuucuaucacuauaaucaaucaaacgauucaacaauuaaauuaauagcaaugcuauacacucccuuaagagcuaauaaugcuggagaugacguauuuacuguauccuguagaguacucacaagaccuucaccagauuuugacuuuaucuuccuaguaccaccaacuguagaaucuagaacaaaaccauuuaccguaccuauccuaacaguagaagaaaugacuaauucacgauuucccauaccauuagaaaaacuauuuacuggaccaucauccgcauucguaguacaaccucaaaauggcagaugcacaacugacggaguacuccuagguacaacacaauuaucaccaguaaauauauguacauuucgaggugacguaacacacauagcaggaucacgaaauuacacuaugaaucuagcauccuuaaauuggaacaauuacgacccaacugaagaaauuccagcaccauuaggaacacccgauuuuguagguaaaauccaaggaguacuaacccaaacaacaaaaggagacggcucuacaagaggucacaaagcaacuguauacacagguucagcagauuucacaccuaaacuaggaaguguucaauucgcaacagacacagaaaaugauuuugaaacacaucaaaauaccaaauuuacaccagucggaguaauacaagacggaucaacaacacaucgaaacgaaccacaacaauggguauuaccaucauauuccggcagaaauguacauaacguacaucuagcuccagcuguagcuccuaacuucccaggagaacaauuacuuuuuuuuagaucaacaaugccaggaugcucaggauauccaaacauggacuuagauugcuuacuaccccaagaauggguacaacauuucuaucaagaagccgcaccugcucaaucugacguugcacuacuucguuucguaaacccugauacaggacgaguauuauuugaaugcaaauuacauaaaucuggauacgucacaguagcacacacaggucaacacgauuuaguuauuccacccaauggcuauuucagauuugacucauggguaaaucaauuuuacacacuagcaccaaugggaaacggaacaggccgccgacgagcauuauaa

SEQ ID NO: 33103 - RNA, 1623 nt, Artificial Sequence
  derived and/or modified sequence opt6 from major_capsid_protein__Norovirus__AJZ77022
augaaaauggcuuccucugacgcaaauccaucugauggcucagcagcuaauuuaguuccagaaguaaacaaugaagucauggcacuugaaccuguaguuggagcagcuauagcugcaccaguagcuggucaacaaaauguaauugacccauggauuagaaauaauuuuguccaagccccaggaggugaauuuacugucucacccagaaacgcuccaggugaaauacuuuggucagcaccacucggaccagaccuaaaccccuaccucucacaucuagccagaauguauaauggauaugcaggaggauuugaaguacaaguaauacucgcaggaaaugcauuuaccgcaggaaaaguuauuuuugcagcagucccaccuaauuuuccaacugaagguuuaaguccaucucaaguaacuauguuuccacauauaguuguagauguaagacaacuagaaccuguacuuauaccacuuccagauguaagaaauaauuuuuaccacuacaaucaaucaaacgauccaaccaucaaauuaauagccaugcuauauacaccacuuagagcuaauaaugccggagaugauguauuuaccguaucaugcaggguauuaacaagaccaucuccagauuuugacuuuauuuuucuuguucccccuacuguagaaucaagaacaaaaccauuuuccguaccuguacucacuguggaagaaaugacaaacucuagauuuccaauaccacuugaaaaauuauuuacgggaccauccagugcauucguaguacaaccacaaaauggacgauguacuacagauggaguucuauuagguacaacucaauuaucaccaguuaauauauguacuuuuagaggagacguaacccauauaacuggaucucguaauuauacuaugaaucuagccucacaaaauuggucaaauuacgauccaacggaagaaauuccagcaccacuaggaacaccagauuuuguaggcaaaauacaaggaguacuaacacaaacaacacgaacagaugguucaacuagaggacacaaagcaacuguuuauacaggaucugcagauuuugcaccuaaacuaggaagaguucaauucgaaacagacacagauagagauuucgaagcaaaccaaaauaccaaauuuaccccaguaggcguuauacaagaugguucuacuacacaucgaaaugaaccacaacaguggguacuuccaucuuauucuggaagaaacacuccaaauguacacuuagcuccagccguugcuccuaccuucccaggagaacaacuuuuguucuucagaucuaccaugccaggauguuccggauauccaaacauggaccuagacugcuuacuuccacaagaauggguacaauacuuuuaucaagaagcugcaccagcacaauccgauguagcuuuauuaagauuuguuaaccccgauacaggaagaguauuauuugaaugcaaauuacauaaaucaggauaugucacaguagcacauacaggacaacaugauuuaguaauaccaccuaauggauacuuucguuucgauuccuggguaaaccaauuuuacacacuugcuccaaugggaaacgguaccggaagaagaagagccuuauaa

SEQ ID NO: 33104 - RNA, 1623 nt, Artificial Sequence
  derived and/or modified sequence opt6 from major_capsid_protein__Norovirus__AJZ77027
augaaaauggccucaagugaugcaaauccaucagauggcagcgcugcaaauuuaguaccugagguaaacaaugaagucauggcauuagaaccgguaguaggagcagcuauagcugcccccguagcaggccaacaaaauguaauagacccuuggauacgaaacaauuucguacaagcuccuggaggagaauuuacaguuucaccaagaaacgcuccaggagagauacuauggucugcuccauuaggaccugaucuuaauccauacuuaucccauuuagcaagaauguauaacggauaugcaggagguuuugaaguacaaguaauacuagcaggaaaugcauuuaccgccggaaaaguaauauuugcugcaguaccaccaaacuucccuacagaaggauuaucaccuucacagguuacaauguuuccacacauaguugucgacguccgacaacuugaaccaguacuaauaccccuaccagauguaagaaauaauuucuaccauuauaaccaaucaaaugaucccacaauaaaauuaauagcaauguuauacacaccucuuagagcaaauaacgcuggcgacgaugucuuuacaguaucuuguagaguauuaacacguccaucaccagauuuugacuuuauauuuuuaguaccucccacaguagaaucaagaacaaaaccauuuucaguaccuguauuaacaguagaagagaugaccaacuccagauucccaauaccucuugaaaaauuauucacuggaccaucuucagcauuuguaguacaaccacaaaauggaagauguaccacagauggaguauuauuaggaacaacucaguuaucaccaguaaauauuuguacuuuccguggagauguaacccauaucacugguucaagaaauuauaccaugaacuuagcaucacaaaauuggaacaauuacgauccgacagaagaaaucccugcaccuuuagguacuccagauuuuguuggaaaaauacaaggaguuuuaacacaaaccacaagaaccgauggaagcacacgaggacauaaagcaaccguauauacuggauccgcagauuucgcaccgaaauuagguagaguacaauucgaaacagauacagaucaugauuucgaagcaaaucaaaauacaaaauuuacaccugucggaguaauccaagacggaggaacaacacauagaaaugaaccacaacaauggguuuuaccaucauauucaggccgaaauacccauaauguacauuuagcaccugcaguagcaccaacuuuuccaggagaacaacuucucuuuuuuagaucaaccaugccaggcuguucaggauauccaaacauggaucuugauugucuauuaccacaagaauggguacaauauuuuuaccaagaagccgcaccagcucaaagugauguugccuuauuaagauuuguaaauccagacacaggucgaguacuauuugaauguaaauuacauaaaucuggauauguuacuguagcacauacaggucaauacgauuuagucauaccuccuaauggauacuucagauuugauucaugggucaaucaauucuacacuuuagcaccaauggguaacggaacaggaagaagaagagcagucuaa

SEQ ID NO: 33105 - RNA, 1623 nt, Artificial Sequence
  derived and/or modified sequence opt6 from major_capsid_protein__Norovirus__AJZ77030
augaaaauggcaucaucugaugcuaauccaucagauggaucagcugccaaccuaguaccugaaguaaacaacgaaguaauggccuuagaacccguaguaggagcagcaauagcagcaccaguagccggucaacaaaaugucauagaucccuggaucagaaauaauuuuguacaagcaccuggaggcgaauuuacaguuucaccaagaaaugccccuggagaaauccuauggucagcaccacuaggaccagacuuaaacccuuaccucucacauuuagcaagaauguauaauggauaugcaggagguuucgaaguacaaguaauccuagcaggaaaugcauuuacagcaggcaaaguaauauucgcagcaguaccuccuaauuucccaaccgaaggucuaucaccaucacaaguaacaauguucccacacauuguaguagauguaagacaacuagaaccagucuuaauuccccuucccgacguaagaaacaauuucuaucacuauaaucaaucaaaugauccaacaauuaaauuaaucgcaauguuauauacuccacuaagagcuaacaaugcaggagaugauguauuuacuguaucauguagaguauuaacaagaccuucucccgauuuugacuuuauuuuucuuguaccaccaacaguagaaucuagaacaaaaccauuuucuguaccaguucuaacaguugaagaaaugacuaauuccagauuuccaauaccacuagaaaaacuauuuacugguccaucaucagcuuucguaguccaaccucaaaauggacguugcacgacagacgguguacuacuaggcacaacucaacuaucaccugucaacauauguaccuuuagaggagacguaacccacauaacaggcuccagaaacuauacuaugaaucuagcaucccaaaacuggaacaauuacgauccaacagaagaaauaccugcaccauuaggaacaccagauuuugucggaaaaauccaaggcguacuaacacaaacaacaagaacagauggaucuacucgaggacacaaagcaacaguauauacaggcucugccgacuucgcuccaaaacuuggacguguacaauucgaaaccgauacagaucaugauuucgaagcaaaucaaaauacuaaauuuacaccaguaggaguaauacaagauggaggaacuacacauagaaacgaaccacaacaauggguucuaccaucauauucuggacgcaauacacauaacguacauuuagcaccugcagucgcaccuacauuucccggagaacaauuauuauucuucagaucaacuaugccugguuguucaggauauccaaauauggacuuagauugccuauuaccucaagaauggguacaauauuuuuaccaagaagcagcaccagcacaaucugaugucgcauuauuacgauuuguuaauccugacacaggaaggguauuauuugaauguaaacuacauaaaucaggauaugucacuguagcacacacaggucaacacgacuuaguaauaccaccaaacggauacuuucgcuucgauucauggguaaaccaauucuauacacuugcaccaaugggaaauggaacuggaagaagacgagcaguuuaa

SEQ ID NO: 33106 - RNA, 1623 nt, Artificial Sequence
  derived and/or modified sequence opt6 from major_capsid_protein__Norovirus__AJZ77033
augaaaauggcuucaucagacgcaaauccauccgauggaucaacagcaaaucuaguaccagaaguuaacaaugaaguaauggccuuagaaccugugguaggugccgcaauagcagccccaguagccggucaacaaaacguaauagacccauggauucgaaacaauuuuguacaagccccaggaggugaauuuacaguaucaccaagaaaugcacccggagaaauauuaugguccgcuccucucggcccagaccuaaaucccuauuuaucccaucuugcaagaauguacaacggcuacgcaggaggauuugaaguucaaguaauucuagcaggcaaugcauucacagcaggcaaaauaauuuuugccgcaguuccaccaaauuuuccaacugaaggucuaucuccaucccaagucacuauguucccacacauaaucguggacguaagacaauuagaacccguucuaauuccauuacccgauguaagaaauaauuucuaucauuauaaccaaucaaaugacucuacaauaaaacuaaucgcaauguuauauacuccucuaagagcuaacaaugcuggagaugacguauucacaguaucauguagaguacuaacacguccauccccggauuuugacuuuauauuccugguaccacccaccguagaaucaagaacaaaacccuucucagugccaguucuaacaguagaagaaaugacuaauucaagauuucccauaccacuagaaaaacuauucaccggaccaagcucagcauucgucguacaaccccaaaauggaagauguacaacagacgguguacuacuaggaacaacacaacuaucaccagucaauauauguacauuucguggagacguaacacacauaccagggucaagaaacuauacaaugaaucuagcaucucaaaauuggaacucauacgauccaacugaagaaauaccagcaccacugggaacaccagauuuuguaggaaaaauacaaggaguacuaacacaaacaacacgaacgaacggaucuacuagaggucacaaagccacaguauauacuggaucagcagacuuuucacccaaacuaggacgcguacaauuugcaacagauacagauaaugauuuugaaacaaaccaaaauaccaaauuuacacccguaggaguuauacaagacgguucuaccacaccacgaaaugaaccucaacaauggguauuaccaucauauuccgguagaaauauacauaacguacauuuagcaccagcaguagccccaacauuuccaggugaacaacuauuauucuuuagaucaacaaugccaggauguaguggauauccaaauauggauuuagacugccuacuaccucaagaauggguacaauauuucuaccaagaagcagcaccagcacaaucagauguagcauuauuaagauucguaaacccagacacaggaagagucuuauuugaaugcaaacuacauaaaucuggcuacgucacaguagcccauacaggccaacaugaucuaguaauaccacccaauggauauuucagauucgauuccuggguaaaccaauuuuauacauuagcacccaugggaaaugguacaggacgacgcagagcuuuauaa

SEQ ID NO: 33107 - RNA, 1623 nt, Artificial Sequence
  derived and/or modified sequence opt6 from major_capsid_protein__Norovirus__AJZ77036
augaaaauggcaucaucugaugcaaacccaagugacggaucaacagcaaaccuaguuccagaaguaaacaaugaaguaauggcucucgaaccaguaguuggagcagcaauagcagcaccaguagcaggacaacaaaacguaauagaccccuggauacgaaacaacuuuguacaagcuccuggaggcgaauucacaguaucaccaagaaaugcaccuggagaaauauuaugguccgcaccacuaggaccagauuuaaaucccuauuuaucacaccucgcaagaauguauaacgguuaugcaggaggauuugaaguucagguaauacuagcaggaaaugcauuuacugcuggaaaaauaauauuugcugccguucccccuaauuucccaacugaaggacuaucuccaucucaaguuacaauguuuccacacauuaucguagacguaagacaacuagaaccaguacuaauaccacuacccgauguuaggaacaacuucuaccacuacaaccagucaaaugacucaacaauaaaacuaaucgcaauguuauauacuccccuuagagcuaauaaugcaggagaugauguguuuacaguaucaugucgaguauuaacuagaccaucacccgacuuugacuuuauuuuucuaguaccaccaacagucgaaucaagaacuaaaccauucucgguaccaguucuuacaguagaagaaaugacaaacucaagauuuccaauaccauuagaaaagcucuucacagguccaucuucagcuuuuguaguucagccacaaaacggaagauguacaacagacggaguacuauuaggaacaacacaauuauccccugucaauauauguacuuuuagaggagacgucacacauaucccaggaucacgaaacuacacaaugaauuuagcaucacaaaauuggaauuccuaugauccuacagaagaaauaccagcaccauuaggaacaccagacuuuguaggaaaaauucaaggaguauuaacacaaacuacaagaacuaacggaaguacaagaggucacaaagcaacaguauauacaggaucagcagacuuuucaccaaaauuaggacguguccaauucgcaacagauaccgacaaugauuuugaaaccaaucaaaacacuaaauucacaccaguuggaguaauacaagacggaucaacaacaccaagaaaugaaccacaacaauggguacugccuucauacucaggucgaaacauacauaacguacacuuagcaccagcaguagcaccaacauuuccuggggaacaacuuuuauucuuuagaucuacaaugccaggaugcagcggcuauccaaauauggauuuagacugccuacuaccucaagaauggguacaguacuucuaucaagaagcugcacccgcacaauccgacguagcucuauuacgauuugucaauccagauacaggacgaguauuguuugaaugcaaauuacacaaaucaggcuaugucacaguagcacauacgggccaacacgaucucguaauuccaccaaauggauauuucagauuugauucauggguuaaucaauuuuacacauuagcaccuaugggaaacgguacaggccgacgucgagcacuauaa

SEQ ID NO: 33108 - RNA, 1623 nt, Artificial Sequence
  derived and/or modified sequence opt6 from major_capsid_protein__Norovirus__AKE31849
augaaaauggcaucaucugacgcaaauccaucugauggauccacugcuaauuuagucccagaagucaauaaugaaguaauggcacucgaaccaguaguaggagcagcaauugcagccccaguagcuggacaacaaaauguaauugauccauggauaaggaauaacuucguucaagcaccaggaggagaauucacaguaucaccacgcaaugcaccuggugaaauauuauggucagcuccccuaggaccugacuuaaaccccuaccuaucacacuuagcaagaauguacaacggauacgcugguggauuugaaguucaaguuauauuagcuggaaacgcauuuacagcuggaaaaauaauauuugcugcaguuccaccaaacuucccaacugaaggauuaucaccaucucaaguaacaauguuuccccacauaauaguugacguaagacaacucgaaccuguauuaauaccuuuaccagacguacgaaauaauuuuuaccacuauaaccaauccaaugauucuacaauaaaauuaauugcaaugcuuuauacuccacuaagagcaaauaaugcaggagaugacgucuuuacagucucaugcagaguauuaacaagaccauccccagauuuugacuucauauuucuaguaccaccaacaguagaaucaagaaccaaacccuuuucuguccccguacuaacaguagaagaaaugacaaacucaagauuuccaaucccauuagaaaaacuauucacaggaccauccucagcauucgucguacaaccacaaaacgguagauguacaacugauggaguucuucuaggaaccacacaacuaucaccaguaaauaucugcacauuuagaggagauguaacacauauaucaggcucaaggaauuauaccaugaaucuugcaucacaaaacuggaauaguuaugauccaacagaagaaauaccugcuccacuaggaaccccagauuuuguagguaaaauacaaggaguacuaacacaagcaacacgcaccaacggaucaacacgaggacacaaagcaaccguuuacacaggauccgccgauuucucaccaaaauuaggaaggguacaauuugcuacagauacagacaacgacuucgaaacuaaucaaaauacaaaauucacuccuguaggaguaauacaagacggaucaacaacuccuagaaacgaaccucaacaauggguacugcccucauauucaggaagaaauauacauaauguccaucuagcaccugcagucgcaccaaccuucccgggagaacaauuacuauucuuuagaucaacgaugccuggcuguucagguuauccaaauauggauuuagacuguuuauuaccacaagaauggguacaauauuucuaucaagaagcagcacccgcucaaucugauguugcauuacuaagauucguuaacccugacacaggaaggguacuauuugaaugcaaauuacauaaaucuggauaugucacaguugcacauacaggacaacacgaucucguuauaccaccaaaugguuauuuccgcuucgauucauggguaaaucaauuuuauacccuagccccaaugggaaauggaacaggacgccgaagagcauuauaa

SEQ ID NO: 33109 - RNA, 1623 nt, Artificial Sequence
  derived and/or modified sequence opt6 from major_capsid_protein__Norovirus__AKE31852
augaaaauggccucauccgacgcaaacccauccgaugguucuacagcaaaucuaguaccagaaguaaauaaugaagucauggcucuagaaccaguaguaggagcagcaauagcagcaccaguagcaggccaacaaaauguaauagacccauggauaagaaacaauuuuguucaagcaccaggcggagaauuuacaguaucaccacgaaaugcucccggagaaauauuauggucagcaccacuugguccagaucuuaacccauauuuaagccacuuagcaagaauguauaauggauauguaggaggauucgaaguacaagucauacuagcaggaaaugcuuuuacagcaggcaaaauaauuuuugcugcaguacccccuaauuucccgacagaaggacuaucaccaucucaaguuacaauguucccacacauaaucguagauguacgucagcuagaaccaguccuaauaccuuuacccgauguaagaaacaauuuccaucauuauaaucaauccaaugauccaacaauuaaauuaauagcuaugcuauauacaccacuacgagcaaacaacgcaggagacgauguuuuuaccguaucuuguagaguuuuaacaagaccuucuccugacuuugauuuuauauuuuuaguaccuccuaccguagaaucaagaacaaaacccuucuccguaccaguccuuacaguugaagaaaugaccaacuccagauucccaauaccauuagaaaaauuauuuacugguccaucauccgcauuuguaguucaaccacaaaauggacgauguacaacagauggaguacuacuaggaacaacccaacuuucaccuguaaauaucugcacuuuuagaggugauguuacacauauaccaggaucaagaaacuauacaaugaacuuagcaucacaaaacuggaacucuuaugacccaacagaagaaauaccagcuccuuuaggcacaccagauuuugucggaaaaauacaaggaguacucacucaaacaacaaggacuaacggaucaacaagaggacacaaagcaacugucuacaccgguuccgcagacuucucgccaaaacuuggcagaauacaauucgcuacggauacagacaaugauuucgaaacaaaucaaaauacaaaauucacaccaguaggcguaauacaagauggcucaacaacuccucgaaacgaaccacagcaaugggucuuaccauccuauucaggaagaaacacacacaacguccaucuugcaccagcagucgcaccaaccuuuccaggagaacaacuauuauucuuuagauccacaaugcccggauguucagguuauccaaauauggaucuagacuguuuacuaccacaagaauggguucaauauuucuaucaagaagccgcaccagcucaaagcgacguagcauuacucagauucguuaacccugacacaggaagagucuuauucgaaugcaaauuacauaaaucuggauauguaacuguugcccacaccggccaacaugaccuaguuauaccaccaaauggauauuucagauuugauuccuggguuaaucaauuuuacacauuagcuccaaugggaaacggaacaggaagaagacgugcacuauaa

SEQ ID NO: 33110 - RNA, 1623 nt, Artificial Sequence
  derived and/or modified sequence opt6 from major_capsid_protein__Norovirus__AKE31855
augaaaauggcaucaucagaugcuaaccccucagaugguagcacugcaaaccuaguaccagaaguuaauaaugaaguaauggcacuagaaccaguuguaggagcagcaauagcagccccagucgcaggacaacaaaauguaauagauccauggauccgaaguaauuuuguccaagcaccaggaggagaauuuacaguauccccaagaaaugccccaggagaaauauuauggagcgcaccuuuaggucccgaucuaaaucccuacuuaucucaccuagcacgaauguauaacgguuacgcaggaggauucguuguucaaguaauuuuagcaggcaaugcauuuacagcuggcaaaauaauauucgcagcaguaccaccuaacuuuccaaccgaaggacugucaccaucacaaguaacaauguucccacacauaauaguagacgcacgacaacuagaacccguucuaauaccccuucccgauguaagaaacaauuuuuaucacuacaaucaaagcaacgacccaacaaucaaauuaauagcuauguuauacaccccauuaagagcaaacaacgccggugacgauguuuucacaguaucauguagaguacuaacucgaccaucuccagacuuugauuuuauauuuuuaguaccaccaacaguugaaucaagaacuaaacccuuuucugucccaguacuaacaguagaagaaaugacaaauucuagauuucccauaccacuagaaaaacuauuuacuggaccaucaucagcauucguuguacaaccucaaaacggcagaugcacaacagauggaguucuccuaggaacaacacaacuaagcccaguaaauauaugcacauuccgaggagauguaacacauauaucaggcucacgaaauuacacaaugaaucuagcaucucaaaauuggaauucauacgacccaaccgaagaaauaccagcaccuuuagggaccccugauuuuguagguaaaauacaaggaguacuaacacaaacaacaaaaacagauggaaguacaagaggacacaaagcaaccguauauacaggaucagcagacuuuucaccuaaauuaggaagaguacaauuugcaacugauaccgauaaugauuucgaaacaaaucaaaacacaaaauuuacuccaguaggaguaauacaagauggaucaaccaccccaagaaacgaaccacaacaauggguacuccccucauauucagguagaaauacccauaacguacacuuagcaccagcaguagccccaacauuuccaggagaacaacucuuauuuuuccguucaaccaugccaggauguucaggauacccaaauauggaucuagauugcuuauuaccacaagaauggguacaauacuucuaucaagaagcagcuccagcacaauccgauguagcacuacuccguuucguuaauccugacacaggccguguacuauuugaauguaaacuacauaaaucgggauauguaacaguagcacauacuggacaacacgacuuaguaauaccaccaaacggauauuuucguuucgauucaugggucaaccaauucuauacacuagcuccaaugggaaauggaacuggaagaagaagagccuuauaa

SEQ ID NO: 33111 - RNA, 1623 nt, Artificial Sequence
  derived and/or modified sequence opt6 from major_capsid_protein__Norovirus__AKE31858
augaaaauggcaagcagugaugcaaacccaucugauggaucaacagcaaaccuugucccagaaguuaacaaugaaguaauggcacuagaacccguaguaggagcagcaauagcugcaccaguagcaggacaacaaaauguaauagaucccuggauuagaucaaauuuuguccaagccccuggaggagaauuuacuguaagccccagaaaugcaccaggagaaauauuauggucagcaccuuuaggaccugauuuaaauccauaucuuucacauuuggcuagaauguacaacggauacgcaggaggauuugaaguccaaguuauacuagcaggaaacgcauucacagccggcaaaauaauauuugcagcaguaccaccaaauuucccaacagaaggacuaucacccagccaaguuacaauguucccacauauaauaguggacguacgacaacuagagccaguuuuaauaccccucccugacguaaggaacaacuucuaucacuauaaccaaucuaaugauccaacuauaaaauuaauagcaauguuauacacaccacugcgagccaauaaugcaggagaugauguauuuacaguaucaugcagaguauuaacacgaccuucaccugauuuugacuuuauauuucuuguaccacccacaguagaauccagaacaaaaccauuuucaguacccguauuaaccguagaagaaaugacaaauucaagauucccaauaccauuagaaaaauuauuuacaggaccauccucagccuucguaguacaaccacaaaaugguagauguacaacagauggaguauuauuaggaacaacucaacuuuccccaguaaacauuugcacuuucagaggugauguaacacacauaucaggcucaagaaauuauaccaugaaucuagcaagucaaaauuggaacucuuacgauccaacugaagaaauuccagcaccacuugguacuccugacuucguaggaaaaacacaaggcguauuaacacaaacaaccaaaacuaacgguagcacucgaggccacaaagcaacaguauauacuggcucagcugacuuuucacccaaacuaggccguguacaauuugccacugauacugauaacgauuucgaaacaaaccaaaacacaaaauucacaccaguaggaguaauucaagauggaagcacaacaccacgagacgaaccacaacaauggguacuaccauccuauuccggucgaaauacacauaauguacaccuagcaccagcuguagccccaaccuuuccaggugaacaauuacucuucuuccgaaguacaaugccaggaugcucaggauauccaaauauggaccucgaucgacuacuaccccaagaauggguucaauacuuuuaucaagaacccgcaccagcacaaucagacguagcauuacucagauucguaaacccugauacaggacgaguacuauuugaauguaaacuacauaaaucaggauaugucacuguagcacacacaggucaacaugaucuaguaaucccaccaaacggcuauuuuagauuugacucuuggguaaaucaauuuuacacauuagcaccaaugggaaauggaacaggaagaagacgagcauuauaa

SEQ ID NO: 33112 - RNA, 1623 nt, Artificial Sequence
  derived and/or modified sequence opt6 from major_capsid_protein__Norovirus__AKE31861
augaaaauggcaucaucugaugcaaacccuucugauggaucaacagcaaaccuaguaccagaagucaacaaugaaguuauggcucuagaaccaguuguaggggcugcaauagcagcaccaguagcuggccaacaaaaugucauugauccauggauaagaucaaauuucguacaagcuccuggaggugaauucacagucagccccagaaaugcccccggagaaauauuauggucagcaccucuuggacccgaucuuaacccauacuuaucacaucuagccagaauguauaacggauacgcaggagguuucgagguacaagucauacuagcaggaaaugcauucacagcaggaaaaauaauauuugcagccguaccaccaaacuuucccacagaaggucuauccccaucacaaguaacaauguuuccucauauaauaguugacguaagacaacuagaaccaguguuaauaccccuuccagauguaagaaacaauuuuuaucacuauaaucaaaguaaugacccaacuauaaaauuaauugcaagacucuacacuccauuaagagcaaacaaugcaggugaugauguauuuacaguaucaugccgaguacuaacccgacccucaccagacuuugacuucauauuucuaguaccaccaacaguugaaucacgaacaaaaccauuuucaguuccaguacuaacaguugaagaaaugacaaacucaagauuuccaauaccacuagaaaaauuauucaccggacccucuucagccuucguaguacaaccacaaaacggucgauguacaacugacgguguacuauuagguacaacucaauuaucaccaguuaauauaugcacauucagaggagacguuacacacaucaguggaucuagaaauuacacaaugaacuuagcaucacaaaacuggaauucauacgacccaacagaagaaauuccagcaccucuaggaaccccagacuuugucgguaaaauucaaggaguacuaacacaaacaacaaaaacaaauggaucaacaagaggacauaaagcaacuguauauacaggauccgcugacuuuuccccaaaacuugguagaguacaauucgcaacagauacugauaacgauuuugaaacuaaccaaaacacuaaauucaccccaguagguguaauucaagauggaucaacaacaccaagaaaugaaccacaacaauggguucuaccuucuuauagcggaagaaauacacauaauguacauuuagccccagcaguagcuccaaccuuuccuggagaacaacuccuauucuuuagaucaacaaugccaggaugcuccgguuaucccaacauggaucuagauugcuuauuaccacaagaauggguucaauacuuuuaucaagaggcugcccccgcacaaucagacguagcauuacuccgauuugugaauccugacacuggcagaguacuuuucgaauguaaacuacacaaaucaggauauguuaccguagcacauacaggacaacaugaucuaguaauacccccuaauggauacuucagauuugauucauggguuaaccaauuucacacacuagcuccuaugggaaauggaacuggaagaagaagagcauuauaa

SEQ ID NO: 33113 - RNA, 1623 nt, Artificial Sequence
  derived and/or modified sequence opt6 from major_capsid_protein__Norovirus__AKE31864
augaaaauggcaucaucagaugcaaacccaucagacggaucaacagcaaaccuaguuccugaaguaaacaaugaaguuauggcacuagaaccuguaguaggagcagcaauagcagcaccaguugcuggccaacaaaacguuauugacccauggauaagaaacaacuuuguccaagcuccaggcggagaauuuacaguuuccccaagaaaugcuccaggugaaauauuauggucagcuccacuuggaccagacuuaaauccauaucuuucacaucuugcaagaauguauaauggauacgcaggggguuuugaaguucaaguaauacuagcaggaaaugcauuuaccgccgguaaaauaauauucgccgccgucccaccaaauuuuccaacagaaggacuuucgccaucacaaguaacaauguucccacauauaauaguagauguacgacaauuagaaccaguuuuaaucccauuacccgaugucagaaacaauuuuuaucacuauaaucaaucaaacgaucccaccauaaaauuaauagcaauguuauauacaccacuaagagcaaauaaugcaggagaugacguauuuacaguaucaugccgugucuuaacuagaccaaguccagacuucgacuucauauuucucguaccacccacuguugaaucuagaacaaaaccauuuucuguaccaguacuuacaguugaagaaaugacaaauucucguuuuccaauccccuuagaaaaacucuuuacaggaccaucuucagcauucguuguacagccacaaaacgguagauguacaacugacggaguacuucuaggaaccacacaacucucaccaguuaauauaagaacauuccgaggagaugucacacauauaccaggaucaagaaacuauacaaugaauagcgcuucucaaaacuggaacuccuaugauccaacagaagaaauuccagccccacuaggaaccccagacuuuguaggaaaaauacaaggcguacuuacucaaacaacacgagccaacggcagcacaagaggucauaaagcuacaguuuacaccggauccgcagauuucucacccaaauuaggaagaguccaauuugcaacagauacagauaacgauuuugaaacaaaucaaaauacaaaauucacuccaguaggaguaauacaagauggauccacaacaccaagaaaugaaccacaacaauggguucuaccaucuuacaguggaagaaauauacauaauguacaccuagcaccagccguagccccaaccuuuccaggagaacaauuacucuuuuuucgaucgacaaugccaggaugcucaggauauccaaacauggaucucgauuguuuauuaccacaagaauggguccaauacuucuaucaagaagcagcaccagcacaaucagacguagcucuauuaagauucguaaacccagacacagguagagucuuauuugaaugcaaacuacacaaaucaggauauguuacaguagcacauacuggucaacacgaccuaguaauuccuccaaacgguuacuucagauuugauuccugggucaaucaauuuuacacacucgccccaaugggaaauggaacaggcagacgaagagcauuauaa

SEQ ID NO: 33114 - RNA, 1623 nt, Artificial Sequence
  derived and/or modified sequence opt6 from major_capsid_protein__Norovirus__AKE31867
augaaaauggcuucaucagacgccaauccauccgauggaucaacagcaaaccuuguaccugaagucaacaaugaaguaauggcacuagaacccguagucggugccgccauugcugcaccagucgcuggacaacaaaacgucauagacccauggauacgaaacaauuuuguacaagcaccaggaggagaauucacagucaguccaaggaaugcaccaggagaaauacucuggucugcaccccuaggaccagauuuaaauccauaccuaucucacuuagcaagaauguauaauggcuaugcaggaggauucgaaguccaaguuauacuagcaggaaaugcauuuacagcaggaaaaauaauauucgcagcagucccaccuaacuucccaacagaaggccuaaguccaucccaaguaaccauguucccacauauaauaguugauguuagacaacuagaaccagucucuauaccacuacccgauguacgcaacaauuucuaccacuauaaccaaaguaaugaccccacaauaaaacuaauagccauguuauauacaccacuacgugcuaauaacgcaggagacgacguauucaccgucucaugcagaguccuuacuagaccaucaccagacuuugauuucauauucuuaguaccaccaacuguagaaucuagaacgaaaccauucucaguaccaguacuaacaguagaagaaaugacaaacucucgauuuccaauaccauuagaaaaacuauuuacaggaccaucauccgcauuuguaguacaaccacaaaaugguagauguacuacagacggaguacuacuaggaacaacacaacuaucuccaguaaacaucugcacuuucagaggagacguaacccacauaccuggaucaagaaauuauacaaugaaucuagcaucacaaaauuggaacucauaugacccaacagaagaaauacccgcaccucuaggaacaccagacuuuguaggaaaaauccaaggugucuuaacacaaaccaccagagcaaacggauccacuagaggacacaaagcaacaguauacacaggaucagcagauuuuucaccuaaacuaggucgaguacaauuugcaaccgauacagauaaugacuuugaaacuaaucaaaauaccaaauucacuccaguaggaguaauccaagacgguucaacuacacccagaaaugaaccucaacaguggguucuuccaucauacucuggaagaaauauacauaacguucaccuugcuccagccguugcaccaacuuuuccaggagaacaacuauuauuuuuucguucaacaaugcccgggugcucaggguaucccaauauggaucuagauuguuuacuuccacaagaauggguacaauauuucuaucaagaagcugcaccagcacaaucagacguagcauuacuaagauucguaaacccagacacuggacgagucuuauucgaauguaaacuacauaaaucagguuacguuacaguagcacacacaggccaacaugauuuaguaauaccaccuaacggauacuuuagauucgauagcuggguuaaccaauuuuauacauuagcaccaaugggaaauggcacaggccgaagacgagcacuauaa

SEQ ID NO: 33115 - RNA, 1623 nt, Artificial Sequence
  derived and/or modified sequence opt6 from major_capsid_protein__Norovirus__AKE31870
augaaaauggcaucaucagacgcaaauccaucagauggcucaaccgccaaccuuguaccagaaguaaacaaugaaguaauggcauuagaacccguuguaggagcaucaauugcagccccaguagcuggucaacaaaacguaauagauccuuggauaagaaauaauuuuguccaagcaccuggcggagaauucaccguaucaccaagaaaugcaccaggcgaaauuuuauggucagcaccacuaggacccgacuuaaacccauaucuuccacaccuagcaagaauguauaaugguuaugccggcggauuugaaguacaaguaauacuugcaggaaaugcauucacagcaggcaaaauaauauucgcagccguaccaccaaacuuucccaccgaaggacuaucaccaucacaaguaacuauguuuccucacauaaucguugacguacgucaacuagaaccaguacuaauacccuuaccagauguacgaaacaacuucuaucauuauuaccaaucaaacgauccaacaauuaaauuaaucgcaaugcucuacacaccauuaagagcuaacaacgccggugacgacguuuucacaguaucuugcagaguccuaaccagaccuuccccagauuuugacuucauauuccuuguaccaccaacaguagaaucaagaaccaaaccuuucucagucccaguccuaacaguugaagaaaugacuaacucaagauuccccauaccacuagaaaaauuauuuacaggaccuuccucagcauucguuguucaaccacaaaacggcagaugcaccacagacggaguuuuacuaggaacaacacaacuaucaccuguaaauaucuguacauuccgcggugacguaacacacauaucuggauccagaaacuacaccaugaauuuagcuucacaaaacuggaauucauacgauccaacagaagaaauaccugcaccauuaggaacccccgauuuuguaggaaaaauacaagguguauuaacacaaacaacuagaacaaauggaucuaccagaggacacaaagcuacaguauacacaggauccgccgacuuuucccccaaauuaggccgaguccaauuugcaacagauacagacaaugacuuugaaacaaaucaaaauaccaaauuuacaccagucggaguuauccaagauggaucaacuacccccagaaaugaaucacaacaauggguauuacccucauacucuggacgaaacacacacaacguucacuuagcaccagcaguagcuccaacauucccaggagaacaacuacuauucuuucgaucuacaaugccagguugcuccggauacccaaacauggaccuagacugcuuacuuccacaagaauggguacaauauuucuaucaagaagcagccccugcacaaucagacguagcauuauuaagauuuguaaacccagauacaggaagagucuuauucgaauguaaacuccauaaaucuggauauguaaccguagcacauacaggucaacacgacuuaguaauaccaccaaauggauauuuuagauucgacucauggguaaaucaauucuauacacuugcaccuaugggcaacggaacaggaagaaggagagcuuuauaa

SEQ ID NO: 33116 - RNA, 1623 nt, Artificial Sequence
  derived and/or modified sequence opt6 from major_capsid_protein__Norovirus__AKE31873
augaaaauggcaagcagugacgcaaauccauccgauggcucaacugcaaacuuagucccagaaguaaacaaugaaguuauggcucuugaaccaguuguuggagccgcaauagcagcaccagucgcaggacaacaaaauguaaucgauccauggauuagaaacaacuucguacaagcaccagguggagaauucaccguaucacccagaaaugcaccaggcgaaauauuauggucugcaccacuaggaccagaucucaacccauauuuaucacacuuagcacgaauguauaauggauacgcaggcggauuugaaguacaagucauccuugcaggaaaugcauucaccgccggaaaaaucauuuucgcugcagucccaccuaacuuuccaacugaaggauuaucuccaucacaaguuaccauguuuccacauaucauagucgacguuagacaacuagaacccguauuaauaccauuaccagauguaagaaauaauuucuaccacuauaaccaaucaaaugauccaaccauaaaacuuauagcaaugcucuauacaccauuaagagccaauaacgcuggagaugauguuuuuaccguaucaugucgaguacuaacaagaccaucacccgauuucgauuuuauauuccuagucccaccaacagucgaaucuagaacaaaaccauucucaguuccuguauuaacagucgaagaaaugaccaacucuagauuuccaauaccacuagaaaaacuuuuuaccggaccaucuucagcauucgucguucaaccacaaaauggaagauguacaacugacggaguacuacuugggacaacucagcuaucaccaguaaauaucuguacauuuagaggagauguaacccacauaucaggaucaagaaauuacacaaugaaccucgcaucacaaaacuggaacucauaugauccuacagaagaaauucccgcaccauuagguacaccagauuuuguaggaaaaauacaaggaguacuaacacagacaacacguacaaacgguuccaccagaggacacaaagcaacuguuuauacaggaucagcagacuucucaccaaaacuaggaagaguacaauucgcaaccgauacagacaacgauuuugaaacaaaccaaaauaccaaauucacaccagucggagucauucaagacggaucaacuacaccaagaaaugaaccacaacaauggaugcuaccaagcuacucuggaagaaauacacauaauguacaccuugccccugcugucgcaccuacauuucccggugaacaacuauuauucuuuagaucaaccaugcccgguugcuccggauauccaaauauggaucuagacugccuuuuaccucaagaauggguacaauauuucuaucaagaagcagcccccgcucaauccgacguugcucuuuuaagauuuguuaauccagacacaggaagaguauuauuugaaugcaaauuacacaaaucugguuauguaacaguugcacauacgggucaacacgauuuaguaaucccaccaaauggauauuucagauucgacucauggguuaaucaauuuuacacacucgcaccaaugggcaauggaacaggaagaagacgagcacuauaa

SEQ ID NO: 33117 - RNA, 1623 nt, Artificial Sequence
  derived and/or modified sequence opt6 from major_capsid_protein__Norovirus__AKE31876
augaaaauggcaucuuccgaugcaaauccaucagaugguucaacagcaaaucuaguaccagaaguaaacaaugaaguaauggcuuuagaacccguaguaggagcagccauagccgcaccagucgcagggcaacaaaauguaauagacccauggauacgaaauaauuuuguacaagcaccuggcggcgaauuuacaguaucaccaagaaaugccccuggagaaauauuauggagugcaccauuagguccagacuuaaauccauauuuaucucaucuagcaagaauguacaacggauacgccggagguuucgaaguacaaguaauacuagccggaaaugccuuuacagccggaaagauuauauuugccgcuguaccaccaaacuucccaacagaaggauuauccccaucacaaguaacaauguuuccacauauaauaguugacgucagacaauuagaaccaguucuaauaccauuaccugacguaagaaauaauuucuaucacuacaaucaaucuaacgacccaacaauuaaauuaauagcaaugcuauauacuccacuaagagcaaauaaugcaagagaugauguauucacaguaucauguagaguacuaacacgacccagucccgacuuugacuuuauauuccuuguaccaccaaccguagaaucucgaacuaaaccauucucaguuccaguucuuaccguugaagaaaugaccaacagcagauuuccuauaccccuagaaaaauuauuuacagguccaucaucagcauuugucguacaaccacaaaauggaagaugcacuaccgauggaguacuacucggaacaacucagcuaucaccuguaaauauauguacauucagaggagacguaacccauaucucugguucccgaaauuacacaaugaaucuagcuucacaaaauuggaauucauaugacccaacagaagaaauaccugccccccucgguacuccagacuucguaggaaaaauacagggaguauuaacacaaaccacaagaacagacggaucaacaagaggacauaaagcuacugucuauaccgguuccgcagacuuuaguccuaaacucggacgaguucaauucgcuacagacacagauaacgacuucgagacuaaccaaaauacaaaguucacaccaguaggcguaauacaagacggcggaacaacccauagaaaugaaccacaacaauggguacuaccaaauuacucugguagaaauacacacaauguacacuuagcaccagcaguagcaccaaccuuuccaggugaacaauuauuauuuuuccgaucaacaaugccagguugcaguggauauccaaauauggaucucgauugccuacuaccacaagaauggguucaauauuucuaccaagaagcagcaccagcucaaucagauguugcccuacuucgcuuuguaaauccagacacaggucgagucuuauuugaaugcaaacugcauaaaagcgguuauguuacaguugcacauacaggacaacacgaccuaguaauaccuccaaaugguuacuuccgauucgacucauggguaaaucaauuuuacacacuagccccaaugggaaacggaacaggacguagaagagcauuauaa

SEQ ID NO: 33118 - RNA, 1632 nt, Artificial Sequence
  derived and/or modified sequence opt6 from major_capsid_protein__Norovirus__AKF02368
augaaaauggcaucaaaugaugcugccccaucaaacgacggagccgcaggacuaguaccagaaaucaacaaugaaacaauggccuuagaaccaguagccggaggugcaauagcggccccucuaacaggccaaacaaacuuuauagacccauggauaagaggaaauuauguacaagccccaaacggagaauucacaguaucuccacgaaauaguccaggugagauauuacuaaauuuagaacuaggcccagaauuaaauccauucuuaucccacuuaucucgcauguacaacgguuacgccggaggaaucgacguucaaguaaucauggcagguaaugcauuuaccgcaggcaaaaucauauucgcagcuauaccuccccacuucccagucgaaaaccuaucaccuccacaaauaacaauguuuccacacauaaucguagacguacguacacucgaaccaauaaauaucccaguuccagacguaagaaacaacuuuuuccacuacaaucaaaauaaugaaucaagaaugagauuagucgcuaugcuauacaccccacuacgcucaaacggaucugccgaagacguauucacaguauccugcagaguccuuacaaaaccuucagcagacuucgaauucaauuacuuaguaccaccaaccguagaaucacgaacuaaaccauucacuauaccuauauuaacaauaggagaaaugacaaacucaagauucccuguuccaauagauauguuacauacaaguccaacagaaaauauaguaguacaaccacaaaauggaagaugcacaaucgacggagaacuauuaggaaccacacaauuaauaacaucaaauauaugcucuuuuagaggaucaauuuccggacacgaaggaaacgaugaucaacaucuauggcacuucaauauaacaaacccuaauggaacucccuucgauccaacagaagauguaccagcaccucucggaacaccagauuucagaggccaacuauacggaguaauuucccaaagagauagagaaggaacaccaucagaaaauaaucaaaaagcaaacagaucccaugaaggaguaaucucaaccauaaguccaaaauuuguaccaaaacuaggaucaguaaugauaggaacauggacuacagacgacauaaaaaaccagccaucuaaauucacaccaauaggacuuaacgaugacgacaauuuuaaacaaugggaauuacccaauuauucuggugcccuuacacuuaacaugggccuugccccaucaguauuuccaacauauccuggcgaacaaguuuuauucuuccgauccuacuuaccaaugaaaggcggcuacggaucucccuucaucgacugucuagucccacaagaauggguagcccacuucuaucaagaaucagcaccagcacaaacagacguagcacuaaucagauacguaaacccugaaacaggaagaguauuauucgaagcaaaauuacauagacaaggauuuauaacagucgcuaaaucuggagacucucccaucaauguuccugcuaacggauauuucagauuugacucuuggguuaaccaauucuacucauuagcacccauggguacaggaaacggacgaagaagaauacaauaa

SEQ ID NO: 33119 - RNA, 1644 nt, Artificial Sequence
  derived and/or modified sequence opt6 from major_capsid_protein__Norovirus__AKF42429
augaaaauggcuuccaaugacgcagcaccuucuaaugauggagcugcaaauuuaguaccagaagcaacuaaugaaguuauggcacuagaaccaguaguuggugccucaauagcagcucccguaguaggacaacaaaacauaauugacccauggauaagagaaaacuuuguacaagcaccacaaggagaauuuacaguuucaccaagaaacucaccaggagaaauguuauuaaauuuagaauuaggaccagaauuaaacccauaccuaucacauuuaagccgcauguacaaugguuaugcuggaggcaugcaaguccaaguaguauuagccgggaacgcauucaccgcaggcaaaauaauuuuugcagccguaccaccacauuuuccuguagaaaauauuucagcugcacaaauuaccauguguccccacguaauaguagauguacgacaacuugaaccaguucuacuaccauuaccagacauccgaaacagauuuuuucauuauaaccaagaaaauacaccaagaaugagauuaguagcaaugcuguauacuccacucagagcaaauucuggagaagauguuuucacaguaucuugucgaguauuaacaagaccagcaccagauuucgaauuuacauuucuaguaccaccgacaguagaaucuaaaacaaaaccauuuacauuaccuauacuuacuuuaggcgaacuuuccaauucuagauuuccugcaccaaucgacauguuauauacagacccuaaugaagcaauaguagugcaaccacaaaauggaagauguacuuuagauggcacauuacaaggaacaacacaacuuguaccaacccaaauaugcucauucagaggaacauuaauuucucaaacgucaagaagugcagacuccacugacucagccccaagaguaagaaaccacccuuuacauguucaauuaaaaaacuuagauggaaccccguaugauccaacagaugaagucccagcaguauuaggagcuauagacuucaaaggaaccguuuuuggaguagcaagucaacguaacacaacaggaaacuccauuggagcaacaagagcacaugaaguacacauugauacuacaaauccuagauauacaccuaaacuaggcaguguacuaauguauucugaaaguacagacuuugaugauggccaaccuacaagauuuacaccaauaggaaugggagcagaugauuggcaccaaugggaacugccugaauauucaggccacuuaacacuaucuaugucauuagcacccgcaguagcacccgcauucccuggagaaagaauucuuuuuuuuagaucuguaguaccauccgcaggcggcuacgguucaggacauaucgauugcuuaauaccucaagaauggguucaacauuucuaucaagaagcugcaccaagucaaucugcaguagcucuuauaagauacguaaauccagauacuggaagaaauauauuugaagcaaaauuacauagagaaggauuuauuacaguagcuaauucaggcaacaacccaaucgucgugccaccaaauggauacuucagauuugaagcauggguaaaucaauuuuacacacuuacuccaauggguacaggacaaggaagaagacgaguacaauaa

SEQ ID NO: 33120 - RNA, 1644 nt, Artificial Sequence
  derived and/or modified sequence opt6 from major_capsid_protein__Norovirus__AKF42434
augaaaauggccucaaacgacgcagcuccuucuaacgauggugcagcaaaucuuguuccagaagcgacaaaugaaguuauggcuuuggaaccagucguuggagcaucaauugcagcacccguaguuggacaacaaaacauaauagacccauggauaagagaaaacuucguucaagcuccacaaggagaauuuacaguaucaccaagaaauucaccaggcgaaaugcuauuaaaucuagaauuaggcccugaacuaaauccuuaucuaagucaucuaucacgaauguacaaugguuaugcugguggaaugcaaguacaaguaguauuagcaggaaaugcauuuacugcaggaaaaauaauauucgcugcugucccaccacauuuuccuguagaaaacauuagugcagcacaaauaacuauguguccacaugucauagucgauguacgucaacuagaaccagugcuauuaccacuaccagauaucagaaauagauucuuccacuauaaccaagaaaacacaccaagaaugagauuagucgcuauguuauacacaccucuaagggcuaacuccggugaagauguauuuacuguaucuugucgaguauuaacucgaccugcacccgauuuugaauuuacauucuuaguaccaccaacuguagaauccaaaacaaaaccuuuuacacuaccaauacuaacuuuaggagagcuuucaaauucaagauuuccugcaccuauugauaugcuuuauaccgauccaaaugaagcaaucgucguacagccacaaaauggacgaugcacacuugacggaacuuuacaaggaacaacucaacuaguuccaacacaaauaugcucauuuagaggaacuuuaauaucacaaaccucuagaagcgcagauucaaccgauucagcaccaagaguuagaaaucaucccuuacacguacaacuuaaaaacuuagauggaacaccauaugaucccacagaugaagucccagcagucuuaggagcaauagacuuuaaaggcaccguauuugggguagcuucucaaagaaauacuacaggaaacagcauaggagcaacaagagcacaugaaguacacaucgauacaacaaauccuagauauacuccaaaauuaggaucaguucuaauguauucugaaaguucugauuuugaugauggucaaccaaccagauuuacuccaauuggaaugggugcagaugauuggcaucaaugggaauugccagaauauucaggacaucuaacauuaaauaugaauuuagcaccagccguagcacccgcuuuuccuggugaaagaauacuauuuuuuagaucagucguaccaucagcaggaggauauggaucuggucauauagauuguuuaauaccacaagaauggguacaacauuuuuaucaagaagcagccccaucacaaucugccguagcacuaauaagauacguaaauccugacacaggacgaaauaucuuugaagcuaaauuacauagggaaggauuuauaacaguagcaaacucaggaaauaauccaauaguuguacccccuaauggauacuucagauuugaagcauggguaaaucaauuuuauacacuaacaccaaugggaaccggacaaggcagaagaagaguacaauaa

SEQ ID NO: 33121 - RNA, 1650 nt, Artificial Sequence
  derived and/or modified sequence opt6 from major_capsid_protein__Norovirus__AKF42437
augaaaauggcaagcacugaugcagcaccuucuaaugauggagccgcaaauuuaguccccgaagcaaauaacgaaguaauggcacuagaaccaguuguuggugccucaauagcagcaccaguuguaggacaacaaaauauuauagauccauggauaagagaaaauuucguacaagcaccccaaggcgaauuuacaguaucaccacgcaauucgccaggagaaauguuauuaaaucucgaacuuggaccagaauuaaauccauaccuuucacauuuaucuagaauguauaacggauacgcugguggaaugcaaguccaaguaguauuagcaggaaaugcauuuaccgcaggaaaaauaaucuuugcagccguaccaccucacuuuccaguuaaaaacauuuccgcagcacaaauuacaaugugcccccauguaauagucgauguucgacaauuagaaccugucuuacuaccacuaccugauauuagaaacagauucuuccauuauaaucaagaagauacaccaagaaugcgguuaguugcaauguuauauacaccauuaagagccaacucuggcgaggacguuuuuacaguaucuugucgaguuuuaacaagaccagcaccagauuucgaauuuacauuuuuaguaccuccaacagucgaaucuaaaacaaaaccuuucacauuaccuauacuuacauuaggugaacucuccaacucaagauuuccagccccaauugauauguuauacacagauccaaaugaaggaguagucguacaaccacaaaaugguagauguacacucgacgguacuuuacaaggaaccacccaacuaguaccuacacaaauuugcgcuuuuagaggcaaauuaauaggacaaacuucacgaucacccgauucagauucuacagacagcgccccacgaagaagagaccauccccuacauguacaacuagaaaaucuagauggcacucaauacgacccaacagaugaaguucccgcaacucuuggagcaguagacuucaaaggaacaauauucgguguugcaucacaaagagacaccucagguucacaaguaggugcuacaagagcucaugaaguacauauaaauacaacagauccaagauauacaccaaaauuaggaucaauucuaauguacucagaaucacuagauuucgaaacuggacaaccaguaagauucacaccaauuggaaugggugaaaaugauuggcaucaaugggaauuaccagacuacucaggaagacucacccuuaauaugaaucuagcaccagcaguagccccagcuuuuccaggugaaagaauauuauuuuuuagauccauaguacccucugcagguggauacggaucaggacaaauagacugccuaaucccccaagaauggguacaacauuucuaccaagaagccgcaccuucccaaagcgcuguagcacuaauacgauacguuaauccagauacaggaagaaauauuuucgaagcaaaauuacauagagaaggauuuauaacaguagcaaacucaggcaauaauccaaucgucguacccccaaacggauauuuccgauuugaagcauggguaaaucaguuuuauacuuuaacaccuauggguaccggacaaggaagaagacgaaaucaauaa

SEQ ID NO: 33122 - RNA, 1623 nt, Artificial Sequence
  derived and/or modified sequence opt6 from major_capsid_protein__Norovirus__ALA27427
augaaaauggccagcaaugaugcuaacccaagugauggaucagccgcaaacuuaguaccagaaguaaauaaugaaguaauggcacuagaacccgucguaggagccgcaauagccgcuccuguagcuggccaacaaaauguaauagaucccuggauuagaaauaauuuuguacaagccccaggaggugaguuuacaguaucaccaagaaaugcccccggagaaauauuauggucagcaccacuaggaccagaccugaauccauaucuaucucaccucgcuagaauguauaacgguuacgccggaggauucgaaguacaaguaaucuuagcagguaaugcauuuacagcaggaaaaauaauuuucgcugccguaccaccaaacuuuccaacagaagguuuaucacccucacaaguaaccauguuuccucacauuaucguagacguaagacaauuagaaccaguccuaauaccuuuaccagaugugcgaaacaauuucuaucacuacaaucaaucaaaugauucuaccauaaaauuaaucgcaaugcuuuauacccccuuaagagcaaacaaugcaggagaagacguuuuuacaguuucauguagaguacuaacaagaccaucaccugacuuugacuucaucuuucuaguuccuccaaccguugaaucgcgcacaaaacccuucacaguaccaauacuuaccguagaagaaaugacuaauucaagauuucccaucccauuagaaaaacuauuuacagguccauccggagcauuuguaguacagccucaaaacggcagauguacaacugauggaguacuucuaggaacaacucaauuaucacccguaaauaucuguacuuuuagaggugauguuacucauauagcaggcucaagaaacuacacaaugaaccuagcauccuuaaacuggaauaauuacgacccaacugaagaaauaccagcaccucuaggcacaccagauuuugucggaaaaauacaagguguacuaacacaaacaacaaaaggcgacggcucaaccagaggacacaaagcaacaguauauacagguucagcaccauuuacaccaaaacuugguucaguacaauuuuccacagacacagaaaacgauuucgaaacacaccaaaauacaaaauucacacccguaggagucauacaagaugguucaaccacccacagaaaugaaccacaacaauggguauuaccaucuuauucaggaagaaacguacacaacguacacuuagcacccgcaguagcaccaacauucccaggugaacaauuacuauucuuucgcaguaccaugccugguuguucuggauauccaaauauggaccucgauuguuuacuaccacaagaauggguacaacacuucuaccaagaagcagcaccugcucaauccgacguagcauuacuacgauuuguaaauccagauacaggcagaguacuauucgaauguaaacuacauaaaagcggauauguaacugucgcacauacaggacaacacgauuuagucauaccuccaaauggcuauuuuagauuugacucauggguaaaccaauuuuacacuuuagcaccuaugggaaauggaacagguagaagacgagccuuauaa

SEQ ID NO: 33123 - RNA, 1623 nt, Artificial Sequence
  derived and/or modified sequence opt6 from major_capsid_protein__Norovirus__ALD09618
augaaaauggccucaaaugacgcugcaccauccaaugauggagcagcuggacuaguccccgaaggaaacaaugaaacauuaccucuugaaccaguagcuggagcagcuauagcagccccaguuacaggacaaaacaauauaauagacccauggauaagaacaaauuucguacaagcaccaaacggugaauuuacaguauccccaagaaacucaccaggugaaauucuucuaaauuuagaacuaggaccugacuugaauccauaccuugcacaucuuucaaggauguauaauggauacgcaggaggaguagaaguacaagucuuacuagcaggaaaugcauuuacagcagguaaaauccuuuucgcagcaguuccaccaaauuucccaguagaauuucuuucuccagcacaaauuacaaugcucccacacuuaaucguugacguuagaacccuagaaccaauaaugauccccuugcccgaugcacgaaacacauucuuucacuacaguaaccaaccaaacucuagaaugagacuaguugcaaugcuauacacaccccuccgaucaaacggcucaggcgacgaugucuucacaguuucuugccguguucucacaagaccaacaccugacuuugaauucacuuaccuaguaccaccaucuguugaauccaaaaccaaaccuuucucauuaccuauacuaacacuuuccgaauuaacaaauucaagauuuccaguaccaauugacucacucuuuaccgcucaaaauaacguacuacaaguacaaugccaaaauggacgcuguacacuagauggagaacuucaaggaaccacccaacuacuuccaucagguauaugugcauuucgaggcaggguaacagcacaaauaaaucaaagagaccgauggcauaugcaacuacaaaaccuaaacggcacaacuuaugacccuacugaugacguuccugcuccauuaggaacacccgacuucaaaggaguaguauuugguaugguaucacaaagaaacguuggaaaugaugcaccaggaucaacaagagcacaacaagccugggucucaacauacucaccucaauuuguaccuaaacuggguuccguaaaccuaagaaucucugacaacgaugauuuccaauuccaaccgacaaaauuuaccccagucgguguaaacgacgacgacgauggacauccauuuagacaaugggaauuaccaaacuacucaggagaauuaacccuaaauaugaaccuagcaccuccaguagcaccuaacuuuccaggagaacaauuacuauucuuuagaucauuugucccaugcucagguggauacaaucaaggaauuauagauugucuuauaccccaagaauggauacaacauuucuaccaagaaucagcuccaucacaaucugacguugcacuuauaagauauguaaaccccgacacaggaagaacauuauuugaagcaaaacuccauagaucuggcuacauaacuguugcacacuccggagauuauccacuaguagucccagcaaauggacacuuucgauucgauuccuggguaaaucaauuuuauucauuagcaccaaugggaacuggaaauggaagaagaagggcacaauaa

SEQ ID NO: 33124 - RNA, 1623 nt, Artificial Sequence
  derived and/or modified sequence opt6 from major_capsid_protein__Norovirus__ALM96644
augaaaauggcaucaucugacgccaacccauccgaugguucaacagcaaacuuaauaccugaaguuaauaaugaaguuauggcacuagaaccaguagucggagccgcaauagcagcaccaguagccggucaacaaaacguaauagaucccuggauaagaaauaacuuuguccaagcacccggaggagaauuuacaguaucaccuagaaaugcaccaggagaaauacuaugguccgccccacuaggucccgauuuaaauccauaccuaucacaucuugcaagaauguauaacggauacgcaggcggauuugaaguacaagucauauuagccggaaaugcauucacugcuggaaaaauaaucuucgcagcaguacccccuaacuucccaacugaaggacuuucacccucucaaguaaccauguucccacauaucauaguagauguaagacaacuagaaccaguauuaaucccucuaccagacgucagaaauaacuuuuaucacuauaaccaaucaaacgauucaacaauuaaauuaauugcaauguuauacacaccauuacgcgcaaacaaugcaggagaugacauauuuacaguaucuugucgaguacuaacaagaccuucuccagauuuugacuuuauauuuuuagucccaccuacaguagaaucacgaacaaaaccauucucuguaccuguacuuaccguugaagaaaugacuaauucucgauuuccaauaccucucgaaaaacuauuuaccggaccuaguucagcccucguaguccaaccacaaaacggaagauguacaacugacgguguacuauuaggaacaacacaauuaucuccagucaauauauguacauuucguggagacguaacccacauaccaggaucaagaaauuacacaaugaaucuagcaucucaaaacuggaacucauaugauccaacagaagaaaucccagcaccacuaggaacaccagacuucguuggaaaaauacagggaguacuaacacaaacaacaagaacuaauggaucaaccagaggucauaaagcaacaguguauacuggcucugcagacuuuucaccaaagcucggacgaguacaauucgcaaccgauaccgauaacgauuuugaaacaaaucaaaacacaaaauucacuccaguuggagucauacaagacggauccacuacaccuagaaacgaaccucaacaaugggugcuaccaucauauucaggaagaaauauacauaacgugcaccucgcaccugccguagcaccaacuuuucccggcgaacaacucuuauuuuuccgaucuacaaugcccggaugcuccggauauccaaauauggauuuagacugcuuacuaccgcaagaauggguacaauauuucuaucaagaagcugccccagcacaaucagacguugcacuacuccgcuucguaaauccggacacaggaagaguauuauucgaaugcaaauuacauaaaaguggcuauguaacuguagcacauaccggccaacacgauuuaguaauaccccccaauggcuacuuucgauucgacucaugggucaaucaauuuuacacacuagcuccaaugggaaacggcacaggaagaagacgcgcucuauaa

SEQ ID NO: 33125 - RNA, 1623 nt, Artificial Sequence
  derived and/or modified sequence opt6 from major_capsid_protein__Norovirus__ALM96645
augaaaauggcuucauccgacgcaaacccuagcgacggaucaacagcaaaccuagucccagaagucaacaaugaaguaauggcauuagaaccaguagucggagcagcaauugcagcaccaguugcaggacaacaaaauguaauagacccauggauaagaaacaacuucguucaagccccuggaggagaauuuacaguaucaccccgaaaugccccaggagaaauacuaugguccgcaccccuaggaccagaucuaaacccauauuuaucacauuuagcaagaauguauaaugguuacgcuggaggauucgaaguucaaguaauucuagcaggaaacgcauuuacagcaggaaaaaucauauucgcagcaguuccaccaaauuucccaacugaaggucucucuccaucucagguaacaauguucccacacauaauaguagacguacgacaacuagaaccaguuuuaauucccuuaccagauguacguaacaauuuuuaucacuauaaccaaucaaaugauucuacaauaaaauuaauagcaaugcuauacacuccauuaagagcaaacaacgcgggcggagauguauucacaguaucauguagaguacuaaccagaccuucaccugauuuugauuuuauuuuucuaguuccaccaacagucgaauccagaacaaaaccauucucaguaccaguauuaacaguagaagaaaugacuaauucacguuuuccuauaccucuugaaaaauuauuuacaggaccaucaucugcauucguaguacaaccucaaaauggucgauguacuacagacggcguacuacuagguacaacgcaauuaucaccuguaaauauauguacauuuagaggagauguaacacauaucccaggaucacgaaacuacacaaugaauuuagcuucucaaaacuggaauucuuaugauccaaccgaagagauacccgcaccucuaggaacaccagacuucguaggaaaaguacaaggcguauuaacgcaaacaacuagaacaaacggaucaacuagaggucauaaagccacaguauauacaggcucagcagacuuuucacccaaacuuggaagaguacaauuugcaacagauacagauaacgauuucgaaaccaaucaaaauacaaaauucacuccaguaggaguaauacaagauggcucaacuacaccucgcaaugaaccucaacaauggguacuaccaaguuacucaggaaggaacauacacaacguacacuuagcaccagcaguagcaccuaccuucccuggagaacaauuauuauucuuuagaucaacuaugccagguugcucaggauacccaaauauggauuuagacugccuccuaccacaagaauggguacaauauuuuuaucaagaagcagccccagcacaaagcgacguagcacuacucagauuugucaauccugauacaguuagaguuuuauucgaauguaaacuccauaaaucaggcuacguaacaguagcacauacuggacaacaugaccuuguaauaccaccaaauggauacuuucguuucgauaguugggugaaucaauucuauacucuagcaccuaugggaaacggaacagguagacguagagcacuuuaa

SEQ ID NO: 33126 - RNA, 1623 nt, Artificial Sequence
  derived and/or modified sequence opt6 from major_capsid_protein__Norovirus__ALM96646
augaaaauggccaguaaugaugccaacccauccgauggaucagcagcaaauuuaguacccaaaguaaacaaugaaguaauggcucuugaaccuguagucggugcagcaauagcagcuccaguagcaggacaacaaaauguaauagacccauggauuaaaaacaauuuuguacaagcacccggaggaaaauuuacuguaucccccaaaaaugccccuggagaaauacuauggucugcuccacuagguccagaucucaacccauacuuaucccacuuagcaagaauguauaaaggucaugcaggcggauucgaaguacaagucauuuuagcuggaaaugcauuuacagcaggcaaaauuauauucgccgcaguuccaccuaacuuuccaacagaaggacuaucuccaucucaagucacaauguucccucauauaauaguagacgucagacaauuagaaccaguacuaauaccacucccagauguuagaaacaauuuuuaucacuauaaucaaucaaaugauucaacaauuaaauuaauagcuaugcuauacaccccacuaagagcaaacaaugcaggugaagauguuuucaccguuucauguagagucuuaacaagaccauccccagacuucgacuuuauauuccuaguuccacccacaguugaaucaagaacaaaacccuucacaguaccuauacuaacaguagaagaaaugacaaacucaagauuuccgauaccacuagaaaaacucuuuacaggaccaucaucagcuuucguaguacaaccacaaaacggacgauguacuacagacggaguucuacucggaacaacucaacuaucaccuguaaauaucugcacauucagaggagacgucacacauauagcuggcucacgaaacuacacuaugaaucuagcaucauuaaauuggaacaacuaugauccaacagaagaaaucccagcgccauuaggcacaccagauuuuguaggaaaaauccaaggcguacuaacacaaacaacuaaaggagacggaucaacacgaggccacaaagcaacaguauauacuggauccgcacccuucacacccaaacuaggauccguacaauucucuacagauaccgaaaaugauuuugaaacccaccaaaauacaaaauucacaccaguugguguaauacaagacgguggaacaacacacagaaaugaaccacaacaauggguucucccaucauauuccggacgcaauguaccaaauguacaccuagcaccugcugucgcaccuacauucccaggcgaacaacuauuauuuuuuagauccacaaugccagggugcucaggauauccuaauauggaucuagacugcuuauuaccccaagaauggguacaacacuucuaucaagaagccgcaccagcacaaucugauguagcacuacucagauucgucaacccugauacuggaagaguauuauuugaauguaaacuacacaaaucaggauauguaacaguagcacauacaggacaacaugaccuaguuauaccacccaauggauauuuuagauucgauucauggguaaaucaauuuuacacacuagccccaaugggcaauggaacaggcagaagaagagcacuauaa

SEQ ID NO: 33127 - RNA, 1623 nt, Artificial Sequence
  derived and/or modified sequence opt6 from major_capsid_protein__Norovirus__ALM96647
augaaaauggcuagcaacgacgcaaauccaucagauggauccgccgcaaaccuaguaccuaaaguuaacaacgaaguaauggcuuuagaaccuguaguaggagcagcuaucgcagcuccuguagcaggucaacaaaacguaauagacccauggauccgaaacaacuuuguacaagcaccugguggaaaauucacaguaucaccuagaaacgcacccggagaaauauuauggucagcuccauuaggaccagaccuaaauccuuaucuaucucauuuagcaagaauguauaacggauacgcaggaggauucgaaguccaaguaauucuagcaggaaacgcuuucaccgcaggcaaaauaauauucgcagcaguacccccaaacuuuccaacagaaggacuuuccccaucucaaguaacuauguucccacauauaauaguagacguacgucaauuagaaccaguauuaauaccucuacccgacgucagaaacaauuuuuaccauuacaaccaaucaaacgauuccacaauaaaacuaauagcaauguuauacacaccccuaagagcaaacaaugcaggugaagaugucuucacuguaucuugucgaguacucacucgcccaagccccgacuucgacuucauauuuuuagucccuccuacaguagaaucuaggacaaaaccauucacuguuccaauauuaacagucgaagaaaugacaaacucaagauuuccaauaccauuagaaaaacuauucacaggacccucaggagcauuuguuguacaaccucaaaauggaagauguacaacagacggcguauuacuaggaacaacacaauuaucaccagucaauauauguacauucagaggugacguaacacauauagcuggaucaagaaauuacaccaugaaucuagcaucacuaaauuggaacaauuacgauccaacagaagaaaucccagccccuuuagguacuccagauuuuguaggaaaaauacaaggcguacucacacaaacaacaaaaggcgacggaucaacaagagggcacaaagcaacaguauauacagguucagcccccuuuaccccuaaauuaggaucaguacaauucuccacagauacagaaaacgacuucgaaacucaccaaaauacgaaauucacaccaguaggcguaauacaagacggaggcacuacacauagaaaugaaccucaacaauggguauuacccagcuauucaggaagaaacguacauaacguacaccuagcuccagcaguagcaccaacauucccaggcgaacaacugcuauucuuucguucaacaaugccaggcuguucaggcuacccaaacauggaucuagacugucuacuuccacaagaauggguacaacauuucuaccaagaagcugcaccagcucaauccgauguagcccuucuacgauucguaaaccccgauaccggcagaguauuauucgaauguaaauuacacaaauccggauacguaaccguagcccacacaggacaacacgaucuaguuauacccccaaauggauauuucagauucgauucauggguaaaucaauucuacacucucgcaccuaugggaaacggcacaggacgaagaagagccuuauaa

SEQ ID NO: 33128 - RNA, 1623 nt, Artificial Sequence
  derived and/or modified sequence opt6 from major_capsid_protein__Norovirus__ALM98891
augaaaauggcuucuaaugacgcagccccaucuaaugauggagcagcuggauuaguacccgaaggaaacaaugaaaccuuaccauuagaaccaguagccggagccgcaauugcagcacccguaaccggacaaaauaauaucauagauccauggaucaggacuaacuucguacaagcaccaaauggugaauuuacaguaagcccacgaaauucaccaggugaaauauuauuaaaccuagaacuagguccagaccuaaacccauaccuagcucaucuaucacgaauguauaacggauacgcaggaggcguugaaguacaaguucuauuagcaggaaaugcauucaccgcaggaaaaauacuauucgcagcaguuccucccaauuuuccagucgaauucuuaucaccagcacaaauaaccaugcuaccacauuuaauaguagacguucgaacauuagaaccaauuaugauaccccuaccugauguacgaaacacauucuuucacuauucuaaccagcccaauucacguaugcgacuagucgcaaugcuauacacuccuuuaagaucaaacggaagcggagacgauguauuuaccguaagcuguagaguucuaaccagaccuacuccugacuuugaauuuacauauuuaguacccccauccguagaaucuaaaacaaaaccauuuucccuaccuauauuaacccuaucugaacuaacaaacucccgauuuccaguaccaauagacucauuauuuacagcacaaaauaacgucuuacaaguacaaugucaaaacgguagauguacauuagacggagaauuacaaggcacaacucaacuauuaccaucugggauaugugcuuucagagguagaguuacagcacagauaaaccaaagagacagauggcacaugcaguuacaaaaucuuaauggcacaacuuaugauccaacagaugauguaccagcuccauuaggaacaccagacuucaaaggaguaguuuuuggcaugguaucacaaagaaauguuggaaaugacgcaccuggcuccacuagagcccaacaagcauggguaucaacauacucaccacaauucguaccaaaacuaggaucaguaaaucucagaauaucagacaaugacgacuuccaauuccaaccaacuaaauuuacaccuguagguguaaacgacgaugacgauggccauccauuuagacaaugggaacuuccaaacuauucuggagaacuaacauuaaauaugaacuuagcaccaccaguagcaccaaacuucccaggcgaacaauuacuauucuuuagaucguucguuccauguucaggaggauauaaccaaggaauaauagauugcuuaaucccucaagaauggauacaacauuuuuaccaagaauccgccccaagucaaucugauguagcuuuaauccgcuacguaaauccagacaccggcagaacucuauucgaagcaaaacuacauagauccggauacaucacaguagcucauucuggugacuauccacuagucguuccagcaaauggacauuucagauuugauucuugggucaaucaauuuuacucauuagcuccaaugggaacagguaauggacgaagaagggcacaauaa

SEQ ID NO: 33129 - RNA, 1623 nt, Artificial Sequence
  derived and/or modified sequence opt6 from major_capsid_protein__Norovirus__ALM98892
augaaaauggcauccaaugacgcagcacccagcaaugacggcgcagccggauuaguaccagaaggaaacaaugaaacauuaccuuuagaaccaguagccggagccgcaauagcagcaccagucacuggacaaaacaauaucauagacccauggauaagaaccaacuucguacaagcaccaaauggagaauuuacaguaucaccaagaaauucaccaggagaaauauuacucaauuuagaguuaggaccagauuuaaauccauaucuagcucaucuuagccgcauguauaacggauaugcaggaggaguagaaguacaagucuuacuagcuggaaaugcuuuuaccgcaggaaaaauacuauucgcugcagucccaccaaauuuuccaguagaauuucuaucacccgcacaaauaacaaugcuaccacauuuaauaguagacguucgcacacuagaaccaauuaugaucccucucccagauguaagaaacacuuucuuucacuauaguaaucaaccuaauucacgaaugagauuaguagcuauguuauacacuccauuaagaucaaaugguucuggagaugauguauuuacaguuuccugccgcguacuaacacgaccaacaccagacuucgaauucaccuaucuaguaccacccucaguugaaucaaaaacuaaaccuuuuucacuuccaauacuuacauuaucagaauuaacaaauucacgauucccaguaccaauagacucuuuauuuacagcacaaaauaacguauuacaaguacagugccaaaacggcagauguacacuugacggcgaauuacaaggcacaacacaauuacuaccaucaggaauaugcgcauuuagaggaagaguaacagcccaaauuaaccaaagagauagauggcacaugcaacuacaaaaucuaaaugguacaaccuaugacccaacagaugaugucccugcuccucucggaacaccagacuucaagggaguaguauucggaaugguuagucaaagaaauguuggaaaugaugcaccaggaucaaccagagcucaacaagcauggguuucuaccuauucuccucaauuugucccaaaauuaggaucaguaaauuuaagaauaucagacaacgacgacuuucaauuucaaccuacaaaauucacuccaguuggaguaaaugacgaugacgauggccacccauuuagacaaugggaacuaccaaauuauagcggagaacuuacccucaacaugaacuuagcaccaccaguugcaccuaacuucccaggagaacaauuauuauuuuuucgcuccuucgugcccugcucugguggauacaaucaaggaauaauagauugccuaauaccacaagaauggauacaacacuucuaucaagaaucagcucccucucaauccgaugucgcacuaauaagauacguaaauccagacacaggacgaacauuauuugaagcaaaacuacaucgaaguggauauauaacaguagcacacucaggcgauuauccauuaguagucccugcuaacggucauuucagauucgauucauggguaaaccaauuuuacucuuuagcucccauggguacagguaaugguagaagaagagcacaauaa

SEQ ID NO: 33130 - RNA, 1623 nt, Artificial Sequence
  derived and/or modified sequence opt6 from major_capsid_protein__Norovirus__ALM98893
augaaaauggcaucaaaugacgccgccccaucaaaugauggugccgcaggacuaguacccgaaggaaacaaugaaacacuaccacuagaaccagucgccggagcagccauagcugccccuguaacaggucaaaauaacauaauugaucccuggauuagaacaaauuucguucaagcaccaaacggugaauucacaguuuccccacgcaauucaccaggagaaauacuccuaaaccucgaacuaggucccgaccuaaacccauauuuagcacaccuuucuagaauguauaaugguuaugcuggaggaguugaaguccaaguauuacuagcaggaaacgcauucacagcaggcaaaauacuauucgcagcaguuccaccaaauuuuccaguagaauuucuaucaccagcacagauuacaaugcuaccacacuuaauagucgauguacgaacucuagaacccauaaugauucccuuacccgauguaagaaacaccuucuuucacuauucaaaucaaccaaauucacgaaugcgauuaguugccauguuauacacaccuuuacgaucaaauggaucaggcgacgacguauuuacaguuucaugucgaguacuaacaagaccaacaccugacuuugaauuuacauaucuaguaccuccuucaguugaaucaaaaacaaaaccuuucucauuaccaaucuuaacauuaucagaauuaacaaacucaagauuuccaguacccauugauagccuuuuuacagcucaaaauaauguacuacaaguacaaugucaaaacggaagauguacauuagacggagaauuacaaggaacaacacaacuucuuccuucagguauaugcgcauuuagagguagaguaacagcccaaaucaaccaacgagauagauggcacaugcaauuacaaaaccuaaauggaacaaccuaugacccaacagaugacguacccgcaccauuaggaacaccagauuuuaaaggcguaguauucgguaugguaucacaaagaaacgucggaaaugacgcaccaggaucaacaagagcccaacaagcauggguaucaacauauucuccacaauucguaccgaaacuuggaucuguuaaucuaagaauaucugacaaugacgauuuucaauuucaaccaacaaaauucacccccguagguguuaacgaugaugaugauggacacccauucagacaaugggaacuuccaaacuacucaggagaauuaacccuuaacaugaaucucgcaccuccaguagcacccaacuuuccuggagaacaauuauuauucuuuagaucauucguuccauguaguggaggauauaaucaaggcauaauagacuguuuaaucccacaagaauggauacaacauuucuaucaagaaagcgcaccaucucaaucugacguagcacuaauaagauacguaaacccagacaccggcagaacauuauucgaagcaaaacuacaucgaucaggauauauaaccguugcacacucuggagauuacccacucguagucccagccaacggccauuuuagauucgauucauggguaaaccaauuuuauucauuagcaccaaugggaacuggaaauggaagacguagagcacaauaa

SEQ ID NO: 33131 - RNA, 1623 nt, Artificial Sequence
  derived and/or modified sequence opt6 from major_capsid_protein__Norovirus__ALM98894
augaagauggcaucaaacgaugcagcacccucuaaugauggugcagcaggacuaguaccagaaggaaauaaugaaacauuaccacuagaaccuguugcaggagcagcaauugcagcacccguaacaggacaaaacaauauaauagacccauggauacgaacaaacuucguucaagcuccaaacggugaauuuacaguaucaccaagaaacucuccuggagaaauccuauuaaaccuagaacucggaccugacuuaaacccauacuuagcgcacuuaucacgaauguauaacggauaugcuggagguguugaaguccaaguauuacuagccggaaaugcuuucacugcaggcaaaauauuauucgccgcuguaccucccaauuuuccuguagaauucuuaucuccagcacaaauaaccauguuaccacacuuaauagucgauguaagaacccuagaaccuauaaugauaccccuaccagauguccgaaauacauucuuccacuacucaaaccaaccaaacucccgaaugagauuaguagccaugcuauacacuccauuaagaucaaauggaucaggcgaugacguauucacaguaaguugucgaguacuuacucgaccaacuccagauuucgaauucacauauuuaguaccaccaucaguagaaucuaaaacaaaaccauuuucacucccaauauuaacauuaucugaacucacaaacucaagauuuccaguaccaauugacucuuuauuuacagcccaaaacaauguacuacaaguacaaugccaaaauggaagguguacacuagauggugaauuacaaggaacaacacaacuacuuccauccggcauaugugcauuucgaggaagaguaacagcacaaauaaaucaaagagaucgauggcacaugcaauuacaaaauuuaaacggaacaacauaugacccuacagaugacguaccagcaccacuaggaacacccgauuucaaaggaguaguauucggaaugguuucacaaagaaauguaggcaaugaugcuccugguucaacaagagcacaacaagcauggguaucuacuuauagcccacaauucguaccaaaauuaggaucagucaaccuaagaauaucugauaaugaugacuuccaauuccaaccuacuaaauucacccccguagguguaaacgacgaugacgacggacauccauuuagacaaugggaauuaccuaauuacagcggagaauuaacacuaaacaugaauuuagccccuccuguugcaccaaauuuuccaggcgaacaauuauuauucuuuagaucauucguaccuuguagugguggcuauaaccaaggaauaauagauugccuaauaccacaagaauggauucaacauuuuuaucaagaauccgcaccuucacaaucugacguagcucuaauaagauacguaaauccagacacuggaagaacacuauucgaagcuaaauuacaucgaucaggcuauauuacagucgcacauucaggagauuacccauuaguaguccccgcaaacggacauuucagauucgacucauggguaaaccaauuuuauucacuagcuccaaugggaacaggaaauggacgcagaagagcacaauaa

SEQ ID NO: 33132 - RNA, 1623 nt, Artificial Sequence
  derived and/or modified sequence opt6 from major_capsid_protein__Norovirus__ALM98895
augaaaauggcaucaaaugacgcagcaccaucuaaugacggagcagcaggacuaguaccagaaggaaacaacgaaacuuuaccacuagaacccguagcgggagcugcuaucgcagccccagucacuggacaaaauaauaucauagauccauggauacgaacuaauuuuguacaagcaccaaauggcgaauuuacaguaucaccacgaaauaguccaggcgaaauauuauuaaacuuagaacuaggaccagaucugaacccauaucuugcacacuuaucacgcauguauaaugguuacgcaggaggaguagaaguacaaguauuauuagcuggaaaugcauuuacagcuggaaaaauauuauucgcggcaguaccaccuaauuucccuguagaauuucuauccccagcacaaauaacaaugcuaccucaccuaauaguagacgucagaacacuagaaccgaucaugauaccauuaccagauguacguaauacauucuuucacuauuccaaucaaccaaacucaagaaugagacucguagcaaugcucuacacaccacuaagaucuaauggcucaggugaugauguauuuacaguaucaugcagaguacucaccagaccuacaccagacuuugaauuuaccuauuuaguaccaccaucaguagaaucuaaaacaaaaccuuuuucccuuccgauauuaacacuaagugaauuaacaaauucuagauuccccguaccaauagacucuuuauuuacagcacaaaacaacguacuacaaguacaaugccaaaacggaagauguacacuugauggagaacuacaaggaaccacacaauuacuuccaucugguaucugcgccuuuagaggaagaguaacagcacaaauaaaccaaagagauagauggcacaugcaacuacaaaaucuaaauggaacaacauaugaccccacugaugacguaccagcaccauuaggaacaccagauuuuaaagguguuguauucggcaugguaucacaaagaaauguugguaaugacgcaccagguuccacaagagcacaacaagcaugggucucaacauacuccccacaauuuguuccaaaacuuggaucaguaaaucuuagaauaagugauaaugaugacuuccaauuucaaccuacaaaauuuacaccagucggaguaaaugacgaugacgacggacaucccuuucgacaaugggaauuaccuaacuauucaggagaacuaacauuaaacaugaaucuugccccgccugucgcaccaaauuuccccggagaacaauuacuauuuuuuagaucauucguaccuuguaguggaggauauaaccaaggaauaauagauuguuuaauaccucaagaauggauccaacauuuuuaccaagagucagcaccaucacaauccgauguugcauuaauacgcuacguuaauccagauacaggcagaacacuuuuugaagcaaaacuucauagauccggauauauaacaguagcacacucaggagacuacccacuaguaguaccagcaaacggucacuucagauuugacucauggguaaaucaauuuuacucauuagcuccaaugggaaccggaaauggaagaagaagagcacaauga

SEQ ID NO: 33133 - RNA, 1623 nt, Artificial Sequence
  derived and/or modified sequence opt6 from major_capsid_protein__Norovirus__ALM98896
augaaaauggcauccaaugacgccgcacccucaaaugacggagccgcaggcuuagucccagaaggaaacaaugaaacacucccacuagaaccaguagcaggagccgcuauagcagcaccaguaacaggacaaaacaauauaauagauccuuggauacgcacaaauuuuguacaagcuccaaacggagaauuuacaguaucaccaagaaacucuccaggagaaauauuacuaaacuuagaacuagguccagaucuaaauccauauuuagcacauuuauccagaauguauaacgguuaugcaggcgguguugaaguacaaguacuacuagcuggaaaugcauuuacagccggcaaaauauuauucgcagcaguacccccuaauuuucccguugaauuuuuaucucccgcacaaauaaccaugcuaccacaucucauaguagacguacgaacacucgaaccaauuaugauaccacuacccgacguaagaaauacauuuuuucacuauagcaaucaaccaaauucaagaaugagacuagucgcaaugcuauauacacccuuacgaucuaauggaucaggagacgauguauuuacaguaucaugcagaguuuuaacccguccuacaccggauuuugaauuuacauacuuaguaccaccuaguguagaaucaaaaacaaaaccauuuucuuuaccaauauuaacauuaucagaauuaacuaacucucgauuuccaguaccaauagacucauuauuuacagcacaaaauaacguacuacaaguucagugucaaaacggaagauguacccuagauggggaauuacaaggaacaacacaauuacuaccaacaggaauaugugcauuuagaggaagaguaacagcacaaauuaaccaaagagauagauggcauaugcaauuacaaaaucuaaauggcaccacuuaugauccaacagaugacguaccugccccacucggaacaccagacuucaaaggaguaguauucggaaugguaucacaaagaaacguaggaaaugacgcaccaggaaguacaagagcucaacaagcauggguaagcacauacucaccacaauucguuccaaaauuagguucaguaaauuuaagaaucucugacaacgacgacuuccaauuucaacccacaaaauuuacgccuguaggaguaaaugaugaugacgauggacauccauuuagacaaugggaauuaccuaacuauucaggagagcuaacauuaaauaugaacuuagcaccaccuguagcaccaaacuuuccaggagaacaacuacuuuuuuucagaucauucgucccauguuccggagguuacaaucaaggcauaauagacugcuuaaucccacaagaauggauucaacacuucuaucaagaaucagcacccagucaaucagauguagcacuaauaagauaugucaaccccgacacugguagaacauuauucgaagcaaaauuacaucgaucugguuauauuacuguagcacacucaggagauuaucccuuaguaguaccagcaaauggccacuuucgauucgauucaugggucaaucaauucuacucauuagcuccuaugggaacaggaaacggaagacgaagagcccaauag

SEQ ID NO: 33134 - RNA, 1623 nt, Artificial Sequence
  derived and/or modified sequence opt6 from major_capsid_protein__Norovirus__ALM98897
augaagauggcaucaaacgaugcagcaccuucaaacgacggagcggcaggacuaguaccugaagguaacaaugaaacucuaccauuagaacccgucgcaggcgcagcaaucgcagcacccguaacuggacaaaauaacauaauagacccauggauuagaacaaacuuuguacaagcccccaacggcgaauuuacuguaucacccagaaauucacccggugaaauacuacuaaaucucgaauuagguccagaucuuaacccauauuuagcacacuuauccagaauguauaacgguuacgcaggaggugucgagguacaaguacuauuagcaggaaaugcauucacagcagguaaaauucuauuugcugcagucccaccaaacuuuccuguugaauuuuuaucaccagcucaaauuacaaugcuaccucauuuaauagucgauguacgaacacuagaaccaauaaugauaccacuuccugauguaagaaauacuuucuuccauuauucaaaucaaccaaacucaagaaugcgacuaguagccaugcuuuacacuccuuuaagaucaaaugguuccggugacgauguauucacagucuccuguagaguuuuaacucgaccaacaccugacuucgaauucacuuaucucguaccccccuccgucgaaucaaaaacaaaaccauucucucuaccaauauuaacauuauccgaacuaacaaacucacgauuuccaguaccaauagacucacuauuuaccgcacaaaauaauguucuacaaguccaaugccaaaaugguagaugcaccuuagacggagaacuacaagguacaacucaacuauuaccauccgguauaugugccuuuagaggccgaguaacagcucaaauaaaucaacgagaucgauggcauaugcaacugcaaaauuuaaauggcacuacuuacgacccaacagaugacgucccugcuccacuaggcacuccagacuuuaaaggaguuguauuugguauggucucucaaagaaauguagguaaugacgcucccgguucuacaagagcacaacaagcauggguaucuacauauucaccucaauucgucccaaaacuaggauccgucaaucuaagaauaucagacaaugacgauuuucaauuucaaccuacaaaauucacaccaguagguguaaaugaugaugacgauggacauccauuuagacaaugggaacucccaaacuacucaggugaauuaacauuaaacaugaaccuugcaccuccaguagcaccaaauuuuccaggcgaacaacuauuauuuuuucgcuccuuugucccauguucaggugguuauaaucaaggcauuauagacugccuuauaccucaagaauggauacaacacuucuaccaagaaucagccccaucucaaucugauguagcauuaauccgcuauguaaacccagauacaggacgaacccuauuugaagccaaauuacaccgaaguggauacauaacaguagcucauuccggcgauuauccucuaguuguaccagcaaacggucauuuuagauucgauuccuggguaaaccaauuuuacucucuugcuccaaugggaacaggaaaugggcguagaagagcucaauaa

SEQ ID NO: 33135 - RNA, 1623 nt, Artificial Sequence
  derived and/or modified sequence opt6 from major_capsid_protein__Norovirus__ALM98899
augaaaauggcuucaaaugacgccgcacccucaaaugacggagcagcaggcuuaguaccagaaggaaauaaugaaacccuaccacucgaaccuguagcaggcgcugcaauagcagcuccaguaacaggacaaaauaauaucauagacccauggauacgcacuaacuuuguacaagcaccaaacggcgaauucacaguaucacccagaaauuccccaggcgaaauacuucuuaaccuugaauuaggcccggaccuaaacccuuaucuagcacacuuaucaagaauguauaacggauaugcuggagguguagaaguacaaguucuacuagcaggcaacgcauuuacagcuggcaaaauauuauucgcagccguaccaccaaacuuuccaguagaauuucuaaguccugcccaaauaaccaugcuuccacaccuaaucguagacguuagaacacuagaaccaauuaugauaccauuaccugacguaagaaacaccuucuuucauuauucaaaucaaccaaacucaagaaugagauuagucgcaauguuauacacaccauuaagaucuaacggaucuggagacgauguauuuaccguuucauguagaguacuaaccagaccuacaccagacuuugaauuuaccuauuuaguaccaccuucaguugaaucaaaaacaaaacccuucucacuaccaauacuuacacuaagcgaauuaacuaauaguagauuuccaguaccuaucgacagucuauuuacagcacaaaacaacguacuacaaguacaaugccaaaacggaagauguacacuugauggagaauuacaagguacaacacaauuacuaccaucaggcauuugcgcauucagaggacgaguaacagcucaaauaaaccaaagagaccgauggcauaugcaacuacaaaaucucaauggaacuaccuaugacccaacagaugauguuccagcaccucuaggaacaccagacuucaaaggaguagucuuuggaaugguaucacaacgaaacguaggaaacgacgcaccuggcucuacuagagcucaacaagcauggguaaguaccuauucaccacaauucguaccaaaacuaggauccgucaaccucagaauuucagacaaugaugacuuccaauuccaaccaacaaaauuuacaccagucgguguaaaugaugaugacgauggccacccuuuucgacaaugggaauuaccaaauuauucaggugaacuuacacuaaauaugaaucuagcaccuccagucgcaccuaacuucccaggagaacaacuucuuuuuuuuagaucauucguuccuugcuccggaggauauaaccaaggaaucauagauugccucauaccacaagaauggauucaacauuucuaucaagaauccgcaccuucacaaucugaugucgcacuaauaagauauguuaauccagacacaggacgaacauuauucgaagcaaaauuacauagaucaggauauauaaccguagcacacaguggugauuacccacuuguaguaccugccaacggacauuuccgauucgauucauggguaaaucaauuuuacucacuagcaccuaugggaacaggcaauggcagacgacgcgcacaauaa

SEQ ID NO: 33136 - RNA, 1623 nt, Artificial Sequence
  derived and/or modified sequence opt6 from major_capsid_protein__Norovirus__ALM98901
augaaaauggcauccucagacgccaauccaucagauggaucagcagcaaaucuaguaccagaaguuaauaacgaaguuauggcauuagaaccaguaguaggugcggcaauugcagcaccaguagccggacaacaaaauguaauagacccguggauaagaaauaauuuuguacaagcaccaggaggagaauucacuguaucaccaagaaaugcaccuggugaaauuuuauggucugccccauuaggaccagaucuuaauccuuaccuuucucauuuagcaaggauguauaauggauaugccggaggauuugaaguacaaguaauacuagcuggaaaugcauuuacagcaggaaaaguaauauuugcugccguaccaccaaauuuccccaccgaaggacuaucacccucacaaguaacaauguuuccacacauaguaguagauguacgucaacucgaaccaguauuaauaccccuaccagauguaagaaauaauuucuaucacuauaaucaaucaaaugacccaacaauuaaauuaauagcaaugcucuauacaccacuaagagcuaacaaugcaggagaugacguauucacaguuuccugcagaguucuaaccagaccuucaccagacuuugacuuuaucuuucucguaccaccaacaguagaaucaagaacaaaaccauuuucaguaccaguacuaacagucgaagaaaugacaaacucacgauucccaauaccucuagagaaauuauucacugguccaaguucugcuuuugucguucaaccacaaaacggacgaugcacuacagacggaguucuguuagguacaacucaacuaagcccagucaauauauguacauuucgaggugauguaacacacaucacuggcaguagaaacuacacuaugaaucuagcaucacaaaacuggaguaacuacgauccaacugaagaaauaccagcaccauuaggaacaccagauuucguaggaaaaauacaaggcguacuaacacaaacaacaagaacagauggcuccacacgaggacauaaagcaacaguauauacaggaucagcugacuuugcaccaaaauuagguagaguucaauuugaaaccgauaccgauagagacuuugaagccaaucaaaauacaaaauucacaccuguaggcguuauccaagacggaggcacaacacacagaaaugaaccacaacaauggguauuaccaucuuauuccggcagaaauacaccuaauguacauuuagcucccgccguagccccaacauuuccaggagaacaacuacuauuuuucagaucaacaaugccagguuguucaggauauccaaauauggaucuagauuguuuauuaccacaagaauggguacaauauuuuuaccaagaagcagcaccugcacaaucugauguugcccuucuaagauucguuaauccagauacaggaagaguacuauuugaauguaaacuucacaaaucagguuauguaaccgucgcccauacaggucaacacgaucugguuauaccuccuaacggcuacuuuagauuugauuccuggguaaaccaauuuuauacauuagcacccaugggaaaugguacagguagaagaagagcacuuuaa

SEQ ID NO: 33137 - RNA, 1623 nt, Artificial Sequence
  derived and/or modified sequence opt6 from major_capsid_protein__Norovirus__ALM98907
augaaaauggccucauccgaugcaaauccuucagacggaucagcugccaaccuaguaccugaaguaaacaacgaaguaauggcauuagaaccaguugucggugcugcaauagcagccccaguagcaggccaacaaaauguaauagauccauggauaagaaauaauuuuguucaagcgccagggggugaauucacagucagcccacgaaaugcaccaggagaaaucuuauggucagcaccacucgguccugauuuaaauccauaucuaucacaucucgcacgaauguauaacggauaugcuggaggauuugaaguacaaguaauacuagcaggaaaugcuuuuacugcaggaaaaguaauauuugcagcaguaccaccaaauuucccaacagaaggauuaucaccaucucaaguaacaauguuuccacacaucgugguagauguuagacaacuagaaccaguccuaauaccacuacccgauguacgaaacaacuucuaucacuauaaucaaucaaaugacccaacaauuaaauuaauagcaaugcuauauacuccacuacgugcaaacaaugcaggugacgacguauucacagucucaugccgcguacuuacaagaccuucuccagacuuugacuuuauauuucuaguacccccuacuguagaaucacguacaaaaccauuuucaguacccguuuuaaccguagaagaaaugacaaacucacgcuuuccuauaccucuagaaaaauuauuuaccggcccaucaucagcauuuguuguacaaccucaaaacgguagauguacuacagacgguguacuacuugguacuacacaauuaagcccaguaaacaucuguacauuuagaggcgauguaacucauauaacugguucacgaaauuauacuaugaaucuagcaucacaaaauuggucaaauuaugauccaacagaagaaauaccagccccauuaggaacaccagauuucguaggaaaaauacaaggaguauuaacccaaacuacaagaacagauggcucuacccgaggacacaaagcuaccguauacacaggaucugcugauuuugcaccaaaacuaggaagaguucaauuugaaaccgacacagaccgcgauuuugaagcuaaucaaaacacaaaauuuacucccguuggaguaauacaagaugguggaacaacacaucgaaaugaaccacaacaauggguacuaccuucauacucaggaagaaacauaccaaacguacaucuagcaccugcaguagcaccaacauucccaggugaacaacuacuauucuuuagaucaacaaugccaggaugcucaggcuacccaaacauggacuuagacuguuuacuaccacaagaauggguacaauauuuuuaucaagaagcagcaccagcacaaucagauguagcccuacuaagauucguaaacccugauacuggacgaguacuauuugaaugcaaacuacauaaaucaggauauguaacuguugcacacacaggacaacaugacuuaguaauaccaccuaaugguuauuuccgauucgauucauggguaaaccaauuuuauacacuagcaccuaugggcaauggaacuggaagaagaagagcccuauaa

SEQ ID NO: 33138 - RNA, 1623 nt, Artificial Sequence
  derived and/or modified sequence opt6 from major_capsid_protein__Norovirus__ALM98910
augaaaauggcaucuucugaugcaaauccauccgauggauccgcagcaaaccuugucccagaaguuaauaaugaaguuauggcccuagagccaguaguaggagcagcgauagcugcaccagucgcaggacaacaaaauguaauugauccauggauuagaaauaacuuuguacaagcuccuggaggagaauuuaccguaucaccaagaaaugcaccaggagaaauucuauggucugcaccauuaggaccagacuuaaacccauaccuaucacauuuagcaagaauguauaacggauacgcuggagguuucgaaguacaaguaauauuagcaggaaaugcauuuacugcaggaaaaguaauuuuugcagcaguaccaccaaauuuucccacagaaggacucucaccaucacaaguuacaauguuuccacacauaguagucgacguuagacaauuagaaccuguacuaauacccuuacccgauguaagaaacaacuucuaucauuauaaccaaucaaacgauccaacgauaaaauuaauugcuaugcucuacacaccucuuagagcaaacaaugccggagaugaugucuucacaguuucuuguagaguucuaacaagaccuuccccagacuuugacuuuauauuuuuaguuccaccaacaguagaaucccgaacuaaaccauucucaguaccagucuuaacaguagaagaaaugacuaauucaagauuuccaauccccuuagaaaaauuauuuacaggacccucauccgcuuuuguuguacaaccccaaaacggucgcugcaccacagacgguguccuacuaggaacaacacaacuaucacccguaaauauauguacauucagaggugacguaacucauauaacaggaucuagaaauuacacuaugaaccuugccucacaaaacuggucaaauuaugaucccacugaagaaaucccagcaccauuagguacaccagacuuuguaggcaaaauucaagguguauuaacacaaacaacucgaaccgauggauccacacgaggucauaaagcuacagucuauacaggcucagcagauuuugccccuaaacuuggacguguacaauuugaaacagauaccgaccacgacuucgaagcuaaccaaaauacaaaauucacaccaguaggaguaauacaagauggaggaacaacacauagaaaugaaccucaacaauggguauuaccaaguuauaguggaagaaacacaccuaacguacaccuagcacccgcaguagcuccaacauuuccuggagaacaauuauuauucuuuagaucaaccaugccaggauguucaggauacccaaauauggauuuagacugcuuacuaccacaagaauggguacaguauuucuaccaagacgcagcuccugcacaauccgacguugcauuacuaagauucguaaacccugacacaggacgaguauuauucgaauguaaacuacacaaaucuggauacguaacuguagcccacacaggucaacaugauuuaguaaucccaccaaaugguuauuuuagauuugacucauggguuaaccaauuuuacacuuuagcaccaauggguaaugguacuggacgcagacgugccuuauaa

SEQ ID NO: 33139 - RNA, 1623 nt, Artificial Sequence
  derived and/or modified sequence opt6 from major_capsid_protein__Norovirus__ALM98913
augaaaauggcaaguucagacgcaaauccaucugauggcuccgcugcuaaccuuguaccagaaguaaauaacgaaguaauggcacuagaaccugucguaggugcagcaauagcugcacccguagcaggacaacaaaauguaauagauccauggauaagaaauaacuuuguacaagcaccuggaggagaauuuacaguuucccccagaaaugcaccaggugaaauacuuuggucagccccuuuaggaccagaccuaaauccauaucucucacaucuugcaagaauguauaaugguuaugcagguggcuucgaaguacaaguaauucucgcaggaaacgcauuuacagcuggaaaaguaauuuuugcugcaguaccaccaaacuuuccaacugaagggcuaucucccucacaagucacaauguucccccauauaguaguugacguaagacaacuugaaccuguacuaauaccauuacccgacguaagaaauaauuucuaucacuauaaccaaucaaaugauccuaccaucaaauuaauagcuauguuauacacuccgcuucgagcaaauaacgcaggcgaugauguauuuacaguuuccugccguguccuaaccagacccucaccagauuucgacuuuauauuccuaguacccccaacaguugaaucaagaacaaaaccauuuucugucccuguauuaacuguagaagaaaugacuaacucuagauuuccaauucccuuagaaaaauuauuuacaggaccaucuucugccuuuguaguccaaccacaaaacgguagauguaccacugacgguguacuauuaggaacaacacaacuuucaccaguuaauauuuguacauuucgaggagacguaacacauauaacugguagccacaauuacaccaugaaucuggccucccaaaauuggucuaauuaugauccaacagaagaaauuccagcaccacuaggaacacccgauuuuguaggcaaaauacaaggaguucuaacacaaacaaccagaacagauggaucuacaagaggacauaaagcaacaguauauacagguucagcugauuucgcaccuaaacuuggaagaguacaauuugaaacugacaccgauagagauuucgaagcuaaucaaaacacaaaauucacaccaguagguguaauucaagauggaggaacaacucacagaaaugaaccacaacaauggguucuaccuucuuauucagguagaucaacuccaaacguucacuuagcuccagccguggcaccaacauuucccggugaacaacuacucuuuuuuagaucaacuaugccaggaugcucaggauauccaaauauggacuuagauugucuacuuccucaagaauggguacaauacuuuuaucaagaggcagcaccagcacaaucagauguugcauuacuaagauucguaaacccagacacaggccgcguacuauuugaaugcaaacuccauaaaucaggauauguaaccguagcacacacaggacaacacgaucuaguaauaccaccaaauggauauuuucguuuugacucauggguaaaccaauuuuauacacuagcaccuaugggaaauggcacagguagaagacgagccuuauaa

SEQ ID NO: 33140 - RNA, 1623 nt, Artificial Sequence
  derived and/or modified sequence opt6 from major_capsid_protein__Norovirus__ALM98916
augaaaauggccucaucugacgcaaacccaucagacggcucugcagcuaaucuuguaccggaaguaaacaaugaagucauggcuuuagaaccuguaguaggagcagcaauagcagcaccaguagcaggccaacaaaauguaauagacccuuggauuagaaacaacuuuguacaagcaccaggaggagaauucacaguaagccccagaaaugcaccaggagaaauacuauggagugcaccacucggaccagauuuaaacccauaucuaucacacuuagcuagaauguacaauggcuacgcaggaggauuugaaguacaaguaauacucgcaggaaaugcauucacagcuggaaaaguaauauuugcagcaguucccccaaauuuuccaacagaaggauuaucuccaucacaaguuacaauguucccacauauaguuguugacguaagacaacuugaaccaguccuaauaccucuaccagauguaagaaauaauuucuaucacuauaaucaaucaaacgaccccacaauaaaauuaauagcaaugcuauauacaccuuuacgagcaaacaaugcuggagaugauguauucaccguaucauguagaguacuaacccgaccaucaccugauuuugauuuuauuuuuuuaguaccaccaacugucgaaucaagaacaaaaccuuuuuccguaccagucuuaacaguagaagaaaugacaaacucaagauuuccuauaccucucgaaaaauuauucacagguccaucaucagcuuuuguuguucaaccacaaaauggaagauguaccacugauggagucuuacuaggaaccacccaacuaucaccugucaauaucuguacauuuagaggagacguaacucauauaacugguucuagaaacuauacaaugaauuuagcaucacaaaacuggucuaauuaugauccaacagaggaaauaccagccccauuagguacaccagacuuuguaggaaaaauacaaggaguucuaacacaaacaacccggacagauggcucaacccgaggacacaaagcaacaguauauacaggaucagcugacuuugcaccaaaacucggacgaguacaauuugaaacagauacagaucacgauuucgaagcuaaucaaaauacuaaauuuaccccaguaggaguaauacaagauggaggaacaacucacagaaaugaaccucaacaauggguacuaccaaguuauucuggacgaaauacacccaacguacauuuagcacccgcaguagcaccuacauuuccuggagaacaacuauuauuuuuucgaagcacuaugccaggauguucaggcuacccaaauauggauuuagauugcuuauuaccucaagaguggguacaauauuuuuaccaagaagccgcacccgcucaauccgacguagcacuucuucgauuuguaaauccagauaccggcagaguacuauuugaauguaaauuacacaaaucaggauacguaacaguagcacauacuggucaacacgaucucguaauuccaccaaauggauauuuucgauuugauucauggguaaaccaauuuuauacuuuagcaccuauggguaacggaacuggacguagaagagcauuauaa

SEQ ID NO: 33141 - RNA, 1623 nt, Artificial Sequence
  derived and/or modified sequence opt6 from major_capsid_protein__Norovirus__ALT54478
augaaaauggcaagcagugaugccaauccaucagauggcucagcagcaaacuuaguaccagaaguaaacaaugaagucauggcauuagaaccuguaguaggagccgcaauagcagcaccuguugccggacaacaaaauguaauagauccauggauccgaaauaauuucguacaagcacccggaggugaauucacagucucuccuagaaaugcaccuggagaaauacuauggucagcuccauuaggaccagaucuuaauccauaucucagucauuuagcaagaauguauaacggauaugccggaggauuugaaguacaaguaauucuagcaggaaaugcauuuacagcaggaaaaguaauauuugcagcaguaccaccaaauuuucccacagaaggacuaucacccucacaagucacaauguuuccucacauuguaguugacguaagacaauuagaaccuguacuaauuccauuaccugacguaagaaauaacuuuuaccauuacaaucaaagcaacgauccaacaauaaaauuaauugcaauguuauauacuccauuaagagccaauaaugcaggugaugaugucuuuacaguuucauguagaguccuuacacgaccauccccagacuuugacuuuauauuucuaguuccaccaacuguagaauccagaacaaaaccguucucuguuccagucuuaacaguagaagaaaugacaaauucaagguuuccaauuccauuagaaaaauuauuuacaggaccaucuagugcauucguaguacaaccacaaaacggacgauguacuacugacggaguccuuuuaggaacaacacaauuaucaccaguuaacauuuguacauuuagaggagauguuacacacauaacugguagccgaaacuauacaaugaaucuagcaucacaaaauuggucaaauuacgauccaacagaagaaauuccagcuccacuaggaacuccugauuucguugguaaaauacaaggaguccuaacucaaacaacuagagcagacggaucaacaagaggacauaaagccacaguauacacaggaagugcugauuuugcuccaaaacuaggcagaguacaauuugaaacugauaccgaucaugacuucgaagcuaaucaaaauacaaaauuuacaccuguuggaguaauacaagaugguggaacaacccacagaaacgaaccacaacaauggguacucccaucauauucaggacgaaacacaccaaauguacauuuagcaccagcuguagcaccaaccuuuccuggugaacaauuauuauuuuuuagaucaacaaugccugguugcuccgguuauccaaauauggacuuagauugcuuacuuccucaagaauggguucaauacuuuuaucaagaagccgcaccagcccaaagcgacguagcuuuacucagauuuguuaacccugacacaggaaggguucucuuugaaugcaaacuacacaaaucaggcuauguaacaguagcccauacaggucaacacgaccuaguaauaccaccaaauggcuauuuccguuucgauuccuggguaaaccaauuuuauacccuugcaccaaugggaaacggaacagguagacgacgagcccuauaa

SEQ ID NO: 33142 - RNA, 1617 nt, Artificial Sequence
  derived and/or modified sequence opt6 from major_capsid_protein__Norovirus__ALT54488
augaugauggcaucuaaagacgcaccaucaaauauggauggaacaucaggcgcaggacaauuaguuccggaaguuaacgcagcagaaccauuaccccuagaaccaguaguaggugcggcaacagcugcagcuacagcaggacaaguaaacaugauagauccauggauaaugaauaauuuuguucaagcaccagaaggagaauucacuauuucacccaacaauacuccaggagauauacuuuucgacuuaagauuagguccucauuuaaauccuuucuuauuacaccuaucacaaauguauaauggauggguaggcaacaugagaguaagaguaauguuagcuggaaaugcuuucucugccggaaaaauaauaauaugcugcguuccaccugguuuugaaucccaaaacauaucaauaggacaagcaacaauguuuccacauguaauagcagacguacgaguccucgagccuauagaaguaccucuugaugaugucagaaacguauuauuucauacuaacgaaaacagaccuacaaugagauuacuaugcaugcuauauacaccuuuaagagcaggaggcgcuucaucaggaacagauccuuuuguaauagcugguagaguacuaacauguccagcaccugacuuuaauuucuuauuccuuguaccaccaucagucgaacaaaaaacucgccaacuaacaaucccaaacauaccucuuaauaaccuugcaaauucuagaguaccagcuaugauuaauaaaaugacaguaucugcugaucaaaaccaaguaguucaauuccaaaaugguagaugcacacuagaaggacaauuacuaggaacaacaccuguaucugcaaaucagguagcaagaauccgugguaaaguauuuucaacaaacuccggaacaggauugaaucuaacagaaguagacggaacgcccuaucacgcuuuugaaucacccgcaccacuuggauuuccagauauaggaaacugcgacuggcacguuuaugcuuucaaaguuaaucaaaacacaggugauccaauguacagauuagauaucacccaaggaaauaguuucgcaccccacuuaggaucaauagaauucucaucugaaaaucauccaucaggcgaccaauuagguacacuaacuuggauaucuccauuaaauaacgcaaguagaguagacccuuggaaaauuccaacuuauggaaguacucuuacugaauccacaaacuuagcaccaccaauauuuccuccaggauucggagaaucaauaguauacuucaugucagauuuuccuauaguuuccggaaacacagcacaaauaccauguacacuaccacaagaauuugugagcucauuuguagaacaacaagcaccaauacguggagaagcagcauuauuacauuacguggauccugauacacacagaaaccuaggagaauuuaaacuuuauccagaugguuuuauaacuugugucccaaacacaggagguggaccacaaaauuuaccaucaaauggaguauuuguuuucucaucauggguaucaagauauuaucaauuaaaaccagucggcacaaccgguccaguccgaagauuaggaguacgaagagucuaa

SEQ ID NO: 33143 - RNA, 1620 nt, Artificial Sequence
  derived and/or modified sequence opt6 from major_capsid_protein__Norovirus__ALT54491
augaaaauggccuccaacgaugcuaacccaucagauggaagcgcagccaaccucgucccagaaguuaauaaugaaguuauggcucuagaaccuguaguaggagcagcaauugccgcacccguagcaggacaacaaaauguaauugaccccuggauuagaucuaacuuuguacaagcucccggaggagaauuuacaguaucaccuagaaacgcaccuggagaaauacuuuggucagcaccacucgguccugaccuaaacccauauuuaucgcacuuagcuagaauguauaauggcuacgcaggagguuucgaaguacaaguaauuuuagcaggaaaugccuuuaccgccggcaaaauaaucuuugcugcaguaccccccaacuuuccaacagaaggucuauccccaucccaaguaacaauguucccacauauaauaguagauguaagacaacuugaaccaguuuuaaucccucuaccagauguacgaaacaauuuuuaucauuacaaccaaucaaaagacucuacaauaaaacuaauagcaaugcuauacacaccauuaagagcuaauaaugcaggcgacgauguauucacaguaaguugccgaguacuaacuagaccaucacccgauuucgacuucauauuucuaguaccacccacagucgaauccagaacuaaaccauuuaccguuccaauuuuaacuguugaagaaaugacaaacucuagauucccaauaccccuagaaaaauuauuuacuggucccuccaaugcuuuuguaguacaaccacaaaacggaagauguacaacagacgguguccuauuaggaacaacacagcuaucaccuguuaauauauguacauuuagaggagacguaacacaaauugcuucaacccaaacauacacuaugaaccucgccucuuuaaacuggaauaauuaugauccaaccgaagaaauaccagcccccuuaggugcuccagacuuuaugggaaaaauacaaggaguauuaacccaaacaacaagacaaggagguucuacacgcggacacaaagcaacuguaucaacaggaucaguacauuuuacuccuaaacuagguucaguccgauucgauacagauacaaacaaugaucuacaaccacaucaaucuacaagauucacuccuguaggaguaauucaagauggagacacacaccaaaacgaaccacaacaaugggcauuaccauguuauucaggacgagacguaaauaauguacauuuagcccccgcuguagccccaucuuucccuggagaacaacuacucuuuuuccgaucuacuaugccaggauguagcggauauccuaauauggaccuagacuguuuacuaccacaagaauggguacaacauuuuuaccaagaagcagccccugcacaaucugauguagcauuacucagauuuguaaacccagauacaggaagaguauuauuugaaugcaaacuacauaaaucuggauacguaacuguagcacauacuggucaacauaaucuuguuaucccaccuaaugguuauuucagguuugacuccugggucaaccaauucuauacacucgcacccauggguaauggaacuggucgacgcagaguauuauaa

SEQ ID NO: 33144 - RNA, 1620 nt, Artificial Sequence
  derived and/or modified sequence opt6 from major_capsid_protein__Norovirus__ALT54494
augaaaauggcaucaaaugacgcaaauccaucagacggcucggccgcaaacuuagucccagaaguuaauaaugaaguaauggcacuagaacccguaguaggagcagcaauagcagcaccaguagcaggacaacagaaugucauagacccauggaucagaucaaauuuuguacaagcuccaggaggcgaauuuacaguauccccaagaaaugcacccggugaaauauuauggucugcaccacuaggaccagauuuaaacccauaccuaucacaucuugcaagaauguauaacggcuaugcaggcgguuuugaaguacaaguaauacuagccggaaaugcuuuuacagccgguaaaauaauuuucgcugcaguaccaccaaacuuuccaacagaaggacuauccccuucucaaguuacaauguuuccacacauaauaguugacguaagacaauuagaaccuguauuaaucccauuaccugauguaagaaacaauuucuaucauuacaaucaaaguaaagauagcacaauaaaauuaaucgcgauguuauacacaccucucagagcaaauaaugcuggagacgauguauuuacugucucauguagaguuuuaacaagaccaucaccagauuuugacuuuauauuuuuaguaccaccuacuguagaauccagaacaaaaccuuucacuguaccaauacuaacaguagaagaaaugacuaauuccagauuuccuauaccacuagaaaaacuauucacaggaccaagcaacgcauucguuguacaaccacaaaacggccgaugcacaacagacgguguacuauuaggaaccacacaauuaucaccaguaaauauuuguacuuuuagaggcgauguaacccaaauagcaucaacacaaaccuauacaaugaauuuagcaucccuaaauuggaauaacuaugauccaacagaagaaauaccugcaccauuaggagcuccagacuuuauggguaaaauacaggguguccuaacacaaacaacacgucaagacggcucaacaagaggccauaaagcaacgguaucaacaggcaguguucauuuuacaccuaaacuuggaucuguccgauuugauaccgacacuaauaauaacuuacaaccacaccaaucuacccgauuuaccccaguaggaguaauacaagauggagacacucaucaaaaugaaccacaacaauggguacuaccuuguuauuccggaagggacguuaacaacguacauuuagcaccagccguagcaccaucauuucccggcgaacaacuucucuucuuucgaucuacaaugccaggcuguaguggauauccuaauauggacuuagacugucuauuaccucaagaauggguacaacauuucuaucaagaagcugcaccagcccaaucagauguagcauuacuaagauucguuaacccagauacugguagaguauuauucgaauguaaauuacauaaaucaggauauguaacaguagcacacacaggacaacauaaucuugucauuccacccaauggauacuuuagauuugauaguuggguaaaucaauuuuauacauuagcacccauggguaauggaaccggaagaagacgagucuuauaa

SEQ ID NO: 33145 - RNA, 1620 nt, Artificial Sequence
  derived and/or modified sequence opt6 from major_capsid_protein__Norovirus__BAM65003
augaugauggcaucaaaagaugcaccaucaaauauggacggaacaucaggugcaggccaauuaguccccgaagucaacgcagcagaaccauuaccuuuagaaccaguaguuggcgcagcaacagcugcagcaacugcaggucaaguaaaucuaauagauccauggauuaugaacaauuuuguacaagcuccugaaggugaauuuacuauaucaccaaauaacacaccaggagacauauuauuugaccuacaauuagguccccauuuaaauccauucuuacaacaccuuucucaaauguacaauggauggguaggaaacaugagaguaagagugauguuagccggaaacgcauuuaccgcaggcaaaauuauaauuugcuguguaccaccagguuuugcaucacaaaauauaucaauaggucaagccacaauguuuccacacguuaucgcagauguaagaguccuagaaccuauagaaauuccuuuagaugauguacguaaugucuuauuucacaccaaugaaaacagaccaacuaugcgacuuuuauguauguuauauaccccacuacgugcaggcggagcuucuucuggaacagacccauucguaauugcaggacgcguauuaaccugcccuucaccagauuuuaauuucuuauuucuaguuccaccaucaguagaacaaaaaacacgccaacuaaccgugccuaacauaccacuuaauaacuuagcaaacucucguguaccagcaaugauaaauaaaaugacaguaucuacagaucaaaaccaaguaguacaauuccaaaacggccguugcacucucgaaggacaauuacuuggaacaacuccaguauccgccucacaaguagcaagaauacguggaaaaguauuuucaacagcaucugguaaaggauuaaaccuaacagaacuagacgguacaccauaucacgcauuugaaucaccagcaccauuaggcuuucccgauauaggcgcaugcgauuggcauguuucaacauuuaaaguagaucaaaacuuaucuggcgacccuaugucaagauuagauauaaaacaaaacgcccccuuugcaccacacuuaggaucuauagaauuuacaucagaucaagaaccaaccggcgaucaauuaggaacauuagccugggucuccccuucaacaucaggcgcaagaguagauccauggaaaaucccuucauauggaucaacaguuacugaauccacacaccuagcuccaccaauauuccccccuggauuuggagaagcaauaguuuauuuuaugucagauuuuccaauuguaucugguaauacagcucaaguuccauguacacuaccacaagaauucguaucacauuuuguugaacaacaggcacccauacgaggugaagcagcauuauuacauuacgucgauccugacacacauagaaaccuaggcgaauuuaaauuauaucccgauggauucauuacauguguaccaaauacaggaggaggaccucaaaaccuaccuauaaacggaguuuucguauuuuccuccuggguuucccgauauuaucaacuaaaaccagugggaacagcagguccagcgagaagauuagguguacgacgaguauaa

SEQ ID NO: 33146 - RNA, 1647 nt, Artificial Sequence
  derived and/or modified sequence opt6 from major_capsid_protein__Norovirus__BAM65005
augaaaauggcaucaaaugacgcagccccuucuaaugacggugcagcaggucuaguaccagaaauuaauaaugaagcaauggcacuagacccuguagcaggagcagcaauagcugccccacuaacaggccaacaaaauauaaucgaccccuggauaaugaauaauuucguacaagcaccaggaggcgaauuuacaguuucaccaagaaauucaccaggagaaguauuauuaaaucuagaacucggaccugaaauaaacccuuaucuagcccaccuagcaagaauguauaacggcuacgcaggaggauucgaaguacaaguaguucuagcaggaaacgcauucacagcaggaaaaauaauuuucgcugcaaucccaccaaauuucccaauugauaaccuauccgcagcgcaaauuacaauguguccacacguaauaguugacguacgacaauuagaaccaguaaaccuaccuaugccagauguacgaaauaacuucuuccacuauaaucaagggucagauagcagauuacgacuaauagcaauguuauacacaccauuaagagcaaauaacucuggcgacgacgucuucaccguguccugccgcguacuaacacgacccuccccugauuucucuuuuaauuuccuaguuccaccaacaguagaaucaaaaacaaaaccauuuacacuuccaauuuuaacaauaucagaaauguccaauucacgcuucccuguaccaauagacucucuccauacaaguccaacagaaaauauaguuguccaaugucaaaacggaagaguaacucuagauggagaacuuaugggaacaacacaauuauuaccaagucaaaucugcgcauuuagaggaguauuaaccagaucaacaucaagagcuagugaucaagcagauacagcaacaccaagauuauuuaacuauuacuggcacauucaacucgacaaccuaaacggaacucccuaugacccagcagaagacauaccagguccauuaggaacaccugacuucagaggaaaaguauuuggcguagcaucacagcgaaauccagauuccacuacaagagcucaugaagcaaaaguugauacuaccuccggacgcuucacacccaaacuugguucauuagaaauuucuaccgaaucuggugauuucgaccaaaaucaaccuacuagauucacaccagucgguauaggagucgacaaugaagcagacuuucaacaauggucauuaccagauuacucaggacaauucacucacaauaugaacuuagcaccagcaguagcaccuaacuuuccuggagaacaacuacuauuuuuucgaucacaacucccuucuucuggaggcagauccaaugguauauuagacugcuuagucccacaagaauggguacaacauuucuaccaagaauccgccccagcacaaacacaaguugcuuuagucagauauguaaacccugacacaggcagaguauuauucgaagcaaaacuacauaaacuaggauucaugacaauagcaaaauccggagauucuccaauaacaguaccaccuaaugguuacuuuagauuugaaaguuggguuaacccuuucuauacauuagcaccaaugggaacaggaaacggaagacguagaauacaauaa

SEQ ID NO: 33147 - RNA, 1644 nt, Artificial Sequence
  derived and/or modified sequence opt6 from major_capsid_protein__Norovirus__BAM65007
augaaaauggcaaguaaugaugcugccccaucaaaugauggggcugcaaauuuaguaccagaagcaaauaacgaaguaauggcacuagaacccguuguaggagcaucaauagcugcaccaguaguaggacaacaaaacauuauagacccauggauaagagaaaauuuuguacaggcaccacaaggggaauucacuguaagccccagaaauucaccaggagaaauguuacuaaacuuagaauuaggacccgaacuaaacccauacuuaucacaccuuucaagaauguauaauggauaugcaggaggaaugcaaguccaaguuguacuagcaggaaacgcauuuacagcuggaaaaauaauauuugcagcaguaccaccacauuuuccagucgaaaauauuucagcagcucaaauuaccauguguccucacgugauaguagacguaagacaacucgaaccaguucuacuaccacuaccagauauaagaaacagauuuuuucacuacaaccaagaaaauacaccucgaaugcgccuaguagccaugcuuuauacgccuuuaagagcuaauucaggagaagacguauuuacagucuccugccguguuuuaacaagaccagcaccagauuuugaauucacauucuuaguacccccgacagucgaaucaaaaacaaaacccuuuacauuaccaauauuaacacuuggagaacuaucaaauaguagguucccagcaccuauugauauguuauacacagacccaaaugaaggaauaguuguacaaccacaaaauggacgauguacauuagauggaacauuacaaggaacaacucaauuaguaccaacccaaauaugcgcguuuagaggcacacuuauaggacaaacaucaagaucaucagauucuacugauucagcaccacgcagacgagaucacccucuucauguacaacuaaagaauuuagauggaacucaauaugauccaacugaugaaguuccagcaguccuaggagcaauagauuuuaaagguaccguauucggaguagcaucccaaagagacguaucaggucaacaaguuggagcaacuagggcacaugaaguacacauaaauacaaccgaucccagauacacaccuaaauuagggaguauauuaaugcacucagaaucugaugauuuuguaacuggacaaccuguaagauucacaccuauaggaaugggagauaaugauuggcaccaaugggaauuaccagacuauucgggacauuuaacuuuaaauaugaauuuagccccagccgucgcuccagcauuuccaggcgaaagaauacucuucuuucgaaguaucguaccuucagcagguggauauggaucaggacaaauagauugucuaauaccacaagaauggguacaacacuuuuaucaagaagcagcaccaucacaaucugcaguugcacuaauaagauacguaaauccugauacaggacguaauauauuugaagcuaaacuacauagagaaggauucauaaccgucgcaaauaguggaaacaauccaauagucgucccuccaaauggauacuuucgauuugaagccuggguaaaucaauucuacacucuaaccccuaugggcacuggacaaggcagaagaagaaaucaauaa

SEQ ID NO: 33148 - RNA, 1623 nt, Artificial Sequence
  derived and/or modified sequence opt6 from major_capsid_protein__Norovirus__CCX28604
augaaaauggcaucuuccgaugcaaacccuagugaugguucaacagcuaacuuaguaccagaagucaacaacgaagucauggcucuagaaccaguagucggagcagcaauagcagcuccaguugccggacaacagaauguaauagauccauggauuagaaauaacuuuguccaagcaccuggaggagaauuuacaguaucacccagaaaugccccuggagaaauauuauggagugcaccuuuaggcccagaucucaauccauauuuaagucaccuagcaagaauguauaauggauacgcaggagguuucgaaguacaaguaauacuagcaggaaaugcuuuuacagcaggaaaaauaaucuucgcugcuguacccccaaauuuuccaacagaaggcuuaucuccaucucaaguuacaauguucccacauauaaucguagacguccgacaacucgaacccguauugauaccauuaccagauguaaggaauaacuuuuaccacuauaaccaaucaaaugacucuacaauaaaacuuauagcaauguuauacaccccauuaagagccaacaacgcaggugaugauguauucacagucagcuguagaguauuaacucgaccuucuccagauuuugacuuuauauucuuagucccaccaacaguagaauccagaacaaaaccauuuucaguccccguccuaacaguagaagaaaugaccaauucaagguuuccaauaccuuuagaaaaacuauuuaccggaccaucauccgccuucguaguacaaccacaaaacggaagauguaccaccgauggaguauuacucggcacaacccaacuuagcccaguaaauauauguacauuuagaggugacguaacucauauaccaggaucuagaaacuacacuaugaaccuagcaagucaaaauuggaacucauaugauccuacagaagaaauaccagcaccauuaggaacaccagauuuuguagguaaaauacaagguguauuaacccaaacaacaagaacaaauggaucaaccagaggacauaaagcaacaguuuauacaggaagcgccgauuuuucgccuaaauuaggaagaguccaauuugcuacugauaccgauaacgacuucgaaacaaaccaaaauacaaaauucacacccguagguguaauacaagauggauccacuacaccaagaaaugaaccccaacaauggguauuaccaucuuauucuggaagaaauauacauaacguucaccuugcaccagcaguagccccaacuuuuccuggagaacaauuauuauucuuuagaucuacuaugccaggauguucaggauaucccaauauggaucuagauugccuccuaccacaagaauggguucaauauuucuaucaagaagcugcacccgcucaaucagacguggccuuacucagauucguuaauccagacacaggaaggguucuauuugaaugcaaacuacauaaaucaggauauguaacugucgcacauacaggccaacaugaccucguaaucccaccaaauggauauuuccgauuugacucauggguaaaucaauuuuacacauuagcuccaaugggcaacggaacaggaagacgaagagcucucuaa

SEQ ID NO: 33149 - RNA, 1623 nt, Artificial Sequence
  derived and/or modified sequence opt6 from major_capsid_protein__Norovirus__CCX28607
augaaaauggccucaucagacgccaauccauccgauggaucaacagcuaacuuaguacccgaaguaaacaaugaaguaauggcacuagaacccguagucggcgcagcuauagcagccccaguagcaggacaacaaaauauaauagaucccuggauaagaaacaacuucgugcaagcaccaggcggagaauuuacuguuagccccaggaaugccccaggagaaauacuauggucagccccucuagggcccgaccuaaauccauacuuaucacacuuagcaagaauguacaacggauacgcaggaggauuugaaguacaaguaauauuagcaggaaacgccuuuacagcuggaaaaauaauuuucgcagcaguucccccaaacuucccaacagaaggacucagcccaucccaaguaaccauguuuccacauauaauaguagacguuagacaacuagaaccaguacuagucccccuaccagauguaagaaacaauuucuaucauuacaaccaaucuaaugauccaacaauaaaacucauagcaaugcuauacacaccacuaagagccaauaaugcaggugaugauguauuuacaguaucauguagaguacuaacaagaccaagcccagacuucgauuucauauuucuaguaccaccuacaguugaaucccgaacaaaacccuucuccguaccuauucuaacagucgaggaaaugacuaacucaagauuucccauaccauuagaaaaacuauuuacagguccuucuucagcauucgucguacaaccucaaaacggaagauguacaacagauggagucuuacuaggaaccacucaacuuucaccagucaacauauguaccuuucgaggugacguaacacauauagcaggcagcagaaacuacacaaugaaucuagcaucacaaaauuggaacucuuacgaucccacagaagaaaucccagccccauuaggaacaccagauuuuguagguaaaauucaagguguacucacacaaacaacuagaacagacggauccacucgaggacacaaagcaacaguauauacaggauccgcagacuuuucaccuaaacuuggaagaguacaguucgcuacagacacugauaacgauuuugaagcaaaucaaaauacaaaauucacaccaguuggcguuauccaagacggaucuacugcacauagaaaugaaccacaacaauggguacuuccaagcuauucaggaagaaacauacauaauguccaucuagccccagcaguagcucccacuuucccuggagaacaauuauuauuuuuccguucuacaaugccaggaugcucaggauacccaaauauggaucuugacugcuuauuaccucaagaauggguacaauacuuuuaucaagaagcagcaccagcacaaucagacguagcauuauuaagauuugucaacccagacacaggaagaguauuauucgaaugcaaacuacauaaaccaggauacguuacaguagcacauacaggacaacacgaucuaguuaucccacccaauggauauuucagauucgauucauggguaaaucaauucuacacacuagcuccgauggguaauggaacagguagacgacgcgcauuauaa

SEQ ID NO: 33150 - RNA, 1623 nt, Artificial Sequence
  derived and/or modified sequence opt6 from major_capsid_protein__Norovirus__CCX28619
augaaaauggcuucaagugacgcuaacccauccgaugguucaacagcaaacuuaguacccgaaguaaauaaugaaguaauggcacuagaaccuguaguuggagcagcaauagcagcaccuguagcaggacaacaaaauguaaucgacccauggaucagaaauaacuuuguacaagcaccaggaggagaauucacaguuucacccagaaaugccccaggagaaauuuuaugguccgcaccauuaggacccgauuuaaauccuuacuuaucacacuuagcaagaauguauaacggauaugcuggaggauuugaaguacaaguaauuuuagccggaaacgcauuuacugcagguaaaauuauauucgcagcaguaccuccaaacuucccaacugaaggauuaucaccaucucaaguuacaauguucccucacauaauaguagacguaaggcaacuagaaccaguacuaauaccccuacccgauguaagaaacaauuucuaucacuacaaucaaucaaacgaccccaccauaaaacuaauugcuauguuauacacaccauuaagagcuaauaaugccggagacgacguauuuacuguaucauguagaguacuaacaagaccuaguccagacuuugacuuuauauuuuuaguacccccaacuguagaaucacgaacuaaaccauucucagucccaauacuuacaguugaagaaaugacaaauucuagauucccuauaccauuagaaaaacuuuucacaggaccaucuucugcauucguaguacaaccccaaaacggaagauguacaacugacggaguacuauuaggaacaacucaauuauccccaguaaauauauguaccuuuagaggagacguaacccauauaccagguagucacaauuacacaaugaacuuagcaucacaaaauuggaauucauacgauccuacagaagaaauaccugcuccacuaggaaccccagacuuuguagguaaaauucaagguguccuaacucaaacaacuagaacuaaugguucuacaagaggacauaaagcaacaguuuacacaggaagugcagauuucuccccaaaacuaggaagaguacaauucgcuacagacacagacaacgacuuugaaacaaaccaaaauacaaaauucacacccguagguguuauacaagacggcucaacaacaccuagaaacgaaccacaacaauggguacucccaagcuacucaggaagaaacauacauaacguccacuuagcuccugcuguagcaccaaccuuccccggagaacaauuacuauuuuuucgaucaacaaugccagggugcucaggcuauccaaacauggaucuagauuguuuacuaccacaagaauggguucaauacuucuaccaagaagcagcaccagcucaaucagacguagcccuacucagauucguaaauccagacacuggucguguacuuuucgaauguaaacuacauaaaucagguuacguuacagucgcacacaccggacaacacgaucucguaauaccaccaaauggcuauuucagauucgacaguuggguaaaucaauuuuacacauuagcaccaaugggcaacggaaccggcagaagacgagcacuuuaa

SEQ ID NO: 33151 - RNA, 1623 nt, Artificial Sequence
  derived and/or modified sequence opt6 from major_capsid_protein__Norovirus__CCX28622
augaaaauggcaucaucugacgcaaauccaagcgaugguucaacagcaaaucuaguaccagaaguuaauaaugaagucauggcccuagaaccuguaguaggagcugcaauagcagcaccgguagccggacaacaaaacguaauagauccauggauacgaucaaacuuuguacaagcaccuggaggagaauucacaguaucucccagaaaugcaccaggagagauauuauggucugcuccacuaggaccagaucucaacccauaucuaucacacuuagcaagaauguauaacgguuacgcaggaggcuucgaaguccaaguaauacuugccggcaacgcauuuaccgcaggaaaaauaaucuucgcagcuguaccacccaacuuuccaacagaaggccuaucccccucacaaguaacaauguuuccucacaucauaguagacguuagacaacuagaaccaguuuuaauaccacuuccagaugucagaaacaauuucuaucauuacaaccaaagcaaugauccaacaauuaaauuaauagccauguuauauacaccacuaagagcaaacaaugccggugacgacgucuucacaguuuccuguagaguauuaacaagaccuucuccagacuuugacuucauauuucuagucccaccaacaguagaaucaagaacuaaaccuuucucuguaccaguacuaacaguugaagaaaugacaaacuccagauuucccauaccacuugaaaaauuauuuacuggaccuuccucagccuucguuguacaaccucaaaauggucgauguacaacagacggaguauuacuaggaacaacacaacucucaccaguaaauaucuguacauuuagaggcgacguaacacauauuucaggaucaagaaauuacacaaugaacuuagccgcacaaaauuggaacucauaugauccaacugaagaaaucccugcuccacuuggaacaccagacuuuguagguaaaauacagggcguauuaacucaaacaacaaaaacuaauggaucuacuagaggacacaaagcaacagucuauacaggauccgcagauuuuaguccaaaauuaggaagaguucaauuugcuacugauacugacaacgauuuugaaaccaaccaaaauacuaaauuuaccccaguaggaguaauacaagacggauccacaaccccacgcaaugaaccacaacaauggguauuaccuucuuauagcggaagaaacacccauaauguacaccuugcaccagcuguagccccaacuuuuccuggugaacaacuuuuauuuuuucgcucaaccaugccugguugcucagguuacccuaacauggaucuagacuguuuacuaccacaagaauggguacaauauuucuaucaagaagcagcccccgcccaaucugacguagcccuauuaagauucguaaauccagacacuggccguguacuauuugaaugcaaacuccacaaaucaggauauguaacaguagcucauacgggacaacaugaccuaguaauaccaccaaacggauacuucagauucgacaguuggguaaaccaauuuuacacacuagcaccaaugggaaauggaaccggaagaagacgagcucuauaa

SEQ ID NO: 33152 - RNA, 1623 nt, Artificial Sequence
  derived and/or modified sequence opt6 from major_capsid_protein__Norovirus__CCX28625
augaaaauggcauccucagacgcaaacccaagcgauggaucaacugcaaaccuaguuccagaaguaaacaaugaaguaauggcacuagaaccaguaguaggagcagcaauagcugcuccagucgcaggccaacaaaacgucaucgacccuuggauacgcaauaacuuuguccaagcaccaggaggcgaauuuacaguauccccacgaaaugcaccaggagaaauacuuugguccgccccauuaggacccgauuuaaacccauacuuaucucaccuagcacgaauguauaauggauacgcagggggauuugaaguacaaguaauauuagcaggaaaugcauuuacagcaggcaaaauuauauuugcagcaguacccccaaauuuuccaacagaaggucuaucuccuucucaaguaacaauguucccacauauaauaguagauguaagacaacuagaaccaguauuaauuccauuaccagacgucagaaacaauuuuuaucacuauaaccaaucaaacgauccuacaauuaaauuaauagcaaugcuuuacacuccacuaagagccaauaacgcaggugacgauguuuucacaguaucaugucgcguacuaacaagaccaucucccgacuuugacuuuauauuucuaguacccccuacagucgaaucacgaacaaaaccuuucuccguuccaauacuuacaguugaagaaaugacuaacucaagauuucccauaccccuagaaaaacuauuuaccgguccaucaucagcauuuguaguacaaccacaaaacgguagauguaccacugacggaguccuuuuaggaacaacucaauuauccccuguuaauauauguacauuuagaggagacguuacccauauaccuggcucacacaauuauacaaugaaucuugcaucacaaaacuggaacucuuacgacccaacagaagaaauaccugccccauuagguacaccugacuuugucggaaaaauucaaggaguccuaacacaaacaaccagaacaaacggaucuacaagaggccacaaagcaacaguauauacuggaucagcagacuucuccccaaaacuaggacgaguacaauuugcaacagauacagauaacgauuucgaaaccaaccaaaauacaaaauucacucccguagguguuauacaagacggaagcaccacaccaagaaaugaaccacaacaguggguacuaccaucauacucaggucguaauauacauaauguucauuuagcaccagcaguagcaccaaccuuucccggugaacaacucuuauucuuucgauccacaaugcccggaugcucaggauauccaaauauggacuuagauugccuauuaccucaagaauggguacaauauuucuaucaagaagcagcaccagcacaaucugacguagcccuacuaagauuuguuaauccagacacuggaagaguacuauucgaauguaaacuucauaaaucuggauacgucaccguugcacacacuggacaacaugaccucguaauaccacccaacggauacuuucgauuugauagcuggguaaaccaauuuuacacacuagcaccaauggguaauggaacaggaagacgacgagcauuauaa

SEQ ID NO: 33153 - RNA, 1623 nt, Artificial Sequence
  derived and/or modified sequence opt6 from major_capsid_protein__Norovirus__CCX28628
augaaaauggcuucaucagacgcaaacccaucagauggcucaaccgcaaaucuuguaccagaagucaauaaugaagucauggcacucgaaccuguaguaggagcagccauagcagcaccaguagcaggacaacaaaaugucauugacccauggauaagaucaaauuuuguccaagcaccgggaggugaauuuaccguauccccacgaaaugcacccggagaaauacuauggucagcaccauuaggaccagacuuaaauccuuaucuuucacacuuagcacgaauguauaacgguuaugcuggagguuuugaaguacaaguaauacucgcaggaaaugcauuuacagcaggaaaaaucauauucgcagcuguuccuccaaacuuccccacagaaggacucucaccaucacaagucacaauguuuccacauauaauaguagacguaagacaacuagaacccguauuaauaccacuuccagacguaagaaacaacuucuaucacuacaaccagucaaaugauccaacaauaaaauuaaucgcuaugcuuuacacaccacuaagagcaaacaacgccggagacgauguuuucacaguuaguuguagaguacuaacuagaccaucaccugacuuugacuuuaucuucuuaguuccaccaacaguagaauccagaacaaaaccauucucaguuccaguacuaacaguugaagaaaugacuaacucacgauuuccaauuccccuugaaaaacucuuuacagguccaucuucagccuucguaguacaaccucaaaacgguagaugcacuacugacggaguauuacucggaacaacccaauuaucaccaguaaauauaugcacuuuccguggagacguaacccacauaucaggaaguagaaauuacacuaugaauuuagcagcacaaaacuggaauucauacgacccaacagaagaaauaccagcaccacuaggaacaccagacuuuguaggaaaaauucaaggcgucuuaacucaaaccacaaaaaccaacggaucuacacgcggucacaaagcaacuguguacacaggauccgcagauuuuucaccgaaauuagguagaguucaauucgcaacagauacagacaaugauuucgaaaccaaucaaaauacaaaauucacaccaguuggaguaauccaagauggaucaacaacaccaagaaaugaaccacaacaauggguauuaccuucuuacuccggaagaaauacccacaacguacaccuagcacccgcaguagccccaacuuucccaggugaacaacuauuauucuuuagauccacaaugccaggauguucaggauauccaaauauggauuuagauugcuuauuaccacaagaauggguacaauauuuuuaccaggaagcagcacccgcucaaucagacguagcacuacuaagauucgucaaucccgauacaggacgaguauuauuugaaugcaaauuacauaaauccggauacguaacuguagcccacacuggacaacaugaucuaguaauuccacccaauggauauuucagauucgauaguuggguaaaucaauuuuacacucuagcaccaaugggaaacggaaccggaagaagaagagcucuauga

SEQ ID NO: 33154 - RNA, 1623 nt, Artificial Sequence
  derived and/or modified sequence opt6 from major_capsid_protein__Norovirus__CCX28631
augaaaauggcaucaucagaugcuaacccaucagauggauccacagcaaauuuaguaccugaaguaaacaacgaaguuauggcucucgaaccaguaguaggagcagccauagcagcaccagucgcaggacaacaaaaugugauagacccauggauacgaaauaacuuuguacaagcuccuggaggcgaauuuacaguuucaccaagaaaugcaccuggagaaauauuaugguccgcaccauuaggcccagaucuuaauccuuauuuaagccacuuagccagaauguauaacggauacgcuggaggauucgaaguacaaguaauacuugcaggaaaugcauucacagcaggaaaaaucauuuucgcagcagucccaccaaauuuuccaacagaaggauuauccccaucucaaguaacaauguucccucauauaaucguagacguacgacaauuagaaccaguacuaauuccccuuccagacguaagaaacaacuucuaucacuauaaccaaucaaaugacucaacaauuaaacucauagcaauguuauacacaccacuaagagcaaacaaugcaggcgaugacgucuuuacaguaucuuguagaguucuaacaagaccaucccccgacuuugauuuuauauuucucguucccccaacaguagaaucucguacaaaaccuuucuccguaccuguacuuacaguagaagagaugacaaacucuagauucccaauaccacuagaaaaauuauuuacaggaccaucaucagcauucguuguacaaccacaaaacggucgaugcacaacagacggaguauuacuagguaccacccaauuaucaccaguaaacauauguaccuuccguggggacguaacacacauaccaggaucgcgaaauuauacuaugaaucuagcaucccaaaauuggaacucauaugacccaacugaagaaauaccagcucccuuaggaaccccagacuuuguagguaaaauccaaggaguauuaacacaaacaacccguacuaacggaucuacaagaggacauaaagcaacaguauacacaggaucagcagacuuuucacccaaauuaggaagaguacaauucgcuacagauaccgacaacgauuuugagaccaaucaaaacacuaaauucaccccuguaggaguuauacaagacggaucuacaacuccuagaaaugaaccccaacaauggguauuaccaucauauucagguagaaacauacacaauguacauuuagcaccagcuguagcuccaacauuuccuggugaacaacuauuauuuuuuagaucaacaaugcccggcuguuccggauauccaaauauggacuuagacugucuauuaccacaggaguggguacaauauuuuuaccaagaagcagcuccagcccagucagacguagccuuauuaagauucguaaaccccgacacuggcagaguacuauucgaaugcaaacuacauaaaucuggauacguaaccguagcucauacaggacaacacgaccuaguaauaccuccaaauggauauuuuagauucgacuccuggguaaaucaauuuuacacacuagcaccaaugggaaauggaacaggaagaagacgagcccuauaa

SEQ ID NO: 33155 - RNA, 1623 nt, Artificial Sequence
  derived and/or modified sequence opt6 from major_capsid_protein__Norovirus__CCX28634
augaaaauggcuucaucugaugcaaacccaagugacggaucaacugcaaaccuuguaccugaagucaauaaugaagucauggcauuagaaccuguaguaggagcagccaucgccgcaccaguagcaggucaacaaaauguaaucgacccauggaucagaaacaauuuuguucaagcaccugguggugaauuuacugucucaccacgaaaugcacccggagaaauccuauggucagccccauuaggaccagacuuaaauccauaucuaucacacuuggcccgcauguauaauggauaugcaggaggauucgagguccaaguaauauuagcaggaaaugcauuuacagcaggaaaaauaauuuucgcagcugucccuccaaacuuuccaaccgaaggccucucaccaucacaaguaaccauguucccucauauaauugucgauguaagacaacuagaaccaguauuaauaccacuaccugauguacgaaacaacuucuaucauuauaaccaaucaaaugauccaacaauaaaacuaauagcuauguuauacacaccucuacgagcaaauaaugcuggagacgacguauucacaguauccugcagaguauuaacaagaccuuccccagacuuugacuuuauauuuuuaguaccuccuacaguagaaucaagaacaaaaccuuucucaguaccaauccuuacaguagaagaaaugacuaacucaagauucccaauacccuuagaaaaacuauuuacaggaccaucuucagcauucguaguacaaccacaaaauggacgauguaccacagacggaguauuacuaggaacaacucaauuauccccugucaauauauguacauuuagaggagacguaacacauauuccaggcucacacaacuacacaaugaaucucgcaagccaaaauuggaacucuuaugacccaacugaagaaauaccugccccacuaggcacaccagacuuugucggaaagauucaaggaguacuaacacaaaccacuagaacuaauggaagcacucgaggacacaaagcaacaguauauacagguucagcagacuuuucuccuaaacucgguagaguacaauuugcaacagauacagauaacgacuucgaaacaaaccaaaauacaaaauucacaccaguaggaguuauucaagaugguaguacuacccccagaaaugaaccucaacaauggguacucccaagcuauuccggaagaaacauacauaauguccaccuagcacccgccguagcaccuacauuuccaggugaacaacuauuauuuuuuagaucuacaaugcccggauguucaggauacccaaauauggaucuagauugccuauuaccacaagaauggguacaauacuuuuaucaagaagcagcuccugcucaaucagauguugcacuuuuaagauucgucaacccugacacuggcagaguauuauuugaaugcaaacuacacaaauccggauauguaacuguagcacacaccggacaacaugauuuaguaaucccgccaaauggauauuuuagauuugacucauggguaaaccaauuuuauacacuagccccuaugggaaauggaacuggcagaagaagagcucuauaa

SEQ ID NO: 33156 - RNA, 1623 nt, Artificial Sequence
  derived and/or modified sequence opt6 from major_capsid_protein__Norovirus__CCX28637
augaaaauggcauccucugaugcuaacccaucagauggaaguacagcuaacuuagucccugaaguuaauaaugaaguuauggcuuuagaaccaguagucggugcagcaaucgcagcaccuguagcuggacaacaaaauguaauagacccauggauaagaucaaacuuuguacaagcuccaggaggugaauuuacagucucaccaagaaacgcaccaggagaaauauuauggucugcaccacuaggccccgaucuaaauccauaccuaucacacuuagccagaauguauaacggcuacgccggagguuucgaaguucaaguaauucuagcuggaaaugccuuuacagcaggaaaaauuauauucgcagcaguaccucccaauuuuccaacagaaggacuaucuccaucucaaguaacaauguucccacauauuauuguagauguaagacaacuagaaccaguacuaauaccauuacccgacguucgcaauaauuucuaccacuacaaucaaucaaaugacucaacaauaaaacuaauagcaauguuauacacaccauuacgagcaaauaaugcuggagacgaugucuuuacaguaucaugucgaguacuuacaagaccuaguccagacuuugauuuuauauuccuaguuccuccaaccgucgaaucacgcacaaaaccuuuuucaguaccaguauuaacaguugaagaaaugacaaauucuagauuuccaauaccucuagaaaaacuauucacuggaccaucuucugcauucguuguucaaccacaaaaugguagguguaccacugauggaguacuauuaggaacaacccaacuaucuccaguaaauauaugcacuuuucgaggcgauguaacacacauaucuggaucaagaaacuauacaaugaaucuagcuucacaaaacuggaacucauacgauccaacagaagaaauaccagcaccccuaggaacaccagauuuugucgguaaaauacaagguguacuuacacaaacuacaaaaacuaauggaucaacacgaggacacaaagcaacuguauacacagguucagcagauuucucaccaaaauuaggacgaguacaauucgcaaccgacacagauaaugauuuugaaacaaaucaaaacacaaaauucacaccagucggaguaauccaagacggcuccacuacacccagaaacgaaccacaacaauggguacuaccaucauauuccggaagaaauacccauaacguccaucuagccccagcaguggccccuaccuuucccggagaacaacuacucuuuuucagaucaacaaugccaggcuguucaggauauccaaauauggauuuagauugucuauuaccacaagaauggguacaauauuucuaucaagaagcagccccagcucaaucagauguagccuuacucagauucguaaaccccgacaccggacguguauuauuugaauguaaacuacauaaaucaggauacguaacuguagcucauacaggacaacacgauuuaguaauaccaccuaauggauacuucagauuugauuccugggucaaccaauuuuacacacuugcaccaaugggcaauggaacaggacgaagacgugccuuauaa

SEQ ID NO: 33157 - RNA, 1623 nt, Artificial Sequence
  derived and/or modified sequence opt6 from major_capsid_protein__Norovirus__CCX28640
augaaaauggcaucuucagacgccaauccaucagacggaucaacagcaaauuuaguuccagaaguaaacaaugaaguaauggcacuagaaccagugguaggagcagcaauagcagcaccaguagcaggacagcaaaauguaauagauccauggaucagaaauaauuucguucaagcaccaggaggagaauuuacugucuccccgcgaaacgcaccaggcgaaauucucuggucagcuccacuaggaccagacuuaaacccauaucuaucucaccuagcaagaauguauaacggauaugcaggaggauucgaaguucaagucaucuuagcagguaaugcauucaccgcaggcaaaauaauauuugcagcaguaccuccaaauuuuccaacugaaggauuaucaccaucacaaguaacuauguucccacauauaauuguugacguacgacaauuagaaccuguucuaauaccccuucccgaugucagaaauaauuuuuaucauuacaaucaaucaaaugauucaacaauuaaacuaauagcuauguuauacaccccauuacgcgccaacaaugccggagaugacgucuuuacuguuuccuguagaguucuuacccgcccaucccccgauuuugacuucauauuucuaguaccaccaacuguagaaucaagaacaaaaccauuuucaguaccaguucuaacugucgaagaaaugacaaauagccgauuuccaauaccccucgaaaaauuauucacagguccuucauccgcauuuguaguacaaccucaaaacggucguuguacaacugacggcguccuacuuggaacuacucaacuaucuccagucaauauauguacauuucgaggugacgucacccauaucccaggaucacgaaauuacacaaugaaccuagcaucacaaaauuggaacucauaugauccuacagaagaaauaccugcaccucuagguacuccagacuuugucggaaaaauacaaggaguuuuaacacaaacaacaagaacaaacggauccacucgaggacacaaagccacaguauauacaggaucggcagacuucuccccaaaauuaggcagaguacaauucgcaacagacacagacaaugauuucgaaacaaaucaaaauacuaaauuuaccccaguaggagucauacaagacggaucuacaacaccaagaaaugaaccacaacaauggguacucccuucuuauucaggucgaaacauacauaauguacaucuagccccagccguagccccaaccuuuccuggagaacaacuucuauuuuuucgaucaacaaugccuggaugcucaggcuauccaaacauggauuuagauuguuuauuaccacaagaauggguacaauauuuuuaccaagaagcugcaccugcacaaucugacguugcccuauuaagauucguaaauccagauacaggacgcguacuauuugaaugcaaacuacauaaaucaggauauguaacuguagcccauacaggacaacacgacuuaguaauuccaccuaacgguuacuucagauuugacucaugggugaaucaauuuuacacuuuagcaccaaugggaaaugguacaggaagaagacgagcuuuauaa

SEQ ID NO: 33158 - RNA, 1623 nt, Artificial Sequence
  derived and/or modified sequence opt6 from major_capsid_protein__Norovirus__CCX28643
augaaaauggcuuccuccgaugcuaacccaucagacggaucaacagcaaaccuagucccugaaguaaacaacgaagucauggcauuagagccaguagucggagcagccauagcagcaccaguagcaggacaacaaaauguuaucgacccuuggauaagaaauaacuuuguucaagcaccaggcggcgaauuuacaguuucuccacgaaacgcaccaggagaaauucuauggucugcaccuuuaggaccagacuuaaauccauauuuaucucacuuagcaagaauguauaauggauacgcaggaggauucgaaguacaaguaauauuagcaggaaaugcuuuuacagcaggaaaaauaauauuugcagcaguuccaccaaauuuuccaacagaaggauuaucaccaucacaagucacaauguucccacacauaauaguugacguuagacaacuugaaccaguuuuaauaccauuaccagauguucgaaauaauuucuaccacuauaaucaaucaaaugauccaaccauaaaauuaauagccaugcuuuacacaccauuacgagcaaauaacgcaggagaugaugucuucacaguuucaugcagaguacuaacccgaccaucuccagacuucgacuuuauauuucuaguaccaccaaccguagaaucaagaacuaaaccuuucucaguaccaauacuaacaguagaagaaaugacaaacucaagauucccaauacccuuagaaaaacucuuuacaggacccucuucagcuuucguaguccaaccccaaaauggaagauguacaacugacggaguauuauuaggaacaacacaacuaucuccagucaauauaugcaccuuuagaggagacguaacccacauaccaggaucccacaacuauaccaugaaucuagcuagccaaaacuggaacuccuacgaucccacugaagaaaucccagcuccacuaggaacacccgauuucguagguaaaauacaaggaguauuaacacaaacaacaagaacaaacggaucaacaagaggucauaaagcaacaguauacaccgguagugcagacuuuuccccaaagcuaggacgaguccaauucgcaacagacacagauaacgauuuugaaacaaaccaaaacacaaaauuuacaccaguaggaguaauccaagacggaucaacaacaccaagaaaugaaccacaacaauggguacuaccauccuauagcgguagaaauauacacaacguacaucuugcaccugcaguugcaccuaccuuuccuggggaacaauuacuauuuuuucguucaaccaugccaggaugcucuggauauccuaauauggauuuagacugccuacucccacaagaauggguacaauauuucuaccaagaagcagcaccagcacaaucagacguagcacuccuaagguucguaaauccugacacaggaagaguacuauucgaauguaaacuucacaaaucaggauauguaaccguagcccauacaggacaacaugauuuaguaauaccaccuaauggcuauuuucgauuugauucauggguaaaucaauuuuauacuuuagcucccaugggcaauggaacaggaagaagaagagcacucuaa

SEQ ID NO: 33159 - RNA, 1623 nt, Artificial Sequence
  derived and/or modified sequence opt6 from major_capsid_protein__Norovirus__CCX28646
augaaaauggcauccucugaugccaacccuucagacggauccacagcaaaucuaguacccgaaguaaauaacgaaguaauggccuuagaaccuguaguaggagcugcaauagcugccccagucgcaggacaacaaaauguaauagauccauggauaagaaauaauuucguacaagcaccaggaggcgaauucacaguuuccccaagaaacgcaccaggagaaauucuauggucagcuccauuagguccagauuuaaauccuuaucuaucacacuuagcaagaauguauaacgguuacgcaggaggauucgaaguccaaguaauccuugcagguaaugcauuuacagcuggaaaaauuauauucgcagcuguaccaccuaauuucccuacagaaggacuaucaccaucucaaguaacaauguucccccauauaauaguugauguacgucaauuagaaccaguacuuaucccauuaccagauguaagaaacaauuucuaucacuauaaccaaucaaaugauucuacaauaaaacuaauugcuaugcucuacacaccuuuaagagcaaauaaugcaggugacgacgucuuuacuguauccugucgaguccucacacgaccaagccccgacuuugacuuuauauuuuuaguaccaccaacaguagaaucaagaacaaaaccauuuucaguaccaguauuaacaguagaagaaaugacaaauuccagauuuccaauaccacucgaaaaacuauuuacuggaccuucuuccgcauucguaguacaaccacaaaaugguagauguacaacagauggaguacuacuagguacaacucaauuaucaccaguaaauaucuguaccuucagaggugacgucacacauauaccuggaucccgcaauuacacaaugaaccuagcaucccaaaacuggaacucuuaugauccaacagaagaaauaccugccccucucggcaccccugauuuuguaggaaaaauacaaggaguauuaacacaaacaacacgaacaaacggaucaacaagaggacauaaagcaacaguauacacaggcucugcagacuuuucaccaaaacuaggaagaguacaauucgcaacagauacagacaaugacuucgaaacuaaucaaaacacaaaauucacuccugucggaguaauacaagacgguucuacaacaccuaggaacgaaccacaacaauggguacuacccaguuauagcgguagaaauauacauaauguacaccuagcaccagcaguagcaccaacauuuccaggagaacaacuucuauucuuccgaucuacaaugccagguugcucaggcuauccuaacauggauuuagacugccuucuaccacaagaauggguacaauauuucuaucaagaagcagcacccgcucaaucugacgucgccuugcuaagauuuguuaauccagacacugguagaguauuauucgaaugcaaacuucacaaaucuggcuauguuacugucgcccauacaggacaacaugacuuaguuaucccaccuaauggauauuucagauuugauucauggguaaaccaauuuuauacauuagcuccaaugggaaauggcacaggaagaagaagagcacuauaa

SEQ ID NO: 33160 - RNA, 1623 nt, Artificial Sequence
  derived and/or modified sequence opt6 from major_capsid_protein__Norovirus__CCX28649
augaaaauggcaagcucagaugcaaacccuucagacggaaguacagcaaaccuaguaccagaaguaaacaacgaaguaauggcauuagaaccaguaguaggagccgcuauagcagcuccaguugccggccaacaaaauguaauagauccuuggauaagaaauaacuuuguucaagcucccgggggagaauucacaguauccccaagaaacgcuccuggagaaauauuauggucagccccccuaggaccagacuuaaaccccuacuuaucucaucuugcaagaauguauaaugguuaugcaggcggauucgaaguucaaguaauauuagcaggaaaugccuuuaccgcagguaaaauuauauucgcagcagucccaccuaauuuuccuacagaaggacuaucuccaucacaaguaacaauguucccucauauaauaguagacguaagacaauuagaaccaguauuaauuccucuacccgacguaagaaauaauuucuaucacuauaaucaaaguaaugauccaacaauuaaacuaauugcaaugcuauacaccccauuaagagcuaauaaugccggagacgauguauuuacaguauccuguagaguauuaacuagaccaagccccgauuucgacuuuauauuuuuaguacccccuacaguagaaucacgaacaaaaccauucucaguacccguuuuaacaguagaagaaaugacuaacuccagauucccaaucccauuggaaaaacuauuuaccggaccaucauccgcauucguaguacaaccacaaaauggacguuguacuacagacggugucuuauuaggaacuacucaauuaucaccaguuaauauauguacuuuucgaggugacguaacacauauaucaggaucaagaaauuacacaaugaaucuagccucccaaaacuggaacucauacgauccuacagaagaaauaccagcuccacuaggaacaccagauuuuguaggcaaaauucaaggaguauuaacacaaacaacaagaacagaugguucaacacgaggacacaaagcaacaguauauacaggaucagcugacuuuuccccaaaauuaggaagaguucaauucgcaaccgauaccgacaacgauuucgucacaaaucaaaacacuaaauucacaccaguaggaguaauccaagacggaucuacaacaccaagaaaugaaccacaacaauggguacuaccaucuuacuccggccgaaauacccacaauguacacuuagcaccagcaguagccccaacauuuccaggagaacaacuacuauuuuucagaucaacaaugccaggaugcucaggcuacccaaauauggauuuagauugcuuacuaccacaagaauggguucaauauuucuaccaagaagccgcaccagcacaaucagauguagccuuacuuagauuuguaaaucccgauacaggaagaguacuauuugaaugcaaacuacauaaaucaggauauguaacuguagcacacacaggacaacaugaccuaguaauccccccuaacggauacuucagauucgacucuugggucaaucaauuuuauacacuagcaccaaugggaaauggcacuggaagaagaagggcacucuaa

SEQ ID NO: 33161 - RNA, 1623 nt, Artificial Sequence
  derived and/or modified sequence opt6 from major_capsid_protein__Norovirus__CCX28652
augaaaauggcaucaucagaugccaauccaucagaugguucaacagcaaaccucguuccagaaguaaauaaugaaguaauggcacuagaaccaguaguuggggcagcaauagcagccccaguagcaggacaacaaaacguaaucgacccauggauaagaucaaacuuuguacaagcaccagguggagaauuuaccguuuccccuagaaaugccccuggagaaauucuauggucagcaccacuugguccagauuuaaauccuuaucuuucacaccuagcaagaauguauaacggcuaugcaggaggauuugaaguucaaguuauauuagcaggaaaugcauucaccgcaggaaaaauaauauucgcagcaguaccaccaaauuuuccuacagaaggauuauccccaucucaaguaacaauguucccacacauaauaguagacguacgucaauuagaaccaguacuaaucccuuuacccgaugucagaaauaauuucuaccauuauaaccaaucuaaugauccaacaauaaaacuaauagcaauguuguacacaccauuaagagcaaacaacgcaggagacgaugucuucacaguaucaugccgcguacuaacaagaccuucuccugacuucgauuuuauauuuuuaguucccccaaccguagaaagcagaacuaaaccauuuucaguaccaguccuaaccguagaagaaaugacaaacucaagauuuccaauaccauuagaaaaacuuuucaccggcccauccucugcuuucgucguacaaccacaaaauggacgauguacuaccgacggaguucuauuaggaaccacucaacuaucaccaguuaacauuuguacauuucgaggagacguaacucauauaucugguucaagaaacuacaccaugaaucucgcugcccaaaacuggaauucauacgauccaacagaagaaaucccagcaccacuagguacaccagacuuuguagguaaaauccaaggaguucuaacccaaacuacaaaaacaaauggcuccacaagaggucauaaagccacaguauauacaggaucugcagauuuuuccccuaaacuuggccgcguacaauucgcaacagauacugacaacgacuuugaaaccaaucaaaauacaaaauuuacaccaguugguguaauucaagauggaucuacaacaccccgaaaugaaccacaacaauggguucucccuagcuauucaggucgaaauacacauaacguacaucuagcaccagcaguagcuccaacauuccccggcgaacaauuauuauuuuuuagauccacaaugccuggauguucuggauauccaaauauggaucuagacugucuucuaccacaagaauggguacaauauuucuaucaagaagccgccccagcacaaucagacguagcacuucuuagauucguaaauccagacacaggaagaguuuuauuugaauguaaauuacauaaaucaggauauguaacuguagcucauacaggacaacacgaucuaguaauaccucccaauggauacuuuagauuugauucaugggucaaucaguuuuacacacucgcaccaaugggaaauggaacgggacgacguagagccuuauga

SEQ ID NO: 33162 - RNA, 1626 nt, Artificial Sequence
  derived and/or modified sequence opt6 from major_capsid_protein_VP1__Norovirus__AEE10000
augagaaugucagauggagcagcacccaaagcaaauggaucugaagccucaggacaagauuuaguaccuaccgcaguagaacaagcaguacccauacaaccaguagcaggagcagcauuagcugcaccugcagcaggacaaauaaaucaaauagauccuuggauauuucaaaauuuuguacaauguccuuuaggagaauuuaguauauccccacgaaacacaccaggcgaaauuuuauuugauuuagcucuaggaccaggauuaaauccauaucuagcgcaccuuagugcaauguauacuggauggguaggaaauauggaaguacaauuaguauuagcugguaaugcauuuacagcaggaaaaguaguugucgcacucguuccuccauauuuuccaaaagguucacuuacuacagcacaaauaaccugcuuuccacauguuaugugugauguacgaacauuagaaccaauacaauuaccauuacuagauguaagaagagucuuauggcacgcuacacaagaucaagaagaaucaaugagauuagucuguaugcucuauacaccucuacgaacaaacucaccaggugaugaauccuuuguaguaagcgguagacuauuaucaaaaccagcagcugauuuuaauuuuguauaccuuacaccacccauagaacgaaccauauaccgaaugguugaucuaccuguuauacaaccaagacuuuguacacacgcaagauggccugcacccguauauggucuuuuaguagacccaucucuaccaucaaauccacaauggcaaaauggucgcguucgaguagacggaacauuacuagguacuacuccaguuucaggaucuuggguaucauguuuugcagcagaagcagccuaugaauuucagucuggaacaggagaaguagcuacauuuacccuuauagaacaagaugguucagccuauguucccggugacagagcugcaccauuagguuauccagauuuuucaggacaauuagaaaucgaaguucaaacagaaacaacuaagacuggugauaaacuaaaaguaacuaccuuugaaaugguauuaggaccagaaaccaacguagaucaagcaccauaccaagguagaguuuaugcaucuguaaaugcugcagcaucucuagauuuaguagauggucgaguacgugcaguaccuagaagcguuuauucauuccaagauguaauacccgaauacaacgacggacuacuaguaccauuagcuccaccuauaggaccauuucuuccaggagaaguacuuuuaagauuucgaacauauaugcgacaaauagauaccacagaugcagcagccgaagcuauagauugugcacucccacaagaauuuauuagcugguucgcaucaaaugcuuuuacuguccaaucagaagcccuacuucuaagauaucgaaauacauuaacaggucaacuuuuauucgaauguaaauuauauucagaagguuauaucgccuuaucauauucagguucaggugcuuuaacauuuccaacagacggauucuucgaaguaguuucuuggguaccacgacuauaucaauuagcaucaguugguucauuagcaacuggacgcacacuaaaacaauaa

SEQ ID NO: 33163 - RNA, 1626 nt, Artificial Sequence
  derived and/or modified sequence opt6 from major_capsid_protein_VP1__Norovirus__AEE10012
augagaaugucagauggagcagcaccaaaagcaaacggcagugaagcaagcggccaagaucuaguuccuacugcaguagaacaagcaguaccaauacaaccuguugcaggagcagccuuagcagcaccagccgcaggccaaauaaaucaaauagauccauggauauuucaaaauuuuguccaauguccauuaggagaauuuucuaucucaccaagaaacacaccuggugaaauacucuuugacuuggcauuaggaccaggauuaaauccauacuuagcucauuuauccgcaauguauacagguuggguagguaauauggaaguacaauuaguuuuagccggaaaugcauuuacagcaggaaaaguuguaguugcacucguaccaccauacuuuccaaaaggaucucuuacaacagcacaaauaacaugcuucccucacgucaugugugacguucgaacauuagaaccaauucaauuaccucuacuagauguaagaagaguacuauggcaugcuacacaagaucaagaagaaucaaugagacuaguaugcaugcuuuacacacccuuaagaaccaauucaccaggagaugaaucauuuguuguuucaggacgauuauuaucuaaaccagcugcagauuucaacuuuguauaucuaacaccgccaauagaaagaacuauauaucgaaugguagauuuaccaguaauacaaccaagacuauguacgcacgcaagauggccagcaccaguuuacggauuauuaguagauccuucauuaccauccaauccacaauggcaaaacggaagaguaagaguugauggaacacuacuuggaacaacuccaguaucaggauccuggguuucauguuuugcugcagaagcagcauaugaauuucaaucaggcacaggcgaaguugcuacauuuacucucauagaacaagaugguucugccuacguaccaggagauagagcugcacccuuaggauauccugauuuuucuggucaauuagaaauugaaguacaaacugaaacaacaaaaacuggugacaaacuaaaaguuacaaccuuugaaaugguacuagguccagaaaccaauguagaucaagcgccauaucaaggacgaguuuaugcaucaguaaaugcagcagcaucuuuagauuuaguagauggacgaguuagggcaguaccucgaucaguauauucauuccaagauguaauaccagaauauaaugacggucuacuaguaccuuuagcaccaccaauaggaccuuuuuuaccaggagaaguacuuuuaagauuucgaacauauaugagacaaauagauacuacagaugcagcugcugaagcaauugauugcgcauuaccacaagaauuuguaucaugguuugcaucaaaugcuuuuacuguacaaucagaggcauuacuauuaagauaucgaaauacacuaacuggucaacuauuauucgaaugcaaauuauauucagaagguuauauugcauuaucuuauucaggaucaggagcacuaacauucccuacagauggauucuuugaaguuguaaguuggguaccucguuuauaucaacucgccaguguugguucacuagcaacaggcagaacauuaaaacaauaa

SEQ ID NO: 33164 - RNA, 1623 nt, Artificial Sequence
  derived and/or modified sequence opt6 from major_capsid_protein_VP1__Norovirus__AGJ52172
augaaaauggcaucaucugaugcaaacccaucagacgguucagcagcaaacuuagugccagaaguaaauaaugaaguuauggcacuagaaccaguaguuggugcggcaauagcugccccaguugcuggacaacaaaauguaauagacccuuggaucagaaacaacuuuguacaagccccagggggcgaauuuacuguaucuccaagaaacgcaccaggagaaauacuauggagugcaccauuaggacccgaucuaaacccauaucuaucacaucuagcacgaauguacaauggauaugcaggagguuuugaaguacaaguaauauuagcuggaaaugcauuuacugcuggaaaaguaauuuucgcagcagucccaccaaacuucccaacagaaggcuuaucaccaucacaaguaacaauguuuccucauauaguaguagauguacgucaauuagaaccaguauuaauucccuuaccugauguaagaaauaauuuuuaucauuacaaucaaucuaaugauccaacaauuaaauuaauagcaauguuauacaccccauuaagagcaaauaaugcaggagaugacguauucacagugaguuguagaguacuaacacgaccaucaccugauuucgacuuuauuuuucuaguaccaccaacaguagaaucaagaacaaaacccuucuccguaccaguacuaacuguagaagaaaugacaaacucaagauucccaaucccacucgaaaaacuauuuacaggacccagcucagccuucguaguccaaccacaaaacggaagauguacaacagacggaguacuacuaggaacaacacaauuaucaccaguaaauauauguaccuuccgaggugacguaacacacauaacaggaaguagaaauuauaccaugaauuuagcaucacaaaacuggaauaauuaugaucccacagaagaaauaccagcaccccuagguacaccugauuuuguugguaaaauucaagguguauuaacacaaacaaccagaacugacggaucaacaagaggacauaaagccacaguauauacaggaucagcagacuuugcaccaaaacuaggaagaguacaauucgaaacagacaccgaucacgacuuugaagcaaaccaaaauacaaaauucaccccagucggaguaauacaagacggaucaacaacccauagaaaugaaccacaacaauggguuuugccuucuuacucaggaagaaacacaccaaauguccaccuagcuccugccguagcuccaacauuucccggugaacaacuccuauucuuuagaucaacaaugccaggaugcucaggcuauccaaauauggauuuagauuguuuacucccacaagaauggguacaauauuucuaucaagaagcagcaccugcacaaucagacgucgcccuauuaagauucguaaauccagacacaggcagaguauuauucgaaugcaaauuacauaaaaguggauacguaacaguagcacacacaggacaacacgauuuaguaauacccccuaacgguuauuuucgauucgauuccuggguaaaucaauucuacacccuugccccaaugggaaacggaacaggcagaagaagagcuuuauaa

SEQ ID NO: 33165 - RNA, 1623 nt, Artificial Sequence
  derived and/or modified sequence opt6 from major_capsid_protein_VP1__Norovirus__AGJ52173
augaaaauggccucuucugacgcaaacccaucugacggaucagccgcaaaccuaguaccagaaguaaauaaugaaguaauggcauuagaaccaguaguaggagcagcaauugcagcaccaguagcaggccaacaaaacguaaucgauccauggauaagaaauaauuucguacaagcaccugguggagaauuuacaguauccccaagaaacgcaccaggagaaauacuuuggucagcaccacuuggaccagaccucaauccauaccucucucaucuugcuagaauguauaauggcuacgcaggaggauuugaaguacaaguuauacuugcaggaaaugcauucacagccggaaaagucauauucgcagccguacccccuaauuucccuacagaaggauuaucaccaucacaaguuaccauguuuccucauauuguaguagacgucagacaacucgaaccugucuuaauacccuuaccugacguaagaaacaauuuuuaccauuacaaucaaucaaacgauccaacuauaaaacuaauagcaaugcuauacacaccauuaagagcaaauaaugcaggggaugauguauuuacaguaucaugucgcguccuaacaagaccuucaccugauuucgacuuuauauuucucguaccacccacaguagaaucacguacaaaaccuuucucuguuccaguauuaacaguugaagaaaugacaaacagucgauuuccuauacccuuagaaaaauuauucacaggucccucaucagcuuuuguaguacaaccacaaaacggaagauguacuacugacggcgucuuauuaggaacuacacaauuaucaccaguuaacauaugcacuuuuagaggugauguaacucauauuacagguagcagaaauuauaccaugaacuuagcaucacaaaauuggaacaauuacgauccaacagaagaaauaccagcaccacuaggcaccccagauuuuguaggaaaaauucaaggaguauuaacucaaacaacaagaacagacggaucaacaagaggacauaaagcaacagucuauacaggaucugccgacuuugccccaaaauuaggcagaguucaauuugaaacugauacagaucaugauuucgaagccaaucaaaauacaaaauucacaccaguaggugucauucaagauggaucaacaacacaucgaaaugaaccacaacaauggguacucccaucauacucaggaagaaauacacacaacguacaucuagcaccagcuguagcaccgacuuuucccggagaacaauuacuauucuucagaucaacaaugcccggauguagugguuacccaaauauggaucuagauuguuuauuaccucaagaauggguacaauacuuuuaucaagaagccgcaccggcacaauccgauguagcauuguuaagauucguaaauccagacacaggacgaguuuuauuugaaugcaaauugcacaaaucaggauacguuacgguagcacacacaggacaacaugaucuaguaauaccaccuaaugguuacuuucguuucgauucauggguaaaucaauuuuauacauuagccccaaugggcaacggaacaggaagaagaagagccguauaa

SEQ ID NO: 33166 - RNA, 1623 nt, Artificial Sequence
  derived and/or modified sequence opt6 from major_capsid_protein_VP1__Norovirus__AGJ52174
augaaaauggcaucaagugaugcaaauccauccgacggaucagcugcaaacuuaguaccagaaguaaacaaugaaguaauggcacuagaaccaguuguaggagcagcaaucgcagcacccguagcuggacaacaaaauguaauagacccauggauuagaaacaauuuuguucaagcaccaggaggagaauuuacaguaucaccacgaaacgcaccaggcgaaauacuauggucugccccauuaggacccgaucuaaauccuuaucuaucacaucuagcacgaauguauaacgguuacgcaggaggcuucgaaguacaaguaauacuagcaggaaaugcauuuacagcuggcaaaguaauuuuugcugcaguuccccccaacuuuccaacugaaggacuaucaccaucacaaguuacaauguucccucacauaguaguugauguuagacaacuugaaccugucuuaauuccucuaccagauguacgcaacaauuucuaucauuauaaucaaagcaaugauccaacaauaaaauuaauagccauguuauacacaccccuaagagcuaacaacgccggagaugauguauuuacaguaucuuguagaguacuaacaagaccuuccccagauuuugacuuuauauuucucguaccaccaaccguagaaucaagaacaaaaccuuucucaguaccaguacuaaccguagaagaaaugacaaauucaagauuuccaauaccccuagaaaaacuauuuacgggaccaucaagcgcauucguaguacaaccacaaaacggaagaugcacaacagauggcguacuucuuggcacaacacaauuaucaccaguaaauauauguacauuuagaggagauguuacacauauaacaggauccagaaauuauacaaugaaucuagcaucccaaaacuggaacaauuaugauccaacugaagaaauaccugcaccauuggguacaccagauuuuguaggcaaaauacaagguguacuaacucaaacaacaagaacugacggaagcacccguggacacaaagcaacagucuauacaggaucugcagacuuugcaccuaaacucggacgaguacaauuugaaacagauacagaucacgauuuugaagcaaaucaaaauaccaaauucacaccaguaggaguaauacaagacggugguacaacacauagaaaugaaccacaacaauggguacuaccuuccuauucaggaagaaacacuccaaacguucaccuugccccagcugucgcaccaacauuuccaggcgaacaauuacuauucuucagaucaacaaugccaggauguucagguuauccaaauauggauuuagauugucuacuaccacaagaauggguacaauauuuuuaccaagaagcggcuccagcacaauccgauguugcacuacucagauucguaaacccagacacuggaagaguucuauucgaauguaaauuacacaaauccggcuauguaaccguagcucacacuggacaacaugaucuaguaauuccaccaaacggauauuucagauuugacucaugggucaaucaauuuuauacacucgcuccaauggguaauggcaccggaagaagacgagcuuuauaa

SEQ ID NO: 33167 - RNA, 1632 nt, Artificial Sequence
  derived and/or modified sequence opt6 from major_capsid_protein_VP1__Norovirus__AGJ52176
augaugauggccucuaaagacgcaccaacaaauauggauggaacaucaggagcaggacaauuaguuccagaagcuaauacagcagaaccauuaccgauaaaaccaguagcaggagccgccacagcaguagcaacagcuggacaaguuaauaugauagauccauggauaaugaauaacuucguacaagccccacaaggugaauucacaauaucuccuaauaacacaccaggagauauuuuauucgacuuacaacuaggcccacaucucaauccuuuuuuagcacaucuuucaagaauguauaauggauggguagggaacaugcaaguaagaauaaugcucgcaggaaaugcauuuagugcaggaaaaauaauuguaugcugcauuccaccuggauuuucaucccaaucaauaaguauagcacaagcaacuauguuuccacauguaauagccgauguaagaguauuagaaccuauugacguaccauuagaugauguaagaaauguauuauuccauaauaacgacaacccucaaacaaugagauuauugugcauguuauauaccccacuaagaucuggcgguacuucaucaggaacagauccauucguaaucgcugguagaguacuaaccugucccacaccagacuuuucauuucuauucuuaguuccaccagacauugaacaaagaacaaagccauuuucuguaccaaauauacccaugaaccuuauguccaacucaagaguuucaauguuaauagacggcaugaugguaucaaaugaucaaaaccaaguaccccaauuccaaaauggcagagucacauuagacggacaacuacaaggaacaacaacuguauccgccgcaugcguagccagaaugagagguagaauuuuuaauaacaauggaaacuauggcguaaauuuaacugaacuagacggaaaccccuaccaugcuuuugauucaccagcaccauuaggauuuccagacuucgguaauugugacuuacacaugacauuuguaaaaauaaauccaaacgaauuaucaucaggugauccaucuggaaaaguaguuauaagaucauaugaugcaacauucgccccucacuuaggaacuguaaaacuagaaaaugaugacgaauuagcaagauuuguagguaaagaaguaguucuugaacuaacauggguaucaaauagagaaggagcaacauuaaaucuaugggcuguaccaaauuauggaucaucacuaacucaagcaucacaauuagcaccuccuauauauccaccugguuucggagaagcaauaguauauuuuacaaguacauuuccuacaguuucaaaucccaaaguaccauguaccuuaccacaagaauuuguaucacauuucguaaaugaacaagcaccaacucguggagaugccgcauuacuacacuacgucgacccagauacacaccguaaucuaggagaauuuaaaauguauccagaagguuauaugacaugcguacccaaugccggaggaggaccacaaacacuuccaauuaauggcguauuuguauuuauaucauggguaucuagauauuaucaacucaaaccaguaggaacagcaggcgcagccagaagauuaggauuaagacgaucuuaa

SEQ ID NO: 33168 - RNA, 1608 nt, Artificial Sequence
  derived and/or modified sequence opt6 from major_capsid_region__Norovirus__ADO85555
augaagauggcaucaaaugacgcagcaccaucaaacgauggagcagcuggauuaguaccagaaguaaauaaugaaacaauggcacuagaaccugucgcuggcgcuucuauagccgcaccauugacuggacaaaacaacgucauagacccauggauaagauuaaauuucguacaagcaccaaauggagaauuuacaguaucaccacgaaacucaccaggagaaguccuacucaauuuagaauuaggaccagaacuaaacccuuaucuugcucaucuaucacgaauguacaacgguuaugccggagguguagagguacaaguucuacucgcaggaaaugcauucacagcaggaaaauuaguauuugcagcugucccaccucacuucccauuagaaaauauaucuccaggucaaauaacaauguucccccauguaauaauagauguaagaacauuagaaccugugcuauuaccucuaccagacguuagaaacaacuucuuucacuauaaucaacaaaacgagccauggaugagauuaguagcaaugcuauauacaccauuaagauccaacggaagcggggacgauguauucacaguaagcuguaggguucuaacaagaccaucacccgauuucgacuuuaacuauuuaguuccaccuacagucgaaucaaaaacaaaaccuuuuacauuaccaauacuaacaauaggagaacuaacaaacucccgauuuccaguuccaauagacgaauuauauacaucaccaaacgaaucauuaguaguacaaccccaaaacggaagaugcgcccuagauggagaauuacaagguaccacccaacuacucccaacagccauaugcucauucagaggcagaauuaaccaaaaaguaucaggagaaaaucacguuuggaauaugcagguaacaaauaucaauggaaccccauucgacccaacagaagauguaccagccccacuugguacaccagacuuuucuggaaaacuauuuggagucuuaucacaacgagaucaugacaacgccuguagaucacaugaugcaguaauagcaacaaacucugcaaaauuuacuccaaaacuuggugcaauacaaauugguaccugggaagaaaaugacguacauauuaaucagccaacaaaauuuacaccaguaggacuauuugaaucagaaggauucaaccaauggacuuuaccaaauuacucaggagccuuaacacuuaacaugggauuagccccuccaguagccccaacuuuucccggagaacaaauauuauucuuuagaagccauauaccauuaaaaggaggaguagcugacccaguuauagauugucuucuaccacaagaauggauacaacaucuuuaucaagaaucagcaccaucacaaacagauguagcccucaucagaaucacuaacccagacaccggaagaguacuuuucgaagcuaaacuacauagaucaggauacauaacaguagcaaacaccggcucaagacccauaguaguaccagcaaacggauauuuccgauucgauucauggguuaaucaauucuauaguuuagcaccaaugggaacugguaauggaagaagacgaguacaauaa

SEQ ID NO: 33169 - RNA, 1626 nt, Artificial Sequence
  derived and/or modified sequence opt6 from majore_capsid_protein__Norovirus__AFO84035
augagaaugucagacggugcagcacccaaagccaauggaucagaagcaucaggacaagaccuuguaccaacagccguagaacaagcaguaccuauacaacccguugcaggagcagcacuagcagccccugcugcaggucaaauuaaucaaaucgaucccuggauuuuucaaaacuucguacaauguccacuuggagaauucucaauaagcccaagaaauacaccaggagaaaucuuauuugaucuagcacuagguccaggacuuaauccauaucuagcacauuuaucagcaauguacacaggaugggucgguaacauggaaguacaauuaguauuagcaggaaaugcauuuacugcagguaaaguaguaguugcacucguuccacccuacuuuccaaaaggcucacuuacaacugcucaaauuacauguuucccucacguuaugugugauguaagagcacuugaaccaauucaacuaccccuacuugacguuagacguguuuuauggcacgcaacacaagaucaagaagaaucaaugagacuugucuguaugcuauacacucccuuacgaacaaauucacccggugaugaaucauuuguaguuucaggaagauuauuaucaaaaccagcugcagauuuuaacuuuguauaccuaacucccccaauagaacgaacuauauauagaaugguagacuuaccuguccuucaaccaagacuuuguacacacgcaagauggcccgcaccagucuauggauuauuaguugacccauccuuaccaucaaacccacaauggcaaaauggacgaguccauguagaugguacacuacuaggaaccacuccaguaucaggaucuuggguaucuugcuuugcagcagaagccgcauaugaauaucaaucugaaguuggagaaguugccacauuuacauuaauugaacaagauggaucugcauauguaccaggcgauagagcagcaccauuagguuauccagacuacucaggccaauuagaaaucgaaguacaaaccgaaacaacaaaaaccggagauaaauuaaaaguaacaacuuuugacaugauauuaggaccuacuacaaacguagaucaaguaccauaucaaggaaaaguauaugcauccuuaacaacagcaucaagucuagaucuagucgaugggagagcucgugcaguaccucgaagcguauauucauuccaagauguuuuacccgaauauaacgauggauuauuaguaccauuagcaccaccucuaggacccuauuuaccuggagaaguauuauuaagauuuagaacauauaugagacaacuugauaccgcagaugcagcagcacaaccaauagauugcgcucuuccacaagaauuuauauccugguucgcaucaaauaacuucaccguucaaagugaugcuuuauuaauuagauacagaaauacacuuaccggucaacuacuauuugaagcaaaacuauauucagaaggauacauagcaguaucauauucaggaagcggaccacuuaccuucccuacagauggauuuuucgaaguuguauccuggguuccaagauuauuucaacuagcuuccguaggaucacuuguuacaggaagaacacuaaaacaauaa

SEQ ID NO: 33170 - RNA, 1623 nt, Artificial Sequence
  derived and/or modified sequence opt6 from major_viral_capsid_protein__Norovirus__AFN09918
augaaaauggcaucuaacgacgcuacaccaucagacgguucaacagcuaaucuaguuccagagguaaauaacgaaguuauggcacuagaacccguaguaggagcagccauagcugccccuguugccggccaacaaaaugucauagauccauggauaagaaauaacuuuguucaagcaccaggaggagaauucaccguaucaccccgaaaugcaccuggagaaauauuauggucugcaccauuaggaccggaucucaauccauacuuaucacacuuagcaagaauguauaacgguuaugcaggagguuuugaaguccaaguaauacuagcagguaacgccuucacagcuggcaaaauuauauucgcagcaguaccaccuaacuuuccaacagaaggacuuucaccaucucaagugacaauguuuccucacauaauuguugauguaagacaacucgaacccguuuuaauuccuuuaccugauguacgaaacaauuucuaucauuauaaccaaucaaacgauccaacaauaaaauuaaucgcuauguuauauacuccacucagagcaaacaaugcaggagacgacguauucacaguuagcugucgcguacuaacaagacccucaccagacuucgacuuuauauuccuaguuccuccaacuguugaaucucgaacaaaaccauuuucuguaccuauucuaacaguagaagaaaugacuaauucucgauucccaauaccacuugaaaaacuuuuuaccgguccuucauccgcuuuuguaguacaaccacaaaacggacgauguacaaccgacggaguauuacuggguaccacacaacuaucaccaguaaauauauguacauuuagaggugauguuacacacauagcaggcacucaaaacuauacuaugaaucuagcaucccaaaacuggaauaacuacgaucccacagaagaaauaccagcaccacuaggaacacccgacuucguuggaaaaauacaaggcgucuuaacacaaacaacaucaagagacggaucuacaagaggacauaaagcuacaguuucaacuggaucaguccacuucacuccaaaauuaggaucaguacaauuuucuacagacacaucaaacgauuucgaaaccggacaaaauacacgauuuacaccagucggagucguacaagaugggucuacaacacaucaaaacgaaccacaacaauggguucuacccaauuauucuggaagagacucucauaauguacaucuagcaccagcaguugcaccaacauuucccggagaacaauuauuguucuuuagaucuacaaugccuggaugcagcggcuauccaaacaugaacuuagacugcuuacuaccacaagaauggguccaacauuuuuaucaagaaucagcaccagcgcaaucagauguagcuuuacuacgauuuguaaacccugauaccggacgcguacuuuucgaauguaaauuacauaaaccaggauauguuacaguagcacauacaggacaacacgaucuaguuauuccacccaacggauauuuuagauuugauucuugggucaaucaauuuuauacucuugcaccaaugggaaauggagcagguagaagaagagcuuuauaa

SEQ ID NO: 33171 - RNA, 1623 nt, Artificial Sequence
  derived and/or modified sequence opt6 from major_viral_capsid_protein__Norovirus__AFN09921
augaaaauggcaucaaacgacgcaaauccuucagauggaagugcagcaaaccuaguacccgaaguuaacaacgaaguaauggcauuagaaccaguuguuggugcagcuauagccgcaccaguagcaggacaacaaaauguaauagacccauggauaagaaauaacuuugugcaagcaccagguggugaauucacaguaagccccagaaacgcaccaggugaaauacuauggagugcuccccuaggacccgauuuaaauccuuaucuaucacaccuagcacgaauguauaaugguuaugcugguggauuugaaguacaaguaauacuagcuggaaaugcuuuuacagcaggaaaaaucauuuucgccgcuguccccccuaauuuuccaacagaaggacuaaguccaucccaaguuacaauguucccccacauaaucgucgacguacgacaauuagaaccuguauuaauaccauuaccugauguaagaaacaauuuuuaucacuauaaccaaucaaaugacucuacuauaaaacuaauagcaaugcuauacacaccacuaagagcaaacaaugcaggugaagauguauuuaccguaucaugucgcguucuaacaagaccaucaccagauuuugacuucauauuucuaguaccaccaacaguagaaucaagaacaaaaccauucacaguuccuauacucacaguugaagaaaugacaaauucacgauuuccaauaccauuagaaaaacuuuuuacagguccuucuggagcauuuguuguacaaccacaaaacggacgaugcaccacagacggaguauuacucggaaccacacaacuaucaccaguaaauauauguaccuuuagaggagacgucacccauauagcaggaaguagaaauuauacuaugaaucuagccucauuaaacuggaauaacuacgaucccacagaagagauaccugcaccauuagguacaccagauuucguaggaaaaauucaaggugucuuaacccaaacgacuaaaggugacgguucaacaagaggacauaaagcaacaguauacacaggauccgcucccuucacuccaaaauuaggaucuguacaauuuucaacugauacugaaaaugauuucgaaacacaucaaaauacuaaauuuacaccaguaggaguaauacaagacggaucaacaacucauagaaacgaaccacaacaauggguacucccaucauauucuggacguaauguacauaacguacauuuagcaccagcaguagcuccaacauuuccuggcgaacaacuauuauuuuuuagauccacaaugcccggaugcucugguuacccaaauauggaucuagacugccuuuuaccucaagaauggguacaacacuuuuaccaagaagcagccccagcucaaucagauguagcucuauuaagauucguuaacccagacacaggaagaguccuuuuugaaugcaaacuacauaaaucaggauauguaacaguagcacauacaggacaacaugauuuaguaauaccaccaaauggauauuucagauucgauuccugggucaaucaauuuuauacacuagcuccaauggguaaugguacagguagaagaagagcauuauaa

SEQ ID NO: 33172 - RNA, 1623 nt, Artificial Sequence
  derived and/or modified sequence opt6 from major_viral_capsid_protein__Norovirus__AFN09924
augaaaauggcaucaaaugacgcaaacccaucagauggaucagcagcaaaucucguaccagaaguaaacaaugaaguuauggcauuagaaccaguagucggagcagccauagcagccccaguagcuggacaacaaaacguaauagacccuuggauaagaaauaauuucguacaagcaccugguggcgaauuuacugucuccccuagaaacgcaccaggagaaaucuuauggucagcuccacuaggcccagaucuaaacccauaccuaagucacuuagcacguauguauaacggauaugcgggaggcuucgaaguacaaguuauacuagccgguaacgcauuuacagcuggaaaaauaauuuucgcugcaguaccucccaacuucccaacugaaggccuaucaccuagccaaguaacaauguuuccacacauaauaguagacguaagacaacuagaaccaguacuaauuccauuaccagauguccgcaacaauuuuuaucauuauaaccaaucaaaugauucaacaauuaaauuaauagcuaugcuauauacaccacucagagcaaacaacgcaggagaagauguuuuuacaguuucauguagaguauuaaccagaccaucuccugacuuugacuuuauuuuuuuaguaccaccaacuguugaaucaagaacaaaaccauucacuguaccaauauuaacaguagaagaaaugacuaauucaagauuuccaauaccauuagaaaaacuauuuacaggcccaucaggggcauucguaguccaaccacaaaacggacgaugcaccacagauggaguacuacucggaacaacacaauuaucaccaguaaauaucuguacauuuagaggagacguaacccacauagcaggcucaagagauuauacaaugaauuuagcuagccuaaauuggaauaauuaugauccaacagaagaaauaccagcaccacuuggaaccccagacuuuguagguaaaauacaaggaguauuaacacaaacaacaaaagguaauggaucuaccagaggucacaaagcaacaguauauacaggaucagcaccauuuacaccuaaauuaggaucuguccaauucaguacugacacagaaaacgauuucgaaacacaucaaaauacaaaauucacaccagucggcguaauacaagauggcuccacuacccaucgaaaugaaccacaacaauggguccuaccaucauauuccggaagaaauguccauaacguacaucucgcaccugccguagcuccaacuuuuccaggagaacaacuacucuucuuucgaucuacaaugcccgguugcaguggauauccuaacauggaccuagauugcuuacuuccacaagaauggguacaacacuucuaccaagaagcagcacccgcccaaucagacguugccuuauuaagauuuguaaaucccgacacaggaagaguauuauucgaaugcaaacuacauaaauccggcuacauaacuguagcacacacaggacaacaugaucuaguaauaccgccaaaugguuauuucagauucgauucauggguuaaucaauucuacacacuagcaccaaugggcaauggaacugguagaagaagagcacuauaa

SEQ ID NO: 33173 - RNA, 1623 nt, Artificial Sequence
  derived and/or modified sequence opt6 from major_viral_capsid_protein__Norovirus__AFN09927
augaaaauggcaagcaaugacgcaaacccaucugauggaucagcagcaaaucuaguuccagaaguaaacaaugaagucauggcacuagaacccguaguaggagcagcaaucgcugcaccuguagcuggccaacaaaauguaauugacccauggauacgaaacaacuuuguacaagcaccaggaggagaauuuaccgucucuccaaggaaugcaccaggagaaauauuaugguccgcaccucuaggaccagauuuaaauccuuaccuaucacauuuagcaagaauguauaacgguuaugcaggaggauuugaaguacaaguaauacuagcaggaaacgcauucacagcaggcaaaaucauauucgcagcaguaccuccaaacuuucccacagaaggacuauccccaucacaaguuacaauguucccucacauaauuguugacguaagacaacucgaaccaguacucauaccauuaccagacgucagaaauaacuucuaucacuacaaccaaucaaaugauuccacaauaaaauuaaucgcaaugcuuuauacuccgcucagagcaaacaaugcaggagaagaugucuuuaccgucucauguagaguauuaacucgaccaucccccgacuucgacuucauauucuuaguacccccuacaguagaauccagaacaaaaccauuuacaguaccaauacuaacaguggaagaaaugacaaauucacgauucccaauaccauuagaaaaauuauuuacaggaccaucaggagcauucguaguucaaccacaaaauggcagauguacuacagacggaguauuauuaggaacaacacaauuauccccaguaaauauauguacauuucgaggcgauguaacucauauagcaggaucacgaaauuauacaaugaaucuagcaagcuuaaauuggaacaauuaugauccaacagaagaaauaccugcaccacuaggaaccccagauuuuguaggaaaaauacaaggaguacuaacccaaacaacaaaaggcgacggaucaacaaggggacacaaagcaacuguauauaccggcucagcaccauuuacacccaaacuaggaucaguacaauuuucuaccgacaccgaaaacgauuucgaaacacaucaaaauacaaaauucacacccgucgguguaauucaagacggauccacaacgcauagaaacgaaccacaacaauggguuuuaccauccuauuccggaagaaauguacacaacguucauuuagcuccugcagucgcaccaacuuuuccaggugaacaacucuuauuuuucagaucuacaaugccagguugcagcggauaucccaauauggauuuagacugucuucuaccccaagaauggguacaacauuucuaucaagaagcagcaccagcucaauccgacguagcacuuuuaagauuuguuaacccagauacuggcagaguucuuuucgaaugcaaacuacacaaaucgggauauguaacaguagcacauacaggacaacacgaccuaguaauaccaccaaauggauauuucagguucgacucuuggguaaaucaauuuuacacucuagcacccaugggaaacggaacuggacgcagacgagcccuauaa

SEQ ID NO: 33174 - RNA, 1623 nt, Artificial Sequence
  derived and/or modified sequence opt6 from major_viral_capsid_protein__Norovirus__AFN09930
augaaaauggcaucuaacgaugcaaacccaucugacggcucugcagcaaacuuagucccagaaguaaauaaugaaguuauggcucucgaaccagucguaggugcagcaauagcagcuccagucgcaggacaacaaaacguaauugacccuuggauaagaaacaacuuuguacaagcaccaggaggugaauucacaguaucaccgagaaaugccccaggagaaauacuauggucugcaccccuaggaccagaucuuaacccauaucuaucucauuuagcaagaauguauaacggauacgcagguggauucgaaguucaaguaauauuagcuggaaaugcauuuacagcugguaaaaucauauuugcugcaguaccaccuaacuuccccacagaaggucuaaguccaucucaaguaacaauguuuccucauauaaucguagauguaagacaacuagaaccaguacuaaucccacuuccugacguccgaaacaauuucuaucauuauaaucaaucuaacgacuccacuauaaaauuaaucgcaaugcuauauacaccauuaagagcaaacaaugcaggagaagacguauuuacaguaaguuguagaguauuaacucguccuagcccagauuuugacuuuauauuuuuaguaccaccaacaguagaaucccgaacaaaaccauucacuguaccuauccuaaccgucgaagaaaugacaaacucuagauuuccaaucccauuagaaaaacuauuuacagguccaucaucagcuuucguaguccaaccucaaaacggcagauguacuacagauggaguauuacuagguaccacccaauuaucaccaguaaauauauguacauuuagaggagauguaacucauauugcaggauccagaaauuauaccaugaauuuagcuagcuuaaauuggaacaauuaugauccaacagaagaaauacccgcuccacucggaacaccagacuuuguaggaaaaauccaaggaguacuaacacaaauaacaaaaggagacggaucaacaagaggacacaaagcaacaguauauacuggaggagcacccuuuacaccaaaauuaggauccguacaauuuucaacagauacagaaaaugauuucgaaacacaucaaaauacuaaauucacuccaguaggaguuauacaagaugguucaacaacacacagaaacgaaccccaacaauggguccuuccauccuauuccggacgaaauguccauaacguucaucuagcacccgcugucgcaccaaccuuuccaggagaacaauuauuauucuuucgaucuacaaugccagguugcucaggauauccaaacauggauuuagauugcuuacuaccacaagaauggguacaacacuuuuaucaagaagcagcuccagcucaaucagacguugcauuauuacgauucguaaacccagauacuggaagaguauuauucgaaugcaaauuacauaaaucaggauauguaaccguugcacacacaggacaacacgaucuaguaauaccucccaaugguuacuucagauucgacucauggguaaaccaauuuuacacacuagccccaauggguaauggaacaggaagaagaagagcccuauaa

SEQ ID NO: 33175 - RNA, 1623 nt, Artificial Sequence
  derived and/or modified sequence opt6 from major_viral_capsid_protein__Norovirus__AFN09933
augaaaauggccuccaaugaugcaaauccaucagacggaucagcugcaaauuuaguaccagaaguaaacaaugaaguaauggcacuagaaccaguaguaggagcagcaauagcagcaccuguagcaggccaacaaaauguaauagacccuuggauacgaaauaacuucguacaagcuccaggaggcgaauuuaccguaucaccacgcaaugcaccaggagaaauacuuugguccgccccccuaggcccagacuuaaauccauaccuaagccaccuagcaagaauguauaacggauaugcuggaggauucgaaguacaaguaauauuagcugguaaugcauuuacagcaggaaaaauaaucuucgcugcaguaccaccaaacuuucccacugaaggauuaucuccaucccaagucaccauguucccacacaucaucguagauguaagacaauuagaaccaguacucauaccacuaccagauguaagaaauaauuuuuaccauuauaaccaauccaaugauuccacaauaaaauuaauagccauguuauacacaccacuaagagccaauaaugcaggagaagauguauucacaguuucauguagaguacuaacaagaccaucaccagauuuugauuuuauauuucuaguacccccuacaguagaaucacgaacaaaaccauuuacaguaccaaucuuaacaguugaagaaaugacaaacagcagauuccccauaccauuagaaaaauuauuuaccggaccaucaggcgccuucguaguucaaccccaaaauggaagauguacaacagacggagucuuguuaggaacaacacaacugucaccaguaaauauauguacauuucgaggagauguaacacauauagcaggcucacgaaacuauacaaugaauuuagcaagucucaacuggaauaauuacgauccaacugaagaaauaccugcaccucuuggaacuccugauuuugucggaaaaauacaagguguacuaacacaaacaaccaaaggagacggcucaaccagaggacacaaagcaacagucuacacaggauccgcaccauucacuccaaaauuaggaucaguacaauuuucaacagauacagaaaacgauuucgaaacccaccaaaauacaaaauuuaccccaguaggagucauacaagacgguucaacaacacaucgaaacgaaccccaacaauggguuuuaccaagcuacucaggaagaaauguacauaacguccauuuagcaccagcuguagccccaacauuucccggagaacaacuauuauucuuuagauccaccaugccagguuguucaggcuacccaaauauggauuuagacuguuuacuaccacaagaauggguacaacacuuuuaucaagaagcugcaccagcccaaagugacgucgcauuauuaagauucguaaacccagacacuggaagaguacuauuugaaugcaaacuacauaaaucaggauaugucacagucgcacacacaggccaacacgauuuaguaauaccacccaaugguuacuucagauucgacucauggguaaaccaauuuuacacuuuagcaccgaugggaaauggaacaggaagaagaagagcauuauaa

SEQ ID NO: 33176 - RNA, 1623 nt, Artificial Sequence
  derived and/or modified sequence opt6 from major_viral_capsid_protein__Norovirus__AFN09936
augaaaauggcaucaaaugacgcuaacccaucagauggaucagcagccaacuuaguccccgaaguaaacaacgaaguaauggcauuagaaccaguuguaggagccgcaauagcggcaccaguagcaggacaacaaaacguaauagauccuuggauacgaaauaauuucguacaagcaccuggaggagaauuuacaguaucaccccguaaugcaccaggcgaaauucuauggucagcaccauuagguccagaucuaaaccccuaccuaucccaccuagccagaauguauaauggauaugcugggggauucgaaguccaaguuauauuagcagguaacgcauuuacagccggaaaaauaauauuugcagcaguaccaccaaauuuuccuacagaaggccuaucaccgucccaaguaacaauguucccccauauuauuguugacguaagacaauuagaacccguacuaauaccacuccccgaugucagaaauaauuucuaccauuauaaccaaucaaaugauaguacaauaaaacuaauagcaauguuauauacaccuuuaagagcaaauaaugcaggcgaagauguauuuacaguaucaugucgaguacuaacaagaccuucucccgauuuugauuuuauauuucucguaccuccaacagucgaaucuagaacaaaaccuuuuacaguuccaauucuaacaguagaagaaaugacaaacucacgauuuccaauaccauuagaaaaauuauuuaccgguccaucaggugccuucguagugcaaccacaaaacgguagauguacaacagacggaguacuauuaggaacaacucaacuaagccccguaaauaucuguacuuuuagaggugauguaacacauauagcuggaucgagaaacuauacaaugaacuuagcuucgcuaaacuggaacaauuacgauccuaccgaagaaauaccagcaccauuaggaacaccagacuucguaggaaaaauacagggaguuuuaacacaaacaacaaaaggugacggaucaacaagaggacauaaagccacaguauauaccgguucagcaccauucaccccuaaauuaggaucaguccaauuuucuaccgauacugaaaaugauuuugaaacccaucagaauacaaaauuuacaccaguaggugucauccaagauggauccacaacacacagaaaugaaccacaacaauggguauuaccaucauacucaggacgcaauguucauaacguacaucuagccccagcaguagccccuaccuuuccaggagaacaauuacuauucuuuagaucaacaaugccaggguguaguggauauccaaacauggacuuagauugucuauuaccacaagaauggguacaacacuucuaccaagaagcagccccagcacaaucagacguagcauuauuaagauucguaaauccugacacuggacgaguacuauucgaaugcaaacuacacaaaucagguuacguaacaguagcacacacaggacaacacgaucuaguuauuccaccaaauggcuacuucagauucgauucauggguaaaccaauucuacacacuagcuccaaugggaaauggcacaggaagaagaagagcauuauga

SEQ ID NO: 33177 - RNA, 1623 nt, Artificial Sequence
  derived and/or modified sequence opt6 from major_viral_capsid_protein__Norovirus__AFN09939
augaaaauggcaucuaaugaugcaaauccuucagauggaucugcagcaaaucuugucccagaaguaaauaacgaaguuauggcauuagaaccagucgucggagcugcaaucgcugccccaguagcuggacaacaaaauguaauugauccuuggauaagaaauaauuuuguacaagcaccagguggagaauuuacaguauccccaagaaaugcacccggugaaauccucuggucugcaccauuaggacccgaucucaaucccuauuuaucccacuuagcacgaauguauaauggauacgcaggcggauuugaaguacaaguaauacucgcaggaaaugcauuuacagcaggaaaaauaauauuugcagcaguaccuccaaacuucccaaccgaaggucuaucaccaucacaaguaacaauguucccucacauuaucguagacguaagacaacuagaaccuguccuaauaccauuacccgauguaagaaauaauuuuuaccauuauaaucaaucuaaugauucaacaauaaaauuaauugcuaugcuauacacaccuuuacgcgcaaacaaugcaggagaagauguuuuuacagucucuugcagaguauuaacaagaccaucuccagacuuugauuuuauauuucucguaccaccaacaguugaaagccgcacaaaacccuuuacaguacccauacuaacaguagaagaaaugacaaauucccgauucccaauacccuuagaaaaacuauucacagguccaaguucagcauucguaguacaaccacaaaacggccgauguacaacagauggcguacuucuuggcacaacacaacuaucacccgucaauauaugcacauuuagaggugacguaacacacaucgcuggauccaggaauuacacaaugaaucuagcaucauuaaauuggaacaauuacgacccaacagaagaaauaccugcaccacuuggaacaccagacuucguagguaaaauacaaggcguauuaacccaaacaacuaaaggagaugguagcaccagaggacacaaagcuacaguauacaccggaggagcaccauuuacuccaaaacuagguuccguacaauucucaacagacacagaaaacgacuuugaaacacaccagaauacaaaauucacaccaguaggcguaauacaagacggaucaacuacacacagaaacgaaccucaacaauggguucuaccaucauauucagguagaaauguacauaauguccaccuagcaccugcaguagcuccuacauuuccaggagaacaauuacuauuuuuucgaaguacaaugccaggaugcucuggcuauccuaauauggauuuagauugccuccucccucaagaauggguacaacacuucuaccaagaagcugcucccgcacaaucugacguugcauuacuaagauucguaaauccagacacaggcagaguauuauucgaaugcaaacuacacaaauccggauauguaaccgucgcacauacugggcaacacgacuuaguaaucccacccaauggauacuuuagauuugacucauggguaaaccaauuuuacacauuagccccaaugggaaacggcacaggaagaagaagagcauuauaa

SEQ ID NO: 33178 - RNA, 1623 nt, Artificial Sequence
  derived and/or modified sequence opt6 from major_viral_capsid_protein__Norovirus__AFN09942
augaaaauggcaucaaaugacgccaacccaucagacggaucagcagcuaauuuaguaccagaaguuaauaaugagguaauggcccucgaaccaguagucggcgcagcaauagcugcaccaguagcaggacaacaaaacguuauagacccauggauaagaaauaacuuuguacaagcaccuggaggagaauucacaguaucgccacgaaacgcaccaggagaaauuuuauggucugcaccacuaggcccagaccucaacccauauuuaucacaccuagcaagaauguauaauggauacgcaggcggauucgaaguccaaguaaucuuagcuggaaaugcuuuuacagcaggcaaaauaauauucgcagcaguaccaccaaauuuccccacagaaggauuaaguccaucucaaguaacaauguucccacacauaaucguagacgucagacaauuagaaccaguuuuaauuccacuaccagauguaagaaacaacuuuuaccauuauaaccaauccaaugauucuaccauaaaauuaauagcuaugcuauacacaccauuaagagcaaacaaugcaggagaagauguuuuuacaguuaguugccguguacuaacacgaccaucccccgacuuugacuucauauuuuuaguacccccaaccguugaaucuagaaccaaaccauucacaguaccaauacuuacuguagaagaaaugacaaacucacgauuuccaaucccacuagaaaaauuauuuacaggaccaucaggagcauucguaguccaaccacaaaauggaagauguacuacagacggaguucuucuaggaaccacacaauuaucaccugugaacauauguacauuucgaggagacguuacacauauagcaggaucaagaaauuacacuaugaaccucgcgucauuaaauuggaacaauuaugaucccacggaagaaauaccagcaccuuuagguacaccagacuuugucggcaaaauacaaggaguauuaacucaaacuacuaaaggagaugguucgacacggggccacaaagcaacaguauauacaggauccgcuccauucacaccaaaauuaggauccguacaauucucaacugauacagaaaacgauuuugaaacucaccaaaacacaaaauucacuccaguuggaguaauacaagacgguucaacaacacaucgaaaugaaccacaacaauggguacucccauccuauuccggccgaaauguucauaacguacaccuagcaccagccguugcaccaaccuuuccaggagaacaauuauuauucuuuagauccacaaugccaggauguucaggauauccaaauauggaucuagauuguuuauuaccacaagaauggguacaacauuuuuaucaagaagcagcuccagcacaaucagauguagcucuacuacgauuuguuaauccagacacuggaagaguuuuauucgaauguaaacuacacaagucuggauaugucacaguagcacauacaggacaacaugauuuaguuauacccccuaacggauacuuucgauuugacucauggguuaaucaauucuacacacuagccccaaugggaaauggaacaggcagaagacgagcuuuauaa

SEQ ID NO: 33179 - RNA, 1623 nt, Artificial Sequence
  derived and/or modified sequence opt6 from major_viral_capsid_protein__Norovirus__AFN09945
augaaaauggcaucuaacgaugcaaacccaucugacggcagugcagcaaacuuaguaccagaaguaaauaaugaaguaauggcucuagaaccaguaguaggagcugcaauagcagcaccuguagcaggacaacaaaacguaauagacccauggaucagaaauaauuucguucaagccccaggcggagaauuuacaguaucaccaagaaaugccccuggcgaaauccuauggucagcaccacuaggcccagauuuaaauccauaucuuucacaccucgcuagaauguauaacgguuacgcgggaggauucgaaguacaagucauucuagcaggaaacgcauuuacagcaggaaaaauaauuuucgcagcaguuccaccuaacuuuccaaccgaaggauuaucucccucacaaguuacuauguucccucauaucauaguagauguacgacaauuagaaccaguucucauuccacuuccagacguaagaaauaauuuuuaucacuacaaccaaucaaaugauucaacaauaaaacuuauagcaauguuauacacuccacuaagagcuaacaaugcaggagaagacguuuuuaccgucucaugucgugugcuuacuagaccaucccccgacuuugacuucauauuuuuaguaccuccaacaguagaaucacgaacaaaaccauucacuguaccaauacuaaccguagaagaaaugacaaacucaagauuuccaaucccucuagaaaaauuauuuacaggaccaucuagugcauucguuguacaaccacaaaacggaagauguacaaccgacggaguacuacuagguaccacucaacuuuccccaguaaauauauguaccuucagaggugacguaacacacauagcagguucucacaauuacacuaugaauuuagcaagccuaaacuggaacaauuacgacccaacugaagaaauacccgcaccauuaggaaccccugacuuugucgguaaaauacaaggagucuugacacaaacaacaaaaggagacgguucaacaagaggucauaaagcaacaguauauacaggaucagcaccauuuacaccaaaauuagguaguguacaauucucaaccgauacagaaaaugauuucgaaacccaucaaaauacaaaauuuacaccuguuggcguaauacaagacgguucuacuacacaucgcaaugaaccacaacaauggguucuuccuuccuauucaggaggaaauguacacaacguacacuuagcaccagcaguagcuccaaccuuuccaggagaacaacuacuuuucuuuagaucaaccaugccaggcuguucuggauauccaaauauggacuuagauugucuauuaccccaagaauggguacaacauuucuaccaagaagcagcgccugcacaaucagacguagcacuacuaagauuuguuaauccagauacaggaagaguacucuuugaauguaaacuccauaaaucaggauaugucaccguugcucauacuggacaacaugaccuaguuauacccccaaauggauauuucagauuugacucauggguaaaucaauuuuacacuuuagccccaaugggaaacggcacgggaagacgcagagccuuauaa

SEQ ID NO: 33180 - RNA, 1623 nt, Artificial Sequence
  derived and/or modified sequence opt6 from major_viral_capsid_protein__Norovirus__AFN09948
augaaaauggcauccaaugacgcaaacccaucagauggaagcgcagcaaauuuagucccugaaguaaauaaugaagucauggcauuagaaccaguugucggagcagcuauagcagcaccaguagcaggccaacaaaauguaauagacccauggauuagaaauaacuuuguacaagcuccagguggagaauucacaguaucaccaagaaaugcaccuggagaaauauuauggucagcaccauuaggaccagauuuaaauccauacuuaucacauuuagcaagaauguauaacggauaugccggaggauucgaaguccaaguaauacuagccggcaaugcauuuacagcaggaaaaauaauauucgcugcagucccaccuaacuucccaaccgaaggacucgguccaucccaaguuacaauguuuccacacauaaucguagauguuagacaauuagaaccuguacuuauaccauuacccgauguacgaaacaacuucuaucauuacaaccaaagcaaugauucaaccauuaaauuaauagcaaugcuuuauacuccacucagagccaacaacgcaggagaagacguauuuacaguuucuugucgaguacuaacacgaccuucaccagacuuugacuucauuuuucuaguuccaccaacaguagaaucuagaacuaaaccauuuacaguacccauauuaacaguagaagaaaugacaaacucaagauuuccuauuccauuagaaaaacuuuuuacaggaccaucaggagcuuucguuguacaaccacaaaaugguagauguacaacagaugguguauuacuaggaacaacacaauuaucaccaguaaauauuuguacauuucgaggugaugucacacauauagcgggaucaagaaacuacacuaugaaucuagccucucuaaacuggaauaacuaugauccuacugaagaaauaccagcaccacucggaaccccagauuuuguaggaaaaauacaaggugucuuaacacaaacaacaaagggcgauggaucaacuagaggacacaaggccacuguauauacaggaggagcaccauuuacaccuaaacucggaucaguacaauucuccacagacacagaaaaugacuucgaaacacaucaaaacacaaaauuuacccccguuggaguuauacaagacggaucaaccacgcaccgaaaugaaccucaacaaugggucuuacccucuuacucugguagaaauguacacaauguacaucuugcuccagcaguagcaccaacauuuccuggagaacaauuacuauucuucagaucaacaaugccagguugcucaggauaucccaauauggauuuagauugcuuauuaccacaagaauggguacaacauuuuuaccaagaagcagcaccagcucaaucagauguagcauuacuacgcuuuguuaauccugacacaggaagaguuuuauuugaauguaaauuacauaaaagcggauauguaacagucgcucacacaggucaacaugaucuaguaauaccaccaaauggauauuucagauuugauagcuggguaaaucaauuuuacacacuagcaccaauggguaauggaacaggaagaagaagagccuuauaa

SEQ ID NO: 33181 - RNA, 1623 nt, Artificial Sequence
  derived and/or modified sequence opt6 from major_viral_capsid_protein__Norovirus__AFN09951
augaaaauggcuuccaaugaugcaaauccuuccgauggauccgcagcuaaucuagucccagaagucaacaacgaaguaauggcacuagaaccaguaguuggagcagcuauagcagcaccuguagccggacaacaaaaugugauugacccauggauacgcaacaacuuuguucaagcaccagguggcgaauuuacagucaguccaagaaaugcuccuggcgaaauccuaugguccgcaccacuaggaccagaucuaaauccauaucuaucgcaccuagcacgaauguauaauggauaugcaggaggauucgaaguucaaguuauauuagcaggaaaugcauucacagcaggaaaaauaauauucgccgcaguaccaccaaacuuuccaacagaaggauuaucuccaucacaaguuacaauguuuccacacauaauaguagacguuagacaacuugaaccaguacuaauaccauuaccagauguaagaaauaauuucuaucauuauaaucaaucaaacgacucaacaauaaaauuaauagccauguuauauacaccccuaagagcaaauaaugccggcgaagauguauuuacaguaucauguagaguuuuaacaagaccuucaccagacuuugauuucauauucuuaguaccuccaaccguugaaucccgaacaaaaccauucaccguuccaauauuaacaguugaagaaaugacuaauucuagauucccaauaccacuugaaaaacuauuuacaggaccaucaggagcauucguuguccaaccucaaaacggaagauguaccacugacggagucuuacuuggcaccacacaauuaucacccguaaauauauguacauuuagaggagaugucacacauauugcaggaucaagaaauuauaccaugaaucuagcaucacuuaauuggaauaauuaugacccaacagaagaaauaccugcaccuuuaggaacaccagauuuuguaggaaaaauacaaggcguucuaacccaaacaacaaaaggugacggcuccacuagaggacacaaagcaacugucuauaccggcuccgcaccauuuacaccuaaauuagguucaguccaauuuuccaccgauacugaaaacgacuucgaaacacaucaaaacacuaaauucacaccaguuggaguaauacaagacggaucuacaacacauagaaacgaaccacaacaauggguauuaccauccuauucugguagaaauguacacaauguacaccuagcuccagcuguagcaccaacauuucccggagaacaacuacuauucuuccgaucuacaaugcccggauguuccggauacccaaauauggaucuagauugccuccugccacaagaauggguacaacauuucuaucaagaagcagcuccagcacaaagugauguagccuuacuaagauuugucaauccggacaccggaagaguacuauucgaaugcaaauuacacaaaucaggauauguaacuguagcacauacaggccaacacgaucuaguuauaccacccaacggauauuuuagauucgauucuuggguaaaccaauuuuacacacuugccccaaugggaaauggaaccggacguagaagagcacuauaa

SEQ ID NO: 33182 - RNA, 1623 nt, Artificial Sequence
  derived and/or modified sequence opt6 from major_viral_capsid_protein__Norovirus__AFN09954
augaaaauggcaucaaaugaugccaauccuucagacggaucagcugcaaaucuuguuccagaagucaacaaugaaguaauggcauuagaaccaguuguaggagccgcaauagcagcacccguugcaggacaacaaaacgucauagauccauggauacgaaacaacuuuguacaagcaccuggaggagaauuuacaguaucaccuagaaaugcacccggcgaaaucuuauggucagccccauuagguccagacuuaaauccauacuuaucccaccuugccagaauguacaacggauaugcaggaggauuugaaguacaaguaauauuagcgggcaaugccuuuacagcuggcaaaauaaucuucgcagcaguuccaccuaacuuucccacagaaggacuaucaccaucacaaguaaccauguucccacacauaauaguugacguuagacaacuagaaccaguauuaaucccccuacccgauguccgaaauaauuucuaccauuauaaccaaucaaaugacucaacuauaaaauuaaucgcaaugcucuacacaccccuucgagcuaacaaugcaggagaagacguauucacaguaucuuguagaguacuaacaagaccaaguccagauuucgacuuaauauuucuaguaccaccuacaguugaaucaagaacuaaaccauucaccguaccaaucuuaacagucgaagaaaugaccaacucaagauuuccuauaccacuagaaaaauuauucacuggaccaucaggagcauucguaguacaaccccaaaauggacgcuguacaacugacggaguauuauuaggaacaacacaacuaucaccagucaacauauguacauucagaggagacguaacucauauagcaggaucacgcaauuacacuaugaaucuagcaucuuuaaacuggaacaauuacgauccaacagaagaaauuccugcacccuuaggaaccccugacuuuguagguaaaauucaaggcguacuaacccaaacaacaaaaggugauggauccacuagaggucacaaagcaacuguauauacaggaggugcaccauucacaccuaaauuaggcucaguucaauucucaacagauacagaaaaugacuuugagacacaccaaaauacaaaauucacccccguaggaguuauacaagacgguaguacaacacaccgcaaugaaccccaacaauggguccucccuucauauucaggaagaaacguacauaacguucauuuagcacccgcagucgcaccuacauucccaggagaacaacuauuauucuuuaggucuacuaugccagguugcucagguuaccccaacauggaucuagauuguuuauuaccccaagaauggguucaacacuuuuaccaagaagcagcaccagcacaaucugauguugcacuuuuaagauuuguaaauccagacacuggcagaguauuauuugaaugcaaacuacauaagaguggauacguaacuguagcacauacaggacaacacgaucuaguaauuccaccaaacggcuauuucagauuugauucauggguuaaucaauucuacacauuagcaccaauggguaacggcacaggaagaagaagagcauuauag

SEQ ID NO: 33183 - RNA, 1623 nt, Artificial Sequence
  derived and/or modified sequence opt6 from major_viral_capsid_protein__Norovirus__AFN09957
augaaaauggcaucuaacgaugcuaacccuucugauggcuccgccgcaaacuuaguuccagaaguaaacaaugaaguaauggcucuugaacccgucguaggagcagccauagcagcaccaguagcaggacaacaaaauguaaucgauccauggauaagaaauaauuuuguacaagcaccuggaggugaauucacaguuucaccacguaaugcaccaggagaaauacucuggucugccccacuaggacccgaucuuaacccauaccuaagucaccuagccagaauguacaacggauacgccggaggauuugaaguccaaguaauacuagcagguaacgcuuuuacugcaggaaaaauaauauucgcagcaguaccaccaaacuuucccacagaaggacuaagcccaucucaaguuacaauguucccacauauuauaguugacguacgccaauuagaaccaguacucauaccauuaccagacgucagaaauaacuucuaucacuacaaucaaucaaacgacucuacaauuaaacuaauugcaauguuauacacuccucuuagagcaaacaaugcuggagaagauguauuuaccguaaguugcagaguacuaacaagaccuucaccagauuucgacuuuauauuucuggugccaccaacuguagaaucaagaacaaaaccauucacagucccaauauuaacaguugaagaaaugacaaacuccagauucccaauaccacucgaaaaauuauuuacugguccaucaggagcauucguaguacaaccacaaaauggaagauguacuacagauggaguauuauuaggaacaacacaauuguccccuguaaacauauguacauuccgcggagacguaacacauauagcaggaucucguaauuacacaaugaaucuagccucacuaaacuggaacaauuacgaucccacugaagaaauaccggcaccucucggaacuccugacuuugucggaaaaauucaagguguucuaacacaaacaacaaaaggagacggaucuacaagaggucauaaagcaacaguauauacaggcggagccccauuuacaccaaaauuaggaucuguacaauuuucaacagauaccgaaaaugacuucgaaacacaucaaaacaccaaauucacacccguaggagugauacaagacggaucaacuacacauagaaaugaaccacaacaauggguauuacccucauauucaggacgaaacguacauaauguacauuuagccccugcuguagcuccuacauuuccuggagaacaauuauuauucuucagaucaacuaugccaggauguuccggauacccuaauauggaucuagauuguuuacuaccacaagaauggguccaacacuucuaccaagaagcagcacccgcacaaucagacguggcauuacucagauucguaaauccagacacaggaagaguuuuauucgaaugcaaacuacauaaaucuggauauguaacaguagcacauacaggucaacaugacuuaguuauaccaccuaauggcuauuucagauucgauucauggguaaaccaauuuuauacacuagcucccauggguaauggaacaggaagaagaagagcacuauaa

SEQ ID NO: 33184 - RNA, 1623 nt, Artificial Sequence
  derived and/or modified sequence opt6 from major_viral_capsid_protein__Norovirus__AFN09960
augaaaauggcaucaaaugacgcuaacccaucagacggcucagcugcaaaucuagucccagaaguaaauaaugaaguaauggccuuagaaccagucguaggagcagcuauagcagcaccaguugcaggacaacaaaacguaauagaccccuggauacgaaacaauuucguucaagcaccaggaggagaauuuacaguuucaccaagaaacgcacccggugaaauacuauggucagccccacuaggcccugaucuuaaccccuauuuaucccacuuagcacguauguauaacggcuaugcuggaggcuuugaaguucaagucauucuagccgguaaugcauucacagcaggaaaaauuauauucgcagccguaccaccuaacuuuccaacagagggacuuucacccucccaaguuacaauguuuccacacauuauaguagacguacgucaauuagaaccaguuuuaauaccauuaccagacguccgaaauaauuuuuaccacuauaaccaaucaaaugacuccacaauuaaacuuauagcaaugcucuacacaccacuaagagcaaauaaugccggagaagacguauuuaccgucucauguagaguauuaacaagaccaucacccgauuuugacuuuauauuuuuaguuccaccaaccguagaaaguagaaccaaaccauuuaccguaccaauauuaacaguagaagaaaugaccaacagcagauucccaauaccccuugaaaaauuauuuagaggaagaucaucagcauuagucguucauccacaaaauggacguuguacaacagauggaguacuccuagguacuacacaacuuuccccaguaaauauauguacuuuuagaggcgacguaacccauauagccggaucucauaauuauacaaugaaccuagcaucauuaaacuggaacaauuaugauccuaccgaagaaauaccugcaccauuagguacaccggacuuuguaggaaaaauucaaggaguacuuacacaaacaacaaaaggagauggauccacaagaggacacaaagcaacaguuuacacaggauccgccccauuuacaccuaaauuaggauccguacaauucucaacagauacagaaaaugauuuugaaacacaucaaaacaccaaauucacaccagucggaguaauccaagauggaucaacuacucaucgcaaugaaccacaacaauggguauuacccucauauucaggugguaacguccauaacguccauuuagcccccgcaguagcaccuacauuuccaggcgaacaacugcuauuuuuuagaaguacaaugccaggcugcucaggauaccccaacauggaucucgacuguuuauuaccacaagaauggguacaacauuuuuaucaagaagcagcaccagcacaaucagauguggcacuccuacgauuuguuaacccagauacagguagagucuuauucgaauacaaacuacauaaaucagauuauguaacaguagcucacacuggacaacacgauuuaguaaucccaccuaacggauauuucagauucgauuccugggucaaccaauuuuacacauuagcugcaaugggcaacggaacaggaagaagacgagcauuauaa

SEQ ID NO: 33185 - RNA, 1623 nt, Artificial Sequence
  derived and/or modified sequence opt6 from major_viral_capsid_protein__Norovirus__AFN09963
augaaaauggcuucaaaugacgcuaaucccucagauggauccgcagcaaaucucguacccgaaguuaacaaugaaguaauggcauuagaacccguagucggagcugcuauagccgcaccaguagcuggacaacaaaaugucauagacccauggauccgaaauaacuucguacaagcaccaggaggugaguucacaguaucaccuagaaaugcaccuggagaaauacuauggucagcaccccuuggaccagaucuaaauccauauuuaucccacuuagcaagaauguauaacgguuacgcuggcggauuugaaguacaaguaauacuggccggcaacgcauuuacagcaggaaaaaucauuuuugcagccguacccccaaacuucccaaccgaaggacuaucaccuucucaaguuaccauguuuccacauauaauaguagacguaagacaacucgaacccguacuaauuccacuaccagaugucagaaacaauuuuuaucacuacaaccaaucaaaugacuccacaauaaaacuaauagcaauguuauacaccccucuuagagcuaacaaugccggagaugauguauuuacagucucauguagaguacuaacaagaccaucaccagacuuugacuucauuuuccuaguaccaccaaccguagaaucuagaacaaaaccauucacgguaccuauuuuaacaguagaagaaaugacaaauucacgauuuccaauaccccuagaaaaacucuucacaggacccucaucagcauucguaguucaaccacaaaauggacguugcaccacugauggaguacuucuagguacuacucaauuaaguccaguaaauauauguacauucagaggugacguaacacacauagcaggaucacggaauuacacaaugaauuuagccucccuaaacuggaacaauuaugauccuacagaagaaauuccagcaccacuaggaaccccagacuuugucggaaaaauacaaggaguauuaacacaaacaacaaaaggugaugguagcacuagaggucauaaagcaacaguauacacaggcucagcaucauuuacaccaaaauuaggaagcguacaauucucaacagacacagaaaaugauuuugaaacacaucaaaacacaaaauucacacccguagguguaauacaagacggauccacuacacauagaaaugaaccacaacaauggguacuaccauccuauaguggacggaauguacauaauguacaucucgcaccagcuguagcaccuacauuuccaggagaacaacuccuauuuuuuagaucaaccaugcccgguuguucaggcuauccaaauauggauuuagauuguuuacuaccacaagaauggguucaacacuucuaucaagaagccgcaccagcucaaucugacguagcauuacuaagauucguaaacccggacaccggacguguauuauuugaaugcaaauuacacaaaucaggauauguaaccguagcacauacuggccaacacgaucuagucauaccaccgaauggauauuucagauucgacucauggguaaaucaauuuuauacucuagcuccaauggguaacgguacaggaagaagacgugcacuuuaa

SEQ ID NO: 33186 - RNA, 1623 nt, Artificial Sequence
  derived and/or modified sequence opt6 from major_viral_capsid_protein__Norovirus__AFN09966
augaaaauggcauccaaugacgcaaacccuagcgaugguucugcagcaaaucuuguuccagagguaaacaacgaaguuauggcauuagaaccaguaguaggagcagcaauagcugcaccaguagcaggccaacaaaauguaauagauccauggauacguaauaacuuuguacaagcacccggcggagaauuuacaguuagcccacgaaacgcccccggagaaauacuauggucagccccauuagguccagacuuaaauccauaucuuucacauuuagcacgaauguauaacggauacgcagguggauuugaaguacaaguaauacuagcaggcaacgcauuuacagcaggcaaaauaauauuugcagcaguuccaccaaacuucccaacugaaggacuaucccccucccaaguaacaauguuuccacacauuauuguagacguaagacaacuagaacccguuuuaauaccauuaccagauguaagaaacaauuucuaccacuauaaccaaagcaaugacaguacaauaaaauuaauagcaauguuauacacaccauuacgagcuaacaacgcaggggaagauguguuuacaguaagcuguagaguacuaacacgaccaagcccagacuuugacuucauuuuucuaguaccaccaacaguugaaucaagaacuaaaccuuuuacaguaccuauacuaacuguagaagaaaugacuaauucaagauuccccauaccacuagaaaaauuauuuacagguccaucaggugcuuucguaguacaaccucaaaacggacgcuguacaacagauggaguuuuacuaggaacaacacaauuaucaccaguaaacauuugcacauucaggggcgacguaacacacauagcuggauccagaaacuacacaaugaaccucgcauccuuaaacuggaacaauuacgacccaaccgaagaaauaccggccccacuugguacaccugauuuuguaggaaaaauucaaggagucuuaacucaaacuacaaaaggcgacggaucaacaagaggucacaaagcaacaguauacacagguucagcaccauuuacaccaaaacucggaucuguacaauucucuaccgacacagaaaacgacuucgaaacacaucaaaauaccaaauucacacccguaggcguaauccaagacgguagcacaacacaucgaaaugaaccacaacaauggguuuuaccaucauacagcggaagaaauguacacaacguucaccuagcuccagcaguagcaccuacauuuccaggagaacaacuacucuuuuuuagaucaacuaugccaggauguuccggauauccaaauauggacuuagauugcuuacuaccacaagaauggguacaacacuucuaucaagaggcagcacccgcacaaagcgauguagcuuuauuacgauucguaaaccccgacacuggcagaguauuauucgaaugcaaacuacauaaaucaggauauguaacaguagcccauacuggacaacacgacuuaguuauaccucccaauggauauuucagauuugacaguuggguaaaucaauucuauacacucgcaccaaugggaaauggaacuggaagaagaagagcacuauaa

SEQ ID NO: 33187 - RNA, 1623 nt, Artificial Sequence
  derived and/or modified sequence opt6 from major_viral_capsid_protein__Norovirus__AFN09969
augaaaauggcaucuaaugacgcaaauccaucagauggaucagcagcaaacuuaguuccagaaguaaacaaugaaguaauggcacuagaaccaguuguaggagccgcuauagccgccccaguagcuggucaacaaaacguaauugacccauggauaagaaacaacuucguacaagcacccggaggugaauucaccguuucaccuagaaacgcaccuggagaaauacuauggucagcaccccuaggaccagaccuaaacccauauuuaucucaucucgcuagaauguauaacgguuaugcaggaggauucgaaguacaagucauacuagcaggaaaugccuucacagccgguaaaaucauauuugcagcaguucccccuaacuuuccaacagaagguuuaucccccucucaaguuacaauguucccacacauaaucguugacguaagacaacuugaaccuguucuaauaccauuaccagauguuagaaacaauuuuuaucacuacaaccaauccaaugacucuacaauaaaauuaauagcaauguuauacacuccacuaagagcaaacaacgcaggagaagauguauucacaguaucuuguagaguacuaacaagacccucaccugauuuugacuuuauauuuuuaguacccccaacaguagaaucaagaacaaaaccauucacuguacccauauuaacaguugaagaaaugacaaauucaagauuucccauaccauuagaaaaacuauuuacaggucccucaucagccuucguaguacaaccacaaaauggacgcugcacaaccgacggaguauuauuagguacuacacaauuaucaccaguaaauauauguacauucagaggagacguuacacauauagcaggaucacgaaacuauaccaugaaccuugcaucccuaaauuggaauaauuacgauccaacugaagaaauaccagccccacuaggcacaccagauuucguaggaaaaauacaaggaguauuaacucaaaccacaaaaggagacggaucaacaagaggucacaaagccacagucuauaccggaucugcaccauuuacaccuaaauuaggaucaguacaauuuucaaccgauacagaaaaugauuucgaaacacaucaaaauacaaaauucacuccaguaggaguaauccaagacggaggaaccacucacagaaaugaaccucaacaauggguucuucccucuuauucaggaagagacguaccaaacguacaccucgcaccagcagucgcacccaccuuuccuggagaacaacuacuauucuuuagaucaacuaugccaggaugcucaggauauccaaacauggaucuagacugucuccuaccccaagaauggguucaacacuucuaucaagaagcagcaccagcacaaucagacguugcacuacuaagauucguaaauccagacaccggaagaguccuuuuugaauguaaacuacauaaauccggauauguaacaguagcucauaccggacagcacgaucuuguaauaccacccaacggauacuuuagauuugacucauggguaaaucaauuuuacacccuagcaccaaugggaaauggaacuggaagaagacgagcauuauaa

SEQ ID NO: 33188 - RNA, 1623 nt, Artificial Sequence
  derived and/or modified sequence opt6 from major_viral_capsid_protein__Norovirus__AFN09972
augaaaauggcuuccaacgacgcaucuccauccgauggaagcgcagcgaauuuagucccagaaguuaacaaugaaguaauggcucucgaaccaguaguaggagccgcaauagcagcaccaguagcaggccaacaaaauguaauugacccauggauaagaaauaacuucguucaagcaccaggaggagaauuuacuguaagcccaagaaaugcuccaggagaaauauuauggucagcaccacuaggcccagauuuaaacccauaucucucucacuuagcaagaauguauaaugguuacgcugguggauucgaaguacaaguaauucucgcaggaaacgcauuuacagcaggaaaaaucauuuucgcugcugucccacccaacuuuccuacagaaggauuaaguccaucacaaguaacaauguuuccucauauaauaguugacguaagacaacuagaaccaguucuaaucccauuaccagacguacguaacaauuucuaucauuauaaccaaucaaaugacucaacaauuaaauuaauagcaaugcuauauacuccacuaagagcuaacaaugcaggcgaagauguauuuaccguaaguugccgagucuuaacaagaccuucaccugacuucgacuuuauauuuuuaguuccaccuacaguagaaucacgaacaaaaccuuucacaguaccuauacuaacaguagaagaaaugacuaacucuagauuuccaauaccacuagaaaaacuauuuacagguccaaguggagcauuuguaguacaaccacaaaauggacgauguacaacagaugguguacuauuaggaacaacacaauuaucaccaguuaauaucuguacauuuagaggugaugucacccauaucgcaggaucaagaaauuacacaaugaaucuugcagcacuuaacuggaacaacuaugauccaacagaagaaauaccugcaccauuagggacuccugacuuugucggaaaaauccaagguguacuaacccaaacaacaaaagcagacgguucaacuagaggacacaaagcaacaguauauacaggaucagcagacuucacaccuaaacuaggcucaguucaauuuucaacagauacagaaaacgacuucgaaacccaccaaaacacaaaauucacucccguaggaguaauucaagacggauccacaacacauagaaaugaaccucaacaauggguauuaccuaguuacucaggacgaaacguacagaacguccaccuagcacccgcugucgcaccuacauuucccggagaacaacuauuauuuuuucgaucaacaaugccaggauguucagguuauccaaauauggaccucgauugcuuacuaccacaagaauggguacaacacuucuaucaagaagcagcuccagcacaaucagacgucgcauuacuuagauuuguaaaucccgauacaggcagaguauuauuugaaugcaaacuacauaaaucaggauauguaacaguagcacauacaggacaacacgaucuaguaaucccacccaacggauauuuucgauuugauuccugggucaaucaauuuuacacacuagcacccaugggaaauggaacagggcgcaggagagcucuauaa

SEQ ID NO: 33189 - RNA, 1593 nt, Artificial Sequence
  derived and/or modified sequence opt6 from major_viral_capsid_protein__Norovirus__AFN09975
augaaaauggcgucaagugacgcuaacccauccgacggaaguacagcaaaccuuguaccagaaguaaauaaugaaguaauggcacuagaaccuguaguaggugccgcaaucgcugcuccagucgccggacaacaaaacguaauagacccuuggaucagaaacaacuuuguacaggcuccaggaggcgaauucacaguaucaccaagaaaugcucccggcgaaauacuauggucagcaccauuaggaccagaccuuaaucccuacuuaucgcaccuagcaagaauguauaauggauaugcaggaggauucgaaguacaaguuauuuuagcaggaaaugcauuuacugcaggaaaaauaauauucgcagcaguaccaccaaacuucccaacagaagguuuaucuccaagucaaguuacaauguucccccacauaauuguagacgucagacaacuugagcccguacuaauaccucuuccugauguacgaaauaauuuuuaucacuauaaucaaucaaaugauuccacaauaaaauuaauagcaauguuauauacaccgcuaagagcaaauaaugccggagaugaugucuuuacuguaagcugucguguauuaacuagacccucuccaagauuugaauccagaacuaaaccauuuucaguaccaguauuaacuguagaagaaaugaccaacucaagauuuccaauaccauuagaaaaacuauuuacaggcccaagcucagcauucguuguacaaccacaaaacggacgauguacaacagauggaguacuacuaggcacaacucaacuaucaccaguaaauauauguacauucagaggagauguaacacacauaccaggaucuagaaauuacacuaugaaucuagcaucccaaaacuggaacucuuauggaccaaccgaagaaauaccagcaccauuagguacaccagauuucguaggcaaaauacaaggaguacuaacccaaacaacaagaacaaacggauccacaagaggacauaaagcaacaguauacacaggaucugccgacuuuucaccaaaacuaggaagaguacaauucgcaacagauaccgauaaugacuucgaaacaaaccaaaauacaaaguuuacucccguaggaguaauacaagauggaucuacuacaccuagaaacgaaccacaacaauggguacuaccuuccuauuccggaagaaauauccauaauguacauuuagcccccgcaguagcaccuacauuuccaggugaacaauuauuguucuuucguucaacaaugcccgguuguucuggauauccaaauauggaucuagacuguuuguuaccucaagaauggguucaauauuuuuaucaagaagccgcaccagcacaaucugauguugcauuauuaagauucguaaacccagacacaggaagaguauuauucgaaugcaaacuccauaaaucagguuauguaacuguagcacacaccggacaacacgauuuaguaauaccuccaaauggauauuucagauuugauucauggguaaaucaauuuuacacauuagcaccaauggguaacggaaccggccgaagacgugcauuauaa

SEQ ID NO: 33190 - RNA, 1623 nt, Artificial Sequence
  derived and/or modified sequence opt6 from major_viral_capsid_protein__Norovirus__AFN09978
augaaaauggcauccucagacgcaaacccuucagacggaagcaccgcaaacuuaguaccugaaguaaauaaugaaguaauggcauuagaaccaguuguaggcgcagcuauagcagcacccgucgcaggacaacaaaauguaauagauccauggauaagaaacaauuuuguucaagcaccauguggugaauuuacaguaaguccaagaaacgccccaggagaaauccuaugguccgcaccucuaggaccagaucuuaacccauauuuaagccauuuagcaagaauguacaauggauacgcaggagguuuugaaguacaaguaauacuagcaggcaacgcauucacagcagguaaaauaauauucgcagccguaccacccaauuuuccaaccgaaggacuaucaccaucacaaguaacuauguuuccacacauaaucguagauguacgacaacuagaaccaguccuaauuccccuaccggaugucagaaacaacuucuaccacuauaaccaaagcaaugacaguacaauaaaauuaauagcaaugcuuuacacaccacuacgagccaacaaugcaggcgacgauguauuuacaguaucauguagaguauuaacuagaccaagcccagacuuugauuuuauauuuuuaguaccaccaacuguagaaagccguacaaaaccuuucucagucccaguauuaacaguugaagaaaugacaaauucaagauucccaauaccauuagaaaaacuauuuacagguccauccucugcauucguaguccaaccccaaaacggucgcugcacaacugacgguguacuauuaggaacaacucaacuaaguccuguaaauauauguacauucagaggagauguaacacacauaccaggaucacgaaauuauacaaugaaucuagcaucacaaaacuggaacucuuacgacccaacagaagaaaucccggccccauuaggaaccccagacuuuguaggaaaaauacaaggaguacuuacucaaacaacacgaacaaacggaucaacacgaggacacaaagcuacuguauauacaggaucagcagacuucucaccaaaacuaggaagaguacaauuugcuaccgauacugauaacgauuuugaaacuaaucaaaauacaaaauucacaccagucgguguaauacaagacgguucaacaacaccaagaaaugaaccacaacaauggguauuacccucauauucaggacgaaauauacauaacguacaccuagcaccagcagucgcaccuacauuuccaggagaacaacuacuauuuuuccguucuacaaugccuggauguucaggauauccaaauauggaccuagauugccuauuaccacaagaauggguacaauacuucuaccaagaagcagcaccagcacaaagugacguagcacuucuaagauucgucaaccccgacacaggcagaguauuauuugaaugcaaacuucacaaaucuggauaugucacuguagcacacacuggacaacacgaucuaguaauaccacccaaugguuacuuccgauuugauaguuggguaaaucaauuuuacacauuagcacccaugggaaauggaacaggacguagaagagcauuauaa

SEQ ID NO: 33191 - RNA, 1623 nt, Artificial Sequence
  derived and/or modified sequence opt6 from major_viral_capsid_protein__Norovirus__AFN09981
augaaaauggcauccaaugaugucaacccuucagacgguucagcugcaaaccuuguuccagagguuaauaaugaagucauggcacuugaaccaguaguaggugcagcuauugcagccccuguagcuggacaacaaaauguaauagaucccuggauuagaaacaacuuuguccaagccccaggaggagaauucacaguaucacccagaaaugcaccaggagaaauacuauggucagcaccauuaggcccggauuuaaauccuuaucuuagucacuuagccagaauguacaauggauacgcaggaggauucgaaguacaaguuauuuuagcaggaaacgcuuucacagcuggaaaaauaauuuucgcagcugucccaccaaacuuuccaacagaaggucuaucaccaucacaaguaacaauguuuccacauauaaucgucgacguaagacaacuagaaccaguauuaauaccauuacccgauguaagaaauaacuucuaccacuacaaccagucuaacgacuccaccaucaaauuaauagcaauguuguacacaccacuaagagcaaacaaugcaggagaagaugucuuuacaguaucuugccgaguauuaacuagaccaucaccugauuuugacuuuauauucuuaguaccaccaacaguagaaucaagaacaaaaccauucaccguccccauuuuaacaguugaagaaaugacaaacaguagauuucccaucccacuugaaaaacuauuuacuggaccaucuucagccuucguaguucaaccacaaaauggaagaugcacaacagaugguguacuacuaggcacaacucaacuaucaccaguaaacauaugcacuuuuagaggcgacguuacacacauugcuggaagcagaaacuauacaaugaaucucgcaucauuaaauuggaauaauuaugauccaaccgaagaaauacccgcaccauuaggaacaccagacuuugucggaaaaauacaaggaguauuaacacaaacaacaaaaggagacgguucuacaagaggucacaaagcaacaguauauacuggcucagcaccauuuacaccaaaauugggauccguacaauuuuccacagauacagaaaaugauuucgaaacacaucaaaauacuaaauuuacaccuguaggggucauacaagauggaggaacaacucauagaaaugaaccacaacaauggguucuacccucauauucaggcagagauguaccaaauguacaccuagccccugcaguagccccaacauuuccaggagaacaauuauuauucuuucgcuccacaaugccaggauguuccggauaucccaacauggacuuagauugccuuuugccucaagaauggguacaacacuucuaccaagaagcugcaccugcacaaagcgauguagcauuauuaagauuuguaaaccccgauacagguagaguacuauucgaauguaaauuacauaaaucuggauaugucacaguagcacacacagggcaacaugaccuaguaauaccacccaaugguuauuuccgcuucgauucauggguaaaccaauuuuauacuuuagcaccaaugggaaauggcacaggaagaagaagagcacuuuaa

SEQ ID NO: 33192 - RNA, 1623 nt, Artificial Sequence
  derived and/or modified sequence opt6 from major_viral_capsid_protein__Norovirus__AFN09984
augaaaauggcaucaucugacgccaaccccagcgauggauccacagccaauuuaguaccagaagucaauaaugaagucauggcccucgaaccaguaguaggagcugcaaucgcagcaccaguagcaggacaacaaaauguaauagaccccuggauuagaaauaauuuuguacaagcaccaggaggcgaauucacaguaucaccacgaaacgcaccaggagagauccucugguccgcaccucuaggcccagacuuaaacccauacuuaucccauuuagcuagaauguauaacgguuacgcuggaggauuugaaguacaaguaauacucgcuggaaaugcauuuacagcaggaaaaauaauauuugcagcaguuccaccuaauuuuccaaccgaaggacuaucaccaucucaaguaacaauguucccucacauuauaguagacguucgucaacuugaaccaguacuuauaccacuaccagacguacgaaauaauuucuaucauuauaaccaauccaaugacucaacaaucaaacuaauagcaaugcucuauacacccuuacgagcaaacaaugcuggagaugacguuuucaccguaucuugucgcguacuuacacgaccaucccccgacuuugauuuuauauuucuaguucccccaacaguagaaucacgaacaaaaccuuuuucagucccaguacuuacagucgaagagaugacuaacuccagauuuccaauuccacuugaaaaauuauuuacaggaccaucauccgcauuuguaguccaaccacaaaauggaagauguacaacagauggcgucuuauuagguacaacacaacuaagucccguaaauauaugcacuuuuagaggagaugucacacauauaccaggcucaagaaauuacacaaugaaccuugcaucacaaaauuggaacucauacgaucccaccgaagaaaucccugcaccucuaggaacaccugacuucguaggcaaaauacaagguguauuaacacaaaccacaagaacaaauggaagcacacgcggucauaaagccacagucuauacaggaucagcagauuucuccccaaaauuaggucgaguucaauuugcaacugacacagauaaugacuucgaaacaaaucaaaauaccaaauucacaccaguaggaguuauacaagacggaucuacaacacccagaaaugaaccacaacaauggguucuaccaucauauucaggacgaaacauacauaauguccaccuugcaccagcaguagcaccaacauuuccaggagaacaacuuuuauuuuuuagaucaacaaugccagguuguuccggcuacccaaauauggaucuagauuguuuacuaccacaagaauggguacaauauuuuuaucaagaagccgcaccagcacaaucagauguagcauuacuaagauuuguaaaccccgacacaggccgaguaauguucgaaugcaaauuacauaaaucaggcuauguuacagucgcacauacaggacaacacgauuuaguuaucccaccaaauggauauuuucgauuugauucauggguuaaccaauucuacacacucgcaccaaugggaaacggcacaggcagaagaagagcacucuaa

SEQ ID NO: 33193 - RNA, 1623 nt, Artificial Sequence
  derived and/or modified sequence opt6 from major_viral_capsid_protein__Norovirus__AFN09987
augaaaauggcaucaucugacgcaaacccaucagauggaucaacagcaaaccuugucccagaaguaaauaaugaaguaauggcauuagaacccgucguaggagcagccauagcugcaccaguugcaggacaacaaaacguaauagacccauggauucguaacaauuuuguucaagcaccaggaggagaauucacaguuucaccccgaaaugcaccaggagaaauauuauggucugcaccuuuaggaccagacuuaaauccuuauuuaucacacuuagcgagaauguauaauggcuacgccggaggauucgaaguucaaguaauuuuagccggaaaugcauuuacugcaggcaaaauaauuuucgcagcuguaccaccaaacuucccaacagaaggauuaucaccaucacaaguaaccauguucccccauauuauaguagauguuagacaacuagagccaguccuaauaccauuaccagaugucagaaauaauuucuaucauuauaaccaaucaaacgauccuacaauaaaauuaauagcaaugcuauauacuccacuacgcgcaaacaaugccggcgacgauguauuuacaguuucauguagaguuuuaacaagaccauccccagauuuugacuuuauauuuuuaguaccuccaacaguagaaucaagaacaaaaccauucucaguaccaguauuaacagucgaagaaaugacaaauucaagauuuccaauuccccuagaaaaacuauuuaccggaccauccucagcauuuguaguacaaccacaaaacggaagauguacaacagacggaguuuuacuugguacaacacaauuauccccuguuaauaucuguacauucagaggagauguaacacauauaccaggaucuagaaauuauacaaugaauuuagcaucacaaaacuggaauucauaugacccuacagaagaaauacccgcaccuuuaggaaccccagauuuuguagguaaaauacaaggaguauuaacacaaacaaccagaacaaauggaucaacuagaggacacaaagcuacaguauauacaggaucagcugauuuuucaccuaaauuaggucgcguacaauuugcaacagauacagacaacgacuucgaaacaaaucaaaauacuaaauucacaccaguagguguuauucaagauggaucaacaacaccaagaaacgaaccccaacaauggguauuaccuucauacucaggaagaaauauacacaauguucacuuagcaccagcaguagcaccaacauuuccaggugaacaauuacuauucuucagaucuacaaugccaggaugcucagguuacccuaauauggaucuagacugcuuauuaccacaagaauggguccaguauuuuuaccaagaagccgcuccagcacaaucagacguugcacuacuaagauucguuaacccagauacaggccgcguauuguucgaaugcaaauuacacaaguccggauaugugacugucgcacauacaggacaacaugauuuaguaauaccaccaaacggauauuuucguuucgauagcuggguaaaucaauuuuauacacuagccccaaugggaaauggaacuggaagaagacgugcauuauaa

SEQ ID NO: 33194 - RNA, 1623 nt, Artificial Sequence
  derived and/or modified sequence opt6 from major_viral_capsid_protein__Norovirus__AFN09990
augaaaauggcuucuucugaugcaaaccccuccgauggaucuacagcaaaccuuguaccagaaguaaacaaugaaguaauggcccuagaaccuguaguuggagcagcaauagcagcacccguagcaggacaacaaaauguaauugaccccuggauaagaaacaacuuuguucaagcaccaggaggagaauuuacagucucaccacgaaaugccccaggagaaauauuauggucagcaccacucggaccagaccuaaauccauauuuaucucacuuagcaagaauguauaauggauaugcaggaggauuugaaguacaaguaauauuagcagguaaugcauuuaccgcaggaaagauuauauuugcagcaguaccaccaaacuucccaacagaaggauuaucaccaucccaaguaacaauguucccccauauaaucguagacguuagacaacuggaaccaguuuuaauaccuuuaccugacgucagaaacaauuucuaucacuauaaucaaagcaaugacccaacaauuaaauuaauagcaauguuauacacuccacuccgcgcaaauaaugcaggugaugauguauuuacaguaucaugccgaguucuaacaagaccaucaccagacuuugauuuuauauuucuaguuccuccaaccgucgaaucacgaacaaaaccauuuucagucccaguacuuacuguagaagaaaugacaaacucuagauuucccauaccucuugaaaaacuauuuacaggaccaucuucagccuucguaguacaaccccaaaauggacgauguacaacagacggaguacuacucggaacaacucaacucucccccguaaauauauguacauucagaggagacguuacucauauacccggcucccgaaauuacacuaugaauuuagcuagucaaaacuggaauucauacgacccaaccgaagaaauaccagcuccacuaggaacaccagacuuuguagguaaaauacaaggaguacucacacaaacaacacgaacaaacgguucaacuagaggacacaaagcaacaguuuauaccggaucagcagauuucucuccaaaacuuggcagaguacaauucgcaacagauacagauaacgacuuugaaaccaaucaaaauaccaaauucacaccaguaggaguaauucaagacggauccacaacaccaagaaaugaaccacaacaguggguacuaccaucuuauucaggaagaaacauacauaauguacacuuagcaccagcuguagcaccaacuuucccaggugaacaacuacuauucuucagaucuacaaugccugguugcucuggauauccuaauauggauuuagacuguuuacuaccccaagaauggguucaauauuuuuaccaagaagcagcaccagcacaaucagauguagcauuacuaagauucguaaauccugacacuggaagaguucuauuugaaugcaaacuacauaaaucaggauauguaacagucgcucacaccggacaacacgaucuaguuaucccaccaaauggcuacuuccguuucgauuccuggguaaaucaauuuuacacauuagcaccaaugggcaacgguacaggcagacgcagagcauuauaa

SEQ ID NO: 33195 - RNA, 1623 nt, Artificial Sequence
  derived and/or modified sequence opt6 from major_viral_capsid_protein__Norovirus__AFN09993
augaaaauggcaucuucugaugcaaacccauccgauggaucuacugcaaauuuaguaccugaaguuaauaacgaaguaauggcacuagaaccaguaguaggagcagcuauagcagcaccugucgcuggacaacaaaauguaaucgacccuuggauuagaaacaauuuuguacaagcuccaggaggagaauuuacuguuucaccaagaaaugcaccuggagaaauuuuauggucagcaccucuaggcccagaucuaaacccauauuuaucucaucuugcccguauguauaacggauaugccggaggauucgaaguacaagucauucuugcaggaaaugcauucacagcaggaaaaauaauuuuugcagcaguuccaccaaacuucccaacagaaggccuaucaccaucacaaguaaccauguucccacauaucaucguugacguaagacaacuugaaccaguuuuaauaccccuucccgacguaagaaacaauuuuuaccauuauaaccaaagcaaugacccaaccauaaaauuaauagcaaugcuuuauacgccacuacgagcaaacaaugcaggagaugauguauuuaccguaucauguagaguacuuacacgccccucaccagauuucgauuucauauuucuaguacccccuacaguagaaucacguacaaaaccauuuagugucccaguacuuacuguagaagaaaugacaaauucuagauuucccauucccuuagaaaaacuauuuacaggaccaucuucagcauucguaguacaaccacaaaacgacagaugcacaacagauggaguacuauuagguacaacacaauuaucucccguaaauauauguacauuuagaggagauguuacacauaucccaggauccagaaacuauacaaugaacuuagcaagccaaaauuggaauucauacgauccuacagaagaaauacccgccccacuaggaacacccgauuuuguagguaaaauacaagguguuuuaacucaaacaacacguacaaacggaucaacacggggacacaaagccacagucuauacaggaucagcugacuuuucaccaaaauuaggaagaguacaauuugcuacagauacagacaacgauuucgaaaccaaucaaaacacuaaauucacaccaguaggaguaauacaagacggaagcacaacaccaagaaaugaaccacaacaauggguucuaccaagcuauuccggaagaaacauacacucaguacaccucgcaccagcugucgcaccuacauuuccuggagaacaauuacuauucuucagaucuacaaugccagguugcuccggcuauccaaauauggaucuagauugccuauuaccacaagaauggguacaauauuucuaucaagaagcagcuccagcacaaucagacguugcacuauuaagauucguuaacccagacacaggacgaguauuguucgaaugcaaauuacauaaguccggauauguaacugucgcacacacaggacaacacgauuuagucauacccccaaacgguuacuucagauuugauuccuggguaaaccaauuuuacaccuuagcacccaugggaaauggaacuggaagaagaagagcacuuuaa

SEQ ID NO: 33196 - RNA, 1623 nt, Artificial Sequence
  derived and/or modified sequence opt6 from major_viral_capsid_protein__Norovirus__AFN09996
augaaaauggcuucauccgaugcuaacccaucagauggcucaacagcaaacuuaguacccgaagucaacaacgaagugauggcacuagaaccagucguuggugcagcaaucgcagccccaguagcuggacaacaaaauguaaucgacccuuggauacgaaauaacuuuguccaagcaccaggaggagaauuuacaguaucaccacgaaaugcaccuggugagauucucuggucagcaccacuaggcccagaccucaacccauauuuaagucaccuugcuagaauguauaacggauaugcagguggauuugaaguacaagucauauuagcuggaaaugcauuuaccgcaggaaaaauaauuuuugcagcugucccaccaaauuuuccaacagaaggacuaucaccuucacaaguaacuauguucccacauauuaucguagacguacgccaacuugaaccaguacuaauaccacuacccgauguaagaaacaauuuuuaucauuauaaccaaucaaaugacccaacaaucaaauuaaucgcaauguuauacacccccuuacgagcaaacaacgcuggagacgauguuuucacaguuagcugcagaguauuaacacguccaucaccagacuuugauuuuauauuuuuagucccuccaacgguugaaucccgaaccaaaccauucuccguacccguucuaacaguagaagaaaugacuaacuccagauuuccaauuccauuagaaaaacuauuuacaggaccaucaagugcauucguaguacaaccacaaaacggaagaugcacaacagacggcguauuacucggcacaacacaacucucacccguaaacauaugcacuuucagaggagacguuacucauauaccugguucacguaacuauacaaugaaucuagcaagccaaaacuggaacucuuacgauccuacugaagaaauccccgcaccauuaggaaccccugacuucguagguaaaauacaagguguauuaacacaaacaacaagaacuaacgguucaacucguggacauaaggcaacaguauacaccgguucagcagacuuuucacccaaauuaggcagaguacaauucgcaacugauacagauaaugauuucgaaacaaaucaaaauacaaaauucacaccaguaggaguaauucaagacggaucaacaacaccuagaaacgaaccacaacaauggguauuaccauccuauucagguagaaauauacauaauguacaccuagcaccagccguagccccuacauuucccggcgaacaauuacuauucuuuagaucaacaaugcccggcugcucugguuacccuaauauggauuuagauugccuccuaccucaagaauggguccaauauuucuaucaagaagcugcuccagcacaaucugauguagcacuucuaagauuuguaaacccagacacuggaagaguauuauucgaaugcaaacuacauaaaucaggcuauguaacuguagcacacacaggacaacaugauuuaguaauaccacccaauggauauuuucguuucgacucuugggucaaucaauuuuacacacuagcuccaaugggaaacggaacuggccgacgcagagcccucuaa

SEQ ID NO: 33197 - RNA, 1623 nt, Artificial Sequence
  derived and/or modified sequence opt6 from major_viral_capsid_protein__Norovirus__AFN09999
augaaaauggcaucaaacgaugcaaacccaucugauggaagugcagcuaacuuaguaccagaaguaaauaaugaaguaauggcauuagaaccaguaguuggagcugcaauagcagcacccgucgcaggacaacagaauguaauagacccauggauaagaaacaacuuuguacaagcacccgguggagaauuuacaguaucucccagaaaugcaccaggagaaaucuuauggucagcaccacuuggaccagaucuaaauccuuaccuaagucaucuagcaagaauguauaacggauacgcaggaggauuugaaguucaaguaauacuagcaggaaaugcuuuuacagcaggcaaaauaauauucgcagcagucccuccuaacuuucccaccgaaggacuaucaccgucacaaguaacaauguuuccucacauaauagucgauguccgacaauuagaaccaguacuaauuccauuaccagauguaagaaacaauuucuaccauuacaaccaaucaaaugacucaacaauaaaguuaauagcaaugcuauacacaccacuaagagcaaauaaugcaggcgaagaugucuuuacaguaagcugucgaguacuuacuagaccaucuccugacuuugauuucauauuuuuaguuccuccgaccguagaaucccgaacaaaaccuuucacuguaccaauucuaacaguugaagaaaugacaaauucgcgcuucccaauaccacuggaaaaacuauuuacagguccaaguucugcauuuguaguacaaccacaaaauggacguuguacaacagacggaguacuauuagguaccacacaacuuagcccaguaaacauuuguacauuuagaggcgacguaacacauauagcaggaucuagaaauuauacaaugaaucuagcaucucuaaacuggaacaacuacgauccuacggaagaaauaccagcaccucuaggcacaccugacuuuguaggaaaaauacaaggaguacuaacacaaacaaccaaaggugauggaucuacaagaggucacaaagccacaguauacacagguucugcaccuuuuaccccgaaacuaggaucaguacaauuuuccacugauaccgaaaaugauuuugaaacccaucaaaacacaaaauucacaccaguaggagucauacaagaugguggcacaacucacagaaaugaaccucaacaauggguacuaccuucauauucaggcagagauguaccaaauguucauuuagcuccugccguugcaccuacauuuccaggcgaacaauuauuauuuuuucguuccacaaugccuggauguucuggauacccaaauauggauuuagauugcuuacuaccucaagaauggguacaacauuuuuaucaagaagcagcucccgcacaauccgacguagcacuccuaagauucguuaauccagacacaggacgaguacuauucgaaugcaaacuacauaaaucugguuaugucacuguagcucacaccggacaacacgaccuaguaauacccccaaaugguuauuuuagauucgacaguugggucaaucaauuuuacacacuugccccaaugggaaauggcacaggacguagacgagcauuauag

SEQ ID NO: 33198 - RNA, 1623 nt, Artificial Sequence
  derived and/or modified sequence opt6 from major_viral_capsid_protein__Norovirus__AGC96529
augaaaauggcuucaaaugacgcaaauccaucugacggaucagcagcaaauuuaguaccugaaguaaauaaugaaguaauggcacucgaaccaguagucggagcagcaaucgcagcaccuguagcaggacaacaaaacgucaucgauccauggauuagaaauaacuuuguucaagccccaggaggagaauuuacaguuucaccaagaaaugcaccaggugaaauauuauggucagcaccccucggaccugaccuuaauccuuauuuaucacacuuagcaagaauguauaacggauacgcagguggauuugaaguacaagucauacuagccggaaacgcauucacagcaggaaaaauuauauucgcagcaguaccaccaaacuuuccaacagaaggacucuccccaucacaaguaacuauguucccccacauaauaguagacguaagacagcuagaaccaguauuaauuccacuuccagacguuagaaauaauuuuuaucacuauaaccaaucuaaugacagcacuaucaaacucaucgcaauguuauacaccccauuaagagcaaacaaugcaggagaagacguuuucaccguuucaugcagaguacuaaccagaccaucaccagauuuugacuucauuuuuuuaguaccuccaacaguagaaucccgaacaaaacccuucacagucccaauacuaacaguagaagaaaugaccaauucuagauuuccaauuccucuggaaaaacuauuuacaggaccuucaucugccuucguaguucaaccucaaaauggacgauguacaacagacggcguauuacuaggaaccacucaacuaucuccugucaauauaugcaccuuucguggcgacguaacucacauagcaggcucaagaaauuauacaaugaauuuagcaucacuaaacuggaacaauuacgauccaacagaagaaauuccagcccccuuaggaacaccagacuuuguaggcaaaauucaaggaaugcucacacaaaccacaaaaggagacggauccacaagaggacauaaagcaacagucuacaccggaucagcaccuuuuacacccaaauuaggcucaguacaauuuucuacagacacagaaaacgauuuugaaacccaucaaaauacuaaauucacuccaguagguguuauacaagacgguuccacaacucauagaaaugaaccccaacaauggguauuaccaucauauucaggacgagauaucccaaacguacacuuagcaccagcuguagcaccaacauuuccuggugaacaacuccuuuucuuucgaucaacaaugccaggauguucaggauauccaaauauggaucuugauugucuacuaccacaagaauggguacaacauuucuaccaagaagcagcacccgcacaaucagauguagcucuauuaagauucguaaacccagauacaggacguguacuauucgaaugcaaauuacacaaaucaggcuauguaacuguagcacacacaggacaacaugaucuaguaauaccaccgaacgguuauuuuagauuugauuccuggguaaaccaauuuuauacacucgcaccaauggguaauggaacaggccgacgcagagcucuuuaa

SEQ ID NO: 33199 - RNA, 1623 nt, Artificial Sequence
  derived and/or modified sequence opt6 from major_viral_capsid_protein__Norovirus__AGC96532
augaagauggcaucuucagaugcaaacccuucagauggaucaaccgcuaaccuaguaccagaaguaaacaaugaaguaauggcacuagaaccaguuguaggagcagcuauagccgcaccuguugcuggucaacaaaauguaauagacccuuggauucgcaauaauuucguacaagcaccaggcggagaauuuacaguaucaccaagaaaugccccuggcgaaauauuauggucugcaccccuaggaccagaucuaaauccauaucuaucucaccucgcaagaauguauaacggauacgcaggagguuuugaaguacaaguuauucuagcagguaaugcauuuaccgcaggcaaaauaauauucgcugcagucccaccuaauuuuccaaccgaaggacuuucaccuucucaaguaacaauguuuccccacauaauaguugacgucagacaacuagaaccaguacuaauaccuuuaccagauguccgaaauaauuucuaucauuauaaccaaucaaaugauucuaccauaaaauuaaucgcaaugcuuuacacaccucuuagagcuaacaaugccggagacgauguauuuacaguuucaugcagaguauuaacaagaccuaguccagauuuugauuucauauuuuuaguaccuccuacaguugaaucaagaacaaaaccguuuucaguccccguauuaacaguugaagaaaugacaaauucucgauuccccauaccauuagaaaaacuauuuacaggaccaucaagcgcauuuguuguacaaccgcaaaacggaagauguaccacagacggaguuuuacuagguacaacacaacuaucaccaguuaacauauguacauuuagaggagauguuacccauauaccaggaucaagaaauuauacaaugaauuuagcaucacaaaacuggaauucauaugauccaacagaagaaacuccugccccauuaggaacaccagauuuugucggaaaaauacaaggaguauuaacacaaaccacaagaacuaacggauccacuagaggacacaaagcuaccguauauacaggcucagcagacuuuucacccaaauuaggcagaguacaauuugcaacagauacagauaaugacuucgaaacaaaucaaaauacuaaauucacccccguaggaguaauacaagacggaucaaccacaccuagaaaugaaccacaacaauggguauugccaucauauucaggucgaaauauacauaacguacaucuagcaccagcaguagcaccuacauucccaggugaacaacucuuauucuuucgauccacaaugccaggauguuccggcuacccaaauauggaccuagauugccuucuaccccaagaauggguccaauauuucuaucaagaagcagcaccggcacaaucagacguugcacuacuaagguucguaaacccugacacagggagaguacuauuugaauguaaacuacauaaaucuggauacguaacaguugcacacacuggacaacacgaccuaguaauaccaccaaacggcuauuucagauucgauuccuggguaaaccaauuuuauacauuagcaccaaugggaaauggaaccggucgacgaagagcacuuuaa

SEQ ID NO: 33200 - RNA, 1644 nt, Artificial Sequence
  derived and/or modified sequence opt6 from major_viral_capsid_protein__Norovirus__AGC96535
augaaaauggcaaguaacgacgcagcuccuucaaacgauggagccgcaaacuuagucccagaagcaaauaaugaaguaauggcucuagaaccuguaguaggcgcaucaauugcagcuccuguaguaggacaacagaauauuauugauccauggauacgugaaaauuuuguacaagccccucaaggagaauuuacaguaaguccaagaaauucaccaggugaaaugcuauugaaccuagaauuaggaccagaauuaaaucccuauuuaucacauuuaucaagaauguacaauggauacgcaggaggaaugcaaguucaaguaguauuagcuggaaaugcauucaccgcagguaaaaucauauuugcugcuguaccuccacacuucccuguagaaaauauuucugccgcucaaauaacaauguguccacaugucauaguagauguucgccaauuagaaccaguuuuauuaccuuuaccagauauacgaaauagauuuuuccacuauaaucaagaagauacaccaagaaugagauuaguagcuauguuauacacaccccuacgugcuaauuccggagaagauguauuuacagucaguugucgaguacuaacuagaccagcaccagauuucgaauucacuuuuuuaguaccaccaacaguagaaucuaaaaccaaaccuuuuacacuaccaauacuaacauuaggggaauuauccaacucuagauuuccagccccaauugacaugcuauacacagaucccaaugaaacaauuguaguccaaccucaaaacggcagauguacauuagaugguaccuuacaaggcacaacacaacuuguaccaacucaaauauguucuuuuagagguacauuaauuucacaaacaucuagauccgcagacucaacagacucagccccaagaguacgaaaucauccauuacacguucaauuaaaaaacuuagauggaacacccuaugacccaacagaugaaguaccagcaguauuaggcgcuauagauuucaaaggaacuguguuuggcguagcaucacaaagaaacacaacgggaucuucaguaggcgcaacacgagcacaugaaguucacauagacacaaccaauccucgauauacuccuaaacuaggaaguguucuuaugcauagcgaaaguucagauuucgacgacggacaaccaacaagauuuacaccaauagguaugggagcagaugacuggcaucaaugggaauuaccagaauauucuggacaccuaacccuaaauaugaauuuagcuccagcaguugcaccugcauuuccaggagaaagaauauuauuuuuuagaucaguaguaccaucagcaggaggauauggaucaggucaaauagauugucuuaucccucaagaauggguucaacacuucuaccaagaagcagcuccuagucaauccgcaguagccuuaauaagauaugucaauccugauaccggaagaaauauauuugaagcuaaauuacaucgagaagguuuuauaacaguagcaaauucaggaaacaaucccauaguaguaccaccgaaugguuauuuuagauuugaagcauggguaaaucaauuuuacacuuuaacuccaaugggcacaggacaaggaagaagacgaguucaauaa

SEQ ID NO: 33201 - RNA, 1623 nt, Artificial Sequence
  derived and/or modified sequence opt6 from major_viral_capsid_protein__Norovirus__AGS16690
augaaaauggcuucaaaugaugccaacccuucagacggaucagcagccaaccuaguuccugaagucaacaacgaaguaauggccuuagaacccguaguaggugcagcuaucgcagcaccuguagcaggacaacaaaacguaauagauccuuggauucgaaauaacuuuguacaagcuccaggaggagaauuuacuguaucuccuagaaacgcaccaggcgaaauauuauggucugcaccacuaggaccagauuuaaauccuuauuuaucccacuuagcaagaauguauaauggauacgcuggcggauucgaaguacaaguaauauuagcagguaacgcauucacagcaggaaaaauuauuuuugcagcugucccacccaacuuucccacugaaggauuaucaccaucccaaguaacaauguucccccacauaauaguugacguaagacaacuugaaccagucuuaauaccuuuaccugauguaagaaacaauuucuaucauuauaaucaaucaaaugauucaacaauaaaacucauagcaaugcuauauacaccacuuagagcaaacaaugcaggagaagacguauuuacaguuuccuguagaguacuaacaagaccaagccccgauuucgacuuuauauuccuaguacccccaacagucgaaucaagaaccaaaccauucacaguaccuauauuaaccguagaagaaaugacaaacagcagauuuccuauaccccucgaaaaacuauuuacugguccaucaucagcauuuguaguacaaccucaaaacggcagauguacuacagaugguguacuacuaggaacaacucaacuaucaccaguuaauaucuguacauuucgaggugauguaacacauauugcaggaucaagaaauuacacaaugaaccuagcaucacuaaacuggaauaauuacgauccaacagaagaaauaccagcaccacuaggaacaccagauuuuguaggcaaaauacaaggaguauuaacccaaacgacaaaaggagacgguuccacuagaggccacaaagcaacagucuauacuggcucagcuccauucacuccuaaauuagguucaguacaauuuuccacugauacagaaaacgauuuugaaacacaucaaaauacuaaauucacaccuguugguguuauacaagacggaggaacaacccacagaaaugaaccacaacaauggguucuaccuaacuauagcgggucagacguaccaaauguccaccuagcuccagcaguagcaccaaacuuuccaggagaacaauuauuauucuuccgaaguacaaugccaggcugcucaggauauccaaacauggaccuagacugccuacuaccacaagaauggguacaacauuucuaucaagaagcagcuccagcacaaucugacgucgcauuacuaagauuuguaaauccagacacaggacgaguacuuuucgaaugcaaacuacacaaaagcggauacguaacaguugcucacacaggacaacaugaccuagucauaccaccaaacgguuacuucagauucgacaguugggucaaucaauuuuauacauuagcuccuaugggaaauggaacaggaagacgaagagcacucuaa

SEQ ID NO: 33202 - RNA, 1623 nt, Artificial Sequence
  derived and/or modified sequence opt6 from major_viral_capsid_protein__Norovirus__AGS16693
augaaaauggcuuccaaugacgcaaauccaucagacggaucagcagcaaauuuaguacccgaaguaaacaaugaaguaauggcauuagaaccaguagucggagcagcuaucgcugcuccuguagcaggacaacaaaauguaauugaccccuggauuagaaacaacuuuguccaagcaccaggaggugaauuuaccguaagcccacgcaaugccccaggcgaaauauuauggucagcaccauuaggaccagaccuuaacccauaucuuagucaccucgcccgaauguauaauggauaugcagguggcuucgaagugcaagucauacuagcaggcaaugcauuuacagcaggcaaaauaauauuugcagcaguaccucccaacuuuccaacagaaggauuaucaccaucucaaguaacaauguucccacacauaauaguugacgucagacaauuagaacccguacuuaucccacuaccagacguaagaaauaacuuuuaucacuauaaucaaucuaaugauucuacaauaaaauuaauagcaauguuauacaccccccuaagagccaauaacgccggcgaagauguauuuacaguaucuuguagaguucuaacaagaccaucaccagacuuugauuuuauauucuuaguuccuccaacaguagaaucaagaacaaaaccuuucacuguaccaauauuaacaguagaagaaaugacaaacucuagauucccuauaccauuagaaaaacuauuuacaggaccaucuucggcauuuguuguacaaccccaaaaugguagaugcacaacagauggaguacuacuaggaacaacacaacuuucaccugucaauauuuguacauuuagaggagacguaacacauauagcagguagcagaaauuauaccaugaauuuagccagucuuaauuggaauaacuacgauccaacagaagaaauaccagcaccacuaggcaccccugauuuuguaggaaaaauccaaggaguuuuaacccaaacaacaaaaggagacggauccacaagaggccacaaagcaacaguauauacagguucagcacccuuuacuccaaaauuaggaucaguccaauucucaacagacacagaaaacgauuucgagacacaccaaaauaccaaauucacaccaguaggaguaauacaagacggaggaacuacacauagaaacgagccccaacaauggguacuaccuaacuauucuggaucagauguaccaaacguacacuuagccccagccguagcaccaaauuuuccaggugaacaauuacuauucuuucgaucaacaaugccagguugcucuggcuauccaaacauggaucuagauugucuacuaccucaagaauggguacaacacuucuaucaagaagcagcuccagcacaaucagacguugcauuacuuagauucguaaacccugacacuggucggguauuauuugaaugcaaacuacacaaaucaggauauguaacaguagcacauacaggacaacacgacuuaguaauacccccuaauggauauuuuagguuugauucaugggucaaccaauuuuacacccuagcaccaaugggaaacgguaccggacgcagacgugcacucuaa

SEQ ID NO: 33203 - RNA, 1623 nt, Artificial Sequence
  derived and/or modified sequence opt6 from major_viral_capsid_protein__Norovirus__ALM98919
augaaaauggcaaguaaugaugcugcaccauccaaugauggugcugcuggacucguaccugaaggaaacaaugaaacacuaccauuagaaccaguagcuggugccgcaauagcagccccaguuacaggacaaaauaacauaauagacccauggauaagaaccaauuucguacaagcuccuaauggagaauuuacaguaucaccaagaaauucaccgggagaaauauuacucaauuuagaacucggcccagaucucaacccauacuuagcacacuugucacgaauguauaacgguuacgcaggaggcguugaaguacaaguucuauuagcaggcaaugccuucacagcugguaaaauuuuauucgcugcaguaccuccaaacuuuccuguagaauuucuuucacccgcacaaauaacuaugcucccacauuuaauaguagacguccguacucuagaaccaauaaugauuccauuaccagauguuagaaacacuuuuuuucacuacucuaaccaaccuaacuccagaaugcgacuaguagcaauguuauacacaccccuaagaucuaacggaucaggagacgacgucuuuacaguaucaugucgaguauuaacaagaccaacuccagacuuugaauucacauauuuaguucccccaucaguagaauccaaaaccaaaccauucucucuaccaauauuaacacuaucagaacuuacaaauucuagauuuccaguacccaucgacucucuauuuacagcccaaaauaauguauuacaaguacaaugccaaaacggccguugcacuuuagacggugaacuacaagguacaacccaacuucuaccaagugguaucugcgcauuucgaggaagaguuacugcucaaauaaaccaacgagauagauggcacaugcaacuacaaaaucuaaacggaacuacauacgauccaacagaugauguaccugcaccacuaggaacaccagacuucaaaggagucguauuuggaaugguuucacaaagaaacguuggaaaugaugcaccaggaaguacuagagcacaacaagcuuggguauccacauauucaccacaauuuguaccuaaauuaggaucaguaaacuuaagaauuucagauaaugacgacuuucaauuucaaccaacuaaauucacaccaguaggagucaacgaugaugaugauggccauccauuccgacaaugggaacuacccaacuacucaggugaauuaacuuuaaauaugaaccuagccccaccaguagccccaaacuucccaggagaacaacuauuauucuuccgaucauucguaccauguucaggaggauacaaucaagguauaauagacugucucauaccccaagaauggauccaacauuucuaucaagaaucagcacccucccaaucagacguagcccuaauacguuacguaaacccagauacaggaagaacauuauucgaagcuaaacuucauagauccggauauauaaccguagcucauucaggcgauuacccauuaguaguuccagcaaauggccauuucagauuugauucauggguaaaucaauuuuacucacuagcaccaaugggaacuggaaauggcagaagaagagcacaauaa

SEQ ID NO: 33204 - RNA, 1623 nt, Artificial Sequence
  derived and/or modified sequence opt6 from major_viral_capsid_protein__Norovirus__ALM98922
augaaaauggcaaguaaugaugcugcuccaucuaacgacggugcagcaggacuaguaccagaaggaaacaaugaaacuuuaccauuagaaccaguagcaggagcagcaauagcagcacccguaaccggucaaaauaauaucauagacccauggauucgaaccaauuucguacaagcaccuaacggagaauuuacaguaucaccaagaaauuccccaggcgaaauucuucuaaaccuagaacucggaccugaucuaaaucccuauuuagcacaucuaucuagaauguauaacggauacgcuggaggcgucgaaguucaaguacuucuagcuggaaaugcauucaccgcgggaaaaauauuauucgcagcaguaccaccuaacuuuccaguagaauuccucucuccugcacaaauaacaaugcuaccacauuuaauuguagacguacgcacacuagaaccaaucaugaucccccuaccagacguccguaauacauuuuuucauuacucaaaccaacccaacucaagaaugcgacuuguagcaaugcucuauacaccauuaagaucaaacggaucaggcgacgaugucuuuacuguaucuuguagaguacuaacacgaccaacaccagauuucgaauuuacauaucuaguaccaccaucaguagaaucaaaaacaaaaccauucucuuuaccuauauuaacauuaagugaauuaacuaauucaagauuuccuguuccaauagauucccucuuuacagcucaaaauaauguuuuacaaguacaaugucaaaacggccgauguacuuuagauggagaauuacaaggaacaacucaauuacucccaucagguauaugcgcauuuagaggaagaguuacugcccaaauaaaccaaagagauagauggcauaugcaauuacaaaaccuaaacgguacaaccuaugacccaacagaugacguaccagcaccacuaggcacaccagauuuuaaaggcguaguuuuuggaaugguaucacaacguaacguaggcaaugacgcaccaggaucaacaagagcacaacaggcauggguaucaaccuacucaccacaauucguaccuaaauuaggaucugucaauuuaagaauuuccgacaacgacgacuuccaauuccaaccuacaaaauucacaccuguagguguaaaugaugacgacgacggacauccauuuagacaaugggaauuaccaaauuauucaggugaacuaacauuaaauaugaaucuagccccucccguagcaccaaacuuuccuggagaacagcuacucuucuuccguucuuuuguaccuugcagcggagguuauaaucaaggaauaauagauugccuaauaccacaagaauggauacaacauuucuaccaagaaucagcaccaucacaaucugauguagcauuaauuagauauguuaacccugacacaggccgaacacuauucgaagcaaaauuacacagaucugguuauauaacaguagcacauucaggagauuauccacuaguagucccagcaaauggucauuucagauucgauucauggguuaaucaauuuuacucacuagcaccuauggguaccggaaaugguagaagacgagcccaauaa

SEQ ID NO: 33205 - RNA, 1623 nt, Artificial Sequence
  derived and/or modified sequence opt6 from major_viral_capsid_protein__Norovirus__ALM98928
augaaaauggcaaguaaugacgcagcaccaucaaaugacggggccgcaggucuuguaccugaaggcaauaacgaaacuuuaccauuagaacccguagcaggcgcagcaauagcagcuccaguuacuggacaaaacaauauaauugacccauggauaagaacaaacuucguacaagccccuaauggcgaauucaccguaagcccgcgaaacagcccaggagaaauccuuuuaaaucuagaacucggaccagaucuaaauccauacuuagcacaccucucacguauguauaacggauacgcuggaggaguagaaguccaaguacuacuagcagguaacgcauuuaccgcgggaaaaauuuuauucgcagcuguaccaccaaacuucccaguagaauuucuaucacccgcucaaauaaccauguuaccacaccuuauagucgacguuagaacucuagaaccuauuaugauaccauuaccagauguaagaaauacauucuuucacuauucaaaucaacccaauucacgaaugagacuagucgcuauguuauacacaccacuacgaaguaacggaucaggagacgauguauuuacaguaucauguagaguauuaacacgaccaacaccagacuucgaauucacuuauuuaguaccaccauccguagaaucuaaaacaaaaccauucucuuuaccaauacuaacacuuucagaacuaacgaacucacgauuccccguaccaauagacucacuauuuacagcacaaaauaacguacuucaagugcaaugucaaaacgguagauguacuuuagacggugaauuacaagguacaacacaauuacuaccaucaggaauaugugcauucagagguagaguaacagcucaaauaaaccaacgagacagauggcacaugcaacuacaaaauuuaaauggaacaacauacgauccuacagacgacguaccagcgccacuaggaaccccagacuuuaaaggcguaguauuuggaaugguaucacaaagaaacguuggcaacgacgcaccagguuccacacgugcacaacaagcauggguauccaccuacucaccacaauuugucccaaaacucggaucaguaaauuuaagaauaucugacaacgacgauuuccaauuucaaccaacaaaauuuacacccguggguguaaacgacgacgacgauggacauccauuucgacaaugggaacuaccuaacuauucaggcgaauuaacauuaaauaugaaucuagcacccccaguagcaccaaacuuucccggagaacaauuauuauucuuucgcucauucguaccauguucugguggcuacaaucaagguauaauagauugucucauaccacaagaauggauacaacauuuuuaccaagaaucagcacccucacaaucagacguagcauuaauacgauauguaaacccagacaccgguaggaccuuauuugaagcaaaacuccauagaucuggcuacauaacuguagcacacucaggagauuacccccuuguagucccugcaaacggacacuucagauuugauucaugggucaaucaauuuuauucacuagccccaaugggaacaggaaauggucgaagaagagcacaauaa

SEQ ID NO: 33206 - RNA, 1623 nt, Artificial Sequence
  derived and/or modified sequence opt6 from major_viral_capsid_protein__Norovirus__ALM98931
augaaaauggccucaaacgaugcagcaccaucaaaugacggagcagcaggauuaguuccagaaggaaacaacgaaacauuaccauuagaaccaguagcuggagcagcaauugcagcaccaguaacuggucaaaauaauauaauagauccauggauaagaacuaauuuuguacaagcuccaaacggugaauuuacaguauccccuagaaauucuccaggagaaauauuacuaaaccuggaauuaggacccgacuuaaacccauauuuagcucaccuaucccguauguauaacgguuaugcaggaggaguugaaguacaaguauuauuagcaggaaaugcuuuuacagcuggcaaaauucuuuucgcugcaguaccaccuaauuucccaguggaauuuuuaucaccagcucaaauuacaaugcuuccccaccuaauaguagacguaagaacuuuagaacccaucaugaucccucuaccagacguuagaaacacauuuuuucauuauuccaaucaaccaaauucuagaaugcgacuagucgccaugcuuuacacaccucuacguucgaacgguuccggagacgacguauucacaguaucaugucgaguucuaacaagaccuacucccgauuuugaauuuacauaccuagucccuccaucugucgaaucaaaaacaaaaccuuuuucuuuaccuauucuaacacuauccgaauuaacuaauucacguuuuccaguaccaauagacucauuauucacggcacaaaauaacguacuacaaguacaaugucaaaacgguagauguacauuagauggagaauuacaagguacaacacaacuuuuaccaagcggaauuugcgcauuuagaggccgagucaccgcacaaauuaaucaaagggauagauggcauaugcaauugcaaaaucuaaacggaacaacauaugauccaacugaugaugucccagcuccccuaggaacaccagacuuuaaaggaguaguauucggaaugguaucacaaagaaacguugguaaugacgcacccggaucaacaagagcacaacaagcauggguaucaacauacuccccacaauuugucccaaaauuaggaucuguaaauuuacgaaucucagacaaugacgauuuccaauuucaaccaacaaaauucacuccaguaggaguuaaugaugaugaugauggacauccauuuagacaaugggaacuaccaaacuauucaggugaauuaacacuaaacaugaauuuagcaccaccaguagccccaaacuuuccaggagaacaauuauuauuuuuuagaucuuuuguucccuguucaggaggauauaaucaaggaaucauagauuguuuaauaccacaagaauggauacaacacuucuaucaagaaucugcaccaucccaaucagauguagcacuaauaagauauguaaauccugacaccggaagaacacuauucgaagcaaaacuacauagaucaggauauaucacuguagcucacuccggagauuacccucugguaguucccgccaauggacauuuucgcuuugauucauggguaaaucaauucuacucucuagcuccaauggguacaggaaauggaagaagaagagcacaguaa

SEQ ID NO: 33207 - RNA, 1623 nt, Artificial Sequence
  derived and/or modified sequence opt6 from major_viral_capsid_protein__Norovirus__ALM98934
augaaaauggcuucaaaugacgcagcaccaucaaacgauggagccgccggcuuaguaccugaaggaaacaaugaaacacuaccccuagaaccaguugccggcgcagcuauagcagcaccuguaacaggacaaaauaauauaauagauccauggauucgcacaaacuuuguccaagcaccuaacggagaauuuacaguaucaccaagaaauucaccaggagaaaucuuacuaaauuuagaacuuggcccagauuuaaacccuuacuuagcacaucuauccagaauguauaauggauaugcaggcggagucgaaguacaaguauuauuagcaggcaaugccuuuacugcagguaaaauacuauucgcagcaguacccccaaauuuuccagucgaauuuuuaucaccagcacaaauaacaaugcuaccacacuuaaucguagauguucgaacauuagaaccaaucaugauaccauuaccagauguucgcaauaccuucuuucacuauuccaaccaaccaaacucucgaaugagguuagucgccauguuauacacaccacuacgcucuaauggaucgggagacgacguauuuacagucagcugcagaguauuaacacgaccaaccccugauuuugaauuuacauauuuaguacccccaucagucgaaucaaaaacaaaaccauuuagucuaccaauauuaacacuaucugaacuaacuaacucaagauuuccuguaccaauagauucauuauuuaccgcccaaaauaauguacuacaaguacaaugccaaaacggccgaugcacccuagacggagaacugcaaggaacgacacaacuucuaccaacaggaauuugcgcauucagaggucgaguuacagcacaaauuaaccaaagagaucgauggcauaugcaauuacaaaauuuaaauggaacaaccuaugacccaacagaugacguaccagcaccauuaggaacaccagacuuuaaaggaguugucuucgguaugguaucacaacguaauguaggaaaugacgcaccagggucaacaagagcacaacaagcauggguaucuacuuacucaccucaauuuguaccaaaauuaggauccguaaaucuaagaauaucagauaacgacgacuuucaauuccaaccaacaaaauuuacaccagucgguguaaaugaugacgacgacggucauccauuuagacaaugggaacucccaaauuauucaggugaauuaacucuaaauaugaaucuagcaccaccaguagcaccuaauuucccaggagaacaauuacuauucuuuagaucauucguaccaugcucgggugguuacaaucaaggaauaauugauuguuuaauaccacaagaauggauccaacauuucuaucaagaaucagcaccaucacaaucugacguugcauuaaucagauacguaaauccagacacuggcaggacuuuauuugaagcaaaacuacacagaucagguuauauaacagucgcacacucaggcgacuauccacuaguaguaccagcaaauggacacuuccguuucgauucauggguaaaccaauuuuauucacuagcuccaaugggaaccggaaauggaagaagaagagcacaauaa

SEQ ID NO: 33208 - RNA, 1623 nt, Artificial Sequence
  derived and/or modified sequence opt6 from major_viral_capsid_protein__Norovirus__ALM98940
augaaaauggcaucaaaugacgcagcaccaucuaaugauggagccgcaggcuuaguaccagaaggaaauaaugaaacacuuccucuugaaccgguagcaggugcagcaauagcagcaccugucacaggacaaaauaauauuauagauccauggauaagaacaaacuucguacaagcaccaaauggagaauucacaguaagcccucgcaacucaccaggcgaaauauuauuaaacuuagaacuaggaccagaccuaaauccauauuuagcacaccuaagcagaauguauaacggauaugcaggcgguguagaaguacaaguauuacuugcaggaaacgccuuuacagcaggaaaaauauuauuugcagcaguacccccaaauuuuccaguagaauuuuuaucuccagcucaaauuacaaugcuaccacacuuaauaguugauguacgaacucucgaaccaauaaugauuccacuaccagauguacgaaacacauucuuccauuauucaaaucaaccaaacucaagaaugagauuaguagccaugcucuacacaccauuaagaucaaauggaucaggagaugauguauucacaguuuccugucgaguauuaacuagaccaaccccagauuucgaauucacauaucuaguacccccaucaguagaaucuaaaacaaaacccuucucauuaccuauauuaacauuaucagaacucacuaacuccagauuccccguaccaauagacucucuuuuuacagcucaaaacaacgucuuacaaguucaaugucaaaacggaagaugcacuuuagacggagaauuacaaggaacaacucaauuauuaccauccggaauaugugccuuuagaggcagaguuacagcacaaauaaaucaaagagacagauggcacaugcaacuacaaaaucuaaaugguacaacauacgacccaacagaugacgugccagcuccauuagguacacccgauuuuaaaggaguaguuuucggaaugguaucacaaagaaauguaggcaaugaugcuccugguucuacaagagcacaacaagccugggucucaaccuauagcccccaauucguuccaaaacuuggguccguaaauuuacgaaucucugauaaugacgauuuccaauuccaacccacuaaauuuaccccuguagguguaaaugacgaugaugauggacauccauuuagacaaugggaacuuccuaacuauucaggugaauuaacauuaaauaugaaucuagccccaccaguugcacccaacuuuccuggagaacaauuauuauucuuuagaucauuuguuccuuguagcggugguuauaaccaaggaauaguagauugccuaauaccccaagaauggauacaacauuuuuaucaagaaucugcaccaucgcaaucugauguagcucuaauuagauacguaaaccccgacacaggaagaaccuuauucgaagcaaaacuacauagaucaggauauauuacagucgcucacucuggagauuacccucuaguagucccagccaauggacacuuuagauuugauucauggguaaaccaauucuacucuuuagcacccaugggaacaggcaauggacgacgacgagcacaauaa

SEQ ID NO: 33209 - RNA, 1623 nt, Artificial Sequence
  derived and/or modified sequence opt6 from major_viral_capsid_protein__Norovirus__ALM98943
augaaaauggccucuaacgacgcagcuccaagcaaugacggagcagccggacuuguaccugaagguaauaacgaaacuuuaccccucgaaccuguugcaggcgcagcaauagcugcgccuguaacuggucaaaacaauauaauagauccauggauacgcacaaacuuuguccaagcaccuaacggagaauuuacagucucaccccgaaacucaccaggcgaaauccuacuaaauuuagaacuaggaccagauuuaaauccuuacuuagcacaucuuucucgcauguauaauggauacgcaggagguguagaaguucaaguauuauuagcagguaaugcauuuacagcaggaaaaaucuuauucgcugcuguuccaccaaacuucccaguagaauuucuaucaccagcacaaauuacaaugcucccacaccucauaguagacguuagaacacucgaaccaauaaugauaccauuaccagacgucagaaacacauuuuuucacuauucaaaccaaccuaacucacgcaugagauuagucgcaaugcuauauaccccacuacgcucaaauggcucaggagacgauguauuuaccguuucaugcagagucuuaacaagaccaacaccagauuuugaauuuaccuaucuaguaccuccaucaguugaaucaaaaaccaaaccauucucucuaccuauauuaacccuuucugaacuaacaaauuccagauucccaguucccauugacucacuauuuacagcccaaaauaacguauuacaaguucaaugccaaaacgguagauguacgcuagauggcgaauuacaaggcacaacacaauuauuaccuagcgguauaugugcauuuagaggacgagucacagcacaaauaaaucaacgagauagauggcacaugcaacuacaaaaucucaacggcacaacuuaugaucccacagacgacguaccagcaccccucggaacucccgauuucaaaggaguaguauuuggaaugguaucacaaagaaacguaggcaaugaugcaccuggaucaacaagagcucaacaagccuggguaucaacauacucaccacaauucguaccuaaacuuggaucaguaaauuuacgaaucucagacaacgacgacuuucaauuucaaccuacaaaauuuacaccuguaggaguaaaugacgaugaugauggacauccauuuagacaaugggaacuacccaacuacucaggagaacuuacauuaaacaugaacuuagcaccaccuguugcuccaaauuuuccaggugaacaacuauuauucuucagaucauucgucccaugcagcgguggauauaaccaagguauaaucgauugucuaauaccacaagaauggauacaacacuucuaucaagaaucagcaccuucacaaucagacguugcauuaauacguuauguaaacccagauacuggccguacauuauucgaagcaaaauuacaucgaucaggauauauaacuguagcacacucaggugauuacccacuuguaguaccggcaaauggccauuuucguuuugauucauggguaaaucaauuuuacucauuagcccccauggguacuggaaauggccgcagaagagcacaauaa

SEQ ID NO: 33210 - RNA, 1623 nt, Artificial Sequence
  derived and/or modified sequence opt6 from putative_capsid_protein__Norovirus__ABD73936
augaaaauggcaucuaacgacgcuaauccaucagauggaucuacagcaaaucucguaccugaaguaaauaaugaaguaauggcuuuagaaccaguuguaggugcagcaauagcagcaccaguagcaggacaacaaaacguuauagacccauggauaagaaauaauuuuguacaagccccugguggagaauuuacaguauccccaagaaaugcaccaggagaaauucuaugguccgcuccacuagguccagaucuuaaucccuaucuaagucaccucgcacgaauguauaacggauacgcaggcggauucgaaguacaaguuauauuagcaggaaaugcauucacagcaggcaaaauaauauuugcagccguacccccaaacuuuccaacagaaggucuaucuccaucccaaguuaccauguuuccucauguaauuguagauguccgucaacuagaaccgguacuuauaccuuuaccagaugucagaaauaacuuuuaucacuauaaucaaucaaaugacccaacuauaaaauuaauagcuaugcucuauacaccauuacgcgcaaauaaugcaggagaagauguauuuacaguuuccuguagaguacuuacgcguccuucaccugacuucgauuuuauuuuccuaguaccaccaaccguagaaucaagaacaaaacccuuuacaguuccaauauuaacugucgaagaaaugacaaauucaagauucccaauaccacuugaaaaauuauuuacuggacccucaggagcauucguaguacaaccccaaaauggacgaugcaccacagacggaguacuucuaggaacaacucaacucucuccuguaaauauaugcacauuucgcggugaugucacucacauugcaggcacucacaauuacacaaugaacuuagcaagucaaaacuggaauaauuaugauccuacugaagaaauaccagcuccauuaggaacuccagauuuuguuggaagaauacagggaaugcuaacacaaacuacaagaggagacggauccacaagaggucauaaagcaaccguaucuacaggagacguacacuuuaccccaaaacuaggaucuauacaauucaauacagauacaaauaaugauuuugaaacuggacaaaauacaaaauuuacuccaguuggaguuguccaagaugguaauggaacacaucaaaaugaaccucaacaauggguauuaccaucuuauucaggaagaacuggucacaauguacauuuagcaccugcuguagccccuacuuuuccuggagaacaauuacucuuuuuuagaucaacaaugccugguuguucaggauauccaaacaugaauuuagacugccuacuaccacaagaauggguucaacauuucuaucaagaagcagcaccagcacaaucagacguagcacuccuccgauuuguaaaccccgauacaggccgaguacuauucgaauguaaacuacauaaaucaggauaugucacuguagcacacacaggccaacaugauuuaguaauaccuccaaauggauauuuccgauuugacucauggguaaaucaauuuuauacacuagcuccaaugggcaauggcacuggaagaagacgagcacuauaa

SEQ ID NO: 33211 - RNA, 1560 nt, Artificial Sequence
  derived and/or modified sequence opt6 from structural_capsid_protein__Norovirus__ABY67257
augaaaaugacagacaaagauacucaagaagcagcaccugcauuaggccaagucuuaccaccagaaguagaaguagcaauaccaguagaaccaacagcaggagcacaaaucgcagcaccuacugcuggucaaguaaacccaauagauccauggauauucgcaaauuuuguacaagcuccacaaggagaauucacuauuucacccaauaauaauccaggagaaguauuauucgaauuagaacuaggaccagaauuaaacccauaccuugcucacuuaagacaaauguauaauggauggacaggaucuauaaggguaaaaguaauacuagcaggaaacgcauuuucagcugguaaaauaauuguauuuugcauaccaccaggauuugaugccaguuaccuaacaccuuuccaagcaacacaauuuccacacguaauaauggacguaagagcagcagaaccuauagaaaucccauuagcagauguuaggaauguacuauuucaccaaggaccagauucacgcaugagauuaaugggaauguuauauacaccuuuacgcgcaaauuccggagcagauccauucguuguaacaggaagagucuuaacauguccaucuccagauuuuucauucuuuuuucuaguaccuccaacaguugaagaaagaucaacaccuuucucaguaccuaauguuccuguauacucauuaacuaauucaagagcaccugucccaauauacgaauuaagaucuucccguucucuaccacuaacagugcaguuucaaaauggacgauguacaguugaaggagaucuuuuaggaacuacuccauuuuccgcaggagaucucuguucauuuauguguauucgaggagacacacaacauauagcagaauuauuagaaccagacgaaucugccuucguaguaggagaaagaccagcuacauuaggauuucccgauuuuucacaauguguauuacauuuacucuuagcugacggcacagguauauggcaucaaucauuagacguaaaaaauccacaacacuuuaccccagcaaucggacaagucguauuaucaggagauguaccauuaaccagaacuagagucagacuagauuauguauuaucaacaucccgagauucuuucuggguacucccugauuauagauccgauguccuagguuccgaauuugcaccugcaguaucagcaccaggaguaggagaaacuuuacuauuuuuuaugggaagagcacccguacaagguccuucaaacccucuaccauguuuacuaccacuagaauggguauuccauuucgcauccgaaagaccaacuaaacaaucagauguagcuuuauuaaauuauguaaauccagauaccgguagaguuuuauuugaagcaaaauuauacucaucaggcuuuuugacaguaaauuuaggaacagcaaaugaaguaguacucccaacuuccggaauauucaaauuugcuucuuggguaucuuuauacuaucaauuaagacccguaggaacauuaucugcaggcagaagacuuccaagaguagauggauauuaa

SEQ ID NO: 33212 - RNA, 1653 nt, Artificial Sequence
  derived and/or modified sequence opt6 from viral_capsid_protein__Norovirus__AHA91656
augaugauggcaucaaaagacgccacaucaaauauggauggaacaucaggagcaggacaacuaguaccagaaaacaacaacacaucugaaccaauaaauauggaaccaguagcaggagcaguaacagcagcagcaacagcaggacaaguaaauaugauugacccuuggauaaugaacaauuacgugcaagcaccacaaggagaauuuacaauauccccaaauaauacaccaggagauauauuauuugauuuacaacuuggaccgcaucuuaauccauuucuagcacaucuaagucaaauguauaacggcuggguaggcaacaugaaaguacgaguaguauuagcagguaaugccuuuucagcaggaaaaauuauaguuugcugcauaccaccagguuucucagcaccaaacauaaguauagcacaagcuacaauguuuccacaugucauagcagauguacgaguuuuagaaccuauagacauucccuuagacgacguacguaacguauuauuucauaauaaugacaaugguaaucagacaaugcgucuacuuuguauguuauauacaccacuucgaaguggaggaacauccucagguacugauccuuuuguaaucgcuggaagagugcuuacauguccuacaccagauuuuaacuuccuauuucuagucccaccaacaguagaacaaaaaaccaaacaauuuucuguuccaaacuuaccacuuaauguuauguccaacucucgaguaccaucucuacuaaaugccauggucguuucuccugaucaagcccaaguaguucaauuccaaaacggacgcuguacacucgacggacaaaugcuaggaacaaccacaguaucugcuucaugcguugcaagauuuaggggaaaaacauuucaagcaccagacaaccgcuuaggaauaaauuuagcagaaauaucaggggaaccuuaucaugccuuugaaucaccagcuccacuuggauuucccgacuucggagacggagacuggcauguaacagcaacuaaaguaaccccaucucaauuagaagcaaaugacccaguagucaugggaaacguucaaccauacaacccgcaauucgccccacauuuaggcacuuuaguuguagaaaauccaacuccagauaauguuacuacaggaacagaucuccuauuuaauauaacuuggcuaucaaauagagcaaauaacagauucaauccauggguaauaccaaauuauggaucaacuuuaaccgaagcagcacaacuagcaccaucuauauuuccaccaggauuuggagaaacaauuguauauuuuaauucuacauuuccagcaguaggcgcaaccacacaugcugccauaccaugcuuacuuccccaagaauuuguagcacauuuugucaacgaacaagcaccuaucagaggugaagcagcauuacuacauuauaucgauccagauacacauagaaaucuuggagaauuuaaaauauacccagaaggauuuguaacauguguaccaaauguaggagguacaggaccacaaucacuaccuacaaauggcauauuuguauuuguaaguuggguaucacgauauuaccaacuuaaaccaguaggcacagcuggccaagcccgaagacuuggauuuagaagaguauaa

SEQ ID NO: 33213 - RNA, 1629 nt, Artificial Sequence
  derived and/or modified sequence opt6 from VP1_capsid_protein__Norovirus__BAL60747
augaaaauggcaaguaaugaugcagcaccaaguacugauggagcagcaggacuagucccagaaucgaauaaugaaguaauggcauuagaaccaguagcaggagcugcauuggcagcucccguaacaggacaaacaaacauaauagacccuuggauaagagccaauuuuguacaagcaccaaauggagaauuuacaguaucaccaagaaaugcaccaggcgaaguacuauuaucucuugaacuaggaccagaacuaaauccauacuuagcacauuuagcuagaauguacaaugguuaugcaggaggcauggaaguacaaguaaugcuagcagguaaugcuuuuacugcagguaaauuaguauucgcagcaguaccaccccacuuuccaguagaaaaucuuucaccacaacaaauaacuauguucccacauguaauaauagauguaagaacucucgaaccuguucuauuaccacuuccagauguuagaaacaauuuuuuccacuauaaucaaaaagaugaucccaaaaugagaaucguugcaauguuauauaccccauuaagaucaaaugguucaggugaugacguguucacaguauccugcagaguuuuaacccgaccaaguccagauuuugauuuuacauauuuaguuccaccaacaguagaauccaaaacaaaacccuuuacacucccaauacuaacacuuggagaacuaucaaauucacguuuuccuguaaguauagaucaaauguacacuuccccaaacgaaguaauauccguacaaugucaaaacggacgauguacucuagauggugaauuacaagguacaacacaacuacaaguaucaggaauaugcgcuuuuaaaggcgaaguaacagcacauuuacacgacaacgaucauuuauauaacguaaccauaacaaauuuaaauggaaguccauuugauccuagugaagauguaccugcuccacuagguguaccagauuuucaaggccgcguauuugguguaaucucucaaagagauaaacaaaacgcagcaggucauaaugaaccagccaaccgaggccaugaugcugucguccccacauauacugcacaauacacaccaaaauuaggacaaguacaaauaggaacauggcaaacagaugaucuucaaguaaaucaaccaguaaaauuuaccccaguaggucuuaaugacaccgaacauuuuaaucaauggguuguuccacgauaugcaggagcuuuaaaucuaaauacaaaucuagccccaaguguagcaccuguauucccaggugaaagacuauuauuuuuuagaaguuauauaccucuaaaagguggauacggcaaucccgcaauagauugucuucucccacaagaauggguccaacacuuuuaucaagaagcagcacccucaaugagugaaguagcauuaguacgauauauaaacccagauacaggaagggcucuauuugaagccaaauuacaucgagcuggauucaugacaguaucauccaacacaucagcuccaguaguagugccagcaaacgguuacuuucgcuucgacuccuggguaaaccaauucuacucauuagcucccaugggaacaggaaauggacgacgucguguucaauaa

SEQ ID NO: 33214 - RNA, 1629 nt, Artificial Sequence
  derived and/or modified sequence opt6 from VP1_capsid_protein__Norovirus__BAL60751
augaaaauggcaucaaaugacgcugcaccaucaacugauggagcagcuggauuagucccagaaucuaacaacgaagucauggcauuagaaccuguagcaggagcagcucuagcagcaccaguuacaggacaaacuaauauuauagaccccuggauaagagcaaacuuuguacaagcaccuaacggagaauuuacaguaucaccaagaaacgcaccaggagaaguacuauuaaaucuagaacuuggcccagaauuaaauccauaucuagcacaucuugcacguauguauaauggauacgccgguggaauggaaguacaaguaauguuagcaggaaacgcauuuacagcaggaaaacuaguuuucgcagcaguuccuccucacuuccccguugaaaacuuaucuccacaacaaauaacaauguuuccacacgugauaauagacguucguacacuugaaccaguauuacucccauuaccagaugucagaaauaauuucuuccacuauaaucaaaaagaugauccuaaaaugagaauuguagccaugcuuuauacaccauuacgaucaaacggaucaggcgaugauguauucacagucucauguagaguucuaacuagaccaucuccagauuucgacuuuacauaccuaguaccaccuacaguugaaucaaaaacaaaaccuuuuacacuacccauacuuacacuaggagaauuaucaaauucucgauucccaguaucaauagaucaaauguacacaagcccaaaugaaguaaucucaguacaaugccaaaauggcagauguacacuagacggagaacuucaagguacaacacaauuacaagucagcggaauaugugccuucaaaggagaaguaacagcacaucuccacgacaacgaccaccuauacaauguaacuaucacaaauuuaaacggaucacccuucgauccaucugaagauauaccugcaccucuagguguaccagacuuucaaggaagagucuucggaguaauaucacaaagagacaaacauaauucaccaggacacaacgaaccugcaaauagaggccaugaugcuguaguaccaacauauacuucacaauauaccccuaaauuaggucaaauacaaauaggcacauggcaaacagacgaccuaacaguaaaucaaccaguuaaauucacaccaguaggguuaaacgacacagaacauuuuaaucaauggguaguuccacgauaugcaggagcacuuaacuuaaauacaaaccuagcacccucaguagcgccaguuuucccaggagaaagacuacuauuuuuuagaaguuauauaccacucaaaggcgguuauggcaacccagcaauagacugucuuuuaccacaagaauggguacaacacuucuaucaagaagcagcaccaaguaugucagaaguugcauuaguccgauauauaaauccagacacaggccgugcccuuuucgaagcaaaauuacaucgugcaggauuuaugacaguaucuagcaacacauccgcaccaguagucguaccagcaaauggcuauuucagauucgacucauggguuaaucaauuuuacucuuuagcuccaauggguacaggaaacggaagaagaaggguacaauaa

SEQ ID NO: 33215 - RNA, 1629 nt, Artificial Sequence
  derived and/or modified sequence opt6 from VP1_capsid_protein__Norovirus__BAL60763
augaaaauggccaguaaugaugccgcaccaagcacagauggagcagcaggucuagucccugaaucaaauaaugaaguaauggcauuagaaccaguagcuggagcugcauuagcagccccaguaacaggacaaaccaauauaauagacccauggauuagagccaacuuuguacaagcuccuaauggagaauuuacuguaucaccaagaaaugcaccaggcgaaguacuauuaaacuuagaacuuggaccagaacuaaaccccuaucuagcacaucuagcaagaauguacaauggauaugcaggaggaauggaaguacaagucaugcuagcuggcaacgcauuuacugcaggaaaacuaguuuuugcagcaguuccaccacauuucccuauagaaaacuuaucaccucaacaaauaacaauguuuccccauguaauaauagaugucagaacacuagaacccguauuauuaccacuuccagauguucgcaacaauuuuuuccacuauaaccaaaaagaugauccaaaaaugcgcaucguagcaauguuguacacaccauuaaggucaaauggaucaggcgaugauguauucacuguaucauguagaguuuuaacaagaccaucaccagacuuugauuucacauaccuuguaccaccaacaguagaaucaaaaacaaaaccuuuuaccuuaccaauacuaacacuuggagaauuauccaauucacgauucccugucucaauagaucaaauguauacaucuccaaacgaaguuauaucaguacaaugucaaaauggaagguguacacuagauggagaauuacaaggaacaacucaacuacaaguaucuggcauuugugcauucaaaggcgaaguaacugcacaucuacaugacaacgaucaucuauacaauauaacaauuacaaacuugaacgguucaccauuugauccaucagaagacauaccagcaccacuuggaguaccagacuuccaaggaagaguuuucggcauaaucucacaacgugauaaacauaauagcccuggacauaaugaaccagcuaaccgaggacaugaugcuguaguaccaaccuauacugcacaauauaccccuaaauuaggacaaauacaaauagguacauggcaaacagacgaccuaacaguuucacaacccguaaaauuuacaccaguaggauuaaaugauacugaacacuuuaaucaauggguagucccacgcuaugcuggugcauuaaauuuaaauacaaauuuagcaccaucaguugccccaguauuuccuggcgaaagguuacuuuuuuuucgaaguuacauaccauuaaaagguggauauggcaauccagccauagacuguuuauuaccccaagaauggguacaacauuuuuaucaagaagcagcuccaucaaugucagaaguagcacuaguaagauacauuaaucccgacacugguagagcauuauuugaagcaaaacuucauagagcgggauuuaugacagucaguucaaauacaucagcaccuguaguagucccagcaaauggauacuuucgauucgauucauggguaaaccaauuuuauucauuagcaccaaugggaacaggaaacgguagaagaagaguacaauaa

SEQ ID NO: 33216 - RNA, 1629 nt, Artificial Sequence
  derived and/or modified sequence opt6 from VP1_capsid_protein__Norovirus__BAL60765
augaaaauggcaucaaaugaugcagccccaucaacagauggagcugcaggacugguacccgaaucaaauaaugaaguaauggcauuagaaccagucgcaggugccgcuuuagcagcaccaguaacaggacaaacaaacauuauugaccccuggauuagagcaaauuuuguacaagcccccaauggagaauucacuguaucaccacgaaaugcaccaggagaaguacuauuaaauuuagagcuaggaccagaacuaaaucccuaccuagcacaucucgcaagaauguauaauggauaugcuggaggaauggaaguccaaguaaugcuagcugguaaugcuuuuacagcaggcaaauuaguuuuugcagcugucccaccacauuuuccaguugaaaacuugagcccacaacaaauaacaauguuuccucacguaauaauagauguuagaaccuuagaaccuguucuauuacccuuaccagauguacgaaauaauuuuuuucauuauaaucaaaaagacgauccaaaaaugagaauuguagcaaugcuauacaccccauuacgaucaaacggauccggagacgauguauucacuguauccuguagaguauuaacacgaccuucaccugauuuugauuuuacauaucuuguaccucccaccguagaaagcaaaacuaaaccuuucacccuaccaauauuaaccuugggagaauuaucuaauuccagguuuccaguaucaauagaucaaauguacaccucaccaaaugaagucauuagcguacaaugucaaaacggaagaugcacacuagauggagaauuacaaggaacaacccaauuacagguaucuggaauaugugcuuucaaaggugaaguaacagcacauuuacaugauaaugaucaucuauauaauguaacuauaacuaacuuaaauggaucaccguuugacccaucagaagauauaccagcaccauuagguguaccagauuuccaaggcagaguauuuggaauaguaucucaacgagauaaacauaauucaccaggccacaaugaaccagccaacagaggacaugaugcuguagucccaacauacacagcacaauauacaccuaaacuuggucaaauucaaauagguaccuggcaaacagaugaccuaaccguaaaucaaccuguaaaauuuacuccagucggacuaaaugauauagaacauuuuaaucaaugggucguaccucguuacgcaggagcccuuaaccuuaauacaaaucuagcuccauccguagcaccugucuuucccggagaacgucuccuauuuuuuagaucauacauaccucuuaaaggagguuauggaaacccagcaauagauuguuuauuaccucaagaauggguucaacauuucuaucaagaagcugcacccaguaugucugaaguagcacucguuagauauauaaauccagauacuggcagagcauuauucgaagcuaaauuacauagagcaggcuuuaugacaguaucuucaaauaccucagcaccaguaguugucccagcuaacggauacuuccgauuugacucauggguaaaucaauuuuauucauuagcaccaaugggaacaggaaacggaagacgaagaguacaauga

SEQ ID NO: 33217 - RNA, 1629 nt, Artificial Sequence
  derived and/or modified sequence opt6 from VP1_capsid_protein__Norovirus__BAL60787
augaaaauggcaucuaaugacgcagcuccuuccacugauggagccgcaggacuaguaccagaaucaaacaacgaaguuauggcacuagaaccagucgcaggugccgcucuagcagcuccaguaacgggucaaacaaauauaaucgauccauggauaagagcaaacuuuguacaagcaccaaauggagaauuuaccguaaguccaagaaauucaccaggagaaguacuauuaaaucuugaauuaggaccugaacuuaauccauacuuagcacaccucgccagaauguauaacggauaugcagggggaauggaaguacaaguaauguuagcaggaaacgcauuuacagcaggaaaauuaguuuuugcagcaguacccccucauuuuccaguagaaaaucuuucuccacaacaaaucacaauguucccacauguaauaauugacguaagaacacuagaaccaguucucuuaccacucccagauguaagaaacaacuucuuucauuauaaucaaaaagaugauccaaaaaugagaauaguagccaugcuauauacaccucuucguucuaauggaucaggugaugacguauucacaguaucauguaggguuuuaacacguccuucaccugauuuugacuuuacuuaccucguacccccuacuguagaaucaaaaaccaaaccuuuuacacuaccaauauuaacauuaggagaauuaaguaauaguagauuuccaguuaguauagaccaaauguauacaucuccuaaugaaguaaucucaguucaaugccaaaacggaagauguacuuuagacggcgaacuacaaggaacaacacaacuacaaguuucaggaaucugcgcauuuaaaggugaaguaacugcacauuuacaugauaacgaucacuuauacaaugucacaauaacaaacuuaaauggaucacccuuugaucccucagaagacauaccagccccccucggcgucccagacuuccaaggaagaguauuuggaguaauaucccaacgagauaaacauaauacuccaggacauaaugaaccagcaaaucgagcacaugaugccguuguaccaaccuauacagcacaauauacaccaaaacucggacaaauccaaauagguacauggcaaaccgacgacuuaaccguuaaucaaccagucaacuuuacuccaguaggauugucugacacugaccacuuuaaucaaugggucguaccacgauacgccggagcccucaaucucaauaccaacuuagcuccaucaguagcaccaguuuuuccaggagaaagacuauuauuuuuuagaucuuauauaccauuaaaaggcggauacggaacuccugcaauagauugcuuauuaccucaagaauggguucaacauuucuaccaagaagcagcacccucaaugucugaaguagcacuaguaagauauauuaauccugauacaggaagagcacuuuuugaagcuaaauugcacagagcaggauucaugacaguaucuucaaacacaucagccccagucguaguaccugcuaauggauauuuuagauuugacucauggguaaaucaauuuuauucuuuagcaccaaugggaaccggaaauggacgaagaaggauacaauaa

SEQ ID NO: 33218 - RNA, 1629 nt, Artificial Sequence
  derived and/or modified sequence opt6 from VP1_capsid_protein__Norovirus__BAL60789
augaaaauggcaucaaaugacgcagcaccuucaacagauggugcagcaggacucguaccagaaucaaauaaugaaguuauggcacuagaacccguugccggagcagcauuagcagcaccagucacaggacaaacaaauauaauugacccuuggauacgagcuaauuucguacaagcaccaaauggagaauuuacaguaucaccaagaaaugcaccaggagaagucuuacuaaaucuagaauuaggaccagaauuaaauccauaucuagcucacuuagcaagaauguauaauggcuacgcaggaggaauggaaguacaaguuauguuagcaggaaaugcauucacagcugguaaacuggucuucgcagcaguccccccccauuuucccguagaaaaucuaucaccucaacaaauaaccauguucccacacguaauaauagauguuagaacacuagaaccagucuuacuaccacuaccugauguacgaaauaacuuuuuucacuauaaccaaaaagaugauccaaaaaugagaauuguugcaauguuauacacaccacuuagaucaaacggaucaggagaugacguauuuacuguaucuugcagaguuuuaacacgcccaucacccgauuuugacuuuacauaccucgucccaccaacaguagaauccaaaacaaaaccuuuuacacuacccauacuaacacuuggugaacucucaaacucaagauuuccaguauccauugaccaaauguauacuuccccaaaugaaguaauaucuguucaaugccaaaacggaagaugcacucuagacggugaauuacaaggcacaacacaacuucaaguaagcggaauaugugcauucaaaggagaaguaacagcacaucuacaugacaaugaucaucuuuacaauauaacuauaacuaaucucaacggaucaccuuuugacccaucagaagauauacccgcaccacuaggaguaccagacuuucaaggccgcgucuucggaauaauaucacaaagagauaaacauaacuccccaggacacaaugaaccugcuaaucguggucacgaugcaguuguccccacauacaccgcacaauacacuccaaaacuaggacaaauacaaauaggaaccuggcaaacugacgaucuaacaguaagucaacccgucaaauucacacccguuggauuaaaugauacagaacacuucaaccaauggguagucccaagauaugcaggagcacuaaacuuaaauacuaauuuagcaccuucaguagcaccaguauuuccuggagaacgacuacuauuuuucagaucuuauaucccacuaaaaggaggauauggcgauccggcaauagauugccuacuaccacaagaauggguacaacauuucuaucaagaagcagcucccucuaugucugaaguagcacuuguacguuauauaaauccagacacaggccgugcauuauuugaagcaaaacuacauagagccggauucaugacaguaucuucaaauacaagugccccaguuguaguaccugcuaacggcuauuuccgauuugauuccuggguaaaucaauuuuacucccuagcaccaaugggaacaggaaauggacguagacgaguacaauaa

SEQ ID NO: 33219 - RNA, 1629 nt, Artificial Sequence
  derived and/or modified sequence opt6 from VP1_capsid_protein__Norovirus__BAL60807
augaaaauggcuucaaaugacgcugcuccaucaacagacggagcagccgguuuaguacccgaaucaaacaaugaaguaauggccuuagaaccagucgccggagcagcgcuagccgcuccaguaacuggucaaacaaacaucauagauccauggauaagggcaaauuuuguccaagcaccgaacggugaauuuaccguaucuccaagaaauuccccaggagaaguauuacuaaaucuagaacuagguccagaacuaaacccauaccuagcacacuuagcccgaauguacaaugguuaugcaggcggaauggaaguccaaguaauguuagcaggaaacgcuuuuacugcaggaaaacucguuuucgccgcaguuccaccacacuuccccguagagaauuuaucaccacaacaaauaaccauguucccacacguuauaauagacguaagaacauuagaaccaguuuuacuaccgcuuccagacguaagaaauaauuucuuccacuauaaccaaaaagaugacccaaaaaugagaauaguagcuauguuauacacuccauuaagaucaaacgguucaggagaugauguauuuacaguuucauguagaguucucacccgaccuucaccugacuuugauuucacauauuuagucccaccaacaguagaaucaaaaacaaaaccauuuacuuuacccauauuaacucuuggagaauuauccaacucacgauuuccaguaucaauagaccaaauguacacaucaccaaaugaaguaauuucaguucaaugucaaaacggucgcuguacacucgacggagaacuccaaggaacaacacaauuacaagucuccggaauaugugcauuuaaaggagaaguuaccgcacaccuucaugauaacgaucaccuuuauaauguaaccauaaccaaucucaacggaucaccauucgacccuucagaagauaucccagcucccuuaggaguaccagacuuucaaggacguguauucggaguaauaucccaaagagacaaacauaacacaccaggacauaaugaacccgcaaaucgagcacaugacgcaguaguaccaacauauacagcacaauauacaccaaaauuaggacaaauacaaauaggaacauggcaaacagacgaccucacaguaaaucaaccaguaaacuuuacccccguuggacuaaacgacacagaucacuuuaaucaauggguaguaccaagauaugcaggcgcucuaaaccuaaacacaaaccuagcaccaucuguugcaccaguguucccaggagaaagacuacuuuuuuuuagaucuuauauuccuuuaaaaggaggauauggaacaccagcaauagauugccuucuaccacaagaauggguucaacacuucuaucaagaagcagcuccuucaaugucugaaguagcauuaguacgauacauaaacccggacaccggucgugcauuauucgaagcaaaauuacauagagcuggauucaugacaguaucaucaaauacaucagcaccaguagucguaccagcaaauggauacuuucgcuuugacucauggguaaaucaauuuuacucucuagccccuaugggaacuggaaacggaagaagacgaauacaauaa

SEQ ID NO: 33220 - RNA, 390 nt, Artificial Sequence
  derived and/or modified sequence opt6 from capsid__Norovirus__ACL14997
auggcaucaaaugacgcagcaccaucaaaugacggagcagcaggauuaguaccagaaucaaacaaugaaguaauggcacuagaaccaguagcaggagcaucacuagcagcaccaguaacaggacaaacaaauauaauagacccauggauaagaaugaacuucguacaagcaccaaacggagaauucacaguaucaccaagaaacucaccaggagaaguacuacuaaaucuagaacuaggaccagaacuaaauccauacuuagcacacuuaucaagaauguauaacggauacgcaggaggaauggaaguacaaauaaugcuagcaggaaacgcauuuacagcaggaaaacuaauauucgcagcaguaccaccauacaauagaagauguuaa

SEQ ID NO: 33221 - RNA, 561 nt, Artificial Sequence
  derived and/or modified sequence opt6 from truncated_capsid_protein__Norovirus__ACB56490
augaaaauggcaucaaacgacgcaaacccaucagacggaucagcagcaaaccuaguaccagaaguaaacaacgaaguaauggcauuagaaccaguaguaggagcagcaauagcagcaccaguagcaggacaacaaaacguaauagacccauggauaagaaacaacuucguacaagcaccaggaggagaauucacaguaucacccagaaacgcaccaggagaaauacuauggucagcaccacuaggaccagaccuaaacccauacuuaucacacuuagcaagaauguacaacggauacgcaggaggcuucgaaguacaaguaauacuagcaggaaacgcauucacagcaggaaaaauaauauucgcagcaguacccccaaacuucccaacagaaggacuaucaccaucacaaguaacaauguucccacacauaauaguagacguaaugcaacuagaaccaguacuaauaccacuaccagacguacgaaauaacuucuaccacuacaaccaaucaaacgacucaacaauaaaauucgacucaaacgcaguauacacaacauaa

SEQ ID NO: 33222 - RNA, 627 nt, Artificial Sequence
  derived and/or modified sequence opt6 from truncated_capsid_protein__Norovirus__ACF77106
augaaaauggcaucaaacgacgcaaacccaucagacggauccgcagcaaaccuaguaccagaaguaaauaacgaaguaauggcacuagaaccaguuguaggagcagcaauagcagcacccguagcaggacaacaaaacguaauagacccauggauaagaaacaacuucguacaagcaccaggaggagaauucacagucucaccaagaaacgcaccaggagaaauauuaugguccgcaccauuaggaccagacuuaaacccauaccuaucacaccuagcaagaauguauaacggauacgcaggaggauuugaaguacaaguaauauuagcaggcaacgcauucaccgcaggaaaaauaauauucgcagcaguaccaccaaacuucccaacagaaggauuaucaccaucacaaguaaccauguucccacacauaauaguagacguaagacaacuagaaccaguacuaauaccauuaccagacguaagaaauaacuucuaucacuacaaccaaucaaacgacucaacaauaaaacuaauagcaauguuauacacaccacuacgagcaaacaacgcaggagaagacguauucaccguaagcugcagaguauuaacaagaccaauaucauaa

SEQ ID NO: 33223 - RNA, 627 nt, Artificial Sequence
  derived and/or modified sequence opt6 from truncated_capsid_protein__Norovirus__ACF77107
augaaaauggcaucaaacgacgcaaacccaucagacggaucagcagcaaacuuaguaccagaaguaaacaacgaaguaauggcacuagaaccaguaguaggagcagcaauagcagcaccaguagcaggacaacaaaacguaauugacccauggauaagaaacaacuucguacaagcaccaggcggugaauucacaguaucuccaagaaacgcaccaggagaaauccuauggucagcaccacuaggcccagaccuaaacccauaccuaucacacuuagcaagaauguacaauggauacgcaggaggauucgaaguacaaguaauacuagcaggaaaugcauucacagcaggcaaaauaauauucgcagcaguaccacccaacuucccaacagaaggauuauccccaucacaaguaacaauguucccacacauaauaguagacguaagacaacucgaaccaguacuaauaccacuaccagacguaagaaacaacuuuuaucacuauaaccaaucaaacgacucaacaauaaaauuaauagcaauguuauacacaccacuaagagcaaacaacgcaggagaagacguauucacaguaucauguagaguacuaacaagaccaucacccuaa

SEQ ID NO: 33224 - RNA, 66 nt, Artificial Sequence
  derived and/or modified sequence opt6 from truncated_capsid_protein__Norovirus__ACU28807
augaaaauggcaucaaaugacgcacacccaucagacggaucagcagcaacaucaucacaaagauaa

SEQ ID NO: 33225 - RNA, 312 nt, Artificial Sequence
  derived and/or modified sequence opt6 from truncated_capsid_protein__Norovirus__ACU28808
augaaaauggcaucaaaugaugcaaauccaucagacggaagugcagcaaauuuaguaccagaaguaaauaaugaaguaauggcauuagaaccaguaguaggagcagcaauagcagcaccaguagcaggacaacaaaauguaauagauccauggauaagaaauaauuuuguacaagcaccaggaggagaauuuacaguaucaccaagaaaugcaccaggagaaauacuauggagcgcaccauuaggaccagacuuaaauccauacuuaagucaucuagcaagaauguacaauggauaugcaggaggauuauaa

SEQ ID NO: 33226 - RNA, 123 nt, Artificial Sequence
  derived and/or modified sequence opt6 from truncated_capsid_protein__Norovirus__ACV03476
augaaaauggcaucaaugacaccaacacaccuaaugggcccacaaccaacaucaucacaaagaucaacaaugagacuauggcuauggucaccauuaucaguaccauuacucagaagacuauaa

SEQ ID NO: 33227 - RNA, 87 nt, Artificial Sequence
  derived and/or modified sequence opt6 from truncated_capsid_protein__Norovirus__ACV03479
augaaaauggcaucaaugacaccacuacaucuaaugaugguaccaccagcaucaucacaaagaucaacaaugagacaauggagauaa

SEQ ID NO: 33228 - RNA, 1623 nt, Artificial Sequence
  derived and/or modified sequence opt6 from capsid_protein__Norovirus__AFN70960.1
augaaaauggccucaaaagacgcgaaucccagcgacggaucaacagcaaaucuaguaccagaagucaauaaugaaguaauggcacuagaacccguaguaggcgcagcaauagcugcgccaguagcaggacaacaaaauguaauugauccauggauaagaaacaauuuuguacaagcuccagguggugaauuuacaguaucaccuagaaacgcaccaggugaaauccuauggucugccccacuagguccagaucuuaauccuuaucuaucacacuuagccagaauguauaacgguuaugccggaggguucgaaguccaaguaauacuagcaggaaaugccuuuacagcaggaaaaguaauuuuugcagccguuccaccaaacuuuccaacagaaggacuaucucccucucaaguuacaauguucccacauauaguagucgaugucagacaacuagaaccaguucuaauuccacuaccagacguaagaaacaauuuuuaucauuacaaucaaaguaaugaucccaccauaaaacuaauagcaaugcuauauaccccauuaagagcuaacaaugcaggagaagauguuuuuacaguaucauguagaguauuaacccgaccaucaccugauuuugacuuuauauucuuagucccaccuaccguagaaucaagaacuaaacccuucacaguaccaaucuuaacaguugaagaaaugacaaauucaagauuuccaauuccauuagaaaaacuauuuacaggaccaucaggagcuuucguuguacaaccgcaaaauggacgaugcacaacugacggaguacuauuaggaacaacucaacucucacccguaaauauauguaccuuuagaggagacguuacacacauagcaggcacacacaauuacaccaugaacuuagcaucacaaaauuggaacaauuacgauccaacagaagaaauaccagcaccacuaggaacaccagacuuuguaggacgaauacaagguauguuaacacaaacaaccagaggagacggaucaacccgaggucauaaagcuaccguaucaacaggugacguacacuucacaccaaaauuaggaucaauacaauucaacacagauacuaauaaugauuucgaaacuggacaaaauacaaaauucacacccguaggaguaguacaagacggaaacggaacacaucaaaacgaaccacaacaauggguacuaccuagcuacucaggcagaacaggacauaacguacauuuagcaccagcaguagcaccaacauuuccaggagaacaauuacuauuuuuucgcucaacaaugccaggauguucaggcuauccaaacaugaaucuggauugucuacuuccacaagaauggguacaacauuuuuaucaagaagccgcuccagcacaaagcgauguugcauuacuacguuucguaaauccagauacaggacgcguacuauucgaaugcaaacuacauaaaucagguuauguaacaguagcacacacagggcaacacgauuuaguuauaccaccaaacggauauuucagauucgauagcuggguuaaucaauuuuauacccucgcuccuuuaggaaauggaacaggacgaagacgagccuuauaa

SEQ ID NO: 33229 - RNA, 1629 nt, Artificial Sequence
  derived and/or modified sequence opt6 from VP1__Norovirus_and/or_Norovirus-like__X81879
augaaaauggcuagcaaugaugcagcaccaucaacagauggcgcagccgguuuaguuccagaaucaaacaaugaaguaauggcacuugaaccuguugcaggagcugcacuagcagcaccaguaaccggacaaaccaacauuaucgauccauggauacgugcaaauuuuguacaagccccaaauggagaauuuacagucucuccuagaaaugcuccaggagaaguccuacuaaaucuugaacuagguccagagcuaaauccuuauuuagcacaccuagcaagaauguauaacggauaugcuggaggaauggaaguacaagucaugcuugcaggcaaugcauuuacugccggaaaauuaguuuucgcugcaguaccaccacacuuuccaguugaaaaccuaucaccccagaaaauaacaauguucccacauguaauaauagauguaagaacacuugaaccaguacuauuaccauuaccagauguuagaaacucauuuuuccauuauaaucaaaaagaugacccaaaaaugcgaauaguugcgaugcuauacacaccauuaagaaguaauggaucaggagaugacguauuuacuguaucuugucgagucuuaacucgaccuucaccagacuuugauuucacauaccuaguuccucccaccguagaauccaaaaccaaaccauucacauuaccaauauuaaccuuaggagaacucucuaauucucgcuuuccaguaccaauugaucaaauguacacauccccaaacgaaguuauaucaguacaaugucaaaacggaagauguacacuagauggagaacuacaaggaacaacacaacuacaaguaucaggcauaugcgcauuuaaaggagaaguaacugcucaucuucacgacaaugaccaucuaaacaacgucacuauaacaaacuuaaacggauccccuuuugauccaucugaagauauaccagcaccacuaggcguacccgauuuccaaggacguguuuucggaguaauaucacaaagagacaaacaaaaugcagcaggacacuccgaaccagcuaauagaggacaugacgcaguaguaccaaccuauacagcucaauacacuccaaaauuaggacaaauccaaauaggaacauggcaaacugacgaucucacaguaaaucaaccaguaaaauuuacccccguagguuuaaaugacacagaacauuucaaccaauggguuguacccagauaugccggagccuuaaaccuaaauacaaacuuagcuccaucaguagcaccaguuuuuccaggagaacgauuacucuuuuuccguucucauuuaccacuaaaaggagguuauggcaaucccgcuauagauuguuuacuaccacaagaauggguccaacacuuuuaccaagaagcagcaccauccaugucagaagucgcauuagucagauauaucaauccagacacugggagagcucuauucgaagcuaaauuacaucgagccggauuuaugacaguaucuucuaauacaucagcaccuguuguaguaccagcuaauggauacuucagauucgacucauggguaaaccaauuuuacucauuagcaccaaugggaacaggaaacggaagaagaagaguacaauaa

SEQ ID NO: 33230 - RNA, 1728 nt, Artificial Sequence
  derived and/or modified sequence opt6 from VP1__Norovirus_and/or_Norovirus-like__FJ875027
augaaaauggcuucaaaugaugcagccccaccaucauccgauggugcagcuaauuuaguaccggaaauaaauaacgaaguaauggcacucgaaccaguagcaggcgcacaauuagcagcaccugucgcaggucaauucaaugcuauagacccauggauacgacaaaauuucguacaggcaccagaaggagaauuuacaguaucucccagaaacgcuccaggagaaauauuauuaaaucuagaauuaggaccucaccucaaccccuucuuacaacaucuagcacaaauguauaaugcuuacgcaggaggaauggaaguacaaguuguccuagcaggaaaugccuuuacagcaggaaaaauaauauucgcagcaauuccaccacacuuuccucccgaaagacuauccgcagcacaagcaacccaauucccucauguuauaguagacguacgucaauuagaaccaauaguauuaccauuaccagacguacgacauaaucucuuucacuuuaaucaacaaaacgacgaaagaaugcaucuaguagcauucuuauacacaccacuaagagcaaacagcggaaacggagacgauguauuuacuguaaguuguagaguauuaaccagaccaucucaagauuuugaauuuauguucuuaguaccuccuacaguugaaaagaaaacaguagcuuucucauuaccucaacuagcuguaggagaaaugucaaauucgcgauggccagcaagaauaacagguaugguuguagauccuagauuaccgcaaguauuacauauacaaaaugggagaugcacacuagacggaacuuuaaugggaacaacacaacuaaacccaaaugacauuuguagaauaagaggauauuucucaucaaguagaccugaacuucugugugaaggagaagaaucagaaguuaauacaacaccaacagacaguggugcaacaggugaucaaaccccugaaguacguacagguacgagagcuacacaaagaugguucgccgucacagaacuuaauggacaaguauaugauccuuuuggagaccaaccagcuccacuaggaguuccagauuuuaaagcaagaauacucggagcacucaugagauuaccaggaacuaacccaacaagcaacagcagauuugaagaugcauggguugaaacuaauaaucaaacaacuuacgccccagcaacugguguaguagcaauaacaacaaacgauaauucaagugguaauuaugcaaaugaccaaacaugugaguucguaccauuaggaauugaaauuacagacucagcuccauacaaugaauuugacuuaccaagcuauggcggugcagccaguagugguaauagaaacuuagcaccaacaguagcuccaaccuucccaggugaagcaauacuauuauuuggaucaaauaugcccguauacaauagauccaguggaaccgauaacaaagacauaagauguuuacuacccaacgaauacguacaacauuuauaugauacacaagcaccuucuuuaucagauguagcucuaguaagauacguaaauagagauacaggaagaguuuuauucgaagcaaaacuacauagagacggauucaugacuguuaaugcaucuucaaccacaguccuaccaguagauggauauuuccgauucgauucauggguaaaccaauuuuaugcccuaucuccuguugguaaugcaucaggucgaagauaa

SEQ ID NO: 33231 - RNA, 1725 nt, Artificial Sequence
  derived and/or modified sequence opt6 from VP1__Norovirus_and/or_Norovirus-like__JF939046
augaaaauggcaucaaaugaugcagcaucaccaucuucagauggagcagcuaauuuagucccagaaauaaauaaugagguaauggcuuuagaaccuguagccggagcacaauuagcagcaccaguagcgggacaauuuaacgcaauagaucccuggauaagacaaaacuuuguacaagcuccugaaggagaauuuacagucucuccccgaaaugcuccuggagaaauacuauuaaacuuagaauugggaccucaccuaaauccauuuuuacaacauuuagcccaaauguauaaugcuuaugcuggaggaauggaaguacaagucguauuagcaggcaacgcuuuuacagcaggcaaaauaauauucgccgcuguaccaccacauuuuccaccggaacgauuaagcgcagcucaagcuacccaauuuccucacguaauuguagauguaagacaauuagaaccaauuauuuuaccauuaccugauguccgccauaacuuguuccauuuuaaucaacaaaacgaugaaagaaugcaucuaguagcauuccucuauacaccacuaagagcuaauucaggcuccggcgacgacguauuuacaguuucaugccgaguuuuaacucgaccaagucaagauuuugaauuuauguuuuuagucccaccaacaguagaaaaaaaaacaguagccuuuucucuaccccaauuagcaaucggagaaaugucaaauucaagauggccugcacguauuacuggucuaguuguugauccacgucucccacaaguauuacauauacaaaauggacgcugcacauuagacggcacauuaaugggaacaacccaauuaaacccaaaugauauauguagaauccgaggauacuucucuucaucaagaccagaauuauuaugcgaaaacgaagaaucugcaacagacccaaugccaacagaaacagacacagacaaucaaccaccugaaguaagagcacaagcaagagccacccaacguugguucgccguaacugaauuaaauggccaaguauacgacccuuuuggagaccaaccagcaccccuaggagucccagauuucaaagcuagaauauuaggagcacuaaugcgauuaccuggcacaaacccuaccucuaauucaagauucgaggaugccuggguagaaacaaacaaucaaacuacauacgcaccagcagccggcguaguagccauuaccacuaaugacaauucaucauccaacuaugcuaaugaccaaacaugugaauucguaccccuaggaauugaaauaacagacucagcucccuaucacgaauucgaccuuccaagcuaugguggagcagcaucaucaggaaaucgaaaucuagcaccaacuguugcaccuacauucccaggagaagccauacuauuauuuggaucuaacaugccaguuuacaacagaaauacugguacaucuaacaaagacauaagauguuuacucccuaaugaauauguacaacaucuauaugauacacaagcaccuucauuaucugaugucgccuuaguaagauauguaaauagagauaccggaagaguccuauuugaagcaaaacuacaucgagacggauuuaugacagucaacgcaucaucaaccacuguacuaccuguagauggcuauuuuagauuugauucuuggguaaaucaauuuuaugcauuauccccaguugguaaugccucuggccgcagauaa

SEQ ID NO: 33232 - RNA, 1722 nt, Artificial Sequence
  derived and/or modified sequence opt6 from VP1__Norovirus_and/or_Norovirus-like__JF930689
augaaaauggcgucaaaugaugccaccgcaccuucacaagacggugcagcuaauuuaguaccugaaagucaacaugaaguauuagcucuugaaccuguagcaggagcagcacuagcagcucccguugcaggccaauuuaaugcaauagacccuuggauaaaacaaaauuuuguucaagccccagccggugaauuuacugucucaccgaggaaugcaccuggagaaauacuaauggaccuagaacuaggacccgaacuaaacccauuucuugcacauuuagcucaaauguauaaugcauaugcugguggaauggaaguucaaauaauauuagcaggaaaugcauuuacugcuggaaaaauuauaguuugcgcugucccaccaaauuuuccaccagacagacuaucagcaucacaagcaacaaauuuuccacauguaaucauggauguuagaacacuagaaccaguaauauuaccacuacccgauguccgcgcaggauuuuuccacuacaaucaauuacgugaaccucgaaugagacuuauggcccuguuauauacaccacuacgagcaaauggaacuggugaugaugcuuuuacaguaucaugucgaguacuaacuagaccaaugcaagauuuugaauuuauguuuuuaguaccaccuaccguagaaucuagaguaacaccuuucuccguuccuacauauccuguuguagaaaugacaaauucuagauggccagcaaggauuaguggaaugcauguuaaugcaaaucaaacucuagcuguucaauuccaaaacggaagauguaccuuagauggacaauuaaugggcacuacacaauuaugugcagcagauguauguagaaugagagguagauacacaucuaccagagcagaucuagcaggcguugaccauacagaucaaggaccaucuuuaggaaccggacccucugacgacucaguaucaguaccagaagcacgagcacaaacacguacaggaguuucagcacaccuacaauuagaggaacuuaauggacaaccuuaugaaguauauggagaacaaccagcuccacuagguacaccugauuuccguugucgacuaaugggcgaacucguucgguuaccauccacuucuccugcugcacaaucaagauuuagggaugccuuuuucgauacuuauggagcacuauuugcgccugcaguagguucaacaacauuuacuguuaauaauaguucaacaucagacuucgcaaacggacaaccauuugaauuucuaccuaucggaguagaaauaggaaacagugcccaauaugacgaauuugcccuaccuucauauaacggagcaauaggagaaaacagacauuuagcaccaguugcagcuccaggauucccgggagaaaauauaguuuucuuuucauccaauuuacccguaugggauucaacaucagcacaaaauaauagaagaauaucaugucuauuaccaaaugaauuuguacaacacuuuuaugauuuacaagcacccucacaauccgauguagcauuauuaagauauguacauccagaaucaggcagaguucuauuugaauguaaacuuuaucgagauggauuuuuaacaguaaauggcgcaucccuagcugaauuuccuguuaaugguuacuuuagauuugacucuugggucaaucaauucuuuacacuuucaccuguaggcacugguucagguagacgcuaa

SEQ ID NO: 33233 - RNA, 1719 nt, Artificial Sequence
  derived and/or modified sequence opt6 from VP1__Norovirus_and/or_Norovirus-like__GQ443611
augaaaauggccucuaaugaugcuacugcaccuagucaagauggagcagcaaauuuaguccccgaaagucaacaugaaguacuagcacuagaaccaguagcuggugcagcuuuagcugcaccaguugcaggacaauuuaacgccauagauccauggauaaaacaaaauuucguacaagcuccagcuggugaguuuacaguuucgccacgaaaugcacccggagaaauuuuaauggauuuagaacuuggaccugaacuuucucccuuuuuagcucaucuugcacaaauguauaaugcuuaugcugguggaauggaaguacaaauaauauuagccggaaaugcauuuacagcagguaaaauaauaguaugugcuguaccuccaaauuuuccaccagauagauuaagugcaagccaagcaacuaauuuuccucacguuauaauggauguaagaacccuagaaccaguuauauuaccucuaccagauguaagagccggauucuuucacuacaaucaacuacgugaaccaagaaugcguuuaauggcucuacuauauacaccacuaagagcaaaugguacuggagacgaugcauucacuguaucauguagaguauugacuagaccaaugcaagauuuugaauuuauguuucuaguaccaccaaccguagaaucaagaguaacacccuucucaguaccaacauauccaguuguagaaaugacuaacucaagguggccagcccgaauuucaggaaugcauguuaaugcaaaucaaacauuagccguacaauuucaaaauggucgaugcacacuagauggacaacuaaugggaacaacacaacuuugcgcugcagacguaugccgaaugagagguagauauacaucaacucgagcugauuuagcaggaguagaccauacagaucaaggaccaucauuaggagcaggaccuucaaaugacccuguauccguaccugaagcaagaucccaaacaagaacuucaguauccgcucaucuacaauuagaagaauuaaacggucaaccauaugaaguuuauggggaacaaccagccccucuagguacccccgauuucuguuguagauuaaugggcgaauuaguacguuuacccagcacaucuccagcagcacaaucuagauuucgagaugcauuuuucgacaccuauggugcccuauuugccccugcgguuggaucuacaacuuucacuguaaauaauucuucaacaucagauuucgccaauggucaaccauuugaauuucucccaauuggaguagaaauuggaaacucugcccaauaugaugaauuugccuuaccaucuuauaauggugcaauuggagaaaaucgacauuuagcaccaguagcagcaccaggauucccuggugaaaauauagucuucuucucuucaaaucuaccugucugggauaguacaucagcucaaaacaauagaagaauuuccugucuacuaccgaaugaauuuguacaacacuuuuaugauuuacaagccccuucacaaucugacgucgcacuauuacgcuacguacacccugaaucaggucgaguucuauuugaauguaaacuauaccgugaugguuuccuaacaguaaacggagcuucacuagcagaauuuccaguaaacggauauuuuagauuugauucuugggucaaucaauuuuucacauuaucuccuguuggaacagguucaggaagauaa

SEQ ID NO: 33234 - RNA, 1719 nt, Artificial Sequence
  derived and/or modified sequence opt6 from VP1__Norovirus_and/or_Norovirus-like__EU224456
augaagauggcaucaaacgaugcagcuccaaguucagauggagcuggaaaccuuguaccagaaagucaccaagagguacuaccuuuagcaccaguugcaggagcugcaauugcagcaccaguaguuggacaacaaaauauaauagauccauggaucaaagaaaacuuuguacaagcaccucaaggagaauuuacaguuucuccuaaaaacucuccaggcgaaguuuuaguaaauuuagaacuuucuccaaaauuaaauccauacuuggaucacuuaucaaaaauguauaaugcuuacgcuggaggaauggaaauagaaauuauuuuagcaggaaaugcauuuacagcugggaaaguauuaaucgcagcagucccuccaaauuucccaguagaaaauauaucaguuucccaagcaucccaauucccacauguaauaguagauguuagaacauuagaaccaauaagacuuccauuaccagauguaagaacaaacuucuuucauuauacaacacgugaugaaccaaaaaugagaauuguagcaugguuauauaccccacucagaacaaauggcaguggugaugauucuuucacaguaucaggaagaauauuaacacgccccagugcagacuuugaauuuagcuuuuuaguucccccaacuguagaaacgaaaacaguaucauucucagucccaggcuuaacuguagaagaaaugucaaauucucgauggccugcucaaauaaauggccuaguugucagaggaaaugaggcccaaguuguacauuuccaaaauggcagauguacaaccgaaggaauguuacuugguacuacgacauuaaauguaaauucuaucugcggacuacgaggaacaucuauaucccaugccucaguaagagaagcaccagcuuuaucagaagaaaugccaccuuuagaagacgaagucgcucauggagccgcagcaacauaugcugucgguagagcagcagauacaaccuuauggauaagaguugaagaaccaaacggacaaccauaugauauauucggagaacaaccugcuccacuuggaacuccugacuuuacagcuguaauaauaggcacagcaauaagaccaagaaccgcuaguggugcauauuuacaugacgcauaugucgacacacgaccaggagaugcagauuucacaccuucaacaggaaauaccaaaauaguauuacgaggaggaggaaguggacacguuggugaaggacauuacuggcaauucaaaccuauagcugucgaaggaggcccaaaucguccaguuuaccaagaauauaaucuuccagaauaugcuggaccaacagccucaaaccacaacuuagcaccuccaguugcaccuaaaaugccaggagaacuauuauuauuauuugaaucagauaugccaguaugggauaauggaagugguucagcaccaacucagaaaauacauugcuuguuaccaaacgauuuuguaacucauuucuuugacuuacaagcuccugcacuagccgaagccgcacuacuaagauacguucauccugauucuggaagaacuuuauuugaaugcaaacuauauagagaaggauacaugguaguaguugcaccaucaggaagacuagauuuuccucuagauggauacuuuagauuugauaguuggguaaaugcauuuuacguauuaucuccuguaggaaauggacaaggaagaagauga

SEQ ID NO: 33235 - RNA, 1719 nt, Artificial Sequence
  derived and/or modified sequence opt6 from VP1__Norovirus_and/or_Norovirus-like__EF450827
augaaaauggcaucaucugaugcuacuccaucaagugauggugcugguaaucuuguaccagaaagucaacaagaaguacuuccauuagcaccuguagcuggagccgcacuagcugcaccaguaguaggacaacaaaauauaauagauccauggauuaaagaaaauuuuguacaagccccacaaggugaauuuacuguaucaccuaaaaacuccccaggugaaguacucguuaacuuagaacuaucaccacgauuaaacccuuaucuacaccacuuaucaaaaauguauaaugcauaugcaggagguauggaaguugaaauaauacuagccggaaacgcauuuacugcaggcaaaguacuaauagcagccguaccuccaaacuucccaauagaaaacguuucagccucacaagcaucacaauuuccacauguaaucguagauguaagaacuuuagaaccaauacgauuaccauuaccagacguaagaaccaauuucuuucauuacaccacacaagaagaaccaagaaugagaauuguagcuuggcuauacacuccacuuaggacaaacggaucaggugaugacucuuucacagucucaggaagaauauuaacuagaccaaguccugauuuugaauuuucauuccuugugccaccaacuguagaaacaaaaacaguaucauucuccguuccuggccuaguaguucaagauaugucuaauucuagauggcccgcacaaauaucaggauuaguaguaaggggaaaugaagcacaagucguccacuuccaaaaugguagauguacaacagaaggaauguuacucggaacaacgacauuaaacauaaacaguauuuguggccuacgaggauuaucaguaucucaagcaucagucaggggugcuccagcauuaacugaagaaaugccaccacuagaagaugaaguagcugauggagcagcagcaacuuacacauuaacuagggcugccgauaccgcacuaugguuacgaguagaagaaccagacgguagaccauaugauauauuuggagaucaaccagcaccgcuuggaacaccagauuuuaccgcagucauugugggcacagcaauuagaccuagaacgacaucaggugcuuaccuacaugaugcauaugucgauacaaccccaggagaugcagauuuuaccccuucuacaggaaacacaaaaauaguauuaagaggugguggcucaggacauguaggacaaggacauuauuggcaauucaaaccaauagcaguugaaggaggaggauccagaccacaauaccaggaauauaauuuaccagauuacgcugguccaacugcuucaaaccacgaucuagcaccaccagucgcaccaagaaugccuggagaauuauuauuauuauucgaaagugauaugccaguaugggacaacggagcaggcgcugcacccgcacagaaaauucacugucuauuaccuaaugaauuuauaacacaucuauuugauuuacaagcuccugcuuuagcagaagcagcauuauuacgauauguacauccagacucaggaagaacauuauucgaauguaaacuauauagagaagguuauaugguaguagcagcaccuguaggaagauuaaauuuuccauuagauggauauuuuagauucgacaguuggguuagugcuuucuauguacuuagucccguagguucaggacaaggaagacgauaa

SEQ ID NO: 33236 - RNA, 1719 nt, Artificial Sequence
  derived and/or modified sequence opt6 from VP1__Norovirus_and/or_Norovirus-like__JF781268
augaaaauggcaagcucagacgcaaccccaucuucagacggagcaggcaauuuaguuccagaaucacaacaagaaguuuuaccacuugcaccuguagcaggcgcggcacuagcagcaccaguaguaggacaacaaaacauaauugauccuuggauaaaagaaaauuuuguacaagcaccgcaaggagaauucacaguaucacccaaaaacucaccaggugaaguauuagucaaucuggaacuaaguccaagacuaaauccauaucucgaccaucuuagcaaaauguauaaugcauacgcaggugggauggaagucgaaauaauauuagcuggaaaugcauuuacugcuggaaaaguauuaauagcagcaguaccaccuaacuucccaauagaaaauauaucugcaucacaagcuucacaauuuccgcacguaauaguagauguccgaacuuuagaaccaauacgauuaccuuugccagauguaagaacuaauuuuuuucauuauacaacacaagaagaaccacgaaugagaauaguugcuugguuauacacaccauuaagaacaaaugggaguggugacgacucuuuuacugucucuggaagaauauuaaccagaccgucaccagauuuugaauuuucauuuuuaguaccaccuacagucgaaacaaaaacaguaucuuucagcgucccaggauuaguaguagaagauaugucaaacucaagauggccagcacaaauuaacggauuaguuguaagaggaaacgaagcacaagucguacauuuucaaaauggaagauguacaaccgaaggaacacuacuugguacaacaacgcucucaaucaacucaauuuguggacucagaggucuaucaguuagccaagcgucaguaagaggugccccagccuuaacugaagaaaugccuccauuagaagacgaaguagcagauggugcagcugcaacauacacauuagcacgcgcagcugauacaacauuauggcuacgaguagaagaaccagaugguagaccuuacgauauauuuggugaucaaccagcaccauuagguacaccagacuuuacugcaguuauaguagguacagcaauaagaccaagaacagcaucaggugcauauuuacaugacgcauaugucgauacaacaccaggagaugccgauuuuacuccauccacuggaaauacuaaaauaguacuaagaggaggcggaucuggucauguaggacaaggccacuauuggcaauuuagaccuauagcuguagagggaggaggaucuagaccacaauaccaagaauauaaucuaccugauuacgcaggcccuacugcaaguaaccaugauuuagcaccaccuguagcaccuagaaugccuggagaauuacucuuauuauuugaaucagauaugccaguaugggauaauggagcaggagcagcuccugcacaaaaaauucauuguuuacuaccaaaugaauuuauuacacauuuauucgaccugcaagccccugcauuagcagaagcagcauuacuaagauauguucaucccgauucaggcagaacauuauuugaauguaaacuauaccgagaagguuauaugguaguugccgcaccagcaggacgcuuaaauuuuccuuuagauggauacuuuagauuugauucaugggucucugcauucuacauauuaucccccguaggauccggacaaggaagaagauaa

SEQ ID NO: 33237 - RNA, 1698 nt, Artificial Sequence
  derived and/or modified sequence opt6 from VP1__Norovirus_and/or_Norovirus-like__KT245136
augaaaauggcuaguaauggagcugcagcaccaucacaagacggcgcagcuaaucuaguaccugaaucucaacaagagguccuagcauuagaaccaguugcaggcgcagcucuagcugcaccuguagcaggacaauuuaacgcaauagaucccuggauaaaacaaaauuuuguacaagcuccugcaggcgaauuuacuguaucuccuagaaaugcaccaggagaaguacuaauggacuuagaacuaggaccugaaaugaacccguuccuugcacauuuagcacaaauguauaaugcauaugcaggaggaauggaaguacaaauuauauuagcagggaaugcauucaccgcagguaaaauaauaguaugugcaguaccaccaaacuucccacccgauagauuaagugcaucacaagcaacaaauuuuccucauguuaucauggauguuagaacacuugaaccaguuguuuuaccccuaccagacguacgugccggauucuuucacuauaaucaacuaagagaaccuagaaugaggcucaugacuuuacuuuauacaccacuaagagcuaaugguacuggugaugacgcauuuacaguaucaugccgaguccuaacaagacccauguuagacuuugaauuuauguucuuaguaccaccaacugucgagucucgagucacaccauuuucaguaccaacauauccaguaguagaaaugacaaauucaagauggccagcacgaauauccggaaugcauguaaacgcaaaucaaacuuuagcaguacaauuccaaaauggaagauguacacuugauggucaacuuaugggaacaacucaacucugugcagcggauguaugucgaaugagagguagauauacaucaaccagagcagauccagcaggcuuaggcugggaccuugacgcaacuacauuaguugacggcccagaagcuagaguacaagcaagaauaaguguuucugcacaucuacaauuagaagaacucucaggacaacccuaugaaguauauggagaacaaccugcaccacuagguacaccagauuuucaauguagacucaugggagaauuagucagauuaccaucagcaaacccuguagcacaauccagguuuagagacgcauucuuugauacuuauggugcacuauuugcuccagcaguaggauccguuaccguaaccguaaacaauagcucaucuucugauuuugcaaaugaucaaccuuucgaauuuuuacccaucggaguagaaauaggaaauucagcacgcuacgaugaauuugcucuacccuccuauaacggagcaauaggagagaauagacaccuagcaccaauugcagcaccaggauuuccaggagaaaaucucaucuucuucucaaguaaucucccaguuugggauucaacaucagcacaaucuaauaggagaauaucuugucuauuaccuaaugaauuuauacaacauuucuacgaucuacaagccccaagucaauccgauguagcuuuacuacgauauguucauccagaaacagauagauuuuuauuugagugcaaacucuaucgagaugcauuuuuaacaguaaacggagcaucauaugcagaauuuccaguaaauggauacagucguuuugauucauggguaaaacaauucuuuacacuaaguccaguaggaaccgguucaggccgaagauaa

SEQ ID NO: 33238 - RNA, 1659 nt, Artificial Sequence
  derived and/or modified sequence opt6 from VP1__Norovirus_and/or_Norovirus-like__AJ844470
augaaaauggcaagcaaagacgcuucaccuucuacagacggcgcagcgaaucuagucccugaaucacaacaagaaguauuagcacuacaaccagucgcgggugcacaaauagcugcaccuguagcaggccaauucaauguuaucgauccuuggauauaccaaaacuucguacaggcaccagaaggagaauuuacagugaguccaagaaacucaacaggugaaauauuaaugaaccuagaacucggaccacaauuaaauccauaccuagcacacuuagcaagaauguacaaugcauacgcaggcgguuucgaaguucaaguauuauuagcaggaaacgcauucacugcugguaaaaucauaguaugugcagucccaccaaacuuuccauuacaaaauauaucagcagcacaagcuacacaacuaccccauguagucguagauguucgacaacuagaacccgucguacuuccccuaccagauguaagagcaggauucuaucacuauaaucaaguagaagaaucuagaaugagauuaguagccauacuauacacuccacuacgaacaaacucugcuggugacgacgcauuuaccguaaguugcagaauauuaacacgaccagcaccagacuuuuccuuuuucuuucuaauaccaccaacuauugaaucaaaaacaaccccauucacacuaccaagacuaccuauauccgaaaugacaaacucaagauuucccuuagucaucaaagguaugguagucgacccaaauuuaccccuacaagcaaauuuccaaaacggaagaauaacauuagauggagaauuacaaggcaccacucuaccaacaucaacauccauaggaagaauaucaggcacauacauguccucaacccccucacgaauaauccaacacgaagauucaggagacucaacacaaccucgaguauucaacccaguauggauggaccuuacagaaaauaauuggacagaauuucaaccuuucaaugaccaaccagcaccacuagguugcccugauuucaaagcaaaaauuuuaggaacacuaauuagacaaccaaacaacggaaguuauuauuuugaugcauauuuagauacaagacagcacggcaccuuugcaccauacaccggucaugcagcaguccacagcgaccaacaagcuggacauuuagcucaaggauauaaaauccaauuuucaccuacaggcauagaaucagaccaaaauaccgacuuaaaccaauuaccagacuacggcggagccaugaccguaucaaaagguuuagccccagcagcagcaccagauuucccaggagaaaugauacucuacuucgucagugauaugccaguaagaaacccuaauggagaacgaagagauacagaaauucuaugucuacuaccccaagaaauggucacgcauuuuuaugaacaacaagcaccaucucaaggagauguagcauuaguaagauauauaaaugcugaaacaggaagaguuauguucgaaggaaaacuacaccgaaauggauucuuuacuguuucagcaacagcaagaaccuuaaucguacccgauggcuacuuuagauuugauuccuggguaaauagauuuuacacccuaucaccaaugggaacaggaaacggaagaagacgagcaagauaa

SEQ ID NO: 33239 - RNA, 1659 nt, Artificial Sequence
  derived and/or modified sequence opt6 from VP1__Norovirus_and/or_Norovirus-like__KJ196291
augaaaauggccucaaaagacgcaucaccaucaacugacggaacagcaaaccuaguaccagaaucucaacaagaaguccuagcguuacaacccguagcaggggcacaaauagccgcacccguagccggacaauuuaauguaaucgauccauggauauaccaaaacuuuguacaagcuccagaaggagaauuuacaguauccccacgaaauucuacaggagaaauauuaaugaaccuagaacuaggaccacaauuaaacccauauuuagcacauuuagcaagaauguauaaugcauaugcaggaggauucgaaguacaaguacuacuagccggcaaugcauucacugcaggaaaaauaaucguaugcgcuguuccaccaaacuuuccccuucaaaauauaucugcagcacaagcaacacaacuaccccacguaguagucgauguuagacaauuagaaccaguaguauuaccacuuccugacguacgugcaggauucuaucacuauaaucaaguagaagaaagcagaaugcgccuuguagccaucuuauacacaccccuacgaacaaauucagcaggagaugacgccuuuacaguuucuuguagaauacucacacgaccagcccccgacuucucauucuucuuccuuauaccaccaacaauagaauccaaaacaaccccauuuacauuaccaagauuaccaauaucagaaaugacaaacucacgcuuuccauuaguaauaaaagguaugguugucgaucccaaucucccacuccaagcaaauuuucaaaacggaagaauaacacuagacggagaacuacaaggaacaacccuaccaacuucaacaucuauaggaagaauaaguggaacccauaugucuucaacaccaucaagaauaauacaacaugaagacuccggagauucaacucaacccagaguauuuaauccugucuggauggacuuaacagaaaacaauuggacagaguuccaaccuuucaacgaccaacccgcaccauuaggauguccagauuuuaaagcaaaaauacuuggcacacuaauacgacaaccaaauaacgguuccuauuauuucgaugcuuauuuagauacuagacaacaugguacauuugcaccuuauacaggccaugcagcaguacauagcgaucaacaagcaggccaccucgcacaaggauacaaaauccaauucucaccaacagguauagaaucagaucaaaacacagaucucaaucaacuacccgacuacggaggagcaaugacuguuaguaaaggucucgccccagcagcagcaccugacuucccaggagaaaugauacuauauuuuguaucugauaugccaguaagaaacccaaauggugaacgaagagacacagaaauauuaugcuuacuaccacaagaaauggucacucacuucuaugaacaacaagcuccgucacaaggugacguagcauuaguuagauauauaaacgcugaaacaggacgaguaauguuugaaggaaaauuacacagaaauggauuuuucacaguaucagcaacagcaagaacauuaauagucccagacggcuauuucagauucgauucuuggguaaauagauuuuauacauuaucaccaaugggaacuggaaacggaagaagacgagccagauaa

SEQ ID NO: 33240 - RNA, 1653 nt, Artificial Sequence
  derived and/or modified sequence opt6 from VP1__Norovirus_and/or_Norovirus-like__KU870455
augaaaauggccaguaaugaugcagcaccaucaaaugauggugcagcaaauuuagucccagaagcaaauaaugaaguaauggcccucgaaccaguuguuggagcaaguauagcugccccuguaguaggacaacaaaauauaauagauccuuggauaagagaaaauuucguacaagcuccacaaggagaauuuacaguuucuccaagaaauagccccggugaaaugcuuuuaaaccucgaacucggcccagaauugaacccauauuuaucacauuuaaguagaauguauaauggcuaugcuggugguaugcaaguacaaguaguuuuagcuggaaacgcuuucacagcaggaaaaauaauauuugcagcuguaccaccacacuuuccagucgauaacauaagugccgcacaaauaacuauguguccacauguaauuguugauguaagacaacuagaaccaguucuauuaccacucccagauauaagaaauagauucuuucauuauaaucaagaagauacaccccgaaugagauuaguagcaaugcuauacacuccacuaagagcaaauagcggcgaagacguauucacuguaucaugcagaguucuaacuagaccagcgccagacuuugaauuuacauuccucgucccaccaacaguagaaucuaaaacaaaaccauuuacacuaccuauauuaacacuaggagaacuaucuaauucaagauuccccgccgcaauugacaugcucuauacagauccaaaugaaucaauaguaguacaaccacaaaauggcagauguacauuagaugguacauuacaaggcacuacacagcuaguaccaacacaaauuugugcauuuagagguacauuaaucucacaaaacgcucgagcugcagaccuaacagacucaccacaaagagcaagagaccacccacuucauguacaaguuaaaaaccuagacggcacacaauacgauccuacugacgauauaccagccguacuaggagcaauagauuuuaaaggaacaguauuuggaguagcaucacaaagagauguaucaggaacacaagaacaaggucauuaugcaacaagagcacaugaagcucauauagauacuacagauccaaaauaugcaccaaaauuagguacgauauuaauaaaaucugaaucaacagacuucacuaccaaucaaccuauacguuuuacaccaguaggaaugggagacaauaacuggagacaaugggaacuaccagauuacucaggaaguuuaacauuaaacaugaaccuagcaccagcaguaucaccaucauuuccaggagaacgaauauuauuuuuccgaaguauuguacccucagcuggagguuacggaucugguuacauugacugucucauaccacaagaauggguacaacacuuuuaccaagaagcagcaccuagccaaucugcuguagccuuaguuagauacguaaauccagauacagguagaaacauauucgaagcaaaacuccauagagaaggauuucuuacaguagcuaacucaggaaauaauccaauaguaguuccuccaaauggauauuucagauuugaagcauggguaaaccaauucuauacauuagcuccuauggguucaggacaagguagaagacgggcucaauaa

SEQ ID NO: 33241 - RNA, 1653 nt, Artificial Sequence
  derived and/or modified sequence opt6 from VP1__Norovirus_and/or_Norovirus-like__AF414408
augaaaauggcauccaacgacgcagcaccuucaaaugauggcgccgcaaacuuaguaccagaagcaaacaaugaaguaauggcacuagaaccuguaguaggagccucaaucgcagcuccuguaguaggccaacaaaauauaauagauccauggauaagagaaaauuuuguacaagcaccccaaggagaauuuacuguaucaccaagaaauucaccaggagaaaugcucuuaaauuuagaacuaggaccagaauuaaauccuuaccuaucacaucuaucuagaauguauaauggcuacgcaggaggaaugcaaguacaaguaguuuuagcaggaaaugcauucacagcagguaaaauuaucuucgcagcaguacccccucauuuuccaguagaaaacauaucagcagcucaaauaacuaugugcccacacguaauaguagacguuaaacaacucgaaccuguacuacuaccauuaccagauauacgcaacagguucuuucauuauaaucaagaagacacuccccguaugcgacuuguagcaauguuauauacuccauuaagagccaauuccggugaagauguauucaccgucaguugcagaguacucacacguccugcaccagauuucgaauuuacauuccuuguaccaccaacaguagaaucaaaaacaaaaccuuuuacacuuccaauauuaacacuaggagaauuaucuaacucaagauucccagccgcaaucgauauguuauauacagacccuaacgagucuauaguaguacaaccacaaaauggaagauguacacucgacggcacacuccaagguacaacccaauuaguaccaacacaaaucugcgcuuucagaggaacacuaauaucucaaacugcaagagcagcagauuccacaggaucaccucaacgagcacgaaaccauccacuccauguacaagucaaaaauuuagauggaacacaauacgauccaacugacgacauaccagcaguauuaggagcaauagacuuuaaaggcacaguauucggaguagccucccaacgagauguaucaggccaacaagaacaaggacacuaugcuacaagagcucacgaagcacacaucgauacuacagacccaaaauacgcacccaaacucggaacaauccuuauaaaauccgacucagaugacuucaacacuaaccaacccauaagauuuacaccuguaggaaugggugacaauaauuggagacaaugggaacucccagauuauucaggacaucuaacacuuaauaugaacuuagcuccugcaguuucacccucauucccuggagaaagaauacuauucuuucgaucaauuguaccaucagcuggcgguuauggaucaggauacaucgacugucuuauaccacaagaauggguucaacacuuuuaucaagaagcagccccaucucaauccgccguagcacucguaagauacgucaauccagauacaggaagaaauauauucgaagcaaaacuucacagagaaggauuuuuaacuguagcuaacucuggaaauaauccaaucguuguuccaccuaauggauauuuucgauucgaagcaugggucaaccaauuuuacacauuagcacccaugggcuccggucaaggacgcagacgagcucaauaa

SEQ ID NO: 33242 - RNA, 1653 nt, Artificial Sequence
  derived and/or modified sequence opt6 from VP1__Norovirus_and/or_Norovirus-like__AB084071
augaaaauggccaguaaugacgcagccccaucaaaugauggagcagcaaacuuaguuccagaagccaauaaugaaguaauggcucuagaaccaguaguaggagcaucaauagcagcaccaguuguuggccaacaaaauauaaucgauccauggauacgugaaaauuuuguacaagcaccccaaggagaauuuaccguuucaccucgcaacagcccaggagaaaugcuucuaaauuuagaacuaggaccugaacugaauccauaucuuucacacuuaagcaggauguauaacggauaugccggaggcaugcaaguacaaguaguuuuagcuggcaaugcuuuuacagcugguaaaaucauauucgcagcaguaccaccacacuuucccguagacaacaucucagcagcccaaauuacuaugugcccacacguaauaguagauguacgacaauuagaaccaguauuauuaccucuaccugacauaagaaaucgauucuuucacuauaaccaagaaaauacaccccgcaugcgucuaguagcaauguuauauacaccauuaagagcaaauucaggagaagacguauucacuguaucaugucgaguacuaacaagacccgcuccugacuucgaauuuacuuucuuaguuccaccaacuguagaaucaaaaacaaaaccauuuacauuaccaauacuaacuuuaggugaauuaucaaauucacgauucccagcagccauagacaugcuauauacagacccaaacgaaucaauaguaguccaaccccaaaacggacgcugcacgcuagauggcacacuucaaggaacuacacagcuaguaccaacacaaauaugugccuucagaggaacauuaauuucacaaacagcaagagcagcagacucuacagacuccccacaaagagcaagagaucacccacuacacguccaaguuaaaaacuuagauggaacucaauaugaucccacagacgauaucccugcaguacucggugcaauagauuucaaaggaacuguauucggaguagccucacaaagagauguaucagguccucaagaacaaggucacuaugcaacucgcgcacacgaaacacacauugauacaacagauccaaaauaugcaccaaaauuaggaacaauuuuaauaaaauccgaaucaaaugauuuuauaacaaaucaaccaauucgauuuacaccuguaggaaugggugauaauaauuggagacaaugggaacuaccugacuauagcgguagacuaaccuuaaacaugaacuuagcaccagcaguaucacccucauuuccaggcgaaagaauauuauuuuucagaucaauaguaccaagugcaggcggcuauggaucugguuauauagauuguuuaauaccucaagaauggguacaacauuucuaccaagaagcugcacccucacaaucugcaguugcauuagucagauacguaaacccagacacaggaagaaauauauucgaagccaaacuacauagagaaggauucuuaaccguugcaaacucggggaauaauccuauuguaguaccgccaaauggauauuuccgauuugaggcuuggguaaaucaauuuuacacucuagcuccaaugggauccggacaaggacgucgacgugcacaauaa

SEQ ID NO: 33243 - RNA, 1653 nt, Artificial Sequence
  derived and/or modified sequence opt6 from VP1__Norovirus_and/or_Norovirus-like__AF414407
augaaaauggcuucaaaugacgccgcacccuccaaugauggagccgcaaacuuaguaccagaagcuaacaacgaaguaauggcauuagaaccaguuguaggagcauccauugcagcaccagcagucggacaacaaaauaucauugauccauggauaagagaaaauuucguacaagccccacaaggagaauuuacaguaucaccuagaaauuccccaggagaaauguuauuaaauuuagaacuaggcccugaacuuaauccauaucuaucacauuuaucgagaauguauaauggcuacgcaggcggcaugcaaguacaagucguacucgcuggaaaugcauucacagcaggaaaaauaauauuugcagcaguuccuccccacuuucccguagaaaacauauccgcggcacaaauuacaauguguccccauguaaucguagauguaagacaacuugaaccaguccuauuaccacucccagauauaagaaacagauuuuuccauuacaaccaagaaaacacccccagaaugagauuaguagcaauguuauacacuccacuacgugcaaauucaggagaagacguauucacaguauccugcagagucuuaacaagaccagcaccagauuuugaauuuacauuuuuaguaccuccaacagucgaaucaaaaaccaaaccauuuacccuuccaacauuaacgcuaggagaauuaucaaaccccagauucccagcagcaauagauaugcuauauacagauccaaacgaauccauagucguucaaccgcaaaauggucgauguacacuagauggaacucuacaaggaaccacccaacucguuccaacucaaauaugcgcauuuagagguaccuuaauaagccaaacagcuagagcagcagauucuacagauucuccacaaagagcaagaaaucauccucuacauguccaaguuaaaaacuuagauggaacucaauacgauccaacagacgacauaccugcaguacuaggagcaauugacuucaaaggaacaguauuuggagucgcaagccaacgagauguaucaggacaacaagaacagggacacuaugcaacuagagcacacgaagcacacauagauaccacugauccuaaauaugcaccaaaauuagguacaauacucauaaaaucagauagcgaugacuuuaacacuaaccaacccauacgauuuacacccguaggaaugggagacaauaacuggagacaaugggaauuaccagacuauucaggucgcuuaacacuaaauaugaauuuagccccagcaguuucuccaucauuuccaggagaaagaauacucuucuuucgaucaauagucccuucugcaggaggauacgguaguggauauauugacugucuaauaccacaagaauggguacaacauuuuuaucaagaagccgcaccaucacaaucugccguagcccuaguaagauauguaaauccagacacagguagaaauauuuucgaagcaaaauuacauagagaaggauuucuaacaguugcaaacucaggaaauaauccaauaguaguuccaccaaauggauauuuuagauuugaagcauggguuaaucaauucuacacauuagcaccuaugggaucuggacaaggucgaagacgagcacaauaa

SEQ ID NO: 33244 - RNA, 1653 nt, Artificial Sequence
  derived and/or modified sequence opt6 from VP1__Norovirus_and/or_Norovirus-like__AB039777
augaaaauggcauccaacgaugcagcaccaagcaaugauggugccgcaaauuuaguccccgaagcgaacaaugaaguaauggcacuagagccaguaguaggagcauccauagcagcaccaguaguuggacaacaaaacauaauagacccauggauaagagaaaacuuuguacaagcuccgcaaggugaauuuacaguauccccaagaaacucuccuggcgaaauguuauuaaaucuagaauuaggacccgaauuaaacccauauuuaucucauuuaagucccauguauaauggauacgcaggaggaaugcaaguucaagucguacuagcaggcaaugccuuuacagcuggaaaaauaauauucgcagccguacccccucacuuuccuguagauaauauaucggcagcucaaauaacaaugugcccacacguaaucguagauguacgacaacucgaaccaguacccuuaccauuaccagauauaagaaacagauucuuucacuauaaccaagaaaauacaccaagaaugcgauuaguagcuauguuauauacacccuuaagagcaaauuccggugaagacguuuuuacaguaucauguagaguacuuacaagaccagcuccagauuucgaauuuacuuuucuuguaccacccacaguagaaucaaaaaccaaacccuucacucuaccaauauuaacauuaggagaauuaucaaauuccagauucccagcagcuauagauauguuauacacagacccaaacgaaucaauaguaguacaaccacaaaauggcagauguacacuugacggaacacuucaaggaacuacucaacucguacccacacaaauuugcgcauuuagaggaacauuaauaucccaaacagccagagcagcagacucaacugacucaccacaaagagcuagagaccacccucuacauguacaagucaaaaaucuuggcggaacucaauaugaucccaccgacgauauucccgcuguauuaggcgccauagauuucaaaggcacaguauucggaguagcuagccaaagagacguuucuggaccacaagagcaaggacacuaugccacuagagcacaugaagcucauauagauacaacugauccaaaauacgcuccaaaauuaggaacuauauuaauaaaaucugaaucuaaugauuucacaacaaaccaaccaauuagauuuacaccaguuggaaugggagauaacaauuggagacaaugggaacuaccagauuauucaggcagauuaacauuaaauaugaaucuggcacccgccguaucaccaucauuucccggugaaagaauauuauuuuucaggucaauaguacccucugcugguggauauggcaguggauauaucgacugccuaauaccucaagaauggguucaacauuucuaucaagaagcagcaccuucacaaucagcaguagcauuaguuagauaugucaauccugacaccggcagaaacauauuugaagcuaaauuacacagagaaggcuuuuuaacaguagcaaauucaggaaauaauccaauaguaguaccaccuaacggcuauuuuagauucgaagccuggguaaaucaauuuuacacauuagcaccaaugggcucaggacaaggucguagacgagcacaauaa

SEQ ID NO: 33245 - RNA, 1653 nt, Artificial Sequence
  derived and/or modified sequence opt6 from VP1__Norovirus_and/or_Norovirus-like__AB078337
augaaaauggcaaguaaugaugcagcaccaucaaaugauggagcagcuaaucucguaccagaagcaaacgaugaaguaauggcacuagaaccuguaguuggagcauccauagcagcuccaguaguuggucaacaaaauauaauagacccauggauaagagaaaacuucguucaggcaccacaaggagaauuuacaguaucaccacguaauucaccaggugaaaugcuacuuaaucucgaauugggaccagaauuaaauccauaucuaucucauuuaucuagaauguacaaugguuaugcuggaggcaugcaaguccaagucguauuagccggaaacgcauuuacagcaggaaaaauaauauuugcagcaguuccuccacacuuccccguagaaaauaucucagcagcgcaaaucacaaugugcccacacguaauaguugacguacgccaacucgaaccaguacuauuaccauuacccgauauaagaaacagauucuuccacuacaaccaagaaaauacaccacgaaugagauuagucgcaaugcuauauaccccauuaagagcaaacucaggagaagacguauuuacuguuaguuguagaguacucacaagaccagcaccagauuuugaauuuacauuucuaguaccaccaacuguagaaucaaaaaccaagccauuuacuuuaccaauuuuaacuuuaggcgaauuaucaaacagcagauuuccagcagcaauagauaugcuauauacugaucccaacgaaaguauagucguacagccacaaaacggcagauguacauuagacggaacauuacaaggaaccacccaauuaguaccaacacaaauuugcgcauuuagaggaacccuaauaagucaaacagcaagagcugcagauucaacugauucgccucaaagagcaagaaaucaucccuuacauguccaaguuaaaaauuuagauggaacacaauaugacccaacugacgauauuccagcaguauuaggagcaaucgacuucaagggaacuguauucggcguagcaagucaaagagacguaucaggacaacaagaacaaggacauuacgcaacaagagcacacgaagcacauaucgacacaacagauccaaaauacgcgccaaaauuaggaacuauuuuaauaaaaucaggaucagaugacuuuaacacaaaccaaccaauacgauuuacacccgucggaaugggagacaauaauuggagacaaugggaguuaccagauuauaguggaagacuaacacuaaacaugaacuuagcaccagcuguaaguccuagcuuuccaggagaacgaauacuauucuuuagaucgauuguaccaucagcugguggauaugguucagguuauauagacuguuuaauaccacaagaauggguacaacacuuuuaccaagaagcagcaccaucucaaucagcaguugcucuaguacgauaugucaauccagacacuggacgaaacauauuugaagcaaaacuacauagagaaggauuucuaacagucgcaaacugcggaaacaauccaauaguagucccucccaauggauacuucagauucgaagcauggggaaaucaauucuacacuuuagcaccaaugggaaguggacaaggaagaagaagggcccaauaa

SEQ ID NO: 33246 - RNA, 1653 nt, Artificial Sequence
  derived and/or modified sequence opt6 from VP1__Norovirus_and/or_Norovirus-like__AB039776
augaaaauggcaucuaacgaugcagcaccaucaaaugauggagcagcuaaucuaguaccugaagcaaacaaugaaguaauggcacuagaaccagucguuggagcuuccaucgcagcuccuguaguaggccaacaaaauauaauugacccauggauuagagaaaauuucguucaagccccacaaggagaauuuacaguuuccccaagaaauucacccggcgaaaugcuacuaaaucucgaauuaggaccugaauuaaacccauaucuuucccacuuaucuccaauguauaauggcuaugccggcggaaugcaaguacaaguaguauuagcugguaacgcauuuaccgcaggaaaaauaauauuugcagcaguaccaccacacuuuccuguugauaauauuucugcugcucaaauaacaauguguccacauguaaucgucgauguaagacaacuagaaccagucccacuuccauuaccugacaucagaaauagauucuuucauuauaaccaagaaaauacuccaagaaugagauuaguugcaaugcuauacacaccauuaagagcaaacucaggugaagacguauucacaguaagcuguagaguauuaaccagaccagcaccugauuuugaauuuacauuuuuaguaccaccaaccguugaaucaaaaacaaaaccuuuuacacugccaauacuaacacuaggugaacuaucuaacaguagauuuccagcagcaauagauauguuauauacagacccaaacgaaucaaucguaguacaaccacaaaacggaagauguacauuagaugguacauuacaaggaacaacacaauuaguaccaacccaaauaugcgcauuccgaggaacccuuauaucacaaaccgcacgagcugccgacucaacugauucaccucaaagagcaagagaccauccacuacauguacaaguuaaaaaccuagauggcacucaauacgacccuacagacgacaucccagccguauuaggagcaaucgauuuuaaaggaacuguauuuggaguagcuucacaaagagauguaucagguccacaagaacaaggacauuaugccacacgagcacacgaagcacacaucgacacaacagauccaaaauaugccccaaaguuaggaacaauauuaauaaaaucagaaucaaacgacuucacaacaaaccaaccaauaagauuuacaccaguaggaaugggcgauaacaacuggagacaaugggaacuaccagacuacucaggacgccuagccuuaaauaugaaucuugcacccgccguuucuccauccuuucccggagaacgcauucuauucuuuagaucaaucguaccuucagcugguggauacggcagcggcuacauagauuacuugauaccacaagaauggguacaacauuuuuaccaagaagccgccccaucccaaucagccguagcucuaguacgauauguaaauccagacacaggaagaaauauauucgaagcaaaacuucacagagaaggauuucucacaguagccaauucaggaaauaacccaaucguagucccaccaaauggcuacuuuagauuugaagcauggguaaaucaauuuuauacauuagcaccaaugggcuccggacaaggaagaagacgagcacaauaa

SEQ ID NO: 33247 - RNA, 1653 nt, Artificial Sequence
  derived and/or modified sequence opt6 from VP1__Norovirus_and/or_Norovirus-like__KT030674
augaaaauggccagcucagaugcagcacccucaacagacggagcaggaaaccucguuccugaaucacaacaagaaguacuuccauuagccccaguagccggugcugcauuagcagcuccaguaguaggacaaacaaacauaaucgacccauggaucaaagaaaauuuuguacaagcaccacaaggagaauuuaccgucucacccaaaaacucaccaggagaaauacucgucaauuuagaguuaggaccaaaacuaaauccuuaucuagaucaccuaucaagaauguauaauucauaugcagggggcauagaugucaugguaguauuagcuggaaaugcauucaccgcaggaaaaguacuaauagcagcaaucccuccuaauuucccuguagaaggcguaucugccagccaagcaacacaauucccacauguaauaauugauguaagaacacuagauccaguuagacuaccacuaccagauguaagaucuaccuuuuuucauuacacaaacgauaccgaaccaaaaaugagauuaguuauaugguuauauaccccacuuagaacuaauggaucaggagaugauuccuuuacaguaucuggaagaauacuaacccgaccaucacaagauuuugaguucgcauuuuuaaucccaccaacaguagaaacaaaaacaaccccauuuuccguacccggauucucaguucaagaaaugagcaauuccagauggccagccgcaauaucagcaaugguuguaagagguaaugaaccacaaguuguccaauuucaaaaugguagagcucaccuagauggaauguuauuaggcacaacaccaguaucaccaaauuauauagcaucuuauagaggaauauccaccggaaauucaagaagugcuuccagugaagcagaugaaagagcaguaggaucuuuugacgucuggguaagauuacaagaaccagacggacaaccauacgacauauucggaaaacaaccagcaccaauaggaacaccagauuucaaagcagucauaguuggauucgccgcuagaccauuaacaucaggaucauaugcaaacgaagcauaugucaauacaacugcaagcgauuaugcaccagcaacuggaaauaugcgauuuacaguaagaaauggagguacaggacacauaucagcaaacaaauacugggaauucaaaucauuuggaguagaaggagaaagacauacagauauucaauaccaagaauacgaacuaccagauuauucuggucaaguagcaucaaaucacaaucucgccccaccgguugcaccacguaugccaggcgaaucuuugcuccuauuucaaucaaacaugccaguaugggacgauggaagaggagaaagcacaccaaaaaaaauacauugccuauugccacaagaauuuauaggacacuuuuuugauaaacaagcaccaucauugggagaugcagcacuacuacgauaugucaaucaagaaaccaacagaguauuauuugaaugcaaauuauacagagauggauacauaacgguggcagcaucaucuggacuacucgauuuuccauuagacggauuuuucagauucgauucauggguaucaaguuuuuacauacuaagucccguaggaucaggccaaggaagaagauaa

SEQ ID NO: 33248 - RNA, 1653 nt, Artificial Sequence
  derived and/or modified sequence opt6 from VP1__Norovirus_and/or_Norovirus-like__DQ093067
augaaaauggcaucuaaugaugcugcaccaucaacugacggugcaggaaaccuaguaccugaaucucaacaagaaguauuaccauuagcuccuguugcaggagccgcauuagccgcaccaguaguaggacaaacaaacauaauugauccauggauaaaagaaaacuuuguacaagcaccucaaggagaguucacagucucacccaaaaacaguccaggugaaauauuagucaacuuagaacuaggaccaaaauuaaauccauaccuagaccaucuaucacgcauguauaacucauaugcaggaggaauagacguaaugguaguauuagcaggaaaugccuuuaccgccggaaaaguauuaauagccgcaauaccacccaacuuuccuguagaaggaguuagugcuagccaagcaacacaauuuccucauguuguaauugauguaagaaccuuagauccaguaagauuaccacuaccugacguaagguccacuuucuuucauuacacaaacgacacagaaccuaaaaugcgauuaguaauauggcuauacacaccacuaagaacaaauggaucaggagaugauucauuuacaguaucaggacguauacuaacacguccaagucaagacuuugaauuugcauucuuaauaccaccaacaguugaaacaaaaacuacaccauucucaguaccaggauucucuguacaagaaauguccaauucaagauggccagcagcuauaucagcaaugguuguaagagguaaugaaccccaaguaguccaauuucaaaacggcagagcacaucuagacggaaugcuacuuggaacaacuccaguaucaccaaacuauaucgcaucauacagaggaauaucaacaggaaauucaagaagcgcaaguucagaagcagaugaaagagcaguaggaaguuucgacguauggguuagauuacaagaaccugauggccaaccauaugauauauuuggaaaacaaccggcacccaucggaacaccagauuuuaaagcaguaauaguuggauuugccgcuagaccacuaaccagugggucauaugcaaaugaagcauauguaaacacaaccgcaucagauuacgcaccggcaaccggaaauaugagauuuacaguuagaaaugguggaacaggucauauaagugccaauaaauauugggaauuuaaaucauuugguguugaaggagaaggucauacuaauauacaauaccaagaauaugaauuaccagauuacaguggacaagucgcuucaaaucacaacuuagccccaccuguagcaccacguaugccaggagaaucauuacuauuauuucaaucuucaaugccaguaugggaugauggccauggagaaaguacaccaaagaaaauucacugucuauugccacaagaauuuauuggucauuucuuugauaaacaagcuccaucauuaggugacgcagcacuauuaagauacguaaaucaagaaacaaacagaguauuauuugaauguaaacuuuacagagauggauauaucacaguagcagcaagcucugguuuauuagauuuuccacuagauggauuuuucagauucgauucauggguaucaaguuuuuacauauuauccccaguugguuccggucaagguagacguuaa

SEQ ID NO: 33249 - RNA, 1653 nt, Artificial Sequence
  derived and/or modified sequence opt6 from VP1__Norovirus_and/or_Norovirus-like__AF195847
augaaaauggccucaagugacgccgcaccaucagcugacggagcaggaaauuuaguaccagaaucucaacaagaaguacuaccauuagcaccaguagccggagcagccuuagccgcaccaguaguaggacaaacaaauauaauagacccuuggauaaaagaaaacuuuguacaagcaccacaaggugaauuuaccguaucaccuaaaaauaguccaggagaaauccuaguuaaucuagaauuagguccuaaacuuaauccauaucuagaucauuuaucacgaauguauaauucauacgccgguggcauagacguaaugguuguccuagccggaaaugcauuuacagcaggaaaaguacuaauagcagcaauuccaccaaacuucccagucgaaggcguaagcgcaucacaagcaacacaauucccacauguuauaauugauguaagaacauuagauccaguacgauuaccacuaccagauguaagaucaacauucuuucauuauacuaaugauacagaaccaaaaaugagauuaguaauaugguuauauacaccucuucguacuaacggaagcggagaugauaguuuuacuguaucaggaagaauauuaacuaggccaucacaagauuuugaauuugccuuuuuaauaccacccacaguggaaacuaaaacaacacccuucucuguuccugguuucucaguacaagaaaugucaaacucacgauggccugcagcuauaucggcaaugguaguaagaggaaaugaaccacaaguaguacaauuccagaaugguagagcucaucuugacggaaugcuauuaggaacaaccccaguaucuccaaauuauauagccucuuauagaggaauuucaacaggaaauucaagauccgcaucucccgaagccgaugaaagagcagucggaucauuugauguauggauccgauuacaagaacccgauggucaaccauaugauauauucgguaaacaacccgcaccuauaggaacucccgacuuuaaagcaguaauagucggauuugcagcacguccccuuacaucaggaucuuacgcaaaugaagcauauguaaauacaacugcaagugauuaugcacccgcuaccggcaauaugagauucacuguuagaaauggaggaucaggacauauaucagccaacaaauacugggaauuuaaaucauuuggaguagaaggugaaagacauacagauauacaauaucaagaauaugaauuaccagauuauaguggccaggucgcaagcaaccacaaucuugcacccccaguagcaccacggaugccuggugaaucauuacuauuauuucaaucaaauaugccaguaugggaugauggacauggugaaagcacuccuaagaaaauacauugucucuuaccacaagaauuuauaggacauuucuuugauaaacaagccccauccuuaggcgaugcagcauuauuaagauaugucaaucaagaaacuaauagaguacuauucgaauguaaauuauaucgugaugguuacauaacuguagcagccucauccgggcuuuuagacuuuccacucgauggauucuuucgcuuugauaguuggguuucaucauucuauauacuaucaccaguaggaaguggacaaggcagacgauaa

SEQ ID NO: 33250 - RNA, 1653 nt, Artificial Sequence
  derived and/or modified sequence opt6 from VP1__Norovirus_and/or_Norovirus-like__JQ970479
augaaaauggcauccucagaugcagcuccaucagcagauggagcugguaaccuugucccagaaucucaacaagaaguauuaccauuagcaccaguugcuggagcagcacuugcagcuccuguaguaggucaaaccaauauaauagauccauggauaaaagaaaauuuuguucaagcuccacaaggagaauuuaccguuaguccaaaaaauucaccaggagaaauuuuaguaaacuuagaacuaggaccaaaacuuaauccguacuuagaucauuuauccagaauguauaauucauaugcugguggaauagaugugaugguaguauuagcuggaaaugcauuuacagcaggcaaaguacuaauagcagcaauaccuccaaauuuuccaguagaaggaguaagugcaucccaagcaacccaauucccacauguaauaauagauguaagaacuuuagacccaguaagacuaccauuaccugauguaagauccacauuuuuccacuacacaaaugauacagaaccaaaaaugagacuuguaauaugguuauauacacccuuaagaacgaacgguucaggagaugauucauucacaguuaguggcagaauauuaacccgaccaagccaagacuuugaauucgcuuuuuuaauaccaccaacaguagaaacaaaaacaacuccuuuuucaguuccagguuucucaguccaagaaauguccaacuccagauggccagcagcaauauccgcaauggucguacgaggaaacgaaccacaaguuguacaauuucaaaacggcagagcacaucuagauggaauguuacuagguacaacacccguuucaccaaacuauauagcaucauauagagguauaaguacuggaaauucgagaucugcauccucugaagccgaugaacgagcaguaggaucauucgacguuuggauaagauuacaagaaccagauggucaaccauaugauauauucggaaaacaaccugcgccaauaggaacaccagacuucaaagcugucauaguagguuucgcagcaaggccacuuaccucaggaucuuaugcaaaugaagcauauguaaauaccacagcaucagacuaugccccagcaaccggaaauaugcgcuucacagucagaaauggaggaaccgggcauauaucagcuaacaaauauugggaauuuagaucauuuggaguagaaggcgaaaggcauacagacguacaauaucaagaauaugaacuacccgauuauucaggucaaguagcuucaaaccauaauuuggcuccuccuguagcaccucguaugccuggcgaaagccuacuacuauuccaaucuaacaugccaguaugggaugauggaagaggcgaaucaacaccaaaaaaaauacauuguuuauuaccccaagaauuuauaggacauuucuuugauaaacaagcaccuucacuaggcgaugcagcacuucuacgauacguaaaucaagaaacaaaucgaguauuauuugaauguaaauuauacagagauggauacauaacaguagcagcagcaucaggauuauuagauuucccauuagacgguuuuuuuagauuugauaguuggguuaguucuuuuuauauauuaucaccaguaggauccggacaggguagacguuaa

SEQ ID NO: 33251 - RNA, 1653 nt, Artificial Sequence
  derived and/or modified sequence opt6 from VP1__Norovirus_and/or_Norovirus-like__FM865412
augaaaauggccucaucagaugcagcuccaucaacagauggagcaggaaaucuuguuccugaaucucaacaagagguacuuccacuagccccugucgcaggagcugcauuagcugcuccaguagucggacaaacaaauauaauagacccuuggauaaaagaaaauuucguacaagcaccacaaggugaauucacgguaucaccaaaaaauucgccaggagaaauacuaguaaacuuagaacuaggcccaaaauuaaauccauauuuagaucaucuuucuagaauguacaauucauacgccggcgguauugacguaaugguuguccuagcaggaaaugcuuuuacagcaggaaaaguuuuaauugcagcaauuccaccaaauuuuccaguagaaggcguuucugcuucacaagcaacacaauucccacauguuauuaucgauguacgaacucuagauccugucagacuucccuuaccagauguuagaucuacuuuuuuucauuauacaaacgauacagaaccaaaaaugagauuaguuauuuggcuuuauacaccacuuagaacaaauggcucaggagaugauucauuuacaguaucaggacgaauauuaaccagacccucacaagauuuugaauuugcauuuuuaauaccaccuacaguugaaaccaaaacaacuccauuuucaguaccaggauucucaguacaagaaaugucaaauuccagauggccagcagcaauaucagcuaugguaguuagaggaaaugaaccacaaguaguacaauuucaaaaugguagagcacauuuagacggaauguuacuaggcacaacuccagucucaccuaauuauauagcuucauauagagguauuucuacuggaaauucuagauccgcuucaucugaagccgaugaacgcgcaguugguucauuugacguauggguacgucuucaagaaccagacggucaaccauaugauauauuugguaaacaaccugcuccaauuggaacaccagauuuuaaagcaguaauaguaggauuugcagcacgcccauuaacaucaggaucauacgcaaacgaagcauauguaaacaccaccgcaucagauuaugcaccugcaacaggaaacaugcguuucacaguccguaauggcggaacuggacauauaagcgcaaauaaauauugggaauuuaaaucuuuuggaguagaaggagaaagacacacaaauauacaauaucaagaauacgaacuaccagauuacagcggccaaguagcaucaaaucacaaucuugcaccaccaguugcucccagaaugccaggagaaucuuuauuauuauuccaauccaauaugcccguaugggaugauggacauggagaaaguacucccaaaaaaauacauugucucuuaccucaagaauucauaggacauuuuuuugauaaacaagcaccaucccucggugaugcagcuuuacuaagauacguaaaucaagaaacgaaucgaguacuuuuugaauguaaauuauaucgagacggauacauaacaguagcagcaucaucagguuuauuagacuuuccacucgauggauucuuuagauuugauucaugggugucuucauucuauauauuaucaccuguaggaaguggccaaggaagacgauaa

SEQ ID NO: 33252 - RNA, 1653 nt, Artificial Sequence
  derived and/or modified sequence opt6 from VP1__Norovirus_and/or_Norovirus-like__AF414426
augaaaauggccucuagugaugcugcacccucaacagauggugcaggaaauuuaguaccagaaucacaacaagagguuuuaccauuagcaccagucgcuggcgcagcauuagccgcaccaguaguuggccaaacgaauauuauagacccauggauaaaagaaaauuuuguacaagcaccacaaggagaauuuacaguaucaccuaaaaacucuccaggagagauacuugucaaucuagaauuaggaccaaaacuuaacccauaucuugaucaucuaucaagaauguacaacucauacgcugguggaauagauguaaugguaguacuugcaggcaaugcauuuacagcaggaaaaguacuaauagcagcuauuccaccuaauuuuccugucgaaggaguaucagcaucacaagcuacacaauuuccacacguaauaauugauguaagaacauuagauccaguaagauuaccacuacccgauguacgaucaacuuucuuucauuacacaaaugauacagaacccaaaaugagauuaguaauaugguuauauacuccacucagaacaaauggaucaggagaugauucauuuacaguaucaggaagaauacuaacaagaccaucacaagacuucgaauuugccuucuuaauaccaccuacaguagaaacaaaaaccacacccuuuucaguacccggauucucuguucaagaaaugucuaauuccagauggccagcagcuauaucagccaugguaguacgagggaacgaaccucaaguaguacaauuucaaaaugguagagcucauuuagauggaaugcuauuaggaacaacacccguaucaccaaauuacauagcuuccuauagaggaauaagcacaggcaauaguaggucugcaucauccgaagcugacgaaagagcaguaggaucauuugauguuuggguaagacuacaagaaccagauggacaaccauaugauauauuuggaaaacagccagccccaauagguacaccagacuucaaagcgguaauaguagguuucgcugcaagaccucuaacaucaggaucauaugcaaaugaagccuauguaaauacuacugcuucagauuaugcaccagcuacaggaaauaugagauuuacgguaagaaauggaggaacaggacacauaagugcaaacaaauacugggaauuuaaaucauuuggagucgaagguaaaagacauacuucaauucaauaucaagaauaugaguuaccagauuacaguggucaaguagcaucaaaucauaacuuagcaccaccagucgcuccaagaaugcccggcgaaucccuauuauuauuccaaucaaauaugccaguuugggacgauggacacggugaaucuacaccaaagaaaauacauugucuauuaccucaagaauuuauaggacauuucuuugauaaacaagcaccuucacuaggugacgcagcucuuuuaagauauguuaaucaagaaacaaacagaguauuauuugaaugcaaauuauauagagauggauauauuacaguagcagcaagcucagguuuacuagacuuuccucuagaugguuucuuuagauuugacucaugggucagcucuuuuuacauauuaucaccuguaggaucaggucaaggaaggagauga

SEQ ID NO: 33253 - RNA, 1653 nt, Artificial Sequence
  derived and/or modified sequence opt6 from VP1__Norovirus_and/or_Norovirus-like__AF414427
augaaaauggcuagcucugaugcagcaccuagugcugauggcgcaggaaauuuaguaccagaaucccaacaagaaguacuacccuuagcccccguagcgggugcagcauuagcagcaccaguaguuggacaaacuaauauaauagauccauggauuaaagaaaauuuuguacaagcaccccaaggagaauuuacuguaucuccuaaaaauaguccuggagaaauauuaguuaacuuagaacuaggacccaaauuaaauccauacuuagaccaucuaucaagaauguacaacucauaugcaggagguauugauguaaugguaguacuagcaggaaacgcauuuacugcaggaaaaguucucauagcagcaauuccacccaauuucccaguugaaggaguaagcgcaucacaagccacccaauuuccacacguaauaauagauguuagaacauuagacccaguaagacuuccacuuccagauguuagaucaacauucuuucauuauacuaaugauacugaaccuaaaaugagacucguaauuugguuauacacaccauuacgaacgaaugguuccggagaugacucauuuacaguuaguggaagaauauuaacaagaccaucacaagauuuugaauuugcauuccuaauaccuccaacaguagaaacuaaaacaacuccuuuuucaguaccuggcuucucuguccaagaaaugucaaauucacgauggccagcugccauauccgcuaugguaguaagaggaaaugaaccucaagucguacaauuucaaaauggacgugcacaccuugaugguauguuauuaggcacaacaccuguaucuccaaauuauauagcaaguuacagagguauaaguacuggcaacucacgaucagcuagcacagaagccgacgaaagagccgucggcucuuucgauguauggauaagacuccaagaacccgauggccaacccuaugauauauucggaaaacaaccagcacccauuggaacaccugacuuuaaagccguaauaguaggauuugccgcuagaccacuaacaucaggaucuuacgcuaaugaagcauacguaaauacaacagcaagugacuacgcaccagcaacugguaauaugcgcuucacuguaagaaacggagguucaggucauauaucagcaaauaaauauugggaauuuaaaaguuucgguguagaaggcgaaagacacacugauauacaauaucaagaauaugaauuaccagauuacucaggacaaguagcaucaaaccauaacuuagcaccaccaguagcaccaagaaugccaggagaaucacuauuauuauuucaaucaaauaugcccguaugggaugacggacauggugaaaguacuccaaagaaaauucacugucucuuaccacaggaauuuaucggacacuucuuugauaaacaagcaccaucccucggagaugcugcacuauuaagauauguuaaccaagaaacaaauagagucuuguuugaauguaaauuauaucgcgacggauacauaaccgucgccgcaucaucuggauuacuagauuuuccacuagacggauucuuucguuucgauucauggguaucaucauuuuauauucuuucaccaguaggaucaggacaaggucgacgauaa

SEQ ID NO: 33254 - RNA, 1653 nt, Artificial Sequence
  derived and/or modified sequence opt6 from VP1__Norovirus_and/or_Norovirus-like__JQ613567
augaaaauggcaucuucugaugcugcuccaucaaccgauggcgccggaaauuuaguaccugaaucccaacaagaaguauuaccccuagcaccaguugcgggugcagcacuagcagcaccugucgucggacagacaaauauaauagacccauggauaaaagaaaauuucguccaagcaccacaaggagaauuuacaguaucacccaaaaacucaccaggagaaauauuaguaaaccuagaauuagguccaaaauuaaauccauauuuagaucaucuaucucgaauguacaauaguuaugccggaggaauagaugucaugguaguccuugcuggaaacgcauuuacagcagguaaaguccuaauagcagcaauuccaccaaacuuuccaguagaaggaguuucagcuucacaagcaacacaauuuccacauguuauaauagauguuagaacucuagauccaguaagauuacccuuaccagauguucgaucgacuuucuuucauuauacaaaugacacagaacccaaaaugagauuaguaauaugguuauacacaccacuaaggacaaacggcucaggagaugauucauuuacaguaucaggacgaauauuaaccagaccaucccaagacuuugaauuugcauuucuaauuccuccaacuguagaaacaaaaacaacaccauuuucuguacccggauuuucuguucaagaaaugucuaauucuagauggccagcagccauaucagcuaugguaguaagaggaaacgaaccccaagucguacaauuccaaaacggacgagcacacuuagaugguauguuacuaggaacaacaccugugucuccaaauuauauugcgucuuauagaggaauaucaacaggaaauucuagaucagccucaucagaagcagacgaacgcgcagucggcucauucgauguauggguaagauuacaagaaccagauggacaaccauaugacauauuuggaaaacaaccagcaccaauagguacaccagauuucaaagcaguuauugucggauuugcagcuagaccucucacaucaggaucauaugcaaaugaagcauacguaaacacgacagcuucugauuacgcuccagcaaccggaaauaugagauucacaguacgaaauggaggaacaggacauauaucagccaacaaauacugggaauuuaaaucauucggcguagaaggagaacgacacacagacauccaauaccaagaauaugaauuacccgauuauucaggacaagucgcauccaaccauaaccuagcaccaccuguugcaccgagaaugccaggagaaagccuucucuuauuucaaucaaauaugccagucugggaugauggacacggagaaucuaccccaaagaaaauacacuguuuacuaccacaagaauuuauaggacauuucuucgauagacaagcaccaucauuaggcgacgcugcacuauuacguuaugucaaccaagaaacaaauagaguacuauuugaauguaaauuauauagagacggcuauauaacaguugccgcaucuucaggauuguuagauuuuccacuagaugguuucuucagauuugauucaugggucuccucuuuuuacauuuuaucaccuguaggauccggacaaggacgacguuaa

SEQ ID NO: 33255 - RNA, 1653 nt, Artificial Sequence
  derived and/or modified sequence opt6 from VP1__Norovirus_and/or_Norovirus-like__KC894731
augaaaauggcuucaucagaugcagcaccaucaaccgauggagcaggaaacuuaguaccagaaucacaacaagaaguucuacccuuagccccaguagcaggagcagcucuagcagcacccguaguaggccaaacuaauauaauugauccauggauaaaagaaaauuuuguucaagcaccucaaggagaauuuacaguaaguccuaaaaauucaccuggugaaauacuuguaaaucuugaacuaggaccaaaauuaaauccuuaucuugaccauuuaucaagaauguacaacucauaugcugguggcauugauguaaugguuguuuuagcaggcaaugcauuuacagcugguaaaguguuaauagcugcaaucccaccaaacuucccaguagaaguaguuagcgcuucucaagcgacccaauuuccacauguaauaauagauguaagaacucuugauccaguacgacuaccauuaccagauguaagaucaacauuuuuccauuauacaaacgauaccgaaccaaaaaugagauuaguaauuuggcuauauacaccauuaagaacaaauggaaguggagaugauuccuuuacuguaagcggaagaauauuaacucgaccaucacaagauuuugaauuugcauuuuuaauuccaccaacaguagaaacaaaaacuacaccauuuaguguaccaggauuuucaguacaagagaugucaaacagucguuggccagcugcuauaucagcuaugguuguaagaggaaacgaaccccagguaguacaauuucaaaaugguagagcucaucuagauggaauguuauuaggcacaacaccuguaagcccuaauuauaucgcaucauacagaggaauaaguacaggaaauucaagaucagcaucacccgaagcagacgaaagagcaguaggaucauucgacguuuggguaagauuacaagaacccgauggucaaccauacgauauauucggaaaacaaccagcuccaauuggcaccccugauuucaaagcaguuauuguaggauuugcagccagaccacugacaucaggaucguacgccaaugaggcauauguuaauacaacugcuucaaacuaugcaccagcaacaggaaauaugagauucacaguuaggaauggaggaacuggccauacaagugcaaauaaauauugggaauuuaaaucuuucggaguagaaggugaacgacauacagguauacaauaucaagaauaugaacuaccagauuauucaggacaaguagcuuccaaccauaacuuagcaccaccaguugcuccuagaaugccaggagaaucacuacuauuauuucaaaguaacaugccaguaugggaugauggacauggagaaucaacaccaaagaaaauacauugucuacuaccacaagaguucaucggacauuucuuugauaaacaagcuccuagcuugggugaugcagcucuauuacgcuacguuaaccaagaaacaaauagaguacuauuugaauguaaauuauacagagacggguacauaacuguagcagcaagcucuggucuauuagacuucccucuagacggauucuuucgauuugauucauggguuucaucuuucuauauauuaucaccaguaggcuccggacaaggaagaagauaa

SEQ ID NO: 33256 - RNA, 1647 nt, Artificial Sequence
  derived and/or modified sequence opt6 from VP1__Norovirus_and/or_Norovirus-like__AF427118
augaaaauggcuagcaaugaugcugcaccauccucugauggagcugcaggucuaguaccagaaucaaacaaugaaguaauggcacuagaaccaguagcuggagcuuccuuagccgcaccagucacaggacaaacuaauauaauagauccuuggauucgaaugaacuuuguacaagcaccaaauggcgaauuuacagucagcccgagaaauucuccuggugaaguucuccuaaaccuagagcucggaccagaacuaaacccauacuuagcacaucucucucgaauguacaacggauaugcaggaggaauggaaguccaaauaaugcuagccggaaaugcauucacagcagguaaacuaauauuugccgcaguaccaccacacuucccaauagaaaauuuaucaccuccucaaauuacaauguuuccacacgucauaaucgacguaagaacacucgaaccaguacuauuaccaaugccagacauaagaaauucauucuuccacuucauacaaagagacgaaccuaaaaugagauuaguagccaugcuauacacaccauuaagaucaaacggaucuggcgacgauguauucacaguauccuguagaguccuaaccagaccaacaccagacuucgacuucacauauuuaguuccaccaaccgucgagucaaaaucgaaacccuucacacucccaauauuaacccuaggagaacucaccaacucucgauuuccauuaccaauagauguauuauacacaaacccaaaugaaucagccauuguucaaugccaaaacgguagaugcacccuagauggagaauuacaagguacaacacaauugcuaccaacaggaauaugugcauuuagagguaaaguaacacaacaaguacaagaugaacauagagguacgcauuggaauaugaccguaacuaacuuaaauggaacaccuuucgauccaacagaagauguacccgcuccuuuagguacaccagauuuuucaggacaaauauacggaguaauaucccaaagaaauacaaauacuguaccaggagaaggagaucuuccagcaaacagagcucaugaagcuguaauagcaacauacucaccaaaauucacccccaaacuagguaauauacaauuuucaacaugggaaacucaagauguaucuucaggacaacccacaaaauucacaccuguuggacuagcauccguagacgcaaauucacauuucgaucaauggacauuaccaucuuauucuggggcacuaaccuuaaacaugaacuuagcaccaucaguagcaccagucuuuccuggagaaugucuuuuauucuuuagaucuuuuauaccccuaaaaggaggauauggaaacccagcaaucgacugcuuaaugccacaagaauggguacaacaucuauaucaagagucagcaccaucacuauccgacguagcauuaguacguuauguaaaccccgaaacuggaagaaccuuauuugaagcaaaacuacauagaaaugguuuccucacuguugcaagaaacucagcaggcccaguaguagcaccaacaaauggauauuucagauucgauucauggguaaaucaauuuuauacacuugcuccaaugggaaauggaucaggcagaagaagaaugcaauaa

SEQ ID NO: 33257 - RNA, 1647 nt, Artificial Sequence
  derived and/or modified sequence opt6 from VP1__Norovirus_and/or_Norovirus-like__AY237415
augaagauggcuucaaaugaugcagcaccaucaucagacggcgcagcaggauuaguuccagaaucaaauaaugaagucauggcucuagaacccguagccggugcaaguuuagcagcuccugucacaggacaaacaaacauaaucgacccuuggauccgaaugaacuuuguccaagcaccaaacggagaauuuaccgucucaccaagaaauucaccaggagaaguacuacuaaaucuugaacucggaccagaacucaauccauacuuagcacacuuaucacgaauguacaacggauaugccggaggaauggaaguccaaauaauguuagcaggaaaugccuucacagcaggaaaacuaauauuugcagcaguuccaccacacuuuccaauugaaaaucuaucaccaccacaaauuaccauguucccacauguaauaauagauguaagaaccuuagaaccaguucuuuuaccaaugccagacauaagaaauucauuuuuccauuucauacaacgagacgaaccaaaaaugcgacucgucgcaaugcuauauaccccacuaagaucaaauggauccggugaugauguauucacaguauccugcagaguacuaacacgaccaacacccgacuuugacuuuacauacuuaguacccccaacaguagaaucaaaaucuaaaccauucacuuuaccaauauuaaccuuaggagaacuaaccaauucacguuuuccacuaccaauagaugucuuauauacaaaccccaaugaaucagcaaucguacaaugucaaaacggaagaugcacucuagauggcgaauuacaaggaacaacucaacuacuaccaaccggaauaugcgcauuucgcggaaaaguaacccaacaaguacaagaugaacaccgcggaacacacuggaacaugacagucacaaacuuaaauggcacacccuucgacccaacagaagacguaccugcaccauuaggaacacccgauuuuucaggacaaaucuauggaguaauaucucaacgaaacaccaauacagucccaggcgaagguaauuuaccugcaaauagagcacaugaagcaguaauagcaacauauucuccaaaauucacucccaaacuuggaaauauacaauucucaacuugggaaacacaagacguaagcuccggacaaccaaccaaauuuacaccaguaggacucgcauccgucgacgcaaauucacauuuugaccaauggacacuaccaucauauucaggagcauuaacccuuaacaugaauuuagcuccuucagucgccccagucuuuccaggugaauguuuauuauucuuucguucauucauaccccuaaaaggaggauauggaaacccagcgauagauuguuuaaugccacaagaauggguacaacaccuuuaucaagaauccgcaccaucacuauccgacguagcuuuaguaagauacguaaacccagaaaccggcagaacauuauucgaagcaaaauuacacagaaacggauuucuaacaguagcaagaaacagcgcagguccaguagucgcaccaacaaauggauauuucagauuugacuccuggguaaaccaauuuuauaccuuagccccgaugggaaauggcucuggacgaagacgaaugcaauaa

SEQ ID NO: 33258 - RNA, 1647 nt, Artificial Sequence
  derived and/or modified sequence opt6 from VP1__Norovirus_and/or_Norovirus-like__AF504671
augaaaauggcuucuaaugaugcugcaccaucaaacgauggagcagcuggacuuguaccagaaucaaauaaugaaguaauggccuuagaaccaguagcaggagcaucauuagcagcaccaguaaccggacaaacaaauauaauagacccuuggauccgaaugaauuuuguacaagcaccaaauggcgaauuuacaguuucgccacgcaacucaccuggagaaguacuacuaaaccuagaacuaggacccgaacuaaacccauaccucgcccaccuuucaagaauguauaauggauacgcaggaggaauggaaguacaaauaauguuagcaggaaacgccuucaccgcugguaaauuaauauuugcagcaguacccccacauuuccccauagaaaaucuuucaccuccucaaauaacaauguuuccucacguaauaauagauguaagaacauuagaaccaguauuacuaccaaugccagauauuagaaauucauucuuucauuuuauacaacgagaugaaccuaaaaugcgauuaguagccauguuguacacaccacuaagaucaaacggaucaggagacgauguauuuacuguaucauguagaguacuaacaagaccuacaccagauuuugauuucaccuaucuaguaccaccaacaguagaaucaaaaucaaaaccauucacauuaccaauccugacccuaggagaacuaacaaauucaagauucccacuaccaauagacguauuauauacaaaucccaaugaauccgcaauuguacaaugucaaaauggcagauguacacuagacggugaauuacaaggaacaacacaacuauuaccaaccggaauuugcgccuuuagaggaaaagucacacaacaaguucaagacgaacaucgugguacucauuggaauaugacuguuacuaauuuaaacggaacaccuuucgauccaacagaagacguaccagcaccucucggaacuccugacuuuucaggacaaauauacggugucauuagccaacguaacacaaauacaguuccaggugaaggaaacuuaccugcaaacagagcacaugaagcaguaauugcaacuuauucaccaaaauucacaccaaaacuuggaaauauucaauucucaaccugggaaacacaagacguaaguucaggucaaccuacaaaauuuacaccaguuggacuagcuucuguagaugcuaacucacacuuugaccaauggacacucccaucauacucaggagcuuuaaccuuaaacaugaaccucgccccuaguguagcuccagucuuuccaggcgaaugucuauuauucuuccgaucauuuaucccucuuaaaggaggcuacggaaauccagcaauugacugucuaaugccacaagaauggguucaacauuuauaucaagaauccgccccuagcuuaucagauguugcauuagucagauaugucaauccagaaacaggaagaacauuauuugaagcaaaacuacaucguaauggauuuuuaacaguagcaagaaauucagcaggaccaguaguugcaccaacaaauggauacuuuagauucgacuccuggguaaaucaauuuuacacauuagcucccaugggaaacggaucuggaagaagaagaaugcaauaa

SEQ ID NO: 33259 - RNA, 1647 nt, Artificial Sequence
  derived and/or modified sequence opt6 from VP1__Norovirus_and/or_Norovirus-like__KJ194504
augaaaauggccuccaacgaugcagcaccaucaaacgauggagcagcaggccuaguaccagaaauaaacaaugaagcuauggcauuagaaccaguagcaggagcugcaauagcugcaccacucaccggacaacaaaauauaauagacccauggauuaugaauaacuuuguacaagccccaggaggugaauuuaccguaucaccaagaaauucaccuggagaaguucuacuaaaucuagaacuaggccccgaaaucaauccauacuuagcacaucuagcaagaauguacaacggauaugccggaggauuugaaguccaaguaguacuagccggaaacgcauuuacagccggaaaaguaauauucgccgcaauuccaccaaacuuuccaaucgacaaucuaucugcugcacaaauaacgauguguccacaugucauuguagacguacgacaauuagaacccauaaaccuucccaugccagacguacgaaauaacuucuuucauuauaaucaaggaagcgauucuagacuaagauuaguagcaaugcuauacacuccauuaagagcuaauaauucuggagacgacguauuuacaguuucuuguagaguauuaaccagaccaucaccugacuuuuccuuuaacuuucuaguaccacccacaguagaaucaaaaacaaaacccuucacauuaccaauucuaacaauauccgaaaugucaaacucccgauuuccaguaccaauagauucacuucauacaucaccaaccgaaaacauaguaguacaaugucaaaaugguagaguaacacuagauggagaacuaaugggaacaacacaacuauuacccucacagaucugcgcauucagaggaacacuaacaagaucaacaucccgagcaucugaccaagccgacacaccaacuccaagacaauucgaccacagauggcacauacaacuagacaaucucaacggaacccccuacgauccagcugaagauaucccagcucccuuaggaaccccagacuuuagaggaaaagucuucgguguagcaucgcaaagaaacccagacggaacuaccagagcacaugaagcaaaaguagacaccacaacaaauagauuuacccccaaacuaggaucauuagaaaucauaacagaauccgaagauuucgauacaaaucaaucuacaaaauuuacaccuguaggagucggaguagacaaugaagaagaauuucaacaauggucauuaccuaauuacucuggacaauuuacucacaacaugaacuuagccccugcaguagcuccuaacuuucccggagaacaauuacuauucuuucgcucacaacucccaucuucaggaggaugguccaacggcauauuagauugucuaguaccacaagaauggguacaacacuucuaucaagaaucagcuccagcucaaacacaaguagcucuuguuagauacguaaacccagacacuggaagaguuuuauucgaagcaaaacuacauaaacuaggauuuaugaccauagcuaaaaacggcgauucaccaaucacuguacccccaaauggauauuucagauucgaauccuggguaaacccuuuuuauacccucgcacccaugggaaccggaaauggaagaagaaggauacaauaa

SEQ ID NO: 33260 - RNA, 1647 nt, Artificial Sequence
  derived and/or modified sequence opt6 from VP1__Norovirus_and/or_Norovirus-like__KJ194500
augaaaauggcaucuaaugacgcagcaccuucaaacgacggugcagcuggauuaguaccagaaauaaauaaugaagcaauggccuuagaaccaguggcuggugcagcuauagcugcuccauuaacaggccaacaaaauaucauagacccauggauaaugaauaacuuuguacaagcucccgguggagaauuuacgguaucaccaagaaauucaccaggagaaguacuauugucacuugaacuagguccagaaauaaauccuuaccuagcccauuuagcaagaauguauaacgguuacgcaggaggauucgaaguacaaguaguacuugccgguaacgcuuuuacagcaggaaaaauaauauucgcagcuauaccaccaaacuuuccuauagacaauuuaucugccgcacaaauaacaauguguccacauguaauaguagacguuagacaacucgaaccaguaaaucuaccaaugccagacgucagaaacaauuucuuucacuauaaccaaagcucugaaucacguuuaagauuaauugcaauguuauauacaccauuacgagcaaauaauucaggugacgauguuuucacaguaucaugccgcgucuuaacaagaccauccccagauuucaguuucaacuuucuaguuccaccaaccgucgaaucaaaaacgaaaccuuucacacuaccuauacucacaauaucagaaaugucaaauucaagauuuccaguaccaauugauucauuacauacaucuccaacagaaaauaucguaguacaaugucaaaacggcagaguaacacucgacggagaacuaaugggaacaacucaauuacuaccaucacaaauaugugcauuccgaggaacacuaacggguucaacaucaagagcauccgaccaaacagauacaccaacaccaagacaauuugacagacgguggcacauacaacuagacaaccuaaacgguaccccauacgacccugccgaagacaucccagcaccucuuggaacaccugauuuucgaggaaaaguauucggaguagcaucacaaagaaaccccgauagagcuacacgagcacacgaagccaaaguugacacuaccucagaccguuuugcuccaaaacuaggcucauuagaaauaacaacagaaucaggugauuucgaagccaaccaaccaacaaaauucacuccaguaggaauaggaguagacaacgaagcagaauuucaacaauggucucuaccaaauuauagcggacaaauaacacacaauaugaauuuagcaccagcaguagcgccaaacuucccaggagaacaauuauuauucuuuagaucacaauuacccuccuccggaggauggucaaauggcguacuagauugcuuauugccacaagaauggguucaacauuuuuaccaagaaucagcaccagcacaaacacaaguagcccucguaagauauguaaacccagauacaggcagaguacuuuucgaagcaaaauuacauaaauuaggauucaugaccauagcuaaaaauggugacucaccaauuacaguaccaccuaacggauauuucagauuugaaucauggguaaauccauuuuauacacuagcaccaaugggaacugguaauggaagaaggagaauccaauaa

SEQ ID NO: 33261 - RNA, 1647 nt, Artificial Sequence
  derived and/or modified sequence opt6 from VP1__Norovirus_and/or_Norovirus-like__DQ093063
augaaaauggcaucaaacgaugcagcacccucaaacgacggagcugcagguuuaguacccgaaauuaauaaugaagcaauggcccuagauccaguagcaggagccgcaauagcagcaccucucacaggucaacagaauauaauagaccccuggauuaugaauaauuucguacaagcacccggaggagaauuuacaguaucuccaagaaacuccccaggcgaaguccuacucaauuuagaauuaggcccugaaaucaacccauaucuagcccaucuagcaagaauguacaacggcuacgcaggaggauuugaaguccaagucgucuuagcaggaaaugcauuuaccgcaggaaaaguuauauuugcagcaauaccaccaaauuucccaauagauaacuuaucagcugcccaaaucacuauguguccucauguaauaguagauguaagacaauuagaaccgauaaaccuaccaaugcccgauguaagaaacaauuucuuucauuauaaucaaggaagugacaguagacuaagacuaauugcaauguuauauacacccuuaagagccaacaacagcggagaugauguuuuuacagucuccuguagaguauuaacaagacccucaccagauuucuccuuuaacuucuuaguaccacccacaguagaaucaaaaaccaaaccauuuaccuuacccauuuuaacaauaagugaaaugucaaacucacgauucccaguaccuauugauucacuucauacuucacccacugaauccguaguaguacaaugucaaaauggaagaguaacuuuggauggugaauuaaugggaacaacacaacuacuaccaagccaaauaugcgcauuucgcggaacauuaacaagaccaacaaauagagcuagcgaucaagcagauacugcuaccccacgccuuuucaaucaucaauggcacauacaauuagacaaccuaaacggcacuccauaugacccugccgaagacauacccgcaccuuuaggaacaccugauuuccguggaaaaguuuuuggaguagcaucccaacgugacccagacggaacaacaagagcucacgaagcuaaaguagauacuacuucaggaagauuuacaccaaaauuaggaucucuugaaauaacuaccgaaagugaugacuuuaaccaaaauaaaccaacaagauucacuccaguaggcauaggcguagauaacgaagcagacuuccaacaauggauccuaccagauuacucaggacaauuuacacacaauaugaauuuagcuccugcaguugcaccaaauuuuccaggagaacaauuauuauucuuuagaucacaacucccaucauccggcgguagaucaaacggaauauuagauugucuaguaccacaagaauggguacaacacuuuuaccaggaaucugcaccagcacaaacacaaguugcacuuguacgauauguaaauccugacacagguagaguacuauuugaagcaaaacuccauaaaaugggauuuaugacuauagccaaaaacggagauucuccaaucacuguaccaccuaauggcuauuucagauuugaaucauggguaaauccauuuuauacacuagcuccuauggguacuggaaaaggcagaagaagaauacaauaa

SEQ ID NO: 33262 - RNA, 1647 nt, Artificial Sequence
  derived and/or modified sequence opt6 from VP1__Norovirus_and/or_Norovirus-like__AY030313
augaaaauggcuucaaaugacgcagcaccaucaaaugacggagcugcaggucucguacccgaaaucaacaaugaagccauggcacuagacccaguugcaggagccgcaauagcugcacccuuaacaggacaacaaaauauaauagacccauggauuaugaacaauuuuguccaagcuccaggaggagaauuuacaguuucaccaagaaauuccccaggagaaguuuuauuaaauuuagaacuaggcccugaaauaaaccccuaucuagcacaccuagcucgaauguacaacgguuaugccggcggauucgaaguucaaguaguacuugccgguaacgcuuuuacagccggaaaaguaauauucgcagcaauaccaccuaauuuccccauagauaaucuaucagcagcacaaauaacaauguguccacacguaauaguugaugucagacaauuagaaccuauuaaucuaccaaugccagacguacgaaacaacuucuuccacuauaaccaaggaucagacucccgccuaagacucauagcaauguuauacacuccauuaagagccaacaacuccggagacgauguauuuacaguaucaugcaggguacuaacaagaccgucacccgacuuuucauuuaacuucuuaguaccgccaacaguugaauccaaaacaaaaccauuuacacuaccuauacucacaauaucggaaaugucuaauucaagauuuccuguuccuauugauucacuacauacuucacccacagaaagcauaguaguucaaugccaaaaugggagagucaccuuagacggagaauuaaugggaacaacacaauuacuuccaaaccaaauaugcgcguuuagaggaacauuaacacgaucaacaaauagagccucagaucaagcagacaccgcaacaccaagacucuuugaucaucacuggcauauacaacuggacaaucuuaacggcacacccuacgauccagccgaagauauaccagcaccacuaggaacacccgacuuccgaggaaaagucuuuggaguagcaucacaaagaaauccagacucaacaacaagggcacacgaagccaaaguagacacaaccucaggucgauucacuccaaaacuuggaucauuagaaauuacaaccgaaagcgaugacuuugacccaaaucaaucaacaaaauuuacaccaguaggaauaggaguagauaaugaagcugauuuucaacaauggucacuaccugauuauagcggacaauucacacacaacaugaaccuagccccagcaguugcaccaaacuuuccaggagaacaauuacuauucuuuagaucacaauuaccuucauccgguggaagaucaaauggaauacuugauugcuuaguuccacaagaauggguacaacauuucuaucaggaaucagccccagcccaaacucaaguagcauuaguaagauacguaaacccagauacaggcagaguauuauucgaagccaaacuacauaaacuaggauucaugacaauagccaaaaauggagauucaccaauaacaguaccaccaaacggauacuuccguuucgaaucauggguaaaucccuuuuacacgcuagcaccuaugggaacaggaaauggacgacgaagaauacaauaa

SEQ ID NO: 33263 - RNA, 1647 nt, Artificial Sequence
  derived and/or modified sequence opt6 from VP1__Norovirus_and/or_Norovirus-like__U02030
augaaaauggcaucuaaugacgcagccccuucaaacgacggagcugcaugucucguaccugaaauaaacaacgaagcaauggcacuagaaccagucgcaggcagcgcaauagcagcaccccuaacaggccaacaaaacauaauagauccauggauaaugaacaauuucguccaagccccagguggugaauuuaccguaucaccaagaaauucaccaggcgaagucuuacuaaaucucgaauuaggaccagaaauaaacccauauuuagcccaccuagcacgaauguauaacggauaugcaggaggauucgaaguacaagucguuuuagcaggaaaugccuuuacugcaggcaaaauuauauucgccgcaauaccaccaaacuucccaauugacaauuuaagcgcugcacaaauaacaaugugcccccauguaauugucgacguaagacaauuagaaccaauaaaucuaccaaugccagacguaagaaacaauuucuuucacuauaaucaaggaagcgauucaagacuucgauuaaucgcaauguuauacacaccauuaagagcaaacaauaguggugaugauguauuuacaguuucaugccgagucuuaacuagacccucccccgauuucucuuuuaacuucuuagucccaccaacaguagaaucuaagacaaaaccuuucacacuuccuauauuaacaauaucugaaaugaguaacucaagauucccaguaccaaucgacucucuccacacaagcccaacagaaaacaucguaguacaaugccaaaauggaagaguaacacuagacggagaacuaaugggaacaacucaauuauuacccucccaaauuugcgcuuuuagaggcacgcuaacacgaucaaccuccagagccucagaucaagcagacacaccaacaccaagacuauucaauuauuacuggcacauacaauuagacaacuuaaacggcaccccauaugauccagcugaagacauuccagcaccccuagguacaccagacuuuagagguaaaguauuuggagucgcaucccaacgaaacccagacucaacaacacgagcacacgaagccaaagucgacacaacaucaggacgcuucacaccaaaauuaggaucucuagaaauaaccacugaaucagaugacuuugauccaaaccaaccaacaaaauucacuccaguaggcguaggaguagauaaugaagcagaauuucaacaauggucauuacccaauuauaguggacaauucacccacaacaugaaucuugcuccagcaguugcaccaaauuuccccggagaacaacuauuauucuuuagaucacaacuaccaucaucuggagguagaucaaacggaguucuugauugucucgucccacaagaauggguacaacacuuuuaccaagaaucagcaccagcccaaacacaaguagcauuaguaagauauguaaauccugauaccgguagaguacuauuugaagcuaaauuacauaaauuaggauuuaugacaaucgccaaaaauggagauucaccuauaacagucccacccaacggauauuuucgauuugaauccuggguuaauccauucuauacauuagcacccaugggaacaggaaauggaagaagaagaauacaauaa

SEQ ID NO: 33264 - RNA, 1647 nt, Artificial Sequence
  derived and/or modified sequence opt6 from VP1__Norovirus_and/or_Norovirus-like__AB039782
augaaaauggcauccaaugaugcagcuccuucuaacgauggagccgccggauuaguuccugaaauaaauaaugaagcaauggcacuagaacccguugcuggugcagcaauagcagccccacuaacuggacaacaaaauaucauagacccauggauaaugaacaacuuuguucaagcuccuggaggagaauuuacaguaagcccgagaaacucaccuggagaaguucuacucaaccuggaacuaggccccgaaaucaacccauaucucgcacacuuagcuagaauguauaacggauaugcaggagguuucgaaguacagguaguucuagcuggaaaugccuuuaccgccggaaaaguaauauucgcugcaauucccccuaacuuccccauugacaaccuaucugcagcacaaauuacaaugugcccucauguaauaguagauguuagacaacucgaaccaauaaacuuaccaaugccugacguacgaaauaauuucuuucauuauaaccaaggcucugacuccagauuaagacuaauagcuauguuauacacacccuuaagagcaaacaauucaggugacgauguauuuacaguaucauguagaguuuuaacccgucccucaccagacuuuucauuuaacuuuuugguaccuccaacugucgaaucaaaaaccaaauuauuuacacuaccuauauuaacaauaagugaaauguccaauucaagguuuccaguaccaauagacucacuacauacuucaccaacagaaaauauaguaguacaaugucaaaacggacgaguaacacuugacggagaacuaaugggaacaacucaauuauuaccaucacaaauaugugcauuuagagguaccuuaacaagaucaaccucaagagcaucagaucaagcugauacaccaacaccacgauuauucaaccacagauggcauauacaauuagacaacuuaaauggcaccccauaugauccagcagaagauauaccagcuccacuaggaacaccugacuucagaggaaaaguauuuggaguagcaucacaaagaaauccugauucaacaaccagagcacaugaagccaaaguagacacuacaucaggaagauuuaccccuaaauuaggcucauuagaaauaacaacagaaucugacgauuucgacacaaaucaaucuaccaaauuuacuccaguaggaauaggaguugauaaugaagcugaauuucaacaauggucucuaccaaacuacucaggacaauucacucauaacaugaacuuagccccugcaguagcaccuaauuuuccaggcgaacaauuauuauucuuuagaagccaacuaccauccucuggaggacgaucuaauggaguucuagauugccucguuccccaagaauggguacaacauuuuuaucaagaaucagcaccagcacaaacccaaguugcauuaguaagauauguaaauccugacacuggaagaguauuauuugaagcaaaacuacacaaauuaggauuuaugaccauagccaaaaacggagacucaccaauaacuguaccuccaaauggauauuuccgauucgaaucuugggucaaccccuuuuacacacuagcaccaaugggcacuggaaauggacgcagaagaauccaauaa

SEQ ID NO: 33265 - RNA, 1647 nt, Artificial Sequence
  derived and/or modified sequence opt6 from VP1__Norovirus_and/or_Norovirus-like__U46039
augaaaauggccucaaaugacgcagcaccaucaaaugacggagcagcaggauuaguaccagaaauuaauaaugaagcaauggcauuagaaccagucgcaggagcugcaaucgcagcaccccuaacuggccaacaaaauauuauugauccuuggauaaugaauaacuuuguacaagcccccgguggagaauuuacaguaucuccaagaaauucccccggcgaaguuuuacuuaaucuagaacuuggaccagaaauaaacccauaucuagcucacuuagcaagaauguacaacgguuaugcuggaggauuugaaguccaagucguacuugcuggcaacgcauucacagcagguaaaguuauauucgcagcaauaccuccaaacuuuccaaucgacaauuuaucagcugcacaaauaacaaugugcccacacguaauaguagacguaagacaauuagaacccaucaaccuuccaaugccagacguaagaaacaauuucuuccacuacaaccaaggaagugauucccgauuaagacucaucgcaaugcuauucaccccauuaagagcaaacaauagcggagacgauguauucaccguaucaugucgaguacuaacaagaccaucuccagauuucucauuuaauuuucuuguaccaccaaccguagagucaaaaaucaaaccauuuacccuaccaauucuaccaauaucagaaaugucaaauucacgcuuuccaguuccaauagacucauuacauacuucacccacagaaaacauaguuguacaaugccaaaauggacgaguaacacuagacggagaacuaaugggaacaacucaacuauucccaucacaaauuugugcauuuagagguacauuaacacgaagcacuucaagagcaucagaccaagcagacacauccacaccacgucuauuuaacuacuacuggcacauccaacuagacaauuuaaacggaaccccauacgacccagcugaagacauaccugcaccacucgguacaccugauuuucaagguaaaguauucggcguugcaucacaaagaaauccagacucaacuaccagagcucaugaagcaaaaguagacacaacuucaggaagauuuacaccaaaacuaggcaguuuagaaaucuccacagaaucugacgacuuugacucaaaucaaccuacuaaauucacaccaguuggaauaggaguagauaaugaagccgacuuucaacaauggucacuuccaaauuauucaggacaauucacucacaacaugaaccuagcccccgcaguagcuccaauauuuccuggugaacaaauacuauucuuucgcucucaaguaccaucauccggaggaagaucuaacggaguauuagauuguuuaguaccacaagaauggguccaacauuucuaccaagagucagcaccagcucaaacacaaguagcccuagucagauauguaaauccagauacaggaagaguauuauucgaagcaaaacuacauaaacucgguuuuaugacaauagcuaaaaauggagauucaccaauaaccguaccaccaaaugguuauuuuagauucgaaagcuggguaaacccuuuuuacacacuagcaccaaugggaacaggaaauggacgacgaagaauacaauaa

SEQ ID NO: 33266 - RNA, 1647 nt, Artificial Sequence
  derived and/or modified sequence opt6 from VP1__Norovirus_and/or_Norovirus-like__DQ093066
augaaaauggcaucaaaugacgcagcaccuucaaaugacggggcagcaggucuaguaccagaaaucaacaaugaagcaauggcacucgauccagucgcaggcgcagcaaucgcugcaccacuaacuggacaacaaaacauaauagauccauggauuaugaauaacuucguucaagcaccaggaggagaauuuaccguaucaccaagaaacucccccggagaaguacuucucaaucuagaauuaggcccagaaauaaaucccuacuuagcacacuuagcaagaauguauaauggauacgcuggagguuucgaaguccaaguaguauuagcaggcaaugcauucacagcagguaaaguaauauucgcugcaauacccccaaauuucccaauagauaauuuauccgcagcacaaauaacuaugugcccucacguuauaguagacguuagacaauuagaaccuaucaaccucccaaugccagacguaagaaauaauuucuuucacuauaaccaaggaucugacucacgauuacgauuaauagcaauguuauauaccccacuuagagcuaauaauucaggcgaugauguauucacaguaucaugucgaguuuuaacucgaccaucaccagacuuuuccuuuaacuuuuuagucccaccaaccguugaaucaaaaaccaaaccauuuaccuuacccauuuuaacaauaucagaaaugagcaauucaagauucccaguuccaauagacuccuuacauacaucacccacagaaaacaucguaguacaaugucaaaacggcagaguaacacuagauggcgaauuaaugggaacaacacaauuacuacccagucaaaucugcacauuucguggcacacucacacgaucaacaucaagagccucagaucaagcagacacagcaacaccaagacuauuuaauuacuauuggcacauccaauuagauaaucuaaacggaacucccuaugauccagcagaagauauaccagcaccccuaggaacaccugacuuucgagguaaaguauuuggaguagcuucccaacguaaccccgauucaaccacaagagcucaugaagcuaaaguagauacuacaucaggaagauuuaucccaaaacucggcucacuugaaauuucuaccgaaagugaugauuucgaucaaaaucaaccuacccgauuuaccccaguaggcauaggaguagauaaugaagcuggauuccaacaauggucauuaccugauuauaguggacaauuuacccacaacaugaauuuagcaccagcaguagcaccaaacuuuccaggagaacaacuauuauucuuucguucccaacuaccaucuucaggcggucgaaguaauggaauccuagauuguuuaguaccucaagaguggguacaacauuucuaucaagaaucugcuccagcucaaacucaaguagcauuaguaagauacguaaauccugacaccggacguguccuauucgaagcaaaacugcacaaacuaggauuuaugacaauaucuaaaaacggagacucaccaauuacuguaccaccaaauggauauuucagauuugaaucauggguaaacccauuuuauacacuugcaccuaugggaacuggaaacggaagaagacgaauacaauaa

SEQ ID NO: 33267 - RNA, 1647 nt, Artificial Sequence
  derived and/or modified sequence opt6 from VP1__Norovirus_and/or_Norovirus-like__DQ093062
augaaaauggcaucaaaugacgcagcaccuucaaaugauggagccgcaggucuaguaccagaaauuaacaaugaagcaauggcacuagaaccaguugccggagcagcaauagcagcaccacuaacuggacaacaaaauauaauugacccauggaucaugaacaacuuuguacaagcaccaggaggugaauuuacaguaucaccacgaaacucccccggagaaguuuuacuaaaucuagaacucggacccgaaauaaauccauaucuagcacauuuagccagaauguauaaugguuaugcaggaggauuugaaguccaaguuguacuagcaggaaaugcauuuacagcuggcaagguaauuuuugcagcaauaccaccaaacuuuccaauagacaacuuaucagcagcacaaauaacaaugugcccccauguaauaguggacguucgacaauuagaaccaauaaaccucccaaugccagauguacgcaacaauuucuuccacuauaaccaaggaucagauucacgguugcgauuaaucgcuaugcuuuacacuccacuaagagcaaauaauucaggugacgauguauuuacaguuuccuguagagucuuaacuagaccaucaccugauuuuuccuuuaacuuuuuaguaccuccaacaguagaaucaaaaacaaaacuauuuacacuaccaauauuaacaauuuccgaaaugucaaacucuagguucccuguaccaauugacucucuccacaccuccccaacugaaaauauaguaguccaaugucaaaauggacgaguuaccuuagauggagaacuuaugggcaccacacaacuccuaccuucucaaauuugcgcauuuagaggcacuuuaacaagaccaacuucaagagcaagcgaccaagcagacacaccaacaccaagauuauuuaaccauagauggcauauacaauuagauaauuuaaacggcacaccauacgacccagcugaagauauuccagcaccuuugggcacccccgacuuucgaggaaaggucuucgguguagcaucccaaagaaauccagacuccacaacaagagcacaugaagcaaaaguugauacaacauccgguagauucacaccaaaacuuggaucacuagaaauuacaacagaauccgacgacuuugacacaaaucaauccacuaaauuuacaccaguaggaauaggcguugacaaugaagcagaauuucaacaaugguccuuaccuaauuauagcggacaauuuacucacaacaugaaucuagccccagcuguagcaccaaacuuuccaggcgaacaacucuuauucuuuagaucucaacuucccuccucaggaggaagaucuaacgguguauuagacugcuuagugccccaagaauggguacaacauuucuaccaagaaucagccccugcacaaacacaaguagcauuaguaaaauacguaaauccagauacaggaagaguacuauucgaagcaaaauuacacaaauuagguuuuaugacaauagcuaaaaauggugacagcccaauaacaguaccuccaaacggauacuuuagauucgagaguuggguaaauccauuuuauacccuugcacccaugggcacaggaaaugggagaagaagaauacaauaa

SEQ ID NO: 33268 - RNA, 1647 nt, Artificial Sequence
  derived and/or modified sequence opt6 from VP1__Norovirus_and/or_Norovirus-like__GU930737
augaaaauggcaagcaaugaugcagccccuucaaaugacggagcagcaaaccuaguaccagaagcaaacucagaagucauggcauuagaaccaguaguuggagcaucaauagcagcaccaguaguaggucaacaaaauauaaucgacccauggauaagagaaaauuuuguccaagcaccucaaggagaauuuacaguaucaccaagaaauucaccuggagaaauguuauuaaauuuagaacuaggcccggaauuaaaccccuaccuaagucauuuauccagaauguauaauggauacgcaggaggcaugcaaguccaaguuguacuagcagguaaugcauuuaccgcaggaaaaauuauauucgcugcuguaccuccccauuuuccugucgaaaauaucucagcagcacaaauaacaauguguccacauguaauaguugauguaaggcaacuagagccuguucuauugccacuuccugauauucguaaccgauuuuuucauuauaaucaagaagauaccccaagaaugcguuuaguagcuauguuauauacaccacuacgagcaaacucuggagaagauguauuuacaguaaguugcagaguauuaacaagaccugcaccagacuuugaauuuacauuucuaguaccacccacaguagaauccaaaaccaaaccauucacuuuaccaauauuaacauuaggcgaacuaucaaauagccgauucccagccccaauagacaugcuauacacagacccuaaugaagcaauaguaguacaaccacaaaauggacgauguacuuuagaugguacauuacaaggcacaacacaauuaguaccaacccaaaucuguucauucagaggcacauuaauaucucaaacaucaagaucagcugauucaacugauucugcaccacguguucgcaaucauccacuccauguacaacuaaaaaaucuagacggaacaccuuaugauccaacagaugaaguaccagcaguuuuaggagcuauagauuucaaagguacagucuucgguguagcuucacaaagaaauaccacaggaaacucugaagaaggagcaacucgugcacaugaaguacauaucgacaccacaaauccaagauacacuccaaaauuaggaucuguauuuaugcauucagaaucaacagacuuugacgauggacaaccaacccgauuuacaccaaucgguaugggugccgaugauuggagacaaugggaauuaccagaauacucuggacaucuuacacuaaauaugaaucuagcuccagccguagccccagcauucccaggugaacgaauucuauuuuuucguucuguaguaccuucagcaggcggauauggaucuggacaaauugauugccuaauuccccaagaauggguacaacacuucuaccaagaagcagcaccaucacaaucagcaguagcuuuaauuagauauguaaauccagauacaggucgaaacauauucgaagcuaaacuacaucgagaaggguucauaaccguugccaauucuggaaacaauccaauuguaguacccccaaaugguuauuuccgauucgaagcuuggguaaaucaauuuuacacauuaacgccaauggguacaggacaagguagaagacgaguacaauaa

SEQ ID NO: 33269 - RNA, 1647 nt, Artificial Sequence
  derived and/or modified sequence opt6 from VP1__Norovirus_and/or_Norovirus-like__AF414412
augaaaauggcaucuaaugacgcagccccaucaucagauggagcagcaggauuaguaccugaaauuaacaaugaagccauggcccucgaaccagucgcuggagcagcaauagcagcacccuuaacaggccaacaaaauauaauagauccuuggauaaugaauaauuucguucaagccccuggaggagaauuuacaguaucuccaagaaacucaccaggagaaguauuacucaauuuagaauuaggaccugaaauuaacccuuacuuagcacauuuagcccgaauguauaacggauaugccggaggauuugaaguacaaguaguccuagcaggaaaugcuuuuacggccggaaaaguuauauucgcagcaauaccaccuaauuucccaauagauaaucuauccgcugcucaaauaacuauguguccacaugucauagucgauguacgacaacuagaaccaauaaaucuaccuaugccagacguaagaaauaacuuuuuccacuacaaucaaggauccgauucgagauuaagauuaauagcuaugcuauauacaccauuaagagcaaacaacucaggagacgacguauuuaccguaucauguaggguccuaacacguccaucaccagacuuuucuuucaauuuccucguaccaccuacaguagaaucaaaaacaaaacuauuuacacuuccaaucuuaacaaucucagaaaugucaaauucuagauuuccaguuccaaucgauucauuacauacaaguccaacagaaaauauagucguccaaugucaaaacggucguguaacucuagauggcgaauuaaugggaaccacacaacuccucccaucccaaauaugcgcauuucgaggaacauuaacacgauccacaucaagagcaucagaucaagcagauacaccaacaccaagacuauucaacuacuauuggcacauacaacucgacaaucuaaauggaacacccuacgauccagcugaggauauuccagccccauuaggaacaccagauuuccguggaaaaguauuuggaguagcaucucaaagaaacccagacucaaccaccagagcacaugaagcgaaaguagacaccacuucaggaagauuuacgccgaaauuagguucucuagaaauaucuacagaaagugaugacuucgacccaaaucaaccaacaaaauuuacaccaguaggaaucggaguagauaaugaagccgacuuccaacaauggucacucccuaauuacucaggacaauuuacucacaauaugaacuuagcaccagcaguagcuccuaacuuuccaggugaacaacuauuauuuuucagaucucaaagaccaaguucaggagguagaucaaaugguauauuagauugucuaguaccacaagaauggguccaacacuuuuaccaagaaucagcaccagcacaaacacaagucgcacuuguuagauacguuaaucccgauacaggaagaguucuauucgaagcaaaacuacacaaauuaggauucaugaccauagcuaaaaauggugauucucccauaacagucccaccaaauggauacuuuagauuugaaucauggguuaauccauucuauacacuugcaccaaugggaacuggaaaugguagaagacguauucaauaa

SEQ ID NO: 33270 - RNA, 1647 nt, Artificial Sequence
  derived and/or modified sequence opt6 from VP1__Norovirus_and/or_Norovirus-like__AB039781
augaaaauggcaucaaaugaugcagcaccaucaaaugacggagcagcaggccuagucccagaaauaaauaacgaagcaauggcccuagaaccuguugcaggagcagccaucgcagccccauuaacaggacaacaaaacauaauagaccccuggauaaugaacaacuuuguacaagcucccgguggagaauuuacaguaucaccaagaaauucuccaggugaaguacuacuaaauuuagaacuaggaccagaaauaaaccccuaucuagcucaucuagcacgaauguauaacggauacgcaggagguuucgaaguacaagucguacucgcagguaacgcuuucacagccggcaaaguaauauucgcagcaaucccacccaacuuccccauagauaaccuuucugcagcccaaauaacaauguguccacacgucauagucgauguaagacaauuagaaccaauuaaccucccaaugccagacguacgaaacaauuucuuccacuauaaucaaggaucagauagccgcuuaaggcuuauagcaaugcuauauacaccacuaagagcaaauaauucuggagacgauguuuuuacagucucaugcagaguucuaacccgaccaucuccagacuucucauuuaauuucuuaguacccccuacagucgaaucuaaaacaaagcucuuuacacuaccaauauuaacaaucucagaaaugucaaauucucgauuuccaguaccaauagauucuuuacauacuagcccaacugaaaauauuguaguacaaugccaaaacggaagaguuacauuagacggcgaauuaaugggcgcaacacaacucuuaccaucacaaaucugcgcauucagaggaacuuuaacucgaucaacaucaagagcaucagaucaaacagauacaccaacuccucgacuauucaaccaucgauggcauauccaacuagacaaucuaaauggaacgccauacgauccugcagaagauauucccgcuccauuaggcacaccugacuucagagguaaaguauucggaguagccucccaaagaaauccagacucaacaacaagagcucacgaagcuaaaguagauaccacauccggcagauucacaccuaaauuagguucacuugaaauaacaacugaaucagacgauuuagauacaaaucaaucuacuaaauuuacuccagucggaauaggaguagacaacgaagcagaauuucaacaauggucccucccaaauuacaguggucaauucacucauaacaugaauuuagcuccagcaguagcacuaaacuucccaggugaacaacuauuauucuucagaagucaacuacccuccucagguggacgaucaaacggaguuuuagacuguuuaguaccacaagaauggguacaacauuucuaucaagaaucagcacccgcccaaacucaaguugccuuagucagauauguaaauccagacacaggaagaguacuauucgaagcaaaacuacauaaacuaggauuuaugaccaucgccaaaaacggcgacucacccauaacagucccacccaacggauauuucagauucgaauccugggucaaucccuuuuacacacucgcacccaugggaacuggaaaugguagaagaagaauccaauag

SEQ ID NO: 33271 - RNA, 1647 nt, Artificial Sequence
  derived and/or modified sequence opt6 from VP1__Norovirus_and/or_Norovirus-like__LC035073
augaaaauggcaucuaaugaugcaacaccuucaaacgacggugcagcaggauuagucccagaaauuaauaaugaagcaauggcacucgauccaguugcaggagccgcaauagcagcaccacuuacaggacaacaaaacauaauagacccauggauaaugaacaacuuuguacaagcaccaggaggcgaguucacaguuucaccccguaauuccccuggagaagucuuacuuaauuuagaauuaggaccagaaauuaauccuuaucuagcucauuuagccagaauguauaauggauaugcaggcggcuucgaaguccaggucguacucgcaggaaacgcauuuacagcuggaaaaaucauuuuugcagcaauuccaccaaacuuucccauugacaaucuaucagcagcacaaauuacaauguguccacauguuaucguagacguaagacaauuagaaccuguuaauuuaccaaugccagaugucagaaauaauuucuuucacuauaaucaaggauccgauucaagacuaagauuaaucgcuauguuauauacaccucuuagagcuaacaauucaggagacgacguauuuacaguaucaugucgaguuuuaacuagaccuuccccagaauuuucauuuaacuuucuaguaccaccaacaguagaaucaaaaacaaaaccauucacacuaccaauacucaccauaucagaaaugucaaacucacgauuuccagucccaauagacucauuacauacauccccaacagaaaacauagucguccaaugucaaaacggccgaguaaccuuagacggagaauuaaugggaacaacacaacuacucccaucccaaauaugugcauuuagaggaguacucaccagaucaacuucccgugcguccgaccaagccgacaccgcaacaccucgauuauuuaauuauuacuggcacauucaacuagauaaccuuaacgguaccccuuacgauccagcugaagauauaccaggcccauuaggaacaccggacuuuagaggcaaaguuuucgguguagcaucacaaagaaauccagauagcacaacacgugcacacgaagcaaaaguugacacaacaucaggaagauuuacacccaaacucggaagccuagaaauaucaacugaaucagacgauuuugaucaaaaucaaccaaccagauuuacccccguagguauagguguagaccacgaagcagauuuucaacaauggucauuaccagauuacuccggacaauucacacauaauaugaauuuagcaccagccguugcaccgaauuucccuggagaacaacuuuuauucuucagaucccaauuaccaucaaguggaggaagaaguaacggaauauuagauugucuugucccucaagaauggguacaacacuuuuaucaagaaagcgcaccagcacaaacacaaguagcauuaguccgauacgucaacccagacacaggccgaguccuuuucgaagcaaaauuacauaaacucggauuuaugacaaucgcuaaaaauggagauucaccaauaacagucccucccaauggauauuucagauuugaauccuggguaaauccauuuuacacacucgcaccaauggguacuggaaauggaagacgcagaguacaauaa

SEQ ID NO: 33272 - RNA, 1647 nt, Artificial Sequence
  derived and/or modified sequence opt6 from VP1__Norovirus_and/or_Norovirus-like__AF539440
augaaaauggcaagcaacgacgcaacaccaucaaaugauggagcagcaggacuuguaccugaaauaaauaaugaagcaauggcacuagacccaguugcaggagcugcaauagcagcuccacucacaggucaacaaaacauuauagaucccuggauaaugaauaacuuuguacaagcaccaggaggagaauuuacaguaaguccaagaaacuccccaggcgagguacuucuaaaucuugaacuuggaccagaaauaaaucccuaccuagcucauuuagccagaauguauaauggauaugcaggaggauucgaaguacaaguaguacuagcuggcaaugcauucacagcaggaaaaauaauauucgcagccauaccuccuaauuucccuauagacaaucuaucugcggcucaaaucacuaugugcccucacguuauuguagauguaagacaacuagaacccguuaaucuaccaaugccggauguccgaaacaacuucuuucacuauaaucaagguucugacucacgacuucgcuuaauagccauguuauauacaccauuacgagcaaauaauuccggagacgacguuuucacugugucaugcagaguacuaacaaggccaaguccagacuuuucauucaauuuucuaguuccaccaacaguagaaaguaaaacaaaaccauucacauuaccuauauuaacuauaucagaaaugucaaauucaagauuuccaguacccauagacucucuccauacuucaccaacagaaaauaucguaguacaaugccaaaacgguagaguaaccuuagauggagaauuaauggguacaacacaacuccuaccaagucaaauaugugcauuuagaggcguucuuacaagaucaacgucacgcgcuucugaucaagcagacacagcaacuccaagacuauuuaauuacuauuggcacauccaacuagacaaucuuaauggaacaccauacgacccagcagaagauauaccaggcccccucggaacaccugauuucagaggaaaaguauucggaguagcaagccaaagaaauccagacucaacaacaagagcacaugaagcaaaaguagacaccacagcaggaagauucacaccaaaauuaggauccuuagaaauauccacugaaucugacgacuucgaucaaaaucaaccuacacgauucacaccaguaggcguaggaguagaucaugaagcagauuuucaacaauggucacuaccagauuacaguggucaauuuacucacaauaugaacuuagccccugcaguagcaccaaacuuucccggggaacaacuauuauucuuucgaucucaauuaccaucauccggaggcagauccaaugggauucuagauugucuaguaccacaagaauggguacaacauuucuaccaagaaucagcaccagcacaaacacaaguagcccuaguaagauacguaaacccugauaccggaagagucuuauucgaagcaaaauuacauaaacuaggauucaugaccaucgccaaaaauggagauuccccuauaacaguaccaccaaauggcuauuuuagauucgaaucauggguaaaucccuucuacacacuagcaccuaugggcacaggaaacggaagacgacgaauacaauaa

SEQ ID NO: 33273 - RNA, 1647 nt, Artificial Sequence
  derived and/or modified sequence opt6 from VP1__Norovirus_and/or_Norovirus-like__AF414414
augaaaauggcaucaaaugacgcagcaccuucuaaugauggcgcagcaggcuuaguaccagaaaucaauaaugaagccauggcacuagaaccuguagcaggagcagccauagcugcuccacuuacaggacaacaaaauauaauugacccauggauuaugaauaauuucguacaagccccuggcggcgaauuuacaguuuccccaagaaauucaccuggagaaguauuauuaaaucuagaacuaggaccugaaauaaacccauaccuagcccaccuugcaagaauguacaacgguuacgcaggagguuuugaaguacaaguaguauuagccggcaaugcauuuacagcgggaaaaguuauuuucgcagcaauaccaccaaacuuucccauagacaaucucuccgcagcacaaauaacaaugugcccacauguaauaguugacguaagacaacucgaaccaauaaauuuaccaaugccagaugucagaaauaauuucuuucauuauaaccaaggaucagauuccagauuacgacuaauagcaaugcucuauacaccacucagagcuaauaauucuggagacgacguauuuaccgucucaugucgaguucuaacuagaccuucaccugacuuuucauuuaacuuucuaguaccaccaacaguagaaucaaaaacaaaacuauucacgcuaccaauacuaacaauaucugaaaugucuaacucccgauucccaguuccaauugacucacuucauacaucaccaacagaaaauaucguuguacaaugccaaaacggcagagucacauuagauggggaauuaaugggaacaacucaauuauuaccaucacaaauaugugcauuucgcggaacacuaacaagaagcacuucaagagcaucagaucaagcagauacaccuacuccuagauuauuuaaccaccguuggcacauacaauuagauaauuuaaauggcacaccuuaugauccagcagaagacauaccagcaccacuaggaacacccgacuuuaggggaaaaguauuuggaguugcaucucaaagaaacccagauuccacuacuagagcacaugaagcaaaaguugacacuacaucuggaagauuuacacccaaauuagguagucuagaaauaauaaccgaaucugacgacuuugauacaaaucaaucuacaaaauucacaccuguaggaauuggaguagauaacgaaucagaguuccaacaauggagccuuccuaacuauuccggacaguuuacucauaacaugaaccucgcccccgcaguagcaccaaauuuccuaggagaacaauuauuauuuuucagaagucaacuaccaucuaguggcggaagaucaaauggaguauuagauuguuuaguuccacaagaauggguacaacauuucuaucaggaaucugcacccgcacaaacucaaguagccuuaguucgauacguaaaccccgauaccggacgaguacuauucgaagcaaaauuacauaaauuaggauuuaugacaauagccaaaaauggugacucuccaauaaccguacccccaaaugguuauuucagauucgaaucauggguaaauccauuuuauacauuagcaccaaugggaacaggaaacggccgucgacguauucaauaa

SEQ ID NO: 33274 - RNA, 1647 nt, Artificial Sequence
  derived and/or modified sequence opt6 from VP1__Norovirus_and/or_Norovirus-like__AB190457
augaaaauggccucaaacgaugcaaccccuucaaaugauggagcugcaggauuaguaccagaaauaaauaacgaagcaauggcuuuagauccaguugcaggcgcagccauugcugcaccacuaacuggucaacaaaauauaauagacccauggauaaugaauaauuuuguccaagcaccagguggagaauuuacaguauccccucgaaauucacccggagaaguccuacuaaaucuagaauuagguccugaaauuaauccauaucuugcucauuuagcaagaauguauaacggauacgcaggagguuucgaaguacaaguaguauuagcaggaaaugcauucacagcagguaaaauuauauucgcugcaauaccaccuaacuuuccaauugauaauuuauccgcagcacaaauaaccaugugcccucacguaauaguugacguccgucaauuagaaccaguaaaccuaccuaugccagauguaagaaauaauuucuuucacuauaaucaaggaucagauucacgauuacgauuaauugcaaugcuauauacaccacuaagagccaauaacucaggagacgacguuuuuacaguauccugucgaguacuaacccgaccuucaccagacuuuucauuuaacuuuuuaguaccuccuacgguagaaucaaaaaccaaaccauuuacacuaccaaucuuaacaauuagugaaaugucuaacucaagauuuccaguaccuauagacucccuacacacauccccuacagagaacauaguaguacaaugccaaaaugguagaguuacucuagacggagaacuaaugggaacaacucaauuacucccuucacaaauaugcgcuuuuagaggaguuuuaacacguuccaccagucgagcaucagaccaagcagacacugcaacuccaagacuauuuaacuacuauuggcacauacaauuagacaaucuuaauggaacaccauaugacccugcagaagauauaccugguccauuaggcacaccagauuuucgaggaaaaguauucggaguagcaucacaaagaaauccagauucuaccaccagagcucaugaagcaaaaguagauacaacagcaggaagauucaccccuaaauuaggaucacuggaaauuaguacagaaucaggugacuucgaccaaaaccaaccaacaagauucacaccaguaggaauaggugucgacaaugaagcagauuuucaacaauggucacuaccagacuacucaggccaauucacucacaacaugaaccuagcaccagccguugcgccaaacuuuccaggagaacaauuacucuucuuuagaucccaacuaccaucaucgggaggacguucaaacgguauauuagacugcuuaguaccacaagaauggguacaacauuuuuaucaagaaucagcaccagcacaaacacaaguagcacucguaagauaugucaauccugacacaggaagagucuuauuugaagcaaaauuacauaaacuaggauuuaugacaauagcuaaaaauggagauucaccaauaacuguaccaccaaauggauauuucagauucgaaucauggguaaauccauucuauacauuagcaccaaugggcacaggaaauggacgaagacguauucaauaa

SEQ ID NO: 33275 - RNA, 1647 nt, Artificial Sequence
  derived and/or modified sequence opt6 from VP1__Norovirus_and/or_Norovirus-like__AF425768
augaaaauggccagcaaugaugcaacaccaucuaacgacggagccgcuggcuuaguaccugaaauaaauaaugaagcaauggcacucgacccaguagcaggagcagcaaucgcggcuccauuaacaggacaacaaaauaucauagauccauggauaaugaauaauuuuguacaagcaccaggcggugaauuuacaguuucuccaagaaauucaccaggagaagucuuacuuaaucuagaacuaggaccagaaauaaauccauauuuagcucacuuagcaagaauguacaaugguuacgcaggaggauucgaaguacaaguuguacucgcaggcaaugcuuuuacagcaggaaaaauaauauucgcagcaauuccaccaaacuuuccaauagacaaccuaucagccgcucaaauaacaaugugcccacauguaauaguugacguaagacaacuagaaccaguaaaccuaccaaugccagauguaagaaauaauuucuuccauuauaaucaaggauccgacucaagauuaagauuaauagcaauguuauauaccccucuaagagcaaacaauucaggagacgacgucuucacuguaucaugccgaguacuaacaagacccucuccagauuucucauuuaacuuccuaguaccuccaaccguugaauccaaaacaaaaccauucacacuaccaauacuaacuauaagcgaaaugucaaacucuagauucccaguacccauugacaguuuacauacaucuccaacagaaaauauaguaguacaaugccaaaacggaagaguuacauuagauggugaauuaaugggaacuacccaauuauuacccucccaaauaugcgcauucagaggaguacuuacaagaucaacaucaagagccagcgaucaagcagauacagcaacuccacgccuuuuuaauuacuauuggcacauccaauuagauaaccuaucaggaacuccauaugacccagcagaagauauaccuggaccacuaggcacaccagacuucagaggcaaagucuucgggguugcgucccaacgaaaucccgacucaacaacacgagcacaugaagcuaaaguugauacaacagcaggaagauucacaccaaaacucggcucacucgaaauauccaccgaaucagaugacuuugaucaaaaucaaccuacaagauuuacaccagucggaguugguguagaucacgaagcagauuuccaacaauggaguuuaccagauuacucaggacaauuuacacacaauaugaauuuagcaccagcaguagcaccaaauuucccuggagaacaacuauuauucuuuagaucacaauuaccaucaucaggaggaagaucaaauggcauacuugauugcuuaguaccacaagaauggguccaacauuuuuaucaagaaucugcaccagcacaaacacaaguagcauuaguaagauacguaaauccagacacuggaagaguauuauuugaagccaaacuacauaaauuaggauuuaugacaauagcuaaaaauggagacaguccuauaacagucccacccaauggauauuucagauucgaaucuuggguaaauccauuuuacacuuuagcaccaauggguacaggaaauggucgacgaagaauacaauaa

SEQ ID NO: 33276 - RNA, 1647 nt, Artificial Sequence
  derived and/or modified sequence opt6 from VP1__Norovirus_and/or_Norovirus-like__AF414415
augaaaauggcaucaaaugaugcagcaccaucaaaugauggagcagcaggucuagucccagaaauuaauaaugaagcaauggcacucgaaccaguugcaggcgccgcaaucgcagccccucuaacaggacaacaaaauaucauagaucccuggauaaugaacaacuuuguacaagcaccaggaggagaauuuacuguaucaccucgaaacucacccggugaaguauuauuaaacuuagaacuaggaccagaaaucaauccauacuuagcacacuuagcaagaauguacaauggauaugccggugguuucgaaguacaagcagucuuagcagguaaugcauucacagcaggaaaagucaucuucgcagcaauaccaccuaacuucccaauagacaaccuaagugcagcacaaauaacaaugugcccacacgucauuguagacguacgacaauuagaacccauaaauuuaccuaugccagacguaagaaauaacuuuuuccauuauaaucaaggaucagacucaagacuaagacuaauagccaugcuauacacaccucuaagagcaaacaauucaggugacgacguauucacaguaucauguagaguccuaacaagaccauccccagauuucucuuucaauuuccuaguaccaccaacagucgaaucuaaaacaaaauuauucacucuaccaauauuaacaauauccgaaauguccaauucaagauuuccaguaccaauagacucacuacauacauccccaacagaaaacaucguaguacaaugccaaaauggcagaguaacucuugauggcgaauuaaugggaaccacacaacuacuaccaucacaaauaugugcuuucagaggaacuuuaacccgaagcaccucaagagcaucagaccaagcagauaccccaacuccaagacucuucaaucacagauggcacauacaacuagacaaccuuaacggaacacccuaugacccagcagaagacauaccagcgccacuagguacucccgauuucagaggaaaagucuuuggagucgcuucacaacgaaauccagacucaacaacaagagcacaugaagcaaaaguugauacaacaucugaccgauucacaccuaaauuaggaucuuuagaaauaauaacagaauccggcgacuucgauacaaaucaaucaacaaaauuuacacccguaggcaucggaguagauaaugaagcagaauuucaacaauggucacuaccaaacuacucaggacaauucacacauaacaugaaucuugcaccagcaguggccccaaauuucccaggugaacaacuacuauucuuuagaucacaacuaccaucuuccggaggucgaucaaacggaguacuagacuguuuagucccucaagaauggguacaacauuuuuaucaagaauccgcuccagcacaaacacaaguagcucuaguacgcuacguaaacccagauacaggcagaguacuauucgaagcaaaacuacauaagcuaggcuucaugacaaucgccaaaaacggagacucgcccauaacugucccaccaaacggauauuuuagauuugaaucuuggguaaacccuuucuauacccuagcaccaauggguacuggaaacggcagaagacgaauacaauaa

SEQ ID NO: 33277 - RNA, 1647 nt, Artificial Sequence
  derived and/or modified sequence opt6 from VP1__Norovirus_and/or_Norovirus-like__KT779557
augaaaauggcaagcaacgacgcagcuccaucaaacgacggagcugcuggauuaguaccagaaauaaauaaugaagcaauggcauuagacccaguugcuggugcagcaauagcagcaccacuaacaggacaacaaaauauaauagauccauggauaaugaacaauuucguacaagcaccaggaggagaauuuacgguaaguccaagaaauucacccggagaaguauuauuaaaucucgaacuugguccagaaauuaacccauaccuagcacaucuagcuagaauguauaacggauaugcuggaggcuuugaaguccaaguaguauuagcugguaacgcuuucacagcaggaaaaguaaucuuugcagccauaccuccuaacuucccaacagauaaucuaucagcugcacaaauaacaauguguccacacguaaucguagauguaagacagcuagaaccuauaaacuuaccaaugccagacguacgaaacaauuucuuucauuacaaucaaggaucagacucacgcuuaagacuaaucgcaaugcuauacacuccacuaagagcuaauaauucuggugaugauguuuuuacaguaucaugcagaguuuuaacaagaccuucaccugauuuuuccuuuaacuuuuuagucccuccaacuguagaauccaaaauaaaaccauuuacacuacccauacuaacuaucucagaaaugucaaauucaagauuucccguaccaauagauucuuuacacacuucacccacagauaauauaguaguucaaugccaaaaugguagaguaacacuagauggagaacuaaugggcacaacacaauuacuuccuucccaaauaugugcauucagaggaguauuaacacgcagcacaucacgagcaucagaucaagcugacgcagcaacaccacguuuauucaauuaucacuggcacauacaacuagauaauuuaaauggaacaccauaugauccagcagaagacauaccagcaccauuagguacccccgacuuccgagguaaaguuuucggcguugcaucacaaaggaacccugacucaacgacacgugcucaugaagcaaaaguugacaccacaucuggaagauucacuccaaaacuagguucacuagaaauaucaacugaaucaggagauuucgaucaaaaucaacccauacgcuuuaccccaguaggaaucggcguagauaacgaagcugacuuccaacaauggacauuaccugauuacucaggccaauucacacauaacacaaaucuagcuccugcaguagcaccaaauuuuccuggagaacaauuauuauuuuucagaucccaacuaccauccucaggcggcagaucuaacggaauacuagacugucucguuccacaagaauggguucaacauuucuaucaagaaucagcaccagcacaaacucaaguagcuuuaguuagauacguaaauccagauacagguagaguauuauuugaagcuaaauuacacaaacugggauauaugaccauugcaaaauccggcgacucucccauuacaguuccaccuaaugguuauuuuagauuugaaucguggguaaacccauucuacacacuagcuccuaugggaacaggcaacgguagaagaagaauacaauaa

SEQ ID NO: 33278 - RNA, 1647 nt, Artificial Sequence
  derived and/or modified sequence opt6 from VP1__Norovirus_and/or_Norovirus-like__AY247432
augaaaauggcaucaaaugacgcaacaccaaguaacgauggagcugcaggcuuagucccagaaauaaacaacgaagcuauggcauuagauccaguagccggagcagcuauugcugcccccuuaaccggucaacaaaauauaaucgacccauggauaaugaacaauuucguacaagcaccuggaggugaauuuacaguaucaccuagaaauucuccaggugaaguuuuacuaaaccuugaauuagguccagaaauaaacccauaccuagcccacuuggcuagaauguacaacggauaugcaggaggauuugaaguacaaguaguauuagcaggaaaugcauuuacugcuggaaaaauuauauuugcagcaauaccaccuaauuuuccaauugacaacuuaucagcagcacaaauuaccaugugcccccacguaauagucgauguacgacaauuagaaccaguaaauuuaccuaugccagauguaagaaacaauuucuuucauuauaaucaaggaucagacucacgccugagacuaauugccaugcuauacacaccacuacgagcaaauaauagcggagacgacguauucacaguaucuugucgcguuuuaacaagaccuucaccagauuucucuuucaauuuccuuguacccccaacaguagaaucaaaaacaaaaccauucacauuaccaauuuuaacaauauccgaaauguccaacucuagauucccuguaccaauagacucacuacauaccucacccaauggaaauuucguuguucaaugccaaaaugguagagucacuuuagacggagaauuaaugggaacaacucaacuauuaccuagucaaauaugugccuuuagagguguucuaacaagacaaguaucuagagcuggagaccaaauagacacagcuacaccacgaucauuugguaaucauuggcauauacaauuagauaaucuaaauggaacaccauaugacccagcagaagauauaccuggaccauuaggaacacccgacuuucaaggcauaguauuuggaguugcaagucagagaaacuccgauggaacaaccagagcucacgaagcuaaaguagacacacguacagggcgauucacaccaaaauuaggaagucuaguaauaucaacagacucagaagacuuucaacaaaacaaaccuacaagauucacacccguaggcgucggugucgauucagaagaagaauuugaucaauggucucucccagauuauucaggcccaauaacacauaauaugaacuuagcuccagccguagcccccaacuuccccggagaacaacuauuauucuucagaucacaacuaccuucaucaggaggcauaucaaaaggaauauuagauugccuagucccucaagaauggguccaacauuucuaucaagaaagcgcuccugcacaaacacaaguagcauuaguccgauacgucaaucccgacacaggcagaguauuauucgaagcaaaauuacauaaauuaggauuuaugacaauagccaaagauggagauucuccaauaacaguaccaccaaauggauauuuuagauuugaaucauggguuaauccauuuuauacccuggcaccaauggguacagguaauggacgaagaagaauacaauaa

SEQ ID NO: 33279 - RNA, 1647 nt, Artificial Sequence
  derived and/or modified sequence opt6 from VP1__Norovirus_and/or_Norovirus-like__AF414411
augaaaauggcaucaaaugacgcagcaccuagcaacgauggagcagcaggucuaguaccugaaauaaauaaugaagcaauggcccuagaaccaguagcaggagcagccauugccgcaccacuaacaggacaacaaaacaucauugacccuuggauaaugaacaauuucguacaagcaccaggaggagaauuuaccguaucaccacgaaacucaccaggagaaguacuacuaaaccuagaacuaggucuagaaauaaacccuuacuuagcccaccuagcaagaauguauaauggauacgcaggaguauuugaaguacaaguaguacuagcaggaaacgccuucacagccggaaaaguaauauuugcagcuauacccccaaacuuucccauugauaaccuaucagcugcacaaauaacaaugugcccccauguaaucgucgauguaagacaauuagaaccuauuaaccucccaaugcccgauguacgcaacaauuucuuccacuauaaccaaggauccgacucaagauuaagauuaauagcaauguuauacacaccauuaagagcaaauaauuccggcgaugauguuuuuacaguaucauguagaguucuuacaagaccaucaccagauuucucuuuuaacuuccuaguaccaccaacagucgaaucaaaaacaaaauuauucacauuaccuauacuaaccauuucugaaaugaguaauagcagauuccccguuccaauagacuccuuacacacaucaccaaccaaaaacaucgucguacaaugccaaaacgguagagucacauuagacggugaauuaaugggaacaacacaacuauuaccaucacaaauaugcgcauuuagaggaacacuaacaagaucaaccucaagagccuccgaucaagcagacacaccaacacccagacuuuucggacacagauggcauauccaacuagacaaucucaauggaaccccauacgauccagcagaagacauuccagcaccauuaggaaccccugacuucagaggcaaaguauucggaguagcaucacaaagaaacccagacucuacaacaagagcucaugaagcaaaaguagacacaaccucaggaagauucacaccuaaacuaggaucguuagaaauaauaaccgaaucagacgacuuugauacaaaccaaagcacgaaauucacaccuguaggaauuggcguagauaacgaagcugaguuccaacaauggucucucccaaauuacuccggacaauucacacacaacaugaauuuagccccagcaguagccccaaacuucccaggagaacaacuauuauucuuuagaagccaacuaccaucaucaggcggaagaucuaacggaguucucgauugcuuaguaccccaagaauggguacaacauuuuuaccaagaauccgccccagcacaaacccaaguagcauuaguaagauacgucaauccagauacaggacgaguuuuauuugaagcuaaauuacauaaacuaggauuuaugacaauagccaaaaacggagauuccccgauaacagucccaccaaacgguuauuucagauucgaauccugggucaacccauucuauacacuugcaccaaugggaacaggaaauggaagaagaagaauacaauaa

SEQ ID NO: 33280 - RNA, 1647 nt, Artificial Sequence
  derived and/or modified sequence opt6 from VP1__Norovirus_and/or_Norovirus-like__AJ277617
augaaaauggcaucuaacgacgcagcaccaucaaaugacggagcugcagguuuaguaccagaaauaaauaaugaagcaauggcacucgaaccuguagcaggcgccgcaauagcagcaccauuaacaggucaacaaaauauaauagaccccuggauaaugaauaacuucgcacaagcaccaggaggagaauuuacagucucuccacgaaacucaccgggagaaguauuguuaaauuuagaacuaggaccagaaauaaacccauaucuagcacauuuagcccgcauguacaacggauaugcaggaggauucgaaguacaaguaguucucgcagguaacgccuucacagcgggaaaaguuauauucgcagcuauacccccuaacuuuccaauagauaauuuaucugcagcacaaauaacuauguguccacacguaaucguagauguacgacaacuagaaccaauaaaccuaccaaugccagacguacguaacaauuucuuucauuauaaccaaggaucagacucaagacuaagauuaauagccauguuauauacaccacuaagagccaacaauaguggcgaugaagucuuuacaguaucaugucgcguauuaaccagaccaucuccagauuuuuccuuuaacuuuuuaguaccaccaacuguagaauccaaaacuaaauuauucacacuaccaauauuaacuauuuccgaaaugucaaauagccguuucccagucccaauugauucacuacauacaucuccaaccgaaaauauuguaguucaaugccaaaacggaagaguaacacuagauggagaauuaauggguacaacacaacuacucccaucccaaauuugcgcuuuccgaggaacauuaaccagauccacaucaagagcaucagaucaagcagacacacccacaccuagauuauuuaaucacagauggcacauccaauuagacaaccuaaacgguacaccauaugauccagcagaagauauaccggcuccacucggaacuccugacuuuagaggaaaaguuuucggaguagcaucacaaagaaauccugauucaacaacaagagcccaugaagcaaaagcagacacuacaucaggccgauucacaccaaaauuaggaagccuagaaauaauaacagaaucagaugacuucgauacuaaucaaucuacuaaauuuacaccuguuggcauaggugucgauaaugaagcagaauuucaacaauggucuuuaccaaauuacucuggacaauucacacacaauaugaacuuggccccagcaguagcaccaaauuuuccaggugaacaacuauuauucuuuagaucacaacuacccuccucuggaggaagaucaaaugguguauuagauuguuuaauaccacaagaauggguacaacauuuuuaccaagaaucagcgccagcacaaacucaaguagcccuaguaagauauguaaauccugacacaggacgaguacuauucgaagcgaaacuacacaaacuaggauuuaugacaauagccaaaaauggcgacucaccaauaacaguuccuccaaauggauauuuaagauucgaaucauggguaaacccauucuauacccucgcaccuauggguacugguaacggaagaagaagaauacaauaa

SEQ ID NO: 33281 - RNA, 1647 nt, Artificial Sequence
  derived and/or modified sequence opt6 from VP1__Norovirus_and/or_Norovirus-like__LC036561
augaaaauggcaucaaacgacgcgaccccaucaaacgauggugcagcuggccuaguaccggaaauaaauaaugaagccauggcauuagauccaguagcaggagcagccauugcagcuccacuuacaggacaacaaaauauaaucgauccauggauaaugaauaauuuuguacaagcuccuggaggagaauuuacuguaucaccaagaaacucacccggcgaaguuuuauuaaaucuagaacuggguccagaaauaaacccauacuuagcacacuuagcaagaauguauaauggcuaugcaggaggcuuugaaguacaaguuguacuagcuggcaaugcauuuacagcaggaaaaauuauauuugcugcaauaccaccaaacuucccaauagacaauuuaagugcagcucaaauaaccauguguccacauguaauagucgacguucgacaacuagaaccaguaaaucuuccaaugcccgacguuagaaauaauuucuuucacuauaaccaagguagcgacucaagauuaagguuaauagccauguuauauacaccccuaagagcaaacaacucuggagacgacgucuuuaccguuucauguagaguuuuaacacgaccuucaccagaauuuaguuucaacuuuuuaguuccuccaacuguugagucaaaaacaaaaccauuuacauuaccuaucuuaaccauaucugaaaugucaaauucaagauucccugucccaaucgauucauuacacacuagcccuacagaaaauauaguaguucaaugucaaaacggaagaguaacucuagauggagaauuaaugggaacaacacaauuauuaccaucucaaauuugugcuuuucguggaguacucacaagaucaacaucaagagcaucagaucaagcagauacagcaacaccuagauuauucaauuauuacuggcauauccaauuagauaacuuaaauggaacaccuuaugauccagcugaagacauaccaggaccuuuaggaacaccagacuuuagaggaaaaguauuuggaguugcuucacaaagaaauccagacucaacaacaagagcacacgaagccaaaguagacaccacguccggacgauucacuccaaaauuaggaaguuuagaaauaucaacugaaucaggagacuucgaucaaaaucaacccacaagauuuacaccaguuggaauaggaguagaccaugaagcagauuuccaacaaugguccuuaccugacuacuccggucaauuuacacacaauaugaaccuagcaccagcaguagcaccaaacuuuccgggagaacaacuacuauucuuuagaucccaacuaccaucauccggcggcagauccaacggaauacuagacugcuuaguaccccaagaauggguacaacauuucuaucaagaaucagcaccagcucaaacacaaguagcacuugucagauaugucaacccugacacaggacgcguacuauucgaagcaaaauuacauaaacuaggauucaugacuauagccaaaaauggugauucaccaauaacaguaccaccaaauggcuacuuuagauuugaaucauggguaaauccauuuuacacauuagcaccaaugggaacaggaaauggcagacgaagaguacaauaa

SEQ ID NO: 33282 - RNA, 1647 nt, Artificial Sequence
  derived and/or modified sequence opt6 from VP1__Norovirus_and/or_Norovirus-like__KT732274
augaaaauggccucaaacgaugcgacaccaucaaacgauggugcagcaggcuuaguaccagaaauaaacaaugaagcaauggcauuagauccaguagccggagccgcaauagcugccccauuaacuggccaacaaaauauaaucgauccauggauaaugaauaauuucguccaagcaccaggaggagaauuuacuguuaguccaagaaacucucccggagaaguauugcuaaaucuagaauuagggccagaaauuaauccauaucuggcacaucuagcacgaauguauaauggcuacgcaggaggauucgaaguacaaguaguacuagcaggaaaugcuuuuaccgcuggaaaaauaauuuuugcagcaauucccccuaauuuccccauagacaacuuaucagcagcacaaauaacaaugugcccacaugucauuguagauguaagacaauuagaaccaguaaaucuucccaugccagauguucguaauaauuucuuucauuacaaucaaggcuccgacucaagacucagauugguagcaauguuauacacaccccuacgagcaaacaauucuggugacgacguauuuacaguaucuuguagaguacuaacacguccaucacccgaauuuucauucaacuuccucguaccucccacaguugaaucaaaaacaaaacuauucacacuaccaauacuaaccauaucagaaauguccaauucacguuucccaguacccauagacucauuacacacaucuccaacagaaaacauaguaguacaaugccaaaacggacgagucacccuagacggagaauuaaugggcacaacucaauuacuuccaucacaaauaugcgcauucagaggaguauuaacaagaucaacaucaagagcauccgaucaagccgacacagccacaccaagacuauucaacuacuacuggcauauacaauuagauaauuugaacggaacaccauacgaucccgcagaagauaucccaggaccacuaggaaccccugauuuucgcggaaaaguuuucgguguagcaucacaaagaaauccagacucaacaacccgagcacacgaagcaaaaguagacacaacaucaggacgauucacaccaaaacuaggaucacuagaaauuucaacagaaucuggcgauuucgaccaaaaccaaccaacccgauuuaccccuguaggcauaggaguugauucagaagcugauuuucaacaauggucacuaccagacuauaguggacaauuuacacacaacaugaaucuagcuccagcagucgcaccaaacuuucccggagaacaauuacuauucuuuagaucucaacuaccaucaucaggaggacguucaaauggaauauuagauugucuagucccacaagaauggguucaacauuuuuaucaagaaucagcaccagcucaaacacaaguagcccuaguaagauacgucaacccagacacaggaagaguauuauucgaagcaaaacuacauaaacuaggauucaugacuauagcuaaaaauggagauucuccaauaacaguaccaccaaauggauauuuccguuuugaaucauggguaaauccauucuauacauuagcaccuaugggaacaggaaacggcagaagacguguucaauaa

SEQ ID NO: 33283 - RNA, 1647 nt, Artificial Sequence
  derived and/or modified sequence opt6 from VP1__Norovirus_and/or_Norovirus-like__AY247439
augaaaauggcaucaaaugaugcagcacccucaaaugacggagcagcaggauuaguaccagaaauuaauaaugaagcaauggcauuagacccaguugcaggagccgccaucgcugcuccacucacaggacaacaaaauauaauagauccauggauaaugaauaacuucguacaagcucccggcggcgaauuuacaguaucaccaagaaauucaccuggugaaguacuacucaaccuagaacuaggaccugaaauaaacccauauuuagcacauuuagccagaauguauaacggcuaugcaggaggguucgaaguacaaguaguacuagcaggaaacgcuuuuacugccggaaaaauuauauucgcagcaauaccucccaacuuuccaaucgacaaucuuucagccgcacaaauuacaauguguccucacguaauaguagauguuagacaacucgaaccaguaaauuuaccaaugccagaugucagaaacaauuucuuucauuacaaccaagguucagauucaagauuacguuuaauagccaugcuauauacuccauuaagagcaaauaacucgggugaugauguauuuacagucucaugcagaguacuuacaagaccaucaccggacuuuucuuuuaacuucuugguaccaccaacuguagaaaguaaaacaaaaccauucacucuaccaauacuaacaauaucagaaaugucaaacaguagauuuccaguaccaaucgacucacuccacacaucucccaacaauaauuucguaguacaaugccaaaauggacguguaacacuagacggcgaacuaaugggaacaacacaacuauuaccaucucaaauaugugcauuccgcggaguacuagcaagacaaauaaaucgcgcaggcgaucaaauagauacaacuacccccagaucauucgaucaccauuggcacauacaauuagauaaccucaauggaaccccauacgacccugcagaagacauaccuggaccacuuggaacaccagguuucaaaggcauaguuuuuggaguagcuucucaaagaaacucagacggaacuacccgagcacaugaagcaaaaguugacacacgaacagguagauucacaccaaaacucgguucccuaguaauaucuaccgauucagaagacagucaacaaaacaaaccaaccagauucaccccaguaggaguaggaguagauaaugaagaagaauuugaccaauggucuuuaccaaacuauucuggacccauaacacacaacaugaauuuagcaccagcuguugccccaaacuucccaggagaacaacucuuauuuuucagaucccaauuaccuucaagcggaggcacaucaaaaggaauacuagacugucuaguaccacaagaauggguccaacauuuuuaucaagaaagugcuccagcacaaacccaagucgcacuuguaagauauguuaacccagauacaggcagaguuuuauuugaagcaaaauuacauaaauuagguuuuaugacaaucgccaaagauggugauucuccuauuacaguaccaccaaacgguuacuucagauuugaauccugggucaauccauuuuauacccuagcaccuauggguacaggaaauggaagaagaagaauccaauaa

SEQ ID NO: 33284 - RNA, 1647 nt, Artificial Sequence
  derived and/or modified sequence opt6 from VP1__Norovirus_and/or_Norovirus-like__AF539439
augaaaauggcaagcucugaugcaacaccaucaaacgacggugcagcaggauuaguaccagaaauaaacaaugaagcaauggcacucgaccccguagcaggagcagcaauagcagccccuuuaacuggacaacaaaauauaauugauccauggauaaugaacaauuucguacaagccccagguggagaauuuacaguaucaccacgaaauagcccaggagaauuacuacuaaauuuagaauuaggaccagaaaucaauccauaucuagcacacuuagcaagaauguauaacggcuaugcaggcggauucgaaguacaaguaguauuagcaggcaaugcauucacagcuggaaaaauaauuuucgcagcaauucccccuaacuucccaauagacaacuuaucagcagcacaaauaacaauguguccucacguuauaguugacguuagacaacuagaaccugucaaccuaccaaugccagacguuagaaacaacuucuuucauuacaaccaaggaucugacucuagacuaagauuaaucgcaaugcuauacacgccgcuacgagcuaauaauucaggugaugauguauuuacaguaucaugccgaguccuuacacgaccaucccccgacuuuucauuuaacuuuuuaguuccaccuacuguagaaucaaaaacaaaaccauuuacuuuaccuauacuaacaauaucagaaaugucaaauaguagauuuccaguuccaauagauucacuucauacaucaccaacagaaaacauaguaguacaaugccaaaauggaagaguuacacuagacggagaacucaugggaacaacacaauuacuaccaucacaaauaugugccuuucgcggaguauuaacuagaucaacaucacgagcaucugaccaagcagacacaccaacaccaagguuauuuaacuauuacuggcauauacaacuagacaacuuaaacggcacaccauaugacccagcagaagauaucccaggaccacuaggcacaccagacuuuagaggaaaaguauuuggcgucgcuucacaaagaaauccagauagcacaacacgagcacacgaagcuaaaguugacacuaccgcaggcagauucacaccaaaauuagguuccuuagaaauaucaacagaaucaggagauuucgaucaaaaccaaccaacaagauuuacaccuguuggaauuggaguagaucaugaagcagacuuucaacaauggucacuaccagacuauucaggacaauucacccacaacaugaauuuagcaccagcugucgccccaaacuucccuggcgaacaauuauuauucuuucgaucacaacuaccaucaucaggcggaagaucaaauggaauacucgauugccuuguaccacaagaauggguucaacauuucuaccaagaaagugcaccagcacaaacucaaguggcauuaguccguuacguuaauccugacacaggaagaguauuauucgaagcaaaacuacauaaacuaggauucaugacaaucgcuaaaaacggagauaguccaauaacaguaccuccuaacggauauuuccgauuugaaucaugggucaauccauucuacacauuagcaccaaugggaacagguaauggcagaagacguauacaauaa

SEQ ID NO: 33285 - RNA, 1647 nt, Artificial Sequence
  derived and/or modified sequence opt6 from VP1__Norovirus_and/or_Norovirus-like__AF414413
augaaaauggcaucuaaugacgcagcaccaucuaaugacggugcugcaggauuaguacccgaaauuaacaacgaagcaauggcauuagaaccaguagcaggagcugcaaucgcagccccauuaacuggccaacaaaauauaauagaucccuggauaaugaacaacuucguucaagcaccaggcggagaauuuacagucucacccagaaauuccccaggagaaguacuucucaauuuagaacuaggcccagaaauaaaucccuacuuagcucaucucgcaagaauguauaacggauaugcaggaggcuuugaaguucaagucgucuuagcaggcaaugcuuuuacagccggaaagguaauuuucgcugccauaccaccaaacuuucccauagacaaucuaucagcagcacaaauaacuaugugcccacacguaauuguagacguuagacaacuagaaccaauaaaccuaccuaugccagauguaagaaacaauuucuuucauuacaaucaaggcuccgauucuagacuuagacuuaucgcaauguuauacacaccauuacgcgcaaauaauuccggagacggaguauuuacaguaucauguagaguacuaacacgacccucacccgauuuuucauuuaauuuccuaguacccccaacaguagaaucaaaaaccagacuauuuacccucccaauacuuacaauaucugaaaugucaaacuccagauuuccugucccaauagauucauuacauacaucaccaacugaaaauauuguaguacaaugccaaaacggaagaguaacucuagacggagaauuaaugggaacaacacaacuauuacccucacaaauaugugcuuuuagaggaaccuuaacacgaucaaccucuagagcauccgaucaagcagauacaccuauaccaagauuauucaaccauagauggcacauccaauuagauaaccucaacggcacaccuuaugauccagccgaagacauaccugcaccacucggaacuccagacuuucgaggcaaaguauucggaguagccucucaaagaaaucccgacucaacaacuagagcucaugaagcuaaagucgacgcuaccccuggaagauucacaccaaaauuaggaucauuagaaauaauuacagaaucugacgacuucgauaccaaucaaucaacaaaauuuacuccuguaggaauagguguugauaaugaagcugaauuucaacaauggucauuaccaaacuauucgggucaauuuacacauaauaugaacuuagcaccagcagucgcaccaaauuuuccaggugaacaauugcuauucuuuagaagucaacuacccucaucaggcggaagaucaaacggagucuuagauugucuuguaccucaagaauggguucaacauuuuuaccaagaaagcgcaccagcccaaacccaaguagcauuaguaagauacgucaaccccgauacuggacgaguccuauucgaagcaaaauuacauaaacuuggauucaugacuauagccaaaaacggagauaguccaauuaccguaccaccaaauggcuacuuuagauucgaaucaugggugaauccauucuacacacuagcaccaaugggaacaggaaauggaagaagaagaauacaauaa

SEQ ID NO: 33286 - RNA, 1647 nt, Artificial Sequence
  derived and/or modified sequence opt6 from VP1__Norovirus_and/or_Norovirus-like__AF427112
augaaaauggccucuaaugaugccacuccaucaaaugauggagcagcuggauuaguaccagaaauaaacaaugaagcaauggccuuagauccuguagcaggagcggcuauagcagcaccacucacaggccaacaaaauauuauagacccauggauaaugaauaacuuuguccaagcucccggaggcgaauuuacuguaucuccucgaaauaguccaggagaaguccuucuaaauuuagaauuaggaccagaaauaaauccauaucuagcacaccuagcacgcauguauaacggauaugcuggaggcuucgaaguacaaguaguacuagcaggaaaugccuucaccgcaggcaaaauaauauuugcagcaaucccuccaaacuuuccaaucgacaauuuaucagcagcccaaauaacaauguguccacacguaauaguagauguaagacaacuagaaccuguaaaucuaccuaugccagacguaagaaacaauuucuuucauuacaaccaaggaucugacucccgucuaagauuaauagccaugcuauacacaccacuaagagcaaacaacucaggagacgacguauucacaguaucauguagaguacuaacaagaccuuccccagauuuuucuuuuaacuuuuuaguacccccuacaguagaauccaaaacuaaaccauucaccuuaccuauacuuacaauaucagaaaugucaaauucaagauucccaguaccuauagacuccuuacacacccgucccacagaaaacauagucguucaaugucaaaaugguagaguuacauuagacggagaacuaaugggaaccacacaacuauuaccaagucaaaucugugccuuuaggggaguccuaacacguucaacaaguagagcaucugaucaagcugauaccgcaacaccacgauuauucaauuauuauuggcacauacaauuagauaaucuaaacggcaccccaugcgauccagcagaagauauaccaggacccuuaggaacgccagacuuucgaggaaaaguauuuggcgucgcaucacaaagaaaucccgauucaaccacaggagcccaugaagcaaaaguugacacuacagcuggcagauucacaccaaaacuuggaucacuagaaauaagcacugaaucaggagacuucgaccaaaaucaaccaacuaaauuuacaccuguuggaauaggagucgaucaugaagcagauuuucaacaauggucacuucccgacuauucaggucaauucacucacaacaugaaucuagccccagcaguagcaccaaauuucccaggagaacaacuacuauucuucagaucacaacuaccaaguucuggcgguagaucaaauggcauacucgauuguuuaguaccacaagaauggguucaacauuuuuaccaagaaucugcaccagcucaaacccaaguugcauuaguaagauacguuaacccagacacaggacgcguacuauuugaagcaaaauuacauaaacuuggauucaugacaaucgccaaaaauggagauucaccaauaacaguaccacccaaugguuauuuuagauuugaaucauggguaaauccauuuuacacauuagcaccaaugggcaccgguaauggucgaagaagaauacaauag

SEQ ID NO: 33287 - RNA, 1647 nt, Artificial Sequence
  derived and/or modified sequence opt6 from VP1__Norovirus_and/or_Norovirus-like__AF190817
augaaaauggccuccaaugacgcaacuccaucaaaugacggagcagccggauuaguaccagaaauaaauaaugaagcuauggcuuuagaucccguggcaggagccgccauagcagcaccacuaacaggacaacaaaauauaauagacccauggauaaugaacaacuuuguacaagcaccaggcggagaauuuacagucucaccacgaaaucccccaggagaaguauuauuaaaucuugaacuuggaccagaaauaaauccauaucuagcacauuuagcacgcauguauaacgguuacgcaggcgguuucgaaguccaaguaguccuagcaggaaaugcauuuacugcaggaaaaauaauauucgcugcaauacccccuaacuuuccaauugauaaucuaucagcugcucaaauuaccauguguccacacguaauaguugacguucgacaacuagaacccguaaaccucccaaugccugauguacguaauaauuucuuucacuauaaccaaggaucagacucuagauuaagacuaauugcaaugcuauacacaccauuacgagcaaauaauuccggugaugacguauuuaccguauccugccgaguauuaacaagaccauccccagauuucucauucaauuuucuaguacccccuacaguagaaucaaaaacaaaaccuuuuacacuaccaauacuaacaauuucagaaaugucaaacucaagauuuccaguaccaauagaaucuuuacauacaggucccacagaaaauauaguuguucaaugucaaaaugguagaguaacccuagacggugaauuaaugggaacaacacaauuacuacccucacaaaucugcgcauuuagagguguccucacaagaucaacuuccagagcuucagaccaagcagauacagcaacaccacgacucuuuaacuacuauuggcauguccaacuagauaaucuaaacgguacuccauaugauccagcagaagauauaccuggaccucucggaaccccugacuucagaggaaaaguuuuuggagucgcaucacaaagaaauccugauaguacuacucgcgcacacgaagcuaaaguugauacuaccgcaggaagauucacaccaaaauuaggaucauuagaaauauccacugauucuucagauuuugaucaaaaccaaccaacuagauuuacaccagucggaauaggcguagauaaugaagcagacuuucaacaauggucauuaccagacuauucaggccaauucacacauaauaugaacuuagcaccagcaguagcaccuaacuuuccaggagaacaauuacuauucuuuagaucacaauuaccaucaucaggcggaagauccaacggaguacucgauuguuuaguaccccaagaaugggcacaacauuucuaucaagaaucugcaccagcucaaacacaaguugcuuuaguaagauacguuaauccagauacuggacgaguacuauucgaagcaaaauuacauaaguuaggcuuuaugacuauagccaaaaauggugacucaccaauaacaguaccaccaaauggauauuuuagauuugaauccuggguuaacccauucuacaccuuagcaccaauggguacaggaaaugguagaagaagaauacaauga

SEQ ID NO: 33288 - RNA, 1647 nt, Artificial Sequence
  derived and/or modified sequence opt6 from VP1__Norovirus_and/or_Norovirus-like__LC035072
augaaaauggcaucaaaugaugcaacaccuucaaacgauggagccgcuggucuaguaccagaaaucaacaaugaagcuauggcacucgauccaguugcaggagcggcuauagcugcaccccucaccggacaacaaaauguaauagauccauggauaaugaacaauuuuguacaagccccaggaggagaauuuacaguaucaccaagaaacuccccaggagaaguuuuacuaaaucuagaauuaggaccugaaauaaaucccuaucuagcccauuuagcuagaauguauaauggcuaugcaggcggauucgaaguacaaguaguacuggcaggaaaugcauuuacugcaggaaaaaucaucuucgcugcaauaccaccaaauuuuccaauagacaaucuaucugcagcacaaauuaccauguguccucauguaauuguagacguaagacaacuugaaccaguaaacuuaccaaugccagacguaagaaacaacuuuuuccacuauaaucaaggaucagauucaagacuuagauuaauugcuauguuauacacacccuuaagagcgaauaauucaggagacgauguauucacaguauccuguagaguauuaacacguccaucacccgaauuuucauuuaacuuucuuguaccucccaccguagaauccaaaacaaaaccauucacauuaccaauauuaacaauaucagaaaugaguaacucaagauuuccaguuccaauagacucauuacauacaucuccuacagaaaacauaguuguacaaugccaaaacggccgaguuacacuagacggcgaacuaaugggaacaacacaauuauuaccaucacaaauuugcgcuuuuagaggaguacuaacacgaucaacaucaagagcaucugaucaagcagacacagcaacaccuagacucuucaauuacuauuggcacauacaacuagacaaccccaacggcaccccauacgauccagcagaagacauaccaggcccacuagguacaccagacuuuagaggcaaaguuuuuggaguagcuucacaacgaaauccagacuccacaaccagagcccaugaagcaaaaguugacacaacaucaggaagauucacaccaaaacuagguucccuagaaauuucaacagaauccgaugacuucgaucaaaaucaaccaacaagauucaccccaguaggaauuggaguagacagagaagcagacuuccaacaauggucacuaccagauuacuccggacaauuuacacacaacaugaauuuagcaccagcaguagcugcaaauucaccaggugaacaacucauauuuuucuggucucaaucuccauacugcggaggaagaucaaaccgaguucuagauugcaugguaccacaagaauggguacaacauuucuaccaagaaagugcacccgcucaaacacaauuagcuuuaguaagauacguaaauccagacaccggacgaguacuauucgaagcaaaauuacacaaacuaggauucaugacaauagccaaaaacggcgacucaccaauaacagucccaccaaacggauauuuccgauucgaaucauggguaaauccauuuuauacucuggcacccaugggaaccggaaauggaagaagaagaguacaauaa

SEQ ID NO: 33289 - RNA, 1647 nt, Artificial Sequence
  derived and/or modified sequence opt6 from VP1__Norovirus_and/or_Norovirus-like__DQ093064
augaaaauggcaucaaacgacgccgccccuucaaacgacggugcagccaaccuaguaccagaagcuaacaaugaaguaauggcauuagaaccuguaguaggugcaucuaucgcggcuccaguaguaggacaacaaaauauaauagacccuuggauuagagaaaacuuuguacaagcaccacaaggagaauuuacuguguccccaagaaauucaccaggagaaauguuauuaaauuuagaacucggcccagaacuaaaucccuaccuuagucaccuaucaagaauguauaacggauacgcaggagguaugcaaguccaaguaguauuagcaggaaacgcauuuacagcaggaaaaaucauauuugcagcaguaccaccacacuuuccaguagacaauauauccgcagcacaaauaacaauguguccacauguaauagucgacguuagacaacuagagcccguccuacuuccuuuaccagauauacgcaauagguucuuucauuauaaccaagaaaauaccccuagaaugagauuaguagcaaugcuauacacaccucuacgagcaaacucaggugaagacguauuuacuguaucaugcagaguauuaacaagaccagcaccugacuucgaauuuacauucuuaguuccaccuacaguagaauccaaaacuaaaccauucacauuaccaauauuaacauuaggagaacuaaguaauaguagauuuccugcagcuaucgauauguuauaugcugaucccaacgaaucaauaguuguccaaccacaaaauggaagauguacacuugauggcacccuacaaggaacaacucaauuaguuccaacacaaaucugcgcauuuagaggaacccuaauaagccaaacugcaagagcaacagauucaacugauaguccacaaagagcaagagaccacccacuacacguacaaguuaaaaauuuagacggaacacaauacgauccaacagacgauauaccagccguauuaggagcaauagacuucaaaggaacaguauucggugucgccagccaacgagauguaucagguccacaagaacaaggucauuaugcaacgcgagcacaugaagcacauauagacacaacagauccaaaauaugcuccaaaauuaggcacaauacuaauaaaaucagaaucaaacgacuuuauaacaaaucaacccauacgguuuacaccaguaggaaugggagacaacaauuggagacaaugggaauuaccugacuauuccggaagacuaacacuuaauaugaaucuagccccugccguuucuccuagcuucccuggagaaagaauccuauucuuuagauccauaguaccuucagcaggcggauauggaaguggauauauugauugcuuaauaccucaagaauggggacaacacuuuuaucaagaggccgcaccaucacaauccgcaguagcucuaguacgauacguuaauccagacaccggaagaaauauauucgaagcaaaacuacauagagaaggauuuuuaacaguagcaaauucaggaaacaacccaauuguaguaccuccuaauggcuauuuccguuuugaagcauggguaaaucaauuuuacacuuuagcacccaugggaaguggacaaggaagaagacguuaa

SEQ ID NO: 33290 - RNA, 1647 nt, Artificial Sequence
  derived and/or modified sequence opt6 from VP1__Norovirus_and/or_Norovirus-like__L23830
augaaaauggcaucuaaugacgcagcaccaaguaaugacggagcagcaggucuagucccagaaauaaacaaugaagcaauggcacuugauccaguagccggagcagcuaucgcugcgccuuuaacaggacaacaaaauauuaucgacccauggaucaugaacaacuucguccaagcgccaggaggugaauuuacaguuagcccccgaaauucacccggagaagucuuacuaaauuuagaacuaggaccagaaauuaacccauaccuagcacacuuagcaagaauguacaauggauacgcaggaggauucgaaguacaaguaguauuagccggcaaugcuuucacagccgcuaaaguaauauucgccgcaauaccuccaaacuuuccuauugacaaucuaucagcagcacaaaucacaauguguccacacguaauaguagacguacgacaacuagaaccaauaaaccucccuaugccagacguaagaaacaacuucuuccacuacaaccaaggaucagauucaagacuaagacuuauagccauguuauacacaccacuuagagcaaauaauuccggagacgacguauucacuguuucauguagaguacuaaccagaccuuccccagacuuuucauuuaacuuccuaguaccaucaacuauggaaucuaaaacaaaaccauuuacauuaccaauacucacaauaucagaaaugucaaauucacgauucccaguaccaauagacucccuacauacaucacccaccgaaucaauaguaguacaaugccaaaaugggagaguaacucuagauggagaauuaaugggcacaacacaauuauuaccaaaucaaauaugugcauucagaggaacacuaacacguuccacaaaccgagcaucagaccaagcagacaccgcaacaccucgacuauuuaaccaccacuggcacauccaacuagacaauuuaaacggcaccccauacgauccagcagaagacauaccagcaccgcuaggaacaccagauuuccgaggaaaaguauuuggcguagcaggucaacgaaauccagacagcacaacaagagcacaugaagcaaaaguagacacaacaucaggacgcuucaccccaaaacuaggaaguuuagaaauuacaacugaaucagaugacuuugaccccaaucaaucaacaaaauuuacaccagucggaauaggugucgacaaugaagcagacuuccaacaauggucacuaccagacuauuccggacaauuuacacacaacaugaaucuugcaccagcaguagcaccuaacuucccaggagaacaacugcuauuuuucagaucucaauuaccuucaucaggaggcagaucgaauggaauuuuagauugcuuaguaccacaagaauggguucaacacuucuaccaagaaucagcacccgcacaaacacaaguagcauuaguacgauauguaaauccagacacaggucgaguacuauuugaagcuaaauuacauaaacucggauuuaugacaauagcuaaaaacggcgauucuccuauaacagucccaccaaaugguuauuucagauucgaauccuggguuaauccauuuuacacacuagcaccaaugggcacuggaaacgguagaagacgaauacaauaa

SEQ ID NO: 33291 - RNA, 1647 nt, Artificial Sequence
  derived and/or modified sequence opt6 from VP1__Norovirus_and/or_Norovirus-like__KX907728
augaaaauggcaucaaaugacgcuccaccaaguuccgauggagcuggcaacuuagucccagaaucgcaccaagaaguacuaccauuagcaccagucgcaggagcagaauuagcagcaccaguaguaggucaaacuaauauaauagauccauggauuaaagaaaauuuuguacaagcaccacaaggagaauuuacgguaucaccaaaaaaugcaccaggagaaauucucguaaaccuugaauuaggcccaaauuuaaauccauauuuagaacaucugagcagaauguauaaugcauacgccgguggcauagaaguagaaauuauauuagcaggaaaugcauucacagcuggaaaaauuuuaauagcagcaguaccacccaauuuuccaguugaaaguguaucagccucccaagcaacacaauuuccucaugccaucguugacguacguacauuagaaccuguaagacuaccacuaccagauguaagaaguaauuucuuucauuauacaacaaaagacgaaccuaaaaugagacuaguuauaugguuauauacaccacuaagaacaaaugggucaggagacgauucauuuacaguuucaggaagauuacuuacaagaccuagcauggauuuccaauuuucauuucuuguaccuccaacaguagaaacaaaaacaguguuauucacaguaccaggucuaacaccacaagaaaugucgaauucuagauggccagcacaaauuagugguaugguuguaagaggaaaugaaccucaaguaguacaauuucaaaauggaagaugccauacagacgguacacuacucggaaccacuaccguuuccgaacaauguauagcaggguuuguaggaaccucaaccaauacaagaucagccacgggcagcacaacagaaacaagaacaggagauacagauuuaugguuacgucuagaagaaccaaauggucaaccauacgauaucuucggagaucaaccagcaccauuaggcacuccagacuuuagagcaguaauagugggauuugcgucaagaccacaaacccaaggaagcuacaugaacgaagcauauguaaauaccguagauagucauuuugcaccagcaacaggaaauacaaaaauaauacuuagaagaggagguacaggacauguaggaggaggacaucuauggaaauuuagaccauuuggaguagaagguggagaaggaagaguaagcuaucaagaauacguacuaccuaauuauaguggugcaaccgcuuccaaucauaacuuagcuccacccguagcuccaagaaugccaggagaauuauuauuacuauuugaaucagacaugccaguaugggaugauggacauggagcugcaccagcgcaaaaaauacauuguuuacuaccacaacaauuuauuacacacuuuuuugauucacaagcaccagcauuagcggaagcagcacuacuuagauauguucacccugauucuucuagaguacuuuuugaaacuaaauuauauagagagggauucaugguaguaucagccccaacaggccgauucgauuuuccacuagauggauacuucagauuugacucuuggguuaauucauuuuauguacuuucaccaguaggaagcggccaaggacgacguuaa

SEQ ID NO: 33292 - RNA, 1644 nt, Artificial Sequence
  derived and/or modified sequence opt6 from VP1__Norovirus_and/or_Norovirus-like__AB039779
augaaaauggcaucaaaugaugcagcaccaaguaaugauggcgcugcaaaucuaguuccagaagcaaauaaugaaguaauggcacuagagccuguagucggagcaucaauagcugccccaguuguaggacaacaaaauauaauagauccuuggauacgagaaaauuucguacaagcuccgcaaggagaauuuacagucucucccagaaacaguccaggagaaauguuacuaaaucuagaacuaggaccagaacuuaauccauaucuaucacauuuaucaagaauguauaauggauaugcugguggaaugcaaguucaaguaguacuagcaggaaaugcauuuacagcagguaaaauuauauucgcagcugugccgccacacuuuccaguagaaaauauaucagcagcccaaauaacaaugugcccacauguuauaguugauguuagacaacuagaaccaguacuccuuccuuuaccugacaucaggaacagauucuuucacuauaaccaagaagauacaccaagaaugcgauugguagcaauguuauacacacccuuaagagcaaauucaggugaagacguauuuacuguuucaugcagaguucuaacacgaccagcaccagauuuugaauuuacauuuuuaguaccacccacuguagaaucaaaaaccaaacccuucacccuaccuauauuaacauuaggagaacuauccaauagcagauucccagcuccuauagauauguuauacacagauccaaaugaaacaauaguaguacaaccacaaaacggaagaugcacccuagacggaacacuccaaggaacuacacaauuaguaccaacccaaauauguucauuuagaggaacacuaauaagucaaacaccacgaucugcagauaguacagauucagcaccacguguaagaaaucaccccuuacacguacaacuuaaaaauuuagacggaacaccauacgauccaacagacgaagucccagcuguacuaggagcaauagauuuuaaaggcacaguauucggcguugcaucccaacguaauaccacaggcucauccguuggagcaacaagagcucacgaaguacacauugacacgacaaaucccagauauacaccaaaacuaggaucaguucuuauguauucagaaucaucagacuucgaugauggacaaccaacuagauucacaccaauagguaugggagcagacgauuggcaucaaugggaauuaccagaauacucaggacaucucacacuaaauaugaauuuagcuccagcaguugcaccagcauucccuggagaaagaauauuauucuuuagaucagucgucccaagcgcuggaggauacggcucuggacaaauagauugucuaauaccacaagaauggguacaacauuuuuaccaagaagcagcaccaucacaaagcgcaguagcucuaauacguuacguaaacccggacacaggaagaaauauauuugaagcaaaacuucacagagaaggauuuaucacaguagcaaauucaggaaauaauccaauaguaguaccuccaaauggauauuuucgauuugaagcauggguaaaucaauuuuaugcacucacaccaauggguacaggucaaggaagaagaagaguacaauaa

SEQ ID NO: 33293 - RNA, 1644 nt, Artificial Sequence
  derived and/or modified sequence opt6 from VP1__Norovirus_and/or_Norovirus-like__AB039778
augaaaauggcaucaaaugaugcagccccaucuaaugauggagcagcaaaucuaguaccagaagcuaauaacgaaguaauggcacucgaaccaguaguaggagcaucaauagcagcaccaguagugggccaacaaaacauuauagauccauggauacgagagaauuuuguacaagccccccaaggagaauuuaccguaucaccaagaaauaguccaggagaaauguuacucaaucucgaacuaggaccugaauuaaacccauaucuaucacacuuauccagaauguauaaugguuaugcaggaggaaugcaaguacagguaguucuugcaggaaacgcauuuacagcuggaaaaauuauauuugcagcaguaccaccacauuuuccagucgaaaauauauccgcagcacaaauaacuauguguccccaugucauaguagauguuagacaacuagaaccaguccuacuaccauuaccugauauuagaaaccgauuuuuccauuauaaucaagaagauacaccacgaaugcgcuuaguagcuaugcuuuacaccccccuaagagcaaauucaggagaagacguuuucacagucucauguagaguucuaacuagaccugcaccugacuucgaauucacuuuccuagucccaccaaccguugaaucaaaaacaaaacccuuuacacucccuauacuuacacuaggggaacuaucaaacucuagauuuccagcuccaauagauauguuauauacugauccaaaugaaacaauugucguccaaccacaaaauggaaggugcacauuagacggaacacuucaagguaccacucaacuaguaccaacucaaauuugcucauucagagguacucuaauaagucaaacuucaagaucagcagauucaacagauucagcaccaagaguacguaaccauccauuacacguacaauuaaaaaaccuagauggaacacccuaugauccuacagaugaaguaccagccguucuaggggcaauagauuuuaaaggaacaguauuuggaguugccucacaacgaaacaccacaggcucaucaguaggagcaacccgcgcucaugaaguacacauagacacgacaaauccuagauacacuccaaaacuaggaucaguacuuauguacucugaaucaucagauuuugaugaugggcaaccaacaagauuuacacccauaggcaugggagccgacgauuggcaucaaugggaauuacccgaauauucaggccaccuuacacuaaauaugaauuuagcacccgcuguugcacccgcauucccaggagaacgaauacuauuuuuuagaucuguaguuccaagugcaggagguuacggaucaggucaaauagauugccuaauaccacaagaaugggugcaacacuuuuaccaagaagcugcuccaucacaaucagcaguagcauuaauuagauacguaaauccagauacugggagaaacauuuuugaagcaaaauuacauagagaaggauucauaacaguagcaaauuccggaaacaacccaauuguagucccucccaauggauauuuucgauuugaagcauggguaaaucaguucuauacacucaccccaaugggaaccggacaaggacgaagaagaguacaauaa

SEQ ID NO: 33294 - RNA, 1644 nt, Artificial Sequence
  derived and/or modified sequence opt6 from VP1__Norovirus_and/or_Norovirus-like__KY424345
augaaaauggcuuccaacgaugcugcuccuagcaacgacggagcagcaaaccuaguaccagaagcaaacaaugaaguaauggcacuagaaccaguaguaggcgcuucaaucgcagcaccaguaguaggucaacaaaacauaauagacccauggauuagagaaaauuucguacaagcuccucaaggagaauuuacaguaagcccaagaaauaguccaggcgaaauguuauuaaaucuagaauuaggaccagaacuuaauccauauuuaucacauuuaucaagaauguacaaugguuacgcaggagguaugcaaguucaagucguuuuagcaggaaacgccuuuacugcaggcaaaauuauauucgcagcaguaccaccacauuucccaguagaaaauauaagugcagcucaaauaacaauguguccacacguuauaguagauguaagacagcucgaaccaguauuacuaccauuacccgacauaagaaacagauuuuuccacuauaaucaagaaaacacaccaagaaugcgauuaguagccaugcuauacacaccacucagagcaaacucaggagaagacgucuuuacaguaucauguagaguuuuaaccagaccagccccagacuucgaauuuacuuucuuaguaccaccaacaguugaaucuaaaacaaaaccuuuuacacucccuauauuaacacuaggagaauuaaguaauuccagauucccagcaccaauagacaugcuauacacagacccaaacgaagguauaguaguucaaccacaaaacggcagauguacuuuagacggaacuuuacaaggaacaacacaauuaguaccaacacaaauaugugcauuuagaggaacacucauaggacaaacaucaagaucaucagacaguacugauucugcaccaagacgaagagaucauccauuacacguccaacuuaaaaauuuagauggaacacaauacgaucccacagacgaaguaccagccguccuaggagcaauagacuuuaaaggagcaguuuucggaguagcaucccaaagagauguaagugguacacaaguuggagcuaccagagcgcaugaaguucauauaaauaccacagaucccagauacacaccaaaauuaggauccauacuaaugcauucagaaucagacgauuuuguaaccggacaaccaauacaauuuacaccaguaggaaugggagacaacgacuggcaucaaugggaauuaccugacuauucaggacacuuaacacuaaacaugaauuuagcaccagcaguagcuccagcauuucccggagaaagaauauuauuuuucagaucaauaguuccaagugcaggaggauauggaucaggacaaaucgauugucuaauaccacaagaauggguacaacacuuuuaucaagaagcggcuccaucacaaucugcaguagccuuaauuagauacguaaauccagauacaggaagaaauauauuugaagcaaaacuacaccgugaaggauuuauaacuguagcuaauucugguaacaauccaauuguagucccuccaaauggauacuuucgauucgaagcauggguaaaucaauucuauacucuaaccccaaugggaacaggucaaggaagacgaagaaaccaauaa

SEQ ID NO: 33295 - RNA, 1644 nt, Artificial Sequence
  derived and/or modified sequence opt6 from VP1__Norovirus_and/or_Norovirus-like__HQ169542
augaugauggcaaguaacgaugcugccccaucuaaugauggagccgcaaaccuaguaccagaagcaaauaaugaaguuauggcucuugaaccaguaguuggagcaucaauagcagccccaguaguuggacaacaaaauauaauugauccauggaucagagaaaauuucguccaagcaccacaaggagaauuuacaguaucaccuaggaauucaccaggagaaaugcuauuaaauuuagaacuuggaccagaacuaaauccauaucucucacaccuaaguagaauguauaacggauacgcaggagguaugcaaguccaaguaguuuuagcaggaaaugcauucacagcaggaaaaaucauuuuugcagccguaccuccacauuuuccaguagaaaauauaagcgcagcacaaauaacaauguguccucacguaauaguagaugugagacaauuagaacccguacuacuaccuuuaccugauauucguaauagauuuuuccauuauaaucaagaagauacuccacgaaugcgcuuaguugcaauguuauacacuccuuuacgagcaaauucaggagaagaugucuucacaguaucauguagaguauuaacaagaccagcaccugauuuugaauucacauuucuaguaccaccuaccguagaaagcaaaacuaaaccauuuacccuaccaauacuaacauuaggagaauuaucaaauucucgauucccagcuccaaucgauauguuauacacagaucccaaugaaacuauaguaguacaaccacaaaauggaagguguacccuugauggaacacuucaagguacaacucaacuaguccccacacaaauuuguucauuuagagggacucuaguaucacaaacaucuagaucugcugauucaacagauucagcuccacgagucagaaaucauccacuacauguucaacucaaaaaucuagauggaacaccauacgauccuacugaugaaguaccagcugucuuaggugcuauagauuuuaaaggaacaguuuuuggagucgcaucacaacgaaauacgacaggagggucaguaggagcuaccagagcacaugaaguacacauagacacuacaaauccacgauacaccccaaaacuuggaucuguauuaauguacucagaaucaucagauuuugacgauggucaaccaacaagauucacuccaauugguaugggagcagacgacuggagacaaugggaauuaccagaauauucaggacauuuaacacuaaauaugaaccucgcacccgcaguagcaccugcauucccuggcgaaagaauuuuauuuuuuagaucaguaguaccaucagcaggaggauacgguucaggacaaauagauuguuuaaucccucaagaauggguccaacauuuuuaucaagaagcagccccaucacaaucugcuguagcccuaauacgcuauguaaauccagauacaggacgaaauauauuugaagcaaaauuacacagagaaggauuuauuacaguagcaaauucugguaauaaucccauaguuguaccacccaacggauauuuuagauuugaagcauggguuaaucaauuuuauacacuuacaccaauggggacaggacaaggacguagacgcguacaauaa

SEQ ID NO: 33296 - RNA, 1644 nt, Artificial Sequence
  derived and/or modified sequence opt6 from VP1__Norovirus_and/or_Norovirus-like__KX228762
augaaaauggcaucaaacgaugccgcuccaucuaaugauggcgcugcaaaccuuguaccagaagccacaaaugaaguaauggcucuagaaccuguaguuggagccucuauagcagcuccuguaguuggucaacaaaacauaauagaccccuggauaagagaaaacuuuguucaagccccacaaggagaauuuacaguaucacccagaaacucuccuggcgaaaugcuacuaaauuuagaacuaggaccagaacucaauccauacuuaucucauuuaucaagaauguauaauggauacgcaggaggaaugcaaguucaagucguguuagcaggcaacgcuuucacagcuggaaaaauaauuuucgcagcaguaccaccacauuuuccaguugaaaauauuucagccgcccaaauuacaaugugcccacauguaauaguagacguuaggcaauuagaaccaguuuuacuaccauuaccagauauaagaaaccgcuuuuuucacuacaaucaggaaaacacuccucgaaugagacuuguagcaaugcuauacacaccacucagagcaaauucaggagaagacguauuuacuguauccugccgagucuuaacccguccagcuccagauuuugaauuuacauucuuaguaccaccaacaguagaaucaaaaacaaaaccuuuuacauuacccauacuaacacuuggagaacuuuccaacucucgauuucccgcaccuauagacauguuauauacagacccaaaugaagcaauuguuguacaaccacaaaauggaagauguacacuagaugguacccuacaaggaacaacucaauuaguaccaacacaaaucugcucauuccgaggaacacuuauaucucaaacaucaagaucagcagauucaacagacucagcaccaagaguaagaaaucauccucuacauguacaauuaaaaaaccuagacggaacaccauacgacccaaccgaugaaguuccagcuguacucggugcaauagauuuuaaaggaacaguuuucgguguagcaagccaaagaaacacaacuggaaauuccaucggagcuacaagagcucaugaaguacauauagacacuacaaauccucgcuacaccccaaaacucggaucaguacuaaugcauucagaaucaaacgauuucgacgacggacaaccaacaagauucaccccaauaggaaugggagcagacgauuggcaucaaugggaacuuccagaauauagcggacaucucacucucaacaugaauuuagcaccagcaguagcaccagcauucccaggugaaagaauauuauuuuuucgaucagucguaccuucagccggcggauacggaucaggucacauugacugucuaauuccacaagaauggguccaacauuuuuaccaagaagcugcaccaucacaaucagccguugcacuaauucgguauguaaauccugauacaggaagaaacauauuugaagccaaauuacaucgagaaggauucauaacaguagcuaauucaggaaauaauccaauuguaguacccccuaauggcuauuucagauuugaagccugggucaaucaauuuuacacauuaacacccaugggaacaggacaaggaagacgaagaguccaauaa

SEQ ID NO: 33297 - RNA, 1644 nt, Artificial Sequence
  derived and/or modified sequence opt6 from VP1__Norovirus_and/or_Norovirus-like__AF414410
augaaaauggcaucaaaugaugcagccccaaguaaugauggagccgcuaauuuagucccugaagcaaacaaugaaguaauggcacuagaaccaguaguaggagcauccauugccgcuccaguaguaggacaacaaaauauuauagauccauggauaagagaaaacuuuguacaagcaccacaaggcgaauuuacuguaucaccucgcaauagcccuggugaaauacuuuuaaaucucgaacuuggaccugaacuaaaucccuaucucagucacuuaaguagaauguauaauggauaugcaggagguaugcaaguacaaguaguacuagcaggcaaugccuuuaccgcaggaaaaauaauauuugcagcaguaccuccacacuuuccuguggaaaauauauccgccgcacaaauaacuauguguccacacguaauaguagauguacgacaacuagaaccaguauucuuaccacuaccagauauucgcaauagauuuuuccauuacaaucaagaaaauacaccuagaaugcgacuaguagcuaugcuauauacaccauuacgagcuaauucaggagaagauguauuuacuguaucauguagagucuuaacuaggccagcuccagauuuugaauuuacauucuuagucccuccaacagucgaaagcaaaacaaaaccauuuacuuuaccaauacucacacucggagaacuaucaaauucaagauucccagcucccauagacauguuauacacagacccaaaugaaacaaucguuguacaaccccaaaaugguagaugcacauuagacggaacacuucaagguaccacacaauuaguuccaacacaaauauguagcuucagaggaacacuaauaucacaaacaucaagauccgcagauucaacagauucagcaccaagagcaagaaaucauccauuacauguucaacuaaaaaauuuagacggcaccccauaugauccaacagacgaaguaccagcaguacuaggugcaauagauuuuaaaggaaccguauuuggaguagcaucacaaagaaauacaacagguucuucuguuggugcuacucgugcacaugaaguacauauagacacuacugauccccgcuauaccccaaaauuagguaguguauuaauguacucagaaucaaaugauuucgacgacggacaaccaacacgauuuaccccuauagguaugggagcugacgauuggcaucaaugggaauuaccagaauauaguggucaccuaacauuaaauaugaaccuugcaccagcaguagcaccagcauucccaggagaacguauacuuuuuuuuagaaguguuguuccaucugcugguggauauggaagcggacaaauagauugucuuauaccacaagaauggguccaacauuuuuaccaagaagcagccccaucacaaucugcaguagcucuuauccguuauguuaauccugauacaggacgcaauauauuugaagccaaauuacauagagaaggauuuauaacuguagcuaacuccggaaauaauccaauaguuguuccucccaauggauauuucagauuugaagccuggguuaaucaauuuuacacacuuacaccaaugggaacaggacaaggcagaagacggguacaauaa

SEQ ID NO: 33298 - RNA, 1644 nt, Artificial Sequence
  derived and/or modified sequence opt6 from VP1__Norovirus_and/or_Norovirus-like__KU935739
augaaaauggcaagcaacgaugcagcaccaaguaaugauggagcagcaaacuuaguuccagaagcgacaaacgaaguaauggcauuggaaccaguaguaggagccucaauugcagcaccaguaguaggacaacaaaauauaauagauccauggauacgcgaaaacuucguacaagcaccacaaggagaauuuacaguaaguccuagaaauucaccuggcgaaaugcuacucaauuuagaacuaggacccgaauugaaucccuaccuuucccaucucucaagaauguauaauggguaugcaggcggaaugcaaguacaaguaguuuuagcaggaaacgcauuuacugcaggaaaaauuauauuugcagcagucccuccacauuuuccaguugaaaauauaucagcagcacaaauuacuaugugcccacauguaauaguagauguaagacaauuagaaccaguauuauuaccacucccagacauaagaaauagauucuuucacuacaaucaagaaaauacgccucgcaugcgauuaguagcaaugcuauauacaccauuacgagccaacucaggagaagauguauucaccguuuccugcagaguuuuaacaagaccagcuccagauuuugaguucacauuuuuaguaccucccacaguagaaucaaaaacuaaaccauuuacauuaccaauacuaacucuaggagaauuaucaaacagccgauuuccagccccaauagacauguuauacacugacccaaacgaagcuauaguuguacaaccacaaaacggccgauguacucuagauggaacucuacaaggaacaacacaauuagucccaacacaaauauguucauuuagaggaacuuuaauaagccaaacuucaagaucagcagauucuacagauucagcaccacgcgcaagaaaucauccuuuacacguccaacugaaaaauuuagaugguacaccuuaugauccuacagaugaaguaccagcaguauuaggagcuauagauuucaaaggaacaguauuuggcguagcaagucaaagaaauacaacaggcaauagcauaggagcuacuagagcccacgaaguacauauagauacuacaaauccaagauauaccccuaaauuaggaucaguauuaauguauucagaaucaaacgauuuugacgacggacaaccuacaagauuuacuccaauuggcaugggagcagacgauuggcaucaaugggaauuacccgaauauucaggucaucuaacacuuaauaugaaccuagcuccugcagucgcuccagccuucccuggagaaagaauauuauucuuuagaucaguaguaccaucagccggaggauauggaagcggacauauagauugccuaauaccucaagaauggguccaacacuucuaucaagaagcagcaccuucccaaagugcaguugcgcuuauaagauauguaaauccagauacuggaagaaauauuuuugaagcaaaacuucauagggaaggguucauaacaguagcaaauucaggaaacaauccaauaguuguaccaccuaaugguuacuuuagauucgaagcauggguuaaucaauuuuauacucuaacaccuaugggaacaggacaaggaagacgaagaguacaauaa

SEQ ID NO: 33299 - RNA, 1644 nt, Artificial Sequence
  derived and/or modified sequence opt6 from VP1__Norovirus_and/or_Norovirus-like__KX268709
augaaaauggccagcaaugacgcagcacccuccaaugacggcgcagcaaaucuaguucccgaagcgacaaacgaaguaauggcccuagaaccugucguuggugcuucuauugcagcuccagucguaggacaacaaaauauaauagauccauggauaagagaaaacuucguacaagcaccacaaggagaauuuacagucaguccccgaaauucccccggcgaaauguuacuaaacuuagaacuaggaccagaacuaaauccauaucuuucacauuuaucaaggauguauaacggauacgcaggcggaaugcaaguccaagucguauuagcuggaaacgcauuuacagccggaaaaauuauauuugcagcaguaccaccacacuuccccguagaaaacauaucagcugcacaaauaacaauguguccucacguaauaguagauguaagacaacucgagccaguccuuuuaccauuaccagauauccgaaauagauucuuucauuacaaccaagaaaauacaccaagaaugagauuaguagccauguuguauacaccauugcgagcaaauucuggagaagacgucuuuacaguaucauguagagucuuaacaagaccagcaccagauuuugaauuuacauucuuaguaccuccaacaguagaaaguaaaacaaaacccuucacuuuaccaauauuaacauuaggagaauuaagcaauucaagauuuccugcaccaauagauaugcuauauacagauccgaacgaagcuauaguuguacaaccacaaaauggaagauguacauuagauggcacacuucaaggaaccacacaacuuguaccaacccaaauaugcucauuucgaggcacacuaauaucucaaacaucaagaucagccgauaguacagauucagcaccacgcgcaagaaaucauccacuacacguucaacucaaaaauuuagauggaacucccuaugacccuaccgaugaaguuccagcaguauuaggcgcuauugacuuuaaaggcacagucuuuggagucgcaagucaaagaaauacaacagguaauagcauaggagcaacacgagcacacgaaguacauauagauacaacuaauccaagauacacaccaaaauuagguucaguauuaaugcacucagaaucaacagauuuugaugacgggcaaccuacaagauuuacacccauuggaaugggagcagacgauuggcaucaaugggaauuacccgaauauucaggacaccucacauuaaauaugaaucuugcaccagcaguagcuccugccuuuccaggagaacgaauacuauucuuuagaucaguaguaccauccgcuggugguuauggcucaggacacauagauugucuaauaccacaagaauggguccaacauuuuuaucaagaagcagcaccaucacaaagugcaguagcauuaauacgauauguaaauccagauacagguagaaauauauuugaagcaaaacuacauagagaaggauucauaacaguugcaaacucuggaaacaaucccauaguaguaccaccaaauggauauuuuagauucgaagcauggguaaaucaauuuuauacacuaaccccaaugggaaccggacaaggacgacgacgaguacaauaa

SEQ ID NO: 33300 - RNA, 1644 nt, Artificial Sequence
  derived and/or modified sequence opt6 from VP1__Norovirus_and/or_Norovirus-like__KX158282
augaaaauggcauccaaugaugcagcacccucuaacgauggagcugcaaauuuaguaccagaagcaacaaacgaaguuauggcacuugaaccuguaguaggugcaucaauagccgcaccaguuguaggacaacaaaacauaaucgauccauggauaagagaaaauuucguucaggcaccacaaggagaauuuacagucaguccccgaaacucacccggagaaauguuauuaaaucuagaacuugguccagaacucaacccauaccuaucacauuuaucaagaauguauaauggauaugcaggaggaaugcaaguacaaguaguacuugcaggaaaugcauucacugcagguaaaauaauauuugcagcaguaccaccucauuuuccaguagaaaacauaucagcagcacaaauaacuauguguccccauguuauaguagauguaagacaauuagaaccaguucuccucccucuaccagacauuagaaauagauuuuuccacuauaaucaagaaaauacuccaagaaugcgauuagucgccaugcuuuauacaccacuaagggccaauucaggagaagacguauuuacaguuucaugcagaguacuaacaagaccugcacccgauuucgaauuuacauuuuuagucccacccaccguugaaucuaaaacaaaaccauucacauuacccaucuuaacuuuaggcgaacuauccaacuccagauuuccagcuccaauagauauguuauauacagauccaaaugaagcaauaguaguacaaccucaaaacggccgaugcacauuagacggaacauuacaaggaacaacucaacuugucccaacacaaauaugcaguuuucgaggaacucuuauaucacaaacuucaagaucagcagauucaacagauucagcaccaagaguacgaaaucacccucuucacguucaacuuaaaaauuuagacggaacuccauaugacccaacagacgaaguuccugcaguauuaggagccaucgauuuuaaaggaacagucuuaggaguagcaucucaaagaaacacuacuggaucuucaauaggcgcuacuagagcacaugaaguacauauagauacaaccaaucccagauacacuccuaaauuaggaucaguucuaaugcauucagaaagcacugauuuugacgacggacaaccaacaagauuuacacccauaggaaugggugcugacgauuggcaucaaugggaacuaccugaauauucaggacaucuaacauuaaacaugaacuuagcaccagcagucgcuccugcauuuccaggugaaagaauauuauucuuccgaucuguaguaccauccgcaggaggauaugguucaggacauauagauugcuuaauuccacaagaauggguacaacauuuuuaucaagaagccgccccaagucaaucugcaguagcacuaauacgauacguuaauccagauacuggaagaaauauauuugaagcaaaacuacacagagaagguuuuauaaccguagcaaacuccggaaauaauccuauuguaguaccaccaaacggauauuuuagauucgaagcaugggucaaucaauuuuauacucuaacucccaugggaauaggccaaggcagaagaagagugcaauaa

SEQ ID NO: 33301 - RNA, 1644 nt, Artificial Sequence
  derived and/or modified sequence opt6 from VP1__Norovirus_and/or_Norovirus-like__AB126320
augaaaauggcauccucagacgcagccccaucaacagauggaucagccagauuaguuccagaaguaaauaacgaaacuauggcauuagaaccagucguaggagcccccuuagcagcccccguagcaggacaacacaauaucauugaccccuggauuaaaaugaauuuuguacaagccccaaacggagaauuuacaguaucaccacguaaugccccaggagaaauauuauuagaucuagaacucggaccugauuuaaauccuuaucuaucccacuuagcaagaauguauaauggauacgcuggaggaauggaaguacaaguaguauuagcaggaaacgcauucacagcaggaaaaauaauuuuugcagcaguaccacccaacuuuccagcugaaaacuuauccgcagcacaaguaaccauguguccacacguaauaguagacguaagacaauuagaaccagucauguuaccuaugcccgauauaaggaauaaacuauuucacuacaaccaaguagacgacccaaaacuucgcuuacuggcauaccuauacacgccauuaagagcaaacaaugcaggcgacgauguauuuacuguuucaugucgaguacucacaagaccaacaccagacuuugaauuuauguuucuaguaccaccaacaguagaaucuaaaacaaaaccuuuuucgcuaccaucuuuaacauuagacgaacuaucaaauucaagauucccagcaccaauaguacaauuauacacaaauccacaugacaaccuaguaguucaaccccaaaauggaagauguacaauagacggacuauuacaaggcacaacacaauuagucucguguaauguaugcucauuccgaggaacaauaggagauggucaaccagcaucacauucagaagaagaaauaaugccaauggcauuuaauauacaaagagaaauaaugcuugaaaaucuagauggaacaccauaugacccagcugacgacauaccagcaguauuaggcucaccugacuuucaaggaguaauauuugguauacuaucacaaagaaauacggauggacaaacaagagcacaugaagcaaaaguagauacucgagccgcaagauucgcuccaaagcuaggauuuguaguagcuacuguagaaucaacagacuuccacgccaaccaaccaucuagauuuacaccaguaggucucggaggcgacaauaaccaagacuucaaccaauggcgcuuaccagcauauggaggugcauuaacuaacaauacuaaucuagcaccacccguaaugccuguauauccuggagaacaauuacuauucuuuagaucacaacugccaucaucaggaggaguuguaggaggaugguuagacugucuucuaccacaagaauggguacaacacuuuuuccaagaaucagccacaagucagagugauguagcuuuaguaagauacauaaauccaacuaccggucgaguacuauuugaagcaaaauuacacaaacaaggauuuuuaaccguagcugccaguggcagcuauccccuagucguaccagcugauggauacuuucgauuugaaucauggguuaaccaauucuacacauuagcuccaaugggaaacggcuccggcagaagacgagccagauaa

SEQ ID NO: 33302 - RNA, 1644 nt, Artificial Sequence
  derived and/or modified sequence opt6 from VP1__Norovirus_and/or_Norovirus-like__AY077644
augaaaauggcuagcaaugacgcaucaccaagugcugacggaagugcugguuuaguaccagaaguaaacaaugaaacaauggcccucgaaccuguuguaggagcaccauuagcagcaccaguagcuggucaacacaauauaauagacccuuggauaaaaaugaacuuuguacaagcaccaaauggagaauuuacaguuaguccacgcaaugccccaggagaaauauuacuagaucuugaacuaggcccagaucuaaauccauaucuaucacacuuagcaagaauguauaacggauacgcaggagguauggaaguacaaguuguacuagcaggaaaugcauuuaccgcaggaaaaauaauauuugcagcuguaccaccuaauuuuccagcugaaaauuuaucugcugcacaaguaacuaugugcccacacguuauuguagaugucagacaacuagaaccaguaaugcuuccaaugccagauauaagaaauaaacuauuccacuauaaucaaguagaugacccaaaauuaagauuacuagcauaucuauacacaccacuuagagcaaauaaugccggagaugauguauuuacaguaagcuguagaguauuaacuagaccaacaccagauuucgaauuuauguuucuaguuccaccaacaguugaauccaaaacaaaaccauuuucgcuaccaucuuuaacacuagaugaacucucaaauaguagauucccagcacccaucguacaauuauacacaaauccacacgacaauuuaguaguccaaccucaaaacgguagauguacaauagacggauuauuacaaggaacaacacaauuaguaucuugcaauguaugcucauuucguggaacuuuaggagauggccaacccgcuucccauagugaagaagaaauaaugccaauggcauuuaauauucaaagagaaauaaugcuugaaaauuuagacggaucaccauacgacccaaccgaugacauaccagccguacuaggaucaccugauuuccaaggaguuguauucggaauuuuaucacaacgaaacacagauggacaaacaagagcacacgaagcaaaaguagacacacgauuagcaagauuugcacccaaauuaggauucguaguagcaacaguagaaaacacagacuuucaugcaaaccaacccugccgauucaccccaguaggacucggcggagauaacaacagagauuucaaucaaugggggcuaccagcauaugguggagcuuuaacuaacaacacaaauuuagcaccucccgucaugccaguauacccaggagagcaauuauuauucuuuagaucacaauuaccaaguucaggagguguuguaggaggaugguuagauuguuuauuaccacaagaauggguacaacacuucuuucaagaaagcgcaacaagucaauccgacgucgcccucguacguuauaucaacccaacuacagguagaguauuauucgaagcuaaauuacauaaacaaggguuucuaacaguugccgcaagcggaaguuauccuuuaguagucccagcagacggauacuuuagauuugaaucauggguaaaccaauucuauacauuagcaccgaugggaaacggaaguggucgaagacgaguaagauag

SEQ ID NO: 33303 - RNA, 1644 nt, Artificial Sequence
  derived and/or modified sequence opt6 from VP1__Norovirus_and/or_Norovirus-like__AY823306
augaaaauggcaaguucagaugcagccccaagcucugacggaucugcaggucuuguaccagaaguaaauucagaaacaauggcccuagaaccuguaguaggagcaccacuagcugcaccugucgccggacaacacaauaucauagauccuuggauaaaauuaaacuuuguccaggcaccaaacggggaguucacuguaucuccaagaaacgcaccaggagaaauauuauuagacuuagaauuaggaccagaucuaaauccauauuuagcacauuuauccagaauguacaaugcauaugccgguggaauggaaguacaagucauuuuagcaggcaaugcauuuacugcagguaagaucauauucgcugcuguuccaccaaauuuuccucuugaaaacuuaucagcagcacaaauaacaauguguccacauauaauaguagauguacgucaauuagaaccaguuaugcuuccaaugccagauguaagaaauagauuauuccauuauaaucaaguaagagaaccaagacuacgauuaguagcuuaucuauauacaccauuacgagcaaauaaugcuggugaugauguauuuacaguaagcuguagaguacuuacuagaccaagucaagauuucgaauuuauguuuuuagucccaccuucuguagaaucaaaaacaaaaccauuuucacuaccaaauuuaacauuagcagaauuaucaaacucacgauuuccucuuccuauagaacaauuauauaccaacccacuagacaaucuaguaguacaaccucaaaacggaagauguacaauagauggaauccuacuagggacuacacaauugguacccucacuaauuugcaguaugcguggaacacuagaagcagaucaagcaagcggucauacagacgaugaaagcguacaaagucgagcuuuuaauagacaacgaagccuaaugcuagaaaauccagauggcucugcauuugaccccuccgaugaagucccagccguauuaggaguaccagauuuuagagguguaguauuuggaguauuaucacaaagaaauaauggagauacuaccagaucacacgaagcaaaaauagacacaagaagaccaagauacgcaccaaaacucggauucguugaaguacuaaccgaaucagacgauuuccaaaauggcccaccaaccaaauuuacaccaguaggauuaggcggugacggaaauccagauuuucaacaaugggcauuaccugauuacgguggugcauuaacaaacaauacaaacuuagcuccaccuguaguaccaguauaucccggagaacaaauauuauucuuuagaucacaauuacccucaagcggaggcaccguagcgggaugguuagauugccuuuuaccacaagaauggauacaacacuuuuaucaagauucugcugcugcucaaucagauguagcauuagucagauauaucaaccccgcaacaggaagaguacuuuuugaagcuaaguuacaucgacaaggauuucugacaguaagugccgcaggaccucauccaguaguagcuccugcagaugguuacuucagauuugaaucauggguaaaucaauucuauacucuagcaccgaugggaaaugguucaggaagaagaagaguauaa

SEQ ID NO: 33304 - RNA, 1638 nt, Artificial Sequence
  derived and/or modified sequence opt6 from VP1__Norovirus_and/or_Norovirus-like__KF586508
augaugauggcaucaaaagacgcaacaucaaauauggauggaacauccggagcaggacaauuagucccagaaaauaauaauacaucugaaccaauaaauauggaaccaguagcuggagcaguaacagcagcagccaccgcuggacaaguaaauaugauagaucccuggauaaugaacaacuauguucaagcaccccaaggugaauuuaccauaucaccuaacaauacaccaggcgacauauuauuugaucuucaauuaggaccucacuuaaauccauuccuagcacaccucucacaaauguacaacgguuggguaggaaauaugaaaguuagaguuguauuagccggaaacgccuuuucagcagguaaaauaauagucuguugcaucccaccaggauuuucagcaccaaacaucucaauagcacaagcaaccauguucccacacguaaucgcagacguaagaguuuuagaaccuauagacauaccauuagacgauguaagaaacguacuauuccauaacaacgacaacggaaaucaaacaaugagacuacucuguaugcuuuauacuccacucagaucaggaggaacauccucaggaacagauccauuuguaauagcaggaagaguauuaacaugcccuacacccgacuuuaauuucuuauuuuuaguuccacccacaguagaacagaaaacaaaacaauuuucuguacccaaccuaccucuuaauguaaugucaaacucaagagucccuaguuuauuaaaugcaaugguaguaucucccgaucaagcacaaguaguacaauuccaaaacggacgauguacuuuagacggucaaaugcuaggcacaacaacaguaucagcuucaugcguagcaagauucagaggcaaaacauuccaagcaccagacaaucgacucggaauaaaccuugcagaaauauccggcgaaccauaucacgcauucgaaucaccagcaccauuaggauuuccagacuucggagauggagacuggcauguuacugcuacaaaagucacaccaucacaauuagaagcaaacgauccaguaguuaugggcaauguacaaccauauaauccacaauucgcaccacaccuagguaccuuaguuguagaaaacccaacaccagauaauguaacaacuggaacagauuuacuauuuaauauaacaugguuaucaaauagagcuaacaacagauucaaccccugggucauaccaaacuacgguucaacuuuaacagaagccgcacaauuagcaccaucuauauuucccccaggcuuuggcgaaaccauaguauauuucaacucaacuuucccagcaguaggagcaacaacacaugcagcuauaccuugucuuuuaccccaagaauuuguagcucauuuugucaaugaacaagccccaauaagaggagaagcagcucuacuccauuauauagauccagauacccaucgaaauuuaggugaauuuaaaaucuauccagaagguuuuguaaccugcguaccaaacguuggaggaacaggaccacaaucauuaccaacuaacggaauuuuuguuuuugucuccuggguaucacguuacuaucaauuaaaaccaguuggaacugcuggacaagccagaagacucuaa

SEQ ID NO: 33305 - RNA, 1638 nt, Artificial Sequence
  derived and/or modified sequence opt6 from VP1__Norovirus_and/or_Norovirus-like__HQ637267
augaugauggcuucuaaggaugcaacaucaaauauggacggaacaucaggagcaggucaauuaguaccagaaaauaauaauacauccgaaccaauaaacauggaacccguagcuggugcaguaacugcagcagcaacagcaggacaaguaaauaugauagacccauggauaaugaauaacuauguacaagcuccucaaggugaauuuacaaucaguccaaauaauacgccaggagacauuuuauuugaucuucaacuagguccacaucuuaacccauuuuuagcacacuuaucccaaauguauaauggauggguaggaaacaugaaaguaagaguuguauuagcaggaaaugcauuuucagcagguaaaaucauaguauguuguauaccaccugguuuuucugcaccaaauauaagcauagcccaagcaacaauguuuccacacgugauagcagacguaagaguuuuagaaccaaucgacauaccauuagaugauguacgaaauguacuauuccacacuaaugauaauggcaaucaaacuaugagauuauuauguauguuauauacuccucuaagaagcgggggaacuucuucaggaacagacccauucgucauagcaggacgcguauuaacuugucccacaccagacuuuaacuuuuuauuucuuguacccccuacaguugaacagaaaacaaaacaauuuucaguaccuaauuugccacuaaauguaaugucaaauucaagaguuccaaguuuauuaaacgcaaugguagucucacccgaucaagcccaaguaguucaauuucaaaauggaagauguacauuagacggacaaaugcuuggaacuacaacaguaucagcuucauguguugcuagauuucgagguaaaacauuucaagcacccgauaauagauuaggaauaaaccuagcagaaauaucaggagaaccauaucaugcauucgaaucaccagcaccauuaggauuucccgauuucggugacggagacuggcaugucacagccacaaaaguaacaccaucacaauuagaagccaacgaucccguaguaguagguaauguucaaccuuacaauccacaauuugccccacaccuaggaaccuuaguaguagaaaauccaacaccagaccaaguugcaacugguaccgaccuucuauucaauauaacauggcuuucaaaccgagcaaauaauagauuuaacccauggguuauaccaaauuauggaucaacccuaaccgaagcagcacaacuagcaccaucuauauucccaccaggauucggggaaaccauuguauacuucaacucuacauuuccagcagucggagcaacaacacaugcagcaauaccuugccuauuaccucaagaauuuguagcacauuuuguaaaugaacaagcacccauaagaggugaagcagcauuauuacauuauauagaccccgauacccauagaaaucuaggagaauuuaaaauauauccagaaggauucguaacauguguuccaaauguagggggaacaggcccacaaucacuaccaacgaauggaguuuuuguauuuguaucauggguaaguagauauuaucaauuaaaaccaguaggaacugcaggacaagcaagaagacuauaa

SEQ ID NO: 33306 - RNA, 1629 nt, Artificial Sequence
  derived and/or modified sequence opt6 from VP1__Norovirus_and/or_Norovirus-like__AY134748
augaaaauggcaaguaaugacgcugccccaucaacugauggcgcagcaggccuaguuccugaaucuaacaaugaaguuauggcccuagaacccguagcaggagcagcucuagcugccccagucaccggacaaacaaacauaauugacccauggauuagagcaaauuuuguacaagccccaaacggagaauuuacuguuucaccaagaaaugcaccaggagaaguucuccuaaacuuagaguuagguccugaacuaaauccauacuuagcucacuuagcaaggauguauaauggauaugcuggaggaauggaaguacagguaauguuagcaggaaaugccuuuaccgcuggaaaacuugucuucgcagcaguaccaccccauuucccaguagaaaacuuaucaccacaacaaauaacaauguuuccacauguaaucauagacguaagaacacuagaaccaguacuauuaccacuaccagauguaagaaacaauuucuuucacuacaaucaaaaagacgacccaaaaaugagaauaguagcaaugcuauacacacccuuaagaucaaauggauccggagacgacguauuuacaguaucaugcagaguacuaacacgcccaucaccugauuuugacuuuaccuacuuaguaccacccacaguagaaucaaaaaccaaaccauuuacuuuaccaauacuaacacuuggagaacuaucaaacucacgauuuccagucuccauagaucaaauguauacaucaccaaaugaaguaauaucaguacaaugccaaaacggcagauguacccuugauggcgaacuacaaggcacaacacaauuacaaguaucagguauaugugcuuucaaaggcgaaguuacagcucacuuacaagauaacgaucacuuauacaacauaacaauaacuaacuuaaacgguucacccuucgauccuucugaagauauaccagcaccacuaggcguaccagacuuucaaggaagaguuuucgguguaauaacacaaagggauaaacagaaugcagcaggacaaagucaaccugcaaauagaggucaugaugcuguuguaccaacauauacugcacaauauaccccaaaauuaggacaaguacaaauaggaacauggcaaacugacgacuuaaaaguaaaucaaccugucaaauuuacuccaguaggacuaaacgauacagaacacuuuaaccaauggguagucccucguuaugccggcgcacuaaauuuaaacacuaauuuagcacccucaguagcaccaguauuuccaggggaacgacuauuauuuuucagaucauauuuaccacuaaagggaggauauggcaacccagcaauagacugucuacuaccacaagaauggguucaacauuuuuaucaggaagcagcaccaucuaugucugaaguagcauuaguacgauacauaaaucccgacacagguagagcacuauucgaagcaaaacuacacagagcuggauucaugacaguaucuucaaacacaucagcacccgucguaguaccagcaaacggauauuuucgauucgauagcugggucaaucaauuuuacucccuagcaccaaugggcacaggaaaugguagaagaagaauccaauaa

SEQ ID NO: 33307 - RNA, 1629 nt, Artificial Sequence
  derived and/or modified sequence opt6 from VP1__Norovirus_and/or_Norovirus-like__AY054300
augaaaauggcuucuaacgacgcagcaccaucaacagauggagcagcuggcuuaguuccagaaucaaauucagaaguaauggcacuugaaccaguagcuggagcggcacuagccgcucccguaacgggacaaacuaauauuauugauccauggaucagagcuaauuuuguacaagcaccaaauggagaauuuacaguuucaccucguaaugcaccaggcgaaguccuacuuaaucuagaacuagggccagaauuaaauccauaccuagcacauuuagcaagaauguauaacgguuaugcugguggaauggaaguccaaguaaugcuagcuggaaacgcauucacagcagguaaacuuguauuugccgccguaccuccacauuucccaguagaaaaucuaucaccucaacaaauaaccauguucccacauguaauaauagauguaagaacucuagaaccaguacuuuuaccacuccccgacguaagaaacaauuucuuucauuauaaucaaaaagaugauccaaaaaugagaauaguagcaaugcuauauacuccauuaagaaguaaugguucaggagaugauguuuuuacuguuucauguagaguacuaacaaggccaucuccugauuuugauuuuacuuacuuaguucccccaacaguugagucuaagacuaaaccauucacuuuaccaauacuuacacuaggggaacuaucaaauucacgauuuccagucccuauagaccaaauguuuaccucuccaaaugaaguaaucucaguacaaugucaaaacgguagaugcacauuagacggagaacuucaaggaacaacacaacuacaaguaucaggaauaugcgcauucaaaggagaaguaacagcacauuuacaugauaaugaucaucuauauaauguuaccauaacuaaccugaacggaucaccuuuugauccuucagaagauauacccgccccauuaggcguaccagauuuucaaggacgcguauuuggaguaauaucacaaagagauaaacaaaaugcagcaggccacucagaaccagcuaauagaggacaugacgcaguaguaccaacauauacagcacaauacacaccaaaacucggacaaauucaaauaggaacauggcaaacagacgaucuacaaguaaaucaaccaguuaaauuuacuccaguaggacucaacgauacagaacauuuuaaucaauggguaguaccacgauacgcaggagcauuaaaccuaaauacaaaucuagcaccaucaguugcaccaguauuuccaggagaacgacuauuauucuuucguucuuaucuaccacucaaaggaggauacggaaaucccgcaauagacuguuuauuaccacaagaauggguacaacauuuuuaucaagaagcugcacccucgaugucugaaguagcucuagucagauauauaaauccagacaccgguagagcacuauuugaagcaaaauuacauagagcagguuuuaugacuguaaguucaaauacaucagccccaguagucguaccugcaaauggauauuuucgauuugauucuuggguaaaccaauuuuauucacuugcaccaaugggaacaggaaauggacgaagaagaguacaauaa

SEQ ID NO: 33308 - RNA, 1629 nt, Artificial Sequence
  derived and/or modified sequence opt6 from VP1__Norovirus_and/or_Norovirus-like__KY485125
augaaaauggcaucaaaugacgccgcuccaucaacugacggugcagcaggacuuguuccagaaaguaacaaugaaguaauggcucuagaaccaguagccggagcagcuuuagcagcaccaguaacaggacaaacaaauauaauagacccauggaucagagcaaauuuuguacaagcaccaaauggagaauuuacaguuuccccuagaaaugcuccaggagaaguauuauuaaaccuagaacuaggaccagaacuaaauccuuacuuagcacauuuagcuagaauguauaauggauaugcaggaggaauggaaguacaaguaauguuagccgguaacgcauuuacagcaggaaaauuaguauucgcugcaguuccuccacacuucccaguagaaaaucuaucaccacaacaaauuacaauguucccacacguaauaauagacgucagaaccuuagaaccaguacuuuuaccacuaccagacguuagaaacaacuucuuucauuacaaucaaaaagaugacccaaaaaugcgaauagucgcaaugcuauauaccccacucagaucuaaugguucaggagaugauguauucacagucucauguagagucuuaacaagaccuucaccagauuuugacuucacauauuuaguaccaccaacuguagaauccaaaacuaaaccuuuuacacuacccauacuaacacucggagaacugucaaauucaagauuucccgucucgauagaccaaauguauacaucuccaaacgaaauaauaucaguccaaugccaaaaugguagaugcacucuugauggagaacuucaagguacaacacaauuacaaguaucuggaauaugugccuuuaaaggugaaguaacagcacacuuacacgauaaugaucaucuuuacaacguaaccauaacaaauuuaaauggaucuccauuugacccuucagaagauauaccugcaccacuaggaguuccugauuuucaaggacgaguuuucgguaucauaucacaaagagauaaacauaacucaccuggucacaacgaacccgcaaauagaggacaugaugcaguagucccgacauacacugcacaauauaccccuaaauuaggucaaauccaaauaggaaccuggcaaacugaugauuuaacagucaaccaacccguaaaauucaccccaguaggauugaaugauacugaacacuucaaccaauggguaguaccacgcuaugcaggagcacuaaaucuaaauacaaaccuagcaccaucaguagcaccuguauuucccggugaaagacuauuauucuuucgaucauauauuccauuaaaaggaggauauggaaauccugcaauagacuguuuacuaccucaagaauggguccaacacuuuuaucaagaagcagcaccaucaaugucagaaguagcauuaguaagauauauaaaucccgacacuggacgagcuuuauucgaagcaaaauuacauagagccggauuuaugacuguuucaucaaauacaucagcaccuguaguagucccagccaauggauauuuccgauuugacucuuggguaaaucaauucuacucucuagcaccaaugggaacagguaacggaagaagacgaguacaauaa

SEQ ID NO: 33309 - RNA, 1629 nt, Artificial Sequence
  derived and/or modified sequence opt6 from VP1__Norovirus_and/or_Norovirus-like__KY485123
augaaaauggcuucuaaugacgcugcaccuucaacagacggagcagcaggccuaguaccggaaucaaacaaugaaguaauggccuuagaaccaguagccggagcagcauuagcagcuccaguaacaggccaaacaaacauaauagacccauggaucagagcaaauuuuguucaagcuccaaacggugaauuuacaguaucccccagaaaugcaccaggugaaguacuucuaaaccucgaauuaggaccagaacuaaauccauaucuagcacacuuagccagaauguacaauggacacgcuggaggaauggaaguacaaguaauguuagccggaaaugccuuuacagcaggaaaacucguauuugcagcaguacccccacacuucccagucgaaaacuuaucaccacaacaaauaacaauguuuccacauguaauaauugacguccguacccuagaaccaguauuauuaccauuaccagacguacgaaacaauuucuuccauuauaaucaaaaagacgauccaaaaaugagaauaguugcaaugcuauacaccccacugcgaucaaauggaucaggugaugacguauucacaguaucuuguagaguucuaacaagaccauccccagacuucgacuuuacauaucuaguuccaccaacaguugaaucaaaaacaaaacccuuuacacuaccaauacuuacccuaggagaauuaucuaacaguagauucccaguauccauagaccaaauguauacauccccaaaugaaguuauaaguguccaaugucaaaauggaagguguacccuugacggagaauuacaaggaacuacacaacuacaaguaucuggaauuugcgcauuuaaaggagaaguaaccgcacauuuacacgacaacgaccauuuauauaauguaacaauaacaaaucuaaauggcucuccauucgacccuucagaagauauaccugcaccacuaggaguaccagauuuccaaggaagaguauucggcauaauaucacaaagagauaaacacaauucuccaggacauaaugaaccagcaaacagaggucaugacgcaguaguaccuacauacacagcccaauacaccccaaaauuaggccaaauacaaauaggcacauggcaaacagacgaccuaacaguuaaccaaccaguaaaauucacaccaguaggacuaaaugacaccgaacacuuuaaccaauggguaguaccuagauaugcaggagccuuaaaccuaaauacaaaccuugcacccuccguagcaccaguauucccaggcgaaagauuauuauucuucagaucauauauaccauuaaaaggaggcuauggcaacccugcaauagauugccuacugccccaagaauggguacaacauuuuuaucaagaagcugcaccaucuaugucugaaguagcccuagucagauauauaaacccagauacaggacgagcacuuuucgaagcaaaacuacaccgagcaggauuuaugacaguaucauccaauacaucagcaccaguaguaguaccagcuaacggauauuucagauuugacucauggguaaaccaauucuauaguuuagcaccaaugggaacaggaaauggacguaggagaguccaauaa

SEQ ID NO: 33310 - RNA, 1629 nt, Artificial Sequence
  derived and/or modified sequence opt6 from VP1__Norovirus_and/or_Norovirus-like__KY485126
augaaaauggcuucaaaugacgcugcaccuagcacagacggagcagcaggcuuaguaccagaaucaaacaaugaagucauggcacuagaaccaguagcaggagcagcacuagcugccccaguaacaggacagacaaauauuaucgauccuuggauucgagcuaauuucguucaagcacccaauggugaauuuacaguuucaccacgaaaugcuccaggagaaguucuacuuaauuuagaauuaggaccugaacuaaauccauaccucgcacaccuagcuagaauguacaacggauacgcugguggaauggaaguacaaguaauguuagcuggaaaugcauucacagcaggaaaauuaguauuugccgccguaccaccacacuuuccaguagaaaaucuaucaccucaacaaauuaccauguuuccucauguaauaauagaugucagaacccuagaaccaguacuacuaccacuaccagauguaagaaauaacuucuuccacuauaaccaaaaagacgacccaaaaaugcguauagucgcuaugcuuuacacaccauuaagaucaaacggaucaggagacgacgucuucacaguuucaugccgaguccuaacacgaccaucacccgauuucgauuuuacuuaucuaguaccaccaacugucgaauccaaaacuaaaccauucacucuucccaucuuaacauuaggagaacuaucaaauucaagauucccuguaucuauagaccaaauguauacuucaccuaacgaaauuauaucaguccaaugucaaaacggaagaugcacauuagacggcgaauuacaaggcacuacucaauuacaaguaucaggaauaugcgccuuuaaaggagaaguaacagcacacuuacacgauaaugaccaucuuuauaacguaacaauaacaaacuuaaacgguuccccuuuugauccaucagaagacauaccagcacccuuagguguucccgacuuccaaggaagaguauucggaauaauaagccaaagagauaaacauaacucgccaggucacaacgaaccagcaaauagaggacaugacgcuguaguucccaccuacacagcccaauauacuccaaaauuaggacaaauacaaauagggaccuggcaaacagacgauuuaacaguaaaucaaccuguaaaauuuacuccuguaggucugaaugacacagaacauuucaaccaauggguaguuccacgauaugcaggagcauuaaacuugaacauuaacuuagcacccucuguagcaccaguauuuccaggugaaagauuauuauucuucagaucauauauaccauuaaaaggcggauauggaaauccagcaauagacugucuacuaccucaagaauggguacaacauuucuaucaagaagcagcaccaucaaugucagaagucgcauuaguaagauacauaaauccugacacugguagagcauuauuugaagcaaaacuccauagagcagguuuuaugacuguuucauccaacacaucugcaccaguaguaguaccagcaaaugguuauuuuagauucgauucauggguuaaccaauuuuacagucuugcaccaaugggaacaggaaauggaagaagacgaguacaauaa

SEQ ID NO: 33311 - RNA, 1629 nt, Artificial Sequence
  derived and/or modified sequence opt6 from VP1__Norovirus_and/or_Norovirus-like__U70059
augaaaauggcaucaaaugaugcugcaccuucaacugauggagcagcaggucuaguaccagaaucuaauaaugaaguaauggcauuagaaccaguagcaggcgccgcauuagccgcaccaguaaccggacaaacaaauaucaucgauccuuggauaagagcaaauuuuguacaagcacccaauggagaauuuacuguaucaccaagaaacgcaccuggagaaguauuauuaaacuuagaauuagguccagaacuaaaucccuacuuagcacacuuagcucguauguauaauggauacgcaggagguauggaaguccaaguaaugcuagcuggaaaugcauucacugcaggaaaauuagucuucgccgcaguaccaccccacuucccuguugaaaauuuaaguccacaacaaauaacaauguuuccacauguaaucauagacguacguaccuuagaaccaguauuacuaccacuucccgacguaagaaacaauuucuuucauuauaaccaaaaagacgaccccaaaaugcgaauaguugcaauguuauacacucccuuaagaucuaacgguuccggagaugauguuuuuacuguaucaugucgugucuuaacuagacccaguccagauuucgauuuuacauaccuuguaccaccuacaguagaaagcaaaacaaaaccuuuuacacuucccauacugacccuaggugaauuaucaaauucuagauuuccaguaucaauagaucaaauguauacaucuccuaaugaagucauaucaguacaaugccaaaacgguagauguacacuugauggugaacuacaaggaaccacacaauuacaaguaucaggcauaugcgcaucaaaaggagaaguaacagcacacuuacaagauaacgaucaccuauauaauauuacaauaaccaaucuaaauggaucaccauucgaucccucagaagacauaccagcaccauuaggaguaccagauuuucaaggacgaguuuucggaguaauaacacaaagagauaaacaaaacgcugcaggacaaucacaaccagcaaauagaggacacgaugcaguaguaccaacauacacagcacaauauacacccaaacucggacaaguacaaaucggcacauggcaaacagacgaccuuaaaguaaaucaaccaguaaaauucacuccaguaggauuaaacgauacagaacacuucaaccaauggguaguaccuagguaugcaggcgccuuaaaucuaaauacaaauuuagcaccaaguguagcaccaguauucccuggagaaagauuauuauucuuucgauccuaccuaccauuaaaaggagguuacggaaauccagcuauagacugcuuacuuccccaagaauggguacaacauuuuuaucaagaagcugcaccauccaugucagaagucgcccuagucagauacauaaauccagacacuggcagagcacuauuugaagcaaaacuacaucgagcuggauucaugacuguaucauccaauacaagugcaccaguuguaguaccagcaaauggauauuucagauucgacucauggguuaaccaauuuuacucucuagcacccaugggaacaggaaacggaagaagaagaguacaauaa

SEQ ID NO: 33312 - RNA, 1629 nt, Artificial Sequence
  derived and/or modified sequence opt6 from VP1__Norovirus_and/or_Norovirus-like__LC145808
augaaaauggcaucuaacgacgcugcaccaucaacagacggcgcagccggcuuaguacccgaaucaaacaaugaaguuauggcauuagaaccaguagcaggagcagcacuugcugccccaguaaccggacaaacaaauauaaucgacccauggauaagagcaaauuucguacaagcuccuaacggagaauuuacaguauccccaagaaauucaccaggcgaaguauuacuaaauuuagaacuuggaccagaauuaaauccauaucuugcucaucuugccagaauguauaacggauacgcaggagggauggaaguucaaguaaugcuagcaggaaaugcauucaccgccggaaaauuaguauucgcagcaguucccccacacuuuccuguagaaaaucuaucaccacaacaaauaacaauguuuccucauguaauaauugacguacgaacacuugaaccaguacuacucccccuucccgauguucgcaauaauuucuuccacuauaaccaaaaagaugacccuaaaaugcgaauugucgcaauguuauauacaccauuaagaucaaaugguucaggagaugacguauucacaguaucuuguagaguacuaacuagaccauccccagauuuugacuuuacauacuuaguaccaccaacaguagaauccaaaacaaaaccauuuacauuaccaauuuuaacucuaggagaacuaucaaauuccagauuuccagucucuauagaccaaauguacacaucaccaaacgaaguaauaucaguccaaugccaaaacggacgauguacacuagauggagaacuucaaggaaccacacaauuacaaguaucagguauaugcgcuuucaaaggcgaaguaacagcacaccuucacgacaacgaucaccuauacaacguaacaauaacaaacuuaaauggaucuccauucgauccaucugaagacauaccggcaccacuaggaguaccugacuuucaaggaaggguuuuuggaguaauuucccaacgagauaaacauaacgcuccuggccauaacgaaccagcaaauagagcacaugacgcaguaguaccaacauacacugcacaauauacaccuaaauuaggacaaauacaaauaggaacauggcaaaccgacgaucuaacaguaaaucaaccaguaaaauucacucccguaggcuuaaaugacacugaucauuucaaucaauggguaguaccaagauaugcuggugcauuaaaucuaaacacaaacuuagcaccaucaguagcaccuguuuuuccuggggaacgucuucuauucuuucgaagcuauauaccacuaaaaggaggauacggaacuccugcaauugauugucuacuuccacaagaauggguacaacauuuuuaucaagaagccgcucccucaaugucagaaguugcucuaguaagauauauaaacccagauacagggcgagcauuguuugaagcaaaauuacauagagcaggauucaugaccguaucaucuaacacaagugcuccaguagucguaccagcaaauggauauuucagauuugauuccuggguaaaucaauucuacucuuuagcuccaaugggaaccggaaauggaagaagaagaauacaauaa

SEQ ID NO: 33313 - RNA, 1629 nt, Artificial Sequence
  derived and/or modified sequence opt6 from VP1__Norovirus_and/or_Norovirus-like__LC145795
augaaaauggccucaaacgaugcagcacccuccacagacggagcagcagguuuaguaccagaaucaaauaacgaaguuauggcacuagaaccaguagcaggagcagcacuagcagcacccguaacaggucaaacaaacauuaucgaccccuggauccgagcaaauuucguacaagcaccaaauggagaauuuacaguaucaccaagaaauucaccaggagaaguacuauuaaaucuagaacucggcccugaauuaaauccauacuuagcacaucuagcaagaauguacaauggauacgcugguggaauggaaguucaaguuauguuggccgguaacgccuucacagcaggcaaauuaguauuugcagcuguaccaccacauuucccuguagaaaaucuaucaccacaacaaauaaccauguucccacacguaauaauugaugucagaacacuagaaccaguuuuauuaccgcucccagauguuagaaauaacuucuuucauuacaaccaaaaagaugaucccaaaaugagaauaguagcuauguuauauacaccccuaagaucaaauggauccggagacgaugucuuuacaguuucauguagaguacucacaagaccaucacccgacuuugauuucacauaccuaguaccaccuacaguagaaaguaaaacaaaaccuuuuacacuaccaaucuuaacauuaggugaacuauccaacucacgcuuucccguaucaauagaucaaauguauacaucaccaaacgaaguuauuuccguucaaugccaaaacggccgcuguacgcuugauggcgaacuacaaggaacaacucaauuacaaguaucaggcauaugcgcauucaaaggagaaguaacagcacaucuucaugacaacgaucauuuauacaacguuacaauuacaaauuuaaaugguucuccauuugacccaucagaagauauaccagcccccuuagguguaccagauuuccaaggcagagucuuuggugucauuucucaacgugacaaacauaauacaccuggucacaaugaaccagcaaacagagcacacgaugcaguuguaccuaccuauacagcacaauauacuccuaaacucggacaaauacaaauaggaacuuggcaaacagacgacuuaacaauaaaucaaccaguaaaauucacaccugucggacuaaacgacacagaucacuucaaccaauggguuguaccaagauaugcaggcgcccuaaaucuaaauacaaauuuagccccaucaguagcaccuguuuuccccggagaacgacuauuauuuuuccguucauauauaccacuaaaaggcggauauggaacaccagcaauagauuguuuauuaccacaagaauggguacaacauuucuaccaagaagcagcaccaucaauguccgaaguagcucuaguacgauauauuaauccagacacagguagagcauuauuugaagccaaacuacaccgugcaggauucaugacaguaucuaguaauacaucagcaccaguaguuguaccugcaaauggauauuucagauuugauucuuggguaaaucaauuuuacucuuuagcuccaaugggaaccgggaauggaagacgaagaauacaauaa

SEQ ID NO: 33314 - RNA, 1629 nt, Artificial Sequence
  derived and/or modified sequence opt6 from VP1__Norovirus_and/or_Norovirus-like__AB629941
augaaaauggcaaguaaugacgcagcaccaucuacagacggugcagcaggccuagucccagaauccaauaaugaaguaauggcauuagaacccguagcaggcgccgcucuagcugcaccaguaacuggacaaacaaacauuauugacccauggauaagagcaaauuuuguacaagcaccaaacggagaauuuacuguaucaccaagaaacgcaccuggagaaguacucuuaaaccuagaacuaggcccugaacucaauccauaucuagcacaccuugcaagacucuacaacggauacgcaggagguauggaaguucaaguaaugcuagcuggaaacgcuuuuacagcagguaaauuaguauuuccugcuguaccuccacauuuuccaauugaaaaucuaucaccacaacaaauuaccauguuuccucacguaauaauugacguaagaacauuagaaccaguacuacuaccauuaccagauguacgaaacaacuucuuccacuacaaccaaaaagaugauccaaaaaugagaauaguagcaaugcucuacacuccucucagaucaaacggaucaggugacgauguauuuacuguaucaugucguguccuaaccagacccucaccagacuucgacuucacauaucucguaccaccaacaguagaaucaaaaacaaaaccauucacauuacccauauuaacacuaggagaacuaaguaacucaagauuuccagugucaauagaccaaauguauaccucaccuaaugaaguuaucucuguccaaugucaaaauggccgcuguaccuuagacggagaacuacaagguacaacacaacuccaaguaucagguauaugugcauucaaaggagaaguuacagcccaucuccacgacaaugaccaucucuacaauauuacuaucacaaauuuaaaugguucaccuuuugacccaucugaagauauacccgcaccccucgguguaccugacuuccaagguagagucuucgguauaauaucucaacgagacaaacauaauagcccaggacacaaugaaccugccaacagaggacaugaugcagucguuccaacauacaccgcacaauacacaccaaaacuuggucaaauacaaauagguacauggcaaacagacgaccuaaccguaagucaaccuguaaaauuuacaccuguaggauuaaacgacauagaacauuucaaucaauggguaguaccaagauacgcaggagcauuaaaccuaaauacaaaccuagcaccaucaguagcaccuguuuuuccaggcgaacgacuucuuuucuucagauccuacauaccauuaaaaggagguuacggaaacccagcaauagauugucuuuuaccacaagaauggguacaacacuuuuaucaagaagcagcuccaucaaugucagaaguagcauuaguacgauauauaaauccagacacaggacgagcuuuauucgaagcaaaauuacauagagcaggauuuaugacaguuucaucaaacacaucugcacccgucguaguuccagcuaauggauacuuccgcuucgauucuuggguaaaccaauuuuacucacucgcccccaugggaacaggaaaugggagaagaagaguacaauaa

SEQ ID NO: 33315 - RNA, 1629 nt, Artificial Sequence
  derived and/or modified sequence opt6 from VP1__Norovirus_and/or_Norovirus-like__LC145792
augaaaauggccucaaaugaugcugcuccaucuaccgauggagcagcgggucuaguuccagaaucuaauaaugaaguaauggcccuagaacccguagcaggggcugcucuagcagcaccaguaacuggccaaacaaauauaauagauccauggauuagagcaaacuuuguccaagcaccuaacggcgaauuuacugucucuccaagaaacucuccuggagaaguacuacuaaaucucgaacuaggucccgaacuaaacccuuaucuagcacaccuagcaagaauguauaacggcuaugcaggagggauggaaguccaaguaaugcuagcugguaaugcauucacagcaggcaaacugguauuugcagcuguaccaccacacuuuccaguagaaaauuuaucuccacaacaaauuacuauguuuccacauguaauaauagauguaagaacauuagaaccuguacuucuaccuuuaccugacguaagaaauaacuucuuucacuauaaucaaaaagacgaucccaaaaugcgaauagucgcaauguuauauacaccacuuagaucuaacggaucaggagaugacguuuuuacugucucaugcagaguauuaacaagaccaucaccagauuuugacuucacuuacuuaguaccaccaacaguugaaucaaaaacaaaaccauuuacucucccaauauuaacauuaggagaauuaucaaauuccagauuucccguaucuaucgaccaaauguacacaucaccaaaugaaguaauaaguguucaaugucaaaauggaaggugcacucuagauggagaacuacaaggcacaacacaacuacaagucucaggaauuugcgcuuucaaaggagaagucacagcacaucuacacgacaacgaccaucuauauaacguaacaauuacaaaccuaaauggaucaccauuugacccaagcgaagacauaccagcaccuuuagguguuccagauuuucaaggaagaguauuugguguaauuucacaacgcgacaaacauaacacaccgggacauaaugaaccagcaaauagagcccaugacgcaguagucccuacauacacagcacaguacacaccaaaauuaggacaaauucaaauaggaaccuggcaaacugaugauuuaacaguaaaucaaccaguaaaauuuacaccagucggccuaaaugauacagaucauuuuaaucaauggguacuaccaagauacgcaggagccuuaaaucuaaacacaaaucuagcaccuucaguagcucccguuuucccaggagaaagauugcuauuuuuccgaucuuauauaccacuaaaaggcggauauggaacaccggcaauagacuguuuauuaccacaagaauggguacaacacuuuuaucaagaagcagcacccucaaugucagaaguagcccuaguaagauauauaaacccagauacugguagagcuuuauuugaagcaaaauuacauagagcaggcuucaugacugugaguucaaacacaucagcaccuguaguagucccagcaaacgguuauuucagauuugacucauggguaaaucaauucuauucacuagcacccaugggaacaggcaauggaagaagacgaauccaauag

SEQ ID NO: 33316 - RNA, 1629 nt, Artificial Sequence
  derived and/or modified sequence opt6 from VP1__Norovirus_and/or_Norovirus-like__LC145786
augaaaauggccucaaacgacgccgcaccuuccacugacggcgcagcaggucuaguaccagaaucaaacaaugaaguuauggcacuagaaccaguagccggagcagcccuagcagcuccaguaacuggacaaacaaauauaauagauccauggauaagagcaaauuuuguacaagcaccaaauggugaauuuaccgucuccccucgaaauucuccaggagaaguauuauuaaacuuagaacuaggcccagaauuaaaucccuauuuagcacaccucgcaagaauguacaacggauaugcuggaggaauggaaguacaaguaauguuagcaggaaacgccuuuacagcaggcaaacuuguauucgcagcaguaccaccacauuucccaguagaaaauuuaucaccacaacaaaucacaauguucccacaugucauaauagauguaagaacacuagaaccaguacucuuacccuuaccagacguaagaaacaacuucuuucauuacucacaaaaagacgacccaaaaaugagaauuguugcaaugcuuuacacaccauuaagaucaaauggaucuggugacgauguauucacagucuccugccgaguucuaacuagaccaucuccagacuucgacuucacguaccuaguaccaccuacaguagaaucaaaaacaaaaccauucacccucccaauauuaacauuaggcgaacuaucuaauuccagauuucccguaucaauagaccaaauguacacaucuccaaaugaaguaaucucaguacaaugccaaaauggcagaugcacuuuagacggagaauuacagggaacgacacaacuacaaguaucaggcauaugcgcauuuaaaggagaaguaacagcucacuuacaugauaaugaucauuuauauaauguaacaauaacaaaucuaaacggauccccauuugacccaucagaagauauaccagcaccauuaggcguaccagacuuccaaggucgaguguuuggggucauaucccaaagagacaaacacaacaccccgggacacaaugaaccugcaaaucgagcacaugaugcagucguaccuaccuauaccgcucaauauacaccaaaacucggacaaauucaaauaggcacauggcaaacagacgauuuaacaguaaaucaaccaguaaaauucacaccaguaggauuaaacgacacagaccauuuuaaucaaugggucgucccuagauaugcaggagcacuaaacuuaaauacaaaccuagcaccaucaguagcuccaguuuuuccuggagaaagauuacuauuuuucagauccuauauaccucuaaaaggaggauauggaacacccgcaauugacuguuuacuaccacaagaauggguucaacauuucuaucaagaagcagcacccucuaugucagaaguggcuuuaguucgauacauaaauccagacacugguagagcauuauucgaagccaaauuacacagagcaggauuuaugacaguaucaucaaauacaucagcaccaguaguaguacccgccaauggauauuucagauuugacuccuggguaaaccaauuuuacucacuagcaccaaugggaacaggaaacggaagacgacgaauacaauaa

SEQ ID NO: 33317 - RNA, 1629 nt, Artificial Sequence
  derived and/or modified sequence opt6 from VP1__Norovirus_and/or_Norovirus-like__LC145793
augaaaauggcuucuaacgacgcugcgccgucaacagacggagcagccggauuaguaccugaaagcaacaaugaagucauggcucuagaaccaguagcaggagucgcauuagcugcaccagucaccggacaaacaaauauuauagacccauggauuagagcaaacuucguucaagcaccaaauggugaauuuacaguauccccuagaaauaguccaggagaaguacuccuaaaccucgaacuuggcccugaacuaaaucccuauuuagcccacuuagcaagaauguauaacggauaugccggaggaauggaaguacaagucaugcucgcugguaacgcuuucacagcaggaaaauuaguauuugccgcuguuccaccucauuuuccaguagaaaaucuaucaccccaacaaauaaccauguucccacauguaauaauagauguaagaacacuagaaccaguauuauuacccuuaccagacguaagaaacaacuucuuucacuauaaucaaaaagaugaccccaaaaugagaauaguagcaauguuauauacuccauuaagauccaacgguucaggcgacgauguauuuacaguuucaugccguguacuaaccagaccaucaccugacuuugauuuuaccuacuuaguaccaccaacagucgaaucaaaaacaaaacccuucacauuaccuauacuaacucuaggcgaacuaucuaacaguagguucccaguuuccauagaccaaauguauacaucacccaaugaaguaauaucaguacaaugucaaaauggcagaugcacuuuagacggagaauugcaagguacuacacaacuacaaguaagcgguauaugcgcauucgaaggagagguaacagcacacuuacaugauaacgaucaucucuauaauguuacaauaacuaacuuaaauggaucacccuucgauccauccgaagauauaccagccccauuaggaguuccagacuuccaaggaagaguauucggcguaauaucacaaagagacaaacauaauacaccaggacacaaugaaccagcaaauagagcacaugacgcaguaguaccuacauauacagcacaauacacaccaaaauuaggacaaauacaaauaggcacauggcaaaccgaugaucuuacaguaaaccaacccguaaaauucacuccaguaggacuaaacgauacugaccauuuuaaucaaugggucgucccaagauaugcuggagcauugaauuuaaacacaaacuuagcaccaucaguagcuccaguauuuccaggugaaagacuauuauuuuucagauccuauauaccacuaaaaggaggauauggaaccccagcaaucgauugucuacuuccacaagaauggguccaacauuuuuaccaagaagcagcaccauccauguccgaaguagcacuugucagauauauaaaucccgauacagguagagccuuauucgaagcaaaacuacauagggccggauucaugacaguuucaucaaauacaucagccccaguuguuguaccagcaaacgguuacuucagauuugacucuuggguaaaucaauuuuacucucuagcacccaugggaaccggcaauggaagaagaagaauacaauga

SEQ ID NO: 33318 - RNA, 1629 nt, Artificial Sequence
  derived and/or modified sequence opt6 from VP1__Norovirus_and/or_Norovirus-like__LC145791
augaaaauggccucaaacgauguugcucccucaacugauggcgcagcuggauuagucccugaaagcaauaaugaagucauggcuuuagaaccagucgcaggagcagcacuagcugcccccguaaccggacaaacaaauauaauagauccauggauaagagcuaacuuuguucaagcacccaauggagaauuuacaguuucuccaagaaauucacccggagagguauuacucaaccuugaauuaggaccugaacuaaauccauaucuagcucaucuagcaagaauguauaauggauacgcaggaggaauggaaguacaagucauguuagcuggaaaugcuuuuaccgcaggaaaacucguuuuugcagcaguaccaccacauuuccccguagaaaauuuaucaccacaacaaauaaccauguuuccacauguaauaauagacgucagaacauuagaaccagucuuauuaccauuaccagauguacgcaacaacuucuuccauuauaaucaaaaagaugacccuaaaaugagaauaguagcaauguuauauacuccauuaagaucaaauggaucaggcgaugauguauuuacaguuaguuguagaguacuaacucgaccaucaccagauuucgauuuuacuuaucuuguuccaccaacaguagaaucaaaaacaaaaccauuuacucucccaauauuaacauuaggugaauuaucuaacucucgauuuccaguauccauagaccaaauguauacuucacccaaugaaguaauaucaguccaaugucaaaauggaagauguacucuugacggugaauuacaaggaaccacacaacuucaggugaguggaauuugugcauuuaaaggagaaguuacagcacacuuacacgacaacgaccaccuguauaauguaacuaucacaaacuuaaauggaucuccuuucgauccaagugaagauauaccagcuccacuaggaguacccgauuuucaaggaagaguauucggaguuauuucacaaagagacaaacauaauacacccggacacaacgaaccugcaaaucgugcucacgaugcaguuguaccaacauauacagcacaauauacaccuaagcuaggacaaauacaaaucggaacauggcaaacagaugaucuaacagucaaccaaccagucaaauuuacaccuguaggauuaaaugauacagaucauuuuaaucaauggguaguaccucgauacgcaggagcucuaaaccuaaacacaaaucuagcaccaagcguagccccaguauuuccaggagaaagacuauuauuuuucagaucauacaucccauuaaaaggaggauauggaacacccgcaauagacuguuuauuaccacaagaauggguacaacacuuuuaucaagaagccgcaccuuccaugucagaagucgcauuaguaagauacauaaacccagauacaggacgagcacuuuucgaagccaaacuccaucgugccggauuuaugacaguuaguucuaauacaucugcuccaguaguuguaccugcaaaugguuauuuucgauuugauaguuggguaaaucaguuuuacuccuuagccccaaugggaacaggaaauggacgaaggcguauucaauaa

SEQ ID NO: 33319 - RNA, 1629 nt, Artificial Sequence
  derived and/or modified sequence opt6 from VP1__Norovirus_and/or_Norovirus-like__LC145788
augaaaauggcaucaaaugaugcagcaccaucaacugacggagcugcaggauuaguaccagaauccaauaaugaaguaauggcuuuagaacccguugcaggagcugcuuuagcagcgccuguuacuggacaaacaaacauaauagacccauggauaagagcaaauuuuguacaagcccccaauggugaauuuaccguuucaccaagaaauagcccaggagaaguacuuuuaaaccuagaacuuggacccgaauuaaauccauauuuagcucaucuagcacgaauguacaacggauacgcugguggaauggaaguacaaguaaugcuagcaggaaacgcauuuacagcaggaaaauuaguauucgcagcaguacccccacauuuuccagucgaaaaucuaucaccucaacaaauaacuauguuuccacacguaauaauagacguaagaacauuagaaccuguauuauuaccauuaccagaugucagaaauaacuucuuucacuacaaccaaaaagaugaucccaaaaugaggauaguagcuaugcucuacacaccauuaagaucaaacgguucuggcgaugauguauucaccguaucaugcagaguacuaacacgaccuucgccagacuuugacuuuacauaccuaguaccaccaacaguugaaucuaaaacaaaaccauuuacauuaccaauccuaacacuaggagaacuuucaaacaguagauuuccuguaucaaucgaucaaauguauacaucacccaacgaaguaauaucaguucaaugccaaaacggacgauguacacuagauggagaauuacaaggaaccacccaauuacaaguaucagguauaugugcauucaaaggagaaguaaccgcacaccuucaugauaacgaucaccuauauaacguuaccauaacaaaccucaacggcucaccauuugaucccagugaagacaucccugcaccacucggaguaccagacuuucaaggccguguauuuggaguaauuucccaaagagacaaacacaauaccccaggacauaaugaaccagcuaacagagcucaugaugcaguaguaccaacauacaccgcccaauauacacccaaauuaggucaaauccaaauuggaacauggcaaacugaugauuuagcaguaaaccaaccaguaaaauuuacaccuguaggauuaaaugauacagaccauuuuaaccaaugggucguuccacgauaugcaggagcucuuaaucuaaacacaaacuuagcaccaucaguagcaccagucuucccuggcgaacgacuacuauucuucagaucuuacauaccauuaaaaggaggauauggaacaccagcaauagauugcuuacuuccacaagaauggguacaacauuucuaucaagaagcagcuccaucaaugucagaaguagcauuaguacguuauauaaacccagacacaggacgagcauuauucgaagcaaaauuacacagagcaggauucaugacaguuucauccaauacauccgcaccaguaguuguccccgcaaauggcuauuuccguuuugauucauggguaaaccaauucuacucuuuagcaccaaugggaacaggcaauggaagaagaagaauacaauaa

SEQ ID NO: 33320 - RNA, 1629 nt, Artificial Sequence
  derived and/or modified sequence opt6 from VP1__Norovirus_and/or_Norovirus-like__LC145803
augaaaauggcuucaaacgaugcugcuccaucuacagacggagcugcagguuuaguuccagaaucaaauaaugaaguaauggccuuagaaccuguagcaggagcagcuuuagcagcaccagucacaggacaaacaaauauaauagacccuuggauucgagccaacuucguccaagcaccuaauggagaauuuacaguuagccccagaaauucaccaggagaaguacuacuuaaccucgaacucggaccagaauuaaaccccuaucuagcucacuuagccagaauguauaacggauacgcaggaggaauggaaguacaaguaaugcucgcuggcaaugcauuuaccgcaggaaaauuaguauuugcggcuguuccaccacacuuuccuguagaaaaccuaucaccucaacaaauaacaauguuuccacauguaauaauagacguaagaacccuagaaccaguacuacuuccccucccagacguaagaaauaauuucuuccauuauaaucaaaaagaugacccuaaaaugagaaucguagcaaugcuauacacaccacuaagaucaaacggcuccggagaugauguauucacagucuccugucgaguccuaacaagaccaucaccugacuuugauuuuacauaccuaguaccacccacaguagaaucuaaaacuaaaccuuuuacacuaccaaucuuaacauuaggcgaacuaucaaacuccagauuuccaguuucaauagaccaaauguauaccucaccuaacgaaguaaucucaguacaaugucaaaacggaaggugcacacuugacggagaauuacaaggaacaacacaacuacaagucucagguauaugugccuuuaaaggagaagucacugcccauuuacaugacaaugaccaucuauauaacguaaccauuacaaaucuaaauggaucaucauuugauccauccgaagacaucccagccccacuaggcauaccagauuuucaagguagaguauuuggaguaauuucccaacgagauaaacauaacacuccuggacacaaugaaccagcaaaccgugcacaugaugcuguaguaccaaccuacaccgcacaauacaccccuaaauuaggucaaauacaaauaggcacauggcaaacagacgauuuaacaguuaaucaaccaguaaaauuuacaccuguugguuuaaaugauaccgaccacuuuaaccaauggguaguacccagauaugccggugcacuaaaccucaauacaaaucuagcaccuucuguagccccaguuuuuccaggagaaagauuauuauucuuucgaucauauauaccucuaaaagguggauauggaacaccagcaauagacugccuauuaccacaagaauggguacaacauuuuuaucaagaagcugcaccaucuauguccgaagucgcauuaguaagauauauaaacccagauacuggucgagcucuauuugaagccaaacuccacagagcaggauuuaugacaguauccucaaacaccucugcaccaguaguaguaccugcaaacggauauuuuagauuugauucauggguaaaccaauuuuacucacuugcaccaauggguacagguaauggaagaagacgaauacaauga

SEQ ID NO: 33321 - RNA, 1629 nt, Artificial Sequence
  derived and/or modified sequence opt6 from VP1__Norovirus_and/or_Norovirus-like__LC145804
augaaaauggcaucaaaugaugcagcaccaucaacagacggagcagcuggccuagucccagaaucuaauucagaaguaauggcauuagaaccaguugcaggagcagcacuagcagcaccaguaacaggacaaacaaacauaauugacccauggaucagagccaauuuuguacaagcaccaaacggagaauuuacaguauccccucgaaauucaccuggagaaguccuauuaaaccuagaauuaggaccugaauuaaaucccuaccucgcacaucucgcacgaauguauaacggauacgcaggaggaauggaaguacaaguuauguuagcaggaaaugcauuuacagcaggaaaauuaguauucgccgcaguuccaccucauuucccaguagaaaaucuaaguccacaacaaauaacaauguucccucauguaauaauugauguccgaacucuagaacccguacuauugccccuaccagauguuagaaauaauuucuuccauuauaaucaaaaagaugauccuaaaaugagaauaguagcuauguuauacacuccacuaagaucuaauggcucaggagaugauguauucacagucucauguagaguacugacuagaccaucaccagacuucgauuuuacauaccuaguaccaccaacagucgaaucuaaaacaaaaccauuuacuuuacccauacuaacauuaggagaacuaagcaauucaagauuuccaguaucaauugaccaaauguauacauccccaaaugaaguaauaucaguacaaugccaaaacggaagauguacacuagauggagaacuucaaggaacaacacaacuccaaguuuccggaauaugugccuuuaaaggcgaaguaacagcacauuuacaugauaaugaucaccuauacaacguaaccauuacaaaccuuaacggaucuccauucgauccaagugaagacaucccagcacccuuaggaguacccgacuuucaaggacgugucuucggcguaaucagucaaagagauaaacauaacacaccaggacauaaugaaccagcaaacagagcacacgaugcaguuguaccaacauacacagcacaauauacaccuaaacuaggacaaauacaaauaggaacuuggcaaacagacgauuuagcaguuaaucaaccaguaaaauucacaccaguaggacuaaaugauacagaucacuuuaaccaauggguagucccaagauacgcaggggcacucaacuuaaacacaaacuuagccccuuccgucgccccaguauuuccaggagaacgacuauuauucuuuagaucauauauucccuuaaaaggaggauauggaacuccagcuauagauugcuuauuaccucaagaauggguacaacacuuuuaucaagaagcagccccaucuaugagugaaguagcuuuaguacgauacauaaauccagacacugguagagcguuauucgaagcaaaacuacaucgagcuggauuuaugacaguaucaucaaauacaucugccccaguaguuguaccagcaaauggauauuuucguuucgacucaugggucaaucaauucuacucacuagcaccaauggguacuggaaaugguagaagaagaauccaauaa

SEQ ID NO: 33322 - RNA, 1629 nt, Artificial Sequence
  derived and/or modified sequence opt6 from VP1__Norovirus_and/or_Norovirus-like__LC145801
augaaaauggccucuaacgaugccgcaccuucuacagacggagcagcaggacuuguuccagaaucuacaaaugaaguaauggcucuagaaccuguugccggagcagcucuagcagcaccagucacuggccaaacaaauaucauagaucccuggaucagagcuaauuuuguccaagcuccaaacggugaauuuacuguuucaccucgaaauucaccuggugaaguauuauuaaauuuagaauuaggaccagaacuuaauccauacuuagcacaucucgcucgaauguauaaugguuaugcaggcggaauggaaguacaagucaugcuagcuggcaaugcuuuuacagcaggcaagcuaguauuugcagcagucccaccucauuuuccaguagaaaauuuaucuccacagcaaauaacaauguuuccacauguuauaauugacguuagaacauuagaaccaguacuccuucccuugccagauguuagaaauaauuucuuucauuauaaccaaaaagaugauccaaaaaugcgcauaguugcaauguuauacacaccacuaagaucuaauggcucuggagaugacguauucacuguuucuuguagaguauuaacaagaccuuccccagacuuugauuuuacauauuuaguaccaccaacaguagaaucaaaaacaaaaccauuuaccuuaccuauccuaacacuaggugaacuaucaaacagucgauucccagucucaauagaucaaauguacacauccccuaaugaaguaauaucaguacaaugucaaaacggaagauguacacuagacggagaauuacaagguacuacccaauuacaaguauccggaauaugcgcauuuaaaggagaagucacugcacacuuacacgauaaugaccauuuauauaaugucacaauaacuaauuuaaaugguucaccuuucgaucccucagaagauaucccagcaccucuaggugcaccugauuuucaaggacgaguauuuggaguaaucucccaaagagauaaacauaauacaccaggacauaaugaacccgcaaaucgagcucaugacgcaguaguacccacauacacagcccaauacaccccaaaauuaggacaaauacaaauaggaacguggcaaacagacgacuuaacuguaaaucaaccaguaaaauucacaccaguaggacuaaaugauacagaccacuuuaaucaauggguaguuccuagauacgcaggagcacuaaacuuaaauacuaacuuagcacccucaguugcaccaguauuuccaggagaaagacuauuauucuuuagaucauauauaccauuaaaaggcggauaugguacacccgcuauagacugccuacucccacaagaauggguccaacauuuuuaccaagaagcugcuccaucaaugucagaaguagcacucguuagauauauaaacccagacacaggcagagcacuauuugaagcaaaacuccaucgagccggauuuaugacaguuucaucaaacacaagcgcaccuguaguaguaccugccaaugguuauuuuagauuugauucauggguaaaucaauuuuacucauuagcaccaaugggaacuggaaauggacguagacgaauacaauaa

SEQ ID NO: 33323 - RNA, 1629 nt, Artificial Sequence
  derived and/or modified sequence opt6 from VP1__Norovirus_and/or_Norovirus-like__LC145802
augaaaauggcaucuaaugaugcagcacccucaacagacggugcagcagguuuaguuccagaaucuaauaacgaagucauggcacuagaaccaguggcuggugcagcacuugcagcuccuguaacaggacaaacuaauauaauagauccauggauacgagcaaauuucguacaagcaccuaacggugaguucacaguaucaccaagaaauucaccuggagaaguuuuauuaaauuuagaauuagguccagaauuaaauccuuauuuagcacaucuagcaagaauguauaauggacacgcuggaggaauggaaguacaaguaauguuagcuggcaaugcauucacagcuggaaaauuaguuuuugccgcaguaccaccacauuuuccaguagaaaauuuaucuccgcaacaaauaacaauguuuccccacgucauaaucgauguuagaacauuagaaccaguucuacuaccauuacccgauguaagaaacaauuucuuccacuauaaccaaaaagacgacccaaaaaugagaauuguagcuaugcucuauacaccacuaagaaguaacggaucuggagacgaugucuucacaguuucauguagggucuuaacuagaccaucaccagauuucgaauuuacuuacuuaguuccaccuacuguugaaucuaaaacaaaaccauucacacuaccaauauugacacuaggagaauuaucaaacucaagauuuccaguuucaauugaccaaauguauacaaguccaaacgaaguuauaucaguucaaugccaaaacgguagauguacacuagacggugaacuacaaggaacaacacaauuacaagcaucagguaucugugcauucaaaggagaaguaacugcacacuuacacgacaacgaucaucuauauaacguaacaauaacuaauuuaaauggaucccccuuugacccaucugaagauauaccagcuccccuaggaguaccagacuuucaaggaagaguuuucgguguaauaucccaaagagacaaacauaaugcaccaggacacaaugaaccugcaaaccgagcucaugaugcaguaguaccaacauauacagcucaauauacuccaaaauuaggccaaauacaaauuggaacauggcaaacagacgaucuaacaguuaaucaaccaguaaaauuuacaccuguuggacuaaacgauacugaucauuuugaucaaugggucguacccagauaugcaggcgcacuaaacuuaaauacaaauuuagcaccaucaguagcucccgucuuuccaggagaaagauuauuauucuucagaucuuauauucccuuaaaaggaggauauggaaccccugcaauagauugccuacuaccacaagaaugggugcaacauuuuuaucaagaagcagcccccucaaugucagaaguagcauuaguccgauacauaaauccugauacaggccgcgcccuauucgaagcaaaauuacaucgagcaggauuuaugacaguaucaucuaacacaucagcaccuguagucgucccagcuaauggauacuuucgauucgacucauggguaaaccaauuuuauucuuuagcccccaugggaacagguaauggaagaaggagaauacaauaa

SEQ ID NO: 33324 - RNA, 1629 nt, Artificial Sequence
  derived and/or modified sequence opt6 from VP1__Norovirus_and/or_Norovirus-like__LC145805
augaaaauggcaucuaaugaugcugcaccaucaacagauggcgccgccggccuuguaccagaaagcaauucagaaguaauggcuuuagaaccuguugcaggagcagcauuagcagcaccaguuacaggacaaacaaauauuauagacccauggaucagagcaaauuucguccaagccccaaacggcgaauuuacaguaaguccuagaaacucaccuggagaaguauuauuaaaccuagaacuaggaccagaauuaaacccuuauuuagcacaucuagcaagaauguauaacggauacgcaggaggaauggaaguucaaguaaugcuagcaggaaaugcauucacagcaggaaagcuaguauucgcagcuguaccaccacauuuucccguugaaaauuuaucaccucaacaaauaacuauguuuccacauguaauaauagauguaagaacacuagaaccaguacuacuaccauuaccugauguaagaaacaauuucuuccauuauaaccaaaaagaugauccuaaaaugagaauaguagcaaugcucuauacaccacuuagaucuaacggaucuggagaugauguguucaccguaucaugcagaguuuuaacaagaccaucaccagacuuugacuuuacuuacuuaguacccccuacuguagaaaguaaaaccaaaccauuuacuuuaccaauuuuaacauuaggggaauuaucaaauucaagauuuccuguaucaauagaccaaauguacacuucaccaaaugaaguaauaucaguacaaugucaaaauggaagauguacuuuagacggagaauuacaaggcaccacucaacuccaaguaaguggaaucugugcauuuaaaggcgaaguuacggcacacuuacaugauaacgaucaucucuauaauguuacaauaacaaaccuaaauggaucuccauuugauccaucugaagauauaccagcgccacuagguguaccagauuuccaaggaagagucuuugguguaauaagucaacgagauaaacauaauacaccaggucacaacgaacccgcaaacagagcacaugaugcugucgucccaacauacacagcucaauauacuccaaaacuaggucaaauacaaauuggcacauggcaaacagacgaccuagcaguaaaccaaccaguaaaauuuacuccaguaggacucaacgauacugaccacuuuaaccaauggguaguaccaagauaugcuggagcauuaaaucuaaacacaaaucucgcaccaagcguagcuccaguuuucccaggugaacgacuacuuuucuuuagaucuuacauuccauuaaaaggaggauacggaacaccagcaauagacugucuccuaccacaagaauggguucaacauuuuuaccaagaagcagcaccuucuaugucagaagucgcauuaguacgauauauuaauccugacacugguagagcucuauuugaagcaaaauuacacagagucgguuuuaugacaguuucuucuaauacuucagcaccaguuguaguccccgcaaauggauacuuuagauuugauucauggguaaaucaauuuuauucucucgcuccgauggguacaggaaauggaagaagaagaauacaauaa

SEQ ID NO: 33325 - RNA, 1629 nt, Artificial Sequence
  derived and/or modified sequence opt6 from VP1__Norovirus_and/or_Norovirus-like__LC145797
augaaaauggccucaaaugaugcagcuccaucuacugauggagccgcuggacucgucccugaaucaaacaaugaagucauggcacuugaaccaguagcaggaguagccuuagcagccccaguaaccggucaaaccaauauaauagacccauggauaagagcaaacuuuguucccgcacccaacggagaauuuacaguaucaccaagaaacucaccuggcgaaguacuccucaacuuagaauuaggcccagaacuaaacccauaucuagcacaucucgcaagaauguauaacggcuaugcaggagguauggaaguccaagucaugcuagcagguaaugcauuuacagcuggaaaauuaguuuuugcagccgucccuccacauuuuccuguagaaaaucuauccccacaacaaauaacuauguucccucauguaauaauagauguaagaacuuuagaaccaguccuauuacccuuaccagaugucagaaacaacuucuuucacuauaaucaaaaagaugacccaaaaaugagaauaguugcuauguuauacacaccacuacgcaguaacggauccggagacgacgucuucaccguuucaugcagagucuuaacccgaccaucaccugacuucgacuuuacauauuuaguacccccaacaguugaaucaaaaaccaaauuauucacauuaccaauauuaacauuaggagaauuauccaauucaagauuuccaguaucaaucgaucaaauguauaccucacccaaugaagucaucucuguacaaugucaaaacggccgcuguacauuagacggagaauuacaaggcacuacacaauuacaaguauccggcauaugugcauuuaaaggagaaguaacagcucacuuacacgacaacgaucacuuauauaauguaacaauaacaaacuuaaacggaucaccauucgacccaucagaagauauaccagcaccucuaggaguaccagacuuccaaggucgaguauuuggagucauaagucaacgagauaaacauaauaucucuggacacaacgaaccagcaaacagagcacacgacgcagucguacccacauauaccgcacaauauacacccaaacucggacaaauucaaaucggaacauggcaaacagaugacuuaacaguaaaucaaccaguaaaauucacaccaguuggauuaaacgauacagaccacuucaaccaauggguaguaccgagauacgccggagcacuaaacuuaaauacaaaccuagcccccucaguagcaccuguauuuccaggcgaaagacuacuauuuuucagaucauacauaccacuaaaaggaggcuacggcacaccagccauagauugccuacuaccacaagaauggguucaacacuucuaucaagaagcagcuccaucaaugucugaaguagcuuuaguacgauauauaaacccagacacaggcagagcccuauucgaagcaaaacuacauagagcuggauucaugacaguaucuucuaauacuucagcaccaguaguagucccagcaaauggauauuuuagauuugacucuugggucaaucaauuuuacucucucgcacccaugggaacaggaaauggaagacgacgaauccaauaa

SEQ ID NO: 33326 - RNA, 1629 nt, Artificial Sequence
  derived and/or modified sequence opt6 from VP1__Norovirus_and/or_Norovirus-like__LC145806
augaaaauggcaucaaacgaugcagcaccuuccacugauggagcagccggauuaguacccgaaucaaacagcgaaguaauggcucuagaacccguugcuggugcagcacuagcagcaccaguaacuggucaaacaaauauaauagauccuuggauuagagcaaucuuuguacaagcaccaaauggagaauuuaccguaucuccaagaaauucaccuggagaaguacuacuaaaucuagaacuaggaccagaacuaaauccauauuuagcccaucuagcccgaauguauaacgguuacgcuggaggaauggaaguccaaguaauguuagcaggcaaugcauuuaccgcuggcaaauuaguauucgcagcaguaccaccacauuuuccaguagaaaaucuaucgccacaacaaauaacaauguuuccacacgucauaauagauguucgaacacuagagccaguucuacuaccuuuaccugacguaagaaauaacuucuuucauuauaaccaaaaagaugauccaaaaaugcgaauaguagcaaugcucuacacaccacuaagaucaaacggaucaggagaugacguauuuacaguaucauguagaguauuaacacgaccaucaccagacuuugacuuuacauaucuuguaccaccuaccguagaaucaaaaacuaaaccauuuacuuuaccaauacuaacauuaggagaacuuucaaacucaagauuuccagugucgauagaucaaauguauacaucucccaaugaaguaauuucuguacaaugucaaaacgguagauguacauuagauggagaauuacaaggcacaacacaauuacaaguauccggaauaugugccuuuaaaggugaaguuaccgcucauuuacacgauaaugaucaucuauacaauguaacaaucacaaaccuaaacgguaguccauucgacccuucagaagauauaccagcaccauuagguguaccagacuuucaaggacgaguauucggaguaauaucacaaagagauaaacauaacacaccuggacacaaugaaccagcaaauagagcacaugaugcaguaguaccaacauacacagcacaauauacaccaaaacuuggccaaauacaaauaggaaccuggcaaacugacgaucuagcaguuaaucaaccagucaaauuuacaccaguaggacuuaacgauacagaccauuucaaccaaugggugguaccaagguacgcaggagcacuaaacuuaaauacaaaccucgcaccaucaguagccccaguauucccaggagaaagauuauuauucuucagaucauacauaccauuaaaagguggauauggaacaccagccaucgacugccuauuaccucaagaauggguccaacauuucuaccaagaagcagcacccaguaugucagaaguugccuuaguccgauauauaaauccagauacaggcagagcacuauuugaagcgaaauuacacagagcagguuuuaugacuguuucaucuaacacaagcgcaccaguaguagucccagcaaacggauacuuucgcuuugauucuuggguaaaucaauucuacucacuagcaccaaugggaacaggaaacggucgaagacgaauacaauaa

SEQ ID NO: 33327 - RNA, 1629 nt, Artificial Sequence
  derived and/or modified sequence opt6 from VP1__Norovirus_and/or_Norovirus-like__KU306738
augaaaauggcaucaaacgacgcagcuccauccaaugacggagcaucaagucuaguaccagaaauaaacaacgaaacaauggcauuagaaccaguugcaggaggagcaauagcagcacccuuaacaggccaaacuaacuucaucgaucccuggauacgaaacaauuauguacaagcaccaaacggagaauuuacaauaucaccaagaaacucuccaggagaaauauuacuaaacuuagaauuaggaccugaacuaaacccauuccucgcacaccuagcaagaauguacaauggcuacgccggaggaguagacguacaaguaauaauggcagguaaugcauucacagcaggaaaaguaauauucgcugcaguaccaccccacuuucccguagaaucacuuagcccaccccaaauaacaauguucccacacauaaucguagauguucgcacacuugaaccaauaaauauacccauaccagacguccgcaauaauuucuuccauuacaaucaaaacaacgaaccaagaaugcgucuaguugccaugcucuauacaccacuaagaucuaacggaucugcagacgacguauuuacagucucuugcagaguauuaacaaaacccucagcagacuuugaauuuaauuaccuaguaccaccaaccguagaaagccgaacaaaaccauucaccauaccuauauuaaccauaggagaaaugacuaauucaagauuccccgucgcaauagauaugcuuuauacaucacccacagaaaacuuaguaguacaaccacaaaacggacgauguacauuagaaggagaacuacuaggcacaacacaauuaguaacaccaaauaucugcucacuacguggagcaauuacaggucaugaaggaaaugacgacaaucacaaauggcacaugaccgucacaaacccaaacggaucagcauuugacccaacagaagauguaccugcaccccuuggaacaccagacuuuauuggagacguauacggaguauuaucacaaagaaacagaaauauagaaagcggacaaacugcaccagcaaaucgaucccacgaagccguaauaucaacaagaucaaacaaauuuacacccaaacuaggauccguaaugauagcaacauggaacacaaacgacguagaaaaucaacccacaaaauuuacaccagucggccuagaaaauccaggaucuuuccaccaaugggaacuuccaaacuacucaggagcacuaacccuaaacaugggacuugcaccaccugucuucccaacauaucccggcgaacaacuauuauucuucagaucauauauaccucuaaaagggggauuuggaaauaguauaauagacugucucguaccacaagaauggauacaacacuucuaccaagaaucagcaccaucacaaacagacguugcacuaauaagauauguaaaucccgaaacaggacgaguauuauucgaagcaaaacuacauagacaaggcuucauaaccguagcaaaaacaggugauucaccaauaaacguaccagcaaacgguuacuucagauuugacucauggguaaacuccuucuacucauuagcaccaaugggaaccggaaacggcagaagaagaauccaauaa

SEQ ID NO: 33328 - RNA, 1629 nt, Artificial Sequence
  derived and/or modified sequence opt6 from VP1__Norovirus_and/or_Norovirus-like__KM036380
augaaaauggccucuaaugacgccgcaccaucaaaugacggagccgcuuccuugguuccagaagccauaaaugaaaccaugccacuagaacccguagcaggagcauccauagcagcaccaguagcaggacaaacuaauaucauagauccauggauccgaacaaacuuuguacaagcacccaauggagaauuuacugucucuccaagaaacucuccaggagaaauauuacuaaacuuagaacucggaccagauuuaaacccauauuuagcacacuuaucaagaauguauaacgguuacgcuggaggcgucgaaguacaaguccuacuagcaggaaaugccuucacugccggcaaaauauuauucgcagcaauaccacccaacuucccaguagacaugauaucaccagcacaaauuacaaugcuaccacacuuaauaguugauguacgaacauuagaaccuauuaugauaccucucccagauguaagaaacguauucuaucacuuuaauaaccaaccucaacccagaaugcgauuaguagcaaugcuauauacaccauuaagaucuaacggcucaggugacgacguuuuuacaguaagcuguagaguacuaacacgcccaacaccagacuucgaguucauauaccuagucccaccaucaguugaaucaaaaaccaaaccauucaccuuaccaauauuaacuauuucagaacuaacaaauucacgcuucccuauacccauagaacaacuauacacagcuccaaacgaaaacaaugucguacaaugucaaaacggaagaugcacucuagauggagaacuucaaggaacaacacaacuacucucaagcgcaguuugcucauauagaggaagaacaguagccaauucaggugacaacugggaucaaaaccuauuacaacuaacauacccaucaggugcaucauacgaucccacagaugaaguaccagcaccuuuaggaacacaagacuucucaggaauauuauauggaguauuaacacaggacaacguaucagaaggcacaggagaagccaaaaaugcaaaaggcguauacauaucaacuacaucuggcagauuuacaccaaaaauaggaacaauaggcuuacauucaauaaccgaaaauguacauccaaaucaacaaucaagauuuacaccuguuggaguagcacaaaacgaaaacacucccuuucaacaauggguccuaccacauuaugccggagcauuagcccuaaauacuaaucuagcaccagcaguagcaccaacauuucccggagaacaauuauuauucuuuagaucaagagucccauguguacaaggauuaagaggacaagacgcuuuuauagauugucuccuaccacaagaauggguaaaccauuucuaucaagaagcagcuccaucacaagcugauguagcauuaauuagauacguaaauccugauacaggaagaacucucuucgaagcaaaauuacaucgaucaggauucauaacuguaagucacacgggaaacuacccccuaguuguaccaccuaacggacauuuucgauuugacuccuggguaaaccaauucuauucauuagcuccaaugggcacaggaaauggacguagaagaguacaauaa

SEQ ID NO: 33329 - RNA, 1629 nt, Artificial Sequence
  derived and/or modified sequence opt6 from VP1__Norovirus_and/or_Norovirus-like__AY113106
augaaaauggcuucaaacgacgcagcccccuccaacgacggagcagccucauuaguaccagaagguauuaaugaaacaaugccacuugaaccaguagcuggugcaucuauagccgcacccguagcaggacaaacaaauauaauagaucccuggauuagaacaaacuuuguacaagcaccaaacggagaauuuacaguaucaccccguaacucaccuggagaaauauuauuaaauuuagaauuaggaccagaucuaaacccauaccucgcacacuuaucacgaauguacaacgguuaugccggaggcgucgaaguucaaguacuuuuagcagguaaugcauucacugccggaaaaauucucuucgccgcaauacccccuaacuucccaguagauaugaucucuccagcucaaauaacaauguuaccacacuuaauaguagauguucgaacccuagaaccaauaaugaucccacuaccagacguaagaaacguauuuuaccacuucaauaaucaaccacaaccacguaugagacuuguagccauguuauacacaccacuaagauccaacggauccggcgaugacguuuuuacaguauccugcagaguacuaacaagaccuacaccagacuuugaauuuauauacuuagucccaccuucaguagaaucaaaaaccaaaccuuucacuuuaccaauuuuaacaauaucagaacuaacaaauucuagauucccuauaccaauagaacaacuauauacagccccuaacgaaacaaauguaguacaaugccaaaauggccgauguacucuugacggagaauuacaaggaacuacacaauuauuaagcuccgcuguaugcuccuaucgaggaagaacaguagcaaacaacggugauaauugggaucaaaaucuccuucaacucacauacccaaauggcgcaucauaugacccuacagacgaagugcccgcaccacuaggaacucaagauuucucagguauguuauacggcgucuuaacacaagacaacguuaacguaucaacuggagaagccaaaaacgcaaaaggcaucuauauauccacaacaucaggaaaauuuaccccaaaaguaggguccauaggauuacacuccauaacagaacacguacaccccaaccaacaaucaagauucacaccaguaggaguagcaguuaacgaaaacacaccauuucagcaaugggucuuaccccacuaugcaggaucauuagcacuaaauaccaaucuugccccagcuguagcaccaaccuucccaggagaacaauuauuauucuuccgauccagagucccaugcguacaaggccuacaaggacaagacgccuucauagacugucuacuaccacaagaaugggucaaucauuucuaccaagaagcagcaccuucacaagcagacguggcauuaauaagauacguuaacccagacaccggacgaacacuauuugaagcaaaauuacaccgaucaggauucauaaccgucagucacacuggugcauacccucuagucguuccuccaaacggccauuuccgauuugauucauggguaaaucaauucuauuccuuagcaccuaugggaacaggaaacggacgaagacgaauacaauaa

SEQ ID NO: 33330 - RNA, 1629 nt, Artificial Sequence
  derived and/or modified sequence opt6 from VP1__Norovirus_and/or_Norovirus-like__AB078334
augaaaauggcaucaaacgaugcugcuccaucuaacgauggagcugcaagccucguaccagaaggaauuaaugaaacaaugccauuagaaccaguagcaggagcgucaauagcagcaccaguagccggacaaacaaauauaauagaccccuggauaagaacaaauuucguacaagcaccaaauggagaauuuacaguaucaccaagaaacucaccaggagaaauacuacuaaacuuagaauuaggaccagaucuuaauccuuaucuagcacaucuaucaagaauguacaacggauaugcuggugguguugaaguacaaguuuuauuagcagggaacgccuucacugcaggaaaaauauuauuugcagcaauaccuccaaauuucuuagucgauaugauauccccagcacaaauaaccauguuaccacacuuaauuguugauguucgcacacuagaaccaauuaugacaccucucccagacguaagaaacguuuucuaucauuucaauaaccaaccacaacccagaaugagauuaguagcaaugcuauauacacccuuaagaucaaacggauccggagaugacguauucacaguuucaugccgaguucuuacacgaccuacgcccgacuuugaauuuauuuaucuugucccuccaucuguugaauccaaaacaaaaccauucacacuuccaauacucaccauuucagaacuaacaaauaguagauuccccaucccuaucgaacaacuauacacagccccaaacgagacaaacguaguacaaugccaaaauggaagauguacuuuagauggagaauuacagggcacuacucaauuauuaucuucagcuguaugcuuuuuacaaggcagaacaguagcagauaauggagacaacugggaucaaaaucuacuacaauuaacauauccuaacggugcaucauacgacccuacggaugaaguaccagcaccccuaggcacacaagauuuuucugguauguuauauggaguucuuacacaagauaacguaaacguaucaacaggugaagccaaaaacgcaaaaggaauauauauaucaacaaccucaggcaaauuuaccccaaaaauaggaucaauuggacuacacucaauaacugaacacguucacccaaaccagcaaucacgcuuuacccccguaggagucgcaguagacgaaaacacuccauuccaacaauggguacuuccacauuaugcaggaucacuagcacuuaauacaaaucuagcucccgcaguugcaccaacauucccaggagaacaacuauuauucuuuagaucuagaguaccauguguucaagguuuacaaggccaagaugcuuucauugacugccuauuaccucaagaauggguuaaccauuucuaccaagaagcagcaccaucacaagcagauguagcccuuauacguuauguaaauccagauacaggaagaacucuauucgaagcaaaacuacaccgaucaggauuuauaacaguaucccacacaggagcauauccgcuagucgucccaccaaacggucauuuuagauuugacucaugggucaaucaauucuauucucuagcaccaaugggaacaggaaacggcaggagaagaauacaauaa

SEQ ID NO: 33331 - RNA, 1629 nt, Artificial Sequence
  derived and/or modified sequence opt6 from VP1__Norovirus_and/or_Norovirus-like__KM289172
augaaaauggcaucuaacgaugcagcaccaucuaaugauggagcagcaggauuaguaccugaaauaaacaaugaagcaauggcucucgauccaguugcaggagcugcaauugcugccccacucacaggccaacaaaacaucauugacccauggaucaugaacaacuuuguacaagcacccggaggagaauuuacaguaucaccacgaaauucuccaggagaaguacuacuuaaccuagaacuaggcccugaaauaaauccauacuuagcacacuuagcaagaauguauaacggauacgcaggaggcuucgaaguacaaguaguucuugcaggaaaugccuuuacagcaggaaaagucaucuuugcagcaauaccaccaaauuucccaaccgacaauuuauccgcagcacaaauaacaauguguccacacguaauaguagauguaagacaacuagaacccauuaauuuaccuaugccagacgucagaaacaacuucuuucauuacaaccaaggcucagacucuagauuaagauuaauagcuaugcuuuacacaccgcuaagagcuaacaauucaggcgacgaugucuuuaccgucucaugcagaguauuaacuagaccuucaccagacuucagcuucaacuuucuaguaccaccaacagucgaaucaaaaacuaaaccuuucacucuaccuauucuaacaaucagcgaaaugaguaauagccgauuuccaguaccaaucgauucauuacauacaucaccuacugauaauauaguuguacaaugucaaaacggaagaguaacucucgauggugaacuaaugggcacaacacaauuacucccaucccaaauaugugcuuuuagaggaguacucaccagaucaacaucuagagcaucagaccaagccgacacugcaacaccccgccuauucaauuacuauuggcauauacaauuagauaauuuaaacggaacaccuuacgacccugcagaagauaucccagccccacuaggaacaccagacuuuagagguaaaguauucggaguagcuagccaaagaaaucccgauagcaccacacgagcacacgaagcuaaaguagauacaacaucagguagauuuacaccuaaacuaggaucccuagaaauauccacagaaucaggagacuucgaucaaaaucaaccaacaagauucacaccuguuggcaucggaguugacucagaagcagacuuucaacaauggacauuaccagacuacagcggacaauuuacucauaauaugaaucuagcaccagcaguagcaccaaacuucccaggcgaacaauuauuauucuuucgaucacaauuaccaucaucaggaggaagaucaaacgguauacuagauugccuaguuccacaagaauggguacaacacuuuuaccaagaaucugcacccgcacaaacacaagucgcucuaguaagauacgucaacccagacaccggacggguauuauuugaagcaaaauuacauaaacuuggcuacaugacaauagcaaaaucaggagauucaccaauaacaguaccuccaaaugguuauuuuagauucgaaucauggguaaacccauuuuauacacuagcaccuaugggaacaggaaauuaa

SEQ ID NO: 33332 - RNA, 1629 nt, Artificial Sequence
  derived and/or modified sequence opt6 from VP1__Norovirus_and/or_Norovirus-like__AY130762
augagaauggccucaagugaugcaccagugucagguacagauggagcagcaggucucguaccagaaagccaacaagaaguacuaccauuagaaccaguagcuggaguacaauuagcugcaccaguagcaggacaaucaaauauaauugauccauggauaaggaugaauuuuguacaagcaccagccggugaauuuacagucucaccaagaaaugcaccuggagagguauuaauugaucuagaauuaggacccgaacuaaacccauaucuaaaccaucucgcuagaauguauaauggauauguagguggcauggaaguagaaguuguacuagcugguaacgcauuuaccgcaggcaaaauacuauuugcagccguaccaccaucauucccaacacauggaauaucagcagcucaagcaacuauguuaccucauguaauuguugauguaagacaacuagaaccaguaagauuaccauugccagauguaagaaauguaauguuucauuuuugccaagaaaauaaagaaccuagaaugagaauaguagccauucuauacacaccauuaagagcaaacggugccggagaugacguauuuacaguauccuguagaguauuaacacgaccaucuccagacuuugauuuuaucuuucuaguaccaccaucaguagaaucaaaauuaaaacaauucacauuaccuaaucuucaaccaaaugaaaugacaaauucacgauuucccacaggcauaacucaacuauauacuucacccaauacaaauuuaguuguacaauuccaaaacggaagauguuuacuagauggcacuuuauuaggaacuacucccguucgagcagcugauauauguucauucagaggcguaaccagcacugaaguugacgcaacugauagucccagaguugccggaucacaucguauuaugguucaacuaaaagaaccagacggagaagaauuuucaccaacaggaccuaacccagcaccaguugguacaccugauuuccaagcagcuauauucggaacacuuucacaacgcaauacaggaggugcuggacaaaacucaaacagagcucauuuugcauacuuuuauacaagaaauccaacauucgcaccaggaauaggaacaguaguauucuccuuugauacaacagauuuucaaaacagacaaccaaccaaauucucaccaucuggcguauucgaugauaauucaucagaaccuuuuaaucaauuuucuuuaccauacuauaacggaucccuuggugcugucgacgcaggaaaacuagccccaccaguagcaccaaacuauccaggagaacaaauuuuauacuuucgagguaacaucccauuuaaaggaggauauggagaaggugaaauagauucuuuauuaccucaagaauggaucacacauuuuuaugcagaacaagcacccacacaaggagacgcugcauuacuaagauauuauaauccagacacuggcagaguacuauuugaaugcaaauuacaucgagaaggauucauuacaauuaauuauacuggaucuaacgcauuagcaguacccguuaaugguguauuuagauuugaaggauggguuaauaaauucuacacacuaacaccuauguga

SEQ ID NO: 33333 - RNA, 1629 nt, Artificial Sequence
  derived and/or modified sequence opt6 from VP1__Norovirus_and/or_Norovirus-like__KJ196290
augagaauggcaucuucugacgcacccguauccggaacagacggugcugccggccuagucccagaaucucagcaagaaguauuaccucuagaaccaguagcaggaguucaacuagcagcaccuguugcuggacaauccaauauaauugacccauggauucgcaugaauuucguccaagcuccagcaggagaguucacuguaucaccacgcaacgccccaggagaaguacuaauagauuuagaauuaggacccgaacuaaacccuuacuuaaaccaucucgccagaauguauaauggauaugucgguggaauggaaguugaaguuguacuugcaggaaacgcauuuacagcugguaaaauacuauuugcagcagucccuccaaguuuucccacacauggaauaucagcugcacaagcaacaaugcuuccacacgucauaguagauguaagacaacuagaacccguacgacuaccacucccagacguuagaaaugucauguuccacuucugucaagaaaacaaagaaccaagaaugcgaauaguagcaauauuauauacaccacuuagagcuaacggagcuggagaugauguauucacaguaucaugucgaguauuaacaagaccaucaccugauuuugacuuuauuuuucuaguaccaccaucagucgaauccaaauuaaaacaauuuacacuaccaaacuuacaaccaaaugaaaugacuaacucacgauucccaacaggaauuacacaacucuauacuucaccaaauaccaauuuaguaguacaauuccaaaaugguagaugccuacuagauggaacacuauuagguacuacaccagucagagcagcagauaucuguagcuucagaggagucacaucaacagaaguagaugcaaccgauucaccaagaguagcagguucacaccgaauuaugguacaacuacgcgaaccagauggagaagaauuuucaccaacaggaccuaauccggcuccaguuggaacaccagauuuucaagccgcaauauucggcacauuaucucaaagaaauacagguggugcaggacaaaacucaaaucgagcacacuucgcauauuuuuauacacgaaacccaacauuugccccuggaauaggaacuguaguauucucauucgauacaacagacuuucaaaauagacaacccacuaaauuuucaccaaguggaguauuugacgacgacucuucagaaccauuuaaucaauucuccuuaccauacuacaacggaucauuaggagcaguugacgcaggaaaauuagcaccaccugucgcaccgaacuauccaggagaacaaauauuauauuucagggggucuguaccauuuaaaggaggauauggcgaaggagaaaucgacucuuuauuaccacaagaauggauaacacauuuuuacgcagaacaagcuccaacccaaggagacgccgcauugcuaagauauuacaauccagacaccggaagaguauuauucgaauguaaauuacauagagaaggauuuauaacuauaaauuauacuggauccaaugcauuagcaguacccguaaauggaguauuuagauuugaagguuggguaaacaaauuuuauacucuuacccccauguaa

SEQ ID NO: 33334 - RNA, 1629 nt, Artificial Sequence
  derived and/or modified sequence opt6 from VP1__Norovirus_and/or_Norovirus-like__GQ856474
augagaauggcuucaucagacgcaccaguaucaggaaccgacggagcagcaggucuaguaccagaaucucaacaagaaguacuaccauuagaaccuguggcaggaguacaauuagcugcaccuguagcaggucaaucgaauauaauagauccauggauaagaaugaauuuuguacaagcaccagcaggagaguucacaguaucuccacgagaugcaccuggagaaguauuaauagacuuagaauuaggaccagaacuuaaucccuaccuaaaccaucuagcaagaauguauaacggauauguaggaggaauggaaguagaaguaguucuagcuggaaacgcauucacugcuggaaaaauauuauuugcugcaguaccacccuccuucccaacccacggaauuucugcagcacaagcuacuauguuaccacauguaauaguagauguuagacaacucgaaccaguuagacuaccuuuaccugauguaagaaauguaauguuucauuuuugucaagaaaacaaagaaccuagaaugagaauuguagcaauacuauacacaccacucagagcaaauggcgcaggagaugacguguuuacaguaucauguagaguauugacucgaccaucacccgauuuugauuucauuuucuuaguacucccaucaguagaaagcaaauuaaaacaauuuacucuaccaaacuuacaaccaaaugaaaugacaaacucuagauucccuacuggaauuauacaauuauauaccucaccaaacacaaaccuuguaguacaauuccaaaauggcagauguuuauuagauggcacucuauuaggaacuacuccaguaagagcugcagauauuugcaguuucagaggaguaacaucaacagaaguagacgcaaccgauucaccaagaguagcaggaucacauagaauaaugguacaauuaaaagaaccagauggagaagaguucucuccaacaggaccaaauccagcaccaguaggaacacccgauuuccaagcagcuaucuuuggaacacucucacaaagaaauacagguggugcaggacaaaauucaaauagagcacgauuugcauauuucuacacaagaaauccaaccuuugcacccggaauuggaacuguaguauuuucuuucgacacuacagauuuucaaaaucgacaaccaacuaaauuuucaccaucgggaguauuugaugaugauaguucagaaccauuuaaucaauuuagucuaccuuauuauaauggaucauuaggugcaguugaugcaggcaaauuagcuccuccaguagcaccaaauuauccaggagaacaaauccuuuauuucagaggaaauauaccauuuaaaggcggcuacggagaaggcgaaauagauucauuauuaccacaagaauggauaacacauuuuuacgcagaacaagcaccaacacaaggcgaugccgcauuauuacgauauuauaauccagauacaggaagaguacuuuucgagugcaaauuacauagggaaggcuuuauuacaauaaacuauacaggcucuaaugcacuagcaguaccuguaaacggcguauuccgcuuugaaggaugggucaacaaauucuauacauuaacaccuauguaa

SEQ ID NO: 33335 - RNA, 1629 nt, Artificial Sequence
  derived and/or modified sequence opt6 from VP1__Norovirus_and/or_Norovirus-like__LC145787
augaaaauggcaagcaacgaugcagcaccauccacagauggugccgccggacucguaccagaaucuaauaaugaaguaauggcccuugaaccaguugcaggagcagcuuuagcugcaccagucacaggacaaacaaacauuauagacccauggauaagagcuaacuucguccaagcaccaaacggagaauuuacaguuucaccacgaaacgcaccaggagaaguacuccuaucucuagaacuaggaccagaacugaaucccuaucuagcacauuuagcaagaauguacaacggauacgccggcggaauggaaguacaaguaauguuagcuggaaacgcuuucacagccggcaaauuaguauucgcugcaguaccaccucauuuuccaguagaaaauuuauccccucaacaaauaacaauguucccccauguaauaauagauguaagaacauuagaaccaguucuauuaccauuaccugauguuagaaauaauuucuuccacuauaaucaaaaagaugauccaaaaaugagaauuguagcaauguuauacacacccuuaagaucaaauggcucaggagacgacguauuuacaguuucuugcagggucuuaacuagaccuucaccagacuuugacuuuacauaccuuguaccacccacuguagaaucaaaaacaaaacccuucacacuaccaaucuuaacccuaggcgaacuuagcaauucaagauuuccaguauccauagaccaaauguacacaucaccaaacgaagucauaucuguacaaugccaaaauggaagauguacauuagauggagaacugcaagguacaacacaacuacaaguuagcgguauaugugcauuuaaaggagaaguaacagcacauuuacaugauaacgaucacuuauauaauguaacaauaacaaacuuaaauggaucaccauuugauccuucagaagauguaccggcaccucuaggcguaccugauuuccaaggacgaguauuugguauaauaucucaaagagauaaacauaauucuccaggacacaaugaaccagcaaaucgaggacaugacgcuguagucccaacauauacagcucaauauacaccaaaacuaggacaaauacaaauaggcaccuggcaaacagaugaucuaacuguaaaccaaccuguaaaauuuacacccguuggccucaacgauacagaacacuuuaaccaauggguaguaccaagauaugcaggagcauuaaaccuaaacacaaauuuagcacccucaguagccccuguuuuuccuggagaaagacuacuuuucuuuagaaguuacguaccauuaaaaggaggauauggaaauccagcaauagauugucuauuaccacaagaauggguacaacauuuuuaucaagaagccgcuccaucaaugucagaaguagcucuaguuagauauauaaaucccgacaccggacgcgcauuauuugaagcaaaauuacauagagcaggauuuaugacaguauccucaaauacauccgcacccgucguaguccccgcaaauggcuauuuccgauuugauucaugggucaaucaauuuuacucacuugcuccgaugggaacaggaaacggaagaagaagaguucaauaa

SEQ ID NO: 33336 - RNA, 1629 nt, Artificial Sequence
  derived and/or modified sequence opt6 from VP1__Norovirus_and/or_Norovirus-like__AB629946
augaaaauggccuccaaugaugcagcaccaagcacugacggagcagccggauuaguaccagaguccaacaacgaaguuauggcacucgaaccagucgcaggagcugcauuagcagcaccuguaacaggacaaacaaacauaauagauccauggauaagagcuaauuuuguacaagcaccaaauggugaauuuacaguuucaccuagaaaugcuccaggagaaguccuauuaucacuagaauuaggaccagaacucaauccauaucuagcacaucuagcucgaauguacaauggauaugcaggaggaauggaaguacaaguaaugcucgcaggaaaugcauuuacagccggaaaauuaguauuugcagcaguaccaccacacuuuccaguugaaaauuuaucuccacaacaaaucaccauguuuccccacguaauaauagaugucagaacauuagaaccaguacuacucccacuaccugauguuagaaauaacuucuuucauuauaaucaaaaagaugacccuaaaaugagaauuguugcaaugcuauacacuccauuacguucuaacggaucaggagaugauguauuuacaguaucuuguagaguguuaacccguccaucuccugacuuugauuuuacauaucuaguaccaccaacaguagaauccaaaacaaaaccuuucacuuuaccaauauuaacacuaggagaauuaucuaauucaagauucacaguaucaauagaccaaauguauacuucccuaaacgaaguuauaaguguccaaugccaaaaugguagauguacuuuagauggagaauuacgaggaacaacucaauuacaaguuucugguauaugcgcuuuuaaaggagaaguaacagcacauguccacgacaaugaucauuuauauaaugucacaauuaccaauuuaaacggaucacccuuugauccaagugaagauguaccagccccacuuggaguaccagacuuucaaggaagaguauuuggaauaaucucacaacgcgauaaacacaacuccccaggacauaacgaaccugcuaacagaggccacgaugccguaguaccaaccuauacagcacaauauacaccuaaacuuggucaaauacaaauaggaacauggcaaacagacgauuuaacuguaaaucaaccaguaaaauuuacuccaguaggauuaaacgauacagaacauuuuaaucaauggguaguuccaagauacgcaggagcauuaaaucuaaauacuaacuuagcuccaucaguugcaccaguauuuccaggagaaagauuacuauucuuuagaucauauguaccucuuaaaggaggauauggcaaucccgccauagauuguuuacuaccccaagaauggguucaacacuuuuaucaagaagcugcaccaucaaugucagaaguagcccuaguaagauauauaaaccccgacacaggcagagcuuuauuugaagcuaaacuccauagagccggauucaugacagucaguucuaacacuucugcaccaguagucguaccagcaaaugguuauuuuagauuugauucauggguuaaccaauuuuacucucucgcaccuaugggaacuggaaacgguagaagaagagugcaauaa

SEQ ID NO: 33337 - RNA, 1629 nt, Artificial Sequence
  derived and/or modified sequence opt6 from VP1__Norovirus_and/or_Norovirus-like__KT962983
augaaaauggcaucaaaugacgcagcucccucaacagauggcgccgcaggccuagucccagaaucaaauacugaaguuauggcuuuagaacccgucgcaggagcugcccuugcagcaccaguaacuggccaaacuaauauaauagauccuuggauucgagcaaauuuuguucaagcucccaacggcgaauuuacaguaucaccaagaaaugcaccaggugaaguccuacuuaauuuagaacucgguccagaauuaaauccauaccuagcucaccuagcaagaauguauaacggcuacgcaggaggcauggaaguacaagucauguuagcaggaaaugccuuuacagccggcaaacuuguguuugccgcuguaccaccucacuucccaguagaaaaucuaucaccacaacaaauaacaauguucccucauguaaucauagacguaagaacccuagaaccaguacuacuaccauuaccagacguaagaaauaacuuuuuccauuacaaucaaaaagacgauccaaaaaugagaauaguagcaaugcuauacacaccauuaagaucaaaugguucaggugacgacguauuuacaguaucaugucgaguauuaacaagaccauccccagacuucgacuucacuuacuuaguaccacccacaguagaauccaaaacaaaaccuuucacacuaccaauauuaacauuaggagaauuaaguaauucucguuuuccuguaucaauagaccaaauguauacuagcccaaaugaaguaauaucaguacaaugccaaaaugguagaugcacauuagacggugaacuacagggcacaacacaacuacagguaucaggaaucugugcauucaaaggagaaguuacagcccaucuucacgacaacgaccaccuauauaauauaacaauaacaaaucucaacggcuccccuuucgauccaucagaagauauaccagcaccccuaggaguuccagauuuucaaggaagaguauuuggaauaauuucucaaagagauaaacauaauuccccuggucauaacgaacccgcaaauagaggacacgacgcaguaguaccuacuuacacugcucaauauacaccaaaacuuggacaaauacaaauagguacauggcaaacugaugauuuaacaguaaaucaacccguaaaauucacaccuguaggccuaaaugacaccgaacauuuuaaccaaugggugguaccccgauaugcuggagcuuuaaaccuaaauacaaacuuagcacccucuguagcaccaguauuuccaggagaaagacuacuauucuuuagaucauauaucccacuaaaaggcggauaugguaacccagccauagacuguuuauuaccacaagaauggguacaacauuuuuaucaagaagcagcuccaucaaugagugaaguagcccuuguacgauauauaaauccagacaccgguagagcacucuuugaagcaaaauuacauagagcuggcuuuaugacaguaucuucaaauacaucagccccuguaguaguacccgcaaauggauacuuucgauucgacuccuggguaaaucaauuuuauucacuagcaccaaugggcaccggcaacggaagaagacgaguccaauaa

SEQ ID NO: 33338 - RNA, 1626 nt, Artificial Sequence
  derived and/or modified sequence opt6 from VP1__Norovirus_and/or_Norovirus-like__AB083780
augaaaauggccucaaacgacgcugcaccgucaaacgacggagcagccggucuaguaccagaaauaaacacagaagucauggcauuagaaccuguagcaggaggagccauagcugcaccacuaacaggucaaacaaauauuauugauccauggauaagaaacaacuucguacaagcaccaaacggagaauuuacaauaucaccaagaaacucacccggagaaauacuacuaaauauggaacuuggaccagaauuaaacccuuucuuagcacaccuaucaagaauguauaacgguuuugcaggagguauggaaguacaaguacuaauggccgguaacgcauuuacagccggaaaagucauauuugccgcagucccuccacauuucccaguagaaaaucuaucaccaccucaaauaacaauguuuccacacauuaucauagauguuagaacacuagaaccuguauuacuucccaugccagacguacgaaaccaauuuuuccacuacaaucaaguaaaugaaccuagaaugagacuuguagcuaugcuauacacuccacuaagaucaaacggauccaccgaagauguauuuaccguaucaugcagaguccuaacuagaccaucaccagacuucgaauuuaacuauuuaguaccacccaccguagaaucucgaaccaaacccuucacacuaccuguacucacaauaggagaaaugacaaacucaagauucccagcaccaauagauauguuauacacaucacccaauggaaacguaguaguacaaccacaaaacggacgcugcacauuagauggagaauuacaagguucaacacagcuaguaccagcaaacguuugugcuuucagaggaaaaauaacugcccgaauagucgaccaagcagcacaucaauggcauaugcaaauagauaacccaaacggaacauuauucgauccaacagaagacguaccugcuccgcuagguacaccagacuucaaagccaaaauauuuggaguuauaucacaaagaaaugacuacaacgacggaucacaagggccugcaaauagagcacaugaugcagucguaccaacaaccucagcaaaauuuaccccuaaacuuggaagcauucuaguaggcacaugggaaaauaacgacauagaaacacaacccuccaaauucacaccaguaggacuacuagaaaugaaugauuucaaucaauggucuuuaccaaauuacuccggagccuuaacacucaauaugggauuagcuccggcuguauuuccaacuuuuccaggagaacaaauucuauucuuccgaucauucauaccacuaaaaggaggccacggaaaucccgcaauagauugccuacuaccacaagaauggauacaacauuucuaccaagaaucagcaccaucacaaacaucaguagcuuuaauaagauacguaaauccagauacugguagaguauuauucgaaggcaaauuacacagacaaggauuuauuacaaucgcuaaauccggagacggaccaauaguuguacccccaaaugguuauuuuagauucgauuccuggguuaaccaauuuuacucccuugcaccaauggguaauggaaauggaagacgcagaauacaauaa

SEQ ID NO: 33339 - RNA, 1626 nt, Artificial Sequence
  derived and/or modified sequence opt6 from VP1__Norovirus_and/or_Norovirus-like__KX987840
augagaaugucagauggugcugcaccuaaagcuaacgguuccgaagcaucaggacaagauuuaguaccaacagccguugaacaagcaguuccaauacaaccugucgcuggugcagcacuagcagcccccgcagcaggucaaaucaaucaaauugacccauggauauuccaaaauuuuguucaauguccucucggugaauuuucaauaucaccaagaaauacaccaggugaaauuuuauucgauuuagcauuaggaccaggauuaaauccauauuuagcccaucuuuccgcaauguauacugguuggguagguaauauggaaguacaauuaguacuagcaggaaaugcauucacugcugguaaaguuguaguagcuuuaguaccucccuauuuucccaaaggaucacuaacaacugcacaaauuacaugcuucccacauguuaugugcgacguucgcacauuagaaccaauacaacuaccauuauuagauguaagaagaguucuuuggcacgcuacacaagaucaagaagaaucaaugaggcucguuuguauguuauauacaccacuucgaaccaacaguccaggugaugaauccuuuguaguaucuggaagauuacucuccaaaccagcagcagacuuuaacuuuguauaucuaacuccuccaauagaaagaacuaucuauagaauggcagacuuaccugucauucaaccaagacuauguacacacgccagauggccagcuccuguauauggauuauuaguagauccaucuuuaccaucuaauccacaauggcaaaacgguagaguccacgucgauggaacacuauuagguacuacaccaauaucuggauccuggguauccugcuuugccgcugaagcagcauacgaauaccaaucugguacaggagaagucgcaacauuuacacuaauagaacaagaugguucugcauacguuccaggagacagagccgcacccuuaggauauccagauuuuuccggacaacuagaaauugaaguccaaacagaaacaacaaaaccaggagauaaauuaaaaguaaccaccuuugaaaugauacucggaccaacaacaaacguagaucaagcaccauaucaaggacguguuuaugcaucaguaaccgcugcagcaacgcuaaauuuaguagauggcagaguaagagcaguaccaagaucaauauacgguuuccaagauguaauaccagaauauaaugauggauugcuaguuccacuagcaccaccaauagguccauuccuaccaggagaagucuuacuuagauuuagaacauauaugagacaaauagauuccuccgaugcagcugcugaagcaauugauugugccuuaccucaagaauuuauaucaugguucgcaucuaacgcauuuacaguucaaucagaagcauuacuucuaagauauagaaauacacucacaggacaacuauuauuugaaugcaaacuauauucagaagguuauauugcucuaucuuaucccgguucgggaccgcuuacauucccaacugauggauucuuugaaguaguaucuuggguaccaagacuauaucaacuugcaagcguaggcucucuagcuacaggcagaacauuaaaacaauaa

SEQ ID NO: 33340 - RNA, 1626 nt, Artificial Sequence
  derived and/or modified sequence opt6 from VP1__Norovirus_and/or_Norovirus-like__KR349276
augcgaaugucagacggcgcagcaccaaaagcuaaugguucugaagcaaauggacaagacuuaguaccaacagcaguagaacaagcaguaccuauccaaccuguagcaggagcaucauuagcagccccugcagcaggccaaauaaaucaaauugaucccuggauauuucaaaauuuuguacaaugcccauuaggagaauuuucuauaucaccaagaaauacuccuggagaaauacuauuugacuuagcacuagguccaggacuuaacccauaccuagcacaucuaagugcaauguauacuggcugggucggaaacauggaaguacaacucguacuagcagguaaugcuuucacagcagguaaaguaguaguugcauuaguaccaccauacuuuccuaaaggaucauuaacaacagcucaaauaaccuguuuuccacauguaaugugugacguucgaacccuugaaccaauucaacuuccauuacuugauguaagaagaguacuauggcacgcaacucaagaucaagaagaaucuaugagacuuguauguauguuauauacaccauuaagaacaaacuccccaggugaugaaucauuuguaguuucaggacgccuauuauccaaaccagcagcagauuuuaauuuuguauaucuaacucccccaauugaaagaacaauauacagaaugguagaucuuccaguacuacaaccaagacuauguacacaugcaagauggccggcaccaguauacggccuccuaguagaucccucucuuggaucaaauccacaauggcaaaaugggcgaguucauguugauggaacccuauuaggaacaacaccaauaaguggaaguuggguuucauuauuugcugcugaagcagcauacgaauuucaauccgguaccggcgaaguagcaacauuuacccuuauugaacaagaugguucagcauaugucccuggagaaagagcagccccacucggauauccugauuuuucaggacaauuagaaauagaaguucaaacagaaacaacaaaaacuggagauaaacuaaaaguaacaaccuuugaaaugauauuaggaccaaccacaaaugucgaucaagcaccauaucaaggaagaguauaugcaucacuaacuacugcugcaucauuagaucuagucgauggacgagugagggcaguaccuagaucaauauauggauuucaagauguuauaccagaauacaaugauggucuauuaguaccacuagcuccuccaaucggaccauuuuuaccuggagaaguacuauuaagauuuagaacuuauaugagacaaauugacucaagugaugcugcagcagaagcuauagacugugcccuaccucaagaauuuguauccugguucgcauccaaugcauuuacaguucaauccgaagcauuauuacugcgauauaggaauacccuuacaggccaauuauuauucgaauguaaacuauauuccgaaggauauauugcauuaucuuauuccggaaguggacccuuaacauucccaaccgauggauuuuucgaaguaguaucuuggggaccacgauuauaccaacuugcaucaguaggaucacuugcaacuggaagaacacuaaaacaauaa

SEQ ID NO: 33341 - RNA, 1626 nt, Artificial Sequence
  derived and/or modified sequence opt6 from VP1__Norovirus_and/or_Norovirus-like__KM102449
augagaaugucagauggggcagccccaaaagcuaauggaagugaagccauaggccaagaucuaguacccaccgcaguagaacaagcugucccaauacaaccuguagccggagcugcccuagcagccccugcagcaggccaaauaaaccaaauagacccauggauuuuccaaaauuuuguacaguguccacuaggagaauuuucaauuaguccacgaaauacuccuggagaaauauuauuugacuuagcacucggaccaggacuaaacccauauuuagcacaucuuucugcaauguacacuggauggguaggaaauauggaaguacaauuaguucuugcagguaaugcauuuacagcaggaaaaguaguuguagcauuaguuccaccauacuucccaaaaggauccuuaacaacagcacaaauuaccuguuuuccacauguuaugugugauguacgagcucuagaaccaauacaauuacccuuacucgauguaagaagaguauuauggcaugcaacacaagaucaagaagaauccaugagauuaguuuguauguuauacacaccauuaagaacaaauucuccaggugaugaaucauuuguaguaucuggaagauuacuaucaaaaccugccgcugacuucaacuuuguuuauuuaacaccuccaauagaaagaacuguauaccguaugguagaucuccccguacuucaaccacgauuauguacccacgcuagauggccagcucccguauauggauuacuuguagacccaagucuaccuuccaauccacaauggcaaaaugguagaguacauguaaacggaacauuacuuggaacuacaccuguuucagguucuugggucucauguuuugcugccgaagcagcauaugaauuucaaucaggaacuggugaaguagccacuuucacaaugauugaacaagacgguucugcuuacguaccaggugauagagcagcaccccuagguuauccugauuucaguggacaacuagaaaucgaaguucaaacugaaacuacaaaaucaggagacaaauuaaaaguuacaacauuugaaaugauuuuagguccuacuacaaacgcagaucaagcaccauaucaaggaaaaguauaugcaucacuagcugcagcagcaccucuagauuuaguagacggaagaguccgggccgugccacguucaguauauuucuuucaagauguacuacccgaauauaaugauggacuauuaguaccauuggcaccuccauuaggcccauuuuuacccggagaaguacugcuacgauuuagaacuuauguacgucaauuagauacagcagacgccgcugcacaaccuauagauugugcacuaccacaagaauuuaucucaugguucgcaagcaauucauuuacaguucaaucagaagcauuacucauaagauauagaaacaccuuaacaggacaacuauuauuugaagccaaauuguauucagaaggguacauugcaguaucauacucuggcucaggaccacuuacauuuccuacagaugguuucuucgaaguaguaucauggguaccaagauuauuucaacuagcuucaguaggaagccuugcaacagguagaacacuaaaacaauaa

SEQ ID NO: 33342 - RNA, 1626 nt, Artificial Sequence
  derived and/or modified sequence opt6 from VP1__Norovirus_and/or_Norovirus-like__KC792553
augagaauguccgauggugcagcacccaaagcaaauggaucagaagcaucaggacaagauuuaguacccacagccgucgaacaagcaguaccuauacaaccaguagcaggcgcagcacuugcagcuccagcugcaggucaaaucaaucaaauugacccauggaucuuucaaaacuucguacaauguccucucggagaguucaguaucucaccacgaaacacaccuggugaaauauuauuugaucuagcauuaggaccaggacucaaucccuaucuugcacauuuaucagcuauguauacaggauggguaggaaauauggaaguacaauuaguucuagccggaaacgcauuuacugcaggaaaaguaguaguagcauuaguaccaccauauuuuccaaaaggaucguuaacaacugcucaaauaacauguuuuccacacguaaugugcgauguaagaacacuagaacccauacaauuaccuuuacuggacguuagaagaguacucuggcacgcaacacaagaucaagaagaauccaugagacucguauguauguuauacacaccauuaagaacuaacucaccaggugaugaaucauucguaguaucaggacgcuuacuaucaaaaccagcagcagauuuuaauuuuguauauuuaacaccaccuauugaaagaacuauuuaucgaaugguagauuuaccaguacuacaacccagacuauguacucacgccagauggccagcuccaguauacgguuuauuaguugaucccucccuacccucuaacccacaauggcaaaacggaagaguacauguugacggaacucuacuugguacuacuccaguuucaggauccugggucucuugcuuugcagcagaagccgcauaugaauuucaaucaggaauaggucaaguugcaacauucacaaugauugaacaagacggauccgcauauguaccaggagacagagccgcuccacuaggauaucccgauuauaguggacaacuagaaauagaaguucaaacugaaacaacaaaagcaggagauaaacuaaaaguaacuacauucgaaaugaucuuaggaccaacuacaaaugcagaucaagcaccauaucaaggcagagcuuacgccucauuaacugcagccgcaucauuagauuuaguugauggaagaguccgagcaguuccuagaucaauauauucauuccaagauguacucccagaguauaacgauggacuuuuaguaccccuagcuccuccauuaggaccauuccuaccaggugaaguauuacuuagauuuagaacauauaugcgucaacuagauacagcagacgcagccgcacaaccaauagacugugcucucccucaagaauuuguaucuugguuugcaucaaauaguuucacuguacaaucagacgcccuauuaguacgauauagaaauacuuuaacaggacaauuauuauuugaagcaaaauuauacucugaaggauacaucgcaguaucauauucagguuccggaccauugacuuuuccagccgaugguauuuucgaaguaguauccuggguaccaagacuauuucaacuagcaaguguuggaucacuugcaacagguagaacucuaaaacaauaa

SEQ ID NO: 33343 - RNA, 1626 nt, Artificial Sequence
  derived and/or modified sequence opt6 from VP1__Norovirus_and/or_Norovirus-like__AB809991
augaaaauggccucaaaugacgcagcaccaucaaacgauggagcugcaucucuaguacccgaagcaauaaaugaaacaaugccuuuagaaccagucgcaggcgcauccauagcugcaccaguagccggccaaacuaauauaauagauccuuggauaagaacaaacuuuguacaagcaccaaauggagaguucacaguauccccucgaaacuccccaggagaaauauuauuaaaucuagaauuagguccagaucuaaauccuuacuuagcacacuuaucacguauguauaacggcuaugcugguggcguagaaguacaaguccuauuagcagguaaugcauucacugcaggcaaaauauuauucgcagcaauaccaccaaacuucccaguagacaugauauccccugcacaaauaacaaugcuaccucaucuuauaguagacguaagaacacuagaacccauaaugauuccacuuccugacguaagaaacguauucuaucacuucaacaaucaaccacaaccuagaaugcgauuaguugcaaugcuauauacaccauuaagaucaaauggcucuggcgaugacguuuucacaguaucaugcagaguauuaacacggcccacaccagacuucgaauuuauuuacuuaguaccaccaucagucgaaucaaaaaccaaaccauuuacauuaccuauauuaaccauaucagaauuaacaaauucccgauuuccuaucccuaucgaacagcuauauacagcaccaaacgaaaacaaugucguacaaugucaaaacgguagauguacccuagauggcgaacuacaaggcacaacacaacucuuaaguuccgcaguuugcucauacagaggcagaacaguagcaaacucaggcgauaauugggaccaaaaccuauuacaacucacauacccauccggcgcuuccuacgaccccacagaugaaguaccagcuccacuugguacacaagacuucucaggcauacuauaugguguucucacacaagauaacguaucagaaggaaccggcgaagccaaaaaugcaaaaggaguauacauaucaacuaccaguggaaaauuuacaccaaaaauuggauccauaggcuuacacucaauaaccgaaaauguacacccaaaccagcaaucacgauucacacccgucggaguagcacaaaaugaaaauacuccuuuucaacaauggguauuaccucacuaugcaggagcacuagcacuuaauacaaauuuagcaccagcaguagcaccaacauucccaggagaacaauuauuauucuucagaaguagaguuccaugcguacaaggauuacaaggccaagacgcauucauugauugucuauuaccucaagaauggguaaaucacuucuaccaagaagcagcucccucacaagcugauguagcuuuaauaagauacguaaauccagauaccggaagaacacucuuugaagcaaaauuacauagaucuggauuuaucacuguuucccacacaggagcuuacccauuaguaguuccaccaaauggacauuucagauuugacucuuggguaaaccaauucuacucccuagcaccaaugggaacuggaaauggucgucgaagagucuaa

SEQ ID NO: 33344 - RNA, 1626 nt, Artificial Sequence
  derived and/or modified sequence opt6 from VP1__Norovirus_and/or_Norovirus-like__AB809990
augaaaauggcuucuaacgaugcugcacccucaaaugauggagcagcaucauuaguuccugaagcaauuaaugaaacaaugccccuugaaccuguagcaggagcuuccauagcugcaccuguagccggccaaaccaacauuauagauccauggauaagaacaaauuucguacaagcaccaaauggagaauuuacaguuuccccacgcaacucaccaggugaaauauuauuaaauuuagaauuagguccagaucuaaauccuuacuuagcccauuuaucucgaauguauaaugguuacgcaggcgguguugaaguccaaguuuuacuagcaggaaacgcauucacugccggaaaaauacuauucgcagcuauuccuccaaacuuucccgucgacaugauaaguccugcacaaauaacaauguuaccacaccuaauuguagacguccgaacacuggaaccuaucaugaucccauuaccugacguacgaaauguauucuaccauuucaauaaccaaccccaaccuagaaugcgucuaguagcuaugcuauauacaccucuaagaucaaauggcaguggugaugauguauucacuguaucaugcagaguucuaacuagaccaacaccagauuucgaguucauauacuuaguaccaccgucaguagaaagcaaaacuaaaccuuucacauuaccuauacucacaauaucugaauuaacaaacucucgauucccaauaccaauugaacaauuauacacugcaccaaaugaaaauaacguuguacaaugucaaaauggacgaugcacacuagauggugaauuacaaggcacuacccaauuauuaucaucugcaguaugcucauaccgaggacgcacaguagcaaacuccggugauaauugggaccaaaaccuacuacaacuaacauauccaucaggcgccaguuacgaccccacagaugaagugcccgcacccuuaggaacacaagacuucucaggcauuuuauacggaguacuuacacaagacaauguaucagaaggaacaggagaagcuaaaaaugcaaaaggagucuacauuucaacaaccucaggaaaauucacaccuaaaauaggaucaaucggccuucauucaauuacagaaaauguacauccaaaucaacaauccagauuuacacccguuggaguagcacaaaaugaaaauacuccauuccaacaauggguauuaccacauuacgcuggagcauuagccuuaaacacaaaucuagccccugcaguagcacccacuuuuccuggcgaacaauuauuauucuuuagaucuagaguaccaugcguacaaggauuacgaggacaagaugccuuuauagacugccuauuaccucaagaauggguaaaucacuuuuaccaagaagcagcaccaucacaagcagauguagcucuaaucagauauguuaauccagacacuggacgaacauuauuugaagcaaaauuacaucgaucaggauuuauaacaguaucccacaccggagcuuauccauuaguaguaccuccuaacggacacuucagauuugacucaugggucaaucaauuuuauucauuagcaccuaugggaacaggcaauggccgaagaagaguauaa

SEQ ID NO: 33345 - RNA, 1626 nt, Artificial Sequence
  derived and/or modified sequence opt6 from VP1__Norovirus_and/or_Norovirus-like__AB809977
augaaaauggcaucgaaugacgccgcgccaucuaacgacggagcugcuucacuuguacccgaagcaauaaacgaaacgaugccccuugaaccaguagcuggugccuccauagccgcaccaguugcaggacaaacaaacauaauagauccauggauacguaccaauuucguacaagcuccaaacggagaauuuacaguaucaccacgaaacucacccggugaaauacuacuaaauuuagaauuaggcccagaccuaaaucccuacuuagcacaucuaucuagaauguacaauggauacgcaggaggcguagaaguacaaguacuacuagcaggaaacgcauucaccgcaggaaaaaucuuauucgcugcaauaccaccaaauuuucccguagacaugauaucaccagcacaaauuacaauguuaccacaucuaauaguagauguucgaacacuugaaccaauaaugauaccuuuaccagauguaagaaauguauuuuaccauuucaauaaucaaccacaaccacgcaugcgauuaguagcaaugcucuauaccccucuaagaucuaaugguucaggagacgauguauuuacuguaucuuguagaguacuaacaagaccaacuccagauuucgaauuuauauacuuaguaccaccaucaguagaaaguaaaaccaaacccuucacacuacccauacuaaccauuucagaauuaacaaacucaagauucccaauaccaauagaacaauuauacacagcuccaaacgaaaauaauguaguccaaugucaaaauggaagaugcacucuagauggcgaacuacaaggaacuacccaacuacuuuccucagcuguuugcucuuacagagguagaacuguagcaaacucuggugacaauugggaucaaaaucuacuucaauuaaccuaucccucaggcgcuucauaugacccaaccgaugaaguaccagcaccuuuaggaacacaagacuucucaggaauuuuauacggaguacuaacacaagacaauguaucagaaagaacuggagaagcuaaaaacgcaaaaggaauauauauaucuacaacauccggaaaauuuacaccaaaaaucggauccauaggauuacauuccauaacagaaaacguacaucccaaccaacaaagucguuuuacaccuguugguguagcacaaaaugaaaauacuccuuuccaacaauggguauuaccucacuaugcaggagccuuagcccuaaauacaaauuuagcaccagcaguugcaccaacauucccgggagaacaacuucuauuuuucagaucaagaguaccaugcguacaaggacuacaaggccaagacgcauucauagacugcuuauuaccucaagaauggguaaaucacuuuuaucaagaagccgcaccaucucaagccgauguagcacuaaucagauauguaaaucccgacacaggccgaacacuauucgaagcuaaacuucauagaucagguuuuauaacuguaucccauacaggcgcauacccccuagucguaccaccuaacggacacuuucgauuugacucauggguuaaccaauucuacucuuuagcaccaaugggaacaggcaacggaagacguagaguauaa

SEQ ID NO: 33346 - RNA, 1626 nt, Artificial Sequence
  derived and/or modified sequence opt6 from VP1__Norovirus_and/or_Norovirus-like__AB809987
augaaaauggcaucaaaugacgcagcacccucuaacgacggagcugccucucuaguacccgaagcuauaaaugaaacaaugccacuagaaccuguagcaggagcaucuauagcagcaccaguagcagggcaaaccaacauaauagacccauggauaagaacuaauuuuguacaagcaccaaauggcgaauuuacuguuucaccacgaaauucuccuggagaaauacuacuaaauuuagaauuaggaccagaucuuaacccauaucuugcccaccuaucgcgaauguacaacgguuaugcuggcggcguagaaguacaaguacuucucgcaggcaacgcauucacagcuggaaaaauacuuuucgcagccauaccaccaaauuucccaguugauaugauaucaccagcccaaauuacaaugcuaccucaccuaauaguugacguacgcacacuagaacccauaaugauacccuuaccagacguaagaaaugucuucuaccacuucaacaaccaaccccaaccuagaaugagauuaguugccaugcuauauacaccauuaagaucaaauggaagcggagacgacguauuuacugucucauguagaguauuaacaagaccuacaccagacuuugaauuuauauaccucguaccaccaucaguagaaucuaaaacaaaaccuuuuacauuaccaauauuaacaauuucggaacuaacaaacuccagauucccuauaccaaucgaacaauuauacacagccccgaacgaaaacaacgucguacaaugucaaaauggaagauguacucuagacggagaauuacaaggaacaacccaacuuuuauccucugccguauguucauauagaggaagaacaguagcaaauucaggagacaacugggaucaaaacuuacuccaauuaaccuauccaucaggagcaucauacgaccccaccgacgaaguuccagcaccacuaggaacacaagacuucucaggcauacucuauggaguccuaauacaagauaaugucucagaaggaacaggagaagccaaaaacgccaaaggcguauauauaucaacaacaucaggaaaauuuacuccaaaaauaggauccauaggacuccauucuauaacugaaaacguucauccaaaucaacaaucaagauucacaccaguaggaguugcucaaaacgaaaacaccccauuccaacaauggguauuaccacauuaugcaggagccuuagccuuaaauacaaaucuagcuccugcaguagcaccgacuuuccccggcgaacaacuucuauucuucagaucaagaguuccaugcguucaaggucuaagaggacaagaugcauuuauagacugcuuauuaccacaagaauggguuaaucauuuuuaccaagaagcagccccuucacaagcagauguagcacuuauaagauacguuaauccagauacaggaagaacauuauucgaagcaaaauuacacagauccgguuucauaaccguuucacacacaggagcauacccauuggucguacccccaaauggucacuuuagauuugauuccuggguaaaucaauucuauucauuagcaccaauggguacaggaaacggaagacgaagaguauaa

SEQ ID NO: 33347 - RNA, 1626 nt, Artificial Sequence
  derived and/or modified sequence opt6 from VP1__Norovirus_and/or_Norovirus-like__AJ844469
augaugauggcaaguaaagaugcacccuccaacauggacgguacuucaggagcaggccaauuaguaccagaagcaaauacagcagauccuauaccacuagaaccaguuguaggagcagcuacagcagcagcaacugcaggacaaguaaauaugaucgacccauggauaaugaauaacuuuguccaaucaccagaaggagaauuuaccauaucaccaaauaacacaccaggagauauauuauucgacuuacaauuaggaccucaccuaaauccuuucuuacaacaccuaucacaaauguauaacggauggguuggcaauaugagaguucgaauccuauuagcugguaaugcauuuuccgcuggaaaaauaauaauaugcuguguaccaccaggcuuuacagcacaaaauauaucaauagcacaagcaacaauguuuccacacguaaucgcugacguacgaguacuugaacccauagaaauuccucuagacgacgucagaaauguauuauuucacacuaaugaaaauaaaccaacaaugagauuacugugcaugcuauauacacccuuaagggcugguggagcaucugcugguacagacccuuuuguaauagcaggcagaguauuaacaugucccucaccugauuucaauuuccuauucuuaguaccaccaucaguagaacagaaaaccagacaacuuacaguaccuaauauaccauuaaauaacuuaucuaauucccgaguaccagcaaugauaucaaaaauggcaaucaguucugaugcaaaucaaguaguacaauuucaaaaugguagauguaccacagacggacaauuauuaggaaccacaccuauaucagccucacaaguagcuagaauacgcggaaaaguauucuccaccucaucuggaaaaggauuaaacuuaucagaacuagacggaagucccuaucaugcauucgaaagcccugcaccuguuggauuuccagauuuaggauauugcgauuggcauguaucaucauuuaaagcagaccauaacucauccucagacccaaucucccgacuagauauaaagcaaggagcauccuucgcaccacacuuagguucuaucgaauauacuacuucacaaaauccagacggugaucaauuaggaacacuaacguggauaagcucaccuucagaugauacaccaggacacggcacaauuaauuuauggaaaauaccaucauauggaagcaccguaacagaaagcguacacuuagcaccaccaauauacccaccaggauucggagaaacauuaguauauuucaugucugauuuuccaauaggccauacaaauucaaauauggcacaaguaccauguacauuaccacaagaauuuguagcucacuucguaaacgaacaagcuccaguaagaggcgacgcagcauuacuacauuacguagacccagacacacauagaaacuuaggugaauuuaaguuauauccugaaggauacauaacuuguguaccaaauaccggaggaggagguccacaaucacuaccuauaaauggaguauucauauuuucaucuuggguaucacgcuauuaccaauuaaaaccaguaggaacugcagguccugcaagacgucucuaa

SEQ ID NO: 33348 - RNA, 1626 nt, Artificial Sequence
  derived and/or modified sequence opt6 from VP1__Norovirus_and/or_Norovirus-like__AY675555
augaaaauggcaucaaaagaugcaccaucaaacauggauggaacaucaggcgcaggacaauuaguaccugaagccaauacugcugacccaaucccauuagaaccaguaguaggagccgcaaccgcugccgccacagcaggacaaguaaauaugauugacccauggauaaugaauaacuuuguacaaucaccagaaggagaauuuacuauaaguccaaacaauacaccaggugacauauuauuugaccuacaacuaggaccacaucuaaauccauuucuccaacacuuaucacaaauguauaauggcuggguuggaaauaugagaguacggauauuauuagcaggaaaugcauucagcgcaggaaaaauuauaauauguugcguuccuccagguuuuacagcccaaaacauaucaauugcacaagcaacaauguucccacacguaaucgcagauguuagaguauuagaaccaaucgaaaucccuuuagacgacguacgaaacguacuauuccauacaaacgaaaauagaccaacaaugagacuauuaugcaugcuauacacaccacuaagagcaggaggagcaucagcaggaacagacccauuugucauagcaggcagaguuuuaacauguccaucuccugauuucaacuuuuuauucuuaguaccaccuucaguagaacagaaaacccggcaacuuacaguuccaaauauaccacuaaacaauuuaucaaauuccaguguaccagcuaugaucaauaaaauggcaauaucuucagacgcaaaccaaguaguacaauuucaaaauggccgaugcacuaccgauggccaacuauuaggaaccaccccaaucucagcaucucaaguagccagaauaagaggaaaaguauucuccaccuccucaggaaaaggauuaaacuuaucagaacuggaugguucuccauaucacgcuuucgaaucuccagcccccguaggauucccugaccuaggacauugcgacuggcauguuuccagcuuuaaagcagaucaaaacucaucaggagauccaaucuccagauuagauauaaaacaaggagcaucuuuugcaccucacuuaggaucgauagaauauacuaccucgcaaaacccugacggaggacaacuagguacauuaacuuggauaagcucaccaucagaugauacaccaggucacgguacuauaaacuuauggaaaauaccaucauacggaucaacaguaacagaaucaguacaccuagcaccaccaauauauccaccaggcuuuggagaaacccuaguuaaucuaaugucaaauuucccaauaggacacacaaacucaaacauggcucaaguuccauguacacuaccccaagaauuuguagcacacuucguaaacgaacaagcaccagucagaggagaugcagcacuuuuacacuauguugacccagauacacaucguaacuuaggugaauuuaaacuauauccagaaggauauauaacaugcgucccaaauacagguggaggaggcccacaaucucuaccaacaaauggaguauucauauucucaaguuggguaucaagauauuaccaacucgaaccaguaggaacagccgguccagcacgacgacuauaa

SEQ ID NO: 33349 - RNA, 1626 nt, Artificial Sequence
  derived and/or modified sequence opt6 from VP1__Norovirus_and/or_Norovirus-like__EU085479
augaaaauggccucaucagaugcaacaccaagcaacgauggagcagcaggucuagucccagaaauaaauaaugaagccauggcucucgacccaguagcaggagcagccauagcagcaccacuaacaggacaacaaaauaucaucgacccauggauaaugaauaacuuuguacaagccccaggaggagaauuuacagugucaccaagaaauucuccaggagaagucuuacuaaaucuagaauuaggaccagaaauuaacccauauuuagcacaccuugcccgcauguacaacggcuacgcuggcggauucgaagugcaaguuguacuagcagguaaugcauuuacagcaggaaaaauaauauuugcugcaauaccaccaaauuuuccuauugauaaucuuucagcagcacaaauaacuaugugcccacauguuauugucgacguaagacaacuagaaccaguaaaucuucccaugccugacguaagaaacaauuucuuucauuauaaucaaggaagugauucaagauuaagauuaauagcaaugcuauacaccccauuaagagcuaauaauucuggugacgauguauucacaguaucuuguagaguucuaaccagaccuucaccagauuuuucauuuaauuuccuaguuccaccaacaguagagucaaaaaccaaaccuuucacauuacccauacuaacuaucagugaaaugaguaacucucguuucccaguaccaauagacucacuacauaccucaccaacugaaaauauuguaguacaaugccaaaauggaagaguuacacucgacggagaauuaaugggaacaacacaauuacucccaucacaaauaugugcauucagaggaguauuaacaagauccacaucacguacaucagaccaagcugauacagcaacaccucgccuauuuaauuauuauuggcauauacaauuagacaaucucaacgguacacccuaugauccagcagaagauauaccaggaccucuagguacuccagacuuucgaggaaaaguauucggaguugccagccaacgaaauccagauucaacaacgagagcacaugaagccaaaguagacacaacagccggaagauuuaccccaaaauuaggauccuuagaaauauccacagaaucuagcgacuucgaucaaaaccaaccaacacgauuuacucccguagguauaggcguagaccacgaaaccgauuuucaacaauggucacuaccugacuauucaggucaauuuacccauaacaugaaucuagcgccagcaguagcaccaaauuuuccaggagaacaauuauuauucuuuagaucucaacuaccuucuucaggcggacgaucaaauggaauuuuagauugucuugucccucaagaauggguucaacacuucuaccaagaaucagcaccagcacaaacacaaguugcacucguacguuacguaaacccagacacaggacguguacuauuugaagcaaaacuucauaaauuaggauuuaugacuaucgcuaaaaauggggacaguccaauaacaguaccaccaaauggauauuuccguuucgaaucuuggguaaauccauuuuauacacuagcaccaaugggaucaggauaa

SEQ ID NO: 33350 - RNA, 1626 nt, Artificial Sequence
  derived and/or modified sequence opt6 from VP1__Norovirus_and/or_Norovirus-like__AF542090
auggcuucaaaagaugcaccaguaucuggaacagauggagcugcaggucuaguaccagaaucucaacaagaaguccuaccuuuagaaccaguagcaggaguucaauuagcugcuccuguugcaggacaaucuaauauaauagauccauggauacgaaugaauuuuguacaagccccagcuggagaguuuacaguaucacccagaaacgcaccaggugaaguucuaauagauuuagaauuaggaccagaacuaaauccauauuuaaaucaccuugccagaauguauaacggauacguaggaggaauggaaguagaaguuguauuagccggaaaugcauuuacagcaggaaaaguacuuuuugcagcaguaccaccuucauuuccaacucauggcauaacagcagcucaagcaacaauguuaccccauguaauaguugauguuagacaacuugaaccaguccgacuaccacuuccagauguuagaaacguaauguuucauuuuugccaagaaaauaaagaaccaagaaugagaauagucgcaauuuuauacacuccacuacgagcuaauggagcaggagaugacguauuuacaguaucauguagaguucuaacaagacccucuccagacuuugacuuuauauuuuuaguuccaccauccguagaaucaaaacuuaaacaauuuacccuaccaaaucuacaaccaaacgaaaugacaaauucaagguucccaacaucaguaacacaacuuuauacaaguccaaauacaaauuuaguaguucaauuucaaaauggacgcugccaauuagacggaacacuguuaggaaccacaccaguacgugcagcagauauuuguucuuuucguggaaucaccucagcugaaguagauacaacugauucaagcagagucgccggaucucaucgcguaauggugcaauuaaaagaaccugauggagaagaauuuagcccaaccggacccaauccugcacccguuggaacuccugauuuucaagccgcaauauuuggcacccuaucacaaagaaacaauacagguggaucaggacaaaauucaaauagaucacauuucgcuuauuuuuauacacguaauccaacuuuugccccaggaaucggaacuguaguauucucuuuugauacuaccgacuuccaaaacagacaaccaacaaaauuuagucccaguggugucuaugaugacgacucaucagaaccauuuaaucaauuuaguuuaccauacuauaaugguucauuaggagcaguugaugcuggaaaacuugcaccaccaguugcaccaaauuauccaggagaacaaauacuauacuucagaggcaauauuccauucaaaggaggauacggaggaggugaaaucgacuguuuacuuccgcaagaauggauaacucauuuauacgcugaacaagcuccuacacaaggugaugccgcuuuauuaagauacuauaacccugacacaggacgaguacuuuuugaauguaaacuacauagagaagguuuuaucaccauuaauuauacaggaucaaaugcacuagcuguaccuguaaacggaguauuuagauuugaagguuggguaaauaaauuuuauacuuugacaccaauguaa

SEQ ID NO: 33351 - RNA, 1623 nt, Artificial Sequence
  derived and/or modified sequence opt6 from VP1__Norovirus_and/or_Norovirus-like__KM386680
augaaaauggcuucaaaugaugcaacaccuucaaaugacggagcugcuggucuaguaccagaaucaaauaaugaagcaauggcauuagaaccaguagugggugccaguuuagcagcaccaguaaccggacaaacaaauauuauugacccuuggauaagaacaaacuuuguacaagcuccuaauggugaauuuacaguuuccccaagaaauucaccaggagaaauucuaguaaaccuagaacugggucccgaauuaaacccuuacuuagcgcaccuagcaagaauguauaauggauaugcaggagguauggaaguacaaguaauguuagccggaaaugcauucacagcuggcaaaauaauauuugcagcuguaccaccauacuuuccugucgaaaaucuaucaccaccacaaauaacaauguucccacauguaauaauagauguacgcacccuugaacccguacuauuaccaaugccagauguacgauccacucuauuucauuucaaucaaaaagaugaaccaaaaaugcgauugguagcaauguuauauacuccauuacguaguaauggaucuggagacgaugucuucacagucucgugcagaauacuaacacgaccaucaccagaguuugacuucacuuaucuaguaccaccaacuguagaaucuaaaaccaaaccuuuuacauuaccaguacucacucuaggugaacuaucuaauucuagauuuccauuaucaauagacgaaaugguaaccucaccaaaugaaucaauaguaguacaaccacaaaacggaagaguaacucucgauggagaacuuuuaggaacuacacaacuacaagcauguaauaucuguucaauaaggggaaaaguaacaggacaaguaccaaaugaacaacauauguggaaccuagaaauaacaaauuuaaaugguacucaauuugacccaacugaugauguaccagccccauuaggaguaccagauuucgcaggcgaaguuuuuggaguacuaucccaacgaaauagaggugaauccaaccccgcaaaccgugcucaugaugcaguaguugcuacauacucagauaaauauacacccaaauuaggauuaguucaaaucggaacauggaauacaaaugauguagaaaaccaaccaacaaaauuuacaccaauaggauuaaacgaaguagcaaauggacauagauuugaacaauggacuuuaccgagauauucuggcgcacuaacacuaaauaugaauuuagcaccagcaguagcaccauuguuuccaggcgaaagauuauuauucuuuagaucuuauguaccucuaaaaggaggauuuggaaauccagcaauagauugccuggucccacaagaauggguacaacauuucuaccaagaauccgcaccaucauuaggagauguagcucuaguuagauauguaaaucccgauacugguagaguuuuauuugaagcaaaacuccauaaaggaggauuuuuaacaguauccuccacaucaacaggaccaguuguaguaccagccaauggauauuuuagauuugacucauggguaaaccaauuuuauucacuagcacccauggguacaggcaauggaagaagaagauuucaauaa

SEQ ID NO: 33352 - RNA, 1623 nt, Artificial Sequence
  derived and/or modified sequence opt6 from VP1__Norovirus_and/or_Norovirus-like__AF397156
augaaaauggcaucaaacgaugcaacuccaucaaacgauggagcagcaggucuaguaccagaaucuaacaacgaagcaauggcauuagaaccaguugugggagcaucccuagcagccccuguaacaggacaaacaaacauaaucgaccccuggauaagaacuaauuuuguucaagcaccaaauggagaauuuacagucucaccccgaaacagcccaggagaaauacucguaaauuuagaauuaggaccagaauuaaauccguaccuugcacauuuagcacgcauguauaacggcuacgcaggaggcauggaaguccaaguaaugcuugcaggcaaugcauuuacugcuggaaaaauaauauuugccgcaguaccacccuauuuuccaguugaaaaucuaaguccaagucaaauaacaauguuuccucauguaauaauugaugucagaaccuuagaaccaguacuauuaccaaugccagauguaagauccacuuuauuccauuuuaaccaaaaagaugaaccaaagaugagauuaguagcaaugcuauacacuccacuaagaucuaaugguucaggagaugacguuuucacaguauccugucgaauacuaacaagacccaguccagaguucgacuucacauauuugguacccccaacuguagaaucaaaaacaaaaccuuuuaccuuaccaguauuaaccuuaggggaauuaucaaauucacgauucccauuaucaaucgaugaaaugguaacaucuccaaaugaaucuauaguaguucaaccacaaaauggaagaguaacacucgauggagaacuauuagguacaacacaauuacaagcauguaauaucuguucuauuagagguaaaguaacgggccaaguaccaaaugaacaacauauguggaaccuagaaauaacaaaucuaaauggaacucaauuugacccaacagaugauguaccagcaccuuuaggaguaccagauuuugccggugaaguuuuuggaguacucucccaaagaaauagaggugaaaguaauccagcaaacagagcucaugaugcaguaguagcuacauauucagauaaauacacaccuaaacucggauuaguacaaauugguacauggaauacaaaugacguagaaaaucaaccaacaaaauucacaccaauaggauuaaaugaaguugcgaauggucaccgauuugaacaauggacucuuccaagauacagcggagcucuuacucuaaauaugaacuuagcaccagcaguagcacccuuauucccaggugaacgauuauuauucuuuagaucauauguaccauuaaaaggagguuuuggaaauccggcaauagacuguuuaguaccacaagaauggguucaacauuuuuaccaagaaucagcuccaaguuuaggagauguagcgcuaguaagauauguuaacccagauacuggacgaguacuauuugaagcaaaacuacauaaaggaggauuccuuacaguaaguucaacaucaacaggaccaguuguuguuccagcaaauggauauuuuagauuugauccuuggggaaaucaauucuauucauuagcaccaaugggaacaggaaacggaagaagaagauuucaauaa

SEQ ID NO: 33353 - RNA, 1623 nt, Artificial Sequence
  derived and/or modified sequence opt6 from VP1__Norovirus_and/or_Norovirus-like__AF414422
augaaaauggcaucaaaugaugcaaccccaucaaaugacggagccgcaggucuaguaccagaaucaaacaaugaagcaauggcauuagaacccguaguuggagcaucuuuagccgcaccuguaaccggucaaacaaacauaaucgaucccuggauucguacuaacuuuguacaagcuccaaauggcgaauuuacaguaucucccagaaauucaccaggagaaauucuaguaaaucucgaauuaggaccagaauuaaauccuuacuuagcucaucuagcuagaauguauaauggcuaugccggaggcauggaaguacaaguaauguuagcaggcaacgcauucacagccgguaaaauaaucuuugccgcaguaccaccuuauuucccaguagaaaaucucucuccaucacaaauaacaauguucccucauguaauuauagacguaagaacacuagaaccuguauuacuaccaaugccagauguaagaucuacacucuuccacuuuaaccaaaaagaugaaccaaaaaugagauuaguagcaauguuauacaccccacuuaggucaaacgguucuggagaugauguauuuacaguuuccugucgaauauugacaagaccaucuccugaauuugacuucacuuauuuaguaccaccaaccguugaaaguaaaaccaaaccauucacucuacccguauuaacacuaggugaauuaaguaauucaagauuuccacuaucgaucgaugaaaugguaacuucaccaaacgaaaguauaguuguacaaccacaaaacggaagagugacucucgacggagaacuuuugggaacuacucaaccacaagcaugcaacauuuguucaauaagaggcaaaguuacaggucaaguaccuaaugaacaacauacauggaacuuagaaaucaccaaucuaaauggaacucaauucgauccaacugaugauguaccagcuccauuaggaguuccagauuucgcaggagaaguauuugguguacuaagucaacgaaacagaggagaauccaaccccgcaaauagagcacaugaugcagucguagcaacauacucagauaaauauacaccuaaauuaggccucguacaaauuggcaccuggaauacaaacgauguagaaaaucaaccaacaaaauuuacaccaauuggucuaaaugaaguagcaaauggacauagauuugaacaauggacacuaccaagauauucuggagcccuaacuuuaaauaugaacuuagcaccagcaguagccccacuuuucccaggcgaaagauuauuauucuuuagaucauacguaccacuaaaaggaggcuuuggaaauccagccauagacugucuuguaccacaagaauggguccaacauuuuuaccaagaauccgcccccagucucggagauguagcacuuguuagauauguaaaucccgauacuggaagagucuuauucgaagccaaacuacacaaaggaggauuccuaaccguaucuuccacauccacuggaccaguagucgucccugcaaacgguuauuuugguuuugauucauggguaaaccaauuuuauucuuuagcuccaaugggcacuggaaauggaagaagaagauuucaauaa

SEQ ID NO: 33354 - RNA, 1623 nt, Artificial Sequence
  derived and/or modified sequence opt6 from VP1__Norovirus_and/or_Norovirus-like__AF414423
augaaaauggccucaaaugaugcuacuccuucaaaugacggagcugcaggccuaguaccagaaaguaauaacgaggcuauggcacuagaaccaguaguuggagcaucacuagcagcuccaguaacaggacaaacaaauauaauagacccauggauuagaacaaacuucguacaagcaccaaacggagaauuuacaguaagcccacgaaacucaccaggcgaaauacuuguaaauuuagaaucaggcccagaauuaaacccuuaccuagcacaccuagcccgaauguauaacgguuaugcaggaggaauggaaguucaaguuauguuagccggaaacgcauuuacagcaggaaaaauaauuuuugcagcaguaccuccauacuucccaguagaaaaccuaucaccuucacaaaucacaauguuuccacauguaauaauagauguacgaacacuagaaccaguacuacuacccaugccagacguaagaucaacaccauuucauuuuaaccaaaaagaugaaccaaagaugcgcuuaguugcaauguuauacacaccauuaagaucgaacggaucuggagaugacguauuuaccguaucuugcagaaucuuaacacgacccucaccagaauuugacuuuacauaccuuguaccaccaacaguagaaucaaaaacaaaaccauuuacauuacccguauuaacccuaggagaauuaucaaauucaagauucccauuauccaucgacgaaaugguaacaucucccaaugaaaguauaguaguacaaccacaaaacggcagaguaacacuugauggaggauuacuuggcacaacacaauuacaagcaugcaauauauguucaauaagaggaaaaguuacaggacaaguaccaucugaacaacauauguggaaucucgaaauaacaaauuuaaacggaacucaauuugacccaacugaugauguaccagcuccucuggguguacccgacuuugccggagaaguuuuuggaguacuaucacaaagaaaccguggagaaucaaauucugcaaauagagcucacgaugcaguaguugccacauauagcgacaaauauacuccuaaauuagguuuaguacaaauaggaaccuggaacacaaaugacgucgaaaaucaaccuacaaaauuuacaccuauaggauuaaaugguguugcaaauggacaccguuuugaacaauggacacucccuagauacucuggagcauuaacacuuaauaugaaucuagcaccagcaguagccccacuauucccuggagaacgccuacuauucuuuagauccuacgucccucuaaaaggcggauuuggaaaucccgcaauugauuguuuaguaccacaagaauggguucaacacuuuuaucaagaaucagcaccaucacuaggcgaugucgcacuuguaagauacguaaauccagauacaggcagaguauuauuugaagcuaaacuacauaaaggaggauuucucacaguaucaagcacuuccacaggaccaguuguaguaccagcaaaugguuauuuuagauucgauaguuggguaaaccaauuuuauucauuagcaccaaugggcacaggaaaugguagaagaagauuucaauaa

SEQ ID NO: 33355 - RNA, 1623 nt, Artificial Sequence
  derived and/or modified sequence opt6 from VP1__Norovirus_and/or_Norovirus-like__GQ856476
augaaaauggcaagcaacgacgcagccccaucaaaugauggagccgccggacucguaccagaaguaaacaacgaaacaauggcacuagaaccugucgcgggagcaucaauugccgcaccauuaacaggacaaaauaauguuauugauccauggauacgauuaaacuucguucaagcaccaaauggagaauuuacaguaucaccaagaaacucaccuggagaaauucuacuaaaccuagaauuaggaccagaauuaaacccauacuuagcucaucuuaguagaauguacaacggcuacgccgguggaguagaaguucaaguacuacuugcaggaaaugcauucacagcaggaaaauuagucuuugccgcuauaccaccacacuucccaguagacaaucuaucuccuggucaaaucacaauguuuccccacguaauuaucgauguaagaacauuagaaccuguccuacuaccccucccagauguaagaaauaauuucuuucauuauaaucaacagucagaucaacgaaugagauuaguagcaauguuauacaccccacuacgaaguaauggaucgggagaugacguauuuaccgucucauguagaguuuuaacaagacccucuccagauuuugauuuuaauuaccuaguuccaccaacaguagaaucuaaaacuaaaccauuuucaguaccaguacuuacucuaaacgaacuaaccaauucacgauucccaguacccauugacgcaauguacacaucaccaaaugauucaauaguaguacaaccccaaaacgguagagcaaccauagacggagaacuacuaggaacaacacaauuaauuccuucaggaauauguucuuucagaggaaaaaucacaacccaccuagcagacgaucgacauuuauggaauauucaaguaucaaacuuaaauggaaccccauuugacccaacagaugauguaccagcaccacuaggaaugccagauuucuccggacaaauauucggaguaguaucacaacgugacacaggaacaaauccagcuaaucgagcacacgacgcaguucuagcaacauauucagcaaaauauacaccaaaacuaggcucaguacaaaucggaacaugggacacagaagaccuacuugaaaggcaaccaguaaaauuuacaccgguuggauuaaacgaaauaggacaagacaaacauuuugaucaauggguauuaccaaauuacucuggagcucuugguuuaaauaugcauuuagcuccugcagucucaccuuuauuuccaggagaaagauuauuauucuuccgaucauauaucccacuaaaaggaggacauggugauccauucauagauugucuaguaccacaagaauggauacaacacuuuuaccaagaaucugcaccagcccaaucaucaguugcacuauuaagauacguaaaccccgauacaggaagaacacuuuuugaagcaaaauuacauaaaggaggcuucauaaccguaaguucaacagaaaacagaccaguaauaguaccaccaaacgguuacuuuagauuugacucauggguuaaccaauucuauucauuagcaccaaugggaacaggaaacggccgaagaagaaugcaauaa

SEQ ID NO: 33356 - RNA, 1623 nt, Artificial Sequence
  derived and/or modified sequence opt6 from VP1__Norovirus_and/or_Norovirus-like__AJ277607
augaaaauggcaucaaacgaugcaacaccaucuaacgauggugcugcuggauugguaccagaaucuaauaaugaagcaauggcuuuagaaccuguugucggagcaucauuagcagcaccuguaacaggccaaacaaauauaauagauccauggauuagaacaaauuuuguacaagcaccaaacggagaauuuacaguaucaccuaaaaauucaccaggagaaauacuuguaaaucuagaauuagguccagaacuuaacccauauuuagcacaccuagcacgaauguauaacgguuacgcaggagguauggaaguucaaguuaugcuagcaggaaacgcuuucaccgcaggcaaaauaauauucgcagcaguaccacccuauuucccuguagaaaaucuaucuccuucacaaauaacuauguucccccacgucaucauugacguccgcacacuagaaccagucuuauuacccaugccagauguaagaucaacacuauuucacuucaaccaaaaagacgaaccaaaaaugcgacucgucgcaaugcuauacacaccucuuagaucuaacggcucaggagacgauguauuuacaguaucauguagaauacucacacgaccaucucccgaauuugacuuuacauaccuaguaccaccuacaguagaaucuaaaaccaaaccauuuacacuaccaguauuaacacuaggagaacuaucuaacucaagauuuccauuaucgauugaugaaaugguaacaucgccaaaugaaucaauugucguacaaccacaaaauggaagaguuacauuauauggugaauuauuaggaacagcacaacuacaagcaugcaauauaugcucaaucagagguaaagucacaggacaauuuccaaaugaacaaaauauguggaaucucgaaauaacaaaucuuaacgguacucaauucgaucuaacagacgacguaccagcuccucuagguguaccugauuuugcaggcgaaguauucgguguauuaucccaaagaaacagaggugaaucuaacccagcaaaucgcgcccaugaugccguagucgcuacauacagugauaaauauacuccaaaauuaggauuaguacaaauugguacauggaacacuaaugauguagaaaaccaaccaaccaaauucacaccaauaggacuaaacgaaguugcaaacggacacagauuugaacaauggacacuaccuagauauagcggcgccuuaacacucaacaugaaccuagcaccagcaguagcaccuuuauuuccaggagaaagauuacuauucuuuagaucauacguaccccuaaaaggcgguuuuggcaauccagcaauagauugccuaguaccacaagaauggguucaacauuucuaucaagaaucagcuccaucucuuggugauguggcacuuguuagauacguaaauccagauacaggacgaguauuauucgaagcaaaacuacacaaaggcgguuuucuaacugucucaucaacaucuacaggaccaguaguaguuccagcuaauggauauuucagauucgauucauggguaaaucaauuuuauucuuuagccccaaugggaacaggaaaugguagaagacgcuuccaauaa

SEQ ID NO: 33357 - RNA, 1623 nt, Artificial Sequence
  derived and/or modified sequence opt6 from VP1__Norovirus_and/or_Norovirus-like__AY772730
augaaaauggcuucaaaugaugcugcaccaucuaaugauggagccgcagguuuaguucccgaaguaaauaacgaaacaauggcauuagaaccuguagcaggagcaucuauagcagcaccccuaacuggacaaaacaauguaauagauccauggauacgucuaaacuucguacaagccccaaacggagaauuuacaguaucaccacgaaacuccccaggagaaauacuacuuaacuuagaauuaggcccugaauuaaauccuuacuuagcccauuuagcaagaauguauaaugguuacgcugguggcguagaaguacaaguauuacuagcaggaagugcauucaccgcaggaaaauuaguauuugcagcaauaccaccacacuucccuguagauaaccuaucaccaggucaaauaacaauguuuccucauguaauaauagauguaagaacauuagaaccaguuuuauuacccuuaccagacgucagaaauaauuucuuucacuacaaucaacaaagugaucaaagaaugcgccuaguagcaauguuauauaccccucuaagaucuaaugguucaggagacgacguauuuacaguaucuugccguguccuuacucgaccaucaccagauuucgacuucaauuaccuaguaccaccaacagucgaaucaaaaacaaaaccauucucaguacccguacuaacccuaaaugaacuaacaaauucccguuuuccaguaccaauagaugcaauguacacaucuccaaacgauucaauaguaguacaaccacaaaacggcagagcaacaauagauggagaacuacuuggaacaacccaauuaauaccaucaggcauauguucauuuagaggaaaaauaaccacucaucuaucagaugaucgacaucuuuggaacauacaaguauccaaccuuaauggaacaccauuugacccuacagaugacguucccgcaccacugggcaugcccgauuucucaggacaaauuuucggagucguuucacaaagagacacaggaacaaacccagccaacagagcucaugacgcagcacuagcaacauauuccgcaaaauauacaccaaaacuaggaucaguacagauaggugccugggauacagaagaucuauuagaacgacaaccugucaaauucucuccaguuggauuaucagaaauaggacaagacaaacauuucgaucaauggguuuuaccuaauuacucaggagccuuagguuuaaauguccacuuagcaccagcuguaucuccacuauuccccggugaaagauuacuauuuuuccgaucauauauaccauuaaaaggcggacauggugacccauucaucgauugucuaguaccccaagaauggauccaacauuuuuaccaagaaucugcaccagcucagucaucuguugcauuacuaagauauguuaaucccgacacaggacgaacuuuauuugaagcaaaacuacauaaagaaggauuuauaacaguaucuucaaccgagaaucgcccuguaauaguaccaccaaacggauauuucagauucgacucuuggguuaaccaauuuuauucacuagcccccaugggaacaggaaauggaagaagaagaaugcaauaa

SEQ ID NO: 33358 - RNA, 1623 nt, Artificial Sequence
  derived and/or modified sequence opt6 from VP1__Norovirus_and/or_Norovirus-like__KT315718
augaaaauggcauccaaugaugcugcaccauccaacgauggagccgcaggccuagucccagaaggaaacaacgaaacacuuccacuagaaccaguagcuggagccgcaauagcugcuccaguuaccggacaaaauaauauaauugacccauggauaagaaccaacuucguucaagcuccaaauggagaauuuacagugucccccagaaauucaccaggugaaauauuauuaaaccuagaauuaggaccagaccuaaacccauaccucgcacaccuaaguagaauguauaacggauaugcaggaggaguagaaguccaaguauuacuagcaggcaaugcauuuacagccgguaaaauacuauucgcagccguaccaccuaacuuuccaguugaauuucuuucaccagcccaaauaacuaugcuaccacaccuaauaguagauguuagaacucuagaaccuauaaugauaccauuaccagauguaagaaacacauucuuucauuauaacaaccaaccaaauuccagaaugagauuaguagcaaugcuauacacaccucuuagaucaaauggcagcggcgacgauguuuuuacaguaucauguagaguauuaacacgaccaacaccagacuuugaauuuacauauuuaguucccccuaguguagaaucaaaaacuaaaccauucucacucccuaucuuaacacucucagaauuaacaaacucacgauuuccaguaccaauugauucacuauuuacugcacaaaauaacguacuacaaguucaaugucaaaacggaagauguacauuagauggugaacuucaagguaccacacaacuacucccaucuggaauuugcgcauucagagguagaguaacugcucaaauaaaucaaagagauagauggcauaugcaacuccaaaaucuaaauggcaccacauaugauccaacagaugauguuccagcacccuuagguacacccgacuucaaaggcguugucuucggaaugguaucacaaagaaauguaggcaaugacgcacccgauucaacucgagcucaacaagcaucaguaucaaccuacucaccgcaauuugucccaaaacuaggcucagucaaucuaagaaucaguaacaacgaugauuuccaauuucaacccacaaaauucacccccguaggaguaaaugaugaugaugauggacauccauuucgacaaugggaauuaccaaacuacucuggagaacuaacccuaaauaugaauuuagcaccuccuguugcacccaacuucccaggagaacaacuucuauucuuucgaucauucguaccauguucaggcggauauaaucaggguaucauugauuguuuaauaccacaagaauggauacaacacuucuaucaagaaucagcaccuucacaaucagacguagcacuaauuagauacguuaacccugacaccggaagaacucuauucgaagcaaaauuacaucguucugguuauauaaccguagcacauagcggagacuauccccuagucgucccagccaauggacauuuuagauucgauaguuggguuaaucaauuuuauucauuagcaccaaugggaacaggcaacggaagacgcagagcacaauaa

SEQ ID NO: 33359 - RNA, 1623 nt, Artificial Sequence
  derived and/or modified sequence opt6 from VP1__Norovirus_and/or_Norovirus-like__KT315708
augaaaauggcaucaaacgacgccgcacccucaaaugacggugcagcaggauuaguaccagaaggaaauaacgaaacauuaccacuagaacccgucgcaggagcagcuaucgcugcuccaguaacaggucaaaauaacauaauagacccauggauaagaaccaauuuuguacaagcaccaaacggagaauuuacuguuucaccaagaaauucaccuggagaaauauuacuaaaucuagaacuaggaccagauuuaaauccauaucuagcacauuuauccagaauguauaauggauacgcaggaggcguugaaguccaaguccuacuagccggcaacgcauuuaccgcaggaaaaauccuauuugcagcaguaccaccuaauuuuccaguagaauuuuuaucccccgcucaaauaacaauguuaccacauuuaaucguugacgucagaacacucgagccaauaaugauaccauuaccagacguaagaaauacauucuuucauuauucaaaccaaccaaauucaagaaugcgauuaguugcaauguuauauacaccauuaagaucuaacggauccggugacgacguauuuacaguauccuguagaguuuugacaagaccuacaccagauuuugaauuuacauacuuaguucccccaucggucgaauccaaaacuaaaccuuuuuccuuaccuauucuaacacuauccgaauuaacuaacuccagauuucccgucccaauagauucauuauuuaccgcacaaaauaacguacuucaaguucaaugccaaaacggaagauguacccucgacggagaauuacaaggaaccacucaacuccucccaucaggaaucugugcauuucgagguagaguaacagcacaaauuaaucaaagagauagauggcauaugcaauuacaaaaucuaaacggaaccacauaugacccaacagaugacguaccagcaccacuaggaacccccgacuuuaaaggaguaguuuuuggaaugguaucacaaagaaacgucgguaaugaugccccagguagcacaagagcacaacaagccuggguaucaacauacagcccacaauuuguaccuaaacuuggaucaguaaaucuaagaauaucagacaaugacgauuuccaauuucaaccuacuaaauuuacaccaguaggaguaaacgacgaugacgacggacauccuuuucgucaaugggaacuacccaauuauagcggagaauuaacauuaaauaugaaccuugcucccccaguagccccaaacuucccaggagaacaauuauuauucuuuagaucauuuguuccaugcucgggaggauauaaucaagguauaauagacugccuaauaccucaagaauggauacaacauuuuuaucaagaaucagcuccaucccaaagcgacguagcauuaauaagauacguuaauccagauacaggaagaacacuauuugaagcaaaacuacauagaucaggauauauaacagucgcacacucuggagauuacccucuaguaguuccagcuaauggauauuuuagauuugacuccuggguaaaucaauuuuacucauuagccccaaugggaacaggaaauggccgaagacgagcacaauaa

SEQ ID NO: 33360 - RNA, 1623 nt, Artificial Sequence
  derived and/or modified sequence opt6 from VP1__Norovirus_and/or_Norovirus-like__KT315697
augaaaauggcuaguaacgacgcagcaccaucuaaugauggagcagccgguuuaguaccagaaggaaauaacgaaacacuuccacuagaaccaguagcaggcgcagcaauugccgcaccuguaacaggacaaaauaauauaauagacccauggauaagaacaaauuuuguacaagcaccaaauggagaauuuacuguaucuccacguaacucuccuggagaaauacuacuaaacuuagaauuaggacccgauuuaaacccuuauuuagcacauuuaucuagaauguacaauggauaugcaggcggagucgaaguacaagucuuacuagccggcaaugcauuuacagcugguaaaauacuauuugcugcaguucccccaaacuuccccguagaauuucuauccccagcucaaauaacaaugcuaccacaucuuauaguagacguuagaacauuagaaccuauaaugauacccuuaccagauguaagaaauacuuucuuucauuauucaaaccaaccuaauagucgaaugagauuaguugcaaugcuauacaccccauuacguucuaauggaucuggugacgacguauuuacugucucauguagaguucuuacucgaccaacaccagacuucgaauuuacauacuuaguaccuccaaguguagaaucuaaaacaaaaccuuucucuuuaccaauuuuaacccuaucagaacuaacaaauaguagauuuccaguaccaauagacucauuauuuacugcccaaaacaauguacuacaaguucaaugucaaaacgguagauguacacuagauggugaauuacaaggaacaacccaauuacuaccuucuggaauaugugcauuucguggaagaguaacagcacaaauuaaccaaagagauagauggcacaugcaacuacaaaauuuaaauggcacuacauaugaccccacagaugacguuccagcaccacuagguacaccagacuucaaaggaguuguauuuggaaugguuucucaaagaaacguagguaaugaugccccaggaucaacuagagcacaacaagccugggucucaaccuauucuccacaauuuguaccaaaauuaggcucuguaaauuuaagaauaucugacaacgacgacuuccaauuucaaccaacaaaauucaccccaguaggaguaaaugaugacgacgauggccacccauuuagacaaugggaacuaccaaauuauucaggagaacuaacauuaaacaugaaucucgccccaccaguagcaccaaauuuuccaggagaacaacuauuauucuuuagaucauuuguaccauguucagguggauauaaucaagguauaauagauugucuuauaccacaagaauggauacaacacuuuuaucaagaaucagcaccaagccaaucugauguagcacuaauaagauacguaaacccagauacaggcagagcacuuuuugaagcaaaauuacaucguucaggauauauuacagucgcacacucaggugacuauccacuuguaguuccagccaauggacacuuucgauucgauaguuggguuaaucaauuuuacucacuagcuccaauggggacagguaauggaaggcguagagcacaauaa

SEQ ID NO: 33361 - RNA, 1623 nt, Artificial Sequence
  derived and/or modified sequence opt6 from VP1__Norovirus_and/or_Norovirus-like__KT315689
augaaaauggcauccaaugaugcagccccaucaaaugacggagcugcaggauuaguaccugaaggcaacaacgaaacauuaccucuagaaccaguagccggugcagcaauagcagccccagucacugggcaaaauaauaucauugacccuuggauaagaacaaauuuuguacaagcaccaaauggagaguucacagucuccccaagaaacucacccggagaaauccuacucaaucuagaauuaggaccagaccuaaacccauauuuagcacacuuaucuagaauguauaacggauaugccgguggaguagaaguacaagucuuauuagcaggaaaugcauuuacagcaggaaaaauacuuuucgcagcaguaccaccaaacuucccagucgaauuucuaucuccagcucaaauaacaaugcuaccacaccuuauaguagacguuagaacuuuagaaccaaucaugauaccacuacccgauguuagaaacacauucuuucacuauucaaaucaaccaaacucaagaaugagacucgucgcaaugcuauacacaccauuacgaucaaacggaucaggagacgaugucuuuacagucucuugucgaguacuaacaagaccaacaccugacuuugaauuuaccuauuuaguuccaccaucaguagaaucgaaaacaaaaccuuucucacuaccuauauuaacauuauccgaacucacaaacucuagauuccccguaccaauagacucacuuuuuacagcccaaaacaauguacuacaaguacaaugucaaaauggucgauguacccuagacggagaacuacaagguacaacacaauuauuaccauccgguauaugugccuuuagaggucgaguaacagcacaaauaaaccaaagagaucgauggcauaugcaauuacaaaaccuuaauggaaccacauaugauccaacagaugauguacccgcaccucuuggaaccccagacuuuaaaggaguuguauuugguaugguaucccaaagaaacguaggaaacgaugcucccgguucaacaagagcacaacaagcauggguaucaacauauucaccgcaauuugucccaaaauuaggaucaguaaaccuacgaauaucugauaacgacgacuuccaauuucaaccaacaaaauuuacaccuguaggaguaaacgacgaugaugauggacauccauuuagacaaugggaauuaccuaauuacucaggcgaacuuacucuuaauaugaacuuagccccaccagucgcaccuaauuuuccaggagaacaauuacucuucuuuagauccuucgugccauguucaggcggauauaaucaaggaauaauugauugucuuauaccucaagaauggauucaacauuuuuaccaagaaucagcaccaucacaaucagacguugcauuaauaagauacguuaacccagacacaggacgaacauuauucgaagcaaaacuacacagaucaggcuauaucacaguuucucacaguggcgauuauccccuaguaguaccagcaaauggucauuucagauucgauucuuggguaaaucaauuuuacuccuuagccccaaugggcacaggaaauggacguagacgagcacaauaa

SEQ ID NO: 33362 - RNA, 1623 nt, Artificial Sequence
  derived and/or modified sequence opt6 from VP1__Norovirus_and/or_Norovirus-like__KX216805
augaaaauggcuucaaaugaugcagccccauccaaugacggagcagcaggacucgucccugaaggcaacaaugaaacacuaccacuagaaccagucgcuggagcugcaauagccgcuccuguaaccggucaaaauaacauaauagauccauggauaagaacaaacuuuguccaagcaccaaacggagaauuuacaguaucuccacgaaauucacccggagaaaucuuauuaaaucuugaauuagggccagaucuaaaucccuaucuagcacacuuaucuagaauguauaacggcuacgccgguggcguagaaguacaaguuuuauuagcaggaaaugcauuuacugcaggcaaaauccuauucgcagcaguaccucccaauuuuccaguagaguucuuaucaccggcucaaauaaccaugcuaccacacuuaauaguagauguaagaacauuagaaccaauaaugauaccucuacccgauguacgaaauacauucuuucauuauuccaaucaaccaaauucacguaugagacuuguagcaaugcuauacacaccucuacgcucaaaugguucaggugacgauguauuuacuguaucauguagaguucuaacaagaccaaccccagauuucgaauuuaccuauuuaguaccgcccagugucgaauccaaaacaaagccauuuagccuaccaauauuaacauuaagcgaacuaacaaauagcagauucccaguaccgauagacucuuuauucacagcacaaaauaacguucuacaaguacaaugucaaaacggaagauguacccuagauggagaauuacaaggaaccacccaacuauuaccaacugguauaugugcauucagaggacgcguuaccgcacaaauuaaucaaagagauagauggcacaugcaacuacaaaaucuaaauggaacaacauaugacccuacagaugacguaccagcaccauuaggaaccccagauuuuaaaggaguugucuuuggaaugguaucacaacgaaauguaggaaaugaugcuccaggaucaacaagggcacaacaagccuggguaucuacauauucaccucaauucguaccuaaacuaggcucuguuaaccuaagaauaucugauaacgacgauuuccaauuucaaccuacaaaauuuacaccaguaggaguaaaugacgacgaugacggacauccauuccgucaaugggaacucccuaauuauucaggagaacuaacauuaaacaugaacuuagcaccacccgucgcaccaaauuuucccggagaacaacuacucuucuuucgaucauuuguaccaugcagcggaggauacaaccaagguauuauagauugucuuauuccacaagaauggauccaacacuucuaccaagaaucagcaccaucacaaucugauguagcucuuauaagauacguuaauccagacaccggacgaacccucuucgaagcaaaauuacauagaucaggauauauaacagucgcacauagcggcgauuacccauuaguagucccagcaaauggcuacuucagauuugauucuuggguaaaucaauuuuacucauuagcaccuaugggcacaggaaauggaagacguagagcacaauaa

SEQ ID NO: 33363 - RNA, 1623 nt, Artificial Sequence
  derived and/or modified sequence opt6 from VP1__Norovirus_and/or_Norovirus-like__KU557859
augaaaauggcaucaaacgacgcagcaccuucuaaugacggagcagcaggccuuguacccgaaggaaauaacgaaacauuaccauuagaaccuguugcaggagccgcaauugcagcaccaguaacaggucaaaacaauaucaucgacccauggauuagaacaaacuuuguccaagcacccaacggagaauuuacaguuaguccaagaaacucaccaggagaaauauuacuaaauuuagaacuaggaccagaccuaaauccauaccuagcucauuuaucucgaauguacaacggauaugcaggaggcguagaaguacaaguauuacuugcaggcaaugcuuuuacagcaggaaaaauccuuuucgcugccguaccaccaaauuuuccaguagaauuucuaaguccugcccaaauuacuauguuaccacacuuaauaguagacguuagaacacuagaaccaaucaugauaccauuaccagauguaagaaauacauucuuucauuauucaaaucaaccaaacucaagaaugagauuaguagcuaugcuuuauacaccauuaagaucuaacggaucaggugacgacguauucacaguaucauguagaguccuaacaagaccaaccccagauuuugaauuuacauaucuaguaccaccauccguugaauccaaaaccaaaccuuucuccuuacccauacuaacauuaucagaauuaacaaacucacgauucccaguacccauagauucauuauuuacagcacaaaauaauguacuacaaguacaaugccaaaauggaagauguacucuagacggcgaacuacaagguacaacucaguuacucccgucagguauaugugcauuuagaggacgaguaacagcccaaauaaaccaacgugaucgcuggcacaugcaauuacaaaacuuaaauggcacgaccuaugauccaacagaugacgucccugcaccccuuggaacaccagauuuuaaaggcguaguauuuggaaugguaucacaaagaaauguaggaaaugaugcaccaggaucaacaagagcccaacaagcauggguaucaacauauagcccacaauuugucccaaaauuagguucaguaaaucuccguaucucagauaaugacgacuuccaauuucaacccacaaaauuuacaccuguaggaguaaacgaugaugaugacggccauccauuuagacaaugggaauuaccaaauuacucuggagaacuaacacuaaacaugaauuuagcuccacccguagcacccaacuuuccuggugaacaacucuuauucuuuagaucuuuuguccccuguagcggaggcuacaaccaaggcguuauugacuguuuaauaccacaagaauggauacaacacuuuuaucaagaaucagcaccaucacaaucugacguagcccuaauucgauacguaaauccagacacaggaagaacucuauucgaagcaaaacuacaucgaucugguuauauaacaguugcacacucuggagacuacccuuuagucguaccagcaaauggccauuuuagauucgacagcuggguuaaccaauuuuauucauuagcuccaaugggcacuggaaauggaagaagacgagcacaauaa

SEQ ID NO: 33364 - RNA, 1623 nt, Artificial Sequence
  derived and/or modified sequence opt6 from VP1__Norovirus_and/or_Norovirus-like__KU557828
augaaaauggcuagcaacgacgccgccccaucaaaugauggugcugcaggacuuguaccugaaggaaacaaugaaacuuuaccacuagaaccaguagcaggcgcagcaaucgcagcaccaguaacuggacaaaacaauaucauugacccauggauaagaaccaauuuuguacaagcuccaaauggagaauuuacaguaucaccgagaaauucaccaggugaaauauuacuaaaucuagaauuaggaccagaucuaaauccauaucuagcucaucuaucacguauguauaacgguuacgcaggcgguguagaaguacaaguucuuuuagcagguaacgcauucacugcaggcaaaauauuauucgcagcuguaccaccuaauuuuccuguugaauuucuauccccagcucaaauaaccauguuaccacacuuaaucguagauguucguacauuagaaccaauaaugauaccuuuaccugauguacgaaacacauucuuucauuauucuaaucaaccaaacucuagaaugcgccuagucgcaauguuauacacaccacuaagaucaaacgguucuggcgacgauguauucacaguaaguuguagaguucuaacaagacccacaccagacuucgaauuuacauaucucguucccccuucuguagaaucuaaaacuaaaccauucucauuacccaucuuaacacuaucugaauuaacuaacucuagauucccuguaccaauagacucuuuauuuacugcacaaaacaacguuuuacaaguacaaugccaaaacggaagauguacuuuagacggagaacuucaaggcacaacacaauuauuaccaucuggaauaugugcauuucgcggaagaguaacagcacaaauuaaucaacgagauagauggcauaugcaauuacaaaauuuaaauggaacaacauaugaucccacugacgacguuccagcuccauuaggaacaccagacuucaaaggagucguauuuggcaugguaucacaaagaaaugucggaaacgaugcacccgauucaacaagagcucaacaagcauggguaucaacuuauucuccacaauucguuccaaaacuaggaucaguaaaucuacguauuucagacaaugacgauuuccaauuccaaccaacuaaauuuacaccaguugguguuaacgacgaugacgauggccauccauuuagacaaugggaauuaccuaauuacucaggagaauuaacauuaaacaugaacuuagccccaccaguugccccaaacuuuccaggugaacaauuauuauucuucagaucuuucgucccuuguucaggaggcuauaaucaaggcaucauagauugccuaaucccacaagaauggauacaacauuucuaucaagaauccgcacccucacaaucugacguagccuuaauacgauacguaaauccugacacaggaagaacauuauuugaagcaaaacuacauagaucagguuacauaacaguagcacauucuggagacuacccccuaguaguaccagccaacggacacuuucguuuugauaguuggguaaaccaauuuuacucacuagcaccaaugggaacuggaaacggccgaaggagagcucaauaa

SEQ ID NO: 33365 - RNA, 1623 nt, Artificial Sequence
  derived and/or modified sequence opt6 from VP1__Norovirus_and/or_Norovirus-like__KT315692
augaaaauggcuaguaacgaugcagcaccaagcaacgauggugcggcagguuuagucccagaaggaaauaaugaaaccuuaccauuagaaccaguagcaggggcagcaauagcagcaccuguaacuggacaaaacaauauaauagauccauggauaagaaccaacuuuguacaagcaccaaauggugaauuuacuguuuccccaagaaauucaccaggugaaauauuauuaucacuagaacuaggaccagauuuaaauccauaucuagcacaucuaucaagaauguacaauggauaugcugguggaguagaaguacaaguacuauuagcugguaaugcuuuuacagcaggaaaaauacucuucgccgcaguaccaccaaauuuuccaguagaauuucuaucacccgcacaaauaacaaugcuuccacacuuaauagucgauguaagaacauuagaaccaaucaugauuccauuacccgaugucagaaacacuuucuuccacuacucaaaccaacccaacucaagaaugagacucguugcaauguuauauacaccccugagaucuaacggcucuggcgacgacgucuucaccguauccuguagaguacuaaccagaccaacaccagacuucgaguucacauaccuaguaccaccauccguagaaucaaaaacaaaacccuucucccuaccaauacuaacacuuucagaacuaacuaauagccgauuccccguaccaauugacucccuauucacagcucaaaauaacguucuacaaguacaaugucaaaacggaagauguacacuagauggugaacuacaaggaaccacccaauuauuaccuuccgguauaugugcauucagaggcagaguaacagcacaaauaaaucaaagagacagauggcauaugcaacuacaaaauuuaaauggcacaacauacgauccaacagaugacguccccgcuccuuuaggaacaccagauuucaaaggcguagucuucggaaugguaucacaaagaaaugucggcaaugacgcuccagguucuacaagagcacaacaagcauggguauccacuuacucaccacaauucguuccaaaacuaggaucagucaaucuuagaauuucagacaaugaugauuuccaauuucaaccuacuaaauuuacaccaguuggaguuaaugaugaugacgacggacacccauucagacaaugggaauuaccaaauuacucaggagaacuuacccuuaacaugaacuuagcaccuccaguagcaccaaacuuuccaggugaacaacuacuuuucuuucgaucuuucguucccuguuccggcggauauaaccaaggaauuauagauugcuuaauaccacaagaauggauacaacauuucuaucaagaaucugcaccaagucagucugacguagcacuuauaagauacguaaacccagauacuggaaggacccuauucgaagccaaacuacaccgaucaggauacauaacuguagcacauucaggagauuacccucucguaguuccagccaauggccacuucagauucgacucauggguaaaucaauucuauucacuagcacccauggguacaggaaauggaagacgcagagcacaauaa

SEQ ID NO: 33366 - RNA, 1623 nt, Artificial Sequence
  derived and/or modified sequence opt6 from VP1__Norovirus_and/or_Norovirus-like__KX168437
augaaaauggcaucaaaugaugcagccccuuccaacgauggagcagcaggauuagucccagaaggcaauaaugaaacacuaccuuuagaaccaguugccggugcagcaauagcagcaccaguaacaggccaaaacaauauaauagaccccuggauacgaacuaauuuuguccaagcaccaaauggagaauuuacaguaucaccaagaaauucccccggagaaguacuauuaaauuuagaacuaggaccagauuuaaauccauacuuagcucacuuaaguagaauguauaauggauacgcaggaggaguagaaguacaagucuuauuagcaggcaaugcuuuuacagcuggaaaaauauuauucgcagcaguaccaccaaacuuuccaguugaauuuuuaucaccagcacaaauaacaauguuaccccauuuaauaguagacguacgaacucuagaaccaauaaugauaccauuaccagauguaagaaauacuuucuuucauuauucuaaucaacccaauucacgaaugcgucuugucgcaaugcuauacacaccacuaagaucgaacggauccggugacgaugucuuuacaguaucuugcagaguacuaacuagaccaacaccugacuuugaauuuacauacuuaguaccuccaucaguagaaucaaaaaccaaaccuuucucacucccaauauuaacauuaucagaauuaacaaacucaagauuucccguuccaauagauucgcuuuuuacagcacaaaauaacguauuacaaguccaaugucaaaacggacguuguacucucgacggagaauuacaagguacuacacaauuacuaccauccggaaucugugccuuucgaggacgaguaacagcacaaauuaaucaaagagauagauggcacaugcaacuacaaaauuuaaacggaacaacuuacgacccaacugaugacguaccagcaccacuaggaacuccugauuucaaaggcguuguauuuggaaugguaagucaacgaaauguaggaaacgaugccccgggaucuacuagagcccaacaagcauggguaucaacauauucaccacaauucguaccaaaauugggaucuguaaaccuaagaauaucagauaaugaugauuuccaauuucaaccaacaaaauucaccccaguaggaguaaaugacgaugaugauggacauccauuucgacaaugggaacuaccaaauuauucuggagaauuaacauuaaacaugaaccuagcaccuccaguagcaccaaauuuuccaggagaacaacuauuauucuucagaucauuuguucccugcuccggaggcuauaaccaaggaauaaucgauugcuuaauaccacaagaauggauacaacacuucuaucaagaaucagcaccuucucaauccgaugucgcacuaauaagauauguaaauccugauacaggaagaacacuauuugaagcaaaacuccauagaucaggauacauaacaguagcccacucaggagauuauccauuaguaguaccugcaaauggacauuucagauucgacucauggguaaaucaauuuuauuccuuagcaccaaugggcacaggcaauggacgaagacgagcccaauaa

SEQ ID NO: 33367 - RNA, 1623 nt, Artificial Sequence
  derived and/or modified sequence opt6 from VP1__Norovirus_and/or_Norovirus-like__KX168440
augaaaauggccucaaacgacgcagccccaucaaaugacggagcugcaggauuaguaccugaaggaaacaacgaaacauuaccacuagaaccaguagcaggagcagcuauugccgcaccaguaacaggacaaaacaauaucaucgacccauggauccggacuaacuuuguacaagcuccaaacggugaauuuacaguaucaccaagaaauucaccuggugaaauacuacuuaaucuagaacuagguccagauuuaaacccauaucucgcacacuuaucccgaauguacaacggcuacgccggaggaguagaaguccaaguccuucucgcagguaaugcuuucacagcaggaaaaaucuuauuugcagcuguaccaccuaacuucccaguagaauuucuaucaccagcacaaauuacaauguuaccacacuuaaucgucgauguaagaacccuagaaccaauuaugauuccacucccagacguaagaaacacauucuuccacuauucaaaucaacccaauagcagaaugcgccuaguugcaauguuauauacaccacucagaucaaauggaucaggagaugauguauuuacuguaucuuguagaguacuaacaagaccaacacccgacuuugaauuuacuuaucuaguaccaccaucaguugaauccaaaacaaaaccauucagccuaccaauacuuacauugagcgaauuaacaaacucaagauucccaguacccauagacucauuauucacagcacaaaauaacguacuacaaguacaaugccaaaacggaagauguacauuagauggagaacuacaaggaaccacacaacuucucccaucaggaauaugcgcauuuagaggacgaguaaccgcacaaauuaaucaaagagauagauggcauaugcaauuacaaaauuuaaauggaacaacauacgacccaaccgacgauguucccgccccauuaggcacuccagauuuuaaaggcguaguauucggaaugguaucccaacgaaacguaggaucagacgccccuggcucuacuagagcccaacaagcauggguaaguacauauaguccucaguuuguaccaaaacuaggaucagucaaucuacgaauauccgauaaugaugauuuucaauuccaacccacaaaauucaccccagucggaguaaaugacgaugaugacggacaucccuuuagacaaugggaacuaccaaacuauuccggagaacuaacauuaaacaugaaccuagcaccacccguagcacccaauuuccccggugaacaauuacucuucuuuagaucauuuguacccuguucuggaggauauaaccaaggaauaauagauugucucauuccacaagaauggguucaacacuucuaucaagaaucagcaccaucacaauccgauguugcauuaaucagauauguaaacccugacacaggacgaaccuuauuugaagcaaaacuacauaggucuggcuauauaacaguagcccauucaggagauuacccguuaguugucccugccaauggacacuucagauuugauucauggguuaaucaauuuuacucacuagcaccaaugggaacaggaaacggaagacgccgagcacaauag

SEQ ID NO: 33368 - RNA, 1623 nt, Artificial Sequence
  derived and/or modified sequence opt6 from VP1__Norovirus_and/or_Norovirus-like__KX216793
augaaaauggcaagcaacgacgcagcaccuucaaaugacggugcagcuggccuuguaccagaagguaacaaugaaacauuaccacuagaaccaguagccggagcagcuauagcugcaccuguaacaggccaaaacaauaucaucgaccccuggauacgaacaaacuucguacaagcaccuaacggagaauuuacaguuucaccaagaaauucaccuggcgaaauauuauuaaauuuagaauuaggaccagacuuaaacccauauuuagcacauuuaucaagaauguauaacggauacgcaggaggagucgaaguacaaguauuacuagcaggaaaugcuuuuaccgcuggaaaaauuuuauucgccgccguaccaccuaacuuuccaguugaauuucucaguccagcacaaauaacaaugcuaccacacuuaauaguugacguucgaaccuuagaaccaauaaugaucccacuccccgacguucgaaauacauucuuucacuauucaaaccaaccaaauucaagaaugagauuagucgcaaugcuuuauacaccucucagauccaacgguuccggugacgauguauucacaguuucauguagaguuuuaacuagaccaacaccugacuuugaauuuacauauuuagucccaccaucuguugaaaguaaaacaaaacccuucucacucccaauccuuacuuuaucagaacuaacaaacucaagauuuccaguaccaauagacucccuauuuacagcacaaaauaauguucuccaaguacaaugccaaaacgguagauguacacuggacggagaacuacaagguacaacacaacuugucccaucaggaauuugugcuuuuagaggacgcguaacagcacaaauaaaucaacgagauagauggcacaugcaacuacaaaaucucaauggaacuacuuacgacccaacagaugauguacccgcaccacuaggaacaccagauuucaaaggagucguuuucggcauggucagucaacgcaacguaggaaaugacgcaccuggauccacaagagcacaacaagcauggguaucaacauacucgccccaauuuguaccaaaauuaggaucaguaaaucuaagaauaucagacaacgaugauuuucaauuucaaccuaccaaauuuacaccuguagguguaaaugacgaugaugacggucauccauucagacaaugggaacucccaaacuauuccggagaacucacccuaaauaugaacuuagcaccaccuguugcaccuaacuucccaggagaacaauuauuauucuuuagaucauuuguaccaugcuccggagguuacaaccaagguauaauagacugucuuauaccacaagaauggauacaacacuuuuaccaagaaucagccccaucacaaucagacguagcacuuauaagauacguaaauccagauacuggccgaacauuauuugaagcaaaacuccauagaucaggauauaucacaguagcccacucuggagacuacccauuaguaguaccugcuaauggacauuucagauuugacuccugggucaaucaauuuuacuccuuagcaccaaugggaacaggcaacgguagaagacgugcacaauaa

SEQ ID NO: 33369 - RNA, 1623 nt, Artificial Sequence
  derived and/or modified sequence opt6 from VP1__Norovirus_and/or_Norovirus-like__KU557881
augaaaauggcaucaaaugacgcagcuccaucaaaugacggagcagcaggauuaguaccugaaggcaacaacgaaacccuaccccuugaaccaguagccggugcagcaauagcagcaccaguuacaggacaaaauaacauaauagauccguggauaagaacaaacuuuguccaagcaccaaacggugaauuuaccguaagcccuagaaacucuccaggcgaaauuuuacuuaaucuagaacuaggaccagaccuaaacccauaccuagcacauuuaucacgaauguauaacggauacgcgggagguguagaaguccaaguacuauuagcuggaaaugccuucacagccgguaaaauauuauuugcugcaguacccccaaacuucccagucgaauuucuaagccccgcacaaauaacaaugcuuccccaccucauaguagacguuaggacauuagaaccaauaaugauaccucuaccagauguaagaaacacauucuuucauuauucaaaucaacccaacaguagaaugcgcuuaguagcaauguuauauacaccacucagauccaauggaucuggagacgaugucuuuaccgucucauguagaguacucacaagaccaacuccagacuuugaauuuacuuacuuaguacccccaucaguagaaucaaaaacaaaaccauucucauuaccaauauuaacauuaagcgaauugacaaauucaagauuucccguaccaauagacucauuauuuacagcacaaaauaacguauuacaaguacaaugucaaaacgguagauguacauuagauggagaauugcaaggaacuacacaacuauuaccaucaggcauaugcgcauuuagaggaagaguuacagcacaaauaaaucaaagagauagauggcacaugcaacuacaaaaccuaaauggaacuacauacgauccaacagacgauguaccagcaccauuaggaacaccagauuucaaaggaguaguauucggaaugguaucacaaagaaauguaggaaacgacgcuccaggaucaacacgagcccaacaagcauggguaagcacauauuccccucaauuugucccuaaacuaggaucaguaaaucuuagaaucucagauaacgacgacuuccaauuccaacccacaaaauuuacaccaguagguguaaacgacgaugacgauggccauccauuuagacaaugggaacuacccaacuauucuggagaauuaacauuaaacaugaacuuagcaccuccuguugcaccaaauuuucccggagaacaacuacuauucuucagaucccuaguaccauguucagguggauacaaucaaggaauaauagauugccuaauaccacaagaauggauacaacauuucuaccaagaaucagcaccaagucaaucugauguugcacuuaucagauauguaaauccagacacagguagaacauuauucgaagccaaacuccauagaaguggauacauaacaguagcacauucaggcgauuauccacucguaguaccagccaacggucacuuuagauuugauucauggguuaaucaauucuacucauuagccccaaugggaacuggaaauggcagaagacgagcacaauaa

SEQ ID NO: 33370 - RNA, 1623 nt, Artificial Sequence
  derived and/or modified sequence opt6 from VP1__Norovirus_and/or_Norovirus-like__KY424350
augaaaauggcuucaaacgacgcagcaccaucaaacgacggagcagcaggccuaguaccagaagguaauaaugaaacacuaccccuagaaccaguagcaggagcagcaauagcugcaccaguaacaggacaaaacaauauaauagacccauggauaagaaccaacuuuguacaagccccaaacggugaguucaccguuaguccaagaaauucaccaggcgaaauucuacuuaauuuagaacuuggaccagacuuaaaucccuaucuagcucauuuaagcaggauguauaacggauacgcaggaggaguugaaguacagguucuauuagcuggaaacgcauuuacagcaggaaaaauauuauucgcugcuguaccuccaaauuuuccaguagaauuucuaucuccagcucaaauaacaaugcuaccacaccuaauuguugacguuagaacacuagaaccaauaaugauuccauuaccagauguacggaacacauucuuucauuauucaaaucaaccaaacaacagaaugagacuuguagcaaugcuuuacacaccacuaagaucaaacggauccggagaugacgucuuuaccguaucauguaggguuuuaacacgcccuacaccagauuucgaauuuacauauuuaguaccaccaucaguagaaucaaaaaccaaacccuucucuuuaccuauacuaacauuaagcgaauuaaccaacucaagauuucccguaccaauagauucacuauuuacugcacaaaacaauguucuacaaguccaaugccaaaacggaagauguacauuagacggcgaauuacaaggaacaacacaauuacuaccauccggaauaugcgcauuucgaggaagaguuacagcacaaauuaaucaaagagauagauggcacaugcaacugcaaaaucuuaauggcaccacauaugacccuacagaugacguuccagcaccauuagguacaccugacuucaaaggaguaguauuugguaugguaucacaaagaaauguaggaaacgaugcaccaggaucaacaagagcacaacaagcauggguaucaaccuauaguccccaauuuguaccuaaacuaggcuccauaaaccuaagaauaucagauaaugaugacuuccaauuccaaccaacaaaauuuacaccuguaggaguaaaugaugaugacgauggacauccauuuagacaaugggaacuaccaaauuauagcggugaauuaacauuaaacaugaacuuagcuccaccuguagcaccaaacuuuccaggagaacaacuucuauucuuuagaucauucguccccuguagcggaggauauaaccaaggcauaauagauugucuuauaccacaagaauggauacaacacuuuuaccaagaaucagcuccaucacaaucagauguagccuuaauaagauacguaaacccagacacaggccggacacuuuucgaagcaaaacuccacagaagugguuauauaaccguagcacauucaggcgauuaccccuuagucgucccagcaaacggacauuucagauuugauucauggguaaaucaauuuuauucacuagcaccaaugggcacaggaaacggcagaaggagagcacaauaa

SEQ ID NO: 33371 - RNA, 1623 nt, Artificial Sequence
  derived and/or modified sequence opt6 from VP1__Norovirus_and/or_Norovirus-like__KU557884
augaaaauggccucuaaugaugcagcaccaucaaacgauggagcagcuggcuuagugccagaaggaaacaaugaaacuuuaccauuagaaccaguugcaggagcagcaauagcagccccuguaacuggacaaaacaauauaauagaccccuggauuagaacaaacuucguccaagcaccuaacggagaauuuacaguaucaccaagaaauucaccuggggaaauacuauuaaaucucgaacuaggaccagaccuuaacccauaucuagcccaucuaucuagaauguauaacggauaugcaggcggaguagaaguccaaguauuacuagcaggaaaugcauuuacagccggaaaaauucuauucgcugcuguaccaccaaauuuucccguagaauuuuuauccccagcacaaauaacuaugcuaccacaccuaauugucgauguaagaacucuugaaccaauaaugaucccauuaccugauguaagaaacacauucuuucauuacucaaaccaaccaaacucaagaaugagauuaguagcaauguuauauacaccauuacgaucuaauggaucaggagacgauguauuuacaguaucauguagaguacuaacacguccaacaccagauuucgaauuuacauauuuaguaccaccaucaguagaaucuaaaacaaaaccauucucacuaccaauccuaacacuuucugaacuaacuaacuccagauuucccguaccaauagacucuuuauuuacagcucaaaauaacguucuacaaguacaaugccaaaacggacgauguacccuagauggagaauuacaaggcacaacucaauuacuaccaucuggaaucugugccuuucgaggaagaguaacagcccaaauaaaucaacgagaucgauggcacaugcaacuccaaaaucuaaauggagcaacauaugauccaaccgacgauguuccggcuccacuaggaacaccagauuuuaaaggcguaguauucggaaugguaucacaacgaaacguuggaucagaugcuccaggaucaacuagagcacagcaagcauggguaucuaccuauucaccacaauucguaccaaaauuaggaucuguaaaccuaagaaucucagacaaugacgauuuucaauuucaaccaacaaaauucacaccugucggagucaaugacgacgaugacggacauccauuccgccaaugggaauuaccaaacuauucuggcgaauuaacauuaaauaugaacuuagcaccuccaguagcaccuaacuuucccggagaacaacuuuuguucuuuagauccuuuguaccaugcucagguggauacaaucaagguauuauagauugucucauaccucaagaauggauacaacauuucuaccaagaaucagcaccaucacaaucagacguagcuuuaauacgauacguaaacccagacacaggucgaacauuauucgaagcaaaauuacacagauccgguuacauuacaguagcccauucuggagacuacccucuaguaguaccagcuaacggccauuuccgauucgacuccuggguaaaccaauuuuauucauuagccccaaugggaaccggaaacggacgccgcagagcgcaauaa

SEQ ID NO: 33372 - RNA, 1623 nt, Artificial Sequence
  derived and/or modified sequence opt6 from VP1__Norovirus_and/or_Norovirus-like__KU561253
augaaaauggcauccaacgacgccgccccuucaaaugacggagcagcagggcuaguaccugaaggaaacaacgaaacauuaccacuagaaccaguugcaggggcugcuauagcagcaccaguaaccggacaaaacaauauuauagacccuuggauuagaacaaacuucguacaagccccuaauggagaauuuacaguaaguccaagaaacucccccggcgaaauauuacuaaaucuagaacuugguccagacuuaaaccccuauuuagcacaccuauccagaauguauaauggauaugcaggaggaguagaaguucaaguacuacuagccggaaaugcauucacagccggaaaaauauuauucgcagccguuccaccaaauuuuccaguagaauuucucucccccgcacaaauaacaaugcucccucaucuuauaguagaugucagaacauuagaaccaauaaugauaccccuaccagauguaagaaauaccuucuuucacuacagcaaccaaccaaauucaagaaugcgcuuaguugcaaugcuauacacaccuuuacguuccaacggaucaggugaugauguauuuacagucuccugcagaguauuaacacguccuacaccagauuuugaauuuacauaucuaguaccaccaucaguugaaucuaaaacuaaaccauuuucacuaccaauacuaacucuuucagaacuuacaaacucacgauuuccaguaccaauagauucacuauuuaccgcacaaaauaacguacuacaaguccaaugccaaaacggaagaugcacacuagauggugaauuacaaggaacaacacaacuacuaccauccggcauaugugcuuucagaggaagaguuaccgcucaaauuaaucaaagagacagauggcauaugcaacuucaaaaucuaaauggaacaacauacgacccuacugacgauguaccagcaccucuuggaacaccugacuuuaaagguguaguauucggaauggucucacaaagaaacguaggaaaugacgcaccaggaucuacucgugcucaacaagcauggguaucuacauacaguccacaauucguaccaaaauuaggaucaguaaaucuacgaaucuccgacaacgacgauuuucaauuccaaccuacaaaauuuacaccaguaggugucaacgacgaugacgacggacacacuuucagacaaugggaacuucccaacuauucaggagaauuaacacuaaacaugaaccuagcaccuccaguugccccuaacuuucccggagaacaauuacuauucuuuagaucauuuguaccauguucuggaggcuauaaccaaggaauaaucgauugcuuaauaccacaagaauggauucaacauuuuuaucaagaaucagcaccaucucaaucagacguagcauuaauuagguauguuaacccagacacagggagaacuuuauucgaagcuaaauuacaucguucuggauauauuacaguagcacacucuggagacuauccucuaguaguaccagcaaacggacauuuucgauuugauucauggguaaaccaauucuacucucuagcaccaauggguacaggcaauggacguagacgagcucaauaa

SEQ ID NO: 33373 - RNA, 1623 nt, Artificial Sequence
  derived and/or modified sequence opt6 from VP1__Norovirus_and/or_Norovirus-like__KP902588
augaaaauggccucuaaugaugcagcgccuucaaacgauggagcagcuggacuuguaccagaaggaaauaaugaaaccuuaccacuagaaccaguugcaggagcugcaauugcagcaccaguaacuggucaaaauaacaucauagacccauggauaagaacaaauuucguacaagccccuaauggagaauuuacaguaucuccuagaaauuccccuggcgaaauauuauuaaauuuagaacuaggaccagaucuuaacccauaucuagcacaccuaucaagaauguacaacggauacgcaggaggaguagaaguccaaguacuacuugccggcaaugcauuuacagcuggcaaaauacuauucgcagcaguaccaccaaacuuuccaguagaauuucuaucuccagcccaaauaacaauguuaccucacuuaauaguugacguaagaacucuagaaccaauaaugaucccacuaccugauguacgaaauacuuucuuucacuacucaaaccaaccuaauucacguaugagauuaguugcuauguuauauacaccucuacgcuccaauggaaguggagaugaugucuuuacaguauccugucgaguauuaacacgaccaacaccagacuucgaauuuacauaccuaguaccacccuccguagaaucaaaaacaaaacccuuuaguuuaccaauacucacauuaucagaacuaacaaacucuagauucccuguaccaauagacuccuuauuuacagcccaaaauaauguauuacaaguacaaugccaaaacggacgcuguacauuagacggagaauugcaagguacaacacaauuauuaccuucaggcauuugugcauuuagaggaagaguaaccgcacaaauaaaccaaagagaucgauggcacaugcaacuccaaaauuuaaauggaacuacauaugaccccacugaugacguuccagcuccacuaggcacuccagauuuuaaaggaguagucuucggaauggucucacaaagaaaugugggcucagacgcacccggcucuacucgagcacaacaagccuggguaucaacauauucaccucaauuuguaccuaaacuaggaucaguuaaccuaagaauaucagacaacgacgacuuccaauuucaaccaacaaaguuuacacccguaggaguaaaugaugacgacgauggacaccccuuuagacaaugggaauuaccaaacuauucuggcgaacuuacauuaaauaugaaucuagcuccuccuguugcaccaaauuuucccggugaacaacuauuauucuuucgaucuucaguaccaugcucaggaggauauaaucaaggcauaauagauugucuaauuccucaagaauggauucaacauuuuuaccaagaauccgcaccuucacaaucagauguugcauuaauaagauacguaaacccugauacagggcgaacauuauuugaagccaaacuacaccgcuccggauauauaaccguagcucauuccggcgacuacccauuagucgucccagccaauggacacuuuagauucgauucauggguaaaccaauuuuauucacuagcaccaaugggaacuggaaauggaagaagacgagcucaauaa

SEQ ID NO: 33374 - RNA, 1623 nt, Artificial Sequence
  derived and/or modified sequence opt6 from VP1__Norovirus_and/or_Norovirus-like__KX168456
augaaaauggcauccaacgacgcugcuccauccaaugauggagccgccggucuuguuccagaaggaaacaaugaaacacuaccacuagaaccagucgcaggagcagcuauagcugcaccuguaacuggucaaaacaauauaaucgacccauggauaagaacaaacuucguacaagcaccaaauggagaauuuacaguuucaccaagaaauucacccggcgaaauauuacucaauuuagaacuagguccagaccuuaauccauaucuagcacaucuauccagaauguauaacggauaugcaggagguguagaaguucaaguacuauuagcugguaaugcauucacugcaggaaaaauacuauucgcagcuguacccccaaacuuccccguagaauuucuauccccagcacaaauuacuaugcuuccacacuuaauaguugacguuagaacauuagaaccaauaaugauaccucucccugauguaagaaacacauucuuccauuauucaaaccaaccuaacaguagaaugcgauuagucgcuauguuauacacaccacuccguucaaauggcucaggagacgauguauucacaguaucauguagaguacuaacaagaccuacaccagauuucgaauuuacauaccuuguucccccaucaguagaauccaaaaccaaaccauucagcuuaccaauucuaacuuuaucugaacuuacaaacucuagauucccuguucccauagacucauuauucacagcacaaaacaacguucugcaaguacaaugucaaaauggacgcugcacccuugauggugaauuacaaggaacaacacaauuacucccaucaggcauaugugcauucagaggaagaguuacagcacaaauuaaucaacgagauagauggcacaugcaauuacaaaauuuaaauggaacaacauacgauccuacagacgacguaccugcuccauuaggaacaccagauuucaaaggaguaguauuuggaauggucucacaaagaaacguaggaucagacgcaccaggauccacuagagcccaacaagcaugggucucuacauauagcccucaauuuguuccaaaacuugguuccguuaaucuuagaaucucagauaaugaugacuuccaauuucaaccuacaaaauuuacaccuguagguguaaaugacgacgacggaggacauccauucagacaaugggaacucccaaauuauaguggagaauuaacauuaaacaugaacuuagccccaccaguagcaccaaauuucccaggagaacaauuacuauucuuuagauccuuuguuccauguuccggaggauauaaucaaggaauaauugauugccuaauaccacaagaauggauccaacauuucuaucaagaaucagcaccuucacaaucugacguagcauuaauucgauacguaaauccugauacuggaagaacauuauuugaagcaaaacuacauagaucaggcuauaucacuguagcacauucaggagacuauccucuaguaguaccagcaaauggccacuuccgauucgauucuugggucaaccaauuuuacucauuagcaccaaugggcaccgguaauggaagaagacgagcacaauaa

SEQ ID NO: 33375 - RNA, 1623 nt, Artificial Sequence
  derived and/or modified sequence opt6 from VP1__Norovirus_and/or_Norovirus-like__KX168444
augaaaauggcauccaaugaugccgccccaucaaaugauggagcagcaggucuaguaccagaaggaaauaacgaaacauuaccacuagaaccaguugcuggagccgcaauagccgcaccaguuacaggacaaaacaauauaauagacccauggauaagaacaaacuucguccaagcaccaaacggcgaauuuacaguaucacccagaaacagucccggugaaauuuuauuaaauuuagaauuagguccugauuuaaauccauauuuagcacauuuaaguagaauguauaacgguuacgcaggaggcguagaaguucaagucuuacucgcuggcaacgcauuuacagcaggaaaaauauuauucgccgcuguuccacccaauuuucccguugaauuucuaucccccgcacaaauuacaaugcucccacaucuuauaguagauguacgaacccuagaaccaauaaugauaccacucccugauguaagaaacacauucuuccauuauucaaaucaaccaaauucaagaaugcgauuaguagcaauguuauacacuccccuacgaagcaaugguucaggugacgaugucuucaccguaucuuguagaguucuuacuagaccuacuccagauuuugaauuuacauaucuaguaccaccaucaguagaaucaaaaacaaaaccauucucacuuccaauauuaacuuuaucagaauuaacaaacucucgcuuuccaguucccauagauucauuauuuaccgcacaaaacaauguuuuacaaguucaaugccaaaacggaagauguacauuggauggagaauuacaaggaaccacucaguuauuaccaagugguauuugugcauuuagaggaagaguaacagcucaaauuaaccaacgcgauagauggcacaugcaauuacaaaaucuaaauggaacaaccuacgaccccacagaugacguucccgccccauuaggaacaccugauuucaaagguguuguuuucgguaugguuucucaaagaaacgucggaaacgacgcuccugguucaacaagagcccaacaagcaugggucucaacauauucuccucaauucguaccaaaacucggaucuguaaaucuacguaucucugauaaugacgauuuucaauuccaaccaacuaaauuuacaccaguaggaguaaaugaugaugacgacggacauccauuucgccaaugggaauuaccaaauuauucaggagaacuuaccuuaaauaugaacuuagcuccuccaguagcaccaaacuuuccuggagaacaauuauuauucuuuagaucuuucguaccauguucuggaggauauaaccaaggaauaauagauuguuuaauuccacaagaauggauucaacauuucuaccaagaauccucaccaucacaaagugauguugcauuaauccgcuacguuaaccccgacacaggacgaacuuuauucgaagccaaacuacauagaucaggauacauaacuguagcccauucuggcgauuacccacucguagucccagcaaauggacauuucagauucgauucauggguaaaucaauucuauucacuagcaccaaugggaaccggaaacggaagacgucgugcacaauaa

SEQ ID NO: 33376 - RNA, 1623 nt, Artificial Sequence
  derived and/or modified sequence opt6 from VP1__Norovirus_and/or_Norovirus-like__KX216806
augaaaauggcaacaaacgaugcagcaccaucaaacgauggagcugcaggacuuguuccugaaggaaacaaugaaacucucccacuagaacccguagcuggagccgcaauagcggcaccaguaacaggacaaaauaacauuaucgacccauggauaagaacaaacuuuguccaagccccuaauggagaauuuacuguaucaccacgaaacuccccaggugaaauauuacuaaauuuagaacuaggcccagaccuaaaucccuauuuagcacauuuaucuagaauguauaauggauacgcaggagguguugaaguacaaguguuauuagcagguaacgccuucacagcaggaaaaauacuauucgcugcuguaccgccaaacuucccaguugaauuucuaucaccagcacaaauaacaaugcucccccacuuaauaguagacguuagaacauuagaaccaauaaugauaccgcuuccugacguaagaaauacauucuuucacuauaguaaccaaccaaauucacgaaugcgauuaguugcuaugcuauauacaccccuccgaaguaacggaucuggagacgauguauucacaguauccuguagaguauuaacaagaccaacacccgauuuugaauuuacauauuuaguaccaccaucaguugaaagcaaaacaaaacccuucucacuaccaauacuuacauuaagugaauuaacaaauucuagauuuccaguaccaauagacucacucuuuacagcacaaaauaacguauuacaaguacaaugucaaaacggaagaugcacauuagauggagaauuacaaggaaccacacaauuacuaccauccggaaucugcgcauucagaggaagaguaacagcccaaauaaaucaaagagaucgauggcacaugcaauuacaaaauuuaaauggaacaacauaugauccaaccgaugaugucccagcuccauuaggaacaccagauuuuaaaggcgucguauuuggaaugguaucacaaagaaacguaggaaaugacgcuccaggaucaacacgagcacaacaagccugggucuccaccuacuccccucaauucguaccaaaacuagguucuguaaauuuaagaauaucagacaaugaugauuuccaauuucaaccaacaaaauuuacuccaguaggaguuaaugacgaugaugauggucauccauuuagacaaugggaauuaccaaacuacucgggagaauuaacucuaaauaugaauuuagcaccuccaguagcccccaacuucccuggagaacaauuauuauucuuuagaaguuucguaccaugcagcgguggcuauaaccaaggaauaaucgauugucuuauaccacaagaauggauucaacacuucuaucaagaaagcgcaccuucacaaucagacguagcauuaauucgauacgucaauccagauacaggaagaacccuauucgaagcaaagcuccacagaucaggcuacaucacaguagcacacucaggagauuacccucuaguuguaccagccaacggacauuucagauucgauucauggguaaaucaauucuacucacucgcuccaaugggaacaggaaacggaagacgacgagcacaauaa

SEQ ID NO: 33377 - RNA, 1623 nt, Artificial Sequence
  derived and/or modified sequence opt6 from VP1__Norovirus_and/or_Norovirus-like__KX216794
augaaaauggccuccaacgaugcagccccaucaaacgacggagcagccggauuaguuccagaaggaaauaacgaaacuuuaccacuagaaccaguagcaggagcagcuauagcugcuccaguaacaggacaaaauaauauaauagaccccuggauuagaacuaauuucguacaagcaccaaacggagaauuuacaguuucacccagaaauucaccaggagagauacuacuaaaucuagaacuagguccugaucuaaaucccuacuuagcacaccuaucaagaauguauaaugguuacgcuggcggcguagaaguacaaguacuacuugcuggcaaugccuuuacugcuggcaaaauacuauucgcugcagucccaccaaauuuuccuguagaauuuuuauccccagcacaaauaaccauguuaccacaccucauugucgacgucagaacucuagaaccaauaaugauacccuuaccagacguacgcaacacauucuuucacuacucuaaccaaccaaauucacgcaugcgacucguagcaaugcuauacaccccacuacgauccaauggaaguggagacgacguauuuacaguaaguuguagaguuuuaacaagaccaaccccugauuuugaauuuacauaucuaguacccccaagcguagaauccaaaacaaaaccauuuucacuaccuauuuuaacacuaugugaacuaacaaacucccgcuuuccaguucccauugacucacucuuuacagcacaaaauaacguauuacaaguacaaugucaaaauggaagauguacauuggacggagaauuacaaggaacaacacaauuguuaccaucaggaauaugugcauuuagaggaagaguaacagcacaaauaaaucaacgagaccgauggcauaugcaauuacaaaaucuaaacggaacaaccuacgacccaacagaugacguucccgcaccauuagguacuccagauuuuaaaggaguagucuucggcauggucucacaaagaaauguaggaaaugacgccccaggauccaccagagcacaacaagcauggguauccaccuacucuccacaauucguaccaaaauuaggcucugucaaucuacgaauauccgacaaugaugauuuucaauuccaaccaacaaaauuuacaccugucgguguaaaugacgaugaugauggacauccauuuagacaaugggaacuuccaaacuauaguggcgaacuaacuuuaaauaugaacuuagcucccccaguugcaccaaacuuccccggcgaacaacuauuauucuuccgaucuuuugucccaugcuccggcggauacaaccaagguauaaucgauugucuaauaccacaagaauggauacaacauuucuaucaagaaucagcccccucucaaucagauguagcuuuaauacgcuauguaaacccagacacaggaagaacacuauuugaagcaaaauuacauagaucaggauauauaacaguugcacacuccggagauuacccucuagucguaccagcaaacggccauuucagauucgacuccuggguaaaccaauuuuauucauuagcaccaauggggaccggaaacggcagaagacgagcacaauaa

SEQ ID NO: 33378 - RNA, 1623 nt, Artificial Sequence
  derived and/or modified sequence opt6 from VP1__Norovirus_and/or_Norovirus-like__KX420895
augaaaauggcaucuaaugacgcagcuccaucaaaugauggagcagcuggauuaguaccagaaggaaacaaugaaacacuaccacuagaaccaguagcuggugcagcuauagcagcaccaguaacuggacaaaacaauauuauagacccauggauaagaacaaauuuuguacaagcaccaaacggggaauuuacaguaucaccaagaaauucaccaggagaaaucuuacucaacuuagaauuaggaccagaucuaaauccauaucucgcccaccuuucaagaauguacaacggauaugcaggcgguguugaaguccaaguauuauuagcuggaaaugcauuuacagcuggaaaaaucuuauucgcagcaguaccaccaaauuuuccagucgaauuucuaagucccgcacaaauaacaauguuaccucacuuaauaguagauguuagaacccuagaaccaauaaugauaccuuuaccagauguccgaaacacauuuuuccacuacucgaaccaaccaaacucaagaaugagauuaguagcaaugcuauauacaccccuacgaucaaacggcucaggagacgauguauucaccguauccuguagaguucuaacaaggcccacaccagauuucgaauuuaccuaucuuguacccccaucaguagaaucaaaaacaaaaccuuuuucacuaccaauauuaacauuaucugaacucacuaacucuagauuuccaguuccaauugacagucuauuuacagcacaaaauaacgcuuuacaaguucaaugucaaaaugguagauguacacuagacggcgaacuucaaggaacaacacaauuacuucccaguggaaucugugcauuucgaggucguguaacagcccaaauaaaccaacgagaccgcuggcacaugcaauuacagaaucuaaauggaacuacauacgacccuacagacgacguaccagcaccacuaggaaccccugacuucaaaggaguaguauucggaaugguuucacaaagaaauguaggaaaugacgcuccuggauccacuagagcacaacaagcaugggucucuaccuauucuccccaauuuguacccaaauuaggcagcguaaaucuaaggauaucagacaaugacgauuuucaauuccaaccaacuaaauuuacaccaguaggaguaaacgacgacgacgacggacacccauuuagacaaugggaacuaccaaauuauuccggagaauuaacuuuaaacaugaaucuugcaccaccaguagcaccaucauuucccggugaacaacucuuauucuucagaucauucguaccaugcucaggaggauauaaccaaggaauaauagauugccuuauaccacaagaauggauacaacauuucuaccaagaaucagcccccucacaaucagacguagcucuaauacgcuacguuaaucccgacacaggccgaacacuauucgaagcaaaacuucauagaucaggauauauaacagucgcacacucaggugauuacccauuaguuguacccgcaaauggccauuuucgauucgacuccugggucaaucaauucuacagucuugcaccaaugggaacaggcaauggaagaagacgagcucaauaa

SEQ ID NO: 33379 - RNA, 1623 nt, Artificial Sequence
  derived and/or modified sequence opt6 from VP1__Norovirus_and/or_Norovirus-like__KT591501
augaaaauggcauccaaugaugcagcacccucaaacgauggagcagcaggacuuguaccagaaggaaacaaugaaacacucccacucgaacccguugccggugcagcuauugcagcaccuguaacaggucaaaauaauaucauagacccauggauaagaacuaacuuuguccaagcaccuaauggugaauuuaccguaucaccaagaaacucaccuggagaaaucuuacuuaauuuagaacuuggacccgauuuaaaucccuaucucgcacaccuuaguagaauguauaacggauacgcuggcggcguagaaauccaaguacuacucgcaggaaaugcauuuacagcaggaaaaauauuauucgcugcaguacccccgaauuuucccguagaauuuuuaucacccgcacaaauaacgaugcuaccacacuuaauaguugacguaagaacucucgaaccaauaaugauaccauuaccagauguacguaauacauucuuucauuauucaaaccaacccaauucucgaaugagauuaguagcaaugcuauacacaccacuaagaucaaacggcuccggcgaugauguauuuacaguaaguugccgaguacucacaagaccaacaccagacuuugaauuuacauauuuaguaccaccuucaguugaaucaaaaacuaaaccuuucucauuaccaauacuaacacuaucagaacuaacuaauucaagauucccaguuccaauagauucacuauuuacugcacaaaauaauguauugcaaguacaaugucaaaauggccgaugcacauuagacggagaacuacaagguacaacacaacuacuaccauccggaauaugcgccuuucgaggaagaguaacagcacaaauuaaucaaagagauagauggcauaugcaacuucaaaaucuaaaugguacaacauaugacccuacugaugauguaccagcaccccuaggaacuccugacuuuaaaggaguuguauuuggaaugguuucacaacgaaacguaggauccgacgcaccaggauccaccagagcacaacaagcauggguauccaccuacucuccucaauucguacccaaacuaggcucaguaaaucuaagaauaucugacaaugaugacuuccaauuccaaccaacaaaauucaccccaguaggaguaaaugacgaugaugacggacauccauuuagacaaugggaauuaccaaacuauucaggagaauuaacauuaaacaugaacuuagcaccaccaguugcccccaauuucccaggugaacaacuuuuauucuucagaucuuucguacccuguucagguggcuacaaccaaggaauaauugauuguuuaauaccucaagaauggauccaacacuuuuaucaagaaagugcaccuucacaaucagauguagcauuaauacguuacguaaauccagacacuggacgaacuuuauuugaagccaaacuacaccguucuggauauauaacuguagcacacucaggagauuacccauuaguaguaccggcaaacggacauuuuagauuugacucuuggguaaaccaauuuuacucacuugcacccaugggaaccggaaauggccgacgcagagcacaauaa

SEQ ID NO: 33380 - RNA, 1623 nt, Artificial Sequence
  derived and/or modified sequence opt6 from VP1__Norovirus_and/or_Norovirus-like__KT315714
augaaaauggccucuaacgaugcugcaccaucaaaugacggagcagcaggauuaguuccugaggguaacaacgaaaccuuaccacucgaaccaguagcaggagccgccauagcagcaccaguuacuggucaaaauaauauaauagauccauggauaagaacaaacuuuguccaagcuccaaacggagaauuuacaguaucaccaagaaacucaccaggagaaaucuuacuaaaucuagaacuagguccagacuuaaauccauaucuagcacacuuauccaggauguacaauggauacgcuggaggaguagaaguacaagucuuacucgcaggaaaugcauuuacagcuggaaaaauucuauucgcagcaguuccaccaaacuuucccguagaauuuuuaucaccagcacaaauuacaauguuaccacaucuaauaguagacguuagaacauuagaaccaauuaugauaccucuaccagauguuagaaauacuuucuuucauuacucaaaucaaccaaacucaagaaugagacucguagcaauguuauacacuccacucagaucaaacggcaguggagaugacguauuuaccguaucauguagaguccugacaagacccaccccagacuuugaauuuacauaucuaguuccaccaucaguagaaucaaaaacaaaaccauucucucucccuauauuaacauuaucagaauuaacaaauuccagauucccagucccaauagauucacuuuucacagcucaaaauaacgucuuacaaguacaaugccaaaaugguagauguacccuugauggagaacuucaaggaacuacacaauuacucccuuccggaaucugugcauuuagaggaagagugacagcacaaauaaaucaaagagaccguuggcauaugcaauuacaaaauuuaaauggcacaacauaugauccaacagaugacguaccagcuccauuaggaacuccagacuucaaagguguaguauuuggaauggucucucaaagaaacguugggucugacgccccuggaaguacaagagcacaacaagcauggauauccacauacucuccacaauuuguaccaaaauuaggauccgucaaucuacgaauuuccgauaaugaugacuuccaauuucaaccaacuaaauucacuccagucggagugaacgacgaugacgauggacauccauucagacaaugggaacuaccaaauuauucaggagaacuaacauuaaacaugaaucucgcaccuccaguagcaccaaacuuuccaggugaacaacuacuauuuuucagaucuuuuguuccauguaguggagguuauaaccaaggaauuauugauugccuaauaccacaagaauggauucaacacuucuaucaagaaucagcacccucacaaucagacguagccuuaauaagauacguaaacccagacacagguagaacucuauucgaagcaaaacuacaucgaucaggauauauaaccguagcucauagcggcgauuacccacuuguaguuccagcaaacggacauuuuagauuugauucuuggguaaaccaauuuuacagccuagcaccuaugggaacugguaauggaagaaggagagcacaauaa

SEQ ID NO: 33381 - RNA, 1623 nt, Artificial Sequence
  derived and/or modified sequence opt6 from VP1__Norovirus_and/or_Norovirus-like__KT315673
augaaaauggcaucaaacgacgcagcacccuccaaugauggagcagcaggauuaguaccagaaggaaauaaugaaacccuaccacuagaacccguagcuggugcagcaauagcagcaccaguaacaggucaaaauaauauaauagauccauggaucagaacuaacuucguacaagcaccaaacggagaauuuaccguauccccuaaaaauucaccaggagaaauacuccuaaauuuagaacuuggaccagaucuuaacccuuacuuagcacacuuaucaagaauguacaauggauaugcaggagguguugaaguucaaguccuccucgcagguaacgcauuuacugcuggaaaaauauuauuugcagcaguuccaccaaacuucccagucgaauuuuuaucaccagcacaaauaacaaugcuaccacacuuaauaguagaugucagaacacuagaacccauaaugauaccucuaccagacguaagaaacacauucuuucacuauucgaaccaaccaaauucaaggaugagauuaguagcaaugcuauauacaccauuacgaaguaacggauccggagacgacguauuuacuguaagcuguagaguauuaacaagaccaacuccagacuuugaguuuacauaucuaguuccuccaucuguugaaucaaaaacaaaacccuucucauuaccaauauuaacacucucagaacuaacaaauucaagauucccaguaccaaucgacucacuuuuuacagcacaaaauaacguuuuacaaguacaaugccaaaacggaagauguacacuagauggagaacuucaaggaacaacacaauuacucccaucaggaauuugcgcauuuaggggccgagucacagcucagauuaaucaaagagacagauggcacaugcaacuacaaaaucucaaugguacaacauaugacccaacagacgauguuccugcaccauuaggaacuccagacuucaaaggaguaguauucggaaugguaucccaacgcaauguaggaaacgacgcacccggaucuacuagagcacaacaagccuggguuucaacauacucaccacaauuuguaccaaaauuaggaucaguaaauuuaagaauaagcgacaaugaugauuuccaauuucaaccuacuaaauucacuccaguaggaguuaaugaugaugacgauggacauccauucagacaaugggaauuaccuaacuauucaggagaacuuacacuaaauaugaaucuugccccuccaguagccccuaacuuuccaggugaacaauuacuauucuuccgaucauuuguaccuuguuccggcggauauaaccaagggauuauugauugcuuaauaccacaggaauggauacaacauuuuuaucaagaaucagcacccucacaaucagauguagcacuaauaagauacguaaacccagauacaggaagaacacuauuugaagcaaaacuacaucgaucaggauauauaaccguagcccacucaggcgauuauccucuaguuguaccagcaaacggacauuucagauuugacaguuggguaaaucaauuuuauucacuugcaccaaugggcaccggaaacggacgaagacgagcccaauaa

SEQ ID NO: 33382 - RNA, 1623 nt, Artificial Sequence
  derived and/or modified sequence opt6 from VP1__Norovirus_and/or_Norovirus-like__KX216792
augaaaauggcaucaaacgaugcagcaccaucaaacgauggagcugcaggccuuguaccagaagguaacaacgagacacuaccuuuagaacccguagcuggugcagcaauagcagcaccuguaacaggacaaaauaauauaauagacccuuggauaagaacaaauuucguacaagcaccaaauggcgaauuuacaguaagcccaagaaauagucccggcgaaauacuacuaaaucuugaacuaggaccagauuuaaacccauaucuagcacaccuaucuagaauguauaacgguuacgcaggaggaguugaaguccaaguucuauuagcaggaaaugcauuuacugcuggaaaaauacuauucgcagcaguaccucccaacuuccccguagaauuucuaucacccgcacaaauaacuauguuaccacauuuaauaguugauguaagaacuuuagaaccaauaaugauaccauuaccagacguuagaaacacauucuuccacuacuccaaucaacauaacuccagaaugaggcuaguagcaaugcuauacacaccauuaagaucgaauggaucaggugacgacguauuuacuguuuccugcagaguauuaacaagacccaccccagauuucgaauuuacauauuuaguaccaccaucaguagaaucaaaaacaaaaccuuuuucauuaccaaucuuaacauuaucagaacuaacaaauuccagauuccccguaccaauagacucucuguuuaccgcacaaaauaacguauuacaaguacaaugccaaaauggaagaugcacucuagauggcgaacuucaagguacaacccaacucuuaccaucaggaauaugugcuuuucgaggccgaguaacagcacaaauuaaucaaagagaucgauggcacaugcaauuacaaaaccucaauggaacuacauaugacccaacagaugacguaccagcaccacuuggaaccccagauuucaaaggaguaguauucggaaugguuucacaacguaacguuggaaacgaugcacccggauccaccagagcacaacaagcauggguaucaacauauuccccucaauuuguaccaaaacuaggaucagucaauuuucgaauuuccgacaaugacgacuuccaauuccaaccaacaaaauuuacacccguagguguaaaugaugaugacgauggucacccauuuagacaaugggaacuaccaaacuacucaggagaauuaacacuaaacaugaacuuagccccaccagucgcacccaauuuucccggagaacaacucuuauucuuuagauccuuugucccauguucagguggauauaaccaaggcauaaucgacugcuuaauaccucaagaauggauacaacauuucuaucaagaaagugcaccaucacaaucagacgucgcacuaauuagauauguaaacccagacaccggucgaacauuauucgaagcaaaacuacaccgauccggauauauaaccguagcacacucuggugauuauccucucguaguaccagcaaacggccauuuuagauuugacuccuggguaaaccaauucuacucucucgcuccaaugggaacuggaaauggcagaagacgagcacaauaa

SEQ ID NO: 33383 - RNA, 1623 nt, Artificial Sequence
  derived and/or modified sequence opt6 from VP1__Norovirus_and/or_Norovirus-like__KU953398
augaaaauggcuucuaacgacgcugcaccaucaaacgacggagcagcaggccuagucccagaaggaaauaaugaaacuuuaccuuuagaaccaguagccggagcugcaauugccgcacccguaacuggacaaaacaauaucauagacccauggauacgaacaaacuuuguacaagcuccaaacggagaauuuacaguaucaccaagaaacucccccggagaaauacuccuaaauuuagaacuaggaccugaucuaaauccauaucuugcucacuuaucuagaauguauaaugguuaugcuggaggaguagaaguacaaguacuacuagcuggcaacgcauucacagcaggaaaaauauuauuugcugcaguacccccaaauuucccaguagaauuuuuaucaccagcacaaauaacuaugcuuccucaccuuauaguagacguacguacuuuagaaccaauaaugauacccuuaccagauguacgaaauacuuucuuucacuacucuaaccaaccaaacucucgaaugagauuaguagcaauguuauacacaccacucagaucuaacgguucuggugaugacguauucaccguauccugcagaguucuaacaagaccaacaccugacuuugaauuuacauaucuagucccaccaucuguagaaucaaaaaccaaaccauucucacuaccaauauuaacauuaagcgaauuaacaaacucuagauucccaguuccaauagacucacuauuuacagcacaaaauaauguacuucaaguacaaugucaaaacggcagauguacuuuagauggagaauuacaaggaaccacucaauuacuaccaucagguauaugugcauuucgaggaagaguaacagcacaaauaaaucaacgagaucguuggcauaugcaauuacaaaaucucaauggcaccaccuaugacccuacagaugauguacccgcaccucuaggaacuccagauuucaaaggaguuguuuuuggaaugguaucacaacgcaacgucggaacagacgccccagguuccacaagagcacaacaagccuggguuucaacuuauucaccucaauuuguaccaaaacucgguucaguaaaccuaagaauaagugauaaugaugauuuucaauuccaaccaacaaaauucacaccaguaggaguaaacgacgacgacgauggacauccauuuagacaaugggaacuaccuaauuauucaggugaauuaacucucaauaugaauuuagcuccaccaguagccccaaacuuuccaggugaacaauuauuauuuuucagaucauuuguacccuguucagguggauauaaucaaggcaucauugauugccuaauuccacaagaauggauacaacauuuuuaucaagaaucagcaccuucacaaucagacguagcacucauacguuacgucaacccugacacuggaagaacacuauucgaagcaaaacuacauagaucaggauacauaacaguagcacacucaggagauuauccucugguaguaccugcaaauggacauuucagauuugauucaugggucaaucaauucuacucacuagcaccaaugggaacaggaaacggacgacgccgagcacaauaa

SEQ ID NO: 33384 - RNA, 1623 nt, Artificial Sequence
  derived and/or modified sequence opt6 from VP1__Norovirus_and/or_Norovirus-like__KU557888
augaaaauggccucaaacgaugcagcaccuaguaaugacggcgcagccggccuaguaccagaagguaacaacgaaacauuaccacuugaacccguagcaggcgcugcaauagcugccccaguaaccggucaaaauaauauaauagauccauggauaagaacuaacuuuguucaagcaccuaacggagaauuuacagucagcccuagaaacuccccaggugaaauucuccuaaaucuagaauuaggaccagauuuaaauccauauuuagcucacuuaucaagaauguauaaugguuaugccgguggaguagaaguacaaguacuauuagcaggaaaugccuuuaccgcaggaaaaauacuauucgcugcaguacccccaaauuuuccaguagaauuuuuaucaccagcucaaauaacaaugcucccacauuuaauaguugauguacgcacuuuagaaccaauaaugauaccucuuccagacguccgaaauacauucuuucauuacuccaaucaaccaaauucaagaaugagacuuguagcaauguuauacacuccacuaagaucuaacggauccggagaugauguauucaccguaucuuguaggguauuaacaagaccaacaccagacuuugaauuuacuuaucuuguacccccuuccgucgaaucaaaaacuaaaccauuuucuuuaccaauauuaacauuaucugaauuaacaaauucaagauucccuguaccaauagauagcuuauuuacagcacaaaauaacguacuacaaguccaaugucaaaauggaagauguacccuagacggagaacuacaaggaaguacacaacuacuaccaucaggaaucugugccuucagaggaagaguaaccgcucaaauaaaccaaagagauagauggcacaugcaacuacaaaaucuuaauggaaccaccuacgaucccaccgaugacguaccagcuccauuaggaacacccgauuuuaaaggcgucgucuuuggaaugguaucacaaagaaauguagguaaugacgcaccuggaucaacaagagcacaacaagccuggguaucuaccuauagcccucaauuuguaccaaaauuagguucugucaacuuaagaauaucagauaaugaugauuuucaauuccaacccacuaaauuuacaccugucggaguaaaugaugaugaugacggucauccauuccgccaaugggaacuaccaaauuauucuggugaauuaacauuaaauaugaaccuugcuccuccaguugcaccuaacuuccccggugaacaacuccuauuuuucagaucauucguaccaugcagugguggauauaaucaaggaauaauagacugccuaaucccucaagaauggauacaacauuucuaucaagaaucagcaccaucacaaucagaugucgcauuaauaagauaugucaaucccgauacaggcagaacacuuuuugaagcaaaauuacauagaucaggauacauaacaguagcacauucaggcgacuauccuuuaguaguaccagcaaauggccauuucagguucgauuccuggguuaaccaauucuauucauuagcaccaaugggcacaggaaauggaagaagacgagcacaauaa

SEQ ID NO: 33385 - RNA, 1623 nt, Artificial Sequence
  derived and/or modified sequence opt6 from VP1__Norovirus_and/or_Norovirus-like__KU557808
augaaaauggcaaguaaugacguagcaccaucaaacgacggcgcagcagggcucgucccagaaggaaauaaugaaacucuaccauuagaaccaguugccggcgccgcaauagcagccccaguaacaggucaaaacaauauaauagacccauggauacgcacaaacuucguucaagcaccuaauggagaauuuacaguauccccaagaaauuccccaggagaaauacuuuuaaauuuagaacucggacccgauuuaaacccauaucuagcccacuuaucccgaauguauaaugguuaugcaggaggugucgaaguacaaguauuacuagcaggaaacgcuuuuacagcaggaaaaauauuauuugcagcaguacccccaaauuucccagucgaauuucuaucaccagcacaaauaacaaugcuaccucaucuaauaguagauguacgaaccuuagaaccaauaaugauaccauuaccugauguaagaaacacauucuuucauuacucaaaucaaccaaauuccagaaugagacuuguagcaaugcuuuacacaccacuaagaucaaauggaucaggugacgauguuuuuacaguaaguugucguguauuaacaagaccaaccccugauuucgaauuuaccuacuuaguaccaccuuccguagaaucaaaaacaaaaccauucucauuaccaauacucacauuaucagaacuaacaaacucaagauuccccguuccgauagacucuuuauucacagcacaaaauaacguacuacaaguccaaugucaaaauggaagaugcacuuuagauggugaauuacaagguacuacacaauuacuaccaucaggcauaugugccuuuagaggucgaguaacagcacaaauaaaccaaagagauagauggcacaugcaauuacaaaacuuaaauggaacuacauaugacccaacugaugacguaccagcaccauuaggcacucccgacuucaaagguguuguauuuggaaugguaucacaaagaaacguaggaaaugaugcaccaggauccacaagagcccaacaagccuggguaucaacauacucuccacaauuuguaccaaaguuaggaucaguuaaucuaagaauauccgacaaugacgauuuucaauuucaacccacuaaauuuacaccuguaggaguaaaugacgacgaugauggccauccauucagacaaugggaacugccaaacuauucuggagaauuaacacucaacaugaacuuagcucccccuguagccccuaacuucccaggagaacaacuauuauucuuucgaucauucguaccauguagcggaggauauaaucaaggaauuaucgauugcuuaauaccccaagaauggguacaacauuucuaccaagaaucagcuccuucucaaucagauguagcguuaauaagauacguaaacccagauacagguagaacauuauucgaagccaaacuucauagaucaggauauauaacagucgcacacucaggcgacuauccccuaguuguaccagcaaauggccauuucagauucgauuccuggguaaaccaauuuuauucacuagcaccaaugggaacaggaaaugguagaagacgagcacaauaa

SEQ ID NO: 33386 - RNA, 1623 nt, Artificial Sequence
  derived and/or modified sequence opt6 from VP1__Norovirus_and/or_Norovirus-like__KU557807
augaaaauggcaagcaaugauguagcuccaucuaaugacggagcagcaggccuagucccagaaggaaauaaugaaacacuaccacuugaaccaguugcaggagcagcaauugcugcaccuguaaccggacaaaauaauauaauugacccauggaucagaacaaauuucguacaagccccuaacggagaauuuacuguuuccccucgcaauucaccaggcgaaauauuauuaaauuuagaacuaggaccagauuuaaauccauaucuugcucauuuaucaagaauguauaauggauacgcugguggaguagaaguacaaguacuacuagcaggaaacgcauuuacagcaggaaaaauauuauuugcagcaguaccaccuaauuucccaguagaauuucuaucuccagcucaaauaacuauguuaccacaucuuauuguagacguucgaacccuagaaccaauuaugauuccacuaccugauguacgaaacacuuucuuucauuacucaaaccaaccaaacucgagaaugagauuaguagcgaugcuuuacacaccacucagaucaaauggaucaggugaugacguauuuaccguauccugcagaguacuaacucgcccaacaccagacuucgaauuuacauaucuaguacccccuaguguagaaucuaaaacaaaaccauuuucuuuaccaauacuuacacuaagcgaacuaacaaacagcagauuuccaguuccaaucgacuccuuauucacagcacaaaauaacguucuacaaguacaaugccaaaacggaagauguacauuagacggagaauuacaaggaacuacacaacucuuaccaucaggaauaugcgcuuuccgaggcagagugacagcacaaauaaaucaaagagauagauggcacaugcaacuucagaaucuaaaugguacaacauaugaccccacagacgacguaccagcaccuuuagguacacccgauuuuaaaggaguuguauuuggaaugguuucacaacgaaacguaggaaaugacgcaccaggaucaacaagagcacaacaagcauggguuucaacauauucaccacaauuuguaccaaaauuaggaucggucaaucuaagaauaucagauaacgaugauuuucaauuccaaccaacaaaauucacaccagucggaguaaacgacgaugaugauggacauccauuuagacagugggaauuaccaaacuacucaggagaacuaacauuaaauaugaauuuagccccaccagucgcaccuaacuuuccuggagaacaauuauuauucuucagaucauucguaccuugcuccgguggguauaaccaaggaaucauagauuguuuaauaccacaagaauggauucaacauuucuaucaagaaucagccccuucacaauccgauguugcauuaauaagauauguaaacccagacaccggacgcacauuauucgaagccaaacuccaccgauccggauacauaaccgucgcacauucaggagauuauccccuaguuguaccagcaaacggccauuucagauucgauucauggguuaaccaauuuuacucacucgcaccaaugggaacugguaauggaagaagacgagcacaauaa

SEQ ID NO: 33387 - RNA, 1623 nt, Artificial Sequence
  derived and/or modified sequence opt6 from VP1__Norovirus_and/or_Norovirus-like__KX371111
augaaaauggcaucaaaugacgcagccccaucaaaugauggagcagcaggccuaguaccagaaggaaacaacgaaacacucccauuagaaccaguugcaggagcagcaauagcggcaccaguuacuggacaaaacaacauaauagauccuuggauuagaacaaacuuuguacaagcucccaacggagaauuuacuguaagcccaagaaacucaccuggagaaauacuacuuaauuuagaacuaggaccagauuuaaaucccuauuuagcacaccuuuccagaauguacaacggauaugcuggaggcguagaaguccaagucuuauuagcaggaaaugcauuuacagcaggaaaaauauuauuugcagcaguucccccaaacuuucccgucgaauuuuuaucaccagcacagauaacaauguuaccucacuugauaguagacgucagaacacuagaaccaauaaugauaccccuccccgaugucagaaacacauucuuucauuacucaaaucaaccaaauucaagaaugagauuaguugcaaugcuauauacaccacuaagaagcaacggaucaggagaugauguauucacaguuagcuguagaguucuaacaagaccaacacccgacuuugaauuuacuuaucuagucccuccauccgucgaaucaaaaaccaaaccauucucuuuaccuauauuaacccuaucagaacuaacaaauucaagauuucccguaccaaucgacucacuauucacagcucaaaauaacguucuucaaguacaaugccaaaacggaagauguacuuuagauggugaacuacaaggaaccacucaacuccuaccuacaggaauaugugcauuuagaggacguguuacagcucaaauaaaucaacgagauagauggcauaugcaacuacaaaauuuaaauggaacaacauaugacccaaccgacgacguaccagcaccauuaggaaccccagauuucaaaggaguaguauuuggaaugguuucucaacgcaacguuggaagugaugcaccaggaucaaccagagcacaacaagcaugggucucaacauacagcccacaauuuguaccaaaauuaggaucaguaaaucuuagaauauccgacaaugaugacuuucaauuucaacccacaaaauuuaccccaguagguguaaaugacgacgacgauggacauccauuuagacaaugggaauuaccaaacuacuccggagaacuaacccuuaacaugaacuuagcaccucccguugccccaaacuuuccaggcgaacaauuacuauucuuuagaucuuuuguacccuguucaggaggauauaaccaaggaauaauagauugcuuaauaccacaagaauggauacaacacuucuaucaagaaucugcuccaucacaaucagacguugcccuaauaagauacguaaacccagacacaggacgaacucuauucgaagcaaaacuucacagaucagguuauauaacaguugcccacucaggcgacuacccauuaguaguaccagcaaacggucacuuccgauucgacucauggguaaaucaauucuacucucuagcaccaaugggaacuggaaaugguagaagacgugcucaguaa

SEQ ID NO: 33388 - RNA, 1623 nt, Artificial Sequence
  derived and/or modified sequence opt6 from VP1__Norovirus_and/or_Norovirus-like__KX371110
augaagauggcaucuaaugaugcagccccuuccaaugauggagcugcaggauuaguaccagaagguaauaaugaaacccuaccacuugaaccaguugcuggagcugcaauugcugcaccaguaacaggacaaaacaauauaaucgacccauggauaagaacaaauuuuguccaagcucccaacggagaauuuacaguauccccaagaaauucuccuggagaaauccuauuaaacuuagaacuagggccugauuuaaauccauauuuagcacaccuauccagaauguauaacggauacgccggaggaguagaaguacaaguauuacuagccggaaacgcguucacagcaggaaaaauucuuuucgcugcaguaccuccuaacuuuccagucgaauuucucucuccugcacaaauuaccaugcuaccucaccuaauuguugauguuagaacacuagaaccaauaaugauuccucuaccagacguacgaaauacauucuuccauuauucaaaccaaccaaacucaagaaugagauuaguagcaaugcuauacacacccuuaagaucaaauggaucaggugacgacguauucacuguaucaugucgaguauuaacaagaccaacaccagacuuugaauuuacauacuuaguaccaccuucaguagaaucaaaaacaaaaccuuucucauuaccuauauuaacucuaucugaacuuacuaacaguagauucccuguaccaauagacagucuuuucacagcccaaaacaauguuuuacaaguacaaugccaaaauggaagaugcacacuagacggugaacuucaaggaacuacucaauuauuaccauccgguauaugugccuucagaggaagaguuacagcacaaauuaaucaacaugauagauggcauaugcaacuacaaaauuuaaacggaacaacauaugauccuacugacgacguaccagcuccauuaggcacaccagauuucaaaggagucguauuuggaaugguaucacaaagaaacgucgguacagacgcccccgguucaacacgugcacaacaagccugggucaguacuuauucaccacaauuuguaccuaaauuagguucugucaauuuaagaauaucagauaaugacgauuuucaauuccaaccaacaaaauuuacuccaguaggaguaaaugaugaugacgacggacaucccuuuagacaaugggaacucccaaauuauaguggagaauuaacacucaauaugaauuuagcaccaccaguagcaccuaacuuuccaggagaacaacucuuauuuuucagaucuuuuguacccugcucuggaggcuauaaucaggguauaaucgauuguuuaauuccacaagaauggauacaacauuucuaucaagaaucugcaccaucacaaucagacguagcauuaauaagauauguaaauccagauacugguagaacacucuucgaagcuaaauuacauagauccggcuacaucacaguagcacacucaggagauuacccucuagucguaccagccaauggccauuuccgauuugauuccuggguaaaucaauucuacagucuagccccuaugggcaccggaaacgguagaagacgagcucaauaa

SEQ ID NO: 33389 - RNA, 1623 nt, Artificial Sequence
  derived and/or modified sequence opt6 from VP1__Norovirus_and/or_Norovirus-like__KX134669
augaaaauggcuuccagcgaugcugccccuucaaaugauggugcagcaggauuaguaccugaaggaaauaaugaaacacuaccacuugaaccuguagcaggagcagcaaucgcagcaccaguaacuggacaaaauaacauaauugauccauggauuagaacuaauuucguacaagccccuaacggagaauuuacaguuucuccaagaaauucaccaggagaaaucuuauuaaauuuagaacucggaccagaucuaaaucccuacuuagcacauuuaucccgaauguauaacggauacgcugguggaguagaaguacaaguucuacucgcagguaaugcauuuaccgcuggcaaaauauuauuugcagcuguaccacccaauuuucccguagaauuucuaucaccagcacaaauaacaaugcuuccacaccuuauaguagacguaagaacacuagaaccaauaaugauaccauuaccagauguaagaaacacuuucuuccauuauucaaaccaaccuaacucuagaaugagauuaguagcuaugcuauacacaccauuacgaucaaacgguucaggagaugacguauucacuguaucaugcagaguacuaacacgacccacuccagacuucgaauuuacauaucuaguaccaccuucagucgaaucaaaaacaaaaccauuuagcuuaccuauauuaacucucucagaacuaacaaacaguagauucccagucccuaucgacucacuauuuacagcucaaaauaauguucuccaaguacaaugucaaaauggacgcugcacauuagacggcgaauuacaaggaacaacacaacuccucccauccggaauuugugccuuucgaggaagaguaacagcacaaauaaaccaacgagauagauggcacaugcaacuucaaaaucuaaacggaacaacauaugacccaaccgaugacguacccgcaccacuuggaacaccagauuuuaaaggagucguauuuggcaugguaucucaaagaaacguuggaaacgaugcaccaggaucaacaagagcucaacaagcauggguaucuacauauagcccucaauuuguaccaaaacuaggcucugucaaucuaagaauaucagacaaugaugacuuccaauuccaacccacaaaauucaccccaguagguguaaacgaugacgaugacggucacccauuuagacaaugggaauuaccuaauuauucaggagaacuuacauuaaacaugaauuuagcucccccaguugcacccaacuuuccaggagaacaacuacuauucuucagauccuucguaccuuguucaggaggcuauaaucaagguaucauugauugcuuaauaccacaagaauggauacaacauuuuuaucaagaaagugcaccaucucaaucagacguugcacuaauacgcuauguaaauccagacaccggacguacccuuuuugaagcaaaacuucaucgcucagguuauauaacuguugcacacucaggugauuauccccuaguaguccccgcaaauggucacuuccgauuugauagcuggguaaaucaauuuuauucucuagccccaauggguacaggaaauggaagaagacgagcacaauaa

SEQ ID NO: 33390 - RNA, 1623 nt, Artificial Sequence
  derived and/or modified sequence opt6 from VP1__Norovirus_and/or_Norovirus-like__KU557871
augaaaauggcaaguaaugacgcagcaccaucaaaugacggugcagccgguuuaguaccugaaggaaacaaugaaacacuaccacuagaaccaguagcuggugccgcaauagcagccccugucacaggacaaaacaacauaauugauccauggauacgaacaaacuuuguacaagcaccuaauggagaauuuacagucucaccaagaaacaguccuggagaaauuuuacuaaaucuagaauuaggaccugaucuaaauccauaucuagcacaccuaucuagaauguauaacggauacgcugguggaguagaaguacaaguauuauuagcaggaaaugcuuuuacagccgguaaaauauuauucgcugcaguaccaccuaacuucccaguugaauuucuaucuccagcccaaauaaccaugcucccacacuuaauuguagacgucagaacauuagaaccuauaaugauaccacuuccagauguaagaaauacauuuuuccacuauuccaaucaaccaaacucaagaaugcgauuagucgcaaugcuauacacaccucuucgaagcaacgguuccggugaugauguuuuuacaguaucuuguagaguauuaacuagaccaacaccagacuuugaauuuacauaucuaguaccacccuccguagaaucaaaaacuaaacccuucucccuaccuauacuaacauuaucagaacuuacaaacucaagauuuccaguaccaauagacucacuauuuacagcacaaaauaacgcacuucaaguacaaugccaaaacggacgcuguacauuagauggugaauuacaaggcaccacacaacuacuuccuagcgguauaugugcuuuucguggaagaguaacagcacaaauaaaucagagagauagauggcacaugcaauuacaaaaucuaaauggaacaacauaugacccaaccgaugauguaccagcuccucuaggaacuccagauuucaaaggagucguauucggaaugguaagucaaagaaauguuggcaaugacgcaccaggaucaacacgcgcacaacaagcauggguaucaacuuauucuccucaauucguaccaaaauuaggaucagucaauuuaagaauaucagauaaugacgauuuccaauuccaaccuacaaaauuuacaccaguuggagucaaugacgaugacgauggucauccauucagacaaugggaacuaccuaacuauagcggcgaacugacccuaaacaugaaucuagcaccaccaguagcaccuaacuuucccggugaacaacuucuauuuuucagaucauuuguacccugcucagguggcuauaaucaaggaauaauugauugucuuauaccccaagaauggauucaacacuucuaucaagaaucagcacccucacaaucugacguugcccuaauaagauacguaaacccagacacaggaagaacauuauucgaagccaaauuacaucgaucaggauauauuaccguagcucacaguggagauuacccauuagucguaccugccaacggacauuucagauucgacuccuggguaaaucaauucuauucauuagcaccaaugggaacuggcaauggcagacguagagcucaauaa

SEQ ID NO: 33391 - RNA, 1623 nt, Artificial Sequence
  derived and/or modified sequence opt6 from VP1__Norovirus_and/or_Norovirus-like__KX371108
augaagauggcaucaaaugaugcagcaccuuccaaugacggagccgcaggccuaguacccgaaggaaauaaugaaaccuuaccccuagaaccaguagcuggagcagcaaucgcugcaccagugaccggccaaaacaauauaauagacccauggauaagaaccaacuuuguccaagcuccaaacggugaauuuacagucucaccuagaaauucaccuggagaaauauuacuaaaucuagaacuuggcccagaccuaaauccauauuuagcacacuuaucaagaauguauaacggcuaugcaggcggagucgaaauacaaguauuacuagcagguaacgccuucacagcaggaaaaauauuauucgcugcaguuccaccaaauuucccaguugaauuuuuauccccugcccaaauuaccaugcucccacauuuaauaguagauguacgaacacuagaaccaauaaugauacccuuaccugacguaagaaacacauucuuucauuauucaaaucaaccaaauucaagaaugcgauuaguagcaauguuauacacuccccuacgaucaaacggcucaggugacgauguauuuacaguuagcuguagaguucuaacaagacccacaccagacuucgaauuuacauaucuaguaccacccucaguagaaucaaaaacaaaaccuuucucauuaccaaucuuaacacuaucagaacuaacaaacucaagauuuccuguuccuauugauucucuauuuaccgcacaaaauaauguacuacaaguacaaugccaaaauggaagaugcacauuagacggagaauuacaaggaacaacacaauuacuaccaacagguauaugugcauuuagaggucgaguaacagcucaaauuaaccaaagagacagauggcacaugcaacuacaaaauuuaaauggaacaacauaugaucccacagaugauguucccgcaccacuaggaacucccgacuucaaaggaguaguauuuggaaugguaucucaaagaaacguaggaucagaugcaccagguaguacacgagcucaacaggcuuggguaucaacauauucaccacaauuuguaccaaaauuaggcucaguaaaccuaagaauaucagacaacgaugauuuccaauuucaaccuacuaaauucacacccguaggagucaaugacgaugaugacggacacccauuccgucaaugggaacuaccuaauuacucaggugaacuaacauuaaauaugaacuuagcaccuccaguagcuccaaacuuuccuggagaacaauuacuuuucuuucgaucauucguaccauguucaggagguuauaaucaaggaaucaucgacugcuuaauaccacaagaauggauacaacacuucuaucaagaaucagcaccaucacaaucagacguagcauuaauacgauauguuaacccugauacaggaaggacccuauucgaagcaaaacuacauagaucaggauauauaacaguagcucauucaggagauuacccauuaguaguaccagcaaauggacauuuucgauucgauucaugggucaaucaauuuuauucacuagcuccuaugggaacuggaaauggaagaagacgagcacaauaa

SEQ ID NO: 33392 - RNA, 1623 nt, Artificial Sequence
  derived and/or modified sequence opt6 from VP1__Norovirus_and/or_Norovirus-like__KU557829
augaaaauggccuccaacgaugcagcaccaucaaaugauggagcagcaggucuaguaccagaagguaacaaugaaacuuuaccacuagaacccguagcaggagcagcaauagccgcaccaguaacuggacaaaauaauauaacagaccccuggaucagaaccaacuuuguccaagcacccaacggagaauuuacaguauccccaagaaacucaccgggcgaaauucucuuaaaccuagaauuaggaccagacuuaaauccauaucucgcacacuuauccagaauguacaacggauacgcaggagguguagaaguacaaguauuauuagccggcaaugcauucacagcagggaaaauucuauucgcagcaguuccuccaaauuuuccaguugaauuuuuaagccccgcucaaauaacaauguuaccacaccuaaucguagacguaaggacacuagaaccaaucaugauaccacuaccugauguaagaaacacauucuuccacuauucaaaucaacccaacucuagaaugagauuaguagcuaugcuauacaccccauuaagaucaaacggaucaggugaugauguauucacaguauccuguagaguacuaacacgaccaacaccagacuucgaguucacauaccuagucccaccaucaguagaaucaaaaacuaaaccauuuucucucccaauacuaacuuuaagugaauuaacaaauucucguuucccaguucccauagacucauuauucacagcacaaaauaacguacuucaaguccaaugccaaaacggacgauguacauuagauggagaauuacaaggaacuacccaacuauuaccauccggaauaugcgcauuuagaggaagaguuacagcucaaauaaaucaacgagauagauggcacaugcaauuacaaaaccuaaauggaacaacauaugacccaacagacgacgucccagcaccacuaggaacucccgacuucaaaggaguaguauuuggaauggucucccaacgaaacguaggaaacgaugcaccagacucaacuagagcacaacaagccuggguauccacauauucaccacaauuugucccaaaauuaggaucuguaaauuuacgaauauccgacaaugacgauuuucaauuccaaccaaccaaauuuacaccaguuggaguaaacgaugacgaugauggccauccauuuagacaaugggaacuaccaaacuauucaggagaauuaacauuaaacaugaaccuagccccaccagucgcaccaaacuucccuggagaacaauuacuauucuuuagaucauuuguaccuuguucagguggauacaaccaaggaaucauagauuguuuaauaccacaagaauggauacaacauuucuaccaagaaucugcacccucacaaucugauguagcuuuaauaagauacgugaauccagacacaggacggacauuauucgaagcaaaacuacacagaucaggauauauaacuguagcacacucaggagauuauccucuaguugucccagccaacggccauuuccgauuugauuccuggguuaaucaauuuuacuccuuagcaccaaugggaacaggaaauggacguagacgagcacaauaa

SEQ ID NO: 33393 - RNA, 1623 nt, Artificial Sequence
  derived and/or modified sequence opt6 from VP1__Norovirus_and/or_Norovirus-like__KX168452
augaaaauggccaguaaugacgcagccccaucaaaugacggugcagcaggucuaguuccagaagguaacaacgaaaccuuaccauuagaacccguugcuggagcagcaauagcagcaccuguuacaggacaaaacaauauaauugauccauggauaagaacaaacuuuguacaagcuccaaacggagaauuuacaguuucuccccgaaauucaccaggagaaauauuacucaaucucgaauuaggaccagauuuaaauccauaucuagcacaucuaucuagaauguauaacggauacgcaggagguguagaaguucaaguccuacuagcaggcaaugccuucacagcugguaaaauauuauucgcagcaguaccaccaaauuuuccaguagaauuucucucacccgcucaaauuacaauguuaccucauuuaaucguagauguacgaacacuagaaccaauaaugauaccauuaccugaugucagaaacacauucuuucacuauucaaaucaaccuaauucacgcaugcgucuaguugcaaugcuauacacuccccuaagaucaaacggcucaggagaugauguuuuuacaguaagcugucguguuuuaacgcgcccaacaccagauuuugaauuuacauaucuuguaccaccaucaguagaaucaaaaacaaaaccuuucucacuuccaaucuuaacauuaucagaauuaacaaacucaagauuucccgccccuaucgacucuuuauuuacagcacaaaauaauguauuacaaguccaaugucaaaauggacgauguacacucgacggagaacuccaagguacaacacaacuucuuccaucuggaaucugugcauuucgaggaagaguuacagcccaaauaaaucaaagagaccgauggcacaugcaauuacaaaauuuaaauggcacaacuuaugauccaacagacgacgucccagcaccauuagguacuccagauuuuaaaggaguaguuuuugguauggucucacaacgaaacguagguucagacgccccuggaucuacaagagcucaacaagcauggguaucaacauauuccccacaauucguuccaaaauugggcucuguaaaucuaagaauauccgacaaugacgacuuucaauuccaaccaacuaaauuuaccccuguaggagucaaugacgacgacgauggccauccauuuagacaaugggaacuuccaaauuauucuggagaauuaaccuuaaauaugaacuuagcaccaccagucgccccaaacuuuccaggagaacaacucuuauucuuucguuccuuuguaccauguagugguggauauaaccaagguauaauugauugcuuaauaccccaagaauggauacaacacuucuaucaagaaucagcacccucacaaucugacguugcauuaauaagauacguaaauccagauacaggaagaacccucuucgaagccaaauuacacagaaguggauauauaacaguagcccacucaggagauuauccacuuguaguaccagcaaauggucauuuuagauucgacaguugggucaaccaauuuuauucacuugcaccaauggguacaggcaauggaagacgacgagcacaauaa

SEQ ID NO: 33394 - RNA, 1623 nt, Artificial Sequence
  derived and/or modified sequence opt6 from VP1__Norovirus_and/or_Norovirus-like__KU953393
augaaaauggcaagcaaugacgcugcaccuucuaaugacggcgcagcuggauuagucccagaagguaauaaugaaacacuaccacuagaaccuguagcaggagcugcaauagcagcaccagucacaggacaaaauaauauaauagauccauggauaagaacaaauuuuguucaagcaccuaacggcgaauuuaccguaucaccuagaaauucaccuggagaaauauuacuaaauuuagaacuaggaccagaucuaaacccauaucucgcacacuuaagccguauguauaacggauaugcuggugguguugaaguccaaguauuacuagcaggaaacgcauuuacugcaggaaaaauucuauuugcugcaguaccaccaaacuuuccugucgaauuuuuaucaccagcacaaauaacaauguuaccucauuuaaucguugacguucgaacccuagaaccaauaaugauaccauuaccagacguacgaaacacuuucuuucacuacucaaaucaaccaaacucaagaaugagauuaguugcaauguuauacacaccacuaagaucuaauggaagcggagacgauguauucaccguauccugucgaguccucacaagaccaacuccugauuucgaguuuacauacuuaguaccaccgucaguugaaucuaaaacuaaaccauucucucuaccuauauuaacauuaucagaauuaacaaauucacgcuuuccaguaccuaucgacaguuuauuuacagcucaaaacaacguuuuacaaguacaaugucaaaacggaagaugcacccuagacggagaauuacaaggaacaacacaacuuuuaccauccucuaucugugcauucagaggaagaguaaccgcacaaauuaaccaaagagaucgcuggcacaugcaauuacaaaaucuaaauggcacaaccuaugauccuacagaugauguaccagcaccacuuggaacaccagacuucaaaggcguaguauuuggaaugguaucucaacguaacguuggaucagacgcaccaggaucaacaagagcucaacaagcauggguaucuaccuacucuccucaauucguaccuaaauuaggaucagucaacuuaagaauaucugauaaugacgauuuccaauuccaaccaacaaaauuuacacccgucggaguaaacgaugaugacgauggacacccauuccgacaaugggaacucccuaauuauucaggugaacucacucuaaacaugaacuuagcaccaccaguugcaccaaacuuuccuggagaacaacuauuauucuuuagaucuuuuguaccuuguucaggcggauauaaccaaggaauaauugauugccuaaucccacaggaauggauacaacauuucuaucaagaaucugcuccuagccaaucagacguugcacuuauacguuauguuaacccagacacaggaagaacacuauucgaagcaaaacuacauagaucuggauauauaacaguagcacauucaggagauuacccucuaguagucccagcaaauggacauuucagauucgauucuuggguuaaccaauuuuauucauuagcuccaaugggaaccggaaauggaagacgcagagcacaauaa

SEQ ID NO: 33395 - RNA, 1623 nt, Artificial Sequence
  derived and/or modified sequence opt6 from VP1__Norovirus_and/or_Norovirus-like__KR052020
augaaaauggcaucaaaugaugccgccccaucaaaugacggagcagcgggauuaguuccagaaggaaauaaugaaacacuaccuuuagaacccguagccggcgcagcaauagcugcaccaguaacaggacaaaacaauauaauagaucccuggauacgaacuaacuuuguacaagcaccaaacggagaauuuacaguaucaccacgaaauuccccaggagaaauauuacucaaucuagaauuaggacccgaccuaaacccauaucuugcacaucuaucacgaauguauaacgguuacgcaggcggaguagaaguacaaguucuacuugcuggcaacgcauuuacagcagguaaaauacuauuugcagcaguaccaccaaacuuccccguugaauuuuuaucaccagcucaaauuacaauguuaccucauuuaauaguagacguacgaacacuagaaccuauuaugauaccucuaccagauguaagaaacacauucuuucauuauucaaaucaaccaaacucuagaaugcgccuaguagcaauguuauacacaccccuuagaucaaauggaaguggagacgauguauucaccguuaguuguagaguacuaacaagaccuacaccagacuuugaauuuacauaucuuguaccaccaucaguugaaucaaaaacaaaaccauuuucauuaccaauauuaacauuauccgaacuaacaaacagucgauuucccguccccaucgacuccuuauucacagcacaaaauaacguuuuacaaguacaaugucaaaaugguagauguacauuagacggugaauuacaagguacaacacaacucuuaccaucaggaauuugugcuuuuagagguagaguuaccgcucaaauaaaucaacgcgauagauggcacaugcaauuacaaaaucuaaauggaacaacauacgaucccacugacgauguaccagcacccuuaggaacaccagacuuuaaaggaguugucuucgguaugguaucacaacguaacguaggaaacgacgcuccaggauccacaagagcacaacaagccuggguaucaacauauucaccacaauuugucccuaaauuaggcucaguaaaucuaagaauaucagacaaugaugauuuucaauuucaaccuacuaaauuuacaccaguagguguuaaugaugaugacgacggacauccauuuagacaaugggaacuaccaaacuauuccggagaauuaacauuaaauaugaauuuagcuccacccguagccccaaacuuucccggagaacaacuacucuucuuuagauccuucguaccaugcagcggagguuacaaccaaggcauaauagacuguuuaaucccacaagaauggauacaacacuucuaucaagaauccgcacccagccaaccagauguagcauuaauacgauacguaaacccugacacuggucgaaccuuauucgaagcaaaacuacaucguucaggauacauaaccguagcacacucaggcgacuauccucucguaguaccugcuaauggucauuuccguuucgauucauggguaaaucaauuuuauucauuagcucccaugggcacaggcaacggacgaagacgcgcacaauaa

SEQ ID NO: 33396 - RNA, 1623 nt, Artificial Sequence
  derived and/or modified sequence opt6 from VP1__Norovirus_and/or_Norovirus-like__KT315687
augaaaauggcaucaaaugaugcagcaccaucaaaugauggagcugccggucuaguaccagaaggaaacaaugaaacauuaccacuagaaccaguagcaggagcugccauugcagcuccagucaccggccaaaacaauauaauagauccuuggauacgaaccaacuuuguacaagcaccuaauggugaauuuacaguaucaccuagaaauucaccaggagaaauauuacuuaaccuagaauuaggucccgauuuaaaucccuaucuugcucacuuaucaaggauguauaauggcuacgccggaggaguagaaguacaaguacucuuagcaggaaacgcuuucacugcaggaaaaauccuauuugcagcaguaccaccuaacuuuccaguagaauuucuaucuccagcacaaauaacaaugcucccacaccuaaucguugacgucagaacuuuagaaccaaucaugauacccuuaccagaugucagaaauacuuucuuucacuauucaaaccaaccaaacucuagaaugagauuaguagcaauguuauauacuccauuaagaucaaacggaucuggagaugaugucuucacaguaucuugucgcguauuaacuagacccacacccgacuuugaguucacauauuuaguaccaccaagcguugaaucaaaaacuaaaccauucucucuacccauauuaacacuuucugaauuaacaaauucuagauuuccaguaccaauagacucauuauuuacagcacaaucuaauguuuuacaaguccaaugucaaaaugguagauguacacuugauggagaacuucaaggaacaacccaacuauuaccaaccggaauaugugcauuccgaggaagaguaacagcacaaauaaaucaaagagaccgcuggcauaugcaacuacaaaaucuaaacggaaccacguaugacccaaccgacgauguuccugcccccuuaggaacuccagauuuuaaagguguaguauuuggaaugguuucacaaagaaacgucggaaaugaugcaccaggaucaacaagagcacaacaagcauggguaucaacauauuccccacaauucguacccaaauuaggaucuguaaaucucagaauaucugacaaugacgauuuccaauuucaaccaacaaaauuuaccccuguaggaguuaaugacgaugacgauggacauccauucagacaaugggaacuuccaaauuauucaggagaauuaacuuuaaacaugaaucuagcaccuccugucgccccaaacuuucccggagaacaacuacuuuucuuucguucuuucgucccaugcucaggugguuauaaccaaggaauuauagauugcuuaauaccccaagaauggauccaacauuucuaucaagaaucagcucccucacaaucagauguugcccuuauaagauacguaaauccugacacagguagaacacuauuugaagcuaaacuacacagaucaggauauauaacaguagcucacucaggagauuacccuuuaguaguacccgccaauggacacuuuagauucgauucuugggucaaucaauuuuacucauuagcuccaaugggaacaggaaauggccguagacgagcacaauaa

SEQ ID NO: 33397 - RNA, 1623 nt, Artificial Sequence
  derived and/or modified sequence opt6 from VP1__Norovirus_and/or_Norovirus-like__KX356908
augaaaauggcauccaaugacgcagcaccaaguaaugauggagcagcaggucuaguuccagaagguaauaaugaaacuuuaccauuagaacccguagcaggagcagcuauagccgccccuguaacaggacaaaauaauauaauagauccuuggauacgcacaaacuucguacaagccccaaacggagaauuuacaguuucccccagaaacucaccuggagaaauacuucucaauuuagaacuugguccagaccuaaacccauaucuagcacaucuaucccgaauguacaauggauaugccggaggagucgaaguacaaguauuauuagcaggaaaugcauuuacagcuggaaaaauuuuauuugcagcugugccaccuaauuuccccguagaauuucuauccccagcccaaauaacaauguuaccacauuuaauaguugauguaagaacacucgaacccauaaugaucccacuucccgacguaagaaauacauucuuucauuauucaaaccaacccaauucucguaugcgauuaguagcaauguuauacacgccacuuagaucaaacggaucaggagacgauguuuuuacaguaucauguagaguucucacaagaccaacaccagacuuugaauuuacauauuuaguaccuccuuccguugaaucuaaaacaaaaccauucucacuacccauauuaacacuaucugaacuaacuaacucaagauuuccaguuccaauagacucauuauuuaccgcacaaaauaacguacuccaaguccaaugccaaaauggacgauguacauuagacggagaacuacaaggaacuacucaauuacuaucuucagauauaugcgcauucagaggaagaguuacagcccaaauuaaccaaagagaucguuggcauaugcaacuucaaaaucuaaaugguacaacuuacgacccuacagaugauguucccgcaccauuaggaacaccagacuucaaagguguaguauuugguaugguaucucaacgaaacguaggcucagacgcacccggaucaaccagagcacaacaagcauggguaucuacauacuccccacaauucguaccaaaacuuggaucuguuaauuuaagaaucucugauaaugaugacuuccaauuccaacccacaaaauuuaccccaguaggaguaaaugacgacgacgauggacauccauuuagacaaugggaacucccaaacuauucaggagaacuaacacuaaauaugaaccuagcaccaccagucgcaccaaacuuccccggugaacaauuacuuuucuuucgaucauuuguacccuguucaggaggcuauaaucaaggaauuauugauuguuuaaucccccaagaauggauccaacauuucuaucaagaaucugccccaucccaaucugacguagcauuaauacgcuauguaaacccugauacaggcagaacauuauucgaagcaaaacuacauagaucagguuauauaaccgucgcacauagcggagaucacccacucguaguaccugcaaauggucauuucagauucgauucauggguaaaucaauuuuacucgcucgcacccaugggaacuggaaauggcagacgcagagcucaauaa

SEQ ID NO: 33398 - RNA, 1623 nt, Artificial Sequence
  derived and/or modified sequence opt6 from VP1__Norovirus_and/or_Norovirus-like__KX024652
augaaaauggcaucuaacgaugcagcaccaucaaaugacggcgccgcaggauuaguaccugaaggaaacaaugaaacacuaccucuagaaccaguagcaggcgcagcaauugcagcaccuguaacaggacaaaauaauauaauagacccauggauaagaacaaacuuuguucaagccccaaacggagaauuuacaguuaguccaagaaacucaccaggagaaauacuauuaaauuuagaacuaggaccagaucuuaauccuuauuuagcucaccuaucaagaauguacaacggauaugcaggaggaguagaaguacaaguacuauuagcaggaaaugcauucacagcaggaaaaaucuuauucgcagcagucccaccaaacuucccugucgaauuuuuaagcccagcacaaauaaccauguuaccucacuuaaucguagacguucgaacccuagaaccaauaaugauaccauuaccagacgucagaaauaccuuuuuccacuauucaaaucaaccaaacucacgaaugagauuagucgcaauguuauacacuccauuaagaucuaacggaucaggagaugauguauuuacaguaucaugucgaguacuaacacgaccuacgcccgacuucgaauuuacauaucuuguuccaccaucuguagaaucaaaaaccaaacccuucucucuaccaauauuaacccuaagugaacuaacaaauucaagauuucccguuccaauugauucacuuuuuacagcacaaaauaauguccuacaaguacaaugccaaaauggucgcuguacacuagauggagaacuacaaggaacuacccaacuacuaccauccggaauaugcgcauuuagaggaagaguaacagcucaaauaaaccaaagagacagauggcacaugcaacuacaaaauuuaaauggaacuaccuaugacccuacagaugacgucccagcaccauuaggaacaccagauuucaaaggaguaguauuuggaaugguaucacaaagaaacguaggaaaugacgcaccaggaucaacaagggcacaacaagcauggguaucaacauauucaccacaauuuguuccaaaauuaggcucaguaaaucuacguaucagcgacaaugacgauuuucaauuucauccaacuaaauucacuccuguagguguaaaugacgauaaugauggaccuccauuuagacaaugggaauuaccaaacuauuccggagaacuaacucuaaauaugaaucuagcaccaccaguugcaccaaauuuuccuggcgaacaacuacuauucuucagaucauuugucccuuguucaggaggauauaaccaaggaauaaucgauugccuaauaccacaagaauggauacaacacuucuaccaagaaucugcuccaucacaaucagacguagcauuaauacguuacguaaacccagacacaggacgaacauuauucgaagcuaaauuacaucguucagguuauauaacuguagcacauaguggugauuauccucugguaguaccugcaaauggacauuuuagauucgacucauggguaaaccaauucuacucacuagcaccaaugggaacaggaaauggacguagacgagcccaauaa

SEQ ID NO: 33399 - RNA, 1623 nt, Artificial Sequence
  derived and/or modified sequence opt6 from VP1__Norovirus_and/or_Norovirus-like__KT315706
augaaaauggcauccaacgaugcugcaccaucaaaugacggagcagcaggcuuaguaccagaaggaaauaaugaaacauuaccauuagaaccaguagcuggagcagcaauugcugcaccuguaacaggacaaaauaauauaauugaccccuggauaagaacaaacuuuguacaagcaccaaacggugaauuuacagucucaccucgaaauucccccggagaaauauuacuaaacuuagaacuagguccagacuuaaaucccuauuuagcacauuuaucacguauguauaacgguuacgccggagguguagaaguacaaguacuauuagcagguaaugcauucacagccggaaaaauacuguucgcagcaguaccaccaaacuuuccaguagaauuucugucaccagcccaaaucaccaugcuaccacaccuaauaguagacguaagaacacuagaaccaauuaugauaccauuaccagacguacgaaauacauucuuccacuauucaaaccaaccaaauucucguaugagauuagucgcaaugcuauacacuccccuaagaucaaauggaucaggcgacgauguuuuuacaguaucauguagaguucuaacacgaccaaccucagacuuugaauuuaccuacuuaguaccaccaucaguagaaucaaaaacaaaacccuuuuccuuaccaauacucacauuaucugaauuaacaaacaguagauuuccagucccaauagacucacuauuuacagcacaaaauaauguuuuacaaguacaaugccaaaaugguagaugcacacuagauggagaacuacaaggaacaacacaauuacuaccauccggaauaugugcauuucgaggaagaguaacagcacaaauaaaccaaagagaucgauggcacaugcaacuucaaaauuuaaaugguacaacauaugauccaacagaugauguaccagcaccacucgguacaccagauuucaaagguguaguauuuggaaugguaucacaaagaaacgucggaaaugacgccccggguucuacccgagcacaacaagccuggguaucaacauauucaccacaauucguaccaaaacuaggaucaguaaaucuacgaauuuccgauaaugacgauuuccaauuucaaccaacaaaauucaccccuguaggugucaaugacgaugacgauggacauccauuuagacaaugggaacuaccaaacuacuccggagaauuaaccuuaaacaugaacuuagcacccccagucgccccaaacuuuccaggugaacaacuccuauucuuuagaucauucguuccaugcagcggcgguuauaaucaaggaaucauagauugcuuaaucccacaagaauggauacaacauuuuuaucaagaaucugcaccaucacagucagauguugcauuaauuagauacguuaacccagauacaggaagaacacuuuuugaagcaaaacuacaucgauccggauauauaacaguugcucacucaggagauuacccauuaguuguaccagcaaauggccauuucagauuugauuccuggguuaaucaauucuacucauuagcccccaugggaacaggaaacggacgaagacgagcacaauaa

SEQ ID NO: 33400 - RNA, 1623 nt, Artificial Sequence
  derived and/or modified sequence opt6 from VP1__Norovirus_and/or_Norovirus-like__KX134670
augaaaauggccuccaaugaugccgcaccaaguaaugauggugccgcaggauuaguuccugaagguaacaacgaaaccuuacccuuagaaccaguagcaggagccgcuauagcagcaccaguaacaggacaaaacaauauaauugauccauggauacgaacuaacuuuguacaagcaccaaacggagaauuuacaguaucacccagaaauagcccaggagaaauccucuuaaaucuagaauuaggaccagauuuaaauccauaucuagcacaccuaucaagaauguauaaugguuaugcuggaggagucgaaguacaaguucuucuugcaggaaacgcuuuuacagcaggaaaaaucuuauucgcagcuguaccaccaaacuucccaguagaauuucucucaccagcucaaauaaccauguuaccacauuuaauaguagacguucgaacacuagaaccaauaaugauaccacuaccagacguaagaaacacuuucuuucauuauucuaaccaacccaauuccagaaugagacuuguugcaauguuauacacaccauuaagaucaaacgguucaggagacgauguauuuacaguaaguugucgaguacuuacaaugccaacacccgauuuugaauuuacuuaccuaguaccaccuucagucgaaucaaaaacaaaacccuuuucauuaccaauacuaacacuuuccgaacuaacaaacucaagauuucccguuccaauagacucacucuuuacagcacaaaauaacguacuacaaguacaaugccaaaauggaagauguacauuagacggagaacuacaaggcaccacccaacuauuaccuacagguauuugugccuuucgcggaagaguuaccgcccaaauuaaucaaagagauagauggcacaugcaacuccaaaaucucaaugggacaacauaugacccuacagaugacguacccgcuccacucggcaccccagauuuuaaaggaguugucuuuggaaugguaucacaaagaaacguuggaaaugaugcucccggaucaacaagagcacaacaagcauggguaucuacauacucaccacaauuuguuccaaaauuagguucaguaaaucuaagaauaucagauaacgacgauuuccaauuccaaccaacaaaauuuacaccuguaggaguaaaugacgaugacgauggacacccauucagacaaugggaacuuccaaauuauuccggagaacuuacucuaaauaugaaccuagccccuccagucgccccuaacuuuccaggagaacaauuacuauucuucagaucauucguaccauguuccggagguuacaaucaaggaauaauagacugcuuaauuccacaagaauggauacaacauuucuaucaagaauccgcuccuucacaaucagauguagcucuaauaagauacguaaacccagacaccggaagaacuuuauuugaagccaaacuucaucguucaggauacauuacaguagcacacucaggagacuacccucucguaguaccagcaaauggucacuuuagauucgauucauggguuaaucaauuuuauuccuuagcaccaaugggcaccgggaauggccguagacgagcccaauaa

SEQ ID NO: 33401 - RNA, 1623 nt, Artificial Sequence
  derived and/or modified sequence opt6 from VP1__Norovirus_and/or_Norovirus-like__KT780399
augaaaauggccucaaaugacgcagcaccaaguaaugacggagcagcaggauuaguaccagaaggcaacaacgaaacauuaccucuagaaccaguagcuggugcagcaauagcugcaccaguuacaggacaaaauaauauaauugauccauggauaagaacaaauuuuguacaagcaccuaacggagaauuuacaguaucucccagaaauucuccuggugaaauauuacuuaauuuagaacuaggaccagaucuuaauccuuaucuagcacaucuaaguagaauguacaacggauaugcuggaggaguagaaguacaagucuuacuagccggaaaugcauuuacagcuggaaaaauucuauucgcagcuguaccaccuaacuuuccaguagaauuuuuaucacccgcacaaauaaccaugcuaccacaucuuauagucgauguacgaacccuagaaccaaucaugauaccacucccugacguaagaaauacuuucuuccauuacucaaaucaaccaaacucucgcaugcgauuaguagcaaugcuauacacaccccuaagaucuaacggcucaggugacgacguuuucacaguuagcuguacaguacuaaccagaccaacaccagauuuugaauuuacauauuuaguaccaccaucaguagaaucaaaaacaaaaccuuucucacuaccaauacucacacuuucagaacuaacaaacucaagauuucccguuccaauagacucauuauuuacagcacaaaacaaugucuuacaaguccaaugccaaaauggaagauguaccuuagacggcgaacuucaaggaacaacacaacuucucccaacaggaaucugcgcauuuagaggcagaguuacugcacaaauaaaucaacgagauagauggcauaugcaacuacaaaaccuaaaugguacaaccuacgacccaacagaugauguaccagcaccauuaggaacaccagauuucaaaggcguagucuucggcauggucucccaaagaaacguaggaaaugaugcuccaggaucuacacgagcacaacaagcauggguaagcacauacagcccccaauuugucccuaaauuaggcaguguaaauuuaagaaucucugacaaugacgacuuucaauuccaaccuacuaaauucacaccaguagguguaaacgacgaugacgauggacauccauuuagacaaugggaauuaccaaacuauucaggcgaacuaacauuaaacaugaaccuagcaccaccugucgcaccuaacuuuccuggugaacaauuauuauucuuuagaucauucguacccugcucaggaggcuauaaccaaggaauuauagauugcuuaauaccucaagaauggauucaacacuucuaucaagaaucagcaccuucacaaucagacguagcauuaauucgauacguuaauccagauaccggaagaacacuuuuugaagcaaaacuucauagaucaggauauaucacaguagcacauuccggagauuacccccuagugguuccagcaaauggacauuucagauuugacucauggguuaaccaauuuuauucauuagcaccaauggguacaggaaauggacgucgacgagcucaauaa

SEQ ID NO: 33402 - RNA, 1623 nt, Artificial Sequence
  derived and/or modified sequence opt6 from VP1__Norovirus_and/or_Norovirus-like__KP902577
augaaaauggcaucaaacgaugcagccccuuccaaugauggagccgcuggccuaguacccgaaggaaauaaugaaacacuaccacuagaaccuguagcaggggcagcaauugcugccccuguaaccggccaaaacaauauuauugauccuuggauaagaaccaacuucguccaagcaccuaacggagaauuuacaguuucaccaagaaauucaccaggugaaaucuuauuaaaucuagaacucggcccagauuuaaaccccuaucucgcucacuuaucaagaauguauaacggauacgccggcgguguugaaguacaaguacuccucgcaggcaacgcauuuacagcuggaaaaauacucuuugcugcaguuccaccaaauuuucccguagaauuucuaucacccgcacaaauaacaaugcuuccacaccuaauaguugauguaagaacauuagaaccaauaaugauaccccuaccugacguaagaaacacauucuuccauuauucaaaucaaccuaacucgcgaaugagauuaguagcaauguuauacacuccuuuaagauccaauggaucaggagacgauguauucacaguaaguugcacaguauuaacaacaccaaccccagauuucgaauuuaccuauuuaguaccaccauccguagaaucaaaaacaaaaccuuucucuuuaccuauacuaacccuuucagaauuaaccaacucacgauucccaguuccaauugauucauuauucaccgcucaaaauaacguucuacaaguacaaugccaaaacggucgauguacguuagauggugaacuacaaggaaccacacaacuacuaccaacaggaaucugugcauuuagaggaagaguaacagcucaaauuaaucaaagagacagauggcacaugcaacuucaaaaucuaaacggaacaacauacgacccaacagaugauguccccgcuccauuaggcacuccagacuuuaaaggaguaguauuuggcaugguaucucaaagaaacguuggcaaugaugcacccggcucuacacgagcacaacaagcauggguaucaacauauucaccccaauuuguaccaaagcuaggauccguaaaucucagaauaucagauaaugaugauuuucaauuucaaccaacaaaauucacucccgucgguguaaaugacgaugacgacggacauccauuuagacaaugggaacuacccaauuauuccggugaacuuaccuuaaauaugaaccuugcaccaccaguagcaccaaauuuuccaggagaacaauuauuauucuuuagaucuuuugucccaugcucaggagguuauaaucaaggaauaaucgauugccucauuccacaagaauggauacaacauuuuuaccaagaauccgcaccaucucaaucagacguagcacuuauaagauaugucaacccagauaccggaagaacauuauucgaagccaaacuacacagaucaggauauauaacaguagcacacuccggcgacuauccacuuguaguaccagcaaacggacauuucagauuugauucauggguaaaucaauuuuauucauuagcaccaaugggaacuggaaauggacguagacgagcacaauaa

SEQ ID NO: 33403 - RNA, 1623 nt, Artificial Sequence
  derived and/or modified sequence opt6 from VP1__Norovirus_and/or_Norovirus-like__KU587628
augaaaauggcuucaaaugacgcagcaccaucaaacgacggagcagcagguuuagucccugaaggaaacaaugaaaccuuaccucucgaaccaguagcuggagcagcaauagcagcaccaguaacaggacaaaacaauauaauagacccauggauaagaacaaacuucguucaagcucccuacggagaauuuacaguaucuccaagaaauucucccggagaaaucuuacuaaacuuagaacucggaccugauuuaaaucccuauuuagcacacuuaucaagaauguauaauggauaugcaggaggagucgaaguacaaguauuauuagcaggaaaugcauucacagcuggaaaaauccucuucgcagcaguuccaccaaacuucccaguagaauuucuaucacccgcacaaauaacaaugcuaccacacuuaauaguagauguucguacacuagaaccaauaaugauaccauuaccugauguacgaaauacauucuuccauuacuccaaccaaccaaacucaagaaugcgacucguagcaaugcuauauacaccauuaaggucaaauggaucaggcgacgauguauucacaguuucaugucgaguacuaacgcgacccacaccagacuucgaauuuacauaccuaguacccccaucaguagaaucuaaaaauaaacccuucucacuuccaauauuuacauuauccgaacuaacaaauucuagauuuccaguaccaauagacucucuauuuacugcacaaaauaauguacuacaaguacaaugccaaaacgguagaugcacacucgacggagaacuacaaggaacaacucaacuucucccuacuggaaucugugcuuuuagagguagaguaacagcacaaauaaaucaaagagauagauggcauaugcaauuacaaaaucucaauggaacuacauacgacccaacagaugauguaccagcuccacuaggaaccccagauuucaaaggaguuguauucggaaugguaucacaacgaaauguaggaaacgacgccccaggaucuacacgagcacaacaagcaugggucucuacauacaguccacaauuuguuccuaaauuaggcucaguuaaccuuagaauaagcgauaacgaugauuuccaauuucaaccaacuaaauuuacuccaguagguguuaaugaugacgacgacggccacccauuuagacaaugggaacuuccaaacuauucaggagaauuaacuuuaaacaugaaccuagcaccacccguagccccaaauuucccaggagaacaauugcuauucuuucgaucauucguuccauguucaggaggauauaaucaagguauaauagauuguuuaauuccacaagaauggauacaacauuuuuaucaagaaucagcaccaucucaaucagaugucgcacuaauacguuacguaaauccagacaccggaagaaccuuauucgaagccaaacuccauagaucaggauauauaacaguagcucacucaggagauuaccccuuaguuguaccugccaauggacauuucagauucgacucauggguaaaucaauuuuacucucuagcuccaaugggaacaggcaauggacguagacgagcacaauaa

SEQ ID NO: 33404 - RNA, 1623 nt, Artificial Sequence
  derived and/or modified sequence opt6 from VP1__Norovirus_and/or_Norovirus-like__AF414409
augaaaauggccucaaacgacgcagcaccaucaaaugacggagcugcaggccuaguaccagagauaaacaaugaaguaaugcccuuagaaccaguagccggagcaagucuagcuacacccgucguuggacaacaaaauauaauagacccauggauaagaaauaacuuuguacaagcaccagcaggagaauuuacaguuuccccuagaaauucaccaggugaaauuuuauuagaccuugaacuaggcccagaacuaaaucccuaucuagcucaucuagcaagaauguauaacggucacgcaggaggaauggaaguacaaauaguacuagcaggcaacgcauucacagcagguaaaaucauuuucgcagcaauacccccaggcuuccccuacgaaaaccuaucacccucacaaauaacaaugugcccccacguaauaauugauguaagacaauuagaaccaguauuacuaccaaugccagacauaagaaacaauuucuuucacuacaaccaaggcaaugacccaaaauuacgacuuguagcaaugcuauacacuccacuacgcgcaaacaacucuggagacgacguuuucaccguaucauguagaguacuaacaaaaccaucaccugacuuugaauuuacuuuccucguacccccuacuguugaaucaaaaacuaaacaauuuacucuuccaauacuuaaaaucucugaaaugacaaauucgcgauucccaguacccguagaaaugauguacaccaguagaaacgaaaaucaaguaguacaaccccaaaauggaagaguaacauuagauggagaacuacuaggcacaacaccacuauuagcagucaacauaugcaaauucaaaggagaaguaauagcuaaaaauggagauguuagaaguuacagaauggacauggaaaucacuaauacagacggaacaccaauagauccaacagaagacacaccuggacccaucggaucaccagauuuccaagguauauuauuuggaguagcaucccaaaggaauaaaaacgaacaaaauccugcaacaagaucacacgaagcaaauaucaauacaggaggugaccaauaugccccaaaauuagcacaaguaaaaauauucucacaaucacaagacuucgaaguacaucaaccuaccguuuucacacccgucggaguagcaggcgacacaucacacccauuucgacaauggacauuaccaagauacggaggccacuuaaccaauaacacccacuuagcuccugcaguagcaccauuauuuccaggagaacaaauauuauucuuuagaucccaaauaccaucaucugguggacaugaacuuggauacauggauuguuuaguaccacaggaauggguacaacauuucuaucaagaagccgcaacugcacaaucugaaguagcacuaauaagauucauuaauccagauaccggccgaguauuauucgaagcaaaacuacauaaacaaggcuuuauaacagucgcccauacaggagacaacccaauaguaaugccuccaaauggauauuuuagauucgaagcauggguuaaucaauuuuauucccuugcuccagucggaaccggcaacggaagacgacgcauucaauaa

SEQ ID NO: 33405 - RNA, 1623 nt, Artificial Sequence
  derived and/or modified sequence opt6 from VP1__Norovirus_and/or_Norovirus-like__KT943504
augaaaauggcaucaaaugaugcagcaccgaguaaugauggagcagcaggccuuguaccagaaauaaauaaugaaguaaugccacuagaaccagucgccggugcaucacuagcaacuccaguaguaggccaacaaaauaucauugauccauggauaagaacuaacuuuguccaagcacccgcaggcgaauuuacaguaucaccuagaaauucaccaggcgaaauauuauuagaucuugaacucggaccagaacucaauccauaccuagcacacuuagcuaggauguauaacggacacgcuggaggaauggaaguacaaauaguauuagcaggcaacgcauuuacagcaggaaaaauaauauucgcagcaauuccucccggauucccguacgaaaacuuaucacccucucaaauaacuauguguccacauguaauaauagaugucagacaacuagaaccaguauuauuaccaaugccagauauaagaaauaauuucuuucauuauaaccaagguaacgacccaaaacuaagacugguugcaaugcuauacacaccacuaagagcuaacaauaguggugaugacguauuuaccguaaguugccgaguuuuaacaaaaccaaguccagacuuugaauuuacuuuucuaguaccaccaacaguagaaucaaaaacaaaacaauuuacauuacccauauuaaaaauuagcgaaaugacuaacuccagauuuccuguuccaguagaaaugauguauacugcaagaaacgaaaaucaaguaguacaaccccaaaacggaagaguaacauuagacggagaacucuuaggaacuacaccuuuacuagccguuaacauauguaaauuuaaaggggaaauaacagcuaaaucagucgaugucaggucauacagaauggacauggaaauaacuaauacagauggaacacccauagacccuacagaagauacacccggacccauugguucaccagacuuuagaggaauacuuuuuggaguagcaucacaaagaaacaaaggagaacaaauaccagcaacacgagcacaugaagcaaacauaaacacugguggagaccaauacgcacccaaacuagcacaaguaaaauucuuuucaggcucacaagacuuugaaguacaucaaccaacaguauuuacaccaguaggaguugccggugauucaagccauccauuucaacaaugggcacuucccagauacgguggacaucuaaccaacaacacacauuuagcaccagcaguagccccacuuuuuccaggagaacaaauacuauucuucagaucacaaauaccaucauccggaggacacgaaauggguuacauggauugcuuaguaccccaagaauggguucaacauuuuuaucaagaagcugcaacagcgcaaucagaaguagcacuaauaagauucguaaaccccgacaccggaagaguauuauucgaagcaaaacuucauaagcaaggcuuuauaacaguugcacauacaggcgauaacccaauuguaaugccaccuaauggucauuucagauuugaagccugggucaaucaauuuuacucuuuagcaccaguaggaacaggcaauggacgacgaagaauccaauaa

SEQ ID NO: 33406 - RNA, 1623 nt, Artificial Sequence
  derived and/or modified sequence opt6 from VP1__Norovirus_and/or_Norovirus-like__KT943505
augaaaauggcaaguaaugacgcagcacccaguaaugacggagccgccggauuaguccccgaaauaaacaaugaaguaaugccgcuagaaccaguagcaggagcaucacuagcaacaccaguaguaggacaacaaaauauaauugauccauggaucagaacaaauuuuguacaagcaccagcuggagaauuuaccguaagcccaagaaauucaccaggagaaauccuauuagaccuagaacuaggaccagaacucaauccauaucuugcacacuuagcaagaauguacaauggacacgcaggcgguauggaaguucaaauaguauuagcaggaaacgcuuucacagcaggcaaaauaauauuugcagcuauacccccuggauuuccauaugaaaaucuaucuccaucucaaauaacaauguguccacacguaauaauagacguaagacaacuagagccaguccuauuaccaaugccagauauaagaaauaacuucuuucacuauaaccaaggaaaugacccaaaacuaagauuaguagcuauguuauauacaccacuaagagcaaacaauucaggugaugauguauucacuguaagcugcagaguacuaacaaaacccucaccagauuucgaauuuacauuccuagucccucccacuguagaaucaaaaaccaaacaauucacccuacccaucuuaaaaaucucagaaaugacaaauucaagauucccuguaccaguagaaaugauguacacagcaagaaaugaaaaccaagucguacaaccccagaacggaagagucacauuggacggagaacuucugggaacuacaccauuacuagccguaaacauauguaaauuuaaaggagaaauaacagcaaaaaguguugauguacgcaguuaucgaauggacauggaaauaacaaauacagauggaacuccaauugacccaacagaagacacacccggaccaauaggaagcccagauuucagggguauacuauucgggguagcgucccaaagaaauaaaggagaacaaaucccugcuacaagagcacaugaagcaaacauaaauacaggcggagaccaauacgcaccaaaauuagcacaaguuaaauucuuuucaggaucacaagauuuugaaguacaucaaccaaccguuuuuacuccaguaggagucgcuggugacucaagccaucccuuccaacaaugggcacucccacgguauggaggucauuuaacaaacaauacacaccucgcacccgcaguggcacccuuauucccaggagaacaaauuuuauuuuucagaucacaaauaccauccaguggaggacaugaacuuggauauauggauugcuuaguaccucaagaauggguacaacauuuuuaucaagaagcagcaacagcacaaucagaaguagcauuaaucagauuugucaacccagauacaggaagaguauuauucgaagcaaaauuacacaaacaaggcuuuauaacuguagcacacacaggagauaauccaauaguuaugccaccaaacggacacuucagauucgaagccugggucaaucaauuuuacucucuagcaccaguaggaacaggcaacggcagaagaagaauacaauaa

SEQ ID NO: 33407 - RNA, 1623 nt, Artificial Sequence
  derived and/or modified sequence opt6 from VP1__Norovirus_and/or_Norovirus-like__KT962982
augaaaauggcaucuaacgaugcugcaccuucaaaugacggugccgcuggauuaguaccugaaauaaacacagaaacacuaccacuugaaccaguagcaggagcagcaauagccgcacccguaacaggacaaaacaauaucauagacccauggauuagaaauaauuucguacaggcaccgaacggcgaauuuacaguaucaccaagaaauucaccaggcgaaauauuaaugaacuuagaauuagguccagauuuaaaccccuaucucgcacaccucucacguauguacaacggcuaugcaggaggagucgaaguacaaguacuacuagccggaaacgccuucacagcaggaaaaauacucuucgcagcaguaccaccaaacuucccugucgauaugcuaaguccagcacaaauaacaauguuaccacauuuaauagucgacgucagaacgcuagaaccuauaaugauaccacucccagacguacgaaacguuuucuaucauuucaacaaucaaccagccccucguaugagacucguagccauguuauacaccccacuuagaucuaacggaucaggagaugauguuuucacaguaucaugccgaguucuaaccagaccaaccccagacuucgaauuuacauacuuaguaccucccucaguagaaucaaaaacaaaaccauucacauuaccaauacuaaccauaggugaacuuacuaacucaagauuucccgcaccaauagaucaacuauauacaucccccaaugcagacgucguaguacaaccccaaaacggacgauguacucuagacggagaacuacaaggcacaacucaauuauuaacaacugcuauuugcucauauaaaggaaccaccucaaacccaacaagugacuauugggaugaccaccuucugcacuuaguacacccaaauggagccaccuacgacccaacugaagauguaccagcaccauucggaacacaagauuucagaggcauacuuuauggcguccuaacacaaaacacccaaaauccacgagacgaaguaucuaacucucgcggaaucuacaucucauccacaagugauaaauucacaccaaaacuaggaacuauaggcuuacaccaaguacaaggugauacagcaucaaaucaacaaucaaaauuuacaccagucggaauagcuguaaaccaaaauacaccauucaaacaaugggaacuaccuaauuacucaggcgcauuaacccuaaauaccaauuuagcaccagccguaggcccuaauuucccaggagaacaaauacuuuucuuucguucaaacguaccaucaguacaaggcaaccacccuacucaagaaauagauugcuuaaucccucaagaauggguuagucauuuuuaccaagaaucugcacccucucaauccgauguagcauuaguaagauacgucaacccugacacuggcagaacuauauucgaagcaaagcuccauagacaagguuuuauaacaauagcugcaacuggaucuaauccaguaguaguuccaccuaaugguuacuuuagauucgacucuuggguaaaucaauuuuaugcucuugcaccaaugggaacaggcaauggaagaagacgagcccaauga

SEQ ID NO: 33408 - RNA, 1623 nt, Artificial Sequence
  derived and/or modified sequence opt6 from VP1__Norovirus_and/or_Norovirus-like__KX079488
augaaaauggcuucaaacgacgcugcaccaucuaacgauggggcagcaggcuuaguaccagaaauaaacacagaaacucuaccccuagaaccaguagcaggagcugcaauagcugcaccuguaacuggacagaacaacauaauagaccccuggauaagaaauaacuucguacaagcaccaaacggagaauuuacagucucaccuagaaauuccccaggagaaauauuaaugaacuuagaacucggcccugaucuuaauccauacuuagcacacuuaaguagaauguacaacggauacgcuggaggaguugaaguacaaguacuacuagccgguaacgcauucacagcaggaaaaauucuauuugccgccguuccaccaaauuuuccaguagacaugcuaucacccgcccaaauaacaaugcuaccucauuuaaucguugauguaagaacuuuagaaccaaucaugaucccauuacccgauguaagaaacguauuuuaucacuuuaacaaucaaccagcaccaagaaugagauuaguagcaaugcucuauaccccucucagaucuaacgguuccggagacgacguauuuacaguaucuugccgaguacuaacaagacccacaccagauuuugaauuuacauauuuaguucccccaucaguagaaucaaaaacaaaaccauucacacuacccauacucacaaucggagaacuaacaaauucacgauucccagcuccaauugaccaauuauacacaucaccaaaugccgauguaguaguacaaccacaaaaugguagauguacucuagacggagaacuacaagggaccacucaacuacuaacaaccgcuauauguucauacagagggacaacuuccaauccuaccagcgauuacugggacgaucaccuacuacaccuaguucacccuaacggagcaacauacgacccuaccgaagacguuccagcaccauuuggaacacaagauuuuagagguauacuuuauggcguauuaacccaaaacacucaaaaucccagagacgaaguauccaacucucguggaauuuacauaucauccacaagcgauaaauuuaccccaaaauuagguacaauaggucuccaucaaguccaaggagauacagccucuaaccaacaaucaaaauuuacuccaguagguauagcaguaaaccaaaauacacccuuuaaacaaugggaacuccccaacuacucuggugcccuaacacuaaauacaaaucuagccccugcaguaggaccaaauuucccaggcgaacaaauacuauucuucagauccaauguuccaucuguacaagguaaucauccaacccaagaaauagauugucucauuccacaagaauggguuucacauuucuaucaagaaagcgcccccucacaaucagacguagcccuuguaagauauguaaacccagauacugguaggaccauauuugaagcaaaauuacacagacaaggcuuuauaacgauagcagcaacagguucaaaucccguaguaguuccaccaaauggauauuuuagauuugauuccuggguaaaccaauucuaugcauuagcaccaaugggcacaggaaauggacgaagacgagcccaauaa

SEQ ID NO: 33409 - RNA, 1623 nt, Artificial Sequence
  derived and/or modified sequence opt6 from VP1__Norovirus_and/or_Norovirus-like__KR921938
augaaaauggcaucaaacgacgcagcaccaucaaacgacggagccgcuggauuaguaccugaaauaaacacagaaaccuuaccauuagaaccaguugccggcgcagcaauagcagcaccaguaaccggacaaaacaacauaaucgaccccuggauaagaaacaacuuuguacaagcaccuaacggagaauuuacaguaaguccaagaaacucuccaggagaaauauuaaugaaccuagaacuagguccagauuuaaacccauaucuagcacaucuaucaagaauguauaacgguuacgcaggaggaguugaaguacaaguacucuuggcaggaaacgcauuuacugcaggcaaaauccuauuugccgcaguuccaccaaacuucccaguagauaugcucucucccgcacaaauaacaaugcuaccccaccuaaucguagacguaagaacucuagaaccaauuaugauaccacuaccagacgucagaaacguauucuaccauuucaauaaucaacccgcaccaagaaugcgucuaguagcaaugcuuuauacacccuuaagaucaaauggaagcggagacgacguauucacaguaaguugcagaguccuaaccagacccaccccagacuuugaauuuacauauuuagucccucccuccgucgaauccaaaacaaaaccuuucacacuuccuauauuaacaauaggagaacuaaccaauuccagauucccagcaccaauagaccaauuauauaccucacccaacgcugacguaguaguacaaccacaaaacggaagauguacccuagauggagaauuacaaggaacaacacaauuauuaacaaccgcaauauguucuuacagaggaacaacaagcaauccuacaucagauuauugggacgaucaucuacuacauuuaguacaucccaacggagcaacauaugauccaacagaagauguaccugcacccuucggaacccaagacuucagaggaauacucuauggaguccuaacccaaaauacacaaaauccuagagacgaagucucaaacucucgaggcauuuacauaucuucuacuucagacaaauucacaccaaaauuaggaacaauaggacuacaccaaguacaaggagacacagcaucaaaccaacaaucaaaauucacucccguagguauagcagucaaucaaaacacaccuuuuaaacaaugggaacuaccaaauuacucaggcgcacucacauuaaauacaaacuuagccccugcaguaggaccaaacuuucccggagaacaaauacucuucuuccgcucaaacgucccaaguguacaaggaaaccacccaacacaagaaauagauuguuuaauaccacaagaauggauaucacauuucuaucaagaaucugcacccagccaaucagacgucgcacucguccgauauguuaacccagacacaggaagaacaauuuucgaagcaaaacuccauagacaaggauuuauaacaauagcagcuaccggaucaaacccuguaguaguaccaccgaacggauacuucagauuugauuccuggguaaaccaauucuacgcauuagcaccaaugggaacaggcaacggacgacguagagcacaauaa

SEQ ID NO: 33410 - RNA, 1623 nt, Artificial Sequence
  derived and/or modified sequence opt6 from VP1__Norovirus_and/or_Norovirus-like__KR921940
augaaaauggccucaaacgacgcagcuccaucaaaugauggcgcagcuggccugguuccagaaaucaacacugaaacacuaccauuagaaccaguagccggugcagcaauagccgcaccugucacaggacaaaacaauauaauagaucccuggauaagaaacaacuucguccaagcaccaaacggcgaauuuacaguaucaccaagaaacucacccggcgaaauacuaaugaauuuagaauuaggacccgaccuaaacccauaucuagcacaccuaucaagaauguacaacggauaugcgggaggcgucgaaguacaaguccuuuuagcaggaaaugcauucacagcaggaaaaauacuauuugccgccguaccaccaaauuuccccguagacaugcucucaccagcccaaaucaccaugcuaccacacuuaauagucgacguaagaacacuagaaccaauaaugauaccucuaccagauguaagaaacguauuuuaucauuucaacaaucaaccagcgcccagaaugagauuaguagcuaugcuauacacaccauuaagaucaaacggaucuggagacgacguauucacagucuccuguagaguacuuacaagaccaaccccagauuucgaauuuacauaccucguuccacccucagucgaauccaaaacaaaacccuuuacacuaccaauauuaacaauaggagaacuaacaaauuccagguucccagcacccauagaucaauuauauacaucuccaaacgcugacguaguaguacaaccacaaaacggaagauguacauuagacggcgaauuacaaggaacuacccaauuauuaacaaccgcaaucugcuccuaccgcggaacaacauccaaucccacuucagacuacugggacgaccaucuacuacauuuaguucauccaaauggugcaacauaugacccaaccgaagacguaccagcacccuuuggcacacaagacuuccguggaauuuuauacggcguacuaacacaaaauacacaaaaccccagagacgaaguauccaacucaagagguaucuauauaucaucaaccucugauaaauuuacaccaaaacucggaacaauuggacuacaucaaguucaaggagauacagcaucaaaucaacaaucaaaauuuacuccaguagggauagcaguaaaucaaaauacaccauuuaaacagugggaauuaccaaauuacucaggagcauuaacauuaaauacaaaccuagcacccgcaguaggucccaauuuucccggagaacaaauacuauuuuucagauccaacgucccaucaguacaaggaaaccacccaacucaagaaauagauugccuaauaccacaagaauggguaucucacuucuaccaagaaagugcucccucacaaucagacguagcacucguacgauacguaaacccagauacuggaagaacaacauuugaagcaaaacuccaucgucaaggauuuauuacaauagccgcaaccggaucuaauccaguaguagucccaccaaacggauacuuccgauuugacaguuggguaaaccaauuuuacgcuuuagcaccaaugggaacaggcaauggaagaagacgagcucaauaa

SEQ ID NO: 33411 - RNA, 1623 nt, Artificial Sequence
  derived and/or modified sequence opt6 from VP1__Norovirus_and/or_Norovirus-like__DQ358209
augaaaauggcauccaaugacgcagcacccagcaacgacggcgcagcaggacuuguccccgaaauuaauaaugaaguaaugccauuagaaccuguagcuggugcaucacuagcaacaccaguaguaggacaacaaaauauaauugaucccuggauaagaaacaauuuuguacaagcuccugcaggagaauuuacaguaaguccaagaaauucaccaggagaaauacuguuagaccuagaacuaggaccugaacuaaaucccuauuuagcacaccuugcaagaauguacaauggacaugcuggaggaauggaaguccaaauuguacuagcaggaaacgcauuuacagcaggaaaaauaguauucgccgcaauuccaccuggauuuccuuaugaaaaccuaucaccaucacaaauaacaaugugcccacacguaaucauagacguaagacaacucgaaccaguacuacuacuaaugccagauaucaaaaacaauuucuuucacuacaaucaaggaaaugacccaaaauuaagguuaguagcgaugcucuacacaccauuaagggcuaacaauucaggagaugacguauuuacuguaucauguagaguccuaacaaaaccaaguccagacuuugaauuuacauuuuuaguaccaccaaccguugaaucaaaaacaaaacaauucacacuaccuauauuaaaaauaagcgaaaugacgaacucaagauuuccuguaccaguagaaaugauguauacagcuagaaacgaaaaucaaguuguucaaccacaaaacggucgaguaacacuagacggagaauuauuaggaaccacuccauuacuagcaguuaauauauguaaauuuaaaggagaaguaauagcuaaaaauggagacguaagauccuauagaauggacauggaaauuacaaauacagauggaacacccauagacccuacagaagacacaccaggaccaauuggauccccagauuuucaaggaauauuauuuggcguagcaucacaacgaaacaaaaacgaacaaaauccagccacaagagcucaagaaguaaacauaaauacagguggagaccaauaugcuccaaaacuugcccaaguuaaauucuuuucagaaucucaagauuuugaaguacaucaaccaacugucuucacaccaguaggaguagcaggagacccaagccaucccuuucgucaauggacccucccacgauaugguggacaccuaacuaauaauauacauuuagccccugcaguugccccacuauuuccaggugaacaaauacuauuuuucagaucacaaauaccaucaucaggcggacaugaauuaggauauauggacugccuaguaccacaagaguggguacaacauuucuaucaagaagcugcuacagcucaaagugaaguugcuuuaauaagauucauuaacccagacacaggcagaguauuauucgaagcuaaauugcauaaacaaggauuuauaacuguagcacauacaggagauaacccaauaguaaugccaccaaacggauacuucagauucgaagccuggguaaaccaauuuuauucacuagcaccaguuggaacaggaaauggcagacgaagaguccaauaa

SEQ ID NO: 33412 - RNA, 1623 nt, Artificial Sequence
  derived and/or modified sequence opt6 from VP1__Norovirus_and/or_Norovirus-like__KP784694
augaaaauggcaaguucagacgcaaacccaucagauggaagugcagcaaaucuugucccagaagugaauaacgaaguuauggcacuugaaccuguaguaggugcagcaauagccgccccaguagcaggacaacaaaacguaauagauccauggauaagaaauaauuucguacaagcuccagguggagaauuuaccgucucaccuagaaaugcacccggagaaauacuauggucagcuccauuagguccagaucuaaauccauaucuaucacauuuagccagaauguauaacggauaugcuggaggcuucgaaguucaaguaauacuagcagguaacgcauuuacagcuggaaaaauaaucuuugcagcugaucccccaaauuuuccaacugaagguuuaucacccucacaaguuaccauguucccccacauaauugucgacguuagacaacuagaaccaguacuaauuccucuccccgacgucagaaauaacuucuaucacuauaaucaaucaaaugauccaacaauaaaauuaaucgcaauguuauauacuccacuaagagcaaacaaugcaggagaugauguauuuacaguaucauguagaguacuaacuagaccaucaccagauuuugauuuuauauuccuaguacccccaaccgucgaaucuagaaccaaaccauucucaguaccaaucuuaaccguugaagaaaugacuaacuccagauuuccaauucccuuagaaaaacuuuuuacaggacccucaucugcauucguaguucaaccccaaaaugguagaugcaccacagacggcguauuacuaggcacaacccaauuaagucccguuaacauaugcaccuuuagaggagauguaacacacauagcagguagucacaauuacacaaugaauuuagcaacucaaaacuggaacuccuaugacccuaccgaagaaauacccgcaccucuagguacuccagacuucguaggaaaaauacaagguguauuaacccaaaccacaaaaacugacggaucaacacgcucacacaaagcaacaguauauaccggaagugcugacuuugcuccuaaacuaggaagaguacaauuugaaacagacaccaauaaugauuucgaaacaaaucaaaacacaaaauucaccccaguuggaguaauacaaaacggcgaaacugcacaccgaaaugaaccccaacaauggguuuuaccaucuuauuccggacgaaacacacccaacguccaucuugccccugcaguugcaccuacuuuucccggcgaacaauuauuauucuuuagaucaacaaugccagguugcucaggauacccaaauauggaucucgacuguuuauuaccucaagaauggguacaauacuuuuaucaagaagcagcuccagcccaauccgauguagcuuuauuaagauuuguuaacccagauacagguagaguccuauuugaauguaaacuucauaaaucaggauacguaacaguugcacacaccggaagucacgaccucguaauuccaccuaauggauacuucagauucgauucauggguaaaccaauuuuacacacuagcaccaaugggaaauggaaccggacgacgcagagccacuuaa

SEQ ID NO: 33413 - RNA, 1623 nt, Artificial Sequence
  derived and/or modified sequence opt6 from VP1__Norovirus_and/or_Norovirus-like__KX354064
augaaaauggcuucaucugaugcaaaucccucugauggaucagcagccaaucuaguaccagaaguaaacaaugaaguaauggcacuagaaccaguaguaggagcugcaauagcagcaccaguagccggucaacaaaauguaaucgacccuuggauaagaaauaacuuuguacaagcaccaggaggagaauuuacagucucaccaagaaacgccccaggagaaauauuauggucugcaccuuuaggaccugaucucaauccauaucuaucacauuuagcacgaauguauaauggauaugccgguggauucgaaguacaaguuauauuagcuggaaaugccuuuacagcaggaaaaguaauauuugcugcaguuccaccaaauuuuccuacugaaggacucucaccaucacaaguaacuauguucccacauauaguuguagacgucagacaacuugaaccaguacuaauuccacuaccagauguucgaaacaauuuuuaucauuauaaccaaucaaaugacccuacuauuaaacuaauagcaaugcuauacaccccacucagagcaaacaaugcaggagacgauguauuuaccguaucauguagaguucuaacaagaccaaguccagacuuugacuuuauauuucuaguuccaccuacuguagagagcagaacuaaaccauuuucagucccaguucuuacaguugaagaaaugacaaauucacgauuuccaauaccacuugaaaaauuauucacaggacccuccucagcauucguaguacaaccacaaaacggaagauguacaacagacggaguauuacuuggaacaacacaacuaucaccaguaaauauauguacuuuuagaggagacguaacacacauaacugguucuagaaauuauacuaugaauuuagcaucccagaacuggaacaacuaugauccaacagaagaaauuccagcaccauuagguacacccgauuucguaggaaaaauccaaggaguauuaacacaaacaacaagaaccgauggaagcacaagaggacauaaagcaacaguauauaccggaucagcugauuuugcaccaaaacuuggcagaguacaauuugaaacugacacagaccacgauuucgaagcaaaucaaaauacuaaauucacuccuguuggaguuauucaagacggcaguacaacacaucguaaugaaccacaacaauggguauuaccaucauauucaggaagaaauacucauaacguacaucuagccccugcaguugcaccaacauuuccaggagaacaauuacuauucuucagaucaacaaugccuggaugcuccggauacccuaauauggacuuagacuguuuacuuccucaagaauggguacaauacuucuaccaagaagcagcuccagcccaaucagacgucgccuuauuaagauuuguaaauccagauaccggaaggguacuuuuugaauguaaacuacacaaauccggauacguaacaguagcccauacuggacaacacgauuuaguaauaccaccaaauggauacuuucgauuugauagcuggguaaaucaauuuuacacauuagcuccaauggggaacggaaccgguagacgacgugcuauguaa

SEQ ID NO: 33414 - RNA, 1623 nt, Artificial Sequence
  derived and/or modified sequence opt6 from VP1__Norovirus_and/or_Norovirus-like__LC177658
augaaaauggcaucaagugacgcaaacccaucagaugguuccgcagcaaaccuuguaccagagguaaacaaugaagucauggcacuagaaccaguaguaggagcagcuaucgcagcaccaguagcaggucaacaaaauguaauugacccauggauacgaaauaacuuuguacaagcuccaggaggagaauuuacagucucaccaagaaaugcaccuggagaaauauuauggagugcaccuuuaggaccagaucuaaauccauacuuaucucaccuugcaagaauguauaacggauaugcagggggcuuugaaguacaaguuauauuagcuggcaaugcuuuuacagccggaaaaguaauauuugcagcaguaccaccaaacuuuccaacagaagguuuaucaccaucacaagucacaauguuuccacacauaguuguagauguacgucaauuagaaccaguacucauuccauuaccagaugucagaaauaauuuuuaccauuacaaucaauccaacgauccuacaauaaaacuaauagcuaugcuuuauacccccuugagagcuaauaaugcaggagaugauguuuuuacaguaucuugcagaguacuaacaaggccauccccagauuuugacuuuauauuuuuagucccaccaacaguagaaucuagaacuaaaccauuuuccguaccaguucucacaguagaagaaaugacuaacucaagauuuccaauaccccuggaaaaacuuuucacagguccaucaucagcauucguaguacaaccacaaaauggacgauguacaacagauggaguauuauuaggcacaacacaauuaucaccaguaaauaucugcacauuucgcggcgacguuacccauauaacaggaagccgaaauuauacaaugaauuuagcuucacaaaauuggaauaauuacgacccgacagaagaaauaccagcaccuuuaggagccccagacuuugucggcaaaauucaaggaaugcucacacaaaccacuagagccgacggaucuacaagaggccacaaagcaacaguauauacaggcucagcagauuucgcaccaaaauuaggaagaguacaauucgaaacagacacagaucacgauuuugaagcaaaucaaaauacaaaauucaccccuguaggaguaauacaagauggaggaacaacacauagaaacgaaccacaacaauggguccuaccaucauacagcggaagaaauacacauaacguacaucuugcaccagccguagccccaacauuuccaggcgaacaacuucuauucuuuaggucaacaaugccaggcugcucaggauauccaaauauggauuuagacugccuacuuccacaagaauggguccaauauuuuuaucaagaagcagcaccagcacaaucugauguagcacuacuaagauucguaaacccagacacaggaagaguucuauuugaaugcaaacuacauaaaucuggauauguaacugucgcccauacaggacaacacgauuuaguuauaccaccuaauggcuacuucagauuugacaguuggguaaaucaauuuuacacacuugcaccaaugggaaauggagcaggacgaagaagaguagcuuaa

SEQ ID NO: 33415 - RNA, 1623 nt, Artificial Sequence
  derived and/or modified sequence opt6 from VP1__Norovirus_and/or_Norovirus-like__KX514232
augaaaauggcaucuaaugaugcaaacccuagugauggaucagcagcuaaccucgucccagaaguaaauaaugaagucauggcacuagaacccguagucggugccgcaauugcagcaccuguagcaggacaacaaaauguaauagauccauggauaagaaauaacuuuguucaagcaccagguggagaauuuacaguaucaccuagaaacgccccaggagaaauuuuguggagugcaccauuaggaccagaccuaaacccauaccuaucccauuuagcuagaauguauaacgguuaugccgguggauuugaaguacaaguaauucuagcaggaaacgcauuuacagcaggaaaaauaauauuugcagcaguaccaccaaauuuucccacugaaggacuaucaccaucccaagucacaauguucccacauauaauaguugauguaagacaacuugaaccaguauuaauaccacuaccagacguaagaaauaauuuuuaucauuauaaucaaucaaacgacucaacuauuaaauuaaucgcgaugcuauauacuccccuaagagcuaauaaugccggugaugaugucuuuacaguaucaugucgagucuuaacucgaccaucaccagacuuugauuucauauucuuaguuccaccaaccguagaaucuagguccaaaccauucucuguaccuguacuuaccguugaagaaaugacuaauuccagauucccugcaacauuagacaaacuauucacagguccuucaucaacauucguaguccagccccaaaacgguagaugcaugauugauggaguuuuacucggaacaacacaauuaucaccaguuaacaucuguacauuuagaggagauguaacacauccuagagauucaccaaucuauacaaugaaccuagcaucgccaaacuggaauaauuaugauccaacagaagaaauacccgcaccacuaggaacacccgauuuuguugguaagauacaaggcaugcuaacacaaaccaccaaaggagaaggauccacgagaggacacagagcaaccguuuacguaggaucagcaaacuaugcaccaaaauuaggaagaguucaauucgaaacagauacaacaaaugaucuagaugcacaucaaaauacaaaauuuacuccuguagguguaguacaaggaggagaauccccacaacgauccgaaccacaacaauggguauuaccuucauacucaggucgagacacgccuaauguccaucuagcuccugcaguagcaccaacauuuccaggagaacaacuucuauucuuucgaucuacaauaccuggaugcggaggacauccaaacaugaacuuagacuguuuauuaccccaagaauggguacaacauuuuuaucaagaagcagccccagcacaaucagauguagccuuacuaagauucguaaauccagauacaucaagaguauuauucgaauguaaauuacauaaaucaggauauguaacaguagcacauacuggccaacacgaucuaguaauaccuccaaauggauauuuucgauucgacucauggguuaaccaauuuuauacauuagcaccuaugggaaauggcacuggaagaaaaagagccucauaa

SEQ ID NO: 33416 - RNA, 1623 nt, Artificial Sequence
  derived and/or modified sequence opt6 from VP1__Norovirus_and/or_Norovirus-like__LC145787
augaaaauggcuucuaacgaugcagcuccuagcacagacggagcagcaggucuaguaccagaaucuaauaaugaaguaauggcauuagaaccaguugcaggagcagcucuagcagcuccaguaacaggacaaacaaauauaauagauccauggauaagagcuaauuucguacaagcaccaaacggagaauuuacaguaucaccaagaaaugccccaggugaaguacuccuaagucuagaacuaggaccagaauuaaauccuuacuuagcucaucuagcacguauguacaaugguuaugcuggaggaauggaaguucaagucaugcuugcagguaaugcauuuacagcaggaaaacuuguguuugcugcagucccuccccauuuucccguagagaauuuauccccacaacaaauaaccauguucccucacgucauaauagauguuagaacuuuagaaccaguauuauuaccacuaccagauguacgaaauaacuucuuucauuauaaucaaaaagacgacccaaaaaugagaauuguagcuaugcuuuacacaccauuacgaucaaauggaucaggagaugauguauucacaguuucaugucgaguuuuaacuagaccaagcccagacuucgacuuuaccuauuuaguuccaccaacaguagaaucuaaaacaaaaccauuuacauuaccaaucuuaacauuaggagaacucucuaacucacgauucccuguaucaauagaucaaauguauacaucuccaaacgaagucauaucaguucaaugucaaaauggucgaugcacuuuagauggugaacuucaaggaacuacacaauuacagguaucaggaaucugugcauuuaaaggagaaguaacagcucauuuacacgauaacgaccaucuauacaacguaacuaucacaaaucuuaacggaucacccuuugaucccucagaagauguaccagcaccccucgguguuccagauuuccaaggaagaguauucggcauaauaucacaaagggauaaacauaauucaccaggacauaaugaaccagccaauagaggucacgaugcaguuguuccaacuuauacagcccaauauacaccaaaacuuggacaaauccaaaucggaacauggcaaacagacgauuuaacuguaaaccaaccaguuaaauuuacaccaguaggauuaaacgauacugaacacuuuaaucaauggguuguacccagauaugcaggagcuuuaaauuuaaauacaaauuuagcuccaucaguugcaccagucuuuccaggagaacgacuauuauucuuuagaucauauguaccacuaaaaggaggauauggaaauccagccauagauugucucuuaccacaagaauggguacaacauuuuuaucaagaagccgcccccucaaugucugaaguagcccuaguaagauacauaaacccagacacaggcagagcucuauuugaagcaaaacuucauagagcuggauucaugacaguuucaucuaauacaucagcaccaguuguaguaccugcaaauggauacuuuagauuugauuccuggguaaaccaauuuuauucccuagcaccuauggguacaggcaauggaagaagacgauaa

SEQ ID NO: 33417 - RNA, 1623 nt, Artificial Sequence
  derived and/or modified sequence opt6 from VP1__Norovirus_and/or_Norovirus-like__KT962983
augaaaauggcaucaaaugacgcagcuccaucaacagacggagcagcaggauuagucccagaaaguaauacggaaguaauggcacuagaaccaguugcuggugcugcauuagcugcaccuguaaccggucaaacaaauauaauugacccuuggauuagagccaauuuuguucaagccccuaauggagaauuuacaguaucaccaagaaacgcaccaggcgaaguuuuacuaaaucuagaacuuggaccagaauuaaaccccuaucucgcucauuuagcaagaauguacaacgguuaugcaggaggaauggaaguacaaguaauguuagcaggaaacgcauucacagccggaaagcuaguauuugccgcaguaccuccccauuuuccaguagaaaaucuaucuccucaacaaauaacaauguucccacacguaauuauagauguaagaacacuagaaccaguacuuuuaccauuaccagauguacgaaauaauuucuuucacuauaaucaaaaagacgacccuaaaaugcgaauaguagcaauguuauauacaccauuaagauccaauggaucaggagaugauguauuuacaguuuccuguagaguacuuacaagacccucaccugacuuugacuuuacauacuuaguacccccuacaguugaaucuaaaacuaaaccauuuacacucccuauacuuacacuuggagaauuaucaaauucuagauucccuguauccauagaucaaauguauacuucacccaacgaagucauuucaguacaaugccaaaauggaagaugcacauuagauggugaauuacaagguacaacacaacuacaaguauccggcauaugugcauuuaaaggagaaguaacagcucaccuacaugauaaugaccaucuauacaauauaacaauaacaaauuuaaauggaucaccauucgacccuucagaagauauuccagcuccucucgguguaccagacuuucaaggaagaguauuuggcauaauaucucaaagagauaaacacaauucaccaggacauaaugaaccagcaaauagaggucacgacgcaguaguuccuacuuauacagcucaauauacaccaaaacucggacaaauucaaaucggaacauggcaaacugaugaucucacuguuaaucaacccguuaaauuuacaccaguuggauuaaaugacaccgaacacuucaaucaaugggucguaccuagauaugcaggagcacuuaacuuaaauacaaacuuagcacccucaguagcaccuguuuuuccaggcgaaagacuauuauucuuuagaaguuauaucccacuuaaaggcggauauggaaaucccgcaaucgacuguuuacugccccaagaauggguucaacauuuuuaucaagaagcagcuccaucaaugucagaaguagcuuuaguacgauauauaaauccagauacaggacgagcauuauucgaagcaaaauuacaucgagcaggauuuaugacuguaucaucuaauacaagugcaccuguaguuguuccagcuaacggauauuuccgauuugauucauggguuaaccaauuuuauucauuagcaccaauggguacuggaaauggucgcagacguuaa

SEQ ID NO: 33418 - RNA, 1623 nt, Artificial Sequence
  derived and/or modified sequence opt6 from VP1__Norovirus_and/or_Norovirus-like__AB629946
augaaaauggcaagcaaugacgcugcaccuucuacugacggagcagccggacuuguaccagaaucaaauaaugaaguaauggcucucgaaccaguugcuggagcagcacucgcugcuccaguaacaggacaaacaaauauaauagacccauggauaagagcaaacuuuguacaagcaccaaacggagaauuuacaguuucaccucgaaacgcaccaggagaaguauuauuaucccuagaacuaggaccagaauuaaauccauaccuagcacauuuagccagaauguauaacggauacgcaggagguauggaaguacagguaauguuagcuggaaaugcauucacugcaggaaaauuaguauucgccgcaguaccaccccacuucccaguagaaaaucuuucaccccaacaaauaacaauguucccacaugucauaauagauguacgaacacuagaaccuguauuauuaccacuacccgauguaagaaacaauuucuuucacuauaaccaaaaagaugaucccaaaaugagaauaguagcaauguuauacacaccauugagaucaaaugguucaggagacgacguauuuacaguaaguugccgaguucucacaagaccaucaccagauuuugacuuuacuuaucucgucccaccaacaguugaaucaaaaacaaaaccauuuacacuaccaauauuaacgcuaggagaauuaucaaauucccgauuuacaguaaguauagaccagauguacaccucacuaaaugaaguaauaucaguacaaugccaaaaugggagaugcacauuagauggagaauuacgaggaacaacccaauuacaagucucaggaauaugcgcauucaaaggagaagucaccgcucacguucacgauaacgaucauuuauacaacguuacuauaaccaauuuaaaugguucaccauuugauccaucagaagacgugcccgccccucucggaguuccagacuuucaaggaagaguauucgguauaauaagccaaagagacaaacauaauucuccaggacauaacgaaccagccaacagaggacacgaugcaguaguaccaacauacacagcacaauauaccccaaaacuaggacaaauacaaauaggaacauggcaaacagaugaccuaacaguaaaucaaccaguaaaauucaccccaguaggauuaaaugacacagaacauuuuaaccaauggguaguaccaagauacgcgggagcauuaaacuuaaacacaaacuuagcacccucaguagcaccaguuuuucccggagaaagacuauuauucuucagaucauacguuccacuaaaaggaggauauggaaauccagccauagacugccuauuaccacaagaauggguucaacauuucuaucaagaagcugcaccaucaaugucagaaguagcauuaguaagauacauaaacccugacacaggacgagcauuauuugaagcaaaacuucacagagcagguuuuaugacaguaucaaguaauacaucagccccaguaguuguaccagccaacggauacuucagauuugacuccuggguaaaucaauuuuacucucucgcaccaauggguacuggaaauggacgacgaagauaa

SEQ ID NO: 33419 - RNA, 1623 nt, Artificial Sequence
  derived and/or modified sequence opt6 from VP1__Norovirus_and/or_Norovirus-like__AB809993
augaaaauggcaucaaaugaugcugcaccaucaaacgacggagcagccucucuaguaccagaagcaauaaaugaaacaaugccuuuagaaccaguugcuggagcaucaauagcagcaccaguagccggacaaacuaacauuauugacccauggauacguacaaauuuuguacaagcuccaaacggagaauuuacaguaucaccuagaaacucacccggcgaaauacuauuaaaucuagaacuaggaccugacuuaaacccauaucuagcccauuuaucacgaauguacaacggcuacgccgguggcguagaaguacaaguacuccucgcaggcaacgcuuucacagcaggaaaaauacuauuugcugcuaucccaccuaauuucccaguagauaugauaaguccagcacaaauaacaauguuaccucauuuaauagucgaugucagaacuuuagaacccauaaugauaccucucccagacgucagaaauguauucuaucacuucaacaaccaaccacaaccaagaaugagauuaguagcaaugcuuuauacuccacuaagaucaaacgguucuggagacgauguauuuacuguauccugcagaguccuaacaagacccacuccugauuucgaauuuauauauuuaguaccacccucaguagaaucaaaaacaaaaccauucacacuaccaauauuaacaauaucugaacuuacaaacucacgauucccaauacccauagaacaacuuuacacagcuccaaacgaaaauaacgucguacaaugccaaaacgguagauguacacuagauggagaauuacaaggaaccacacaacuacuaaguucagcaguauguucauacagaggcagaacaguagcgaacuccggagauaauugggaccaaaaucuauuacaauuaacauaucccucuggagcaucauaugacccaacagaugaaguccccgcaccacuaggaacucaagacuuuucuggaauauuauaugguguacuaacacaagauaacguuucugaaggaacuggagaagcuaaaaaugccaaaggaguauauaucuccacaacaucaggcaaauucaccccaaaaaucggaucuauuggacuacacucaauaacagaaaauguccauccaaaucaacaauccagauucaccccaguuggcgucgcacaaaaugaaaacacaccauuucaacaauggguuuuaccacauuaugcuggagcucuagcauuaaauacuaauuuagccccugcuguugcaccuaccuuuccaggagaacaauuacuauuuuucagaucaagaguaccaugcguacaaggauuaagaggacaagacgcauucauagacugcuuacuaccacaagaauggguaaaucauuuuuaucaagaagcagcaccaucucaagcagacguugcauuaauucgcuacguuaacccagauacaggaagaacccuauucgaagcuaaacuacacagauccggcuucaucacagucagucacacaggagcauauccucuaguaguaccaccaaacggucacuuccguuucgauuccuggguaaaucaauuuuacucacuagcaccaaugggaacaggcaacggaagacgaagauaa

SEQ ID NO: 33420 - RNA, 1623 nt, Artificial Sequence
  derived and/or modified sequence opt6 from VP1__Norovirus_and/or_Norovirus-like__JQ743330
augaugauggcauccaaagaugcuccuccaaauauggauggaaccucaggagcaggacaauuaguaccagaagcaaauacagcagaaccaauauccauggaaccaguugcuggagcagcaacagcagccgccacggcaggacaaguaaacaugauagauccuuggauaaugaauaacuauguacaagcaccacaaggagaauucaccauuagcccaaauaacacaccaggagauauauuauuugaccuacaauuagguccacauuuaaacccauuuuuaucucauuuagcacaaauguauaauggauggguuggaaauaugaaaguaaaaguacuuuuagcaggaaaugcauuuacagcaggaaaaauaauaauaucauguauaccaccaggauucgcagcucaaaauauauccaucgcccaagcaaccauguuuccacauguaauugcagauguaagaguucuagaaccaauagaaguaccauuagaagauguacguaacguacuauuucacaacaacgacaacacaccaacaaugcgacuaguauguaugcuauacacaccccuaagagcauccggcucaucauccggcacagacccauuuguaauagcaggaagaguucuaacauguccuucacccgauuuuaguuuuuuauuuuugguacccccaaacguagaacaaaaaacaaaacccuucucaguaccaaaccuaccacugaauacacuaucaaauucaagagucccuucauuaauacgcucaaugaugguaucaagagaccacggacaaaugguccaauuucaaaauggaagaguaacuuuagauggacaauuacaaggaacaaccccaacauccgcaucacaacuauguaaaauaagaggauccguauuucaugcaaaugguggaaauggauauaacuuaacagaacuagacgguagcccauaccacgccuucgaaucuccagcuccuauaggcuucccugauuuaggugaaugugauuggcacauggaagcaucuccaaccacacaauucgacacaggagauguaauaaaacaaauaaauguuaaacaagaagcugcauuugcaccucaucucggaacuauucaagcagauggacuuucagaugugucagucaacacaaauaugauagcaaaauuaggauggguaucaccaguaucugacggccauagaggaucaguagacccauggguaauaccaagauauggaucuacacuaacagaagcagcacaauuagcacccccaauauacccaccaggauuuggagaagcaauagucuuuuuuauguccgauuuuccuaucgcucauggcgcaaacggauuauccguuccgugcacaauaccucaagaauuuguaacacacuucguaaaugaacaagcuccaacaagaggcgaagcugcucuacuacauuauuuggauccugauacucauagaaaucuaggagaauuuaaauuauauccagaagguuucaugacaugugucccaaacucaucaggaacaggaccacaaacacuaccaauaaauggaguauuugcauuuguaucuuggguuagcagauucuaucaacuaaaaccaguaggcacugcaggacccgcacgcagauuauaa

SEQ ID NO: 33421 - RNA, 1623 nt, Artificial Sequence
  derived and/or modified sequence opt6 from VP1__Norovirus_and/or_Norovirus-like__AF439267
augaugauggcaucaaaagacgcuccaacuaauauggauggaacaaguggagccggacaacuuguaccagaagcaaauacagcggaacccauaucaauggaaccuguagcaggagcugcaaccgcagcagcaacagcaggucaaguaaauaugauugacccauggauaaugaauaauuauguacaagcaccacaaggugaauuuacaauaucacccaauaacacaccaggagauauacuauuugauuuacaauuaggaccacaucuaaaucccuuuuuaucacauuuagcccaaauguauaauggaugggucgguaauaugaaaguaaaaguguuauuagcaggaaaugcauucacagcaggaaaaauaauuauaaguuguauaccaccagguuucgcagcucaaaacauaaguauagcacaagcuacaauguucccccauguaauagccgauguaagaguucuagaaccaaucgaagucccauuagaagacguaagaaacguacuuuuucauaauaaugacaauacaccuacuaugcgucuaguauguaugcuuuauacaccccuacgagcuucaggaucaucaucaggaacagauccuuuuguaauugcaggaagaguauuaacauguccaucaccagacuucucuuuccuuuuucuaguaccuccgaauguagaacagaaaacaaaaccuuuuucuguuccaaauuuaccgcuuaacacacuaagcaauucaagaguaccuucauuaauaaaaucaaugaugguaagucgugaccauggacaaaugguacaauuucaaaauggaagaguaacauuagauggccaauuacaagguacaacaccaaccucagccucccaauuaugcaaaauaagaggaagcguauuccaugcaaacggaggcaaugguuauaaucuuacagaauuagacggcagccccuaucaugcuuuugaaucaccagcucccguagguuucccagaucuuggugaaugugacuggcauauggaagccucucccacaacccaauuuaauacaggcgacguuauaaaacaaauaaauguaaaacaagaaucagcauuugcaccacacuuagguacuauacaagcagauggauuaucugacguauccguaaauacaaacaugauugcgaaauugggaugggucucaccaguauccgacggucauaaaggagacguagauccaugggucauaccacguuauggaucaacucuaacagaagcugcacaacuagcaccuccaauauaucccccaggauucggagaagccaucguauucuuuaugagcgauuuuccaauagcacacgguacaaauggacuaucuguaccauguacaauaccacaagaauuuguaacccauuuuguaaaugaacaagcaccaacaagaggagaagcagcacuacuucauuacuuagacccugauacacauagaaacuuaggugaauuuaaauuauauccagauggauucaugacuugcguuccaaacucaucaggaacaggaccccaaacacuaccaauaaacggcguauuuguauuugucucauggguuucacgauuuuaucaacuaaaaccaguagguacugcaggaccagcucgaagacuauaa

SEQ ID NO: 33422 - RNA, 1623 nt, Artificial Sequence
  derived and/or modified sequence opt6 from VP1__Norovirus_and/or_Norovirus-like__EF547393
augaugauggcaucuaaaggagcaccaacuaauauggacggcacuucaggcgcuggacaauuaguuccagaagcaaacacagcugaaccuauaucaauggaaccaguagcaggagcagcaacagcagcagccaccgcuggacaaguaaauaugaucgauccuuggauaaugaauaacuacguacaagcaccacaaggugaauuuaccauuucuccaaauaacacuccaggagauauucuauucgacuuacaauuaggaccacacuuaaauccauuccuaucacacuuagcacaaauguauaacgguuggguuggaaauaugaaagucaaaguacuccuagcuggcaaugccuucacagcaggcaaaauaauaauaucaugcauaccaccuggauucguagcacaaaauauauccauagcacaagcaacuauguucccacauguaauagcagacguaagaguauuagaaccuauugaaguaccccuagaagauguaagaaacguucucuuucacaauaacgauaauacaccaacaaugcgauuaguauguaugcuuuauacaccacuaagagcuuccggaucaagcuccggaaccgacccauucguuauagcuggacgaguauuaacuugcccaucaccugauuuuuccuuuuuauuucuuguaccaccaaaugucgaacagaaaacaaaaccauuuucagucccaaauuuaccauuaaacacuuuaucaaauucaagaguacccucauuaauaaaaucaaugauggucucuagagaccauggacaaaugguucaauuccaaaacggaagaguaacuuuagauggacaauuacaaggaacaacuccgacuucagcaucccaacuuugcaaaauacguggaucaguauuucacgcaaaugguggaaauggauauaacuuaacagaacuagauggaucacccuaccaugcuuuugaaucuccugccccaauaggauuuccagauuuaggcgaaugcgacuggcauauggaagcaaguccaacaacacaauucaacacaggagacguaauaaaacaaaucaacguaaaacaagaauccgccuuugccccacacuuaggaacaauacaagcagauggacuauccgauguaucuguaaauacaaauaugauagccaaacucgaauggguaucuccaguaucugacggucacaaaggagacgucgacccauggguaauaccacguuauggaucaacacuaacugaagcagcacaacucgcaccuccaauauauccacccggauuuggcgaagccaucguauucuucaugucagacuucccaauagcccacggaacuaauggauuaucaguaccauguacaauaccacaagaauuugucacacauuuuguaaaugaacaagcuccaacuagaggcgaagcagccuuauuacacuauuuagauccagauacacacagaaacuuaggugaauuuaaauuauacccugacggauuuaugacauguguaccaaacucuucaggaacaggcccacaaacauuaccuauuaauggaguauuuguauucguaucauggguauccagauucuaccaauuaaaaccaguagguacagcagguccugcucgaagauuauaa

SEQ ID NO: 33423 - RNA, 1623 nt, Artificial Sequence
  derived and/or modified sequence opt6 from VP1__Norovirus_and/or_Norovirus-like__AF145709
augaugauggccucaaaagacgcaccaccaaauauggauggaacuucaggagcaggacaauuaaucccagaagcaaauacagcugaaccaauaaguauggaaccaguagcaggugcagcaacagcagccgcaacagcuggacaaguuaacaugauagauccauggauaaugaacaauuauguucaagcaccccaaggagaauuuacaauaucaccuaauaauacaccaggugacauuuuauuugacuuacaauuagguccacaccuuaauccauuuuuaagucaucuugcacaaauguacaacggauggguaggaaacaugaaaaugaaaguauuacuugcaggaaaugcauuuacagcagguaaaauaauaauaucauguauacccccagguuucgccgcacaaaauauaucaauugcucaagcaacuauguucccucauguuauagcagauguaagaguuuuagaaccaauugaaguacccuuagaggauguaagaaacguacuauuccauaauaacgauaacacaccaacaaugagacuagucuguaugcuauauacaccacuuagagcuucaggaaguucaagcgguacagauccauuuguaauugcuggccguguauuaacauguccaucacccgauuuuucauuccuuuuuuuaguaccaccaaacguugaacaaaaaacaaaaccauucuccguaccaaauuuaccacuaaauacacuaucaaauucucgcguacccaguuuaauaaaaucuaugaugguaucuagagaccacggacaaaugguacaauuucaaaauggaagaguaacuuuagauggacaauuacaaggaacuacaccuacaucagcaucccaacuauguaaaauaagaggaucaguauuucaugccaauggagguaauggguauaacuuaacagcauuagauggaucaccauaucaugcauuugaaucaccagcuccaauaggauuuccagauuuaggagaaugugacuggcacauggaagcuuccccuacaacacaauucgauacaggagacguaaucaaacaaauuaauguaaaacaagaaucagcauuugcaccucauuuaggcacuauacaagcugacggacuuucagauguaucaguaaauacaaauaugauugcaaaauuaggauggguauccccagucucagauggucaucgagguaacguagauccuuggguaauuccaagauauggaaguacauuaacugaagcagcacaauuagcuccaccuauuuauccaccaggauuuggagaagcaauaguauucuuuaugucagacuucucaauugcacacggaacaaacggacuaucaguaccauguacaauuccacaagaauuugucacacauuuuguaaacgaacaagcacccacaagaggagaagccgcacuacuacauuauuuagacccagauacacacagaaaucuaggagaauucaaacuuuacccagaaggauuuaugaccugcguaccuaauucaucugguacaggcccucaaacuuuaccaauaaauggaguauucguauuuguaucaugggucucuagauuuuaucaauuaaaaccagucgguacagcaggaccugcacgaagacuuuaa

SEQ ID NO: 33424 - RNA, 1623 nt, Artificial Sequence
  derived and/or modified sequence opt6 from VP1__Norovirus_and/or_Norovirus-like__FJ711163
augaugauggcuucaaaagacgccccuacaaauauggacggaacauccggagcaggacaauuaguuccagaagcaaacacagcagaaccaauuucaauggaacccguagcaggggcagcaaccgcagcugcaacagcaggucaaguaaauaugauugacccguggauuaugaauaauuauguacaagcaccacaaggugaauuuacaauaucaccaaacaauacaccaggcgacguauuauuugauuuacaauuaggaccacauuuaaauccauuuuuaucucaucuagcgcaaauguacaacgguuggguaggaaacaugaaaguaaaaguauuacuugcaggaaaugcauuuacagccggaaaaauaauaauaaguuguauaccuccaggauuugcugcucaaaauuuuucaauagcacaagcaacaauguuuccacauguaauagcagauguaagagucuuagaaccaauagaaguaccauuagaagauguacgaaauguauuauuucacaauaaugacaauacaccaacuaugcgauuagucugcaugcuauacacaccucuaagagccaguggauccucaucaggaacagaccccuucguaauugccggaagagucuuaacauguccaucaccagacuucagcuucuuauucuuaguaccaccuaacguugaacagaaaacuaaacccuucuccguaccaaauuuaccacucaacacauuauccaauucccgaguaccaucacuaauuaaauccaugaugauauccagagaucauggacaaaugguacaauuucaaaacggaagaguaacauuagauggccaauuacaaggaacaaccccaacaucagcaagucaacuaugcaaaauacgaggaucuguauuucacgcuaauggaggcaacggauauaauuugacagaauuagauggcucuccauaccaugcauucgaauccccugcacccauagguuuuccugauuuaggugaaugugauuggcauauggaagcaucaccaauuacacaauuugauaccggagauguaauaaaacaaauuaacguaaaacaagaaucagcauuugcuccacaucuagguacaguacaagcagacggacuaucugacguaucagcaaacacaaauaugauagcaaaauuagguuggguaucaccuguaucagauggacauagaucagacguagauccauggguaauaccuagauauggaucaacauuaacagaagccgcacaacuagccccaccaauauaucccccaggauucggagaagccauaguauuuuucaugucagauuuccccauagcacauggaaccaacggacucucaguaccauguacaauuccacaagaauuuguaacccauuucguaaaugaacaagcaccaacuagaggagaagcagcacuauuacacuauuuagauccagacacucauagaaauuuaggugaauuuaaauuauaucccgacggauucaugacauguguaccaaauucuucaggaaccggaccacaaacuuuaccaauuaauggaguuuucguauucgucucauggguuucacguuuuuaucaauuaaaaccaguuggaacagccggaccugcuagaagacuauaa

SEQ ID NO: 33425 - RNA, 1623 nt, Artificial Sequence
  derived and/or modified sequence opt6 from VP1__Norovirus_and/or_Norovirus-like__FJ711164
augaugauggccuccaaagaugccccaaccaacauggacggaacaaguggagcuggacaauuaguaccagaagcuaauacagcugaaccaauaagcauggaaccaguagcuggugcagccacugcugccgcaacagcaggacaagucaacaugauugauccuuggauaaugaacaauuacguccaagcaccacaaggagaauucaccauuucaccuaauaacacgccaggagacguacucuucgacuuacaauuaggaccacacuuaaauccauuuuuaucccaucuugcacaaauguauaacggauggguaggaaauaugaaaguaaaaguuuuauuagcaggaaaugcuuucacagcagguaaaauaauaauaaguuguauuccaccagguuuuguggcccaaaacuuuucuauagcacaagccaccauguuuccacacguuauagcagauguuagaguacuagaaccaauagaaguacccuuagaagacguuagaaauguauuauuucacaauaacgauaauaccccuacuaugagauuaguauguauguuauauacuccucuaagagcaggaggaaguucaucaggaacugaucccuucgucauagcaggacgaguacuaacaugcccaucacccgacuuuuccuuuuuauuuuuaguaccaccaaauguagaacaaaaaacaaaaccauuuuccguuccaaauuuaccuuuaaauacacucucgaauucuagaguaccuucuuuaauaaaaucuaugaugauaucacgagaucauggacaaaugguacaauuucaaaauggcagaguuacucuagauggacaauuacaaggaacaacaccaacaucagcaucacaauuauguaaaauaagaggcuccguauuucaugcaaauggaggcaacgguuauaaucuaacagaauuagauggauccccauaucaugcauuugaaucaccugccccuauaggcuuuccagauuuaggagaaugcgauuggcauauggaagcaucuccaacaacacaauuugauacuggagacguaauaaaacaaauaaacgugaaacaagaaucugcauuugcaccacaccuaggaacaguucaagcagauggacuaucugauguaucugcaaacacuaacaugauagccaaauuaggauggguuucacccguaucagauggacaucgcucagauguugaccccuggguaauaccaagauauggaucuacacuaacagaagcagcacaacuagcaccaccaauauauccaccaggauucggggaagcuaucguauuuuucaugucagauuuccccauagcacacggaacaaacggacuauccguacccuguacaauaccacaagaauucguaacacauuuuguaaacgaacaagcaccaacaagaggagaagcagcauuacuccacuauuuagauccagauacacauagaaaucuaggagaauucaaacuauaccccgaugguuucaugacauguguaccaaauucuucaggcacaggaccacaaacacuaccaauaaacggaguauuuguauuuguaucauggguuuccagauuuuaucaauuaaaaccugucggaacagcaggaccugcaagaagauuauag

SEQ ID NO: 33426 - RNA, 1623 nt, Artificial Sequence
  derived and/or modified sequence opt6 from VP1__Norovirus_and/or_Norovirus-like__AF414405
augaugauggcaucaaaagaugccccaccaaacauggacggaaccucaggagcaggacaacucguaccagaagcaaauacagcagaaccuauaucaauggaaccaguagcuggagcagcaacagcagccgcaacagcaggacaaguuaacaugauagaucccuggauuaugaauaauuauguccaagcuccacaaggagaauuuaccaucucuccuaauaauaccccaggugauauauuauuugaucuacaauuaggaccucaccuaaacccauuccuaucacaccuagcacaaauguacaaugguuggguuggcaauaugaaagucaaaguauuauuagcaggaaaugcauucacagcuggaaaaauaauaauuucuuguauaccucccggauuugcugcccaaaauauaaguauagcucaagccacaauguucccccaugucauagcugauguuagaguucucgaacccauagaagucccauuagaagacgucagaaauguccuuuuccauaauaaugacaauacaccaacaaugagauuaguaugcaugcuauacacaccucuaagagcaucaggaucuucaucagguacagauccauuuguaauugcaggaagaguacuaacauguccaaguccugacuuuucauuuuuauuuuuagucccccccaauguugaacaaaaaacaaaacccuuuucuguaccaaaucuaccauuaaauacacuaucuaacucacguguaccaaguuuaauaaaaucuaugaugguuucuagagaucauggucaaaugguacaauuccaaaauggacguguaacauuagauggacaauuacaaggaaccacaccuacaucugcaagccaauuauguaaaauaagagguucaguauuucaugcaaauggcggaaauggauauaaccuaacugaacuugauggauccccauaucaugcauuugaauccccagcacccauaggcuucccagauuuaggagaaugugauuggcauauggaagcaucccccacuacacaauucgacacaggagauguaauuaaacaaauaaauguaaaacaagaaagugcauuugcuccucauuuaggaacaauucaagcagguggacucucugacguuagcguuaacaccaauaugauagcaaaacuuggauggguaucaccuguaucagauggacauagaggaaacguagacccauggguaauaccuagauauggaucaacauuaacugaagcagcacaauuagcaccuccuauauauccaccaggauuuggagaagcaauuguauuuuuuaugucagauuucccaauagcacacgguacaaauggacuaucaguuccauuuaccauaccgcaagaauucguaacccauuucgucaacgaacaagccccaacaagaggagaagcagcacuacuauauuacuuagauccagacacacaucguaauuuaggugaauuuaaacucuauccugaagguuuuaugacauguguacccaauagcucuggcacaggcccacaaacacuuccaauuaauggaguauuuguauucguaucaugggucucucgcuuuuaucaauuaaaaccaguaggcacagcaggaccagcccgaagauuauaa

SEQ ID NO: 33427 - RNA, 1623 nt, Artificial Sequence
  derived and/or modified sequence opt6 from VP1__Norovirus_and/or_Norovirus-like__AB022679
augaugauggcauccaaagaugcaacaccaagugcugauggagcuacaggugcaggacaacuuguacccgaaguaaauacugcagacccaauaccaaucgauccuguagcaggauccucuacagcccuagcaacagcaggccaaguaaauuuaauagauccauggauaauaaacaacuuuguacaagcuccacaaggagaauuuacaauaucccccaauaacacacccggugacguauuauuugacuuacaacuaggaccucaucuaaauccuuuccuaucccaccuuucccaaauguacaacggauggguaggaaauaugagaguccgcguaguacuugcaggaaaugcauuuacagcuggaaaaguaauaauauguuguguaccaccuggauuucaaucacgaacucuaucaauagcacaagcaacuuuauucccacacguaauugccgauguuagaaccuuagacccuguugaaguacccuuagaagauguaagaaauguuuuauaucauaauaaugauacucaacccaccaugcgauuauuaugcauguuauacacaccucuacgaacuggcggcgcaucaggcggcacagauuccuuuguagucgcuggucgagucuuaaccuguccaggaccagacuuuaacuuuuuauuucuaguaccacccacuguagaacaaaagacacgaccuuucacuguuccuaacauaccacucaaauaccuaucuaauucuagaauaccaaacccaauagaagguaugucacuaucuccugaucaaacucaaaacguacaauuucaaaauggaagauguaccauagacggacaaccacuaggaacaaccccagucucagucucacaauuauguaaauuuagaggacgaauaacaucaggacaaagaguacuaaaccuuacagaacuagauggcucaccauuuaugggauuuggagcacccgcuccagcaggauucccagaccuaggaucaugcgauuggcauauagaaaugucaaaaauacccaacucaucuacucaaaacaauccaauaguuacaaauuccguaaaaccaaauucacaacaauuuguaccacacuuaaguucaaucacucuagaugaaaauguaucuuccgguggcgauuacauagguacuauacaauggacaaguccacccucagauucaggaggcgcaaacacaaauuuuuggaaaaucccagauuacggaucaucauuagcagaagcaucccaacuagcaccagcaguuuauccucccggcuuuaaugaaguuauaguauauuuuauggccucaauaccaggaccaaaucaaucaggcucaccuaaucuagucccaugccuacuuccacaagaauauauaacucauuucauuucagaacaagcuccuauacaaggugaagcagcauuacuucacuauguagaucccgauaccaaucgaaacuuaggugaauuuaaacucuaucccgguggauacuuaacauguguaccaaauaguucaucaacaggcccacaacaauuaccauuagacggaguauuuguauuugcuucuugggucucaagauuuuaccaauuaaaaccaguaggaacagcaggacccgcucgcggcagauuauaa

SEQ ID NO: 33428 - RNA, 1623 nt, Artificial Sequence
  derived and/or modified sequence opt6 from VP1__Norovirus_and/or_Norovirus-like__AF414403
augaugauggcaucaaaagacgcaccaccaaacauggacggaacaucaggagcaggacaauuaguuccugaagcaaauacagcagaaccaauaucaauggaaccaguagcaggagccgcaacugcugcagccacugccgggcaaguaaacaugauagauccauggaucaugaacaauuauguacaagcaccacaaggagaauuuacaauuucaccaaacaacacaccaggagacauacuauuugauuuacaacuaggaccacacuuaaauccauuucuaagucauuuagcacaaauguauaauggauggguuggaaauaugaaaguaaaaguacucuuagccggaaaugcauuuacagcuggcaaaauaaucauaucauguaucccacccgguuucgcagcucaaaauauuucaauugcucaagcuacaauguuuccccauguaaucgcagauguuagaguuuuagaaccuauagaaguaccacucgaagacguaagaaacguacuuuuccauaacaaugacaacacaccaacaaugcgucuaguauguauguuauacacaccauuacgagcuucaggauccucaucugguacagacccauucguuauugcuggaagaguucuaacaugcccaaguccagauuucucccuauuauuccuuguaccaccaaaugucgaacagaaaacaaaaccauucagcguaccaaaccucccuuuaaauaccuuaaguaauucaagaguaccuucauuaauaaaaucaaugaugguuucaagagaccacggacaaaugguacaauuccaaaauggaagaguagcccuugauggacaauuacaaggaacaacgccaacaucagcaagccaacuauguaaaauaagaggaucaguauuucacgcaaaugguggcaauggauauaauccaacagaacuagauggcucaccauaccaugcauucgaauccccagcaccaauaggauuucccgauuuaggagaaugcgauuggcauauggaagcaucuccaacaacacaauuugacacuggcgacguaauaaaacaaauaaauguaaaacaagaaagugcguuugcuccacaucuuggaacaauacaagcugauggauuaucagauguaucaguuaauacuaacaugauagcaaaauuaggaugggucucaccugucucagacggacauagaggaaacguagauccauggguaauaccaagauaugguucaacuuuaacagaagcagcccaauuagccccaccaauauacccaccaggauuuggagaagcaaucguauuuuucaugucagauuucccaauagcccacggaacaaauggacuaaguguuccaugcacuauaccacaagaauuuguaacucacuucguaaacgaacaagcuccaacaagaggagaagcagcauuacuacacuauuuagauccagauacacacaggaaucuaggugaauuuaaauuauauccagaagguuuuaugacauguguaccuaauucaucagguacaggaccacaaacucuaccaauaaacggaguauucguauucguaucauggguaucacgauucuaucaauuaaagccaguaggaacagcagguccagcaagaagauuauaa

SEQ ID NO: 33429 - RNA, 1623 nt, Artificial Sequence
  derived and/or modified sequence opt6 from VP1__Norovirus_and/or_Norovirus-like__LC101821
augaugauggcaucuaaagaugcagcaccaucagcugacggcgcaacuggcgcuggacaacucguaccagaaguuaauaccgcagacccaauaccaaucgauccgguagcagguucaucuacugcacuagcaacagcuggacaaguaaaucuaauugauccauggauaauaaauaauuuuguacaagcaccucaaggagaauuuacaauauccccaaacaauacaccaggagacguucuauucgaccuucaauuaggcccacauuuaaaucccuuucuaucccauuuaucacaaauguacaacggauggguaggaaauaugcguguaagaguuguauuagcagguaacgcauuuacagcaggaaaaguaauaauuugcugcguaccaccuggauuucaaucaagaacauuaucaauugcacaagccaccuuauucccacauguuauagcagauguacgaacauuagacccaguagaaguaccacucgaagauguaagaaauguuuuauaccauaauaaugauacacaaccuacuaugagauuauuaugcauguuauauacaccacuaagaacugguggugcuucagguggaacagacagcuuuguagucgcuggcagaguacuaaccuguccaggaccagauuuuaauuuccuauuccuagucccaccuacaguagaacaaaagacuagaccauucaccguaccaaauauaccauuaaaauaucuaucuaacucaagaaucccaaauccaauagaaggcaugucauuaucaccagaccaaacacaaaauguacaauuucaaaacggucguugcacaauagacggacaaccacuaggcacaacacccguuucaguaucucaacuaugcaaauuccgcggacgcauaacaucaggacaaaaaguccuuaaucuuacugaauuagacggcucuccauuuauggcauuugcugcaccagcacccguaggauuuccagauuuaggaucaugugauuggcauauagaaaugucaaaaauuccaaauucuucaacccaaucuaaucccauagucguaaacucuguuaaaccaaauucccaacaauucguaccacacuuaucauccauaacucuagacgacaauguaucauccggcggagauuauauaggcacaauacaauggacaucuccaccuucuggaucugguggcgcaaauacaaauuuuuggaaaauccccgauuacgguucuucuuuagcagaagccucacaacuagcuccagccguauaucccccaggauucaaugaaguaauaguuuauuucauggccuccaucccagguccaaaucaaucaggauccccuaacuuaguaccauguuuacucccacaagaguacauaacacauuuuauaucagaacaagcaccaauacaaggagaagccgcuuuacuccacuacguagacccagauacaaauagaaaccuaggagaguucaaauuauacccaggaggauaccuaacuugcguacccaacucuucuucaacaggaccucaacaacuaccucuagacgguguauucguuuucgcuucauggguuucuagauuuuaucaauuaaaacccguaggaacagccgguccagcacgcggaagauuauaa

SEQ ID NO: 33430 - RNA, 1623 nt, Artificial Sequence
  derived and/or modified sequence opt6 from VP1__Norovirus_and/or_Norovirus-like__AY038598
augaugauggcuaguaaagaugcuccaccuaacauggauggaacaucaggggccggacaacucgucccugaagcaaacacagcagaaccaauaaguauggaacccguugcuggcgcagcuacagcugcagcaaccgcaggacaaguaaauaugauagauccauggauaauggacaauuauguacaagcaccacaaggagaauucacaauaucaccaaacaauacuccaggugauauacuuuuugaucuacaauuagguccacaccuaaauccauuuuuaucacauuuagcacaaauguauaauggauggguaggaaauaugaaaguaaaaguacuacucgcagguaacgcauuuacagcuggaaaaauaauaaucucuuguauaccaccaggauucgcagcucaaaauauaucuauagcucaagcuacuauguuuccacaugucauagcagauguaagaguacuagauccaauagaaguaccauuagaagauguagguaaugucuuauuucauaacaauggagauacaccaacaaugagacuagucuguauguuauauacaccuuuaagagcauccggaaguucaucaggaacagacccauuuguuauagcaggacacguuuuaacauguccaucuccagauuucucauuucuauuuuuaggaccacccaacguagaacaaaaaaccaaaccauuuuccguaccaaauuugccauuaaacacauuaucaaacucacguguuccaaguuuaauacguucuaugaugguaucaagagaccacggacaaaugguccaauuccaaaauggaagagucacauuagauggacaauuacaaggaacaacacccacauccgcaucacaauuaugcaaaauacgugguucaguuuuucaugcuaacggcggaaacgguuacacauuaacagaacuagauggaucaccuuaucaugcauuugaaucaccugcaccaauaggauucccagaucucggagaaugugauuggcacauggaagccagcccaacaacacaauuugauacuggagauguaauaaaacaaauaaauguuaaacaagaagcagcuuuugcaccacaucuaggaacaauucaagcggauggcuuaucagauguaucuguaaacacaaacaugaucgcuaaauuaggaugggucucuccagcaucugauggacacagaggcaacguagaucccuggguaauuccacgauauggaucaacauuaacagaagccgcacaauuagcaccucccauauauccuccagguuuuggagaagcaauuguauucuuuaugucagacuuucccauagcacauggagcaaauggacuaaguguaccaugcacaauuccacaagaauuuguaacucacuucguaaacgaacaagcacccacaagaggcgaagcagcucuauuacacuaucuagauccagauacacauagaaacuuaggagaguucaaauuauauccagaaggauuuaugacauguguuccaaauaguucagguacaggcccacaaacauuacccauaaacggaguguuuguauuuguaagcuggguaagccguuucuaccaauuaaaaccaguaggaacagcuggaccggcacguucucuauaa

SEQ ID NO: 33431 - RNA, 1623 nt, Artificial Sequence
  derived and/or modified sequence opt6 from VP1__Norovirus_and/or_Norovirus-like__KJ196292
augaugauggcaucuaaagaugcaccaaccaacauggauggaacaucaggcgcaggacaacuaguaccagaagcaaacacagcugaaccaauuucuauggaaccaguagcaggagcagcuacugcagccgcuacagcaggacaaguaaacaugauagauccauggauuaugaauaauuacguacaagcaccacaaggagaauucacaauaucaccaaauaauacacccggagauauauuauucgacuuacaacuugguccacauuuaaauccuuuuuuaucacacuuagcccaaauguauaacggauggguaggcaauaugaaaguuaaaguauuauuagcagguaaugcauuuacagcuggaaaaauaauaaucagcuguauaccaccaggauuuguagcucaaaaugucaguauagcucaagcaacuauguucccccauguaauagcugauguaagaguucuugaaccaauugaaguaccucuugaagaugucagaaauguauuauuucacaauaacgacaauacuccaacuaugagacuagucugcauguuauauacaccacucagagcaucaggaaguucuucuggaacagacccuuuuguaauagcugguagaguacuaacuuguccaucaccagauuuuucauuucuauuucuuguuccaccuaacgucgaacaaaaaacaaaaccauuuuccgucccuaauuuacccuuaaauacuuuaagcaauaguagaguaccaucacucauaaaaucaaugaugguaucacgcgaccacggacaaaugguacaauuccaaaacggaagaguaacauuagauggucaacuacaaggaacaacaccaacauccgcaucucaauuaugcaaaauuagaggauccguuuuucacgcaaauggaggaaauggauauaaucuaacagaauuagacgguuccccauaucaugcuuucgaaaguccugcaccuauuggauuuccagaccuaggcgaaugcgauuggcauauggaagcuucaccaacuacacaauucaauaccggagauguaauaaaacaaaucaacguaaaacaagaaucugcauuugcaccacacuuaggaacaauacaagcugauggguuaagugauguaucuguaaauacaaauaugauagcaaaacuagguuggguaagccccguaucugauggccauaaaggagauguagauccuuggguaaucccaagauacggaucaacccuaacagaagccgcacaauuagcacccccaauauauccaccuggauuuggagaagcaauaguauuuuucaugucagauuuucccauugcucauggaacaaauggauuaucaguaccauguaccauaccacaagaauuuguaacucauuuuguaaacgaacaagcaccaacaagaggagaggccgcauuacuucacuaucuagauccagacacacacaggaauuuaggcgaauucaaacuauauccagauggauuuaugacauguguaccaaauuccucuggcacaggaccacaaacacuaccuaucaauggaguauuuguauuuguaaguuggguauccagauucuaucaacuaaaaccaguaggaacagcaggaccugcaagaagauuauaa

SEQ ID NO: 33432 - RNA, 1623 nt, Artificial Sequence
  derived and/or modified sequence opt6 from VP1__Norovirus_and/or_Norovirus-like__JQ743331
augaugauggcaucaaaagaugcaacccccucagcagacggagcaacaggagcaggucaauuaguuccugaaguuaauacagcagacccuaucccaauagauccuguagcaggaucuucaacggcacuagcaacugcaggacaaguuaaucuaauagauccauggauaauaaauaacuuuguacaagccccacaaggagaauuuacuauaagcccaaauaauacaccuggagauguauuauucgauuuacaauuaggaccacaucuaaauccauuucuaagccacuuaucgcaaauguacaacggauggguagguaauaugagaguacgaguaguacuugcuggaaaugccuuuacugcaggaaaaguaaucauauguuguguacccccaggauuccaaucccgaacauuaucaauugcucaagccacacuauucccucaugucauagcugauguaagaacucucgauccuguagaaguaccuuuagaagacguacguaaugucuuauaucauaauaaugauacacaaccaacaaugcgccuauuaugcauguuauauacuccucuuagaaccggaggagcaucuggugguacagacucauucgucguagccggaagaguucuaacaugcccaggacccgacuucaacuucuuauuucuuguaccgccuacagucgaacagaaaacaagaccauuuacagucccaaauauaccucuuaaauauuuaucaaauucaagaaucccuaauccaauagaaggaaugagucuaucaccagaccaaacccaaaacguccaauuucaaaauggacgaugcacaauagauggccaaccauuaggcacaacacccguaaguguaucacaacucugcaaauucagaggccgaaucaccucaggucaaaaaguuuuaaacuuaacugaauuagauggaucaccauuuauggcuuucgcugcucccgccccagcugguuucccugaucuaggaucuugugauuggcacaucgaaaugucuaaaauaccaaauucaucaacucaaucaaauccaauugucguaaacucuguaaaaccuaacucccaacaauuuguuccucaccuaagcucaauaacccucgaugacaacguaucuucuggcggagacuacauaggaacaauacaauggacuuccccaccaucagauuccggaggugcaaauacaaauuuuuggaaaauacccgacuacggaucauccuuagcagaagcaucccaacuugcuccagcagucuaucccccuggauuuaacgaaguaauaguuuacuuuauggcaucaaucccuggaccaaaucaaucuggaucaccaaaccuuguaccaugcuuacuuccacaagaauacauaacccacuucauuucagaacaagcaccuauacaaggagaagcagcccuacuacauuacguagacccagacacuaauagaaacuuaggugaauuuaaacuauacccaggaggauaucucacauguguaccaaauucaucuucaacaggaccucaacaauuaccacuagauggcguuuuuguauucgccucauggguauccagauuuuaucaacuaaaaccaguaggaacugcagguccagcaagaggaagacuuuga

SEQ ID NO: 33433 - RNA, 1623 nt, Artificial Sequence
  derived and/or modified sequence opt6 from VP1__Norovirus_and/or_Norovirus-like__EF547394
augaugauggccucuaaagacgcuacuccuucagcagacggagccacaggagcaggucaauuaguucccgaagucaacacagcugauccuauuccuauugauccuguagcaggaaguucaacagcccuagcaaccgcuggucaaguaaaccuuauagauccauggauaauaaauaauuucguucaagccccucaaggagaauuuacuaucucaccuaacaacacaccaggcgacguauuauucgaucuacaacuugguccacaucuuaacccuuuucuaucucauuuaagccaaauguauaacggaugggucggaaauaugcgagucagagucguacuagcaggaaaugccuuuacagcuggaaaaguaauaauauguugcguuccaccaggcuuucaaucacguacccucaguauagcacaagcuacccuauuuccacauguaauagccgauguaagaacacuagauccaguagaaguaccucuagaagauguuagaaacguacucuaucauaauaacgauacacaaccaacaaugagacuauuaugcaugcuuuacacaccacuaagaacaggaggugcaucuggagguacugauucauuuguaguugcuggcagaguauuaacauguccagguccagacuucaauuuucuauucuuagucccaccuacaguagaacagaaaacacgaccuuuuacuguacccaauauaccauuaaaauaccucucuaacucacgaauacccaaccccauugaaggaaugucuuuaaguccagaccaaacacaaaauguacaauuucaaaacggacgcuguacaauagacggacaaccucuaggaaccacaccugucucuguaucucaacucuguaaauucagagguagaauaacaaguggucaaaaaguauuaaaccuaacugaauuagauggaucacccuuuauggcguucgcagcaccagcaccagcaggauuuccugaucuagguaguugugauuggcacaucgaagucagcaaaauaccaaauucaucaacacaaucaaauccuauuguaguaaacucaguaaaaccaaauucucaacaauuuguaccucaucuaucaucaaucacacuugaugacaauguaucaucaggaggagacuacauaggcacaauacaauggacuucucccccuucagacagugguggagcaaauaccaauuuuuggaaaauaccagacuacggaucuucucuugcagaagcaucacaacucgcuccagcaguuuauccaccaggcuucaaugaaguaauaguauauuucauggcaucaauuccaggaccaaaccaaucaggaucacccaacuuaguaccuugucuacuaccacaagaauacauaacacauuuuauuucagaacaagcacccauacaaggagaagcagcauuacuccauuauguagacccugacacuaauagaaaccuaggagaauuuaaacuuuaucccgguggauauuuaacauguguaccaaauuccucaucuacaggaccacaacaauuaccuuuagauggcguauucguauucgcaucauggguauccagauucuaucaacuaaaaccaguuggaaccgccggaccagcacgagguagauuauaa

SEQ ID NO: 33434 - RNA, 1623 nt, Artificial Sequence
  derived and/or modified sequence opt6 from VP1__Norovirus_and/or_Norovirus-like__AF394960
augaugauggcaaguaaagaugcaaccccaucagcagauggagcaacuggagcaggacaauuaguaccagaaguuaauacugccgggccuauuccaauagauccaguagcaggaucuucuacagcacuagcaacagcaggccaaguaaauuuaauagauccauggauaauuaauaauuuuguacaagcaccacaaggagaauuuaccauaucaccaaacaacacaccuggugauguuuuauucgaucuccaacuaggaccucaucucaauccauuucuaucacaucuaucacaaauguacaacggauggguagguaauaugagaguaagaguaguccuugcaggaaaugcauuuacagcaggaaaaguaauaauauguugcguuccucccggauuucaauccagaacauuaucaauagcccaagcaacauuauucccacacguaauagccgacguaagaacacuugacccuguagaaguaccccuugaagauguucguaauguccuauaucacaacaacgauacucaaccaacuaugcgccuucuauguaugcucuauaccccacuaagaacagguggcgccucaggaggcacagacucuuucguuguagcuggucgaguauuaacaugccccggaccagacuucaauuuccuauuucuuguaccgccaacaguugaacagaaaacacgaccauucacaguaccaaauauaccacucaaauaucuaucaaauucuagaaucccaaacccuauagaagguaugagcuuaucacccgaucaaacucaaaacguucaauuucaaaauggaagauguacaauagauggacaaccacuuggaacaaccccuguauccguaucacaacuaugcaaauuuagaggaagaauaacgucuggacaaaaaguacuaaauuuaacagaacuagauggaucuccuuuuauggcuuucgcagcuccagcacccgcaggauucccagaccuaggaucuugcgauuggcauauagaaaugucuaaaauuccaaauucuagcacucaaucaaacccaaucguaguuaacucaguaaaaccaaauucucaacaauucguaccacauuuaagcucuauuacauuagaugacaauguaucuucaggaggagauuacauagguacuauccaauggacaucucccccaucagacucaggaggagccaauaccaauuucuggaaaauacccgacuacggauccucacuagccgaagcaucacaacuagcaccagcaguauauccaccuggcuuuaacgaagucaucguuuauuucauggcaucuauaccaggccccaaccaaagcggaucaccaaauuuaguacccugcuuacuaccucaagaauacauaacacauuucauauccgaacaagcacccauacaaggagaagcagcacuacuacauuacguugauccugauacuaauagaaaccuaggagaauuuaaacuuuaucccgguggauaucuaacauguguaccuaacucuucaaguacaggaccucaacaauuaccacuagacggcguauucguuuucgcaucauggguaucaagauuuuaccaacuuaaaccaguagguacugcaggaccagcaagaggaagacucuaa

SEQ ID NO: 33435 - RNA, 1623 nt, Artificial Sequence
  derived and/or modified sequence opt6 from VP1__Norovirus_and/or_Norovirus-like__AJ277616
augaugauggcuucaaaagacgcaacaccaucagccgacggagccacaggagcaggccaacuaguaccugaaguaaauacagcagacccaauaccaauagauccaguugcuggaucaucuacagcuuuagcaacagcaggacaaguaaaucuaauagacccuuggauuauaaacaauuuuguucaagcuccacaaggagaauuuacaauuuccccuaacaacacaccaggugauguauuauucgaucuacaauuaggaccucauuuaaauccauuccuaucacacuuaucccaaauguauaauggauggguaggcaauaugagaguaagaguuguacuagccgguaacgcauucacagcuggaaaaguaauaauuugcugcguuccaccagguuuucaaucaagaacccuaaguauagcucaagcaacauuauucccacacguuauagccgauguaagaacacuugacccaguagaaguuccacuugaagauguacgaaacguacuuuaucacaacaacgauacccaacccacuaugagauuauuguguauguuauauaccccuuuaagaaccgguggagcaucagguggaacagauucauucguaguagcaggcagaguauuaacaugccccgguccagauuucaauuuucuuuucuuaguaccaccaaccguagaacaaaaaacacgaccauuuacaguuccaaauauaccucuaaaauaucuaucuaacuccagaauaccaaauccaaucgaagguaugucauuaucaccagaucaaacacaaaauguacaauuccaaaauggaagauguacuauagauggacaaccacuaggcacaacuccagucucuguaucucaacuuuguaaauucagaggacguauaacaagcggacaaaaaguacuaaaccuaacaaaauuagauggcuccccauucauggcuuucgcugcaccagccccagcaggcuuuccaaauuuaggaucaugcgauuggcauauagaaaugucaaaaauaccaaauucuucuacacaauccaaucccauaguaguuaacucagucaaacccaacucacaacaauucgucccacauuuaucuucuauaacauuagaugaaaaugucucaucaggaggagauuauauuggaacaauacaauggacuucacccccaucagauucuggaggagcaaacacuaauuuuuggaaaauaccagacuauggaucaucauuagccgaagcaucacaacuagcaccagcaguguauccacuugucuuuaaugaaguaauuguauauuucauggcaugcaucagagguccaaaccaauguggaucaccaaauuuaguaccaugccucuccccccaagaauacauaacacauuucauaagugaacaagcaccaauacaaggagaagcagcuuuacuacacuauguugacccagacacuaacagaaauuuaggagaauuuaaacuauacccuggaggauaucucacauguguaccaaauucaucaucaacuggaccucaacaauuaccucucgauggcguuuucguuuucgccucauggguauccagguuuuaucaauuaaaaccaguaggcacagcaggaccagccagaggaagacuauaa

SEQ ID NO: 33436 - RNA, 1623 nt, Artificial Sequence
  derived and/or modified sequence opt6 from VP1__Norovirus_and/or_Norovirus-like__GQ413970
augaugauggcaucuaaagacgcaacaccauccgcagauggagcuacaggagcaggucaauuaguaccagaagucaacacagcugauccaauaccuauugaucccguagcuggaucuucuacagcucucgccacagcaggacaagucaaucuaauagaccccuggauaauuaacaacuuuguacaagccccacaaggagaauuuacaauaucaccaaauaauacaccaggagauguccuauucgaccuucaauuaggcccacaccuaaauccauuucucucacacuuaagucaaauguauaacgguuggguaggaaacaugagaguaagagucguacuugcaggcaaugcauuuacagcaggcaaaguaauaaucugcugugucccuccaggauuucaaucuagaacucuaucaauagcccaagcaacauuauucccacacguaauagccgauguacgaacacuagacccaguagaaguaccacuagaagauguuagaaauguacuauaccauaacaaugauacucaaccaacaaugagauuacucuguaugcuauacacuccauuaagaacagguggagcuucaggaggaacugacucauucguuguugcaggaagaguacuuaccugucccgguccagauuuuaacuuucuuuucuuaguaccaccuacaguagaacaaaagaccagaccuuucacaguaccaaauauaccacuaaaauacuuaucuaacagucguauaccuaacccuaucgaaggaaugucacuaucacccgaccaaacacaaaauguucaauuucaaaauggacgaugcaccauugacggacaaccacuuggaacaacaccaguaucaguaucacaacucugcaaauuuagaggaagaauaacgucaggacaaagaguauuaaacuuaacagaacuagauggaagucccuucauggcuuucgcugcuccagccccagccggauucccagacuuaggaucuugcgauuggcauauagaaaugucaaaaauacccaauucaucaacacaaaauaauccaauaguaguaaauucuguaaaaccaaauagccaacaauucguaccucacuuaucauccauaacccuagaugacaauguaucuucagguggcgauuacauaggaacaauacaauggacaucuccaccaucagacucuggaggagccaauacaaauuuuuggaaaauaccagauuauggaucaucacuagccgaagcaagucaacuugcaccagcagucuaucccccuggauuuaaugaagucauaguuuacuuuauggcaucuauaccuggaccaaaucaauccgguagcccuaauuuaguaccuuguuuauuaccacaagaauacauuacccauuucauaucagaacaagcaccaauacaaggagaagcagcacuacuucauuacgucgacccagauacuaaccguaaucuaggagaauuuaaauuauauccagguggauaucuaaccugcguaccaaauucaucaucuacaggaccacaacaacuaccuuuagaugguguauuuguauucgcuucauggguaucacgauuuuaccaacuuaaacccguaggaacugcaggaccagcaagaggacgacuauaa

SEQ ID NO: 33437 - RNA, 1623 nt, Artificial Sequence
  derived and/or modified sequence opt6 from VP1__Norovirus_and/or_Norovirus-like__KT732281
augaugauggcaucuaaagacgcgaccccuucugcagauggagccacaggagcaggacaacuaguacccgaagucaauaccgccgauccaauaccaauagauccuguagcaggaucaucaacagcucuugccacagcugggcaaguuaaucuaauagacccauggauaauuaacaacuucguacaagcaccccaaggcgaauucacaauauccccaaacaauacaccuggagacguauuauucgauuuacaauuaggaccacaucuaaacccauuucuaucccaccuuucccaaauguauaacggauggguaggaaauaugcgaguaagaguaguauuagccggaaaugcuuuuacugcuggaaaaguaauuaucuguugcguuccaccaggcuuucaaucucguacauuaucuauagcacaagccaccuuauucccacacguaauagcagacguaagaacucuagacccuguagaaguaccucuagaagacgucagaaauguauuauaccacaauaacgacacacaaccuacaaugcgauuauuauguaugcuuuauacaccacuuaggacaggaggcgcaucuggaggaacagauucuuuuguuguagcaggaagaguuuuaaccugucccgguccagacuucaauuucuuauucuuaguaccuccaaccguagaacaaaaaacacgaccauucacaguacccaacauuccucuaaaauaccuuucaaauaguagaauaccaaacccaauugaagguaugucccuuuccccagaccaaacccaaaauguacaauuucaaaauggacgaugcacaauagacggacaacccuuaggcacaacaccagucuccguaucacaauuauguaaauuuagaggaagaauaacaucaggacaaaaaguauuaaauuuaacagaacucgacggcucuccauuuauggcuuucgcagcaccagcuccagcaggauucccagauuuaggaucaugugauuggcauauagaaguaagcaaaauuccuaauucaucaacccaaggaaauccaauaguuguaaacucaguuaaacccaauagucaacaauucguuccucacuuaucaucaauaacacuagaugacaauguaucauccggaggcgauuacauaggaacaauacaauggacuucaccccccucugauuccggcggagcaaacacaaacuucuggaaaauaccagauuauggaaguucauuagcugaagcaagccaacuagcacccgcaguuuauccacccggcuuuaaugaagucauuguuuauuucauggcauccauuccaggaccaaaucaaucaggcucaccaaaccuugucccuugucuacuuccccaagaauacauuacccauuucauaucagaacaagcuccaauacaaggugaagccgcacuacuacauuacgucgacccugauacaaacagaaacuuaggugaauucaaacuauacccaggaggauaccuaacaugcguaccaaacucaucaaguacaggcccacaacaacuaccucuagauggcguauuuguauucgccuccuggguaucaagauuuuaccaauuaaaaccaguaggaaccgcaggaccagcuagaggacgacuauaa

SEQ ID NO: 33438 - RNA, 1623 nt, Artificial Sequence
  derived and/or modified sequence opt6 from VP1__Norovirus_and/or_Norovirus-like__AF414404
augaugauggcaucuaaagaugcaacuccuucugcagacggcgcaacuggagcaggacaauuaguccccgaaguuaacacagcugacccaaucccaauagauccuguagcaggaucuucaacagcacuagcuacagcaggaagaguaaaccuaauagauccuuggauaauaaauaauuuuguacaagcaccccaaggagaauuuacaauaucuccaaauaauacacccggagacguauuauucgacuuacaacuaggaccacaucuuaauccauuucuuucucaccuaucacaaauguacaacggauggguuggcaauaugcgcguaagagucguccuagcuggaaacgccuuuacugcaggaaaaguaauaauauguuguguuccaccaggauuucaaucuagaacacucucuauagcacaagcaacauuauuuccacauguaauugccgacguaagaacccucgacccaguugaaguaccccuagaagauguaagaaacgucuuacaucauaauaaugauacacaaccuacuaugagauuacuuugcaugcuauauacaccauuaagaacuggaggagcaucagguggaacugauucuuuuguugucucaggcagaguucuuaccugcccagguccagauuuuaauuucuuauuucuaguaccaccaacaguugaacaaaaaacaagaccguucacaguuccaaacaucccuuuaaaaugccuuucaaauucacgaauaccuaaucccauagaagguauguccuuaucacccgaccaaacacaaaacguucaauuccaaaauggacgaugcacaaucgauggccaaccacuagguacaacaccaguaaguguaucacaauuaugcaaauuuagaggacgcauuaccucaggacaaggcguauuaaauuuaacugaacuagaugguuccccuuuuauggcauuugcagcaccagcacccgcaggauuuccugaucuaggcagcugugauuggcacaucgaaaugucaaaaauuccaaauucaucaacccaaaauaacccaauagucgucaacagcguaaaacccaauucacaacaauucgucccacauuuaucaaguauaacccucgacgaaaauguaucaucaggaggagacuacauaggaacaauacaauggacuucaccaccaucagacucagguggagccaauacaaauuucuggaaaauaccugauuauggaucuucuuuagcagaagcaucacaauuagcccccgcagucuauccaccaggauuuaaugaaguaauuguauauuuuauggcaucaauaccaggaccuaaucaaucagguucaccaaacuuaguaccaugucuucuaccacaagaauauauaacacauuuuauaucagaacaagcaccaauacaaggugaagcagcccuauuacauuauguagaccccgacacaaauagaaaucuaggcgaauuuaaauuauauccaggaggauauuuaacuugcguuccuaauucuucaucaaccggaccacaacaacuaccacuagauggaguauuuguuuuugcuuccuggguaucuagguuuuaucaacuuaaacccguagguacagcaggaccagcaagggguagacuuuaa

SEQ ID NO: 33439 - RNA, 1623 nt, Artificial Sequence
  derived and/or modified sequence opt6 from VP1__Norovirus_and/or_Norovirus-like__AF414402
augaugauggccucaaaagacgcaacuccuagugcagauggagcuacaggugcuggccaacuuguaccugaaguaaacacagccgauccaauacccauagacccuguagcaggaucaucaacagcacuagcaacugccggucaaguaaaucuaauagacccauggauaauaaauaacuucguacaagcaccacaaggugaauuuacuauaucaccaaauaauacaccaggugauguccuuuucgaucuacaacuuggcccacaucuaaaucccuuucuaucucacuuaucacaaauguauaacgguugggucggaaauaugcgaguuagaguaguauuagcuggcaaugcauuuaccgcaggaaaaguaaucauaugcagaguaccuccaggauuucaaucacgaacuuuaucuauugcucaagcaaccuuauuuccacacguaauagcugacguucgaacuuuagauccaguugaaguuccacuugaagauguacguaacguacuauaccauaacaacgacacccaaccaacuaugagauuacuauguauguuauauacaccucuaagaacaggaggagcuuccggaggaacagacucauucguaguaguuggacguguacucacaugcccagguccagauuuuaauuuuuuauuccucguaccaccaacaguugaacaaaaaacaagaccauucacagcaccaaacaucccacuaaaauaccuuucaaauucaagaaucccuaacccaaucgaaggaauguccuuaucacccgaccaaacucaaaacguucaauuccaaaauggaagaugcacuauagauggacaacccuuaggagcaaccccaguaucaguaucacaacuuuguaaauuuagagguagaauuaccaguggacaaagagcccucaacuuaaccgaauuagacgguucucccuuuauggccuucgcagcaccagccccagcaggauuccccgaccuagggucaugugauuggcauauagaaaugucaaaaauaccuaauucaucaacacaaaauaauccaauaguaguuaauucaguuaaaccaaauucucaacaauuugucccacaucuaccuucaauaacauuagaugaaaauguaucuucagguggcgauuacauaggaacaauacaauggaccucuccuccaucagacucagguggugcuaauacaaauuuuuggaaaauaccagauuauggaucaucucuagcagaagcaucacaacuagcuccagcuguuuaccccccaggauuuaacgaaguaaucgucuauuucauggccucaauaccagguccaaaccaauccggcucuccaaacuuaguaccuugucuucuaccucaagaauauauaacacauuuuauuucagaacaagcaccaauacaaggagaagcagcacuacuccauuacguagaccccgauacaaaucgcaauuuaggugaauucaaacuauaccccggaggcuaucuuacaugcgucccaaauucaucaucaaccgguccucaacaauuaccucuagacggcguauucguauucgcauccuggguaucaagauuuuaucaacucaaaccagucggaacugcugguccugcaagaggucgauuauaa

SEQ ID NO: 33440 - RNA, 1623 nt, Artificial Sequence
  derived and/or modified sequence opt6 from VP1__Norovirus_and/or_Norovirus-like__AJ313030
augaugauggcaucaaaagaugcuacaccaucagcagauggugcauuaggagcuggacaauuagucccugaaguaaacacagcagacccaauaccuauagauccaguagcuggaucgucaacugcacuagccaccgcuggucaaguuaauuuaauugacccauggauaauaaacaauuuuguccaagcaccacaaggagaauuuacaaucagcccuaauaauacccccggagacguucuguucgaccuacaacuaggaccacaccuaaauccauuuuuaucacacuuaucucaaauguauaacggcugggucggaaacaugcgaguaagagucguacuugccggaaaugcauuuacugccgguaaaguaauaauauguugcguacccccuggcuuucaaucuagaacauuaucaaucgcacaagcaacauuauuuccacacguaaucgcagacguaagaacacuagauccaguagaaguaccuuuagaagacguaagaaacguucuauaucauaauaaugauacccaacccacaaugagacuauuaugcaugcuauauacaccacuaagaaccggcggcgcaucaggaggcacugauucuuucguuguagcuggaagaguacuaacaugcccaggccccgacuuuaacuuuuuauuucuuguccccccaacgguagaacaaaaaacaagaccauuuacaguacccaauauaccacuuaaauacuuauccaauucacgaauacccaacccaauagaaggaaugucauuaaguccugaccaaacacaaaauguucaauuucaaucaggaagauguacuauagauggucaacccuuagguacaacaccagucuccguaagucaauuauguaaauuuagaggcagaauaacauccggacaaaaaguccuaaacuuaacaggauuagauggaucaccauuuauggcguuugcugcaccagccccagcuggauucccagacuuaggaucaugugauuggcauauugaaauguccaaaauaccuaacucaaguacccaaaacaacccaauaguaauuaacuccgucaaaccuaauucacaacaauuuguaccacacuuaaguucuauaacacuagaugaaaauguccucucaggcggagauuacauuggaacaauacaauggacuucaccaccaucagacucuggaggcgccaacacaaauuuuuggaaaauuccugauuacggaucuucacuagcugaagcaucacaauuagcucccgcuguauacccuccaggauuuaaugaaguuauuguauacuucauggcaucaaucccaggaccaaaccaaucagguucaccaaacuuaguaccaugcuuacucccucaagaguauauuacacauuuuauaucugaacaagcacccauucaaggugaagcagccuuacuacacuacguugauccugauacaaaucgaaacuuaggcgaauuuaaauuauauccaggaggcuaccuaacauguguaccaaacucaucaucaacuggaccacaacaacuaccuuuagauggaguauucguauucgcaucauggguauccagauucuaucaauuaaaaccaguaggaaccagaggaccagcaagaggcagauuauaa

SEQ ID NO: 33441 - RNA, 1623 nt, Artificial Sequence
  derived and/or modified sequence opt6 from VP1__Norovirus_and/or_Norovirus-like__KM036381
augaugauggcaucaaaagaugccacaccuucagcagauggagccacaggugcaggacaauuaguacccgaaguaaauacugcugacccaauaccaauagacccaguugccggaucaucaaccgcuuuagcaacagcaggacaaguaaaucuaaucgauccauggauaauaaauaauuuuguacaagcaccacaaggagaauuuacaauuucaccuaacaauacaccaggugauguacuauucgaccuacaauuaggcccacacuuaaauccuuuucuaucacaucuuucacaaauguacaacgguuggguaggaaauaugagaguuagaguuguucuugcaggaaacgcauucaccgcuggcaaagucauaauaugcugugucccucccggcuuucaaucccguacacuaucgauagcacaagccacauuauuuccccacguaaucgccgacguaagaacacucgacccugucgaagucccuuuagaagauguaagaaacguacuauaucacaauaacgauacacaaccaacaaugagacucuuaugcaugcucuauacaccucucagaacagguggagcaucaggcggaacagacucauucguaguugcaggaagaguuuuaacauguccaggaccugauuucaauuuccuuuuucuaguuccaccaaccguagaacagaaaacaagaccauucacagucccaaauauaccauuaaaauaucuuucaaacucuagaauaccaaauccaauagaagguaugucacuuucccccgaucaaacccaaaauguacaauuucaaaauggucgauguacaauagauggacaaccccuaggcacaacaccuguaucaguaucacaauuauguaaauuuagaggacgaauuaccucaggacaaaaaguuuuaaaccuaaccgaacuagauggaucaccauucauggcuuuugcagcaccagccccugcuggguuuccagaucuaggaucaugcgauuggcacaucgaaaugucuaaaauaccaaauucuucaacugaaucaaacccuauaguaguaaacucaguuaaaccaaauucacaacaauuuguaccacaucuaagcucaaucacccucgaugacaacguuucaucaggaggagauuacauaggaacaauacaauggacuucaccaccuucagacucaggaggagccaauacaaacuuuuggaaaauaccaaacuauggaucaucccucgccgaagccucacaauuagcuccagcaguauacccaccaggauucaacgaaguaauaguauauuucauggcuucuauacccggcccaaaccaauccggcucacccaaucuaguuccaugcuuauuaccacaagaauacaucacacacuuuauaagugaacaagcuccaauacagggugaagcagcucuacuacacuacguagauccagauacaaaccguaacuuaggagaauuuaaacuauauccuggaggcuaucuaacauguguuccuaauucaucaucaacagguccacaacaacuaccacuugauggaguauucguuuucgccucauggguuucuagauuuuaucaacuaaaaccugucggaacagccggccccgcuagagguagauuauga

SEQ ID NO: 33442 - RNA, 1623 nt, Artificial Sequence
  derived and/or modified sequence opt6 from VP1__Norovirus_and/or_Norovirus-like__LN854563
augaugauggcauccaaagaugcaacaccaagcgcagauggagcaacuggcgcuggacaacucgugccagaaguuaauacagccgauccaauuccaauagauccaguagcaggaucaucaacugcacuagcgacagcaggacaaguuaacuuaauagauccuuggauuauaaauaacuuuguacaagcaccucaaggagaauuuacaauauccccaaacaauaccccuggagacguauuauucgaccuucaacuaggaccacaucucaauccauucuuaucccaucuaucucaaauguauaacgguuggguagguaauaugagaguuagaguaguuuuagcuggcaacgcauucacagcaggaaaaguaauaauuugcugcguaccaccaggauuucaaucaagaacauuaucaauagcacaagcaacauuauuuccacaugugauagcagauguaagaacauuagauccaguagaaguaccccuagaagauguaagaaacguauuauaccacaauaaugauacccaaccaacaaugagguuacuaugcaugcuuuacacaccccuacgaaccggaggagcuucuggaggaacugauucauucguaguagcuggucgaguacuaacauguccaggaccagauuucaauuuccuauuucuaguuccaccaacaguugagcaaaaaacaagaccauucacaguuccaaauauaccauuaaaauaccucuccaacucacgaauuccuaauccaauugaagguaugagucuaucuccagaucaaacacaaaacguccaauuucaaaacggacgaugcacuauugauggacaaccacucggaaccaccccagucucaguaucucaacuauguaaauuuagagguagaauuaccucaggacaaagaguuuuaaacuuaacagaauuagaugguucaccauuuauggcauuugccgccccagccccugcaggauucccagacuuaggcucuugcgauuggcauauagaaaugucuaaaauaccaaauuccuccacucaaaacaacccaauaguaguaaacucaguuaaacccaauucucaacaauuuguaccacaccucaguaguauuacacuagaugacauaguaucaucugguggagacuacauagguacaauacaauggacaucaccaccuucagauucaggaggcgcaaauaccaauuucuggaaaauuccagacuauggaucuucauuaucagaagcaucccaauuagcaccagcuguauacccaccaggauuuaaugaagucauagucuauuuuauggcaucaauaccaggacccaaccaaucugguuccccaaaccuaguaccaugccuacuaccacaagaauauauaacucauuucauuucugaacaagcaccaauacaaggagaagcagcccuacuucauuacguagacccagacacuaacagaaaucuaggagaauucaaacuuuauccaggaggcuaucuaacauguguaccaaauucuuccucuacugguccacaacaauuaccauuagauggaguauuuguauucgcaucaugggucucucguuuuuaccaacuaaaaccaguagguacagcaggaccagcucgagguagauuauaa

SEQ ID NO: 33443 - RNA, 1623 nt, Artificial Sequence
  derived and/or modified sequence opt6 from VP1__Norovirus_and/or_Norovirus-like__AB042808
augaugauggcauccaaagacgcuaccccaucagcagauggagccaccggagcaggacagcuaguaccagaaguaaacaccgcugauccaauucccauagacccuguagcagguucaucaaccgcacuagcaacagcuggacaaguaaauuuaauagauccauggauaauaaauaauuuuguacaagcuccacaaggcgaauuuacaauauccccuaacaauacaccaggagauguuuuauucgauuuacaauuagguccacacuuaaacccauuccuaucacaccucucucaaauguauaauggauggguuggaaauaugagaguacguguaguacuagcaggaaaugcauucacagcuggcaaaguaauuaucuguugcguaccacccggauuucaaucuagaacauuaaguaucgcacaagccacauuauucccacauguaauagcagacguucgaacccuagauccaguagaaguuccuuuagaagacguacgcaacguacuuuaucauaauaacgauacucaaccaacuaugagacuacuuuguauguuauauaccccacuaagaacaggaggcgcaucaggaggaacagacagcuucguagucgcgggaagaguccuaaccuguccaggcccagauuuuaauuucuuauucuuagucccaccaacaguagaacagaaaacacgaccauuuaccguaccuaauauuccauuaaaauauuuaucaaauucaagaauaccuaacccaauugaaggcaugucauuaucaccugaccaaacacaaaacguccaauuccaaaacgguagaugcacaauagauggacaacccuuaggaacuaccccagucuccguaucccaauuauguaaauuucgcggacgaauaacaucaggacaaagaguuuuaaaucuuacagaacuagacggcucccccuuuauggcauuugcagcaccagccccagcaggauucccagaccuaggaucaugcgacuggcauauagaaauguccaagauaccaaauuccucaacacaaaacaaucccauaguuacuaacucaguaaaacccaacucacagcaauuuguaccucaccucucaucaauaacacucgaugaaaauguaaguaguggaggagauuacauaggaacaauacaauggacaucaccaccaucugacucaggaggugcaaauacaaauuuuuggaaaauuccagauuauggaucaucacuagcagaagcaucacaacucgcucccgccguauauccaccuggauuuaacgaaguaauaguauauuucauggccucaauaccuggaccaaaccaaucuggaucaccaaauuuagucccauguuuauuaccacaagaauacauaacacauuucauauccgaacaagcaccaauccaaggugaagcagcauuacuucauuauguagauccagauacaaauagaaacuuaggagaauuuaaacuauacccaggagguuauuuaacaugcguaccaaauucaucauccacaggcccccaacaauuaccuuuagauggaguauucguuuucgccucauggguaaguagauuuuaucaacuaaagccagucggaacagcaggaccugcacgaggcagauuauaa

SEQ ID NO: 33444 - RNA, 1623 nt, Artificial Sequence
  derived and/or modified sequence opt6 from VP1__Norovirus_and/or_Norovirus-like__EU004679
augagaaugucagauggagcagcaccuaaagcuaauggaucagaagcaucaggacaagaucuaguuccuaccgcuauagaacaagcaguuccaauucaacccguagcaggaagcgccuuagcggcaccagcagcaggacaaauaaaucaaauagacccauggauauuccaaaacuuuguacaauguccauuaggugaauuuaguaucucaccucgcaauacucccggcgaaauacuauucgauuuagcacuaggcccuggacucaacccauauuuagcacaccuaucagcaauguauacagguuggguaggaaauauggaaguccaauuaguacuagcugguaacgcuuucacugcaggaaaaguaguaguagcucuaguaccaccauacuuucccaaaggaucacucacaacugcacaaauuacaugcuuuccacauguaaugugugacguuagaacucuagaaccaauucaauuaccauuauuagauguaagaagaguacuuuggcaugcaacucaggaccaagaagaauccaugagauuaguauguauguuauauacuccuuuaagaacaaacucuccaggugacgaaucauuuguaguuaguggaagacuacucucaaaaccugcagcagauuucaacuucguauaccuaacaccaccaauugaaagaacaauauacagaaugguagaucuacccguauuacaaccaagauuaugcacucaugcaagauggccugcaccuaucuauggacuauuagucgauccaucacuaccuucaaauccacaauggcaaaauggcagaguacauguugacggaacccuauuaggaacaacgcccguaucagguucauggguaucaugcuuugcagcagaagcagcauaugaauuucaaaguggaacaggugaaguagcaacauuuacacuaauagaacaagauggaucugcauauguaccuggugauagagcagccccuuuagguuauccagacuuuucaggacaacuagaaauagaaguacaaaccgaaacaacaaaaacaggcgacaaacuaaaagucacaacauuugaaaugauucuaggccccacaacaaauguugaucaagccccuuaucaaggaaaagucuaugcaucauuagcaguagcugcuucauuagauuuagucgacggaagaguaagagcaguaccaagaucaauauacggauuucaagaugucauaccugaauacaaugacggauuauuaguacccuuagcuccacccauaggcccauuuuuaccuggugagauacuguuaagauucagaacauauaugcgacaacuagauacugcugacgcagcagcugaagcaauagauugugcucuaccacaagaauuuauauccugguuugcuucaaacgcauuuacaguucaagcagacgcuuuacuauuaagauauagaaauacacuaacuggacaacuacuauuugaauguaaacuauacucagaaggauacauagcauuaucauacucaggaagcgcaccacuuacuuuuccaacugauggauuuuucgaaguaguaucauggguuccacguuuauuccaauuagcaucaguaggaucgcuuacaacaggaaggacacuaaaauag

SEQ ID NO: 33445 - RNA, 1623 nt, Artificial Sequence
  derived and/or modified sequence opt6 from VP1__Norovirus_and/or_Norovirus-like__EU004678
augcgaaugucugauggagccgcaccuaaagccaauggaucugaagcaucaggacaagaccuaguaccaaccgccguugaacaagcaguaccuauacaaccaguagcaggauccgcauuagcagcuccugcagcaggacaaauuaaccaaauagauccauggauauuccaaaauuuuguacaaugcccacuuggugaauuuucuauaucuccaagaaauacacccggagaaauuuuauuugauuuagcacuuggaccuggccuaaauccuuaucuagcacaucuuucagcaauguauacagguuggguaggaaauauggaaguacagcuaguauuggccgguaacgccuuuacagcagguaaagugguagucgcuuuaguaccaccauauuuuccaaaagguucauuaacaacagcacaaauuaccuguuuuccucacguaaugugugaugucagaacuuuagaacccauucaauuaccuuuacuagauguacgaagaguauuauggcaugccacacaagaucaagaagaaucaaugcgauuaguauguauguuauauacaccucuaagaacaaauucaccuggagacgaaucuuucguaguuucaggaagauuauuaucuaaaccagcagcagacuuuaacuuuguauauuuaacaccaccaauagaaaggacaauauacagaaugguagacuuaccaguauuacaacccagacuauguacccaugcaagauggccagcuccuauauauggcuuauuagucgacccaagucuaccaucaaacccacaauggcaaaaugguagaguccauguugacggaacauuacuagguacuacaccaguaucaggaucauggguuuccuguuuugcagcugaagcagcauaugaauuucaaucaggaacaggugaaguugcaacauuuacacuaauugaacaagacggaucugcauaugucccuggcgauagagcagcuccauuaggauauccagacuuuucaggucaauuagaaauagaaguucaaaccgaaacaacaaaaacaggagauaaauuaaaaguuaccacauuugaaaugaucuuaggaccuacaacaaauguagaucaagcaccauaucaagguagaguauaugcaucauuaacagcaguagcaucauuagacuuaguagauggaagaguaagagccguaccuagaucuauauacggauuucaagauguaauaccagaauauaacgauggucuauuaguaccauuagccccuccaauaggcccauucuuaccuggagaaguauuauuaagauucagaacauauaugagacaauuagauaccgcagacgcugcagcagaagcuauagacugcgcauuaccacaagaauuuauaucuugguuugcaaguaacgcuuuuacuguacaaagugaugcacuucuacucagauacagaaauacucuuacaggacaauuauuguuugaaugcaaauuauacagcgaaggauauauagcacuauccuacuccggaucaggaccccuaacauuuccuacugaugguuucuuugaaguaguaucuuggguaccaagacuauuucaacuagcaucagucgguaguuuaacuacagguagaacauuaaaauaa

SEQ ID NO: 33446 - RNA, 1623 nt, Artificial Sequence
  derived and/or modified sequence opt6 from VP1__Norovirus_and/or_Norovirus-like__AB281085
augaaaauggcaucaaacgacgcugcaccaucaacagacggagcugcuggauuagucccagaaucaaauaaugaaguaauggcacuagaaccaguagcaggagcagcacuagcugcuccaguaaccggucaaacaaauauuauugacccauggauucgagcuaacuucguacaagcaccaaacggagaauuuacaguauccccuagaaaugcacccggagaaguacuacuaaaucuagaauuaggaccagaauuaaaucccuauuuagcucauuuagcacgcauguauaacggauacgcugguggaauggaaguccaaguuaugcuugcaggaaaugcauuuacagcaggaaaauuaguuuuugcagcuguuccuccacacuuuccaguugaaaaucuaucuccacaacaaauaacaauguuuccucacguaauaauagacguucguacccucgaaccaguacuacuuccacuaccagauguacgaaacaauuucuuucacuauaaccaaaaagacgacccaaaaaugagaauagucgccaugcuuuacacaccacuuagaucaaaugguucaggugaugauguauuuacaguauccugcagaguacuaacaagaccaucaccugauuuugacuuuacauaucuuguacccccaacagucgaaucuaaaacaaaaccauucacuuuaccaauacuaacacuaggagaacuaucaaauucaagauuuccagucucaauagaccaaauguacacauccccaaaugaaguaaucucuguacaaugccaaaauggaagaugcacccucgauggugaacuccaaggaacuacacaauuacaaguaucaggaaucugugccuucaaaggagaaguaacagcacacuuacaugauaaugaccauuuauacaaugucaccauaacaaauuuaaacggaucaccauucgacccuucagaagauauuccagccccacucgguguaccugacuuucaagguagagucuucggaguaauaucacaaagagauaaacacaucgcaucaggacauaaugaaccagcuaaccguggacacgacgcaguuguacccacauauacagcccaauacaccccuaaauuaggacaaauacagauagguacauggcaaacugacgaucuaacaguaaaccaaccuguaaaauucacacccgucggauuaaaugauacagaucauuuuaaccaaugggucgucccuagauaugcuggagcucuuaauuuaaacaccaaucucgcaccaucagucgcuccaguauuuccuggagaaagauuauuauucuuucgaucauacauuccuuuaaaaggcggauacggaaauccagccauagauugccuccuaccccaagaauggguucaacauuucuaucaagaaucagcuccaucaaugucagaaguagcccuaguaagauauauaaacccugacacaggacgagcauuauucgaagcaaaauuacaucgcgcaggauuuaugacagucucaucuaacacaucugcaccagucguaguaccagccaauggcuauuuucgauucgauuccuggguaaaucaauuuuacucccuagcaccaaugggcacaggaaacgguagaagaagauaa

SEQ ID NO: 33447 - RNA, 1623 nt, Artificial Sequence
  derived and/or modified sequence opt6 from VP1__Norovirus_and/or_Norovirus-like__AB662868
augaagauggcaucaaaugacgcagcaccuucaacagacggugcagccggauuaguaccugaaucaaacaaugaaguaauggcuuuagaaccaguagccggugcagcacuagcagccccuguaaccggacaaacaaauauuauagacccauggauacgugcuaacuucguacaagccccaaacggcgaguucacaguuucaccaagaaacucuccaggcgaaguauuauuaaauuuagaauuaggaccagaauuaaacccauaucuagcacauuuagcacgaauguauaacgguuaugccggagguauggaaguccaaguaauguuagccggaaacgccuucacagcaggaaagcuaguauucgcagcaguaccaccacacuuuccaguagaaaaucuaucaccgcaacaaauaacuauguuuccccacguaauaauugauguaagaaccuuagaaccaguacuauuaccacuaccagacgucagaaauaacuucuuucauuauaaucaaaaagaugauccuaaaaugagaauaguagcaaugcuauacacaccacuccguucuaauggaucaggagaugacguauuuacugucucuugucgaguccuuacaagaccaucaccagauuucgacuucacauaccuaguaccucccacagucgaaucaaaaaccaaaccguucacauuaccaauccuaacccucggagaauuaucaaacuccagauucccaguaucaauagaucaaauguauaccucaccaaaugaaguaauaaguguccaaugucaaaacggacgauguacgcuagacggagaacuucaaggaacaacccaacuacaaguauccggaauuugcgcauuuaaaggagaaguaacagcacaucuucacgauaacgaacaccuauacaauguaacaauaauaaaucuaaacggaaguccauuugauccaucagaagauauaccugcaccauuaggaguaccggauuuccaaggaagaguuuucggaguaaucucacaaagagauaaacacaauacuccaggacauaacgaaccagcaaauagagcucacgaugcaguagucccaacauacaccgcacaauauacaccaaaauuaggccaaauucaaauagguacauggcaaacagaugaucuaacaaacaaucagccagugaaauucacaccaguaggacuaaacgacacagaacacuuugaccaaugggucguaccuagauacgcaggagcacuaaacuuaaauacaaaccuagcaccaucaguagcaccaguauuuccuggagaaagauuauuauucuuucgaucauauaucccauuaaaaggaggauauggaacuccugcaauagauuguuuacuaccucaagaauggguacaacauuucuaccaagaagcagcuccuucuaugucagaaguagcccucguucgauacauaaacccagacacaggacgagccuuauucgaagcaaaacuucaucgagcaggauuuaugacaguuucaaguaauacaucagcaccagucguagucccugccaauggauauuuuagauuugacucauggguaaaucaauuuuacucacucgcaccaauggguacaggcaacggaagaagaagauaa

SEQ ID NO: 33448 - RNA, 1623 nt, Artificial Sequence
  derived and/or modified sequence opt6 from VP1__Norovirus_and/or_Norovirus-like__AB662861
augaaaauggcaucaaaugaugcagucccaucaacagacggcgcugcuggucuaguaccagaaucaaauaaugaaguaauggcauuagaaccaguagcuggugccgcauuagccgccccuguaaccggacaaacuaauauaauagauccuuggauucgcgcaaacuucguacaagcuccaaacggugaauuuacaguuucuccacgaaauaguccaggcgaaguacugcuuaaccuagaguuagguccugaacuaaacccuuacuuagcacauuuagcaagaauguauaauggcuacgcaggaggaauggaaguucaaguaaugcuagcaggaaacgccuuuacagcaggcaaauuaguuuucgcugcgguacccccacacuuuccaguagaaaacuuauccccacaacaaaucacaauguucccacauguaauaauagauguacgcaccuuagaaccagucuuacuaccacuaccagacguaagaaacaauuucuuucauuauaaccaaaaagacgauccuaaaaugagaauugucgcaaugcuauauacuccacuaagaucaaauggaucuggcgacgacguauuuacaguaagcuguagaguacucacaagaccaucuccagauuuugauuuuaccuauuuaguaccaccuacaguagaaucaaaaacuaaaccauuuacacuaccaauacuaacacuuggagaacuuuccaauucacguuuucccguaagcauagaccaaauguacacaucaccaaaugaaguaaucucaguacaaugucagaacggucgaugcacauuagacggagaacuucaaggaacaacccaacuacaagucucaggaauaugugcauuuaaaggugaaguuacagcacaccuccaugacaaugaacauuuauauaauguaacuauaacuaauuuaaauggaucuccauuugaucccagugaagauauaccagccccuuuaggcguacccgauuuucaaggaagaguauuuggagucauaagucaaagagauaaacauaauacaccaggacauaaugaaccagcaaaucgagcccaugaugcagucguaccaacauauacagcucaauacacaccuaaacuaggccaaguacaaauuggaacauggcaaacagacgauuuaacagacaaucaaccuguaaaauuuacaccuguagguuuaaaugauaccgaacacuuuaaccaauggguagucccccgauaugcaggagcauuaaacuuaaacacaaauuuagcaccaucaguagcaccuguauuuccaggugaaagacuauuauucuuucgaucauacauaccauuaaaaggaggauauggcacaccagcaauagauuguuuacucccacaagaauggguacaacauuucuaucaagaagcagcuccauccauguccgaaguagcccuaguaagauauaucaauccugauaccggcagagcacuauuugaagcaaaauuacaccgagcaggauuuaugacuguaucuucaaauacuucugcucccguuguaguacccgcaaauggauacuucagauucgacagcuggguaaaccaauucuauucacuagcaccuaugggaacuggaaauggaagaagacguuaa

SEQ ID NO: 33449 - RNA, 1623 nt, Artificial Sequence
  derived and/or modified sequence opt6 from VP1__Norovirus_and/or_Norovirus-like__LC145791
augaaaauggcuucaaacgaugucgcuccuagcacagacggagcugcugggcuaguaccagaaagcaauaaugaaguaauggcuuuagaaccaguagcaggagcagcucuagcugcacccguaacaggacaaacaaacaucauugacccauggauaagagcaaacuuuguacaagcuccaaauggcgaauuuacaguaucaccuagaaauucaccaggagaaguacuacuaaaccuagaacucggaccagaauuaaauccauaccuugcacauuuagcaagaauguauaacgguuaugccggugguauggaaguucaaguaaugcuugcaggaaacgcuuuuacugcaggaaaauuaguauuugcugcuguacccccacauuuuccaguagaaaaccuaagcccacaacaaaucacaauguuuccucauguaauaauagauguaagaacacucgaaccaguuuuauuaccucuaccagauguaagaaauaauuucuuucauuauaaucaaaaagacgacccaaaaaugagaauaguagcgauguuauacacaccacuacguuccaacgguaguggugacgaugucuuuacaguaucaugcagagucuugacacgaccuucuccagacuuugacuucacauauuuaguaccuccuacaguagaguccaaaaccaaaccauuuacacuaccaauuuuaacacuaggagaauuaucaaacucaagauucccaguaucaauagaccaaauguauacauccccuaaugaaguuauaucuguacaaugucaaaaugguagauguacacuagacggcgaauuacaaggaacaacacaauuacaaguuucaggaauaugugcauuuaaaggugaaguaacagcacaucuacacgauaacgaucauuuauacaacguaacaauuaccaauuuaaacggauccccauucgacccuucagaagauauaccagcaccauuaggaguaccagauuuccaagguagagucuucggaguuauaucacaaagagacaaacauaacacuccaggccauaaugaaccagcaaauagagcacacgaugcaguuguaccuacauauacagcacaauauacaccaaaauuaggacaaauacaaauuggaacuuggcaaacagacgaucuuacaguuaaucaaccaguaaaauucacaccaguaggucuuaaugauacugaucauuucaaccaaugggucguacccagauaugcaggagcauuaaaucuaaauacaaauuuagcaccaucaguagccccaguauucccaggugaacgucuacuauucuuuagaucauauaucccacucaaagguggcuaugguacacccgcaauagacuguuuauuaccacaagaauggguucaacauuuuuaucaagaagcagcucccuccaugucugaaguagcccuuguaagauacaucaauccagacacaggucgagcucuauuugaagcaaaacuacauagagcaggauucaugacuguguccucaaauacaagugcaccagucguaguuccagcuaauggauacuucagauuugauucuuggguaaaucaauucuauucauuagcaccaaugggaacugggaacggucgaagacgauaa

SEQ ID NO: 33450 - RNA, 1623 nt, Artificial Sequence
  derived and/or modified sequence opt6 from VP1__Norovirus_and/or_Norovirus-like__LC145790
augaaaauggcuucaaacgaugccgcuccaucaacagacggagcugcuggucuaguaccagaaucaaauaaugaaguaauggcacuagaaccagucgcuggugcagcucuagcugcaccaguaacaggacaaaccaauaucauagacccuuggauuagagcaaauuucguacaagcccccaauggagaauuuacaguuucaccacgaaauucaccaggcgaaguucuacuaaauuuagaauuaggaccagaacuaaacccauaccucgcucaccuagcaagaauguauaacgguuaugccggcggaauggaaguccaaguaaugcuagcaggcaacgcuuucacagcagguaaacuuguuuucgcugcaguucccccacauuucccuguugaaaaccuaucaccacaacaaauaacuauguucccacacguaauaauagaugucagaacacuagaaccaguucuacuacccuuaccagacguacguaauaacuucuuucauuauaaccaaaaagaugacccaaaaaugagaauuguagccauguuauacacaccauuaagaagcaauggaucaggcgacgaugucuuuacaguuucaugucgaguuuuaacuagaccaucaccugacuuugacuuuaccuacuuaguacccccaacugucgaaucaaaaacaaaaccauucacacuaccuauacuaacacucggagaacuaucaaacuccagauucccaguaucaauagaucaaauguacacuucuccaaaugaaguaauaucaguucaaugucaaaacggaagauguacacucgauggagaacuccaaggcacuacacaacuacaaguuucaggaauaugugcauuuaaaggagaaguuacagcucacuuacacgauaacgaccauuuauacaaugucacaauaacaaaccuaaacggcucuccauuugaccccucagaagacauaccagcuccacuaggaguaccagacuuucaaggucgaguauuuggcgucauaucucaaagagacaaacacaacacuccuggucacaaugaaccagcaaauagggcucaugaugcaguaguuccuacuuauacagcacaauacacaccuaaacuaggacaaauacaaauaggaacauggcaaacagaugauuuaacuguaaaccaaccaguaaaauucacaccuguuggacuaaacgacaccgaucauuuuaaccaauggguaguacccagauaugcaggcgcuuuaaaucuuaauacaaacuuggcuccaucaguagcaccagucuuuccaggagaaagacuacuauucuuccgaucauacauaccauuaaaaggagguuauggcaccccagcaauagauugccucuuaccacaagaauggguucaacauuucuaucaagaagcagcaccaucaaugucugaaguagcauuaguccgauacauaaauccugauacaggccgcgcacuauucgaagcuaaacuacauagagcuggauuuaugacaguaucaucaaauacaucagcaccaguaguaguacccgccaacggauauuuuagauucgauuccuggguaaaucaauuuuacucucuugcaccaaugggaacagguaauggaagaagaagauaa

SEQ ID NO: 33451 - RNA, 1623 nt, Artificial Sequence
  derived and/or modified sequence opt6 from VP1__Norovirus_and/or_Norovirus-like__LC145793
augaaaauggcaaguaacgacgcugcaccaucaacagacggagccgccggcuuaguaccagaaucaaacaaugaaguaauggcacuggaaccagucgcugguguagcauuagcugcaccaguuacaggacaaaccaauauaauagacccuuggauaagagcaaauuuuguacaagcaccaaacggagaauuuacaguaucaccccgaaauucaccaggagaaguacuauuaaauuuagaauuaggaccagaauuaaaucccuacuuagcccaccuagcaaggauguauaaugguuacgcugguggaauggaaguacaaguaaugcucgcaggaaacgcuuuuaccgcagguaaauuaguauuugcagccguaccaccacauuuuccaguugaaaaucuaucaccacaacaaauaacaauguuuccucacguaauaauagauguacgaacucuagaaccaguccuucuaccacuuccagauguaagaaauaauuucuuucacuauaaucaaaaagaugaccccaaaaugcgaauaguagcaauguuauacacaccccuacgaucaaauggaagcggagaugauguauuuaccguaucaugucgaguacuaacaagaccauccccugacuuugacuuuacauaccuagugccaccuacaguugaaucaaaaacaaaaccauuuacacuucccauauuaacauuaggugaauuaucaaacuccagauucccaguuucaauagaucaaauguauaccucuccaaaugaaguuauaucuguccaaugccaaaauggucgauguacacucgacggagaacuucaagguacaacccaguuacaaguaucagguauaugugcauuugaaggagaaguaacugcacauuuacacgauaaugaucaccuauauaauguaacaauaacuaaucuaaacgguucaccauucgauccaucagaagauauaccagcaccuuuaggaguaccagacuuucaaggaagaguauucggcguaauaucacaacgagauaaacauaacaccccaggucauaaugaacccgcaaauagagcacacgaugcaguaguaccaacauauacagcacaauauacaccaaaacuaggucaaauacaaauagguacuuggcaaacggacgaucuuacaguaaaucaaccaguaaaauuuacaccaguaggacuaaacgauacagaccauuucaaccaauggguaguaccaagauaugccggcgcucuaaacuuaaacaccaaucuagcacccucaguagcaccuguauuuccuggagaaagacuauuauucuuucgauccuauauaccacuaaaagguggcuauggaacuccagcaauagauugccuccuaccccaagaauggguucaacauuuuuaucaagaagccgcaccaucaaugucagaaguagcccuaguaagauauauaaacccagacaccggacgagcauuauucgaagcaaaacuccauagagcaggauucaugacaguaucaucaaacacaucugcacccguaguaguuccugcaaauggcuauuucagauucgauagcuggguuaaucaauucuauucauuagccccaaugggaacaggaaauggaagaagacguuaa

SEQ ID NO: 33452 - RNA, 1623 nt, Artificial Sequence
  derived and/or modified sequence opt6 from VP1__Norovirus_and/or_Norovirus-like__LC145792
augaaaauggcaucaaaugaugcagcaccuaguaccgacggagcagcaggucuuguaccagaaucaaacaacgaaguaauggcacuagaaccaguagccggugcagcccuagcagccccaguuacaggucaaacaaacauaauagacccauggauuagagcaaauuuuguacaagcuccaaacggagaauuuacagucucaccaagaaauucaccaggugaaguacuacuuaaucuagaacuuggaccggaacuuaaucccuaccuagcacacuuagcaagaauguauaauggauacgcaggaggaauggaaguccagguaaugcucgcaggaaaugcauuuacagcaggaaaauuagucuuugcagcaguuccaccacacuuuccaguagaaaauuuaucaccacaacaaauaacaauguucccacacguuaucauagaugucagaacauuagaaccuguacuacuuccauuaccagacguaagaaacaacuucuuucauuauaaccaaaaagaugacccaaaaaugagaauuguagccauguuauauacaccauuaagaucuaauggaagcggagacgauguauuuacuguuucauguagaguuuuaacacgaccuucaccagauuuugacuuuacauaucuaguaccacccacaguagaauccaaaacuaaaccauuuacacuaccuauucucacacuaggagaacuaucuaacucuagauuuccuguuucaaucgaccaaauguauaccucaccaaacgaaguuauauccguacaaugucaaaacggucguuguacacuugauggagaauuacaagguacaacacaauuacaagucucugguauuugcgccuuuaaaggagaaguaaccgcccacuuacacgauaaugaucacuuauauaacguaacaauuacaaaccuaaacggcucacccuuugauccaagugaagacauaccagcaccccuaggaguuccagacuuucaaggacgaguauucggaguaauaucucaaagagacaaacauaacacaccaggucacaaugaaccagcaaaucgcgcucaugaugcagucguaccuacauauacagcucaauauacuccaaaauuaggacaaauucaaauaggaacauggcaaacugacgaucuuacagugaaucaaccuguaaaauucaccccaguaggacuaaacgauacugaucacuuuaaucaauggguuuuaccaagauacgccggugcucuuaacuuaaacaccaaccuagcaccguccguagcaccgguauuuccaggggaacgucuauuauucuuucgcucauacauacccuuaaaaggaggauacggaacuccagcaauagauuguuuauuaccacaagaauggguacaacacuuuuaccaagaagcagcaccaucuaugucagaaguagcacucguacgauacauuaacccagauacaggcagagcauuauucgaagcaaaacuacaccgagcaggauuuaugacaguaucaucaaauaccucagccccaguaguuguaccagcaaacggauacuucagauuugauucaugggucaaucaauucuacuccuuagcaccuaugggaacagguaacggaagaagaagauaa

SEQ ID NO: 33453 - RNA, 1623 nt, Artificial Sequence
  derived and/or modified sequence opt6 from VP1__Norovirus_and/or_Norovirus-like__LC145797
augaaaauggcaucuaaugaugcugcaccaagcacagacggagcugcaggucuuguuccagaaucaaauaaugaaguaauggcacuagaaccaguagccggagucgcacucgcugcaccaguaacaggucaaacaaauauaauugauccauggauuagagcaaacuuuguaccagcuccaaacggagaauuuacagucaguccuagaaauagcccaggagaagucuuacuaaaucuugaacucggaccugaacuaaauccauaccuagcacaucuugcaagaauguauaauggauacgcaggagguauggaaguucaaguaaugcuagcagguaaugcauuuacagcaggaaaauuaguauuugcggcaguaccgccacacuucccagucgaaaauuuauccccucaacaaauaacuauguuuccacacguuauuauugacguaagaaccuuagaaccaguacucuuaccauuacccgauguaagaaauaauuucuuucauuauaaucaaaaagaugauccaaaaaugcgaauuguagcaaugcuauauaccccauuaagaucaaaugguucaggugaugacguauuuacuguaucuugcagaguucuaacacguccaucaccagauuuugauuuuacauacuuaguuccaccaacuguagagucuaaaacaaaacucuuuaccuuaccgauacuaacuuuaggugaauuaucaaauucacguuuucccguuucaauugaucaaauguacacuuccccaaacgaaguaauaaguguucaaugucagaauggaagaugcacguuagauggagaauuacaagguacuacacaauuacaaguaucaggcauaugcgcauuuaaaggagaaguaacagcacaucuccaugacaacgaucaucuauauaauguaacaauaacuaaucuaaauggaucacccuucgaccccuccgaagacauaccagcaccauuaggaguuccagauuuucaaggacgaguauuuggcguaauaucacaacgagacaaacauaauauuucaggacauaaugaaccugcuaacagagcacaugaugcaguaguuccaacuuauacugcacaauauacaccaaaauuaggccaaauacaaauaggaacauggcaaacugacgacuuaacuguaaaccaaccaguaaaauuuacaccaguagguuuaaacgacacagaucauuucaaucaauggguaguaccaagauaugcaggagcauuaaaucuaaauacaaaucuagcaccuucgguagcaccaguauuuccuggagaaagacuacuauuuuuccgaucauauauaccccuaaaaggcggauauggaacacccgcaauagauugucuauuaccacaagaauggguacaacauuuuuaccaagaagcugcaccaucaaugucugaaguagcucuaguaagauauauaaauccagacacugguagagcacucuucgaagcaaaacuucacagagcaggauucaugacaguaucaucuaacacuucagccccaguugucguuccagcuaacggauauuuucgguuugauucauggguaaaucaauuuuacucacuagcuccuaugggaacaggcaauggcagacgaagauaa

SEQ ID NO: 33454 - RNA, 1623 nt, Artificial Sequence
  derived and/or modified sequence opt6 from VP1__Norovirus_and/or_Norovirus-like__LC145808
augaaaauggcauccaaugacgcagccccaucuacagauggagcagcagguuuaguaccagaauccaauaaugaaguaauggcauuagaaccaguagcaggagccgcacuagcagcaccaguaacaggacaaacaaauauuauagaucccuggauaagagcaaauuuuguacaagcaccaaauggagaauuuacuguuucaccaagaaauucacccggagaaguucuacuaaauuuagaauuaggaccagaauuaaacccuuauuuagcccauuuagcaagaauguauaauggcuaugcaggagguauggaaguccaaguaaugcuagccggaaaugcuuuuacagcaggaaaacuuguauuugcagcaguaccaccacacuuuccuguugaaaaucuaucaccccaacaaaucacuauguuuccacacgucauaauagauguaagaacucuugaaccuguacuucucccauuaccagauguacguaauaacuuuuuccacuauaaccaaaaagaugauccaaaaaugagaauagucgcaauguuauacacaccauuaagaaguaacggaucaggagacgacguauuuacaguauccugcagaguauuaacaagaccaucaccugauuucgacuuuacauaucuaguaccuccaacuguagaauccaaaacuaaaccauucacuuuaccaauucugaccuuaggugaauuauccaauucccgauuuccuguaagcauagaucaaauguauacaucaccuaaugagguuauaucaguacaaugucaaaauggacgaugcacacuagacggagaauuacaaggaacaacucaauuacaaguaucaggcauaugcgcauucaaaggugaaguuaccgcucaucuacaugauaaugaccaccuauauaacguuacgauaaccaaccuuaacggaucaccauuugauccaucagaagacauaccugccccacuaggcgucccagacuuucaaggacguguauucggaguuauuucacaacgagauaaacacaaugcaccaggccacaacgaaccagccaaucgagcacacgaugcagucguaccaacauacacagcucaauauacaccuaaauuaggucaaauacaaauaggaacauggcaaacugacgauuuaacaguaaaccaaccaguaaaauucacaccuguuggacuaaaugauacugaucauuuuaaccaauggguaguaccaagauaugcaggagcuuuaaaccuaaacacaaauuuagcaccaucaguagccccaguauucccaggugaacgauuacuauucuuuagaucuuauauaccacuaaaagguggauacggaacaccagccauagauugucuacuaccacaagaauggguucaacauuucuaucaagaagcugcuccaucaaugucugaaguagcccuaguaagauauauaaacccagacacaggcagagcacuuuuugaagcaaaacuacaucgugcaggauuuaugacaguaagcucaaauaccuccgcaccugucgucguaccagcaaacggauacuuucgauuugauucuugggucaaccaauucuacucacuagcaccuauggguacaggcaauggaagaagaagauaa

SEQ ID NO: 33455 - RNA, 1623 nt, Artificial Sequence
  derived and/or modified sequence opt6 from VP1__Norovirus_and/or_Norovirus-like__LC145801
augaaaauggcauccaaugacgcugcgccauccacagauggagcagccggccuagucccagaaucaacaaaugaaguaauggcacucgaaccaguagcaggagcagcacuagcugcaccaguaacaggacaaacaaauauuauagacccauggauaagagccaacuucguccaagccccaaacggagaauuuacaguaucuccccgaaacuccccaggagaaguucucuuaaacuuagaauuaggaccagaacuaaauccauauuuagcucacuuagcucguauguacaacggauaugcaggagguauggaaguucaaguaauguuagcaggaaacgcuuucacugcaggaaaacucguauucgccgcuguaccaccucacuuuccaguagaaaaucuaucaccacaacaaauuacuauguuuccacauguaauaauagauguccgcacacuagaaccaguauuacuaccauuaccugacguuagaaauaauuucuuucacuacaaucaaaaagacgauccuaaaaugagaauuguagcaauguuauauacaccacuaagaucaaacggcucaggugacgacguauuuaccguaucaugucgaguacucacaagaccaucaccugauuuugauuucacauaucucguaccuccaacagucgaaucaaaaacaaaaccauucacacuaccaauuuuaacacucggagaacucuccaauagucgauuucccgucucaauagaucaaauguauacaucuccaaaugaaguaauuuccguacaaugccaaaacggaagauguacuuuagauggagaauuacaaggaacaacacaauuacaaguauccggaauaugcgcauuuaaaggagaaguaacagcucauuuacacgacaacgaccaccuauacaacgucacuaucaccaaucuaaacggaucuccauuugacccaucugaagauauccccgcaccacuaggagcuccugacuuccaaggacgaguauuuggcguaauuucacaaagagauaaacacaacacccccggucacaacgaaccagcaaaccgagcucacgacgcaguaguuccuacauauacagcacaauacacacccaaauuaggacaaauacaaauaggaacauggcaaaccgaugauuuaacaguaaaucaaccuguuaaauucacuccaguaggauuaaaugacacagaccauuucaaucaauggguaguaccaagauaugccggagcacuaaaccuaaauacaaacuuagcacccucaguagcacccguauuuccaggugaaagauuauuauucuucagauccuacauaccauuaaaaggaggauauggaacaccagcaauagauugccucuuaccucaagaauggguacaacauuuuuaccaagaagcagcaccaucaaugucugaaguugcauuaguacgcuacauaaacccagauacaggacgagcauuauuugaagcaaaacuacaccgugcaggauuuaugacaguuuccucaaacacaucagcacccguuguaguaccagcaaacggauauuuuagauuugauucuugggucaaucaauuuuauucacuagcaccaauggguacaggaaacggaagaagaagauaa

SEQ ID NO: 33456 - RNA, 1623 nt, Artificial Sequence
  derived and/or modified sequence opt6 from VP1__Norovirus_and/or_Norovirus-like__AB662884
augaaaauggcuucaaaugaugcugccccaucaaccgacggagcagcaggucuaguaccugagucaaacaaugaaguaauggcacuagaaccaguagcaggagcagcucuagccgcaccaguuacaggacaaacuaauauaaucgacccauggauaagagcaaauuucguccaagcaccaaauggcgaauuuacaguaucccccagaaauucuccaggugaaguauuauuaaacuuagaauuaggaccagaauuaaauccauauuuagcccaucuagcacgaauguacaacggauacgcaggagguauggaaguacaagucaugcuagcuggaaaugcguuuacagccggcaaauuaguauucgcagcaguaccuccacauuuuccagucgaaaaucuaucaccacaacaaauaacaauguucccgcacguuauaauagacguaagaacacuagaaccaguacuauuaccacuccccgacguaagaaacaacuucuuucacuauaaucaaaaagacgacccaaaaaugcguauagucgcaauguuguacacuccauuaagaucuaacggaucaggagaugauguuuuuacaguuucaugcagaguacuaacucgaccaaguccagauuucgauuucaccuauuugguaccuccuacaguugaaucaaaaacaaaaccauucacucuaccaauauuaacauuaggagaacuaucaaacucuagauuuccaguaucaauagaucaaauguauaccucaccaaaugaagucauauccguacaaugccaaaauggcagaugcacauuagauggagaauuacaaggaacaacucaacuacaaguuucaggaauaugcgcauuuaaaggagaaguaacagcucaccuucaugauaaugaucaccuuuauaauguaacaauaacaaacuuaaauggcagcccauuugacccaucagaagauauuccugcaccauuaggaguaccagauuuccaaggaagagucuuuggaguaauaucucaaagagacaaacauaauacacccggacauaaugaaccagcaaacagagcucaugacgcaguaguaccaacuuauacagcgcaauauacaccuaaauuaggacaaauccaaauaggaacauggcaaacagacgaucugacaguaaaccaaccaguaaacuucacuccaguuggauuauccgauacggaucacuuuaaccaauggguaguaccuagauaugcaggcgcacuaaauuuaaacacuaauuuagcaccaucuguagcuccaguauuuccaggagaacgacuuuuauuuuucagaaguuacauaccacucaaaggaggauauggaaccccugcaauagacuguuuacuaccccaagaauggguucaacauuuuuaucaagaagcagcacccucaaugucugaaguugcauuaguacgcuauauaaacccagacacaggcagagcauuauuugaagccaaauuacacagagcaggcuucaugacaguaucuucaaauacaucagcaccuguaguuguaccugcaaauggcuauuucagauucgacucauggguuaaucaauuuuacucccuagcucccaugggaacuggcaauggcaggcgacgauaa

SEQ ID NO: 33457 - RNA, 1623 nt, Artificial Sequence
  derived and/or modified sequence opt6 from VP1__Norovirus_and/or_Norovirus-like__LC145802
augaaaauggcuucaaacgaugcagcaccaucaacagauggagcagcaggauuagucccagaaucaaauaaugaaguuauggcauuagaaccagucgcaggagcugcacuagcugcaccaguaacuggccaaacaaauauaauugauccuuggauaagagcuaauuuuguacaagcaccaaacggcgaauuuaccgucucaccuagaaauucaccuggggaaguacuacuuaaucucgaauuaggaccagaacuaaauccauaucucgcacauuuagcccguauguauaauggacaugcugguggaauggaaguacaaguaauguuagcaggaaaugcauuuacugcaggaaaacucguuuuugcagcaguaccaccacauuuuccuguagaaaaccuaucuccacaacaaauaacaauguuuccacauguaauaauagacgucagaacucuagaaccgguauugcuaccacuaccagauguucgaaauaauuucuuucauuacaaucaaaaagaugauccaaaaaugagaauaguagcaauguuauacacaccacuaagaucuaauggaucuggagaugacgucuuuacuguuucauguagaguacuaacuagacccucaccagauuucgaauuuacauaucuugucccaccuacuguagaaucgaaaacaaaaccauuuacuuuaccaauauuaacauuaggagaacuuucaaacucaagauuuccaguuucuauugaccaaauguauacauccccaaaugaaguuaucucaguacaaugccaaaaugguagauguacauuagauggugaacuucagggaacaacacaacuacaagcaucaggcaucugugcuuucaaaggagaaguaacugcacauuuacaugacaacgaucaccuauauaauguuacuauuacaaauuuaaauggaucacccuuugauccaucagaagauauaccagcucccuuaggaguaccagacuuccaaggaagaguuuuuggaguaauaucacaaagagauaaacauaacgcaccaggacauaacgaaccugccaauagagcccaugaugccguaguaccuacauauacagcacaauauacuccaaaauuaggccaaauccaaauuggaacauggcaaacugaugaucuaacaguaaaccaaccugucaaauuuacuccaguaggacuaaacgauacagaccacuuugaucaauggguaguaccuagauaugcaggcgcacuuaaucuaaauacaaauuuagcucccucaguugcaccuguauucccuggagaacgacuuuuauuuuuccgaucuuacauccccuuaaaagguggauacggcacuccugcaauagauugucuucuaccacaagaauggguacaacauuuuuaucaagaagcugccccaucaaugucugaaguagcacuuguacgauauauaaacccagauacaggccgagcacuauuugaagcaaaacuucaucgagcaggauuuaugacagucagcucgaauacaucugcuccaguaguuguaccagcaaauggauacuuuagauuugauuccuggguaaaucaauuuuacucacuugcaccaaugggaaccggcaauggaagaagaagauaa

SEQ ID NO: 33458 - RNA, 1623 nt, Artificial Sequence
  derived and/or modified sequence opt6 from VP1__Norovirus_and/or_Norovirus-like__AB662897
augaaaauggccucaaaugaugcagcaccuucaacagacggagcugcagguuuaguaccugaaaguaauaaugaaguuauggcacuagaaccaguagcaggagccgcacuugcagcaccaguaacaggccaaacaaauauaauagauccauggauaagagcaaauuucguacaagcuccaaauggcgaauuuacaguuucaccgcgaaacucacccggagaaguuuuauuaaauuuagaauuaggaccugaauuaaauccauaucuagcacaccuagcaagaauguauaauggauaugcaggaggaauggaaguacaagucaugcuagcagguaaugcuuuuacugcaggcaaauuagucuucgcagcagucccaccccauuucccuguagaaaaccuuucuccacaacaaauaaccauguuuccacauguaaucauagauguaagaacauuagaacccguacuacuaccauuaccagacguuagaaacaauuucuuucauuauaaccaaaaagaugauccaaaaaugcgaauaguagccaugcuguacacaccuuuaagaucaaacgguucaggugaugacguauuuacaguauccuguagaguacuaacacgcccaucacccgauuuugacuuuacauacuuaguaccacccacaguagaaucaaaaacaaaaccauuuacauuaccaauacuaacccuaggagaacuuucaaacucacgauucccaguaucaauagaucaaauguauacaucuccuaacgaaguaauaucuguacaaugucagaacggucgauguacauuagacggugaauuacaaggcacaacccaauuacaagucucuggaauaugugcuuuuaaaggagaaguaacagcacacuuacacgacaaugaccacuuauacaauguuacuauaacaaacuuaaauggaucaccauucgauccaucggaagacauaccagcaccacuagguguuccagacuuucaagguagagucuuugguguaauaucacaacgagacaaacacaauacaccuggacauaaugaaccagcaaauagagcacacgaugccgucguaccaaccuauacagcccaauauaccccaaaacuaggacaaauacaaaucggaacauggcaaacagaugaucuaacagucaaucaaccaguaaaauucacacccguagguuuaaaugacacugaucacuuuaaccaauggguagucccaagauacgcuggagcacuuaaucuaaauacuaacuuagcuccaucaguagcaccaguauuucccggagaaagacuacuauucuucagaucauacauaccccuaaaaggagguuacgguacaucagcaauagauuguuuauuaccucaagaauggguacaacauuuuuaccaagaagcagcuccaucaaugucagaaguagcccuaguacgcuacauuaacccugacacagguagagcauuauuugaagcaaaauuacaucgugcaggauuuaugacaguaucaucaaacacaucugcaccaguaguaguaccagcaaacggcuauuuccgauucgacagcuggguaaaccaauuuuauucacuagcuccuaugggaacaggaaacggacgcagaagauaa

SEQ ID NO: 33459 - RNA, 1623 nt, Artificial Sequence
  derived and/or modified sequence opt6 from VP1__Norovirus_and/or_Norovirus-like__AB662899
augaaaauggcuuccaaugaugcagcuccauccacagacggcgcagccggauuaguaccugaaucaaacaaugaaguaauggccuuagaaccaguugcaggagcagcauuagcagccccaguaacaggacaaacaaauauaauagaucccuggauuagagcaaacuuuguacaagcaccaaauggagaauuuacaguuucaccacgaaauucaccuggcgaagucuuauuaaaucuagaauuaggcccagaauuaaauccauaccuagcucauuuagcaagaauguauaacggcuacgcuggaggaauggaaguucaaguaauguuagccggaaaugcauuuacagcagguaaacuuguauuugcagcagucccaccucacuuucccguugaaaaucucucaccucaacaaauaaccauguucccacauguaaucauagacguaagaacauuagaaccaguacucuuaccauuaccagacguaagaaauaacuucuuucacuacaaccaaaaagaugacccuaaaaugagaauaguugcaaugcucuauacaccauugagaucaaacgggucaggugacgauguauuuacuguaaguugucgaguucuaacaagaccauccccagacuuugacuuuacauaccuagucccaccaaccguugaaucaaaaacaaaaccauuuacacuaccaauacuaacucuaggagaauuaucaaauucuagauuuccaguaucaauagaucaaauguauacaaguccuaacgaaguaauaucaguacaaugucaaaauggacgauguacauuagauggagaacuacaaggaaccacccaauuacaaguuucaggaaucugugcuuuuaaaggagaaguuacagcucaccuacacgauaacgaucacuuauacaacguaaccauaacaaacuuaaacggaucaccauuugauccaucagaagauauaccagcaccacuuggcguacccgacuuccaaggaagaguauuuggaguaauuucucaacgagacaaacauaacacuccuggucauaacgaaccagcaaauagagcccaugacgcagucguaccuacauauacagcucaauauacaccaaaauuaggacaaauacaaauagguacauggcaaacagaugauuuaacuguaaaucaaccagucaacuucacuccuguaggcuuaaacgacacagaucauuucaaccaauggguuguaccacgauaugcaggagccuuaaaccuaaacaccaaccuagcacccucaguugcaccuguauuuccaggcgaacgcuuacucuucuuccgaucauacauaccacuuaaaggaggauacggcacacccgccauagauuguuuacucccacaagaauggguucaacacuucuaucaagaagcagcacccucaaugucagaaguagcauuaguacgauauauaaacccagacacugguagagcauuauucgaagcaaaauuacacagagcaggcuuuaugacagucucaucaaauacaagugcaccaguagucgucccugccaaugguuauuucagauucgauucauggguaaaucaauuuuauucacuagcaccaaugggaaccggaaauggcagaagacgauaa

SEQ ID NO: 33460 - RNA, 1623 nt, Artificial Sequence
  derived and/or modified sequence opt6 from VP1__Norovirus_and/or_Norovirus-like__AB662894
augaaaauggcuucaaaugaugcagccccaaguacagacggagcagcaggccuaguaccugaaucaaauaaugaagucauggcacuagaaccaguagcaggagcagcacuagcagcuccagucacaggacaaacaaauaucauugacccauggauccgagcaaauuuuguacaagccccaaauggugaauuuacaguaucaccaagaaacucaccaggugaaguauuacuaaaucuagaacuagguccagaacucaacccauaccuugcacauuuagcaagaauguacaacggauaugcugguggaauggaaguacaaguuaugcuagcaggaaacgcguucacugcuggaaaauuaguauucgcagccguaccuccucacuuuccaguagaaaaucuaucuccucaacaaauuacaauguucccacacguaauaauagacguacgaacacuagaacccguucuccuaccacuaccagauguacgaaacaauuucuuucacuauaaccaaaaagaugauccaaaaaugagaauuguagcaaugcuuuauacuccacuucgaucaaacggaucaggagacgacguuuuuaccgucucaugccgaguauuaacacgaccaucaccugacuuugauuucacauaucuaguaccuccaacaguagaaucuaaaaccaaaccauucacccuaccaauacuuacacuaggcgaauuauccaauuccagauuuccaguuucaauagaucaaauguauacaucaccaaaugaagucauaucaguacaaugucaaaacgguagguguacacuagauggagaauuacaaggaacaacacaauuacaaguauccggaauaugcgccuuuaaaggagaagucacagcucacuuacaugauaaugaucaccuauacaacgucacaaucacaaauuuaaacgguucaccauucgauccauccgaagacauaccagcaccccuaggaguaccugauuuucaaggaagaguauuuggagucauaucccaacgagauaaacauaauacaccaggccauaacgaaccagcaaauagagcacaugaugcuguaguaccaacauacacagcacaauacacaccuaaacuaggacaaauacaaauagguacauggcaaacagaugauuuaacuguaaaucaaccggcaaauuuuacuccaguaggucuaucagauacagaccauuuuaaccaauggguagucccacguuacgcaggcgcauuaaauuuaaacacaaaucuagccccuucaguagcuccaguuuucccaggagaaagacuauuauucuuuagauccuacaucccacuuaaaggagguuauggaaccccagcuauagauugcuuauuaccacaagaauggguacaacauuuuuaucaagaagcagcaccaucaaugucagaaguagcauuaguacguuauauuaauccagacacuggacgagcauuauuugaagcaaaauuacauagagcaggauuuaugacagucucuucuaauaccucagcaccaguuguaguaccugcaaaugguuauuucagauucgacuccuggguuaaucaauuuuauucccuugcaccuaugggaacagguaauggaagacgaagauaa

SEQ ID NO: 33461 - RNA, 1623 nt, Artificial Sequence
  derived and/or modified sequence opt6 from VP1__Norovirus_and/or_Norovirus-like__LC145803
augaaaauggcaucaaaugaugcugcaccaucaacagacggagcagcuggauuaguaccugaaucaaacaaugaaguaauggcucuugaaccaguagcaggagcagcacuagcagccccagugaccggucaaacaaauauaauagauccuuggauacgcgcaaacuuuguacaagcaccuaacggugaauuuacaguaagcccaagaaauaguccaggagaaguauuauuaaauuuagaacuuggaccugaacuuaauccauaccuugcacaucucgccagaauguauaauggauaugcuggugguauggaaguacaaguaaugcuagcaggaaacgcauucacugcugguaaauuaguauuugcagcaguaccaccacauuucccuguagaaaacuuaagcccccaacaaauuacuauguucccacauguaauaauugauguaagaacucuugaaccaguauuacuaccucuaccagacguaagaaauaauuucuuccacuacaaucaaaaagaugauccuaaaaugcgcauaguugccaugcuauacacuccacuaagaucaaacggaucaggugaugacguauuuacaguauccugcagaguccuuacaagaccaucaccagacuucgauuuuacauauuuaguaccaccuacagucgaaaguaaaacaaaaccauuuacacuuccuauuuuaacgcucggcgaacuaagcaauucacgauuuccuguauccauagaucaaauguauacaucuccaaaugaagucauuaguguacagugucaaaauggaagaugcacuuuagacggugaauuacagggaacaacacaacuucaaguauccggaauaugcgccuucaaaggagaagucacagcucaccuccaugauaacgaucauuuauacaauguaacaauaaccaauuuaaauggaucaucuuuugacccaucagaagacauaccagccccauuaggaauacccgacuuucaaggacgaguuuuuggaguaauuucccagcgagauaaacauaauacacccggacauaaugaaccagcaaacagagcccaugaugcaguaguaccaacauacacagcacaauauacuccaaaacuaggacaaauucaaauaggaacauggcaaaccgaugauuuaacaguaaaucaaccuguaaaauuuacacccgucggauuaaaugauacugaucauuucaaucaauggguaguuccaagauacgcaggagcuuuaaaucuaaauacaaacuuagcuccaucagucgcaccuguauuuccaggagaacgauuauuauuuuucagaagcuauauuccucuaaaaggaggauauggaacuccagcaauagacugucuauuaccacaagaauggguucaacauuucuaucaagaagcagccccaucaauguccgaagucgcauuaguucgauauauaaauccagauacaggcagagcuuuauuugaagcaaaacuacauagagcaggauuuaugacugucagcucuaauacuucugcaccaguaguagucccagcaaauggauauuuuagauuugauucauggguaaaccaauucuauucuuuagcaccaaugggaacaggaaacggacgacgaagauaa

SEQ ID NO: 33462 - RNA, 1623 nt, Artificial Sequence
  derived and/or modified sequence opt6 from VP1__Norovirus_and/or_Norovirus-like__AB662889
augaaaauggcuaguaaugaugcagcaccaucaacagacggcgcagcaggacuugucccggaaucaaacaacgaagucauggcauuagaaccaguagcaggagcagcauuagcagcaccaguaacaggccaaacaaauauuauagauccauggaucagagcaaacuuuguucaagcuccaaacggcgaguuuacagucucaccuagaaacuccccaggagaaguccuauuaaauuuagaacuaggacccgaauuaaaucccuauuuagcacauuuagcaagaauguauaacggauacgcaggaggaauggaaguacaagucaugcuagcaggcaaugcauuuacagccggaaagcuagucuuugccgcaguacccccacauuuuccuguagaaaauuuaucuccccaacaaauaacuauguucccucauguaauuauugaugucagaacccuagaaccaguacuucuaccauuaccagauguucgaaauaacuucuuucauuacaaccaaaaagacgaccccaaaaugagaauaguagccauguuauauacaccccuuagaucaaacggaucaggugacgaugucuuuacaguaucaugccgaguauuaacaagaccuagcccagacuuugauuuuacauauuuaguaccaccaacaguugaaucaaaaaccaaauccuuuaccuuaccaauauuaacauuaggagaacuuuccaacucacguuuuccaguaucaauugaccaaauguauacuucuccaaacgaaguaauaucaguacaaugucaaaacgguagauguacacuagauggagaauuacaagguacaacacaacuucaagucucaggcauaugugcuuuuaaaggagaaguaaccgcacacuuacacgauaacgaccacuuauacaauguaacaauaacaaacuuaaaugguucaccauucgauccauccgaagauauaccugcaccacuaggagucccugauuuccaagguagaguauuuggaguaauuucacaaagagacaaacacaacacaccaggacauaaugaaccugcaaauagagcucacgacgcaguaguaccaacauauacagcccaauauacaccaaaacuaggccaaauccaaauagggacauggcaaacagacgaucuaacuguaaaucaaccaguaaacuucacaccaguaggauuauccgauacagaccacuucaaccaauggguuguucccagauaugcaggagcacuaaacuugaacacaaacuuagcuccaaguguugcaccuguauucccuggagaacgacuauuauucuucagauccuacauaccauuaaaaggaggauauggaacucccgcaauagacugccuauuaccccaagaauggguucaacauuuuuaucaagaagccgcucccucaaugagcgaaguugcucuaguaagauauauaaauccagauacagguagagcacuuuucgaagcaaaauuacacagagcuggauuuaugaccguaucaucaaauacuucagcaccaguuguaguuccagcuaacggauauuucagauuugauucuuggguaaaucaauuuuauucauuagcacccaugggcacaggaaauggaagacgaagguaa

SEQ ID NO: 33463 - RNA, 1623 nt, Artificial Sequence
  derived and/or modified sequence opt6 from VP1__Norovirus_and/or_Norovirus-like__AB662876
augaaaauggcaucaaaugacgccgcuccaucuacugauggagcagcaggacuuguaccagaaucuaacaaugaaguaauggcucuagaacccguagcaggagcagcauuagcagccccagucacaggacaaacaaauauaauugauccauggauucgagccaauuuuguacaagcaccaaacggagaauuuacuguaucuccaagaaacucuccaggagaaguacuauuaaacuuagaacuagguccagaacuuaauccauacuuagcacaucuugcuagaauguauaauggauacgccggagguauggaaguacaaguaaugcuagcuggaaaugcuuuuacugcaggcaaacucguuuuugcagcaguaccaccucauuuuccaguagaaaaucuauccccacaacaaauuacaauguuuccacacguaauaaucgauguacgaacucuagaaccaguauuauuaccucuaccagauguaagaaauaauuucuuucauuauaaccaaaaagaugauccaaaaaugagaauaguagcaaugcuauauacaccuuuaagaucuaaugguucaggugaugauguauucaccguaucauguagaguauuaacaagaccaucaccugacuuugacuuuacuuaccuagugccuccuacaguagaauccaaaacuaaaccauuuacuuuaccaauauuaaccuuaggcgaauuaucaaauucuagauuuccaguaucaauagaucaaauguauacaucaccaaaugaaguaauaucaguacaaugucaaaacggacgauguacauuagauggcgaacuucaagguacaacacaacuacaagucucuggcauaugugcauuuaaaggugaaguuacagcccaucuccacgauaacgaccaccuauauaacguaacaauaacaaaccuuaaugguucgccauuugauccuucagaagauauaccagcaccauuagguguccccgauuuucaaggcagaguuuuuggaguaauaucucaacgagauaaacauaacacaccuggacauaacgaaccagcaaauagagcacaugacgcaguaguaccuacauauaccgcacaauacacaccaaaacuaggucaaauacaaauaggaacauggcaaacagaugauuuaacgguaaaccaaccaguaaauuuuaccccugcaggacuuagugacacagaccacuuuaaucaauggguaguaccacgauaugcuggagcgcucaauuuaaauacaaaucuagcuccaagcgucgcaccagucuucccaggagaaagacuccuauuuuucagaucauacauuccucuaaaaggagguuauggaaccccugcaauagauuguuuauuaccacaagaauggguacaacauuuuuaucaagaagccgcaccaucaaugagcgaaguagcacucgucagauauauaaaccccgacacaggcagagcacucuuugaagccaaacuacaccgugcaggauucaugacagucaguucaaacacauccgcccccguuguaguaccagcaaacggauauuuuagauucgacucauggguaaaucaauucuacucacuagcaccuaugggaacaggaaauggaagacgaagauaa

SEQ ID NO: 33464 - RNA, 1620 nt, Artificial Sequence
  derived and/or modified sequence opt6 from VP1__Norovirus_and/or_Norovirus-like__KU555841
augaaaauggcuucuaaugaugcugcuccaucuaaugauggagcagcaggccuaguaccagaagguaauaacgaaacacuaccacuagaaccuguagccggugcagcaauagcagcaccaguaacuggucaaaacaauauaaucgacccauggaucagaaccaacuucguacaagcacccaacggagaauuuacaguaucaccucguaacucaccaggugaaauucuacuaaaucuagaauuagguccagacuuaaacccauauuuagcacauuuaucucgaauguacaacggauaugcaggaggagucgaaguccaaguucuuuuggcaggaaaugcauucacagcaggaaaaauauuauuugcagcagucccacccaauuuuccaguagaauuuuuaucuccagcacaaauaacuauguuaccacaucuaaucguagauguucguacacuagaaccaauuaugauaccauuaccagacguaagaaauacauucuuucauuacagcaaucaaccaaacuccagaaugcgccucguugcaaugcuauauaccccauuaagaaguaauggauccggcgaugaugucuucacaguuucuugucgcguauuaacaagaccaacuccggacuuugaauuuacauaucuuguaccaccaucaguagaaucaaagacaaaaccauucaguuuacccauacucacauuaucagaacuaacaaauuccagguuuccagucccaauagauucauuauuuaccgcacaaaauaauguuuuacaaguccaaugucaaaaugguagauguacauuagauggagaacuacaaggaacaacacaauuacuaccauccggaaucugugcauuucgaggaaggguaacugcccaaauaaaccaaagagauagauggcauaugcaacuacaaaaccuuaacggaacaacauaugacccuacugaugauguaccagcaccauuaggaacaccagauuucaaaggaguaguauuuggaaugguaucacaaagaaauguaggaucagaugccccaggcucuacgcgugcacaacaagcauggguuuccacauacucuccacaauuugucccaaaauuaggaucuguuaaucuaagaauaucagacaacgacgauuuccaauuccaaccaacaaaauuuacaccaguaggagucaacgaugaugauggacauccauuuagacaaugggaauuaccuaauuauucaggagaacuaacacuaaauaugaacuuagcaccaccaguagcuccuaauuuuccaggugaacaauuacuauucuuuagaucauuuguacccugcucuggaggauacaaucaaggaauaaucgacugucuaauaccacaagaauggauucaacacuucuaucaagaaucagcuccgucacaaucugauguugcccuaauaagauacgucaauccagacacuggaagaacauuauuugaagccaaacuccaccguucaggauacauaacaguagcccauucaggagacuacccccuaguuguaccagcaaaugggcauuuuagauucgauucauggguuaaucaauuuuacucacuugcuccaaugggaaccggaaaugguagacgacgagcucaauaa

SEQ ID NO: 33465 - RNA, 1620 nt, Artificial Sequence
  derived and/or modified sequence opt6 from VP1__Norovirus_and/or_Norovirus-like__GQ856468
augaaaauggcaucaaaugaugccgcccccucaaacgacggcgcuacuggacucguaccagaaauaaacacugaaacucuaccacuagaaccuguagcaggagcagcuauagccgcaccuguaacaggccaaaacaauauaauagacccauggauaagaaacaacuuuguacaggccccaaauggcgaauuuacaguaucaccccgaaacuccccaggagaaauacuaaugaaucucgaauuaggcccagauuuaaauccauacuuagcccaccuuucacgaauguauaacggauacgcaggaggaguugaaguccaaguccuacuagcugguaacgccuuuacagcaggaaaaauccuauuugcagcaguaccaccaaauuucccuguagauaugcuaucaccagcacaaauuacaauguugccccacuuaauaguagauguuagaacacuagaaccaaucaugauaccuuuacccgauguaagaaacguauuuuaucacuucaacaaccaacccgcaccaagaaugagacuuguagcaaugcuauauacuccucuaagaaguaauggaagcggugaugacguauuuacaguaucaugccgaguauuaacaagaccaacaccagauuucgaauuuacauaccucguaccaccaucaguugaaucaaaaaccaaaccauucacauuaccaauccuaacaauaggcgaacuaacaaacucacgcuucccagcuccaauagaccaacuauacacaucuccaaacgcagauauuguaguacaaccacaaaacggacgaugcacacuagacggagaacuucaaggaacuacccaacuacuaacaacagccauauguucuuaccgcggaaugacauccaacccuacaucagauuacugggacgaccacuuacuacacuuaguacacccaaacggagcaacauacgauccaacagaagauguaccagcuccuuuuggcacacaagacuuccgcggaauacuauauggaaugcuaacccaaaacccaagaacaucaggagacgaagcagcaaacucacacgguauauauaucucaaguacaucugaaaaauuuacacccaaacuaggaacaauaggucuucaucaaguccaaggaagacauucacaacaucaacaaucaaaauucacaccugucggaauagcaguaaaugguaauacaccauuuagacaaugggaacuaccaaacuacuccggagcacuuacauuaaacacaaaccuagccccagcaguaggaccuaauuuuccaggagaacaaauacucuucuucagaaguaaugucccauccguccaaggaggacaacccauagaaauagacugccucauaccacaagaauggguaucucauuucuaucaagaaucagcacccagucaaucagauguagcacuuguaagauacgucaacccagauacaggacgaacaauauuugaagcaaaacuacauagacaaggcuuuauaaccaucgcagcaacaggaucaaauccagucguuguacccccuaacggauacuucagauucgacucaugggucaaucaauucuaugcuuuagcucccauggguacaggcaacggaagaagaagaguccaauaa

SEQ ID NO: 33466 - RNA, 1620 nt, Artificial Sequence
  derived and/or modified sequence opt6 from VP1__Norovirus_and/or_Norovirus-like__AB684681
augaaaauggcauccaaugacgcugcaccuuccaacgacggagcagcaggauuaguaccagaaggaaacaacgaaacacuaccacuugaaccaguagcuggagcugcaauagcagcucccguaacuggacaaaauaauauaauagacccuuggauaagaacaaauuucguccaagcaccaaacggugaauuuacagucucuccaagaaacuccccuggagaaauacuauuaaaccuagagcuaggacccgaucucaacccauaucuagcacaccuauccagaauguacaacggauacgccggagguguagaaguacaaguauuacuugcaggcaaugcuuucacugccggaaaaauauuauuugcugcggucccacccaauuucccaguagaauuuuuaucucccgcacaaauaaccauguuaccacaccuaauaguagauguacgaacauuagaaccaauaaugauacccuuaccagauguccgcaacacauucuuucauuacaauaaucaaccagccaacagaaugcgacuuguagcaaugcuauacacaccacuaagauccaauggaucaggagacgauguauucacagucuccuguagaguacuaacccgaccaacacccgacuuugaauuuacuuaucuaguacccccauccguagaaucaaaaacaaaaccauuuucauuaccaauacuaacucuauccgaacuuacaaauucacgcuuuccagcacccauagauucacuauuuacagcacaaaauaacguacuucaaguacaaugccaaaacggucgaugcacacuagauggagaauuacaagguacaacucaacuauuacccacaggaaucugugcauucagaggcagagugacagccgaaacagacaacccagauaaauggcauaugcaacuacaaaaccuuaacggcacaaccuaugacccuaccgacgacgucccugcaccucuaggaacacccgauuuuagaggacuauuauucggaguagcaucacaacgcaacguuggaaaugacgcacccggaucaacacgagcacacgaaguuguaauaucaacaacaucaccacaauuugucccaaaauuaggaucaauaaacuuuagaucaacaucagaagauuuucgcaccggacaaccaacaagauuuacaccaguagguauaaacgaugaagacaaccacccauucaaucaaugggaauuaccagacuacucaggacgauuaacacuaaacaugaaucucgccccaccuguagcacccaacuuuccaggagaacaacuauuauucuuuagaucaaauguccccuguucagguggcuacaaucaaggaauaauagacugucuuauaccucaagaauggauacaacacuucuaccaagaaucagcaccaucucaaucugaaguagcacuaauaagauacguuaauccagauacaggaagaacauuauucgaagcaaaauuacacagaaccggauauaucacaguagcacauucaggcgacuacccauuaguaguacccgcuaacggauauuucagauuugacucauggguuaaccaauucuauucauuagcaccaaugggaacuggcaacggacgaagacgagcacaauaa

SEQ ID NO: 33467 - RNA, 1620 nt, Artificial Sequence
  derived and/or modified sequence opt6 from VP1__Norovirus_and/or_Norovirus-like__AB809988
augaaaauggcaucaaaugacgcagcaccaucaaacgacggagccgcaucccuagucccugaagccauuaacgaaaccaugccucuagaaccuguugcaggcgcaucaauagcagcaccaguagcaggacaaacuaacauuauagacccuuggauaagaacuaauuuuguacaagccccaaauggagaauuuacuguaucaccuagaaauucacccggugaaauuuuauuaaauuuagaacuaggucccgacuuaaacccauaccuugcacaucuuucacgaauguauaacggauacgcuggugguguagaaguccaaguccuauuagcaggcaacgcauucacugccgguaaaauacuauucgcagcaaucccuccuaauuucccaguagauaugaucucaccagcacaaauuaccauguuaccucauuuaauaguagacguaagaacacuagaaccaauaaugaucccacuaccugacguaagaaaugucuucuaccauuucaauaaccaaccacaaccccgcaugagacuuguagcaauguuauacacaccauuaagaucaaauggaucaggagacgacguuuuuacaguuucuugcagaguauuaaccagaccaacaccagauuuugaauuuauauacuuaguuccaccaucaguagaaagcaaaacaaaaccuuucacauuaccaauucuaacaauaucugaauuaacuaacaguagauucccaauaccaauagaacaacuauauacagcuccuaacgaaaauaauguaguacaaugucaaaauggacgaugcacauuagauggcgaauuacaggguacaacacaacuacuauccagugccguuugcucauaccgcggccgaacaguugcaaauucaggagauaauugggaucaaaaucuauuacaauuaacuuacccuucaggugccuccuaugacccaacagacgaaguaccagcuccauugggaacacaagauuucucaggaauccuguacggaguacuaacacaagauaacguaucagaaggaaccggagaagccaaaaacgcaaaaggaguauacauaucaacuacuucaggaaaauuuacaccaaaaauagguucuauagguuuacacuccauaacagaaaacguccacccaaaccaacaaucacgauuuacacccguaggaguagcacaaaaugaaaacacaccuuuccaacaauggguacuaccacauuacgcaggagcauuagcacucaacaccaaccuagcacccgcuguagcaccuacauuccccggcgaacaauuacuauucuucagauccagagucccaugcguucaaggucuacgaggacaagacgcauuuauagauugcuuauuaccucaagaauggguaaaucacuuuuaucaagaagcagccccaucccaagcagacguagcacuuauaagauacguaaauccagacacaggccgaacacuauuugaagcaaaacuucacagaagcggcuucauaacuguuucacauacaggagcauauccuuuaguaguaccaccaaacggucacuucagauuugauaguuggguaaaccaauucuauucacuagcaccaaugggaaccggaaauggaagacgauaa

SEQ ID NO: 33468 - RNA, 1620 nt, Artificial Sequence
  derived and/or modified sequence opt6 from VP1__Norovirus_and/or_Norovirus-like__AB810011
augaaaauggcaucaaacgacgccgcacccucaaacgacggugcugcaucucucguccccgaagcaaucaacgaaaccaugccccuagaaccaguagcaggagcaucuauagcugccccaguugcaggacaaacgaacauaauugauccauggauuagaacaaauuucguacaagcuccaaauggagaauuuacaguaucaccaagaaacucaccuggagaaauacuauuaaauuuagaauuagguccagauuuaaacccauaucuagcccauuuaucaagaauguauaauggauaugccgguggaguagaaguacaaguauuauuagcaggaaacgcauuuacagcaggcaaaauacuauuugcagcaauaccaccaaacuuucccguagauaugauuucaccagcacaaauaaccauguuaccacacuuaauaguagacgucagaacccuagaaccaaucaugauuccacuacccgauguacgcaacguuuucuaccacuuuaacaaucaaccacaaccaagaaugcgucuagucgcaaugcuauauaccccauuaagauccaauggaucaggagacgacgucuucacagucucaugcagagucuuaacaagaccaacaccugacuucgaauuuauauaucucgucccaccauccguagaaucgaaaacaaaaccauucacccuuccuauacuaacaauaucagaacuuacaaauucacguuucccaauuccaauugaacaauuauacaccgccccaaacgaaaauaacguaguacaaugccaaaacggacgcuguacuuuagacggagaacuacaggguacaacccaacuacuaucaagugcaguaugcucuuauagaggucgaacuguagccaauagaggagauaacugggaccaaaauuuauuacaauuaacauauccaucaggugcaucuuacgacccaacugacgaaguaccugccccacuagguacacaagacuucucggguauauuauacgguguauuaacgcaagacaaugucucagaaggaacaggcgaagccaaaaacgcaaaaggaguauauauaucaacuacauccgguaaauucacaccaaaaauuggauccauaggacuccacucaauaacagaaaauguacaucccaaucaacaaucacguuucacuccaguaggaguugcacaaaacgaaaacacaccauuucaacaauggguuuuaccacauuacgcaggagcauuagcacuuaauacaaaccuagcuccagccguagcaccaacauuuccaggcgaacaacuacuauuuuuccgaucuagaguaccuuguguacaaggucuacguggacaagaugcauucauagauugcuuauuaccacaagaaugggucaaccacuucuaucaagaagccgcacccucacaagcagacguagcauuaauuagauauguaaaccccgauacaggacgaacacuauuugaagcaaaacuacauagaucaggauucauaaccguuucccacacaggugcauacccauuaguaguaccaccaaacggacacuuccgcuucgacuccugggucaaccaauucuauaguuuagcaccaaugggaacaggaaacggacgaagauaa

SEQ ID NO: 33469 - RNA, 1620 nt, Artificial Sequence
  derived and/or modified sequence opt6 from VP1__Norovirus_and/or_Norovirus-like__AB809994
augaaaauggcauccaaugaugcagcaccaucaaacgacggugcugcaucccuaguaccagaagcuauaaacgaaacaaugccccucgaaccagucgcaggcgcaucaaucgcugcaccaguagcaggacaaacaaacauuauagacccauggauuagaacaaauuucguccaagcaccaaacggagaauuuacuguaucuccaagaaauucacccggagaaauucuacuaaaucuagaacuaggaccagaccucaacccauacuuagcucaucuuuccagaauguauaauggauaugccggaggaguagaaguacaagucuuacuugcuggaaacgcauucaccgcaggcaaaauccuauucgcagcaauacccccuaauuucccaguagauaugauaucacccgcacaaauuaccaugcuaccacaucuaauaguugauguacgaacacuagaaccuauaaugauacccuuaccugacgucagaaaugucuucuaccauuucaacaaucaaccacaaccaagaaugcgucuagucgcaauguuauacaccccauuacgauccaacggaucaggcgaugauguauucacuguuucaugucgcguacuaacuagaccaacacccgauuuugaauuuauauauuuaguaccaccauccguagaaucgaaaaccaaaccuuucacauuacccauucuaacuauaucagaacuuaccaauucccgcuucccaauaccuauagaacaauuauacacugccccuaaugaaaauaaugucguacaaugucaaaauggcagauguacacuagauggagaacuccaaggaacuacucaauugcuaucaagcgcaguaugcuccuauagaggacgaacaguugcuaacuccggagacaauugggaccaaaaccuacuacaauuaacauauccaucuggagcuucauaugacccaacagaugaaguaccagcuccacuaggaacucaagauuucucuggaauacuauacggcguacuaacccaagacaacguaucagaaggaacaggagaagccaaaaaugcaaaaggaguauacaucucaacaaccuccggaaaauucaccccuaaaauagguucaauuggcuuacacucuauaacagaaaacguucauccaaaccaacaaagcagauuuacaccagucggaguagcacaaaacgaaaauacucccuuccaacaauggguauuaccacacuacgccggugcacuagcauuaaacaccaaccuugcaccagcaguagccccaaccuuuccaggagaacaauuacucuucuuccguucaagagucccaugcguucaaggacuacaacgacaagacgcuuuuauagacugccuacuaccacaagaauggguaaaucacuucuaccaagaagcagcuccaucacaagcagauguagcacuuauaagauacguuaaucccgacaccggccgaacacuuuucgaagcaaaacuacauagauccggcuuuauaacagucucccauacaggugcauauccauuaguaguaccaccaaacggccauuuccgcuuugacucauggguaaaccaauucuacucauuagccccaauggguacuggaaacggcagacgauaa

SEQ ID NO: 33470 - RNA, 1620 nt, Artificial Sequence
  derived and/or modified sequence opt6 from VP1__Norovirus_and/or_Norovirus-like__KX767083
augaaaauggcaucauccgacgcaaacccaucagauggauccgcagcaaaccucguaccagaaguuaauaaugaaguaauggcauuagaacccguagucggagcagcaauugcagccccagucgccggacaacaaaaugucauagacccauggauuagaaacaacuucguacaagcuccaggaggagaauuuacaguaucaccucgaaaugcaccaggagaaauacucuggucagcaccucucggaccugaccuaaauccauacuuaucacaucuugcacguauguacaacggcuacgcaggaggauucgaaguccaaguaauuuuggcaggaaaugcauuuacagcugguaaagucaucuuugcugcagucccaccuaauuucccaacagaaggccuaucuccuucucaaguaacaauguucccacacauuguaguagauguacgucaacuagaaccagucuuaauuccauuaccugacguaagaaacaauuucuaucauuacaaucaaucaaacgacccaacaauaaaacuaauugcaaugcuauacacacccuuaagagcaaauaaugcaggcgacgauguauuuacagugucaugcagaguuuuaacuagaccaucuccagauuuugauuuuauauuccuagucccuccuacagucgaaaguagaacaaaaccguuuucaauucccguacuaacaguagaagaaaugacaaauucuagauuuccaauaccacuugaaaaauuauucacaggaccauccucugcauuuguuguacaaccacaaaacggacgauguacaacagacggaguacucuuaggcacaacacaauuaucaccaguuaauauauguacauuuagaggagaugucacccacauaacuggcucacacaauuacacaaugaaucuagcaucacaaaauuggaacucauaugaucccacagaagaaauaccagcaccacuugguacaccagacuucguaggaaaaauacaaggagucuuaacccaaacaacuagagcagacggaucaacaagaggccacaaagcaacagucuauacuggaucagcagauuucgcacccaaacuaggacgaguacaauuuggaacagacacaucaaaugauuuugaagcaaaccaaaauacaaaauuuacaccaguaggaguuauacaagacggcgauaccacacaccguaaugaaccacaacaauggguucuacccucauauucugguagaaacacacauaacguacaucuugcaccagcuguagcaccuacuuucccuggugaacaacuacuuuucuuucgaucaacaaugccagguugcucaggauauccuaauauggaucucgacugcuuauuaccacaagaauggguacaacacuuuuaucaagaagcagcaccagcacaaucagacguagcacuucuaagauucguaaacccagacacaggaagaguauuauuugaauguaaacuccacaaaccaggauauguaaccguagcacacacaggucaacacgaucuaguaaucccaccaaauggauacuuucgguuugauucuuggguaaaucaauuuuauacauuagcaccaauggguaauggaaccggacgacgcagaguauaa

SEQ ID NO: 33471 - RNA, 1620 nt, Artificial Sequence
  derived and/or modified sequence opt6 from VP1__Norovirus_and/or_Norovirus-like__LN854565
augaaaauggcaucaaaugacgcuaacccuucagauggaucagcagcuaauuuaguaccagaaguaaacaacgaagucauggcauuagaaccagucguaggagcagcuauagcagcccccgucgcaggacaacaaaauaucaucgacccauggauuagaaauaauuuuguucaagcaccaggcggugaauuuaccgucucuccacgaaaugcaccuggagaaauacuuuggucggcaccucuuggaccagaucuaaacccauacuuaagucauuuagcaagaauguauaacggauacgcaggcgguuucgaaguacaaguaauacuagccggaaacgcauucacagcagguaaaauaauauucgcagccguaccaccaaauuucccaacagaaggccuaucaccaucacaaguaaccauguuuccucacauuauuguagauguuagacaacuagaaccaguacuaauaccauuaccagauguccgaaacaacuuuuaucacuauaaucaaucaaaugacaguaccauaaaguuaauagcaauguuauacacaccucucagagcaaacaaugcuggugacgacguauuuacaguaucaugcagaguacucacucgacccucaccagacuucgauuuuauauuccucguuccacccacagucgaaucuagaacuaaacccuuuaccauaccuauauuaacaguugaagaaaugacaaacucacgauucccgauaccuuuagaaaaacuauacaccggaccaucuucagcauucguaguucaaccacaaaacggaagauguacuacugacggaguacuacucgguacaacacaauuaaguccaguaaauauaugcacauuucgaggagacguaacuaacauucaaggcucucacacauacacaaugaacuuagcaucccuaaacuggaauaacuaugauccaacugaagaaacuccagccccacucggaaccccugacuuuguaggaaaaauucaaggaguacuuacucaaacaacaaaaggacaaggaucaacccgaggacacaaagccacaguauauacuggaucagcuucuuuuacaccaaaauuaggauccguacaauuucgcaccgacacacaaaacgauuuugucacucaucaaaauacaaaauucacaccaguaggaguaauacaagauggcgauaccacucaccgaaacgaaccacaacaauggguacuaccaaauuauucaggaguuaauacacauaauguccacuuagcuccugcaguagcuccaacaauaccaggagaacaacuacuuuucuucagauccucaaugccaggauguuccgguuacccaaacauggaucuagauugucuuguuccacaggaauggguucaacauuucuaucaagaagcugcuccagcauuaucugacguagcccuacuaagauucguaaaucccgauacuggcagaguauuauuugaaugcaaauuacacaaaucaggcuauguaacuguagcacacaccggacaucacgauuuaguuaucccacccaaugguuauuuuagauuugacuccuggguaaaccaauucuacacacuagcuccaaugggaaacggaacaggaagaagaagaguauaa

SEQ ID NO: 33472 - RNA, 1620 nt, Artificial Sequence
  derived and/or modified sequence opt6 from VP1__Norovirus_and/or_Norovirus-like__KX354071
augaaaauggcuucaaacgacgcuaacccaucagacggaagcgccgcaaaccuaguaccagaagucaauaacgaaguaauggcucuagaaccaguaguaggagcugcaauagcagcaccaguagcaggacaacaaaauguaauagacccauggauacgaaauaauuuuguacaagcaccaggaggagaauuuacuguaucaccaagaaaugcacccggugaaauacucuggucugcuccacucggaccagauuuaaauccauaccuuucacauuuagccagaauguauaauggauacgcaggaggauuugaaguccaaguaauacuagcagguaacgcuuuuaccgcaggaaaaauuauauuugccgcuguaccaccgaacuuuccaacagaaggucuaucuccaucacaaguuacaauguuuccucacauaauagucgacguuagacaacucgaaccaguacuaaucccauugccagauguaagaaacaauuuuuaccacuacaaccaaucaaaugauucaacaauaaaacuuaucgccaugcuuuacacccccuuaagagcaaacaacgcaggagacgaugucuucacaguaucuugccgagucuuaacuagaccaucaccagacuucgacuuuauauuucuaguaccaccaacaguugaaucaagaacaaaaccuuuuacuguaccaauauuaacugucgaagaaaugacaaacucccgauucccaauccccuuagaaaaacuauucacaggaccuucaucagcauuuguuguacaaccucaaaacgguagauguacaacugacggaguauuacuaggcacaacacaacuaucccccguuaacauaugcacauuucgcggugauguuacacauauagcaggaucucgcgacuacaccaugaacuuagcaucauuaaauuggaacaauuacgacccaacggaagaaauaccagcaccacuaggaacaccagacuuuguaggaaaaauacaagguguuuuaacacaaacaacaaaaggugacgguucaacaagaggacauaaagcaacaguauauaccggcucagcaccuuucacaccuaaauuaggaucuguacaauucucaaccgacacagaaaacgauuucgaaacacaucaaaauacaaaauuuaccccuguuggaguaauucaaaaugguucaacaacacauagaaaugaaccccaacaauggguacuacccucuuauucaggaagaaauguacaaaacguacaccuagccccagcugucgcaccaacauuucccggugaacaauuauuauucuuucgaucaaccaugccuggaugcagugguuauccuaauauggacuuagauugccuacuaccccaagaauggguacaacacuucuaucaagaagcagccccagcucaaucagauguugcacuauuacgauucguaaacccagacacaggccgaguacuuuuugaauguaaauuacauaaaucuggauacguaaccguagcacauaccggacaacacgauuuaguaaucccacccaaugguuauuuccgauucgauucauggguaaaucaauuuuauacacuagcaccaauggguaacggaacuggacgucgaagaguauaa

SEQ ID NO: 33473 - RNA, 1620 nt, Artificial Sequence
  derived and/or modified sequence opt6 from VP1__Norovirus_and/or_Norovirus-like__AB933688
augaaaauggcaucaaaugacgcaaacccaucagaugguucagcagcuaacuuaguaccagaaguaaacaaugaaguuauggcauuagaaccggucguaggagcagcaauagccgcaccaguagcaggacaacaaaaugucauagauccuuggauuagaaauaacuucguccaagccccaggaggugaauuuacaguuucaccaagaaaugcaccaggugaaauauuauggucggcaccacuaggacccgauuuaaacccauaucuuucacaccuagcacgcauguacaaugguuaugcaggaggauuugaaguacaaguaauacuagcaggaaaugcauucacagcaggaaaaauaaucuucgcagccguaccaccaaauuuuccaacugaaggauuaucaccaucucaaguaacaauguuuccccacauaauaguugacguuagacaacuagaaccaguucuaauuccacuaccagauguacgaaacaauuuuuaccacuacaaucaauccaaugauagcacaauuaaauuaauagccauguuauacacaccacuaagagcuaacaaugcaggcgaagauguauucacaguuucauguagaguauuaacaagaccuaguccagauuucgacuuuauauuccuagucccaccaacuguagaaucucgaacaaaaccuuucacagucccaauacuaacagucgaagaaaugacuaauucccgauuuccaauuccucuagaaaaauuauucacaggucccucaucagcuuuuguaguacaaccccaaaacgguagauguacaaccgauggcguauuauuagguacaacccaacuuucacccguaaauauaugcacauuuagaggagacguaacacauauagcuggcucccgagauuauacaaugaacuuagcaucuuuaaacuggaacaauuaugacccaacagaagaaauacccgccccacuagguaccccagauuuuguuggaaaaauacaaggaauguuaacacaaaccaccaaaggagacggaucaacacggggucacaaagcaacaguauauacaggcucagcaccauuuacaccuaaacuaggaucagugagauuuucuacagauacagaaaacgacuucgaaauacaccaaaauacaaaauucacaccaguaggaguuauccaagacggaaguacuacucaucgaaaugaaccacaacaauggguccucccuucauauuccggacgcgaugcacacaacguacacuuagcacccgcaguagcaccaacuuuuccaggcgaacaauuacucuucuuuagaucaacaaugccaggauguucaggauacccaaacauggaucuagauugccuucuaccacaagaauggguucaacacuuuuaucaagaagccgcccccgcacaauccgauguagcacucuuaagauucguaaauccagauacuggaagaguauuauuugaauguaaacuacacaaaucuggauacguaacagucgcucacacuggacaacaugauuuaguaauuccuccaaauggcuacuuccgauucgauucauggguaaaucaauuuuauacacuugcuccaauggguaauggaacaggacgaagaagagucuaa

SEQ ID NO: 33474 - RNA, 1620 nt, Artificial Sequence
  derived and/or modified sequence opt6 from VP1__Norovirus_and/or_Norovirus-like__GQ845337
augaaaauggcauccaacgacgcaaauccaucagauggaucagcagcaaaccuaguaccagaagucaacaaugaaguaauggcacuagaaccgguuguaggugcagcuauagcagcaccaguagcaggacaacaaaacgucauagacccauggauuagaaacaacuuuguccaagcaccaggaggagaauuuacuguauccccaagaaaugccccuggcgaaauacuuuggagugcaccucuuggaccagaucuaaauccuuacuuaucacacuuagccagaauguauaacggauaugcaggagguuuugaaguacaaguaauacuagcagguaacgcauuuacagccggaaaaauaauauuugcagccguuccuccaaauuuuccgacugaaggauuaucacccucccaaguaaccauguuuccucacauaauaguagacguaagacaauuagaaccaguuuuaauaccauuaccagaugucagaaacaauuuuuaucauuacaaccaaucaaaugacucaacaauaaaauuaauugcaauguuauauacaccuuuaagagcuaacaaugcaggggaagauguauuuacaguaucauguagaguucucacuagaccaagcccagacuuugacuuuauauuuuuaguaccacccacaguagaaucaagaacaaaaccauuuacuguuccaauauuaacaguagaggaaaugaccaacagucgauuuccaauaccacuagaaaaauuauucacaggcccuucaucugccuucgucguccaaccacaaaacggucgauguacaacagacggaguauuacuaggaacuacacaauuaucaccaguaaacaucuguacuuucagaggagacguaacacauauagcuggaagucgaaauuauacaaugaauuuagccucauuaaacuggaauaacuaugauccaaccgaagaaauaccagccccacuuggaacaccagacuucguaggaaaaauacaagguguuuuaacacaaacaaccaaaggagauggaagcacaagagggcauaaagcaacaguauauacagguagugcuccauucacaccgaaauuaggaucaguacaauucucaacagauaccgaaaaugauuucgaagcacaccaaaauacaaaauucaccccaguaggaguuauacaagacggaggaacuacacauagaaaugaaccacaacaauggguguuaccaucuuacuccggaagaaauguaccaaacguccaccuagcaccagccguagcaccuacauuuccaggagagcaauuauuauucuucagaagcaccaugccagguugcucaggauauccuaauauggauuuagauugcuuauuaccucaagaauggguacaacauuuuuaccaagaagcagccccugcacaaucugauguagcacuucuaagauucguuaacccagacacaggaagaguauuauuugaaugcaaacuacauaaaucuggauauguaacuguagcacacacuggacaacacgaucuuguaauaccaagcaacggauauuuuagauucgacagcuggguaaaucaauucuauacacuagcacccauggguaauggaacuggucgaagaagaguauaa

SEQ ID NO: 33475 - RNA, 1620 nt, Artificial Sequence
  derived and/or modified sequence opt6 from VP1__Norovirus_and/or_Norovirus-like__JX155747
augaaaauggccaguaaugaugcaaauccaucagauggaucagcagccaaccuugucccagaaguaaacaaugaaguuauggcccuagaaccaguuguaggagcagcaaucgcagcuccaguagccggacaacaaaaugucauugaccccuggauacgaaacaacuuuguccaagcaccuggaggugaguucacuguuaguccuagaaaugcaccaggagaaauuuuauggucagcacccuuaggcccagaucuaaauccauauuuaucucaccuagcaagaauguauaauggcuacgcuggcggauucgaaguacaaguaauucuagcaggaaaugcauuuacagcuggcaaaauaauauuugcagcaguaccucccaauuuuccuaccgaagguuuaucuccuucacaagucacaauguucccacacauaauaguagacguaagacaauuagaaccaguuuuaauaccauuaccagauguaagaaacaauuuuuaucauuacaaccaaucaaacgacucuacaauaaaacuaauagcaauguuauacacuccauuaagagcgaacaacgccggugaagauguauuuaccguaucaugcagaguucuaacacgaccaaguccugacuuugauuucauauuccuaguaccaccaacaguagaaucaagaacaaaaccauucacuguuccaauauuaacaguagaagaaaugacaaacuccagauucccaauaccauuagaaaaacuauuuaccggucccucaucagcauuugucguacaaccccaaaacggacgauguacuacagauggaguacuucuaggaacaacacaacuaagcccaguaaauauaugcaccuuuagaggagacguuacacacauagcaggaucuagaaauuacaccaugaauuuagcaagccuaaauuggaacaauuacgacccaacagaagaaauaccagcaccccuagguacaccagauuuuguaggcaaaauacaaggaguacuaacacaaacaacaaaaggcgacggcucaaccagaggucacaaagcaacaguauauacaggauccgcacccuuuacaccuaaacuaggaucaguacaauucucaacagauaccgaaaacgauuucgaaacacaucaaaauacuaaauucacacccguagguguuauacaagacgguggaacaacacauagaaaugaaccacaacaauggguacuaccuucauauucaggaagaaauguacaaaauguacaccuugcaccagcaguagcaccaacuuucccaggcgaacaauuauuauucuuccgauccacaaugccagguugcucuggauauccaaacauggauuuagacugccuucucccucaagaauggguucaacauuucuaucaagaagcagcacccgcacaaucagauguugcacuacuaagauucgucaacccugauacaggcagaguacuauucgaaugcaaacuacauaaaucaggauauguaacuguagcucacaccggacaacacgaucuaguaauaccaccaaacggauauuucagauuugauucaugggucaaucaauucuauacauuagcaccaaugggcaauggaacaggacgaagacgaguauaa

SEQ ID NO: 33476 - RNA, 1620 nt, Artificial Sequence
  derived and/or modified sequence opt6 from VP1__Norovirus_and/or_Norovirus-like__JX155737
augaaaauggcuucaaaugaugcaaaucccucugaugguuccgcagccaauuuaguaccagaaguaaauaaugaaguaauggcauuagaaccaguugugggagcagcuauagcagcaccuguagcaggucaacaaaauguaauagauccauggauacgaaacaacuuuguacaagcuccaggaggugaauuuacaguaucaccaagaaaugccccaggagaaauauuauggucagcaccauuaggaccagacuugaauccauaucuaucccauuuagcaagaauguacaauggauacgcaggaggauucgaaguacaaguaauacucgcuggaaaugccuucacagcaggaaaaauaauauucgcagccguaccaccaaacuuuccaacugaaggacuaucaccuagccaaguuacaauguucccacauauaauuguggacguuagacaauuagaaccaguucuaauaccacuuccagacguuagaaauaauuucuaucacuacaaccaaucaaaugacucaacuauaaaacuaauugcaaugcuauauacaccauuaagagcaaauaaugccggagaagacgucuuuacagucagcugcagaguauuaacacguccaucuccagacuuugacuuuauauuuuuaguacccccuacaguagaaucuagaacaaaaccauucacaguaccaauacuaacagucgaagaaaugacuaauucaagauuuccaauuccucuugaaaaauuauuuacaggaccaucuucagcuuucguaguccaaccacaaaacggaagauguacaacagauggaguacuucuaggaaccacccaacuaucaccagucaauauauguacauuucgaggugacguuacacauauugcuggaucaagaaauuauacaaugaauuuagccucauuaaauuggaacaacuaugauccaacugaagaaauuccagccccauuaggaacaccugauuucguaggaaaaauacaaggaguacuuacacaaacaacaaaaggagaugguucaacacgaggccacaaagcaacaguauauacaggcucagcaccauuuacuccaaaacuaggcucuguacaauucuccacagacacagaaaaugauuucgaaacacaucaaaauacaaaauuuacuccaguaggaguaauacaagauggaggaacaacacaucgcaaugaaccccaacaauggguacuuccuucauacucagguagaaaugucccaaacguacauuuagcuccagcaguagcaccaaccuuuccuggagaacaacuuuuauucuuuagaucuacaaugccaggcugcaguggcuacccaaacauggaucuagacugcuuauuaccacaagaauggguucaacauuuuuaucaagaagcagcaccagcacaaagugacguagccuuauuaagauucguuaacccugauacaggacgaguauuauuugaaugcaaauuacauaaaucuggauauguaacuguagcacauacaggacaacaugacuuaguaauaccacccaacggauauuuuagauucgauagcuggguaaaucaauuuuauacauuagcucccaugggaaaugguaccggaagaagaagaguuuaa

SEQ ID NO: 33477 - RNA, 1620 nt, Artificial Sequence
  derived and/or modified sequence opt6 from VP1__Norovirus_and/or_Norovirus-like__KX354055
augaagauggccucaucugaugcaaaucccagugacggaucagccgcaaaccuaguaccugaaguaaacaaugaaguuauggcauuagaaccaguuguuggugcagcuaucgcugcaccaguagcuggacaacaaaauguaaucgauccuuggaucagaaauaauuuuguacaagcaccaggcggugaauuuacaguaaguccaagaaaugcaccaggagaaauuuuauggucagcccccuuaggcccagaucuaaacccauauuuaucacaucucgcaagaauguauaauggauacgccggaggauucgaaguacaaguaauauuagcaggcaaugcauucacagcagguaaagucauuuuugcugcaguacccccaaauuuuccaaccgaaggacuaaguccaagucaaguaacaauguucccacauauaguaguagacguaagacaauuagaaccaguacuaauacccuuaccagauguaagaaauaauuucuaucauuacaaucaaucaaaugauccuacaaucaaacuaauagcaaugcuuuauacuccacuuagagcuaacaacgcuggagacgauguauuuacaguuucaugcagaguauuaacaagaccuucaccagacuuugauuucauauuuuuaguaccaccaacagucgaaucaagaacaaaaccauuuucagucccuguacuaacaguagaagaaaugacaaacuccagauucccaauaccacuugaaaaauuauucacaggaccaucaucagccuucguuguacaaccacaaaacgguagauguacaaccgauggcguacuccuaggaacaacacaauuaucacccguaaauauuuguacauuuagaggugacguaacccauauaacaggaucucacaauuauacaaugaaucuagcaagucaaaacuggaacaauuaugauccaacagaagaaauaccagcaccacuugguaccccagauuucguagguaaaauacaaggaguauuaacacaaacuacaagagcagauggaucaacaagaggacauaaagcaacuguauauacaggaucagcagacuuugcaccaaaauuaggaagaguacaauucgaaacugauaccaaccacgacuuugaagccaaucaaaauacaaaauucacuccaguuggaguaauacaagauggaggaacaacucaccgaaaugaaccacaacaauggguucucccaucauauucaggucgaaacacacauaauguacauuuagcacccgcagucgcaccaaccuuucccggagaacaacuacuuuucuuucguuccaccaugccaggauguucuggauacccaaauauggauuuagauugucuauuaccacaagaauggguucagcauuuuuaucaagaagcagcaccagcacaaucugacgucgcccuacuuagauuuguuaauccagauacaggaagaguauuauucgaaugcaaacuacacaagucuggauaugucacaguagcacauacaggacaacaugauuuaguaauaccaccaaauggauauuuucgauucgacaguuggguuaaccaauuuuauacacucgcuccaaugggaaauggaacugguagacgaaggguuuaa

SEQ ID NO: 33478 - RNA, 1620 nt, Artificial Sequence
  derived and/or modified sequence opt6 from VP1__Norovirus_and/or_Norovirus-like__KX353957
augaaaauggcaucaaacgacgccaacccuagcgauggaagcgcagcaaaccuaguaccagaaguaaauaacgaaguaauggcucuagaaccaguaguuggugcagcaaucgcagcaccugucgcaggccaacaaaauguaaucgacccuuggauacgaaacaauuuuguccaagcaccaggaggugaauuuacuguaucaccuagaaaugcaccaggagaaauauuauggucagccccauuaggacccgacuuaaauccauaccuaucacacuuagcacguauguauaacgguuacgcaggaggauuugaaguacaaguaauacucgcaggaaaugcuuucaccgcaggcaaaauaauuuuugcugcaguacccccuaauuuucccacagaagggcuaucaccaucacaagucacaauguucccucacauaauaguugauguaagacaauuagaaccaguuuuaauaccauuaccagauguacguaacaauuucuaucacuacaaccaaucaaaugacucuacaauaaaauuaauagccauguuauauacacccuuaagagcaaauaaugccggagaagauguauuuaccguaucaugccgaguccuaacccgaccuucaccugacuuugacuuuauauuucuaguucccccuacaguggaaucaagaacuaaaccuuuuaccguaccaauauuaaccguagaagaaaugacuaacucacgauuuccaauuccauuagaaaaacuauucacaggucccuccucugcauuuguaguacaaccacaaaacgguagaugcacaacugaugguguauuauuaggcacaacacaacuaucacccguaaauauaugcaccuuucgcggugacguuacacauaucgcaggaucaagaaauuacaccaugaaccuagcaucauuaaacuggaauaauuaugacccaacagaagaaauaccagccccauuaggaacacccgauuucgucgguaagauccaagguguuuuaacucaaacaaccaaaggugacggaucuacucgaggacacaaagcaacugucuuuacaggaucagcaccauuuacaccaaaacucggaucaguucaauuuuccacagauaccgaaaaugauuucgaaacacaucaaaauaccaaauuuacaccaguuggaguaauacaagauggaggaacaacacauagaaacgaaccucaacaauggguauuaccaucuuauucaggaagaaauguccaaaacguacaccuagcaccagcaguagcuccuacauuuccaggugaacaauuauuauucuuccgcucaaccaugcccggcuguucaggauauccaaauauggauuuagacuguuuacuuccacaagaauggguucaacauuucuaccaagaagcagcaccagcacaaucagacgucgcccuacuacgguuugucaacccugauacaggccgagucuuauuugaaugcaaacuacacaaaucugguuaugucacaguagcacacacaggacaacacgauuuagugauacccccuaaugguuauuuccgauuugauucauggguaaaucaauuuuauacacuagcaccaaugggcaauggaacuggaagaagaagaguuuaa

SEQ ID NO: 33479 - RNA, 1620 nt, Artificial Sequence
  derived and/or modified sequence opt6 from VP1__Norovirus_and/or_Norovirus-like__KF509947
augaaaauggcuuccuccgacgcaaacccaucagacggaucagcagcaaaucuaguaccagaaguuaauaaugaaguuauggcucuagaaccagucgucggagcagcuauagcagcaccuguugccggccaacaaaauguaauagauccauggauacguaauaauuucguacaagcuccaggcggagaauuuaccguaucaccaagaaaugcaccaggcgaaauauuaugguccgcaccauuaggaccugacuuaaauccuuaucuaagccaccuagcacgaauguauaacggauacgcaggaggauucgaaguacaaguaauauuagcaggaaacgcauucacagcaggaaaaauaauauucgcagcaguaccaccaaauuuucccacagaaggucuaucaccaagucaaguuacaauguucccccauauuauaguagacguaagacaacuagaaccaguacuaauuccauuaccagacguaagaaacaacuucuaccauuauaaucaauccaacgacccaacaauaaaacuuauagcaaugcucuauacccccuuaagagccaacaaugccggcgacgaugucuuuacaguauccugcagaguauuaacaagaccaucaccagacuuugacuucaucuuuuuaguacccccaacaguagaaucuagaaccaaaccauucucaguaccuaucuuaacaguugaagaaaugacaaacucucgauucccaauuccccucgaaaaauuauuuacaggucccucaucagcauucguaguacaaccccaaaacggaagauguacaacagacggaguacuucucgguacaacucaacuaucacccguaaacauauguacauuuagaggagacauaacacacauaacaggaucaagaaauuauacuaugaaucuagcuucacaaaauuggaacaauuacgacccaaccgaagaaauaccagcuccauuagguacaccagauuuuguaggaaaaauacaaggagucuuaacacaaaccacacgagcagauggaucaacccgaggucauaaagcuauaguuuauacagggucagcugacuuugcaccaaaacuagguagaguacaauucgaaacugauaccgaucacgauuuugaagcaaaucaaaauacaaaauuuacccccgucggaguaacacaagacggaucuacuacucauagaaaugaaccacaacaauggguucuaccuuccuauagcggacgaaacacacacaacguucacuuagcacccgcaguugcaccaacauuuccaggagaacaauuauuauucuuuagaucuacaaugcccggauguucuggcuauccaaauauggacuuagauugcuuacuaccccaagaauggguacaauauuuuuaucaagaagcagcuccagcucaaucugauguagcacuccuacgcuuuguuaaucccgacacuggaagaguauuauuugaaugcaaacuucauaaaaguggauacgucacuguagcacauacaggacaacacgacuuaguaaucccucccaaugguuauuucagauucgauucauggguaaaccaauucuacacacuugcuccaaugggaaaugguacaggcagaagaagaguauaa

SEQ ID NO: 33480 - RNA, 1620 nt, Artificial Sequence
  derived and/or modified sequence opt6 from VP1__Norovirus_and/or_Norovirus-like__AB504326
augaaaauggcaucaaaugacgcaaacccaagcgauggaucugcagcaaaccuaguacccgaagucaauaaugaaguaauggcauuagaacccgucguaggagcagcuauagcugcgccuguagccggccaacaaaauguaauagacccuuggauccgcaauaacuuuguacaagcucccggaggagaguuuacagucucacccagaaaugcaccuggagaaauacuuuggucugcaccacuugguccagacuuaaacccauauuuaucucacuuagcaagaauguauaacggcuaugcuggaggauuugaaguucaagucauauuagccggaaaugcauuuacagcaggaaaaauuauauucgcagcaguaccaccaaacuuuccaacagaaggccucucccccucgcaaguaacaauguucccacacauaauaguugauguaagacaacuagaaccaguuuuaauaccacuuccugauguaagaaauaauuucuaucauuacaaucaaucaaaugauuccacaauaaaacuaauagcaaugcuuuauaccccuuuaagagccaacaaugcuggagaagauguuuuuacagucagcugucgaguauuaacacgacccucaccagacuuugacuuuauauuucuuguaccaccuacuguugaaucaagaaccaaaccuuucacaguuccaauacuaacaguagaagaaaugacaaacucaagauuuccaauuccacuagaaaaacuauucacaggaccaucaucagcauucguuguacaaccacaaaacgguagauguacaacagacggcguacuucuaggaacaacacaacuauccccagucaauauauguacuuuuagaggcgacguaacacauauagcagguuccagaaacuauauaaugaauuuagcauccuuaaauuggaacaauuacgacccaacagaagaaaucccggccccucuaggaacaccagauuucgucggaaaaauacaagguguacuaacacaaaccacuaaaggagacggaucaacaagaggacacaaagcuaccguuuauacaggaucagcaccauucacaccaaaacuaggaaguguccaauucucaacagauacagaaaacgacuuugaaacccaucaaaauacaagauucacaccagucggaguaauacaagacggaggaacaacacauagaaacgaaccacaacaauggguacuaccuuccuacucaggucgcaacguuccaaacguacaucuugcaccagcaguagcaccaacauucccaggugaacaacuauuauucuucagaaguacaaugccaggaugcucaggcuauccaaauauggaucuagacugucuucuuccacaagaauggguccaacacuuuuaucaagaagcagcuccagcucaaucggauguagcccuuuuacgauucguaaaccccgacaccggucguguacuauuugaauguaaguuacauaaaucaggcuacguaacuguugcucacaccggacaacacgauuuaguaauaccuccaaacggauauuucagauucgauucuuggguaaaccaauuuuacacauuagcaccaaugggaaacggaacuggaagaagaagaguauaa

SEQ ID NO: 33481 - RNA, 1620 nt, Artificial Sequence
  derived and/or modified sequence opt6 from VP1__Norovirus_and/or_Norovirus-like__KX354056
augaaaauggcaucuuccgacgcaaauccaucagauggaucagcagcuaaccuaguaccugaaguaaauaaugaagucauggcacuagaaccuguaguaggugcagccauagcagcaccaguagcaggacaacaaaaugucauagauccauggaucagaaauaauuuuguacaagcucccggcggugaauuuaccguaucccccagaaaugccccaggagaaauacuauggucagcaccauuaggaccugaucugaacccauaucuaucucaccuagcaagaauguauaacggauaugcuggaggauuugaaguucaaguaauucucgcaggcaaugcuuucacagcuggaaaaguuauauuugcagcaguuccaccaaacuuuccuaccgaaggucuauccccaucacaaguaacaauguucccacacauuguaguugauguccgucaguuagaaccaguacuaauaccauuaccagauguacguaauaacuucuaucauuauaaccaaucuaaugauccaacaauaaaacuaauagcaaugcuauacacaccuuuaagagcuaacaacgcuggagaugacguauucacuguauccugucgaguacucacacgaccaucaccagauuuugacuucauauucuuaguaccaccaacaguagaaucuagaacaaaaccauucuccguaccuauauuaacaguagaagaaaugacuaauucuagauuucccauaccauuagaaaaauuauuuacagguccaucaucagccuuuguuguccaaccacagaauggaagaugcacaacugaugguguacuauuagguaccacacaauuaucacccguaaacauaugcacauuuagaggugauguaacccauauuacagguucacgaaauuauacaaugaaucuagcaucacaaaauuggaauaacuaugauccuacagaagaaauaccagcuccuuuaggaacaccagacuuugucggaaaaauacaaggcguauuaacacaaacuacucgagcagauggauccacacgaggacauaaagcaacuguauauacuggaucagcagauuuugccccuaaauuaggaagaguacaauuuggcacagacacugaucaugauuucgaagcaaaucaaaacacaaaauuuacaccaguuggaguuauucaagauggaggaacaacacacagaaacgaaccacaacaauggguauuaccuuccuauucaggaagaaauacacauaauguacaccuagcaccagcaguugcuccuacuuucccuggugaacaacuacucuucuuucgcucuaccaugccuggauguucagguuauccuaauauggaccuugauuguuuacuaccucaagaauggguacaauauuuuuaucaagaagcagcaccagcacaaagugacguagcauuauuaagauuuguuaauccagacaccggccgaguacuauuugaauguaaauuacauaaacuaggauauguaacagucgcucauacaggccaacacgacuuaguaauaccuccuaacgguuacuuuagauucgacucuuggguaaaucaauuuuacacucuagcaccuaugggaaauggaacaggacgacgucgaguguaa

SEQ ID NO: 33482 - RNA, 1620 nt, Artificial Sequence
  derived and/or modified sequence opt6 from VP1__Norovirus_and/or_Norovirus-like__AB541255
augaaaauggcauccaaugacgcaaacccaucagauggaucugcagcuaaccuaguaccagaaguuaauaaugaaguaauggcauuagaaccaguagucggagcagcuauagcggccccaguugcuggccaacaaaauguaauagacccauggauaagaaauaauuucguacaagcuccaggaggagaguucacaguaagcccaagaaaugcaccaggagaaauauuauggucagcuccauuaggaccugaccuaaauccguauuuaagucaccucgcaagaauguauaaugguuaugcaggaggauuugaaguucaaguaauacuagcagguaaugccuuuacagcaggcaaaauuauuuucgcagcaguucccccaaacuuuccaacagagggauuaucuccaagccaaguaacaauguucccccacauuaucguagacguaagacaauuagagccaguacuaauaccauuaccagacgucagaaacaauuucuaucauuauaaccaaucaaaugauucuacaauaaaauuaauagcuauguuauacacaccauuaagagcaaacaaugccggcgaagauguauuuacaguuucauguagaguccuuacaagacccuccccagauuucgacuuuauauuuuuaguuccaccuacagucgaaucaagaacaaaaccuuuuacuguacccauuuuaacaguagaagaaaugacaaacucaagauucccaauaccauuagaaaaacuauucacaggaccauccucugccuuuguaguccaaccacaaaauggaagaugcacaacagauggagucuuacuaggaaccacacaauuauccccuguaaacauaugcacuuucagaggugacguaacacacauagcuggcaguagaaacuacacaaugaauuuagcuaguuuaaauuggaacaauuaugacccuacagaagaaaucccugcaccacuagguacaccagacuucguaggaaaaauucaaggaguauuaacacaaacuacaaaaggugacggcucaacuaggggacauaaagcaacaguauauacagguuccgcaccauucacaccaaaacuaggaucaguccaauucucaacagacacagaaaaugauuuugaaacacaucaaaauacacgauucacaccaguaggaguuauacaagauggaggaacaacacaucgaaacgaaccucaacaauggguacuaccaucauacucuggacgaaauguucccaacguucacuuggcuccagcaguugcaccaacauuuccaggagaacaacuauuauucuuuagaagcacaaugccaggauguucaggauauccaaacauggaccuagacugcuuacuaccacaagaauggguucaacacuucuaucaagaagcagcaccagcacaaagugacguugcauuauuacgauucguaaauccagauacuggaagagucuuauucgaauguaaacuccauaaaaguggcuauguaacagucgcacauacaggacaacacgauuuaguuauaccaccaaauggauauuuucgauucgauuccuggguuaaucaauuuuauacacuagcacccaugggaaauggaacuggcagaagaagaguauaa

SEQ ID NO: 33483 - RNA, 1620 nt, Artificial Sequence
  derived and/or modified sequence opt6 from VP1__Norovirus_and/or_Norovirus-like__KP784696
augaaaauggcuucaucagacgcaaauccaucagauggaucagcagcuaaucucguaccugaaguuaauaacgaaguaauggcucuugaaccaguugucggagcagcuauagcugcuccuguagccggacaacaaaaugucaucgaccccuggauuagaaauaauuuuguacaagcaccaggaggagaauuuaccgucucuccacguaaugcuccaggagaaaucuuauggucagcaccucuaggaccagaucuaaacccauauuuaucacauuuagcacgaauguauaauggauaugccggaggcuuugaaguucaaguaauucuagcaggaaaugccuuuacugcaggaaaagucauuuuugcagcaguaccaccaaauuuuccaacagaaggacuauccccaucacaaguuacaauguuuccucacauuguaguagauguacgucaacuagaacccgucuuaaucccucuuccagacguaagaaacaauuuuuaucacuauaaccaaucaaaugauccaacaauuaaauuaauagccauguuauauaccccauuaagagcuaacaaugcuggagacgacguauucacaguauccuguagaguccugaccagaccaaguccagauuucgacuucauauuucuaguaccaccaacugucgaauccagaacaaaaccauuuucagucccaguauuaacaguugaagaaaugacaaauucccgcuuuccaauaccuuuagaaaaauuauuuacaggucccucuucagcuuuugucguccaaccacaaaauggaagauguacaacagauggaguccuucuaggaaccacacaauuauccccuguaaacauuugcacuuuuagaggagauguaacacauauaaccggaucaagaaacuacacaaugaacuuagcaucacaaaacuggaauaauuaugacccaacugaagaaaucccagcccccuuaggaacaccugacuucguaggugaaauacaaggcguacuaacacaaacaacaagaacugauggauccacaaggggacauaaagcaacaguuuauacaggauccgcagauuuugcacccaaacuaggaagaauacaauuugaaacagacaccgaccacgacuuugaagcaaaucaaaacaccaaauucacuccuguaggaguaauacaagacggauccacaacucaucgaaaugaaccucaacaaugggucuuaccaucauacucaggaagaaauacucauaauguucaccuugcacccgcaguagcaccuaccuuuccaggagaacaacuauuauuuuucagauccaccaugccaggcuguucagguuauccuaauauggacuuagauugcuuacuaccacaagaauggguccaauauuuuuaucaagaagcugcuccaagucaaucagaugucgcacuauuaagauuuguaaacccagacacaggaagaguacuauuugaauguaaacuacauaaauccggauauguaacaguagcucacacaggacaacaugacuugguuauuccucccaacgguuacuuuagauucgauucauggguaaaccaauucuauacacucgcacccauggguaacggaacaggaagaagacgaguuuaa

SEQ ID NO: 33484 - RNA, 1620 nt, Artificial Sequence
  derived and/or modified sequence opt6 from VP1__Norovirus_and/or_Norovirus-like__KX354042
augaaaauggcaucuucagacgcaaauccaucagauggaucagcagcaaaccucgucccugaaguuaauaacgaaguaauggcacuagaaccagucguaggagcagcaauagcagcaccaguugcaggacaacaaaaugucauagauccuuggauaagaaauaauuuuguacaagcacccggaggcgaauuuacaguuucaccaagaaacgccccaggagaaauauuauggucugcaccauuagguccagaccucaauccauauuuaucacacuuagcaagaauguacaacggauacgcuggaggauucgaaguacaaguuauucuagcaggaaacgcauucacagcagguaaaauuauauuugccgcaguuccucccaauuuuccaacagaagguuuaucaccaucucaagucacaauguucccacacauaauaguagauguaagacaauuagaacccguauuaauacccuuaccagauguaagaaauaauuucuaccacuauaaccaaagcaaugacccuacaauaaaacuaauugccauguuauacacaccuuuacgugcaaauaaugcaggagacgauguauuuacaguaucauguagaguacuaacacgucccuccccugauuuugauuuuauauuccuaguaccaccaacagucgaaucccgcacaaaaccauuuagcguaccaguacuuacaguugaagaaaugacuaacucaagauucccaauuccccuugaaaaauuauuuaccgguccaucaucugccuucguuguacaaccacaaaacggaagauguaccaccgacggcguacuuuuaggaacaacacaauuaucuucaguaaauauaugcacauuuagaggugacguaacacacauaacugguucuagaaauuacaccaugaaucuagcaucacaaaauuggaacaauuacgauccaacagaagaaauaccugcaccucuugguacuccagacuuuguuggaaaaauacaaggcauguuaacacaaacaacaagaacagacggcucaacucgaggacacaaagcaacaguauacaccgguucagcugacuucgcgcccaaauuaggacggguccaauuugaaaccgauaccgaucaugauuucgaagcaaaucaaaauaccaaauuuaccccagucgguguaauacaagacggaucaacaacgcacagaaaugaaccacaacaauggguacuaccaucauacucaggacgaaacacacauaauguacaucuagcaccagcaguagcuccuacauuuccaggagaacaacuacucuucuuuagaucuacaaugccaggaugcucaggauacccaaauauggauuuagauugcuuacucccacaagaauggguccaauauuuuuaucaagaagcagcaccagcacaaucagauguagcauuacuuagauuuguaaaccccgauacagguagaguccuauucgaaugcaaauuacauaaaucaggauacguuacaguagcacacacuggucaacacgauuuaguuauuccacccaacgguuauuuuagauuugauucuuggguaaaucaauuuuacacucuagcuccaaugggaaaugguacaggacgaagacgaguuuaa

SEQ ID NO: 33485 - RNA, 1620 nt, Artificial Sequence
  derived and/or modified sequence opt6 from VP1__Norovirus_and/or_Norovirus-like__KX354007
augaaaauggcaaguucagacgcuaacccaucagauggcucagcugcuaaccuaguuccugaaguaaauaacgaaguaauggcauuagaaccuguaguaggagcagcuauagcugcccccgucgccggucaacaaaacguuauugacccauggaucagaaauaauuuuguacaagccccaggcggagaauuuacaguaucuccaagaaaugcaccaggagaaauacuauggucagcaccccuagguccagauuuaaauccguaucuaagucauuuagcaagaauguauaacggauacgccggaggauucgaaguucagguaauccuugcaggaaaugccuuuacagcaggaaaaguaauauucgcugcaguaccaccaaauuuuccuacagaaggauuaucuccaucucaaguaacaauguucccacauauaguaguagacguaagacaauuagaacccguccuaauaccacucccagauguaagaaauaauuuuuaucauuacaaccaauccaacgacccaacuauuaaauuaaucgccauguuauacacuccacuacgagcaaacaaugcaggagaugauguauuuacaguaucauguagaguucuuacgcguccaucaccugacuucgacuucauauuccuaguuccaccuacaguagaauccagaaccaaaccauucucaguaccaguauuaacaguagaagaaaugacaaauucaagauuuccuauuccacucgaaaaauuauuuacaggaccaucaucagcauuuguuguucaaccacaaaacgguagaugcacuacagauggaguauuacuagguaccacacaacuaaguccaguaaauauauguacuuucagaggugacguaacccauaucacaggaucacgaaauuacacuaugaaccuugcaucacaaaacuggaacaauuacgauccaaccgaagaagucccagcacccuuagguacacccgauuuugucggaaaaauacaaggaauguuaacacaaacaacuagaacagacggaucuacaagaggacacaaagcaacaguauacacaggcucagcagacuuuacuccaaaacuaggaagaauccaauuugaaacagauacagaccacgauuucgaagccaaucaaaauaccaaauuuacuccaguaggaguaauacaagauggaucuacaacacaccgaaaugaaccucaacaaugggucuuaccaucauauucugguagaaauacacauaauguucaccuugcaccagcaguugcaccaacauuuccuggagaacaauuauuauucuuucgaucuacuaugccagguugcaguggauauccaaacauggauuuagauugucuacuaccucaagaauggguccaauauuucuaucaagaagcagcuccagcccaaucagauguagcacuuuuaagauuuguaaauccagauacaggaagaguacuuuucgaaugcaaacuacauaaaucagguuauguaacaguagcacacacaggccaacaugaucucguaauuccacccaacggcuacuuccgcuucgauucauggguaaaucaauucuacacucuagcaccuauggguaauggaacagguagaagaagaguauaa

SEQ ID NO: 33486 - RNA, 1620 nt, Artificial Sequence
  derived and/or modified sequence opt6 from VP1__Norovirus_and/or_Norovirus-like__KT780393
augaaaauggcaagcucagaugcaaacccuuccgacggaucugcagcuaacuuagucccugaaguaaacaaugaaguuauggcacuagaacccgucguaggagccgcuauagccgccccaguagcaggacaacaaaauguaauugaccccuggauacgaaacaauuuuguccaagcuccaggaggagaauuuacagucuccccaagaaaugcgccaggagaaauauuaugguccgcaccauuaggacccgaccuaaauccuuaucuaucacauuuagcacgcauguauaauggauacgccggaggauucgaaguacaaguaauauuagcaggaaacgcauuuacugcaggcaaaguaauuuucgcagccguuccaccaaauuuuccaacugaaggauuaucuccuucacaaguaacaauguucccacauauagucguugacguaagacaacuugaaccugucuuaauaccauuaccagauguaagaaauaauuuuuaucauuacaaccagucaaaugacccaacaauaaaacuuauugcaaugcuauauacacccuuacgagcuaacaaugccggugaugauguauuuacaguuucauguagaguacuaacucguccauccccagacuuugacuucauauuuuuaguacccccaacaguagaaucacgaacuaaaccauucuccguaccuguacuuacaguagaagaaaugacaaauucaagauuuccuauuccauuagaacgucucuucacaggccccucaucagcauucguuguacaaccacaaaacggaagaugcacaacagaugguguuuuacucgggacaacacaauuaacaccuguaaacaucuguacauuuagaggcgacguaacacauauaacugguucaagaaauuacaccaugaaucuagcaucacaaaacuggaauaacuaugauccaacagaagaaauaccugcaccauuaggaacacccgauuuuguaggaaaaauacaaggaauguuaacacaaacuacacgaacagaugggucuacaagaggacacaaagcaacagucuauacaggaagcgcagacuucgcaccaaaacucggaagaguacaauucgaaacagacacugaccaugauuucgaagcaaaucaaaacaccaaauucacacccguaggaguaauccaagaugguuccacaacacaucguaacgaaccacaacaauggguauuaccaucuuauucagguagaaauacacauaauguacauuuagccccagcaguagcaccuaccuuuccaggagaacaauuacuauucuuuagaaguacaaugccaggcuguuccggauacccaaauauggaccuagauuguuuauuaccacaagaauggguacaacacuuuuaucaagaagcagccccagcacaauccgaugucgcacuauuaagauuuguaaacccagauaccggaagaguacuauuugaauguaaacuacacaagucuggauaugucacaguagcacauacaggacaacacgauuuaguaauaccaccaaacggcuauuuucgauuugauucauggguaaaccaauucuacacuuuagcaccaaugggaaauggcacaggaagaagacguguuuaa

SEQ ID NO: 33487 - RNA, 1620 nt, Artificial Sequence
  derived and/or modified sequence opt6 from VP1__Norovirus_and/or_Norovirus-like__KX354043
augaaaauggccucuuccgacgccaacccuuccgauggauccgcagcuaacuuaguaccagaaguaaacaaugaaguaauggcuuuagagccuguaguaggagcagcuauugcagccccaguagcaggacaacaaaauguaauugauccuuggauucgcaacaacuuuguacaagcaccaggaggagaauuuacaguaucaccacguaaugcaccaggagaaauacuuuggucagcacccuuaggaccugaucuuaacccuuaucuaucacacuuagcccgaauguauaacggauaugcaggcggauucgaaguccaaguaauacuagcagguaaugcuuuuaccgccggaaaaauaauauucgcagcaguaccaccaaacuuuccuacagaaggccucucaccuucacaaguaacaauguuuccacacauaaucguagauguacgacaacuagaaccgguauuaauaccccuaccagacguaagaaacaauuucuaucacuacaaucagucaaacgacucaacuauaaaauuaauagcuauguuauauacaccucuaagagcaaacaaugcaggagaugauguauuuacuguaucaugcagaguacucacaagaccauccccagauuuugacuucaucuuuuuaguaccaccaaccguagaaucaagaacuaaaccuuuuucaguaccgguacuaacaguagaagaaaugacuaauucacgcuucccuauaccacuagaaaaacuuuuuacaggaccaucuucugcuuucgucguacaaccacaaaauggucgaugcacaacagauggaguacuauuaggaacuacccaacuaucaccaguaaauauaugcacauuccgaggagacguaacacauauaacagguucuagaaauuacacaaugaaucuagcaucacaaaauuggaacaauuaugauccaacagaagaaauacccgcaccauuaggcacaccagacuuuguaggaaaaauacaaggcaugcuaacacaaacuacacgaacagauggaucaacaagaggucacaaagcaacaguauauacugguucugcagacuuugcuccaaaacuaggaagaguacaauuugaaacagauacagaucaugauuuugaagcuaaccaaaacacaaaauucaccccaguagguguaauacaagacggcucuacaacccaccgaaaugaaccacaacaauggguacuaccuagcuauucaggacgaaacacuuauaauguacauuuagcaccagcaguugcaccaacauuucccggagaacaacuauuauucuuucgaucuacaaugccagguugcuccggcuaccccaauauggauuuagacugucuauuaccacaagaauggguacaacauuuuuaucaagaagccgcaccagcacaaucagauguugcacuuuuacgauuuguaaauccagacaccggacgagucuuauuugaauguaaauuacauaaaaguggauauguaaccguugcccacacaggacaacaugacuuaguaauuccaccaaauggauacuuuagauucgauucuuggguaaaucaauuuuacacacucgccccuauggguaacggaacaggcagaagacgaguauaa

SEQ ID NO: 33488 - RNA, 1620 nt, Artificial Sequence
  derived and/or modified sequence opt6 from VP1__Norovirus_and/or_Norovirus-like__KX354008
augaaaauggcaucaucagaugcuaacccaucagauggaucugcagcuaaccuaguaccugaaguaaauaaugaaguuauggcacuugaaccugucguaggcgcagcaauagcugcaccagucgcuggucaacaaaacguaauagacccuuggauaagaaauaacuucguacaagcaccuggaggagaauuuacuguuucaccacgaaacgcaccaggagaaauucuauggucugcaccacuuggaccagaccuaaaucccuaucuaucacaucuagcaagaauguacaaugguuacgccggagguuuugaaguucaaguaauauuagcaggaaaugccuuuacagcuggaaaaguaauuuucgcagcaguaccaccuaauuuuccaacagaaggacuaaguccaucacaagucacaauguucccacauauuguaguagacguaagacaacuagaaccaguacucauaccacuaccagacguaagaaacaauuuuuaucauuauaaccaauccaaugacccaacaauuaaguuaauagcuaugcuauacacaccacuaagagcuaacaaugccggugacgauguuuuuacaguaagcuguagaguucuaacccgccccuccccugacuucgacuuuaucuuucuaguaccaccaacaguugaaucacgaacuaaacccuuuucuguuccaguccuaacaguugaagaaaugacaaacagucguuuuccaauaccacuagaaaaacuauuuacuggaccuuccucagcuuucguaguccaaccacaaaaugggagauguaccacagacggaguacuccuaggaacaacacaauuauccccaguaaauauaugcacauuuagaggagauguaacacauauaacuggcucuagaaacuacacaaugaaccuugcaucacaaaauuggaauaacuacgaccccacagaagaaguaccagcaccacuaggaacaccugacuucguaggaaaaauacaaggcauguuaacucaaacuacaagaaccgacggaucaacuagaggacacaaggcuaccguuuacacugguucugcagacuucacaccaaaacuaggcagaauccaauuugaaacagauacagaucaugauuucgaagcaaaucaaaauacaaaauucacaccaguuggaguaauucaagauggcucuacaacacacagaaaugaaccacagcaauggguacuuccauccuacucaggacgaaauacacacaacguacaucuagcuccugcaguagcaccaacauuucccggcgaacaauuauuauuuuucagaucaaccaugccuggauguucuggauauccaaauauggaucuugauugccuucuaccacaagaauggguacaauacuuuuaucaagaagcagccccagcucaaucugacguagcccuauuacgcuuuguuaacccugauacaggucgcguccucuucgaauguaaacuacauaaauccggauacguuacuguagcauauacaggacaacacgauuuaguaauuccaccuaaugguuauuuccguuucgauuccuggguaaaucaauuuuacacacuggcaccuaugggcaacggaacaggacgaagaagaguauaa

SEQ ID NO: 33489 - RNA, 1620 nt, Artificial Sequence
  derived and/or modified sequence opt6 from VP1__Norovirus_and/or_Norovirus-like__KR904217
augaaaauggcaucaucagacgcaaaccccucagauggaucaacagcaaacuuaguaccagaagucaacaaugaaguaauggcccuagaaccaguaguaggagcagcaauagcagcaccaguugcaggacaacaaaaugucauugauccuuggauacgaaacaauuuuguacaagcaccaggaggugaauuuacaguauccccuagaaaugcuccuggagaaauauuauggucagcucccuuaggucccgaccucaacccauauuuaucucacuuagcaagaauguauaauggcuacgcuggagguuucgaaguacaaguuauucuagcaggaaacgcauucacagcagguaaaauaaucuuuuccgccguaccaccuaauuucccaacugaaggacuaucacccucacaaguaacaauguuuccacacauuauaguagacguaagacaauuagaaccuguauuaaucccuuuaccagaugucagaaacaauuucuaucacuauaaucaaucaaaugacccaacaaucaaacuaaucgcuaugcuauauacaccucuaagagccaacaacgcaggagacgauguauuuacaguauccugcagaguauuaacaagaccaucaccugacuuugacuuuauauuccucguuccaccaacaguagaauccagaacuaaaccuuuuagcguccccauucuuacuguagaagaaaugacuaauucaagauuucccauuccccucgaaaaacucuuuacaggcccaucauccgcuuucgucguacaaccucaaaauggaagauguucaacagauggaguuuuacuaggaaccacacaauuauccccaguuaauauauguacauuuagaggagacguaacacauauagcaggcucacacaacuauaccaugaauuuagcaucccaaaauuggagcucauacgaucccacagaagaaauaccagcaccucuaggaacaccugauuuuguaggaaaaauacaagguguauuaacacaaacuacaagaucagauggaucaacccgaggccauaaagcaaccguauacacaggaucugcugacuuuucaccaaaauuaggccgcguacaauucgcaacagauacugauaacgauuuuguauccaaucaaaauacaaaauucacuccaguaggcguuauacaagauggcgacacugcacauagaaaugaaccacaacaauggguucuaccaucauauuccgguagaaauauacauaauguucaccuagccccugccguagcaccuaccuuuccaggagaacaauuacuauucuuuagaucaaccauaccaggauguucaggauauccuaauauggaucuagauuguuuauuaccacaagaauggguacaauauuuuuaucaagaagcagcucccgcacaaucugauguagccuuacuccgauucguaaacccagacacaggaagaguucuauuugaauguaaacuccauaaaucaggauacguaacaguagcucacacuggccaacaugaucucguaauaccaccaaacggauacuucagauuugauucauggguaaaucacuuuuacacuuuagcaccaaugggaaauggcacaggccgacgucgaguauaa

SEQ ID NO: 33490 - RNA, 1620 nt, Artificial Sequence
  derived and/or modified sequence opt6 from VP1__Norovirus_and/or_Norovirus-like__KJ685412
augaaaauggcuucaucugaugccaauccaucagauggaagugccgccaauuuaguaccagaaguuaacaaugaaguuauggcauuagaaccagucguaggagcagcuauugcugcaccagucgcaggacaacaaaauguaauagauccuuggauaagaaauaacuuuguccaagcaccaggaggagaauuuacaguuucaccccgaaaugcaccuggagaaauucuauggagcgcaccucuaggaccagauuuaaauccauaucuaucacauuuagcuagaauguauaauggauaugcaggcggauuugaagugcaaguaauucuagcagguaacgcauucacagcaggaaaaguaauuuucgcagcuguaccaccaaauuuuccaacagaaggauuaucaccaucacaaguaacaauguuuccacauauaguaguugauguaagacaacuggaaccaguucuaaucccuuuaccagacguacgaaauaauuucuaucauuacaaucaauccaaugauccuacuauaaaacuaaucgcaauguuauauacuccucuaagagcaaauaaugcuggagaugauguauuuacaguauccuguagagucuuaacuagaccaucacccgauuuugacuucauauuuuuaguaccaccaaccgucgaaucucguacaaaaccuuuuucuguaccaguacuuacaguagaagaaaugacaaauagucguuuuccuauaccauuagaaaaauuauucacaggcccaucaucagcauuuguaguucaaccacaaaaugguagauguacaaccgacgguguucuacuugguaccacucaauuaucuccaguaaauauauguacuuucagaggcgacguuacacacauuacaggaagucauaacuauacuaugaaucuagcuucacaaaauuggaauaacuacgacccaacagaagaaauuccugcaccauuaggaacuccagauuucguuggcaaaauacaaggcguacuaacacaaacaacaagaacagauggaucaaccagaggacauaaagcaacaguauauacagguucagcugauuucgcacccaaauuaggcagaguucaauuugcaacagacacagaucaugacuucgaagcaaaucaaaacacaaaauuuacaccaguuggaguaauacaagacggcgguacaacucauagaaaugaaccucaacaauggguauuacccucauacucaggaagaaauacccacaacguacaucuugccccagcuguagcaccuacauuuccgggagaacaacuacucuucuuuagaaguacaaugccaggaugcucagguuacccuaacauggacuuagacugcuuauuaccacaagaauggguacaauacuuuuaccaagaagcagcaccagcacaaucugacguagcccuauuaagauuuguuaauccagacacaggccgaguuuuauuugaauguaaauuacacaaaaguggcuacguaacaguagcccauaccggucaacaugaucuaguaauaccaccaaacggcuacuuccgauuugauucauggguaaaucaauuuuacacauuagcaccaauggguaacggaaccggaagaagacguguauaa

SEQ ID NO: 33491 - RNA, 1620 nt, Artificial Sequence
  derived and/or modified sequence opt6 from VP1__Norovirus_and/or_Norovirus-like__KF008240
augaaaauggcuagcagcgaugcaaaccccuccgauggaucagcagccaaccuuguuccagaaguaaacaaugaaguaauggcucuagaacccguaguaggagcagcaauagcagcaccaguagcuggucaacaaaaugucaucgauccauggauucgaaauaauuuuguacaagcaccaggaggagaauuuacagucucccccagaaacgcaccaggagaaauacuauggucagcuccucuagguccugaucuaaauccauaucuuucucauuuagcuagaauguauaacggcuaugcugguggauuugaaguccaaguaauauuagcaggaaacgcauucaccgcaggaaaaguaaucuucgcugcaguaccaccaaacuuuccuaccgaagguuuaucuccaucucaaguaaccauguuuccucauauaguaguagacguaagacaauuagaaccaguacuaauaccacuuccagacgucagaaauaauuuuuaucacuauaaucaaucaaaugacccaacaauaaaauuaauagcaauguuauacacaccacuaagagccaauaaugcuggagaugaugucuuuacaguaucaugcagaguuuuaacuagaccuucaccugacuuugacuuuauauuucuaguucccccaacaguagaaucucgaacuaaacccuucucaguacccguauuaacaguagaagaaaugacaaacucacguuuuccaacaccgcuugaaaaauuauuuacaggaccaucauccgcauuuguaguacaaccacaaaacggaagauguacaacagacggaguacuacuaggcaccacacaacuuucuccaguaaauauaugcacauuuagaggugauguuacucauauaacaggaucaagaaauuacaccaugaauuuagccucacaaaacuggaacaauuacgauccaaccgaagaaauuccagcaccccuaggaacaccugacuucguaggaaaaauacaagguguauuaacacaaacaacaagaacagauggaucaacuagaggacacaaagcaacuguauauacaggcucagcagacuucgcaccaaaacuaggaagaguacaguucgaaacagauaccgaucacgacuucgaaguaaaucaaaauacuaaauucacaccaguaggaguuauccaagacggaggaacaacacauagaaaugaaccacaacaauggguacuaccaucuuauucaggaagaaauacacauaacguacacuuagccccugcuguagcaccaaccuuuccaggagaacaauuacuauucuuuagaaguacaaugccaggcugcuccggauauccaaacauggaucucgauugccuacuaccacaagaauggguacaauauuuuuaucaagaagcagcccccgcacaaagcgacguugcacuccucagauucguaaacccagauacaggaagaguacuauuugaauguaagcuacauaaaucuggauaugucacaguagcacacacuggucaacaugaucuaguuauaccaccaaauggauauuuucguuuugauagcuggguaaaucaauucuacacacuagcaccaauggguaacggaaccggaagaagacgagucuaa

SEQ ID NO: 33492 - RNA, 1620 nt, Artificial Sequence
  derived and/or modified sequence opt6 from VP1__Norovirus_and/or_Norovirus-like__KX354125
augaaaauggcauccucagaugcaaaccccucagauggaucagcugcaaacuuaguuccagaagcaaacaacgaaguaauggcucuagaaccaguaguuggcgcagcaaucgcagccccaguagcaggacaacaaaauguaauagauccuuggauacgaaauaacuuuguacaagcaccaggaggcgaauuuaccguuucaccaagaaaugcgccaggagaaauauuauggucagcaccacucggaccagauuuaaauccauaucuuucacaccucgcacgaauguauaauggauacgcaggaggauuugaaguucaagucauacuagcagguaaugcauuuacugcaggaaaagucauuuuugcugcaguuccaccaaacuucccaacggaaggacuaucaccaucacaaguaacaauguuuccucauauaguagucgauguaagacaacuagaaccaguacuaauaccauuaccugauguaagaaacaauuuuuaccacuauaaccaaucuaacgacccaacaauuaaauuaauagccauguuauacaccccauuaagagcuaauaacgccggcgacgaugucuuuacagucaguuguagaguacuaacaagacccuccccugacuuugacuuuauuuucuuaguaccaccuacaguugaaucaagaacaaaaccauucucaguacccguucuaacaguugaagaaaugacaaacuccagauucccaauuccauuagaaaaacuauuuaccgguccaaguucugcauuuguaguacaaccccaaaauggacgauguacaacagacggaguucucuuaggaaccacucaauuaucaccuguaaauauauguacauuuagaggagauguaacccacauaacaggaucuagaaauuacacuaugaaucuugcuucacaaaacuggaauaauuacgauccuacugaagaaauaccagcaccuuuaggaacaccugauuuuguaggaaaaauucaaggcaugcuaacacaaacuacaagagcugaugguuccacucgaggacacaaagcuacaguauauacaggcuccgcagauuuuuccccaaaauugggacgaguacaauucgaaaccgauacagaucaugauuuugaagcaaaucaaaauacaaaauuuacuccagucggcguaauacaagauggcucaacuacacauagaaaugaaccccaacaauggguucuaccuucauauucaggaagaaacacacauaacguacacuuagcaccagcaguagcuccaacauuuccaggagaacaacuacuauucuuucgaucaacaaugccagguuguucagguuacccaaauauggaccuagauugccuacuaccacaagaauggguacaauauuucuaucaagaagcagcuccagcccaauccgauguugcauuacuaagauucguaaaucccgauacuggacgaguacuauucgaauguaaauuacacaaaucaggauaugucacaguagcacauacaggccaacaugacuuaguuauaccacccaauggauauuuccguuucgacucauggguaaaucaauuuuauacucuagccccaauggguaacggaacagguagaaagagaguauaa

SEQ ID NO: 33493 - RNA, 1620 nt, Artificial Sequence
  derived and/or modified sequence opt6 from VP1__Norovirus_and/or_Norovirus-like__KX354094
augaaaauggcuucuucagaugcaaacccaucagauggauccgcugcaaacuuaguaccagaaguuaacaacgaagucauggcauuagaaccaguaguaggcgcagcaauagcagcaccuguagcaggacaacaaaauguaauagauccuuggauacgaaauaauuucguacaagcaccaggaggagaauuuacaguaucgccaagaaaugccccaggagaaauacucugguccgcgccacucgguccagaucuaaacccauacuuaucacaccuagcaagaauguacaauggauaugccggcggauucgaaguucaaguaauacucgcaggaaaugcauuuacagcuggaaaaguuauauuugccgcaguaccacccaacuucccuacagaaggacuaucaccaucacaaguaacuauguucccccacauaguagucgacguaagacaauuagaaccaguacuaauaccauuaccagauguacgaaacaauuucuaucacuacaaucaaucaaaugacccaacaauaaaacuuauagcuauguuauauacuccacuuagagcuaacaaugccggagacgauguauucacuguuucauguagaguacuaacaagaccaucaccagauuucgacuuuauauuccuagucccucccacaguagaaucucguacaaaacccuuuuccguaccaguacuaaccguagaagaaaugacaaauucaagauuuccaauaccucuagaaaaauuauuuacaggacccucuucagcuuuuguaguacaaccacaaaauggaagaugcacaacagaugguguauuacuaggaacaacacaacuuuccccaguaaacauaugcacauuuagaggagauguuacacacauaacagguucaagaaauuacacaaugaacuuagcaagucaaaacuggaacaauuacgacccuacagaagaaauaccugcaccuuuaggaaccccugacuuugugggaaaaauacaagguguccuaacucaaaccacaagaacagacgguagcacaagaggucacaaagcaacaguauauacagguagcgcagacuuugcaccuaaacuagguagaguacaauucgaaacagauacugaucaugauuucgaagcaaaucaaaauacaaaauuuaccccuguaggaguuauacaagacggauccacaacacacagaaacgaaccucaacaauggguuuuaccaucauauucaggaagaaacacccacaacguacaucucgccccagcagucgcaccaacauuuccaggcgaacaacuauuauucuuuagaucaacaaugccaggaugcucaggauauccaaauauggaucucgauugccuucucccccaagaauggguacaauauuuuuaccaagaagcagcaccagcacaaucagauguugcacuccuacguuuuguuaacccagacacaggcagaguauuauucgaaugcaaauuacauaaaucuggauauguuacaguagcacacacuggacaacaugacuuagugauacccccaaauggcuauuucagguucgauucaugggucaaucaauucuacacacuagcaccuaugggaaauggaacaggacgaagaagaguauaa

SEQ ID NO: 33494 - RNA, 1620 nt, Artificial Sequence
  derived and/or modified sequence opt6 from VP1__Norovirus_and/or_Norovirus-like__KX354058
augaaaauggcaucaucagaugcaaacccauccgauggaucagcagcaaaucuaguacccgaaguuaauaaugaaguaauggcgcuagaaccaguaguaggagcagcuauugcagccccagucgcaggacaacaaaaugucauagacccuuggauuagaaauaacuuuguacaagccccaggaggagaauuuacaguaucccccagaaacgcaccaggagaaauauuauggagugcaccauuaggcccagauuuaaauccauauuuaucucacuuagcaagaauguauaacggauaugcuggaggauucgaaguacagguaauacuagcuggaaaugccuuuacagcuggaaaaguaauuuucgcugcagucccaccaaacuuuccaacagaaggacuauccccaucucaaguaacaauguucccacauauuguuguugacgucagacaauuagaacccguacuaauuccacuaccagacguaagaaacaacuucuaucacuauaaccaaucaaaugacccaaccauuaaauuaauagcaaugcuauacacuccauuaagagcuaacaaugcaggagacgaugucuuuacagucuccugcagaguauuaacccguccaucaccagacuuugacuuuauauucuuaguuccaccaacaguagaaucaagaacuaaaccuuucucaguuccaguuuuaacuguagaagaaaugaccaauagcagauuuccaauaccacucgaaaaacuuuuuacaggaccaaguucagcauuuguuguacaaccacaaaauggcagauguacaacagaugguguacuauuaggaacaacacaauuaaguccuguaaauauauguacauuuagaggcgacguaacacacaucgcaggauccagaaacuacacaaugaaccucgccucacaaaacuggaacaauuacgauccaaccgaagaaauaccagcaccccuaggaacaccagacuucguaggaaaaauucaagguaugcuaacccaaacaacaagaacagacggcucaaccagaggacacaaagcaaccguuuacaccggaucagcagaauuugcaccuaaacuaggaagaguacaauucgaaacagauacagaucaugauuucgaaacaaaucaaaauaccaaauucacaccaguaggagucauccaagacggcagcaccacucacagaaaugaaccccaacaauggguuuuaccuucauauagcgguagaaauacacauaacguacaccucgccccugcuguagcccccacauuuccuggagaacagcuucuuuucuuuagaucuacaaugccuggaugcucaggauacccuaacauggauuuagauugucuuuuaccacaagaauggguccaauauuucuaucaagaagcagcaccagcacaaucugacguugcauuauuaagauucgucaauccagacacaggcagaguacuauuugaaugcaaacuacacaaaucagguuauguaacuguugcucacacaggucaacacgauuuaguaaucccuccaaauggauacuucagauucgacaguuggguaaaucaauucuacacacuagcacccaugggcaauggaacaggaagacguagaguauaa

SEQ ID NO: 33495 - RNA, 1620 nt, Artificial Sequence
  derived and/or modified sequence opt6 from VP1__Norovirus_and/or_Norovirus-like__KX354057
augaaaauggcaucaucagaugcaaacccuucugauggauccgcagcaaaucuaguaccagaaguaaacaacgaagucauggcacuugaaccaguaguaggagcugcaauagcagcaccaguagccggacaacaaaacguaauagaccccuggauaagaaauaauuucguacaagcaccaggaggagaauuuacaguauccccaagaaaugcaccgggagaaauccuuuggucugcaccacuaggaccagauuuaaauccauaucuaucacauuuagcaagaauguauaauggauaugcuggaggauucgaaguacaaguaauacuagcaggaaaugcauucaccgcuggaaaaguuauauucgcugcagucccaccaaauuucccaacugaaggucuaucaccaucacaaguuacaauguucccacacauagucguugacguaagacaauuagaaccaguauuaaucccacuaccagauguccgaaacaacuuuuaucacuauaaccaaagcaaugacccaacaauaaaauuaauagcuaugcucuacaccccauuaagagcaaauaaugcaggagaugauguauuuacaguauccuguagaguucuaacucgacccucaccagacuuugauuuuauauuucuaguuccaccaacagucgaaucuagaacuaaaccauuuucuguaccaguuuuaacaguagaagaaaugacaaauucucguuuuccaauaccuuuagaaaaacuauucacagguccaucauccgcauuugucguccaaccccaaaacggaagauguacaacugauggcguauuacuugguacaacacaauuaagcccuguaaauauauguacauucagaggagauguaacacacauaacaggaucacgaaacuauacaaugaacuuagcaucacaaaacuggaauaauuacgauccaacugaagaaaucccugcaccauuagguacgccagacuuugucggaaaaauacaaggaauguuaacacaaacaaccagaacugauggcucaacuagaggacauaaggcaacaguauauacuggcucagcagaauuugcaccaaaauuaggaagaguacaauucgaaacugauacagaucacgacuuugaaacaaaucaaaauacaaaauuuacucccguaggaguuauacaagauggaucaaccacacauagaaaugaaccacaacaauggguacucccuucuuacucaggacgcaauacacauaacguucacuuagccccagcuguugcaccuaccuuuccaggagaacaacuauuauucuucagauccacaaugccagguugcucugguuacccaaauauggaucuagacugccuauuaccacaagaguggguacaauauuucuaccaagaagccgcaccagcacaauccgauguagcacugcuaagauuuguaaacccugacacaggaagagucuuauucgaauguaaauuacauaaaucaggauacgugacaguagcacacaccggacaacaugauuuaguuauacccccaaacggauauuucagauucgacuccuggguaaaucaauuuuauacucucgcaccaaugggaaauggaacagggagacgcagagucuaa

SEQ ID NO: 33496 - RNA, 1620 nt, Artificial Sequence
  derived and/or modified sequence opt6 from VP1__Norovirus_and/or_Norovirus-like__KX354034
augaaaauggcauccucagaugccaauccaucagauggaucugccgcaaguuuaguaccagaaguaaacaaugaagucauggcacuagaacccguaguaggagcagcaaucgcagcuccaguagcaggacaacaaaauguaauugacccauggauucgcaauaauuucguccaagcaccaggaggugaauuuaccguaucuccaagaaacgcaccaggagaaauauuauggucagcaccacuuggaccagauuuaaauccuuauuuaucucaccuugcuagaauguauaacgguuaugcaggaggauucgaaguacaaguuauacuagcaggcaaugcuuuuacagcaggaaaagucauauuugcagcagucccuccaaacuuucccacagaaggucuuucaccgucacaagucacaauguuuccccacauuguaguugacguaagacaauuagaaccaguauuaauaccauuaccugauguaagaaacaauuuuuaucacuauaaccaaucuaacgacccaacaauaaaauuaauagccaugcuauauacuccuuuacgagcaaacaacgcaggagaugauguuuuuacaguuucaugccguguucuaacaagaccauccccagauuuugacuuuauauuucuuguaccuccaacaguagaauccagaaccaaaccuuuuagcguuccaguauuaacaguagaagagaugacaaacucuagauuuccuauuccacucgaaaaacuauuuacaggaccaucaucugcauucguaguacaaccacaaaauggaagaugcaccacagacggaguacuacuagguacaacacaauuaucaccagucaauauauguacauuucguggugacguuacacauauaacuggaucuagaaacuacacaaugaaccucgccagccaaaauuggaauaauuaugaccccaccgaagaaauuccugcaccccuaggaacaccugauuucguugguaaaauacaaggaguacuuacacaaaccacuagaacagauggaucaacaagaggacacaaagcaaccguuuacacuggauccgcagauuuugcaccaaaauuaggacgaguacaauuugaaacagacaccgaucacgauuuugaagccaaucaaaacacuaaauucacacccguaggaguaauacaagacggaggaacuacucaucgaaacgaaccacaacaaugggucuuaccaucauacagcggacguaacacacauaacguccaucuagcaccagcaguagcaccuacauuuccaggagaacaacuauuauucuuuagaucuaccaugccuggauguucaggauauccaaauauggauuuagauugcuuauuaccacaagaauggguacaauauuuuuaucaagaagcagcacccgcucaaagugauguagcacuuuuaagauuuguaaaccccgauacaggaagaguauuauuugaauguaaacuacacaaaucaggauacguaacagucgcccacacaggacaacaugaccuuguaauaccacccaauggauacuuuagauuugauagcugggucaaucaauucuacacauuagccccaaugggaaacggaacaggucgaagacgcguauaa

SEQ ID NO: 33497 - RNA, 1620 nt, Artificial Sequence
  derived and/or modified sequence opt6 from VP1__Norovirus_and/or_Norovirus-like__KX354027
augaaaauggcaucauccgaugcaaaucccagcgaugguagugcugccaaucuaguaccagaaguaaauaaugaagucauggcauuagaaccaguuguuggugcagcaauagcagcaccuguugccggacaacaaaauguaauagauccauggauaagaaacaauuucguacaagcaccagguggugaauuuacaguaucuccacgaaaugcaccaggugaaauauuauggucugcaccauuaggaccugaucuaaauccuuaucuaucucaucuugcccguauguacaaugguuacgcuggaggauuugaaguacaaguaauacuagcagguaaugcuuucacagccggaaaaguuauuuucgcugcaguuccacccaauuuuccaacagaagguuuaucaccaucucaagucacaauguuuccacauauaguaguagauguaagacaacuagaaccgguccuaauuccauuaccagauguaagaaauaauuuuuaucauuauaaccaaagcaaugacccaacaauaaaauuaaucgcaaugcuauacacuccacuaagagcuaauaaugccggagacgauguuuucacaguuucuuguagaguuuuaacuagaccaucuccagacuucgacuuuauauuucuaguaccuccaacaguagaaaguagaacaaaaccuuuuucaguuccuguauuaacuguugaagaaaugaccaauucacguuuucccauaccacuagaaaaacucuuuacaggaccaucuucagcauucguaguacaaccacaaaacggccguugcacuacugacggaguuuuacucgguacaacucaacuaucuccaguaaauauauguacauuucgaggagauguaacgcacacuacagguucacgaaauuauacaaugaaucuagccucccaaaauuggaacaauuacgauccaacagaagaaaucccagcuccauuaggagcaccagacuuuguagguaaaauacaaggaauguuaacacaaacaacccgagcagacggaucaacacgaggacauaaagcaacaguuuauacaggaucagcagauuuugcacccaaauuaggaagaguccaauuugaaacagacacugaccaugauuuugaagcaaaccaaaauacaaaauuuacacccguuggaguaauacaagacgguucaacuacacacagaaacgaaccacaacaauggguccuaccauccuacuccggaagaaauacacauaacguacaccuagcaccagcaguagcaccaacuuuuccaggugaacaauuacuauucuuuagaucaaccaugccaggauguaguggauauccuaauauggauuuagauugcuuacuaccacaagaauggguucaauauuuuuaucaagaagcagccccugcacagagugauguagcacuauuaagauucguuaauccagauacaggcagaguauuauucgaauguaaacuacauaaaucaggauacgucacuguugcucacacaggacaacaugauuuaguaauaccaccaaaugguuacuuucgauucgacucauggguaaaucaauucuauacacuagccccaaugggaaauggugcaggaaggagaagaguauaa

SEQ ID NO: 33498 - RNA, 1620 nt, Artificial Sequence
  derived and/or modified sequence opt6 from VP1__Norovirus_and/or_Norovirus-like__KX354025
augaaaauggcaucaucugaugccaacccaucagauggaucagccgcaaaucuaguaccugaaguaaauaaugaaguaauggcauuagaaccaguaguaggagcugcaaucgcagcaccaguagcuggucaacaaaauguaauagacccauggauucgaaacaauuuuguucaagcgccaggcggugaauuuacaguaucaccucgaaaugcaccaggugaaauauuauggucugcaccucuaggaccagaucuaaacccauaccuaucacacuuagcccguauguauaauggauacgccggcggauucgaaguucaaguaauauuagccggcaaugccuuuacugcaggaaaaguaauauucgcagcaguaccuccaaacuuucccacagaagguuuaucuccaucucaaguaacaauguuuccacacauaguagucgauguuagacaacuugaaccugucuuaauaccacuaccagauguucguaacaauuucuaucauuauaaccaaucuaaugauccaacuauaaaacuaauagcaauguuauacaccccauuaagagccaauaaugcaggagacgauguauucaccguuucauguagaguacuaacuagaccauccccagauuucgacuuuauauuucuaguuccaccaacaguagaaucaagaacaaaaccuuucucaguuccaguauuaacagucgaagaaaugacaaacucccgauuuccaauaccauuagaaaaacuauuuacaggaccaucaucugcauucguaguacaaccacaaaacgguagauguacaacugacggaguauuacuagguacuacccaacuaucaccaguaaauauauguacauuuagaggagauguaacccauaucacuggaucuagaaacuauacaaugaacuuagcaucacaaaauuggaauaauuacgauccaacagaagaaauaccagcaccacuuggaacaccagauuucguaggcaaaauccaaggaguacuaacccaaacaacaagagccgacggcucaacaagaggacacaaagcaacaguauauacaggaucagcagacuuugcaccuaaauugggcagaguacaauuugaaacugauacugaucacgauuucgaggccaaucaaaacacaaaauuuacaccagucggaguuauacaagauggcgguacaacucauagaaaugaaccacaacaauggguauuacccuccuauucaggaagaaauacacauaauguacaucuugcaccagcaguagcuccuacauuuccuggcgaacaacuacuauucuuuaggucuaccaugccaggaugcucaggcuauccuaauauggauuuagauugcuuauuaccacaagaauggguacaauauuucuaucaagaagccgcuccugcacaaucagacguagcacuuuuaagauuuguaaacccagacacaggcagaguccucuucgaaugcaaacuacacaaaucaggauauguaacaguagcacauacuggacaacacgaucuaguaauaccaccuaacggauauuuucgauuugauuccuggguuaaucaauucuacaccuuagcccccaugggcaacggaacuggaagaagaaggguauaa

SEQ ID NO: 33499 - RNA, 1620 nt, Artificial Sequence
  derived and/or modified sequence opt6 from VP1__Norovirus_and/or_Norovirus-like__KJ685406
augaaaauggcuucuucugaugcaaacccaucugacggcucagcagcuaaucucguaccagaaguuaauaaugaaguuauggcuuuagaaccaguaguaggugcagcaauagcagcaccaguagcaggacaacaaaacguaauagauccuuggauucgaaauaauuucguacaagccccuggaggagaguuuacaguuucaccuagaaaugcaccaggagaaauauuauggucugccccauuaggaccagauuuaaauccauauuuaucucaccuggcaagaauguauaacggauacgcaggcggauuugaaguacaaguaauacuagcaggaaaugcauuuacagcaggaaaaguuauuuucgcagcuguaccaccaaacuuuccaaccgaaggucuaucacccucacaagugacaauguucccacauauaguaguugauguucgacaacuugaaccaguuuuaaucccauuaccagaugucagaaacaauuucuaucacuauaaccaguccaacgauccaacaauuaaauuaauagcaaugcuuuauacaccucucagagcaaacaaugcaggagacgauguauucacuguaucaugcagaguauuaacacgaccaucaccagauuuugacuuuauauucuuaguaccaccuaccguagaaucaagaacaaaaccauuuucaguaccuguuuuaacaguagaagaaaugacaaacucacgauucccaauaccacuagaaaaauuauuuacgggaccaagcuccgcauucguaguacaaccacaaaacggucgauguaccacagacgggguccuauuagguacaacacaacuaagcccaguaaauauauguacauuuagaggagacguaacacacauaacaggaucaagaaauuacacaaugaaucucgccucacaaaauuggaacaauuacgauccaaccgaagaaauacccgcaccucuugguacaccagauuuuguaggcaaaauacaaggaguacuaacucaaaccacaagaacagauggaagcacaagaggccacaaggcuacuguauauacaggaucagcugacuuugcuccaaaacuaggaagaguccaauuugaaacagacacagaccaugauuucgaagccaaucaaaauacaaaauuuaccccaguuggagucauacaagacggaggaacaacucacagaaacgaaccccaacaauggguauuaccaucuuauuccggaagaaauacacauaacguacaucuagccccagcaguagcuccaacauuucccggugaacaauuacuauucuuuagaucaacaaugccaggaugcaguggauauccaaacauggacuuagauugcuuguuaccacaagaauggguacaauauuuuuaucaagaagcugcuccagcacaaagugauguagcacuucugagauuuguaaacccagacacaggaagaguacuuuuugaaugcaaacuccauaaaucaggcuauguuacaguugcacauacaggacaacacgaucuuguaauaccaccaaauggauauuucagauucgauuccuggguaaaccaauuuuauacuuuagcaccaaugggcaacgguacuggacgaagacgaguauaa

SEQ ID NO: 33500 - RNA, 1620 nt, Artificial Sequence
  derived and/or modified sequence opt6 from VP1__Norovirus_and/or_Norovirus-like__KF008241
augaaaauggcaucaucagaugcaaauccuuccgaugguucagccgcuaacuuaguuccagaaguaaauaaugaaguuauggcacuugaaccugucguaggagcagccauagccgcaccagucgcaggacaacaaaauguaauugauccauggauaagaaacaacuuuguacaagccccaggaggagaauuuacaguuucaccacgaaaugcaccaggagaaauauuauggucagcaccccuaggaccagauuuaaacccauauuuaucacacuuagcacgaauguacaacggauacgcaggagguuucgaaguucaaguaauacucgcaggaaaugcauucacugcggguaaagucauauucgcagcaguuccaccaaacuuuccaacagaaggacuaucuccaucucaagugacaauguucccacauauaguaguagacguaagacaauuagaaccaguacucauuccauuaccagaugucagaaauaauuucuaccauuacaaccaaucaaaugacccaaccauaaaacucauagcaaugcuuuacacaccacuaagggcaaacaacgccggugaugauguuuuuacaguaucuugcagaguucuaacuagaccaagcccugacuucgauuucauauuccuaguacccccuacagucgaaucaagaacaaaaccauuuucaguacccguauuaacagucgaagaaaugacuaacuccagauuuccaauaccccuagaaaaauuauucacaggaccuucaucugcauucguaguacaaccucaaaauggaagauguacaacagauggaguucuauuagguacaacacaacuaucacccguaucaauauguacauucagaggagacguaacacauauuacagguucccgcaacuacacaaugaaccuagcaucacagaacuggaacaauuacgacccaacagaagaaauaccagcaccacuuggaacaccugacuucguaggaaaaauacaaggaaugcuaacacaaacaacaagagcugacggaucaacaagaggacauaaagcaacaguauauacaggaucagcagauuuugcaccaaaacuagguagaguucaauuugaaacagauacugaucacgacuucgaagccaaccaaaauacuaaauucacuccaguuggaguaauacaagacggaucaacaacccacagaaaugaaccucaacaauggguuuuaccaucauacagcggaagaaacacacauaacguacacuuagcaccagcaguagcuccuacauuuccaggagaacaacuacuuuucuuucgaucaacaaugccagguuguuccggauauccaaacauggauuuagauugccuacucccacaagaauggguacaauauuuuuaucaagaagcagcuccagcccaaucugacgucgcauuacuaagauucguaaacccagacacuggaagaguacuauuugaaugcaaacuacacaaaucaggauacguaacaguugcacauacaggacaacaugaucuuguaauaccaccgaauggauauuucagauucgacucauggguuaaucaauuuuacacauuagcaccuauggguaacggaacaggacgacgacgaguauaa

SEQ ID NO: 33501 - RNA, 1620 nt, Artificial Sequence
  derived and/or modified sequence opt6 from VP1__Norovirus_and/or_Norovirus-like__AB504327
augaaaauggcaagcaaugacgccaauccaucagacggauccgcagcaaacuuagucccagaaguaaacaacgaaguaauggcauuagaacccguaguaggagcagcaauagcagcaccuguagccggacaacaaaauguaauagauccauggauucgaaauaauuuuguacaagcaccaggcggugaauuuacaguaucacccagaucagcacccggagaaauauuauggucagcaccuuuaggaccugacuuaaauccauaccuuucacacuuagcaagaauguacaauggauacgcaggaggauuugaaguacaaguuauacuagcuggaaaugcauuuacagccggaaaaauaauauucgcugccguaccuccaaacuuuccaaccgaaggacucucaccaagccaagucacuauguuuccacauauaauaguagacguaagacaauuagaaccaguccuaauuccucuuccugacgucagaaauaauuucuaucauuauaaccaaucaaacgacuccaccauaaaacuaauugcuaugcuauauacacccuuaagagcaaacaaugccggugaagauguguuuacaguuucaugcagagucuuaacacgaccaucacccgacuucgacuuuauauuucuaguaccacccaccguagaauccagaacaaaacccuuuacaguaccaauuuuaacaguagaagaaaugacuaacucacgauuuccaauacccuuagaaaaacuauuuaccggaccaucaucugcauuuguuguacaaccacaaaauggccgauguacaacagacgguguauuacuaggcacuacucaauuauccccaguaaauauaugcacauuuagaggagacguaacacacaucgcaggaucuagaaacuacacaaugaaccuagcaucacuaaauuggaacaauuaugauccuacugaagaaauacccgcaccccuaggaacccccgauuuuguagguaaaauccaaggaguacuaacacaaaccacaaaaggagacggaucaacucgaggccauaaagcaacaguauauacaggaucagcaccauuuacaccaaaacucggaucuguacaauucaguaccgauacagaaaacgauuuugaaacacaucaaaauacuagauucacuccagucggaguaauacaagacggaggaaccacccaucgaaaugaaccacaacaauggguccuacccuccuauucaggaagaaaugucccaaacguucauuuagcaccagcaguagcaccaacauuccccggcgaacaacuacuuuucuuuagaucaacaaugccuggaugcucaggauauccaaauauggacuuagauugcuuacucccucaagaauggguccaacauuuuuaccaagaagcagcuccugcacaaucagacguagcacuauuaagauucguaaaccccgacacaggcagaguauuauuugaaugcaaacuacacaaaucuggguauguaaccguagcacacacaggucaacacgaucuaguaauaccaccaaauggauacuucagauucgacucuuggguaaaccaauucuauacacuagcuccgaugggaaauggcacuggaagacgcagaguauaa

SEQ ID NO: 33502 - RNA, 1620 nt, Artificial Sequence
  derived and/or modified sequence opt6 from VP1__Norovirus_and/or_Norovirus-like__KY424329
augaaaauggccuccuccgacgcuaauccaucugacggaucagcagcuaacuuagucccagaagucaacaaugaaguaauggcacuagaaccuguaguuggagccgcaauagcagcaccuguagccggucaacaaaacguaauagacccauggaucagaaauaauuuuguccaagccccagguggagaauuuaccguauccccucgaaaugcaccaggagaaauuuuauggucugcaccacuagguccagaccuuaacccuuacuuaucacaccuagcaagaauguauaacggauacgcaggagguuucgaaguacaaguaauacuagcaggaaaugcauucacagcaggaaaaauaauauucgccgccguacccccuaacuuuccaacagaaggccuauccccuagccaaguuacaauguucccacauauuauaguagacguaagacaauuagaaccuguacuaauaccacuuccagauguacguaauaauuucuaccauuacaaucaauccaaugacccaacaauaaaauuaauagcaaugcuauacacaccacucagagccaacaacgcaggagaugacguauuuacaguaucuuguagaguacuuacuagaccaagccccgacuucgacuucaucuuucuagucccuccuacuguugaaucuagaacuaaaccauucucaguaccaguccuaacaguagaagaaaugacaaacucuagauuuccaauaccacuagaaaaacuauuuacuggaccuucaucagcauucguuguccaaccacaaaacggaagaugcacaacagacgguguauuauuaggcacaacacaauuaucgccaguaaacaucuguaacuucagaggcgacguaacacauaucacaggaucacgaaacuauacaaugaacuuagcaucacaaaacuggaacaauuacgacccuacagaagaaauaccugcaccacuagguacaccagacuuuguaggaaaaauccaaggaaugcuaacacaaacaaccagaacagauggcuccacuagaggccacaaagcaaccguauacacaggaucagcagacuuugcuccaaaauuaggaagaguacaauuugaaaccgacacagaccaugauuuugaagcaaaccaaaacacaaaauucacacccguaggcguaauacaagacggauccacuacacacagaaacgaaccucaacaauggguauuaccuucuuacucaggaagaaauacacauaauguacacuuagcaccagccguagcaccaacauuuccaggugaacaauuacuauucuuuagaucaacaaugccaggcugcucaggauaccccaauauggaucuagauugcuuacuaccacaagaauggguacaauauuucuaccaagaagcagcacccgcacaaagugacguagcccuacuuagauucguaaauccagacacuggaagagucuuauuugaauguaaauuacacaagucuggauauguaacaguugcacacacaggccaacacgaucucguaauaccaccaaauggcuauuuccgauucgauucauggguaaaucaauuuuacacacuagccccaaugggaaacggaacaggaagacgaaggguauaa

SEQ ID NO: 33503 - RNA, 1620 nt, Artificial Sequence
  derived and/or modified sequence opt6 from VP1__Norovirus_and/or_Norovirus-like__KT780389
augaaaauggccuccucugacgcaaaucccuccgauggaucagcugcaaaccuaguaccugaaguaaacaacgaaguaauggcacuagaaccaguaguaggggcagcaauagcagcaccagucgcaggacaacaaaauguaauagaucccuggauuagaaauaacuuuguacaagcaccaggaggagaguucaccgucucaccacgaaacgcacccggugaaauacuauggucagcacccuuaggacccgauuuaaauccuuauuuaucacaccuagcaagaauguauaaugguuaugccggcggauucgaaguccaaguaauacuagcaggcaaugccuuuacagcagguaaaguaaucuuugcagcagucccacccaacuuuccuacugaaggacuuuccccuucucaaguaacaauguucccucacauaguuguagauguaagacaacuugaaccaguacuaauaccauuaccagauguaagaaacaauuuuuaccacuauaaccaaucuaaugaucccacuaucaaacuaauagcuauguuauacacaccacuaagagcuaauaacgcaggagaugacguauuuacaguauccuguagaguuuuaacaagaccaucaccagauuuugacuuuauauuucuaguaccuccaaccguugaaagcagaacaaaaccauucuccguuccaguacucacaguagaagaaaugacaaacucaagauuuccuauaccacucgaaaaacuauuuacuggaccaucuucagcauucgucguacaaccucaaaauggccgcugcacaaccgaugguguacuuuuaggcacaacacaacucaguccaguuaacaucuguacuuuuagaggagauguuacacauauaacaggcucuagaaauuauacaaugaaccucgcaucacaaaacuggaauaauuaugacccuacagaagaaauaccagcaccacuaggcgccccagacuucguaggaaaaauacaagguguacuaacacaaacaacacgugcagacggcucaacaagaggacacaaagcaacaguguauacaggaagcgcagauuuugcaccaaaauuaggaagaguccaauuugaaacagauacagaucacgacuuugaagcaaaccaaaauacuaaauucacaccuguaggaguaauccaagacggaucaaccacacaucgaaaugaaccccaacaauggguacuaccauccuauucaggucgaaacacacauaacguacacuuagcuccugcaguagcaccaacauuuccaggcgaacaacuauuauucuuuagaaguacaaugccagguugcuccggauauccaaauauggaucucgauugcuuacuaccacaagaauggguacaauauuuuuaucaagaagcagcaccagcacaaucagauguagcauuauuacgguuuguaaacccagacaccggaagaguacuuuucgaauguaaacuacauaaaucaggauauguaacaguagcacauacaggccaacaugaucuaguuauaccuccaaauggauacuucagauucgauucuugggucaaucaauuuuauacccuugcaccuauggguaacggagcagguagaaaaagaguauaa

SEQ ID NO: 33504 - RNA, 1620 nt, Artificial Sequence
  derived and/or modified sequence opt6 from VP1__Norovirus_and/or_Norovirus-like__KX354134
augaaaauggcaucauccgaugcaaaucccagugauggauccgcugcaaaucuaguuccugaagucaacaaugaaguaauggcccuugaaccaguuguaggggcagcuaucgcagcaccaguagcaggacaacaaaacguaauagauccauggauaagaaauaacuucguacaagcaccaggaggagaauuuacagucucuccuagaaaugcaccaggugaaauacuauggagcgcaccauuaggaccagaccuaaacccauaccuaucucacuuagcacgaauguacaacgguuacgcaggaggauucgaaguccagguaauacuugcaggaaacgcauucacagccggaaaaauaauauucgcugcaguaccaccaaacuuuccaacugaaggucuaaguccaagucaaguaacaauguucccacauauuauaguagacgucagacaauuagaaccgguauuaauuccauuaccagacguacguaacaacuuuuaucacuauaaccaaucaaacgauucuacaauaaaacuaaucgcaaugcuuuauacaccauuaagagcaaacaaugcuggagacgacguauuuacaguaucaugucgaguauuaacaagaccaucaccagacuuugauuuuauauuucuaguaccacccacagucgaaucuagaacaaaaccuuucucaguaccuauauuaacaguagaagaaaugacaaacucccguuucccaauaccauuagaaaaacuauuuacagguccaucauccgccuucguaguucaaccccaaaacgguagauguacaaccgauggcguacuauuaggaacaacacaacuauccccagucaauauuuguacuuuuagaggagacaucacucauauuacuggaucucauaacuacacuaugaauuuagcaucacaaaauuggaacucauaugauccaacugaagaaauaccagccccacuuggcacuccagacuuuguaggcaaaauccaaggagucuuaacccaaacuacaagagcagacggaaguacaagaggacauaaagcaacaguauauacaggaucagcagacuucgcacccaaacucggaagaguccaauucgaaaccgacacaaaucacgauuuugaagcaaaucaaaauacuaaauucacuccuguaggcguaauacaagauggaagcacaacacacaggaacgaaccccaacaauggguauugccuucauauuccggacgaaauacacauaacguacaccuagccccagcaguagcuccaacauucccaggagaacaauuacuauuuuucagaaguacaaugccagguugcucaggauauccaaauauggauuuagauugcuuauuaccucaagaauggguacaauuuuucuaccaagaagcagcaccagcacaaucagacguagcauuauuacguuuuguaaauccugacacagguagaguacuauuugaauguaaauuacauaaaucagguuaugucacaguagcacacacaggacaacacgauuuagucauaccuccaaauggauacuuuagauuugauuccugggucaaucaauuuuacacucuagcuccaaugggaaacgguacuggaagaagaagaguauaa

SEQ ID NO: 33505 - RNA, 1620 nt, Artificial Sequence
  derived and/or modified sequence opt6 from VP1__Norovirus_and/or_Norovirus-like__KX354126
augaaaauggcuucaucagacgcaaaccccucagauggauccgcagcaaacuuaguacccgaaguuaacaacgaaguaauggcucuagaaccaguaguaggagcagcuauagcagccccuguugccggacaacaaaauguaauagauccauggauacgaaauaacuuuguacaagccccaggaggcgaauuuaccguaucuccuagaaaugccccaggagaaauccuuuggagcgccccauuaggacccgaucuaaauccauauuuaucacacuuagcacgaauguauaacggauacgccggaggauuugaaguacaaguaauacuagcaggaaaugcauucacagcagguaaaguaauauucgcagcaguaccacccaauuucccaacugaaggauuaucuccaucacaaguaacaauguuuccccauaucgucguagacguuagacaacuagaaccaguacuaaucccacuaccagacguaagaaauaauuucuaucauuauaaccaauccaaugauccaacuauuaaauuaauagccaugcuauauacuccacuaagagcaaacaaugccggugacgauguauucacaguauccugucgaguccuaacaagaccuucaccagacuuugacuuuauauuccucguuccaccaacuguugaaucacgaacaaaaccauucucaguaccugucuuaacaguagaagaaaugaccaacucaagauuuccaauaccacuagaaaaacuauucacaggaccuuccucagcuuuuguaguacaaccacaaaauggaagauguacaacugauggaguucuccucgguaccacccaauuaucaccagucaauaucuguaccuuuagaggggacguaacacauaucacaggaagccgaaacuauacaaugaaucuagcaucacaaaauuggaacaacuacgaucccacagaagaaauuccagcaccucuaggaacuccugacuucguaggaaaaauacaaggcauguuaacucaaacuacaagagcagacggaucaacaagaggacauaaggccacaguauauacaggauccgcugauuucucaccuaaacuaggaagaguacaauuugaaacagauacugaucacgauuucgaagcaaaucaaaauaccaaauucacacccguaggcguaauacaagauggaucaacaacacauagaaaugaaccacaacaauggguccuaccaucauauucuggaagaaauacacauaacguacacuuagccccagcaguagcacccaccuuuccuggugaacaacuacuuuucuuuagauccacaaugccuggauguuccggauacccaaauauggauuuagauugcuuacuaccacaagaauggguacaauauuucuaucaagaagcugcaccagcacaaucagacguagcacuacuacgauucguuaauccagacacuggaagaguauuauucgaaugcaaauuacauaaaucaggauaugucacuguagcccacacaggacaacaugauuuaguaauacccccaaauggauauuuccgcuucgauucauggguaaaccaauuuuacaccuuagcuccaaugggaaauggaacuggacgaaaaagaguauaa

SEQ ID NO: 33506 - RNA, 1620 nt, Artificial Sequence
  derived and/or modified sequence opt6 from VP1__Norovirus_and/or_Norovirus-like__KR904237
augaaaauggcuaguucugacgcaaacccuucagacggauccgcagcuaaccuuguuccagaaguaaacaacgaaguaauggcauuagaaccuguugucggugccgcuaucgcagcaccaguagcaggacaacaaaauguaauagacccauggauaagagauaacuucguacaagcaccagguggcgaguucaccguaucaccaagaaaugcaccaggagaaauuuuauggucagccccauuagguccagaccuaaacccauacuuaucgcaccuagcaagaauguauaacgguuaugccggaggauuugaaguacaaguaauacuagcaggaaaugcauuuaccgcaggaaaaguaaucuucgcagccguaccaccuaacuuuccaacagaaggccuaaguccaucucaaguaacaauguucccacauaugauaguagauguaagacaauuagaaccaguacuaauaccauuaccagacguacgaaacaauuuuuaucauuacaaucaaucaaaugauccaaccuuaaaauuaauagcaaugcuauauacaccauuaagagccaacaaugccggugacgauguauucacaguuucauguagaguacuaaccagaccaucaccagacuuugacuucauauuucuaguuccaccuacaguagaauccagaacaaaaccauuuucgguuccuguuuuaacaguagaagaaaugacaaacucaagauuucccaucccauuagaaaaauuauuuacaggaccaucaucagcauuuguaguacaaccacaaaacggaagauguaccacagauggaguuuuauuaggaacaacacaacuaucuccaguaaauauauguacauuuagaggggauguuacucauauaacaggaagccgaaacuacacaaugaacuuagcaucacaaaacuggaacaacuaugacccaacugaagaaauaccagcuccacuaggagccccagauuucguaggaaaaauacaagguaugcuaacacaaacaacaagaaccgauggaucaacacgaggacauaaagccacaguauacacuggcuccgcagacuuugcaccaaaauuaggaagaguacaauucgaaacggauaccgaccaugauuucgaagcaaaccaaaauacaaaauucacaccaguaggaguaauacaagacggaagcacaacacaccgaaaugaaccacaacaauggguauuaccaagcuauuccgguagaaauacccauaacguucacuuagccccagcaguagcaccaacauuuccaggagaacaauuacuauucuuuagaucaacuaugccaggaugcaguggcuaucccaauauggaucucgauugcuuauuaccacaagaauggguacaauauuuuuaucaagaagcagcaccagcacaaucugauguugcacuacuaagauuuguuaauccagacaccggacgcguacuuuuugaaugcaaacuccauaaauccggauauguaacuguugcacauacaggacaacacgauuuaguaauaccucccaacgguuacuuccgauucgauucauggguaaaccaauucuacacccuagcaccaaugggaaacggaacagguagaagaagaauauaa

SEQ ID NO: 33507 - RNA, 1620 nt, Artificial Sequence
  derived and/or modified sequence opt6 from VP1__Norovirus_and/or_Norovirus-like__KP241911
augaaaauggccaguucagacgcaaacccaucagacggaucagcagcuaaccuagucccagaaguaaauaacgaaguaauggcuuuagaacccguuguaggagcagcaauugcagcaccagucgcaggacaacaaaauguaauugacccauggauacgaaauaauuuuguacaagcuccgggaggagaauuuacaguuuccccucgaaacgcaccaggagaaauauuauggucagcaccacucggaccagacuuaaauccauauuuaucacauuuggcuagaauguauaacggauacgcaggcggauucgaaguacaaguaauacucgcaggaaacgccuuuacagcaggaaaagucauauucgcagccguaccaccuaacuucccaaccgaaggccuaucaccaucacaaguaacaauguucccccauauagucgucgauguacgacaacuagaaccaguccuaauaccucuaccagaugucagaaauaauuucuaccauuauaaccaauccaacgauccaacaauaaaacuaauagcaauguuauacacccccuuaagagcuaauaaugccggugaugauguuuuuaccgucaguugucgaguacuaacaagaccaagcccugauuuugacuuuauauuucuaguuccaccaacaguagaaucaagaacuaaaccauuuucaguaccuguucuaacaguagaagaaaugacuaacucacgauucccaauacccuuagaaaaacucuuuacaggaccuuccucugcauuugucguccaaccccagaacggacgauguacaacagauggaguauuacuaggaacaacgcaacuaaguccuguaaauauauguacauuuagaggagauguuacccacauaacaggaucaagaaauuacacuaugaaucucgcaucccaaaacuggaacaauuacgauccaacugaagaaauacccgcaccucuagguacaccugauuucgucggaaaaauacaaggaauguuaacacaaacaacuaggacagacggauccacaagaggacacaaagcaacaguauauacaggauccgcagacuucgcaccuaaacuaggacgaguacaauucgaaacugauacugaccaugauuucgaagcaaaucaaaauacuaaauuuacaccagucggaguaauacaagauggaucaacaacacauagaaacgaaccucaacaauggguccuacccucuuacucaggaagaaauacucauaauguucaucuugcacccgcaguagcuccaacauuuccuggcgaacaacuucuauucuuuagaagcaccaugccaggauguucugguuauccaaacauggaucuagauugcuuauuaccacaagaauggguacaauauuucuaucaagaagcagcuccagcacaaucagacgucgcacuucuacguuucguuaauccugauacaggaagaguacuauucgaaugcaaacuacauaaaucugguuauguaacaguagcacacacaggacaacacgaccuaguaauaccuccaaauggauauuucagauucgacucauggguaaaucaauucuacacccuagcuccaaugggaaacggaacaggaagaagaagaguauaa

SEQ ID NO: 33508 - RNA, 1620 nt, Artificial Sequence
  derived and/or modified sequence opt6 from VP1__Norovirus_and/or_Norovirus-like__KJ685411
augaaaauggcauccucagaugccaacccaucagacggaucagcagcaaauuuaguaccagaaguuaauaacgaaguuauggcacuagaaccaguuguuggagcagcgaucgcugcuccaguugcaggacaacaaaauguaauugacccuuggauaagaaacaauuuuguucaagcaccaggaggagaauuuaccguuucaccucgaaaugcuccaggcgaaauacuauggucagcuccucuaggaccagauuuaaaucccuaucucucacacuuagcaagaauguacaauggauaugcugguggauucgaaguccaaguaauauuagcagguaaugcauucacagcaggaaaaguaauauucgcagcaguacccccaaauuuuccaacagaaggauuaucaccuagccaaguaacuauguuuccccauauaguaguagauguaagacaacuagaaccaguuuuaaucccauuaccagauguacgaaauaauuuuuaccauuauaaucaaucuaaugauccuacuauaaaauuaaucgccaugcuauauaccccacuaagagcaaauaacgcuggugacgacguauuuaccguaucaugcagaguuuuaaccagaccuucaccagauuuugacuucaucuuuuuaguaccuccuacagucgaaucucgaacaaaaccauucagcguaccuguauuaacaguagaagaaaugacaaacucacgauuuccaauaccacuagaaaaacuauuuacugguccaucaucugcuuuuguaguacaaccacaaaauggccguuguacuacagaugguguucuauuaggaaccacccaauuaucaccaguaaauauuuguacuuuccgaggugacguaacccacauaacaggaucacgaaauuacacaaugaaucuugcaucacuaaacuggaauaacuaugauccaacagaagaaauaccagccccacuaggcacaccagauuucgucggaaaaauacaaggaauguuaacacaaacaaccagaacagaugguucaacuagaggucacaaagcaacaguauauacugguucagcagacuuugcaccaaaacuaggcagaguccaauucgaaacagacacagaucacgacuuugaagcuaaucaaaauacuaaauuuacaccaguagguguuauacaagauggaucuaccacucaucguaacgaaccacaacaauggguuuuaccaucauacucagguagaaauacccauaacguacaccuagcaccagccguugcacccacuuuuccaggagaacaauuauuauucuuuagauccacaaugccuggaugcuccggauauccaaacauggacuuagacuguuuauuaccacaagaauggguccaauauuuuuaccaagaagccgcaccagcacaaucugauguagcacuccuaagauucguaaauccagacacaggcagaguacuauuugaauguaaauuacauaaaucuggauauguaacaguagcucacacaggacaacaugaucucguuauaccaccaaauggauacuuccgauuugauucauggguaaaucaauucuauacuuuagcuccaaugggaaacgguacuggaagacgaagaguauga

SEQ ID NO: 33509 - RNA, 1620 nt, Artificial Sequence
  derived and/or modified sequence opt6 from VP1__Norovirus_and/or_Norovirus-like__KF008242
augaaaauggcaagcucugaugcaaauccaucagauggaucagcagccaacuuagucccugaaguaaacaaugaagucauggcacuugaaccaguuguuggagcugcuauagccgcaccuguagccggccaacaaaauguaauagauccauggauaagaaauaacuucguacaagccccaggaggugaauuuacaguuaguccaagaaaugcccccggcgaaauacuauggucagccccacucggaccagauuuaaacccauaccuuucacauuuagcucguauguauaacggauacgcaggcggcuucgaaguccaaguuauacuagcuggaaaugcauuuacagccggaaaaguaauauuugcagcuguaccuccaaacuuuccaacagaaggauuaaguccaucacaaguaaccauguuuccacauauaguaguagacgucagacaacucgaaccaguccuaauaccacuaccagauguacguaacaauuuuuaucacuauaaucaauccaacgacccaacaauaaaauugauagcuauguuauacaccccucuaagagcaaauaaugcuggagacgauguuuucacagucucaugcagaguacuaacaagaccuuccccagacuuugacuucauauuucuaguacccccaacaguagaaucuagaacaaaaccuuucucaguacccguacuaacaguagaagaaaugacaaacucuagauuuccaauuccacuagaaaaacuuuuuacaggcccaagcucugcauuuguaguucaaccacaaaacggaagaugcacaacugauggcguacuacuaggaacaacacaacuaucaccuguaaauauaugcacuuucagaggagacguaacccauauaacaggaucacguaauuacacaaugaaucuagcaucacaaaacuggaauaauuaugaccccacagaagaaauaccugcaccacuagguacaccugacuuugugggcaaaauacaaggcguacuuacacaaacgacaagaacagaugguucaacacgaggucauaaagcuacaguauacacagguucagccgacuucgccccaaaauuaggaagaguacaauucgaaacagauacagaucacgacuucgaagcaaaucaaaauacaaaauucacacccguagguguaauacaagacggcucaacaacccauagaaaugaaccacaacaauggguauuaccuucauauagugguagaaacacccacaauguccaccuagcaccagcaguagcuccaacuuuuccaggcgaacaauuauuauucuuuagaucaaccaugccaggaugcucuggauacccaaauauggaccuagauugucuucuaccacaagaauggguacaauauuuuuaucaagaagcagcaccagcacagucugaugucgcacuucuaagauuuguuaacccugacaccggaagaguauuauucgaaugcaaauuacacaaaucaggauauguaacaguagcacauacaggucagcaugaucucguaauaccacccaauggauauuuucgauucgauucuuggguaaaucaauuuuauacacuagcaccaaugggaaauggaaccggacgaaaaagaguauaa

SEQ ID NO: 33510 - RNA, 1620 nt, Artificial Sequence
  derived and/or modified sequence opt6 from VP1__Norovirus_and/or_Norovirus-like__KF060112
augaaaauggcaucaucagacgcaaacccaucugacgguucagcagcaaacuuaguaccagaaguaaauaaugaaguaauggcauuagaaccaguagucggagcagcuauagcugccccuguugcaggacaacaaaaugucauagauccauggauacguaacaauuuuguacaagcaccaggaggagaauuuacuguaucaccacgaaaugcaccaggugaaauacuauggucugcaccgcuaggaccagaucuaaaucccuaucucagucauuuagcuagaauguauaauggauaugcaggcggauuugaaguucaagucauauuagcagguaaugcauuuacugcuggaaaagucauauuugcagcuguucccccaaacuuuccuacagaaggauuaucaccaucacaaguuacaauguucccacauauuguaguugacguuagacaauuagaaccaguauuaauuccauuaccagacguucgcaacaauuuuuaucacuauaaccaaucuaacgacccaacaauuaaacuuaucgcaaugcuuuacacaccacuuagagcaaauaaugccggugacgaugucuuuacaguuucauguagaguauuaacucguccaucaccugacuuugauuuuauauuuuuaguaccacccacaguagaaucuagaacuaaacccuuuucaguaccaguacuaacagucgaagaaaugacaaauucucgauuuccaauaccauuagaaaaacucuucacagguccauccuccgcauuuguaguacaaccccaaaacgguagauguacaacugauggaguacucuuaggaacaacacaacuuucuccaguaaauaucuguaccuuuagaggagacguuacacauaucacaggaucaagaaauuauacaaugaacuuagcaucccaaaauuggaauaacuaugauccaacagaagaaauacccgcaccucuaggugcaccagauuucguaggaaaaauacaaggaauguuaacucaaaccacaagaacugauggaucaacaagaggacauaaagcaacaguauauacaggaagugcagacuuugcaccuaaacuaggacgcguccaauucgaaacagauacagaucacgacuuugaagcuaaucaaaauacaaaauuuacaccaguugguguaauacaagacggaucaacaacacaucgaaaugaaccucaacaauggguccuacccucauacucaggaagaaacacucauaauguccaucuugcacccgccguagcaccaacuuuuccaggcgaacaauuauuauucuuucgcagcacaaugccaggaugcucaggauauccaaauauggauuuagauuguuuacugccucaagaauggguucaauauuuuuaucaagaagcugcuccagcucaaucagauguugccuuacucagauuuguaaauccagacacaggucguguccuauuugaaugcaaacuacauaaaucagguuaugugacaguagcccacacaggacaacacgaccuaguaauaccaccaaauggauacuuuagauucgauucauggguaaaucaauuuuauaccuuagcuccaaugggaaacgguaccgguagaagaagaguauaa

SEQ ID NO: 33511 - RNA, 1620 nt, Artificial Sequence
  derived and/or modified sequence opt6 from VP1__Norovirus_and/or_Norovirus-like__JX126912
augaaaauggcuucaaaugacgcaaauccauccgaugguucuacagcaaacuuaguaccugaagucaacaacgaaguuauggcauuagaaccaguaguaggagcagcaauagcagcaccugucgcugggcaacaaaaugucauagacccauggauucgaaauaauuuuguacaagcuccaggaggcgaguucacaguauccccuagaaacgcaccaggagaaauacuauggucagcaccucuaggacccgauuuaaauccauauuuaucacaucuugcuagaauguauaauucauacgcaggaggauucgaaguacaaguaauucuugcaggaaacgccuuuacagcuggaaaaauaauuuucgcugcaguaccacccaauuucccaacagaaggccuaucaccuucacaaguaacaauguuuccacacauaauaguugaugucagacaacuagaaccuguccuaauaccauuaccugauguaagaaacaacuuuuaccacuacaaucaaucuaaugacccaaccauuaaauuaauagcaaugcucuacacuccccuaagagcuaacaacgcaggagaagauguauuuaccguuaguugucgaguacucacuagaccuucucccgacuuugacuucauauuuuuaguaccaccaacaguugaaagcagaaccaaaccauuuaccgucccaauacucacaguagaagaaaugacaaauucuagauuuccaauaccacuagaaaaauuauuuaccggccccucuggugccuucguaguacaaccgcaaaauggaagauguacaacagauggugucuuacuugguacaacacaauuaucaccaguaaauauaugcacauucagaggcgacgucacucauaucgcugguacacauaacuauacaaugaauuuagccucacaaaacuggaacaacuacgauccaacagaagaaauaccagccccacuagguacuccagacuuugucggcagaauccaaggaaugcuaacacaaacaacaagaggcgacggaaguaccagaggacacaaagccaccguaucuacaggcgauguacacuucacaccaaaauuaggauccauacaauucaacacagacacaaauaaugauuuugaaacaggacaaaauaccaaauucaccccuguaggcguaauacaagacgguaauggcacacaucaaaaugaaccccaacaauggguauuaccaucuuacucugguagaacuggacauaacguacaccuugcaccagcaguggcaccaacauuuccaggcgaacaauuauuauucuuuagaucaaccaugccaggaugcucaggauauccaaauaugaauuuagacugccuauuaccacaagaauggguacaacauuucuaucaagaagcagcaccagcacaaucagacguagcacuacucagauucguaaacccagauacaggaagaguacuuuucgaauguaaauuacauaaauccggauauguaacaguagcacacacaggacaacacgacuuaguaauucccccaaacggcuauuuuagauucgauuccuggguaaaucaauucuacacauuagcaccaaugggcaauggaacugguagacgacguguauaa

SEQ ID NO: 33512 - RNA, 1620 nt, Artificial Sequence
  derived and/or modified sequence opt6 from VP1__Norovirus_and/or_Norovirus-like__KX354143
augaaaauggcuucaucagaugccaacccaucugauggauccgcagcaaaucucguaccugaaguaaacaaugaaguuauggcacuagaaccagucguaggagcagcaauagcagcaccuguagccggacaacaaaacguaauagaccccuggauucguaauaauuuuguacaagcaccuggaggagaauuuacaguuucaccaagaaacgcaccaggagaaauacuauggucagcaccacuaggacccgaucuaaaccccuaccuaucccacuuagcuagaauguauaaugguuaugcaggagguuucgaaguacaaguaauuuuagcuggaaaugcauucacagcagguaaaauaauauucgcagcaguuccaccaaacuuuccaacugaaggauuaucacccucacaaguaacaauguucccacauauaauaguugauguaagacaacuagaaccaguacucauaccauuaccagauguuagaaauaauuuuuaucauuauaaccaaucaaaugacucaacaauaaaacuuauagcaaugcucuacaccccacuacgcgcuaacaaugccggagaugauguauucacaguaucauguagaguauuaacaagaccaucgcccgauuucgacuuuauauucuuaguaccaccaacaguagaaucacgaacuaaaccuuucucgguaccaguccuuaccguugaagaaaugaccaauuccagauuuccaauaccauuagaaaaacucuucacaggcccaucaucagcauucguaguacaaccacaaaauggcagaugcaccacugauggaguacucuuaggaacuacacaacuaucaccagucaacauuugcaccuuucgaggagacguuacacauauaacaggcucuagaaacuauacuaugaaucuagcaagccaaaacuggaauaauuacgauccaacugaagaaaucccagcaccacuaggaacaccugacuucgucgguaaaauacaagguaugcuaacacaaacaacaagaacagaugguuccacaagaggccauaaagcaauaguauacacaggaucagcugacuucgcaccaaaacuaggaagaguacaauuugaaacugauacagaucacgauuucgaagcaaaccaaaauacaaaauuuacacccguaggaguuauucaagacggaucaacaacacauagaaaugaaccccaacaauggguuuuacccuccuauagcgguagaaauacacauaacguacacuuagcaccagcaguagcaccaaccuuccccggagaacaauuacuauuuuuccgaucuacaaugcccggauguucuggauacccaaauauggaucuugauugcuuauuaccccaagaauggguucaauacuuuuaucaagaagcagcaccagcacaaagcgacguagcacuucuacguuuuguuaauccagauacuggccgaguucuauucgaauguaaauuacauaaaucagguuacguaacaguagcacacacaggacaacacgaucuaguuauaccaccaaauggauacuucagguucgauucaugggucaaucaauuuuauacacuugcaccaaugggaaacggcacuggccgaagacgaguauaa

SEQ ID NO: 33513 - RNA, 1620 nt, Artificial Sequence
  derived and/or modified sequence opt6 from VP1__Norovirus_and/or_Norovirus-like__KU985164
augaaaauggcaaguucagacgcuaacccuuccgauggaucugcugcaaacuuaguaccugaaguaaacaaugaaguaauggcuuuagaaccuguaguaggagcagcuaucgcagcaccaguagcuggucaacaaaaugucauagauccauggauaagaaacaauuucguacaagcaccaggaggugaguucacaguaucaccacgaaacgcaccaggugaaauacuguggucagccccacuaggaccagauuuaaaucccuauuuaucacacuuagcaagaauguauaauggauacgcaggaggauuugaaguacaaguuauacuagcaggaaacgccuucacagcaggaaaaguaauauuugcagcaguuccaccuaauuucccaacugaagggcuaucaccuagucaaguaaccauguuuccacacauaguagucgauguaagacaauuagaaccaguauuaauaccccuacccgaugucagaaacaacuuuuaccauuacaaccaaaguaaugacccaacaauaaaacuuauagcaauguuauacaccccacuacgagccaauaacgcuggagaugacguauuuacaguaucaugucguguacuuacacgaccaagcccggauuuugacuuuauauuuuuagucccaccaacaguagaaucaagaacuaaaccauuuucaguaccaguauuaaccguagaagaaaugacaaacagcagauucccaauacccuuagaaaaauuauuuacaggaccaucaucagcuuuuguaguccaaccccaaaacggacguugcacuacagauggaguacuauuaggaacaacccaacuaucaccaguaaacauauguacauucagaggagacguaacacacauuacaggaucaagaaauuacacaaugaaccuagcuucccaaaauuggaacaauuacgauccuacagaagaaauaccggcaccauuaggagcacccgacuuuguaggaaaaauacaaggaaugcuaacacaaacaacgagagcagacgguagcacacguggucauaaagcaacuguauacaccgggagugcagacuucgcaccaaaacuaggaagaguucaauuugaaacagauacugaucacgauuucgaagcaaaccaaaacacuaaauuuacacccguaggagucauccaagacggaagcacaacacauagaaaugaaccucaacaauggguauuaccuuccuauucuggacgaaacacccauaauguacauuuagcaccagcuguagcaccaacauucccaggagaacaauuauuauuuuuccguucaacuaugccuggcuguucuggauacccaaauauggaucucgacugcuuacuaccacaagaauggguucaauauuuuuaucaagaagcagccccugcacaaagugauguagcauuauuaagauucguaaacccagauacaggucgaguacuauuugaaugcaaacuacauaaaucaggauauguaacaguagcucauacaggacaacaugaucuaguuauaccaccuaacggauauuuucgauuugauucuuggguaaaccaauuuuauacccuagccccuauggguaacggagcaggcagacgaagaguuuaa

SEQ ID NO: 33514 - RNA, 1620 nt, Artificial Sequence
  derived and/or modified sequence opt6 from VP1__Norovirus_and/or_Norovirus-like__KX950760
augaaaauggcaucaucugacgcaaauccuucagacggaucagcagcaaaccuuguaccagaaguaaauaaugaaguaauggcacuugaaccaguaguaggagcagcaauagcagcaccagucgcaggacaacaaaauguaauugauccauggauaagaaauaacuuuguacaagcaccaggaggagaauuuacaguuucaccaagaaaugcaccuggagaaaucuuauggagcgccccucuuggaccggauuuaaauccauaucuaucacacuuagcaagaauguacaauggauaugcaggcggauuugaaguacaaguacuacucgcuggaaaugcauuuacagcuggaaaaguaauauuugcagcagucccaccaaacuuuccaacagaagguuuaucaccaucacaaguuacaauguucccccauauaguaguugacguccgucaauuagagccaguacuaauaccacucccagauguacgaaacaauuuuuaucauuauaaccaaucaaaugauucaacaaucaaauuaauagcuaugcuauacaccccacuaagagcaaauaaugcuggugacgauguauucacuguaucaugucgaguacuaacaagaccaucuccagauuuugauuucauauuuuuaguaccaccaaccguagaaucucgaacaaaaccauuuaguauaccaguacuaaccgucgaagaaaugacuaacucuagauuuccaauaccacuugaaagauuauuuacaggucccucaucagcauucguaguacaaccacaaaauggaagauguacaacagacggaguucuacuaggcacaacacaauuauccccaguaaauauauguacauuuagaggagacguaacacauauaaccggcucucguaauuauacaaugaauuuagccucacaaaacuggaacaauuaugacccaacagaagaaauaccugcaccacuaggaacaccagacuuugucggaaaaauacaaggaauguuaacacaaacuacaagagcaaauggauccacaagaggccauaaagcaacaguauacacaggcagcgcagacuuugcaccaaaacuaggaagaguacaauucgaaaccgauacaagcgacgacuuugaaacaucacaaaacacaaaauucacaccagucggcguaauacaagacggaagcacaacaccaagaaacgaaccacaacaauggguccuaccuucauauucaggccguaauacacauaauguacaccuagcuccugcaguagcaccaacuuuuccaggagaacaauuacuuuucuuccgaucaauuaugccaggauguaguggauaucccaacauggaccuugacugcuuguuaccacaagaauggguacaacacuucuaucaagaagcagcuccugcacaaucugacgucgcauuauuaagauucguaaacccagacacagggagaguacuauuugaauguaaauuacacaaaucaggauauguuacaguagcacacacaggacaacaugacuuaguaauaccaccuaacggauauuucagauucgacucauggguuaaucaauuuuacaccuuagcacccaugggaaauggaacaggaagaagaagaguauaa

SEQ ID NO: 33515 - RNA, 1620 nt, Artificial Sequence
  derived and/or modified sequence opt6 from VP1__Norovirus_and/or_Norovirus-like__KJ685402
augaaaauggcaucaucugacgcaaacccaucagauggcucagcagcuaauuuaguaccagaagucaacaacgaaguaauggcauuagaaccuguaguuggagcagcaauagcugccccagucgcaggacaacaaaauguaauagauccauggauuagaaauaauuuuguccaagcccccggaggagaguucacaguuuccccaagaaaugcaccaggagaaauacuauggucagcaccacuaggaccugacuuaaauccauaucuaucucauuuagcacgaauguauaauggauacgcaggaggauuugaaguucaaguaauuuuagcaggcaacgcauuuacggcuggaaaaguaauauucgcagcagucccaccaaacuuuccaaccgaaggccuaucaccaucacaaguuacaauguucccacacauagucguagauguaagacaauuagaaccuguauuaauaccauuaccagacguaagaaauaauuuuuaucacuauaaccaauccaaugacccaaccaucaaauuaauagcaaugcuauacacuccuuuacgagcaaacaaugcuggugaugauguauuuacaguaucuugcagaguauuaacacgaccauccccagacuuugauuucauauuccuaguucccccaacaguagaaucuagaacaaaaccuuucagcguaccaguuuugacagucgaagaaaugacaaacucaagauucccaauaccauuagaaaaauuauuuacaggaccaucaggugcauuuguaguacaaccacaaaacggaagauguacaacagacgguguucuauuaggaacuacccaacuaucaccaguaaauauauguacauuuagaggagauguuacucacauaacgggcucacgaaauuauacuaugaauuuagcaucacaaaauuggaacaauuacgauccaacagaagaaaucccagcaccauuagggacacccgauuuuguugggaaaauacaagguauguuaacccaaacaacaagaacagacggcaguacuagaggucauaaagcaacagucuauacaggaucagcagauuuugcaccaaaauuaggcagaguacaauuugaaacagauaccgaucacgauuucgaagccaaucaaaauacaaaauuuacuccaguaggaguaauacaagacggaucaacaacccaucgaaacgaaccacaacaauggguauuaccaucauauucagguagaaauacucauaauguucaucuagcaccagcaguagcaccaacauuuccaggagaacaacuacuauucuuuagaucaacaaugccagguugcaguggcuauccaaacauggaucuagauugccuucuaccucaagaauggguccaauacuucuaucaagaagcagcaccagcacaaucagacguugcccugcuacguuucguaaacccagacacuggaagaguacuauucgaauguaaacuccauaaaaguggguacguaacaguagcacacacaggucaacacgacuuaguaauaccacccaauggauauuuucgauuugacagcuggguaaaucaauucuacacacuugcuccaaugggaaacggaacuggcagaagaagaguauaa

SEQ ID NO: 33516 - RNA, 1620 nt, Artificial Sequence
  derived and/or modified sequence opt6 from VP1__Norovirus_and/or_Norovirus-like__KF060140
augaagauggcaucaucagacgcaaacccuucagacgguucagcagcuaacuuaguaccggaaguuaacaaugaaguaauggcacuagaaccaguaguaggagcagcaauagcagcaccuguugcuggacaacaaaauguaauugaccccuggauacguaauaauuuuguacaagcaccaggaggagaauuuacagucaguccaagaaaugcaccaggcgaaauacucuggagcgcaccacuaggacccgauuuaaauccauaccuaucacauuuagccagaauguacaacggauacgcugguggauucgaaguacaaguaauacuugcaggaaaugcauucacugcaggaaaaauaauauuugccgcaguaccaccaaacuucccuacagaaggacuaucaccaucccaaguaaccauguuuccccauauaaucguugacguacgucaacuagaaccaguccuaauuccccuaccagauauaagaaauaauuucuaucauuauaaccaaucaaaugauucaacaaucaaauuaauugcaauguuauauacaccccuacgagcuaacaacgcuggugacgauguauuuacuguaucaugucgaguacucacaagaccaucucccgacuuugacuuuaucuuucuagucccaccaacaguagaaucucgaacaaaaccauucucuguaccuguacuaacaguagaagaaaugacaaacucucgauucccuauaccacuagaaaaauuauuuacaggaccaagcucagcauuuguaguacaaccacaaaacggucgauguacaacagauggugucuuacuaggaacaacacaacuaucaccaguaaacauauguacauucagaggagauguaacccauauaacuggaucaagaaacuacacaaugaaccuagcaucacaaaauuggaacaacuacgauccuacagaagaaauaccagcaccccuaggaacucccgacuuuguaggaaaaauucaaggagucuuaacucaaacuacaagaacagaugguucaaccagaggucacaaggcuacaguauacacaggaagugcugacuucgccccaaaacuagguagaguacaauuugaaacagauaccgaccaugacuuugaagcaaaucaaaauacaaaauuuaccccaguaggaguuauucaagacggaucaacaacacauagaaacgaaccacaacaauggguauuaccuaguuauucuggacgcaauacacauaauguacauuuagcacccgcaguagcaccaacuuuuccaggcgaacaacuauuauucuuuagaucuacaaugccaggaugcucuggauauccaaauauggaucuagauugccuacuaccacaagaauggguccaauauuucuaucaagaagcagccccagcacaaucugacguagcauuauuacgauuuguaaauccugauacaggaagaguacuauuugaaugcaaauuacauaaauccggauaugucaccguagcacauacaggacaacaugaucuaguaauacccccaaauggauauuuuagauuugauucauggguaaaucaauuuuacacauuagccccaaugggaaacggaacuggaagaagaagaguauaa

SEQ ID NO: 33517 - RNA, 1620 nt, Artificial Sequence
  derived and/or modified sequence opt6 from VP1__Norovirus_and/or_Norovirus-like__KX354132
augaaaauggcaagcucugaugcaaauccuucagacggaucagccgccaacuuaguaccugaaguaaauaaugaaguaauggcccucgaaccaguuguaggcgccgcuauagcugcacccguagcaggacaacaaaauguaauagacccuuggauaagaaauaacuuuguacaagcaccaggcggagaauuuacaguuucacccagaaaugcuccaggagaaauccuauggucagcaccauuaggaccagaccucaauccauacuuaagccaccuagcacgaauguacaauggauacgccggcggauucgaaguacaaguaauccuagcaggaaaugcuuucaccgcaggaaaaauaauauuugcugcaguaccuccuaacuuccccacagaaggcuuauccccaucucaaguuacuauguucccccauaucauaguagacguaagacaauuagaaccaguucucauaccacuaccagauguuagaaauaacuuuuaccacuacaaccaauuaaacgauucaacaauaaaauuaauagcaauguuauacacacccuuaagagcuaauaacgcaggcgacgacguauuuacagucucauguagaguauuaacacguccuucaccugauuucgauuucaucuuccuaguaccaccaaccguagaaucuagaacaaaaccuuucuccguaccuauauuaacagucgaagaaaugacaaacucuagauuuccuauaccacuugaaaaacuauuuacaggcccaucaagcgcauuuguaguacaaccacaaaaugguagauguacaacagacggaguauuauuaggcacaacacaauuauccccaguaaauauauguaccuucagaggagacauaacacauacaacaggaagucauaacuacacaaugaauuuagcaucacaaaacuggaacaguuaugacccaaccgaagaaauuccugccccauuaggaaccccagauuuuguaggaaaaauucaaggaguauuaacccaaacaacaagagcagacgggucuacacgaggccacaaagcaacuguuuauacaggaagcgcagauuucgcaccaaaauuaggacgaguacaguucgaaaccgacacaaaucacgauuuugaagcaaaccaaaauacaaaauucacaccaguuggaguaauacaagauggaggaacaacacaucgaaaugaaccacaacaauggguacuaccauccuacaguggaagaaacacucauaacguacacuuagccccagcaguagccccuacauucccaggagaacaacucuuauucuuuagaucaacaaugccaggaugcucaggcuaccccaacauggauuuagauuguuuauuaccucaagaauggguacaauuuuucuaccaagaagcagcaccagcacaaucugaugucgcacuacuaagauuuguaaacccagacacagguagaguauuauucgaaugcaaacuacauaaaucgggauacguaacagucgcccacaccggccaacacgaccuaguaauaccacccaauggauauuuuagauucgacagcuggguaaaucaauuuuacacuuuagcucccaugggcaauggaacaggaagaagacgagucuaa

SEQ ID NO: 33518 - RNA, 1620 nt, Artificial Sequence
  derived and/or modified sequence opt6 from VP1__Norovirus_and/or_Norovirus-like__KX354006
augaaaauggcaucuucagaugcaaacccaucagauggaucagcagcaaauuuaguaccagaaguuaauaacgaagucauggcauuagaaccuguaguaggugcagcaauagcagcccccguagcuggccaacaaaauguaauagacccauggauacgcaacaauuuuguacaagcuccaggaggagaauuuaccguauccccacgaaaugcaccuggagaaauacuauggucagcaccuuuaggaccagauuuaaaucccuauuuaucacaccuugcuagaauguacaauggauaugcaggaggauucgaaguacaaguaauacuagcaggaaacgcguuuacugcaggaaaaguaauauucgcagcaguuccacccaacuuccccacagaaggauuaucucccucacaaguaaccauguuuccucauauaguaguagauguucgccaacuagaaccaguauuaauuccacuuccugaugucagaaauaauuuuuaucacuauaaucagucaaaugauccaacaauaaaacuaauagcuaugcucuacacaccacuaagagcaaacaacgcuggugacgauguauuuacaguaucuuguagaguucuaacucgaccaucaccagacuuugauuuuauauucuuaguuccaccaacagucgaaucaagaaccaaaccauucuccguaccagucuuaacaguugaagaaaugacaaauuccagauuuccaauaccauuagaaaaauuauuuacagguccuucaucagcauucguaguccaaccccaaaacggucgaugcacuacagacgguguacuuuuaggaacaacacaacuaucuccuguaaacauauguaccuucagaggcgacguaacacauaucacaggaucaagaaauuacacaaugaaccuagcaucccaaaauuggaacaauuacgauccaaccgaagaaguuccugccccacuugguacuccagauuuuguaggaaaaauacaaggaaugcuaacacaaaccacuagaacagacggaucuacaagaggacauaaagccacaguuuacacaggaucagcagacuuuacuccuaaacuaggacguauucaauucgaaaccgauacagaucaugacuuugaagcuaaucaaaauacaaaauuuacaccuguaggagucauccaagaugguaguacaacacauagaaaugaaccacaacaauggguacuaccaucauauucaggaagaaauacacauaauguacacuuagccagcgccguugcuccaacauucccaggagaacaauuauuauucuucagaucaaccaugccugguugcucaggauacccuaauauggaucuagacugucuuuuaccccaagaauggguacaauauuuuuaccaggaagcagcaccagcacaaagcgauguagcauuacuaagauucguaaauccggacacuggccguguacuuuucgaaugcaaacuucauaaaucaggauauguuacaguugcauauacuggacaacacgaucuaguaauaccuccuaaugguuauuucagauuugauucauggguaaaucaauuuuacacacuugcuccaauggguaauggaacaggaagacgaagaguauaa

SEQ ID NO: 33519 - RNA, 1620 nt, Artificial Sequence
  derived and/or modified sequence opt6 from VP1__Norovirus_and/or_Norovirus-like__KX354145
augaaaauggcgagcucugacgcaaauccaucagacggaagugcagcaaauuuaguaccagaaguaaacaaugaaguaauggcucuugaaccaguaguaggcgcugcuauagccgcaccaguagcuggacaacaaaacguaauagacccauggauaagaaacaauuuuguacaagcaccuggaggagaauuuacaguaucaccaagaaaugcgccaggcgaaauacuuuggagcgcaccauuaggaccagauuuaaacccauaucuaucacacuuagcacgcauguauaacggauacgccgguggauucgaagugcaaguaauucuagcaggaaaugcuuuuacagccggaaaaauuauuuucgcagccgucccacccaacuucccaacagaaggacuaucaccaucacaaguaacaauguucccucauauaauaguagauguaagacaacuagaaccuguacuaauaccacuaccagauguaagaaacaauuuuuaucauuauaaucaaagcaacgauucaacuauaaaacuaauagccaugcuauacacaccauuaagagcaaauaaugcaggagacgacgucuuuacaguaucauguagaguauuaacaagaccaagcccugacuuugacuucauauucuuaguaccaccuacaguagaaucccgcacuaaaccauucucagucccaguacuuaccguagaagaaaugacuaauucuagauucccaauaccacuagaaaagcuauuuacaggaccaucaucagcauucguuguccaaccccaaaauggaagauguacaacagaugguguauuauuaggcaccacacaacuaucaccaguaaauauauguacauuuagaggagauguaacucacauaacaggaucacgaaauuauacaaugaaucuagcuucacaaaauuggaauaacuaugauccaacagaagaaauaccagcaccauuaggaacaccagacuuugucggaaaaauucaagguaugcuaacacaaacaacuagaacagacggaucuacacggggucacaaagcaacaguauacacuggauccgcagacuucgcuccaaaauuaggaagaguacaauuugaaacagauacagaucaugauuucgaagcaaaucaaaauacaaaauuuacaccagucggaguaauucaagacggaucuacaacacaucguaacgaaccacaacaauggguauuaccuuccuacucagguagaaauacacacaacguucacuuggcuccagcuguagcccccacauucccaggagaacaacucuuauucuuucgcucaacaaugcccggauguucuggcuauccuaacauggaucuagauugccuacuaccacaagaauggguacaauauuucuaucaagaagcagcaccagcacaauccgacguagcauuacuaagauuuguuaacccagauacaggaagaguauuauuugaaugcaaauuacacaaaucaggauaugucacaguagcacacacaggccaacaugaucuuguaaucccaccaaacggauacuucagauucgauaguuggguaaaucaauuuuacacuuuagcaccaauggguaacggaacaggaagacgaagaguauaa

SEQ ID NO: 33520 - RNA, 1620 nt, Artificial Sequence
  derived and/or modified sequence opt6 from VP1__Norovirus_and/or_Norovirus-like__KX354140
augaaaauggcaucaucagacgccucaccaucugauggcucugccgcaaauuuaguuccugaaguuaacaacgaaguaauggcauuagaaccaguaguaggggcagcaaucgccgcuccaguugcaggacaacaaaauguaaucgacccuuggauuagaaauaacuuuguacaagcaccuggaggugaauuuacaguaucccccagaaaugcaccaggagaaaucuuauggucagcaccacucggaccugaucuaaacccauaucuuucacacuuagcacguauguauaauggauaugcaggaggauuugaaguacaaguaauuuuagccggaaacgcauuuaccgcaggaaaaauaauauuugcagcuguaccaccuaacuucccaacagagggacuaucaccuucacaagucacaauguuuccucacaucaucgucgacguaagacaauuagagccagucuuaauuccucuacccgauguaagaaacaauuucuaccacuauaaucaauccaaugauucuacaauaaaacuaauagcuauguuauacacaccuuuaagagcaaauaaugcaggagacgauguuuucacaguaucuuguagaguacuaacaagaccaucaccugauuuugacuuuaucuucuuaguaccacccacaguagaauccagaacaaaaccauucagugucccuguauuaacaguugaagaaaugacaaacucaagauuuccaauaccauuagaaaaacuauuuacaggacccucaucagcauuuguaguacaaccacaaaacggucgcugcacaaccgacggaguucuccucggaacuacucaacuaucaccaguaaauauaugcacuuuuagaggagauguaacacauaucacagguucuagaaacuacacuaugaaccuagccucacaaaauuggaauaauuacgauccaacggaagaaauacccgccccauuagcaacaccagauuuuguugguaaaauucaaggaaugcuaacacaaacaacaagaacagacggcucaacacgaggacauaaagcaacaguauauacagguucagcagauuucgcuccaaaauuaggacgcguacaauucgaaacagauacagaucaugauuucgaagcaaaucaaaauaccaaauuuacacccguuggagucauacaagauggaucaacaacccauagaaacgaaccucaacaauggguucuaccuuccuauuccggaagaaacacucacaacguucaucuagcacccgcaguagccccaacuuuuccaggugaacaacuauuauucuuccgauccacaaugccagguuguucugguuauccaaauauggaccuagauugcuuauuaccacaagaauggguucaauacuuuuaccaagaagcagcaccagcacaaucagauguagcacuauuaagauuugucaacccagacacaggaagagucuuauuugaauguaaacuacacaaaucugguuacguaacaguagcucacacaggacaacaugaucuuguuauaccaccaaauggauauuucagauucgauucauggguuaaucaauucuauacacuagcuccaaugggaaauggaaccggaagaagaagaguauaa

SEQ ID NO: 33521 - RNA, 1620 nt, Artificial Sequence
  derived and/or modified sequence opt6 from VP1__Norovirus_and/or_Norovirus-like__KX354119
augaaaauggcaucuucugacgcuaauccaucugauggaucagccgcaaaccuaguuccagaaguaaauaaugaagucauggcacuggaaccaguaguaggagcagcuauagcugcuccagucgcaggacaacaaaacguaauugacccauggauucgaaauaauuuuguacaagcaccaggaggagaguuuacaguaucuccuagaaaugcuccuggagagaucuuaugguccgcaccuuuaggaccagaucucaauccuuaccuaucacacuuggcaagaauguauaaugguuaugcaggaggauuugaaguacaaguaauauuagcaggaaacgcauuuacagcaggaaaaauaauauucgcagcaguaccuccaaacuuuccaacagaagguuuaucccccucccaaguuacaauguucccacauauaaucguagauguaagacaacuagaaccaguauuaauacccuuaccagauguacgaaauaacuuuuaucacuauaaccaaucaaacgacucaacaauaaaauuaauagcaauguuauauacaccauuacgcgcuaauaaugcuggagacgauguuuucaccguuucaugucgaguacuaacuagaccaucaccagauuucgacuucaucuuucuagucccaccaacuguagaaucacgcacuaaaccuuuuucaguuccaauccuaacaguugaagaaaugacuaacuccagauuuccaauuccccuagaaaaauuauuuacaggaccaaguagcgcuuuugucguacaaccucaaaauggaagauguacuaccgacggagugcuccuaggaacaacccaauuaucaccuguuaauauuuguacauuuagaggugauauaacacacauaacuggcucucauaauuacacaaugaaucuagcuucgcaaaauuggaacucauaugacccaacagaagaaauaccagcaccccuuggaacaccagauuucguaggcaaaauacaaggaguauuaacacaaaccacaagagccgauggaucaacaagaggacauaaagcaacuguauauacaggcucagcagacuuugcaccaaaacuuggaagaguccaauucgaaacagauacaaaucaugauuuugaagcaaaucaaaauacaaaauucacaccuguaggcguuauacaagacggaggaaccacucaccgcaacgaaccacaacaauggguccuaccaucuuacuccggacgcaauacucacaacguucaucuagcuccagcagucgccccaacauucccaggagaacaacuacuauuuuucagaucaacuaugcccggauguucaggauaucccaauauggaccuagacugcuuauuaccccaagaauggguucaauucuucuaccaagaagcugcaccagcacaaucagaugucgcauuacuaagauucgucaacccagacacaggaagaguacuauucgaaugcaaacuacauaaaccaggauauguaacaguagcucauacaggacaacacgauuuaguaauaccuccaaaugguuauuuucgauuugauucuuggguaaaucaauuuuauacauuagcaccaaugggaaauggaacaggaagacgacgaguauaa

SEQ ID NO: 33522 - RNA, 1620 nt, Artificial Sequence
  derived and/or modified sequence opt6 from VP1__Norovirus_and/or_Norovirus-like__KX354018
augaaaauggcaucaucagacgcuaacccaagcgacgguagugccgcuaauuuaguuccagaaguaaauaacgaaguuauggcauuagaaccagucguaggagcagcaauagcagcaccagucgccggucaacaaaauguaauagacccauggauuagaaauaauuucguacaagccccaggaggagaguucaccguauccccucgaaaugcuccaggcgaaauuuuauggucagccccauuaggaccagaccuuaauccuuauuuaucccaccuagcacgaauguauaaugguuacgccggaggauucgaaguacaaguaauacuugcaggcaacgcauuuacugcuggcaagauaauauuugcagcaguaccaccaaauuuuccaaccgaagguuuaucaccaucacaaguaacaauguucccacacauaauaguugauguaagacaacuagaaccaguucuaauaccacuuccagauguaagaaacaauuuuuaucauuauaaccaaucuaaugacagcacaauaaaacuaaucgcaauguuauauacaccuuuaagagcaaauaacgcaggagaugacgucuucaccguaucaugucgcguucuaacaagaccaucuccugacuuugauuuuaucuucuuaguuccaccaacagucgaaucaagaacaaaaccauucucuguaccaguacuuacaguugaagaaaugacaaauucaagauuuccaauaccacucgaaaaacuauuuacuggaccauccuccgcuuuuguaguacaaccucaaaacggaagaugcaccacugacggagucuuacucggaacaacacaauuaucacccguaaacauaugcacauuuagaggagaugucacacauaucacuggaucaagaaauuacacaaugaauuuagcaucacaaaauuggaauaauuacgacccuacagaagaaauaccagcuccacuaggaacuccagacuucguuggaaaaauacaagguauguuaacacaaaccacacgcacagaugguucaacaagaggacauaaagcaacagucuauacuggaucagcagacuuugccccuaaacuaggaagaguacaauucgaaacagauacugaucacgacuucggagcaaaccaaaauacaaaauuuacuccagucggaguaauacaagauggcucaacaacacaucgaaaugaaccucaacaauggguacuacccucauauucaggcagaaauacucauaacguucaucuagcaccagcaguagcaccuacuuuuccaggcgaacaauuacuuuucuuuagaucaacaaugccuggcugcucuggauauccaaauauggaucuagauugucuacuaccccaagaauggguacaauauuucuaccaagaagcagcaccagcacaaucagacguagcacuacuuagauuuguaaacccagacacaggaagaguacuauuugaauguaaacuacauaaauccggauacguaacaguagcacauacaggacaacaugacuuaguuauaccaccaaauggcuauuucagauuugauucauggguaaaucaauuuuacacauuagcaccaaugggaaauggaacuggaagacgaagaguauaa

SEQ ID NO: 33523 - RNA, 1620 nt, Artificial Sequence
  derived and/or modified sequence opt6 from VP1__Norovirus_and/or_Norovirus-like__AB972499
augaaaauggcauccagugacgcaaauccuucagauggaucugccgcuaaucuuguacccgaaguaaauaaugaagucauggcccuagaaccaguaguuggagccgccauugcagcaccaguugcuggacaacaaaauguaauugaccccuggauuagaaacaacuuuguccaagcaccuggcggugaauuuacaguuucaccacgaaaugcaccuggagaaauauuauggucagcaccccucgguccagaucuaaaucccuauuuaucacaccuagcacgaauguacaauggauacgccggagguuucgaaguacaaguaauucuagcuggcaaugcauucacugcagguaaaguaauauucgcagcuguacccccgaacuuuccaacagaaggccuaucaccaucacaaguuacaauguucccacauauaauaguagauguaagacaauuagaacccguauuaauuccauuaccagacguacgaaauaauuuuuaucacuauaaucaaucaaaugacucaacaauaaaacuaauagcuauguuguacacaccauuaagagcaaauaaugcuggagacgacguauuuacuguaucauguagaguccuaacaagaccaucaccagacuuugauuuuauauuuuuaguaccaccaacaguagaaucaagaacaaaaccuuucuccguuccaguacuaacuguagaagaaaugacaaacucucgauucccaauuccacuugaaaaacuauuuaccgguccaucaagugccuuuguuguacagccacaaaacgguagauguacuacagacggcguacuauuaggcacaacacaauuaucaccaguaaauauauguacauuucguggugauguaacacauauaacaggauccagaaacuauacaaugaauuuagcaucacaaaauuggaacaacuaugacccaacugaagaaauaccagcaccauuaggaacaccagacuucgucggaaaaauacaagguaugcuaacacaaaccacacgaaccgauggaagcacaagaggucacaaagcaacagucuacaccggauccgcagauuucgcacccaaacuaggccgaguccaauuugaaacagauaccgaucacgacuuugaagcaaaucaaaacacaaaauuuacaccaguaggaguaauacaagauggaucuacaacacacagaaacgaaccacaacaauggguccuaccuucauacaguggcagaaacacacacaauguacacuuagcaccagcaguugcaccaacauuucccggagaacaacuacucuucuuucgaucaaccaugccagggugcaguggauauccaaauauggauuuagacugucuacuaccccaagaauggguacaauacuuuuaucaagaggcagcaccagcucaaucagacguugcacuacuaagauuuguaaauccagacacugguagaguccuuuuugaauguaaacuacauaaaucaggauauguuacgguagcacacacaggccaacacgaucuaguaauacccccuaauggauauuucagauucgauucaugggucaaucaauucuacacucucgcaccuaugggaaauggaaccggaagaagaagaguauaa

SEQ ID NO: 33524 - RNA, 1620 nt, Artificial Sequence
  derived and/or modified sequence opt6 from VP1__Norovirus_and/or_Norovirus-like__KF060142
augaaaauggcuucaagugacgccaauccuucugauggaucagcagcaaauuuaguaccagaagucaauaaugaaguaauggcacuagauccuguagucggugcagcaauugcagcuccaguagcgggucaacaaaauguaauugauccauggauacgaaacaacuucguucaagccccaggaggugaauuuacaguaucacccagaaaugcaccaggagaaauucuauggucagcaccacuaggaccugauuuaaacccauaccuaucacaccuagcaagaauguauaacggauacgccggaggauuugaaguccaaguuauacuagccggaaaugcuuuuacugcaggaaaaauaauauuugcagcaguaccuccaaacuuuccaaccgaaggauuaucaccaagccaaguaacuauguuuccacauauuauaguugauguuagacaacuagaaccuguauuaauacccuuaccugauguaagaaacaacuucuaccauuauaaccaaucaaaugauucaaccauaaaacuaauagccaugcuauacacuccucuuagagccaauaaugccggugaugauguauucaccguaucuugccgaguauuaacacguccauccccagauuuugauuuuauauuucugguaccaccaaccgucgaaucacgaaccaaaccauuuucagugccaguacuaacaguagaagaaaugacuaacucacgauuucccauaccucucgaaaaauuauucacaggaccaucuucagcauucguaguacaaccacaaaaugguagauguacaacagacggaguccuauuagguaccacucaacuaucuccaguaaauauauguacauuccgaggugaugucacacauauuacuggaucacgaaacuauacaaugaacuuagcuucacaaaacuggaauaauuacgauccaacugaagaaaucccagcaccauuaggaacuccugauuucguaggaaaaauacaaggcauguuaacucaaacuacacgaaccgauggaucuaccagaggacauaaagcuacaguauauacuggauccgcagauuuugcaccaaaauuaggaagaguucaauuugaaacagacacagaucaugacuucgaagcaaaucaaaacacuaaauuuacaccagucggaguaauccaagauggaucuacaacccaccgaaacgaaccacaacaauggguauugccaucauacucaggaagaaacacacauaauguacauuuagcaccagcugucgcacccacuuuuccaggagaacaauuacuauuuuuccguucaacaaugccugguugcucuggauauccuaauauggaucuagauugucuacuuccacaagaauggguacaauauuuuuaccaagaagcggcuccugcacaaucagauguugcacuauuaagauuuguuaauccugauacaggaagaguauuauuugaauguaaauuacacaaaagcggauacguaacagucgcacauacaggacaacaugauuuaguaauacccccgaaugguuacuuucguuuugauucauggguaaaccaauuuuauaccuuagcaccaaugggcaauggaacaggaagacgaagaguuuaa

SEQ ID NO: 33525 - RNA, 1620 nt, Artificial Sequence
  derived and/or modified sequence opt6 from VP1__Norovirus_and/or_Norovirus-like__KF060138
augaaaauggcuucuucagacgcuaacccaucugacgguuccgcagcaaaucuaguuccagaaguuaacaaugaaguuauggccuuagaaccagucguuggagcugcaauagcagcuccaguagcaggucaacaaaacguaauugacccauggauaagaaauaacuucguacaagcaccaggaggagaauuuacuguaucuccaagaaacgcaccaggugaaauauuauggucagcaccauuaggaccagauuuaaaucccuacuuaucacacuuagccagaauguauaaugguuaugcaggaggauucgaaguacaaguuauacuagcaggcaaugcauuuacagcaggcaaaauaauauucgccgccguaccuccuaauuuuccgacugaaggacuauccccaucccaaguuacaauguuuccucacauaaucguugacguacgacaacuagagccaguguuaauaccacuaccagacguaagaaacaauuucuaucacuacaaucaaucaaaugauaguacgauaaaacuaauagcaaugcuauacaccccacucagagcaaacaaugcaggagacgauguauucacaguaucauguagaguuuuaaccagaccaucaccagacuucgacuuuauauuucuaguucccccaacaguagaaucacgaacaaaaccauuuucaguaccuguauuaaccguagaagaaaugaccaauucaagauuuccaauaccacucgaaaaauuauucacaggucccucgaacgcauucgucguacaaccccaaaacggaagaugcacaacagacggcguacuuuuagguaccacccaacuaucaccaguaaauauauguacauuccgaggagacguaacacacauuacuggaagccgaaauuacacaaugaauuuagcaagucaaaauuggaacaauuacgauccgaccgaagaaauaccagcaccacuaggaacuccagacuuugucggaaaaauacaaggaauguuaacacaaaccacacgaacagauggcucaaccagaggacauaaagcaacaguauacacagguucggcagacuuugcacccaaacuuggccgcguacaauucgaaacagauacagaucaugauuucgaagcaaaucaaaacacuaaauuuacuccuguuggagucauacaagaugguucaacaacacauagaaaugaaccacaacaguggguauuacccucauacucaggaagaaauacacacaacguacauuuagcaccagcaguugccccuacauuuccaggagagcaacuacuauucuuuagaucuacaaugccagguugcuccggcuaccccaauauggaucucgacugucuacuaccucaagaauggguacaauauuuuuaucaagaagcagcaccagcacaaagcgauguagcacuacuaagauucguaaauccagacacuggacgaguauuauuugaaugcaaauuacacaaaucuggauauguaacaguagcacacacaggccaacaugaucuaguaauaccaccaaauggauacuuucgauuugauucauggguaaaccaauuuuacacucuagcuccaauggguaauggaacaggaagaagaagaguauaa

SEQ ID NO: 33526 - RNA, 1620 nt, Artificial Sequence
  derived and/or modified sequence opt6 from VP1__Norovirus_and/or_Norovirus-like__KP784697
augaaaauggcaucuucugacgcaaauccuuccgaugguucugcagcuaaccuagucccagaaguaaauaaugaaguuauggcacuagaacccguaguaggagcugcuauagcagccccuguugcaggacaacaaaauguaauagauccauggauaagaaauaacuuuguccaagcacccggcggagaauuuacaguaucccccagaaaugcaccuggagaaauacucugguccgcacccuuagguccagaccuaaacccauauuuaucacacuuagcuagaauguacaacggauacgcuggcggcuucgaaguacaaguaauauuagcaggaaaugcauucacagcaggaaaaguaauauuugccgccgaucccccaaacuucccaacagaaggacuauccccuucacaaguaaccauguucccacacaugauaguagacguuagacaauuagaacccguacuaauaccauuaccagacguacgcaacaauuuuuaucacuauaaucaaucaaaugauccuacauuaaaacucauagcuauguuauacacuccacuacgagcaaauaacgccggagacgaugucuucacaguuucauguagaguucuuacacgcccaucaccagauuuugacuuuaucuuuuuaguaccuccuacuguagaaucacgcacaaaaccauuuucaguaccaaucuuaacaguagaagaaaugacaaauucucgauuuccaauaccccuagaaaaacuauucacuggcccaucaagcgccuuuguaguccaaccccaaaacggaagauguacaacagacgguguacuucucggcacaacacaacuaucaccuguuaacauauguacguuuagaggagauaucacccauauaacuggcucuagaaauuauacuaugaacuuagcuagccaaaacuggaacaacuaugacccaacagaagaaauaccagcuccucuugguacaccagacuuuguuggaaaaauacaaggcauguuaacucaaacaacaagaacagaugguucaacaagaggacacaaagcuacuguauacaccgguucagcagauuucgcgccaaaacucggccgaguccaauuugaaacagauacugaccaugacuuugaagcaaaucaaaacacaaaauucacgccaguaggaguaauucaagauggaucaaccacucauagaaaugaaccacaacaauggguauuaccaucauauucaggcagaaacacucauaauguacaccuagccccugcaguugccccaacauucccaggagaacaauugcuauuuuucagauccaccaugcccggauguuccggcuaucccaauauggaucuagauuguuuacucccacaagaauggguacaguauuuuuaccaagaagcagcaccagcacaaucagacguagcacuacuaagauucguuaacccagacaccggaagaguacuauuugaaugcaaacuccacaaaucaggcuauguuacuguagcccauacaggacaacacgaucuaguuauacccccaaauggauauuuuagauucgauaguuggguaaaccaguuuuacacuuuagcaccaaugggaaauggaaccggacgaagaagagucuaa

SEQ ID NO: 33527 - RNA, 1620 nt, Artificial Sequence
  derived and/or modified sequence opt6 from VP1__Norovirus_and/or_Norovirus-like__KF060111
augaaaauggcaucaucagaugcaaacccauccgacgguucagccgcaaaucuaguaccagaaguaaacaaugaagucauggcacuagaaccaguuguaggugcagcaauagcagcaccugucgcaggacaacaaaauguaauagacccauggauaagaaauaauuuuguacaagcaccaggaggagaauuuacuguaagcccaagaaaugcaccaggagaaauauuauggucagcaccuuuagggccagaucuaaauccauauuuaucacaccucgcaagaauguauaaugguuaugcaggagguuucgaaguucaaguaauccucgcaggaaaugccuuuacagcuggcaaaauaauuuucgcagcagucccaccaaacuucccaacugaaggacuauccccaucacaaguaacaauguuuccacauauaaucguagauguaagacaacuagaaccuguacuaauaccacuaccugacguaagaaacaacuucuaucacuauaaccaaaguaaugauucaacaauaaaauuaauagcaaugcuauauacuccauuaagggccaacaaugcuggagacgauguauucacuguaagcugccgcguauuaacaagaccaucaccagauuuugacuuuauauuucuaguuccacccacuguagaaucacguacaaaaccauucagcgucccagucuuaacaguugaagaaaugacaaauuccagauuuccaaucccauuagaaaaauuauuuacuggaccaucuucagcauuuguuguacaaccacaaaaugggagaugcaccacagacggaguucuauuaggcacuacacaauuaucaccaguaaauaucuguacauuuagaggcgauguaacacauauaacaggaucaagaaauuauacaaugaauuuagcaucacaaaacuggaacaauuaugauccuacugaagaaauaccagcaccacuuggcacaccagacuucguaggaaaaauacaaggaauguuaacacaaacaacacgaacagauggaucaaccagaggacacaaagcaacaguauauacaggaucugcagauuucgcaccaaaauuagguagaguacaauucgaaacagacaccgaccacgauuuugaagccaaucaaaacaccaaauuuacaccaguaggaguuauacaagacggaggaacaacacauagaaaugaaccucaacaauggguacuaccgucauauagcggacgcaauacacacaauguacaucuagcuccugcaguagcacccacuuuucccggagaacaacuacuauucuuucgcucaacuaugcccggaugcuccggcuauccaaauauggaucuagauugucuauuaccacaagaauggguccaauauuuuuaccaagaagcagcaccagcacaaucugacguagcauuacuacgauucguaaacccagacacuggccguguauuauucgaauguaaauuacacaaaucaggauacguaacuguugcacacacaggccaacacgauuuaguaauaccaccaaacggauauuucagauuugauagcugggucaaccaauucuacacacuugcaccuaugggcaacggaacaggcagacgccgaguauaa

SEQ ID NO: 33528 - RNA, 1620 nt, Artificial Sequence
  derived and/or modified sequence opt6 from VP1__Norovirus_and/or_Norovirus-like__KF060089
augaaaauggcaucaucugacgcaaauccaucugauggaucagcagcaaaucuaguaccugaaguuaauaaugaaguaauggcucuagaaccuguaguaggagcagcuauagcagcuccaguagcuggccaacaaaauguuauagacccauggauaagaaacaacuuuguacaagcaccuggaggagaauuuacaguuucaccaagaaaugcaccaggcgaaauuuuauggucagcaccccuagguccagaccuaaacccauauuuaucucaccuugcuagaauguauaauggauacgcuggcgguuuugaaguacaaguaauacuagcaggcaaugcguuuacagccgguaaagucauauuugcugcaguacccccaaauuucccaaccgaaggacuaucaccaucucaaguaacuauguuuccacauauaguaguagacguucgacaacuagaacccguacuaauccccuuaccagacguucgaaauaacuucuaucacuauaaccaaaguaacgacuccacuauaaaauuaauagcaaugcuuuauacuccauuaagagcuaacaaugcaggcgacgacguuuuuacaguaucaugcagaguacuaaccagaccaucaccugauuuugacuuuaucuuccuaguacccccaacaguugaaaguagaaccaaaccauucucaguaccaguauuaacaguagaagaaaugacaaauucccgauuucccauaccacuugaaaaauuauuuacagguccaucauccgccuuuguaguacaaccacaaaacggaagauguacaacugacggaguauuauuaggaaccacucaacuuucaccaguuaauauaugcacauuuagaggagacguaacacauauuaccggaucuagaaauuauacaaugaacuuagcaagccaaaauuggaauaauuaugauccaaccgaagaaauaccagccccuuuaggaacuccagacuuugucggaaaaauacaaggaaugcuaacacaaacaacaagaacugauggauccacacgcggacauaaagccaccguauauacaggcucagcagacuuugccccaaaacuuggcagaguacaauucgaaaccgauacagaucaugacuuugaagcaaaucaaaacacaaaauuuacuccaguaggaguaauacaagauggaucaacaacacauagaaaugaaccacaacaauggguauuacccagcuauucaggcagaaauacacauaauguacauuuagcaccagcaguagcaccuacauuuccaggagaacaauuacuauucuuucgaucuacuaugccagguuguucaggcuacccaaacauggauuuagauuguuuauuaccacaagaauggguucaauacuuuuaccaagaagcagcaccagcacaaucagauguagcuuuacuuagauucguuaaucccgauaccggaagaguacuauuugaauguaaacuacauaaaucggguuauguaacuguugcacauacaggacaacacgacuuaguuauaccaccaaauggcuauuucagauuugauucauggguaaaucaauuuuacacacuugcaccaaugggaaauggaacaggacgaagaagaguauaa

SEQ ID NO: 33529 - RNA, 1620 nt, Artificial Sequence
  derived and/or modified sequence opt6 from VP1__Norovirus_and/or_Norovirus-like__KP096333
augaaaauggcaucaucagacgcuaaccccucagacggcuccacugcuaauuuaguacccgaaguuaacaacgaaguuauggcucuagaaccaguagucggagcagcuauagcagcucccguagcaggacaacaaaauguaauugauccauggauaagaaacaacuuuguacaagcaccaggaggagaauuuacuguaucuccaagaaacgcacccggcgaaauacuauggucagcaccauuagguccagauuuaaaucccuacuuaucucacuuagcucgaauguacaaugguuacgcaggaggauucgaaguacaaguuauauuagcuggcaacgccuucacagcuggaaaaauaauauucgcagcaguaccaccaaacuucccaacagaaggauuaaguccaucacaaguaacaauguuuccucauaucauaguugauguuagacaauuagaaccuguacuaauaccucuaccagauguccgcaauaauuucuaucauuacaaccaauccaaugauccaacaauaaaacuuauagcuauguuauacacaccauuacgagccaacaaugcaggcgacgacguauuuacagucucaugccgaguauuaaccagaccuucaccagacuucgacuucaucuuccuaguaccacccacaguagaauccagaacaaaacccuucagugucccagucuuaacaguagaagaaaugacaaacucucgauuuccaauaccauuagaaaaacuauuuacaggucccucuuccgcauucauaguccaaccccaaaauggaagauguacuacagacggaguacuacugggaacaacacaauuaucaccaguaaauauauguacauuccguggcgacguaacccauauaucaggauccagaaauuauacaaugaauuuagcaucacaaaauuggaacucauacgauccaacagaagaaacuccugcacccuuaggcaccccugacuuuguuggaaaaauacaaggagucuuaacacaaacaacacgaacugauggaucuacccgaggacauaaagccacaguauauaccggaucagcagacuucucaccaaaacucggaagaguccaauuugccacagacacugauaaugauuuuguuaccaaucaaaauacaaaauuuacaccaguuggcgucauacaagacggaucaacaaccccacgaaaugaaccacaacaauggguacuaccuucauauucaggcagaaauacucacaauguccauuuagcucccgcaguugcuccaacauuuccaggagaacaacuacuuuucuuuagaucuacaaugccaggauguucuggauacccaaacauggaucuagauugccuucuaccacaagaauggguacaauacuucuaucaagaagcagcaccagcacaaagcgacguagccuuacuccguuuugucaauccagacaccggaagaguauuauucgaauguaaacuacauaaaacaggauacguaacuguagcccacaccggacaacaugauuuaguaauaccaccaaauggauauuuccgcuuugauucauggguaaaccaauuuuauacauuagcacccaugggaaauggcacaggcagaagacgaguauaa

SEQ ID NO: 33530 - RNA, 1620 nt, Artificial Sequence
  derived and/or modified sequence opt6 from VP1__Norovirus_and/or_Norovirus-like__KF060153
augaagauggcauccucugaugcaaacccaucagacggcucugccgcuaacuuaguaccagaagucaauaacgaagucauggcacuagaaccaguaguaggagcagcaauagcagccccuguagcaggacaacaaaacguaaucgacccuuggauaagaaauaacuuuguacaagcgccaggaggagaguucacaguuagcccuagaaaugcaccuggagaaauucuauggucagcaccucuaggaccagaucuaaauccuuacuuaagucacuuagcuagaauguacaaugguuaugcuggaggauucgaaguagaagucauucuagcuggaaaugcauucaccgcaggaaaaauuauauucgcagcaguaccaccaaacuuuccaacagaagguuuaucaccaucacaaguaacaauguuuccacauauaauaguagacguaagacaacuagaaccaguuuuaaucccacuucccgacguaagaaacaauuucuaucauuacaaucaaucuaacgacucuacuauaaaauuaaucgcaauguuauacacaccacucagagcaaacaacgcaggagacgaugucuuuaccguaucuuguagaguccuuacaagaccuuccccagauuucgacuucauauuucuaguuccaccaacaguagaaucccgcacuaaaccuuucucaguuccaguuuuaacaguagaagaaaugaccaauuccagauuuccuauacccuuagaaaaauuauucacaggucccucaucagcauuuguaguacaaccucaaaacggacgcuguacuacagacggaguacuacuaggaaccacucaauuaucacccguaaauauauguacuuucagaggagacguaacacauauaacugguucacgcaauuauacaaugaaucuugcuucucagaacuggaacaauuacgauccaacagaagaaauaccagcaccacuaggaacaccugacuuuguaggaaaaauacaaggcaugcuaacacaaacuacaagaacagauggaucuacaagaggucacaaagcaacuguauauaccggaucagcagacuucgcaccaaaacucggaagaguacaauucgaaacagauacagaucacgacuucgaagccaaucaaaauaccaaauuuaccccaguuggaguaauccaagacgguaguacuacacauagaaaugaaccacaacaauggguucuaccaaguuauucaggaagaaauacccauaacguccacuuagcaccagcaguugcaccaaccuucccaggugaacaauuauuguucuuucguaguacaaugccagguugcucaggauauccaaauauggaccuagauugccuauuaccacaggaauggguacaauauuuuuaucaagaagcagcaccagcacaaucagacguagcauuauuaagauucguaaauccagacacaggcagaguacuauucgaaugcaaauuacacaaaagcggauacguaacaguagcacacaccggucaacacgauuuaguaauuccaccaaacggauauuuccgauucgauaguuggguaaaucaauuuuauaccuuagcaccaaugggaaacggaaccggaagaagaagaguauaa

SEQ ID NO: 33531 - RNA, 1620 nt, Artificial Sequence
  derived and/or modified sequence opt6 from VP1__Norovirus_and/or_Norovirus-like__KF060125
augaaaauggcuucuucagacgccaacccauccgauggaucugcagcaaaccuuguaccggaaguaaauaacgaaguaauggcacuugaaccaguaguaggagcugcaauagccgcacccgucgcaggacaacaaaauguaauagauccauggauaagaaauaacuuuguccaagcaccaggaggagaauuuacaguaucacccagaaacgccccaggagaaauacucugguccgccccacuaggaccagaccuaaauccauauuuaucacaccuagcaagaauguauaacggauaugccggcggauucgaaguagaaguuauauuagcuggaaaugccuucacagccggaaaaauaauauuugcagcaguaccaccaaauuuccccaccgaaggacuauccccaucucaagucacgauguucccacacauaauuguugacguuagacaacuugaaccaguacuaaucccauuaccugauguaagaaacaauuuuuaccacuacaaucaaucuaaugacucuaccaucaaauuaaucgccaugcuauacacuccuuuaagagcaaauaaugcuggugacgauguauucacaguaaguugucguguauuaacaagaccaucuccagacuuugauuucauauuucuaguaccaccaacaguugaaucuagaacaaaaccauucuccguaccaguauuaacaguagaagaaaugaccaauucaagauuucccauaccacuagaaaaacuauuuacaggacccuccuccgcauucguaguacaaccacaaaacgggcgauguacaacugacggaguauuauuaggaaccacacaauuaucaccuguaaauauauguacuuuccguggggauguaacacauauaacaggaucacgcaauuacacgaugaaucuagcaucccaaaacuggaacaauuacgacccaacagaagaaauucccgcaccacuuggaacuccugacuuuguaggaaaaauacaaggaacuuuaacacaaacaacacgaacagacggaucaacaagaggacauaaagcaaccguauauacaggaagcgcugauuucgcuccaaaauuaggucgaguacaauuugaaacugauacagaucacgauuucgaagcuaaucaaaacacaaaauucacuccuguaggaguaauacaagacggaucaacaacacaccgaaaugaaccacaacaauggguauuaccaucauauuccggaagaaauacucauaauguucaccuugcuccugccguagcaccaacuuucccaggcgaacaacuauuauucuuccgauccacuaugccuggauguucaggauacccaaacauggacuuagauugucuauuaccacaagaauggguacaauacuuuuaccaagaagcagcuccagcacaaucagacguagcauuauuacgauucguaaacccagauacaggaagaguacuuuuugaauguaaacuacauaaaucaggauauguaaccguagcucacacaggacaacaugaucuaguaauaccaccuaaugguuacuuuagauuugauuccuggguaaaucaauucuauacacuagcucccaugggaaaugguacaggacgaagaagaguauaa

SEQ ID NO: 33532 - RNA, 1620 nt, Artificial Sequence
  derived and/or modified sequence opt6 from VP1__Norovirus_and/or_Norovirus-like__KX354135
augaaaauggcaucaucagacgcaaacccaagugauggcucugcugcuaacuuaguaccagaaguaaauaaugaaguaauggcauuagaaccaguaguaggugcugcaauagcugcaccaguagcaggccaacaaaauguaauagauccauggauuagaaauaacuucgugcaagcuccaggaggagaauuuacaguaucaccgcgaaacgccccuggagaaauauuauggucagcaccacuagguccagaccuaaacccuuacuuaucacaccuagcaagaauguauaacggcuacgcaggagguuucgaaguacaaguaauacucgcaggcaaugcauuuacugcaggaaaaauuauuuucgcagccguaccaccaaacuucccaacugaaggcuuaucaccaucccaaguaacaauguuuccacauauuauaguagacgucagacaauuagaaccggucuuaauuccauuaccagacgucagaaacaauuuuuaccacuauaaucaaucaaaugacucuaccauaaaacuaauagcuauguuauacacuccuuuaagagcaaauaaugcaggagaugacguauuuacaguuucauguagaguauuaacaagaccaucaccagacuuugacuucauauuucuaguacccccaacaguugaaucccgaacaaaaccuuuuucaguccccauuuuaaccguugaagagaugacaaacuccagauuuccuauucccuuagaaaaacuauuuacaggaccaucaucugcauuugucguacaaccucaaaacggaagauguacaacagauggaguauuauuaggaacaacacaauuaucccccgucaacauaugcacauuucgaggugacauuacacauauaacaggcucacauaauuauacaaugaauuuagcuucucaaaacuggaacucauaugauccaaccgaagaaauaccugccccauuaggcaccccugacuuuguagggaagauucaaggaguauuaacccaaacuacuagagcagauggaucaacaagaggacacaaagcuacaguauauacagguuccgcagacuuugcacccaaauuaggacgcguucaauucgaaacagacacaaaucacgacuuugaagcaaaucaaaacacaaaauuuacaccagucgguguuauacaagaugguggaaccacacaucgaaacgaaccacaacaauggguacuaccaucauauucuggaagaaacacacacaacguacaccuagcuccugcaguagcaccuacauuuccaggagaacaauuacuauuccuaaaaucuacuaugccuggauguucuggauauccaaauauggaucuagauugucuuuuaccucaagaguggguacaauuuuucuaucaagaagcagcacccgcacaaagugacguagccuuauuaagauuuguaaauccagauacaggaagaguuuuauuugaauguaaacuccauaaaucaggauauguaaccguagcacacacuggacaacaugacuuaguaauaccacccaacggauacuucagauuugauucauggguuaaucaauucuauacacuagcaccaaugggaaauggcacaggacgacgucgaguauaa

SEQ ID NO: 33533 - RNA, 1620 nt, Artificial Sequence
  derived and/or modified sequence opt6 from VP1__Norovirus_and/or_Norovirus-like__KX354045
augaaaauggcuucuucggaugcaaauccauccgacggaagugcagccaacuuaguaccagacguaaauaaugaagucauggcauuagaaccaguaguaggagcugcuauagcagccccaguagcaggacaacaaaacguaaucgauccauggauucgaaauaauuucguacaagcaccaggaggugaauuuacagucucaccaagaaaugcccccggagaaauauuauggucagcuccuuuagggccagaucuaaacccuuauuuaucucaccuagcucguauguauaacggauaugcaggagguuucgaaguacaaguagucuuagccggaaacgcauuuacagcugguaaaauaauuuuugcagcaguuccaccaaauuucccaacagaaggacuaucuccuucacaaguaacuauguucccacacaucauaguggacguucgacaauuagaaccaguccuaaucccauuaccagacgucagaaacaauuucuaccacuauaaccaaucaaaugacuccacaauaaaacuuauagcuauguuguauacacccuuacgagcaaauaacgcaggagacgaugucuuuacaguaucauguagagucuuaacaagaccaucaccugauuuugacuuuauuuuucuaguucccccaacaguagaaucucgaacaaaaccuuuuucuguaccagucuuaacaguagaagaaaugacaaacucaagauuuccaaucccauuagaaaaacuauuuacaggaccaucaucagcauuuguaguacaaccacaaaacggaagauguacaacugacggaguauuauuaggcacaacucaauuaagcccaguaaauaucuguacauuuagaggagacguuacucauauaacaggaagcagaaauuacacaaugaaucucgcaucccaaaauuggaacaauuacgauccuacagaagaaauaccagcaccuuuaggaacaccugacuucguaggaaaaauacaagguauguuaacacaaacaacaagaacagauggaucaacaagaggccauaaagcaacugucuauacaggaucagcagauuuugcuccaaaacuaggacgaguacaauucgaaacagacacugaucaugauuucgaagcaaaucaaaauacuaaauucacccccguuggaguaauacaagacggaucaaccacacauagaaacgaaccacaacaauggguacuuccaucauauucagguagaaauacucacaauguacaucucgcucccgcuguagccccaaccuucccaggagaacaauuacucuucuuuagaucaaccaugcccggauguucaggauauccaaauauggaccuagauugucuacucccccaagaauggguucaauauuuuuaccaagaggcagcacccgcacaaucugacguugcacuacuuagauucguaaacccugacacuggaagaguauuauucgaaugcaaacuacacaaaucagguuacgucacaguugcacauacaggucaacacgauuuaguaauaccaccaaauggauauuuuagauuugauucuugggucaaucaauucuacacucuagcaccuaugggcaacggcacaggacgacgaagaguuuaa

SEQ ID NO: 33534 - RNA, 1620 nt, Artificial Sequence
  derived and/or modified sequence opt6 from VP1__Norovirus_and/or_Norovirus-like__LC153121
augaaaauggcaucauccgaugcaaacccaucagauggaucagccgcaaaccuaguuccugaaguuaauaaugaaguaauggcacuagaaccaguuguaggugcagcuauagcugcaccugucgccggacaacaaaauguaauagacccauggaucagaaauaauuucguacaagcaccaggcggagaguucacaguuucuccaagaaacgcaccaggagaaauacuauggucagcuccacuugguccagaucucaauccauaucucucacaccuugcacgcauguauaacggauacgcaggaggcuuugaaguacaaguaauucuagcagguaacgcauuuacagcaggaaaaauaauauuugccgccgucccaccaaacuuuccaacagaaggauuaucccccucacaaguaacaauguuuccacacauaauaguagacguccgacaacuagaaccaguauuaauaccauuaccagauguccgaaauaacuuuuaucauuacaaccaauccaaugauucaacuauaaaauuaauagccauguuauauacuccuuuacgagcaaacaacgcaggagacgacguauuuacuguuucaugcagaguauuaacaagacccucaccugauuuugauuuuauauuucuugucccaccaacaguugaaucacgaacuaaaccuuuuuccguaccaguccuaacaguugaagaaaugacaaacucaagauucccuauuccauuagaaaaacuauuuaccggaccaucaucagccuucguaguacaaccacaaaacggcagauguaccaccgauggaguacuacuaggaacaacacaacuaucaccaguaaauauauguaccuuccgaggagauguaauacauauaacaggaucgagaaauuacacaaugaaucuagcaucacaaaauuggaacaauuacgacccaacagaagaaauaccugcaccacuagguacaccagacuuuguuggaaaaauucaaggcaugcuaacucaaaccacaagaacagacggaucuacaagaggucacaaagcaacugucuacacaggaucagcggacuuugcaccaaaauuaggaagaguacaauuugaaacagauacugaucacgauuucgaagcaaaucaaaauacaaaauucacacccguaggaguuauacaagacggaucuacaacacaucgaaaugaaccacaacaauggguacuaccaucauauuccggccgcaauacacauaacguacaucuugcuccagccguugcaccaacauucccaggagaacaacuuuuauucuucagauccaccaugccaggcuguucugguuaccccaacauggaucuagacugucuauuaccccaagaauggguacaauauuucuaucaagaagccgcaccagcacaaucagacguugcacuacuacgauuuguaaauccagacacaggaagaguacuauuugaaugcaaacuacacaaaucaggcuauguaacaguugcccacacaggucaacaugauuuaguaauaccacccaaugguuauuucagauucgacaguuggguaaaucaauucuauacacuagcuccaauggguaauggaacaggaagaagaagaguauaa

SEQ ID NO: 33535 - RNA, 1620 nt, Artificial Sequence
  derived and/or modified sequence opt6 from VP1__Norovirus_and/or_Norovirus-like__KF668568
augaaaauggcuucaucagacgcaaacccuucagauggaucagcugcaaaccuuguaccagaaguaaacaaugaaguaauggcacuagaaccaguuguuggugcagcuauagcagcuccugucgcuggacaacaaaauguaauagauccuuggauuagaaauaauuuuguacaagcacccggaggcgaauuuacaguaucaccaagaaaugcaccaggagaaauccucuggucagcaccuuuagguccagaccuaaauccuuaucucucacauuuagcacguauguauaauggauaugcaggcgguuuugaaguucaaguaauacuugcuggcaaugcauucacagcaggaaaagucauauuugcagcaauacccccaaacuuuccaacugaaggacuaaguccaagucaagucacaauguuuccacauauuguuguagauguacgacaacuugaaccaguacuaauaccacuaccagauguaagaaacaauuuuuaucacuauaaucaaucuaaugaucccacuauuaaacuaaucgcaaugcucuauacaccauuaagagcaaauaacgcaggcggagacguauuuacuguaucaugcagaguccuuacaagaccaucaccagacuuugauuuuauauuccuaguaccacccacaguagaaucaagaacaaaaccauucaguguaccaguacuaacaguagaagaaaugacaaacucacguuucccaauacccuuagaaaaauuauucacaggaccaucauccgcauucguaguacaaccacaaaacggaagauguacuaccgaugguguucuauuaggcacuacacaauuauccccaguaaauauaugcacauuccguggcgacguaacacauauaacaggaucuagaaauuacacuaugaauuuagcaucacaaaacuggaacaauuacgauccuacagaagaaauaccugcaccacuaggaacuccagacuuuguaggcaaaauacaaggaauguuaacacaaacaacaagaacagacggauccacacgaggacauaaagcaacaguauacacaggaucagcagacuuugccccuaaacuaggcagaguacaauucgaaacagacacagaccaugauuucgaagcaaaucaaauaacuaaauuuacaccaauugguguuauacaagaugguucaacaacacauagaaaugaaccacaacaauggguacuaccuucauauucuggaagaaauacacauaacguacauuuagcacccgcaguagcaccaacauuuccaggagaacaauuacuauucuucagaaguaccaugccaggauguuccggauacccaaauauggacuuagacugcuuacuaccucaagaauggguacaauauuucuaccaagaagcagcccccgcucaauccgaugucgcauuacuaagauucguaaauccagacacaggaagaguacuauucgaaugcaaacuacauaaaagugguuauguuacuguagcacacacaggucaacaugaucuaguuauaccaccaaacggauacuuccguuuugauucuuggguaaaucaauuuuacacacucgcaccaaugggaaauggcacuggaagacgaaggguauaa

SEQ ID NO: 33536 - RNA, 1620 nt, Artificial Sequence
  derived and/or modified sequence opt6 from VP1__Norovirus_and/or_Norovirus-like__KF668567
augaaaauggcaucaucagaugcaaacccaucugauggaucagcugcaaauuuaguaccugaaguaaauaaugaagucauggcacuagaaccuguugucggcgcagcaauagcagcaccaguagcuggccaacaaaauguaauagauccauggauaagaaauaauuuuguacaagcaccaggaggugaauuuacaguuucaccacgaaaugcaccaggcgaaauccucuggucagcaccucuaggccccgaccugaacccuuacuuaucucaccuagcccgaauguacaacggauacgcuggcggauuugaaguccaaguaauauuagcuggaaaugcauucacagccggcaaaguaauauuugccgcuguuccaccaaauuuuccaacagaaggacuauccccaucacaagucacaauguucccacauauaguaguagauguacgacaacucgaaccaguccuuaucccacuaccagauguaagaaacaauuucuaucauuauaaccaauccaaugaucccacuaucaaauuaauagccaugcucuauacuccacuaagagcaaacaaugcaggagaugauguaucaacaguaucauguagaguauuaacuagaccuucaccagacuuugacuuuaucuuuuuaguuccaccuaccguagaaucaagaaccaaaccauuuucuguaccaguauuaaccguagaagaaaugacaaacucacgcuuuccuauaccauuagaaaaacuauuuacaggaccaucuucagcuuuuguuguacaaccacaaaacggaagauguacaaccgacggcguuuuacuaggaacaacacaacuaagucccguaaauaucugcacauucagaggagacgucacacauauaacagguucuagaaauuacacaaugaauuuagcaucucaaaacuggaacaacuacgauccaacugaagaaauaccagccccacuaggaacaccugauuucgucggaaaaauacaaggcauguuaacucaaacaacaagaacagacgguucaacacgaggccacaaagcaacugucuacacugguucagcagacuuugcuccaaaauuaggaagaguucaauucgaaacagacaccgaucacgacuuugaagcaaaccaaaauacaaaauucacuccaauuggcguaauacaagauggcucaacaacacauagaaaugaaccacaacaaugggucuuacccucauacucuggacguaauacacacaacguccaucuagcuccugcaguagcacccacauuuccaggagaacaauuacuuuucuuuagaucaacaaugccaggauguuccggguacccaaauauggaucuagauugcuuauuaccacaagaauggguacaauacuuuuaccaagaagcagcaccagcacaaucagacgucgcauuacuacgauucguaaacccagacacuggacgaguauuauucgaaugcaaauuacauaaaucaggauauguuacaguagcacauacaggacagcaugaucuuguaauaccacccaacgguuacuucagauuugauucauggguaaaccaauuuuauacacuagcaccaaugggaaauggaacuggcagacgcagaguauaa

SEQ ID NO: 33537 - RNA, 1620 nt, Artificial Sequence
  derived and/or modified sequence opt6 from VP1__Norovirus_and/or_Norovirus-like__KR904210
augaaaauggcgucaucagacgcaaaucccuccgauggaucaaccgcaaacuuaguaccagaaguaaauaaugaaguuauggcucucgaaccagucguuggagcugcaauagcagcaccaguagcaggacaacaaaaugucauagacccuuggauucgcaacaauuuuguacaagcaccuggaggcgaauuuacaguuucuccaagaaaugcaccaggcgaaauacucuggucagcaccacuuggaccagacuuaaauccauaucuaucacaccuugcaagaauguauaauggauaugcaggaggauucgaaguacaaguaauauuagcuggcaaugccuucacagcgggaaaaauaauauucgcugcuguaccaccaaacuuuccaaccgaaggauuaucaccaagccaagugacaauguucccucauaucauaguagacguuagacaacuugaaccaguacuuauaccauuaccagacguaagaaacaauuucuaucacuacaaccaaucaaaugacucaacaauaaaauuaauagcaaugcuauauacucccuuacgugcaaauaacgcaggcgaugauguauuuacaguauccugccgaguacuaacacgacccucaccugauuuugacuuuauauuuuuaguuccaccuacagucgaauccagaacuaaaccauucagcguacccauauuaacagucgaagaaaugacaaauucaagauucccaauuccacuugaaaaauuauuuacugguccaucaucagcuuucguaguccaaccucaaaaugguaggugcacaacagacggaguacuauuaggaacaacacaacuaucuccaguaaacaucugcacauucagaggagauguaacacauauagcuggaucaagaaauuacacuaugaaucuugcuucacaaaacuggaacucauacgauccaacagaagaaauaccagcaccacuagaaacaccugauuuuguaggaaagauacaagguguauuaacacaaacaacaagaaccgaugguucuacacgaggucacaaagccacaguauauacaggcuccgcagauuuuucucccaaauuaggaagaguacaauucgcuaccgauacagauaacgauuucgacucuaaccaaaauacaaaauucacacccguaggcguuauacaagacggcggaacuacucaccgaaaugaaccacaacaguggguauuaccuucuuauucaggaagagauauacacaacguccaccuugcuccugcaguagcaccaacauuuccaggagaacaacucuuauucuuuagaucuacaaugcccgguuguucuggauauccuaauauggaucuagauugcuuacuuccccaagaauggguacaauauuuuuaucaagaagcagcuccagcucaaucagauguagcauuacuaagauucguuaacccagacacaggacgaguacuauucgaaugcaaauuacauaaaucaggcuauguaacaguagcacauacaggacaacacgaucuagucauaccaccaaacggcuauuucagauucgacaguuggguaaaucaauuuuauacccuugcaccaaugggcaacggcacuggaagacgacguguauaa

SEQ ID NO: 33538 - RNA, 1620 nt, Artificial Sequence
  derived and/or modified sequence opt6 from VP1__Norovirus_and/or_Norovirus-like__JX459907
augaaaauggcaucaucagacgcuaacccaucagacgguucagcagcaaaucuuguaccagaaguuaacaaugaaguaauggcauuagaaccgguagucggagcagcaauagccgcaccagucgccggacaacaaaauguaaucgaucccuggauuagaaacaacuuuguacaagcacccggaggagaauuuacuguuucucccagaaaugcacccggcgaaauuuuauggucugcaccuuuaggaccagauuuaaauccuuaucuaucccacuuagcaagaauguauaauggauacgcuggaggcuucgaaguacaaguaauacuagcuggaaaugccuucacugcaggaaaaguuauauucgccgcaguaccuccaaauuuucccacagaaggacuuucccccucucaaguaacaauguuuccacacauaguuguagacguaagacaacuagaaccaguacuaauuccacucccagauguaagaaacaacuucuaucauuauaaucaaucaaaugauucuacaauaaaacuuauugcaauguuauauacacccuuacgagcaaacaaugcaggcgaugaugucuuuacaguaaguuguagaguauuaacaagaccaucuccugacuuugauuuuauauuucuaguucccccaacaguugaaucccgaacaaaaccauuuucuguacccguuuuaacaguagaagaaaugacuaacucuagauucccaauaccucuugaaaaauuauuuacaggacccucaucagcauuuguaguacaaccucaaaauggcagauguacaacugauggaguauuacuaggaacuacacaauuaucacccguuaacauaugcacuuuucguggugauguuacacauauaacaggaucaagaaauuacacaaugaacuuagcaucacaaaauuggaauaacuacgacccaacagaugaaaucccugcaccauuaggaacaccugacuuugucggcaaaauccaaggcauguuaacacaaacaacacgaacagacggauccacacgaggucacaaagcaacaguauauacaggauccgcagauuuugcuccaaaacuuggacgcguacaauucgaaacagacaccgaucacgacuucgaagcaaaucaaaauacaaaauucacaccaguaggaguaauacaagaugguucuacaacacacagaaaugaaccacaacaauggguucuaccaucauacucaggacgaaacacacacaauguacaccuagcaccagcuguagcuccaacuuuuccaggugaacaacuuuuauucuucagaucaacaaugcccggauguuccggauauccaaauauggaccuagauuguuuacucccacaagaauggguacaauacuucuaucaagaagcagcaccagcccaaucagacguagcacuuuuaagauucguaaaucccgacacaggacgcguccuauucgaaugcaaacuacauaaaucagguuauguaacugucgcacacacaggacaacaugaucuaguaauaccacccaacggauacuuuagauucgauucauggguaaaccaauuuuauacauuagcacccaugggcaauggaacaggccgaagaagagucuaa

SEQ ID NO: 33539 - RNA, 1620 nt, Artificial Sequence
  derived and/or modified sequence opt6 from VP1__Norovirus_and/or_Norovirus-like__KF060062
augaaaauggcaucaagcgaugcaaauccaacagauggauccgcagcaaaccuaguuccagaaguaaacaaugaaguaauggcauuagaaccaguaguaggagcagccauagcagcccccguagcaggucaacaaaauguaauugaccccuggauaagaaacaauuuuguacaagcaccagguggagaauuuacuguaucuccuagaaaugcaccuggagaaauauuauggucugcaccauugggaccagaucuaaauccuuaucuuucccaccuagcuagaauguauaacggauacgcaggagguuucgaaguacaaguaauucuagcaggcaaugccuucacagcuggaaaaauaauauucgcagcaguaccucccaacuuuccuaccgaaggccuaucaccaucucaaguaacaauguuuccacauaucauuguugacguaagacaauuagaaccaguucuaauaccacuaccugauguaagaaauaauuuuuaucauuauaaucaauccaaugacucaacuaucaaacuaauagcaauguuauacacaccauuaagagccaauaaugcaggagaugauguauuuaccguauccugccgaguauuaacacgaccaucuccagauuucgacuucaucuuuuuaguuccuccuacaguagaaaguagaacaaaaccuuuuucaguaccaguucuuacaguagaagaaaugacuaauucccgcuuuccaauucccuuagaaaaacuauucacaggcccgucaucugcauuuguaguacaaccacaaaacggcagauguacaacagacgguguacuacuaggaacaacacaauuauccccaguaaacauauguaccuucagaggagauguuacacauauaaccggaagcagaaauuauacuaugaauuuagcaucacaaaacuggaacaauuaugacccaacugaagaaacaccagcaccuuuagguacaccagacuucguaggaaaaauucaaggaauguuaacacaaacaaccagaaccgauggcagcacaagaggacauaaagcaacaguauauaccggaucagcagacuuugcaccuaaacuuggccgaguacaauucgaaacugauaccgaccacgauuucgaagcaaaucaaaauacuaaauucacaccaguuggaguaauacaagauggcucuacaacacauagaaaugaaccacaacaauggguauuaccaucauauuccggacgcaacacccacaauguacaccuagcuccugcaguagcaccaacauuuccaggcgaacaacuacuuuucuucagaucaacaaugccagguugcucuggauauccaaauauggaucuugacuguuuauuaccacaagaauggguccaauauuuuuaucaagaagcagccccagcucaaucagauguagcauuauuaagguucguaaacccagacacaggacgaguauuauucgaaugcaaacuucacaaaaguggauacguaacagucgcacacacaggacaacacgaccucguaauaccaccaaauggauauuuuagauucgauucuuggguaaaucaauuuuauacacuagcuccuaugggaaauggaacaggaagaagaagaguauaa

SEQ ID NO: 33540 - RNA, 1620 nt, Artificial Sequence
  derived and/or modified sequence opt6 from VP1__Norovirus_and/or_Norovirus-like__KF060080
augaaaauggccucaucagacgcaaauccaucugacggcucagcagcaaaccucguaccagaaguaaacaaugaagucauggcauuagaacccguagcgggugcagcaauagcagcaccaguugcaggucaacaaaaugucauagacccauggauaagaaauaacuuuguacaagcaccaggaggagaauuuaccguaucaccaagaaacgcaccaggugaaauacuaugguccgcaccuuuaggaccagauuuaaauccauacuuaucacaucucgccagaauguauaacggauacgccggaggauucgaaguacaaguaauacuagcaggaaaugcauuuaccgcugguaaaguaauauuugcagccguaccgccaaauuucccuacagaaggccuaucaccaucacaaguaacaauguucccucauauaguaguagauguaagacaacucgaaccaguacuaaucccauuaccagauguaagaaacaauuuuuaucacuauaaccaaucaaacgauucaacaauaaaacuaauugcaauguuauacacaccauuacgagcaaacaacgcaggagacgaugucuuuaccguauccugucgcguacuaacaagaccuucaccagauuuugacuuuauauuuuuaguuccaccuacaguagaaucuagaacaaaaccauuuucaguuccuguacuuacaguagaagaaaugacaaauucaagauuuccaauuccacuagaaaaacuuuuuacaggcccuucaucagcauucguaguacaaccacaaaacggcagauguacuacagauggagucuuauuaggaacuacacaauuaaguccaguaaacauauguaccuucagaggugaugugacacauauaacaggaucaagaaauuauaccaugaaucuugcaucccaaaacuggaauaacuacgacccgacagaagaaauuccugcuccacuugguacaccagacuuuguagguaaaauucaagguaugcuaacacaaacaacaagaacagacggaucaaccagaggacacaaagcaacaguuuauacagguagugcagauuuugcaccaaaacuuggaagaguacaauuugaaaccgauaccgaccacgacuucgaagccaaucaaaacacaaaauucacaccaguaggugucauacaagaugguagcacaacacaccgaaaugaaccucaacaauggguauuaccaucauauucaggccguaauacacauaauguucaccuagcaccagcaguugcaccaacauuuccuggagaacaacuacucuucuuuagaucaacaaugccaggaugcucagguuauccaaauauggaccuagauugucuacuuccucaagaauggguacaauauuucuaucaagaagcagcaccagcacaaagcgauguagcauuauuacgauuuguaaacccugacacaggaagaguacuauuugaauguaaacuacauaaaucaggauauguaacugucgcacacacuggacaacaugacuuaguuauaccaccaaauggauauuuuagauucgauaguuggguaaaucaauuuuacacacuugcccccauggguaauggcacaggucgaagaagaguauaa

SEQ ID NO: 33541 - RNA, 1620 nt, Artificial Sequence
  derived and/or modified sequence opt6 from VP1__Norovirus_and/or_Norovirus-like__KF378731
augaaaauggccucaucagacgcaaacccaagugacggcucagcagcuaaucuuguaccagaaguaaauaacgaaguuauggcacuagaaccuguaguaggagccgcaauagcugcaccagucgcuggacaacaaaacgucauagauccauggauacguaauaacuucguacaagcaccugguggagaauuuacagucuccccaagaaaugcaccaggugaaauucuauggucugcaccucuaggaccugaucuaaauccauaccuaucucacuuagccagaauguacaacggauaugcaggagguuuugaaguccaaguaauauuagcaggaaaugcauuugcagcaggaaaaauaauauucgcagcuguuccuccaaauuuucccacagaaggacuauccccaagucaaguuacaauguucccacacauaauaguagacguacgacaacuagaaccagucuuaauaccauuaccagacguaagaaacaacuucuaucacuauaaccaaucaaacgacucaacaauaaaacuuauagcaauguuauauacaccacuucgcgcaaacaaugcaggagacgauguauucacaguuuccuguagaguacuaacacgcccaucaccagauuuugacuucauauuucuagucccaccaaccguugaaucuagaacaaaaccuuucuccguacccguauuaacaguagaagaaaugacaaacucucgauuuccaauaccacuagagaaacuauuuacagguccauccucugcauucguuguacaaccacaaaauggucgaugcacaaccgacggaguauuacuaggaacaacacaacuauccccaguaaacauauguacacuuaggggagacguaacacauauaacuggaaguagaaauuacacaaugaauuuagcaucacaaaacuggaauaacuacgaucccacugaagaaauaccagcaccauuaggaacuccagauuuuguaggaaaaauacaaggaaugcuuacacaaaccacuaggaccgacgguagcacaagagguuacaaagcaacaguauacacuggaucugcagauuucgcacccaaauuaggccgaguacaauucgaaacagauacagaccacgauuuugaagcaaaccaaaacaccaaauucacaccuguuggaguaauucaagauggaucuacaacacauagaaacgaaccccaacaauggguccuuccuucauauagcggaagaaauacccauaacguacauuuagcaccagcaguagcaccaacauuuccaggcgaacaauuacuauucuuuagaucuacaaugccaggcuguucuggauacccaaauauggaccuagacugccuauuaccacaagaauggguucaauauuucuaucaagaggcagcccccgcacaaucagacgucgcacuacuaagauuuguaaauccagauaccggaagaguauuauuugaauguaaacuacauaaaucaggauauguaacuguagcacacacuggacaacacgacuuaguuaucccuccaaauggauauuuuagauuugauuccuggguuaaucaauuuuacacauuagcuccaaugggaaauggcacaggccgucgaagaguauaa

SEQ ID NO: 33542 - RNA, 1620 nt, Artificial Sequence
  derived and/or modified sequence opt6 from VP1__Norovirus_and/or_Norovirus-like__AB933731
augaaaauggcaucaucagacgcaaaucccuccgauggauccaccgcaaauuuaguuccagaaguaaauaaugaaguaauggcuuuagaaccagucguuggugcagccauugcagcuccaguagccggacaacaaaauguaauagacccuuggauaagaaauaauuucguucaagcaccaggaggagaauucacaguauccccaagaaacgcuccaggagaaauacuauggagcgcucccuuaggaccugauuuaaacccuuacuuaucacaucuagcacgaauguauaacggauaugcaggaggauuugaaguucaaguaauauuagcagguaacgcauuuacagcagguaaaauaauauuugcagcaguaccuccuaauuucccaacagaaggacuuucaccuucucaaguaacuauguucccacacaucaucgucgauguaagacaauuagaacccguuuuaauaccacuuccagacguacgcaauaacuucuaccauuauaaucaaucuaaugauccaacaauaaaacuaauugcaauguuauauacaccacuaagagccaauaaugccggugaugauguauuuacgguuuccugcagaguauuaacccgucccucaccugauuucgauuucauauuccuuguaccuccaacaguugaaucaagaaccaaacccuuuucaguaccaguuuuaacuguagaagaaaugaccaauucuaaaguaucaccaauuccucuaaaaaaacuauucacuggaccaucuucagccuucguuguccaaccccaaaacggaagaugcaccacagacggagucuuacuaggaacaacacaacugagucccguaaauauauguacuuuuagaggugacguuacacauauuccaggaucacgcaauuacacaaugaaccuagcuucacaaaacuggaacaguuacgauccaacagaagaaaucccagcuccauuaggaacacccgauuucguaggaaaaauucaaggaguauuaacacaaacaacaagaacaaauggaucaacaagaggacacaaagcaacuguuuacacaggaucagcagauuuuucaccaaaauuaggaagaguacaauuugcaacagacacagauaacgauuuugaaacaaaccaaaacaccaaauucacacccguaggaguaauacaagacggaucuacuaccccaagaaaugaaccacaacaauggguucuaccauccuacucuggacguaacauacauaacguacaccuugcaccagcaguugccccuacauuuccaggcgaacaacuauuauucuuuagauccacaaugccaggauguuccggauauccaaauauggauuuagauugucuacuaccacaagaauggguucaauacuucuaucaagaagccgcacccgcacaaucugauguagcacuauuaagauucguuaacccagacacaggaagaguacuauuugaauguaaauuacacaaauccggcuauguaacaguagcucacacaggacaacaugacuuaguaauaccaccuaaugguuauuuccguuucgauuccuggguaaaucaauuuuauacacuagccccaaugggaaaugguacagguagaagacgauaa

SEQ ID NO: 33543 - RNA, 1620 nt, Artificial Sequence
  derived and/or modified sequence opt6 from VP1__Norovirus_and/or_Norovirus-like__AB933749
augaaaauggcaucaaaugacguaaauccaucagauggaucaacagccaauuuaguuccagaagucaacaacgaaguuauggcacuagaaccaguuguaggagcagcaauagcagcaccaguagcaggacaacaaaauguaauagauccuuggauaagaaacaauuucguacaagcaccuggaggagaauuuacuguuaguccaagaaacgcaccaggagaaauuuuauggucagcaccacucggaccugauuuaaauccuuaucuaagucaccucgcaagaauguacaacggauaugcugguggauucgaaguucaaguaauacuagcagguaaugcauucacugcaguaguaagaauaauauucucagcaguaccuccaaauuuccccacagaaggucuaucaccaucccaaguaacuauguucccucacauaaucguugacguacgccaacuagaaccaguacugauaccauuacccgauguaagaaacaauuucuaucauuauaaucaauccaaugacagcacgauaaaauuaauagcaauguuauacacaccuuuacgagcuaauaacgcuggugacgauguauuuacaguaucaugcagaguucucacaagaccaucaccagauuucgauuuuaucuuuuuaguuccaccaaccgucgaaucacgaaccaaaccauucucuguaccuguauuaacuguagaagaaaugacaaacucacgauuuccaauucccuuagaaaaacuauucacaggaccaucaagcgcauucguaguacaaccacaaaauggaagauguacaacugacgguguauuacucggaacaacacaacuaucaccugucaauaucuguacuuucagaggagacguaacucacauaucuggcuccagaaauuacacaaugaaucuagcaucgcaaaacuggaacucauaugauccaacugaagaaaucccugcaccauuaggaacaccagauuuuguuggaaaaauacaaggaguccuaacucaaacaacaagaacaaauggaucuacuagaggacauaaagcaacaguauauacaggaucggcagauuucucaccaaaacuaggucgaguacaauuugcuacugacacagauaaugauuuugaaacaaaucaaaauacaaaauuuacaccuguuggcguaauacaagacggaucaacaacaccacgaaaugaaccucaacaauggguacuaccauccuauucuggcagaaauauacacaauguucacuuagccccugcaguagcaccaacauuuccaggagaacaauuacuauucuuucgaucgacaaugcccggaugcucaggauacccuaauauggaccuagauuguuuauuaccacaagaauggguacaauacuucuaucaagaagcagcaccagcucaaucagacguagcccuauuaagauuuguaaauccugacacaggccguguuuuauucgaauguaaacuacauaaaucuggauauguaaccguugcacauaccggacaacaugaucuaguaauacccccaaauggauauuucagauucgauagcuggguuaaucaauuuuacacuuuagcacccaugggaaauggcacuggaagacgaagauaa

SEQ ID NO: 33544 - RNA, 1620 nt, Artificial Sequence
  derived and/or modified sequence opt6 from VP1__Norovirus_and/or_Norovirus-like__KC517370
augaaaauggcaucaucagaugcaaauccauccgaugguucagcagccaaccuaguaccugaaguuaacaaugaaguaauggcacuugaaccaguaguuggagcagcuauagcagcaccuguugccggacaacaaaauguaauagaccccuggauaagaaauaacuuuguacaagcaccuggaggagaauuuacuguaucaccaagaaaugcaccuggagaaauacucuggucagcaccacuaggaccagaucuaaauccauacuuaucucaucuagcuagaauguauaacgguuaugcuggagguuucgaaguucaagucauucuggcuggaaacgcauuuacagcaggaaaaguaauauuugcagcaguaccuucuaacuuuccaacugaaggucuauccccuucacaagugacaauguuuccacauauaauaguagauguaagacaacuagaaccaguauuaauaccacuaccagaugucagaaauaauuuuuaucacuauaaucaaucaaaugauucuacaaucaaauuaauagcaauguuauauacacuauuaagagcaaauaaugcaggagaugauguauuuaccguaucauguagagucuuaacccgaccaucaccugauuucgacuuuauauuucuaguuccaccaaccguagaaucuagaacaaaaccauucucaguacccguauuaacgguagaagaaaugacuaauuccagauucccaauaccauuagaaaagcuauucacaggaccaucaucagcauucguuguacaaccacaaaacgguagauguacuacagacggaguuuuacuaggaacaacucaacuuucuccaguaaauauauguacauuccgaggagacguuacacauauaacuggaagcagaaauuacacaaugaaucuugcaucacaaaauuggaauaauuaugacccuacagaagaaaucccugcuccacuagguacaccugacuuuguagguaaaauacaaggaauguuaacacaaacaacucguacagacggaucuacaagaggacauaaagcaacaauguauacaggaucagcugauuuugcaccuaaacuaggcagaguacaauuugaaaccgauacagaccacgauuucgaagccaaucaaaauacaaaauucacaccaguagggguaauacaagacggaggaacuacacaucgaaacgaaccacaacaauggguuuuaccaucauauucaggucgaaacacacacaacguucacuuagcuccugcaguagcaccaacauuuccaggagaacaauuacuauucuuucgcccaacaaugccagguugcaguggauauccaaauauggaucuagauagauuauuaccacaagaauggguccaauauuucuaucaagaagcagcuccugcacaauccgacguagcauuacuaagauucgucaauccugauacaggaagagucuuauucgaaugcaaacuccacaaaucagguuacguaacaguagcacacacuggacaacacgaucuugucauaccaccaaacggauacuuuagauuugauucauggguaaaccaauuuuauacuuuagcaccuaugggcaauggaacuggaagacgacgaguauaa

SEQ ID NO: 33545 - RNA, 1620 nt, Artificial Sequence
  derived and/or modified sequence opt6 from VP1__Norovirus_and/or_Norovirus-like__EF547396
augaugauggcuucaaaagaugcaccuacaaacauggacggaaccuccggugcuggacaauuagucccagaagcuaacaccgcugaaccaauaucaauggacccagucgcaggugcagccacugcaguagcaacagccggacaaauaaauaugauagauccauggauaauguccaacuucguccaagcuccacaaggagaauucacaguauccccaaacaauacuccaggugacgucuuauuugaccuacaauuaggaccacaacuaaaccccuuccuagcacaucuugcacaaauguacaacggaugggucgguaacaugcgaguaaaaguauuauuagcaggaaacgcuuuuaccgcaggaaaaauaauaauaucaugcauaccacccggauuuacuucacaaaacauaucuauagcacaaaugaccauguuuccucacguaauugcagacguaagaguauuagaaccuauagaaguuccccuugaagauguucgaaauguuuuauuucacacaaaugauaacagaccaacuaugagacuaguauguauguuauauacuccauuaagagcaaacggaucaucaucugguaccgauccauucguaaucgcuggaaggguauuaacauguccagauucuaacuucucuuuucuauuucucguaccucccaauguugaacaaaaaaccagaccauuuucaguaccuaauauaccccuuaacacccuauccaauuccagaguaccaucuuuaauaaaaaguaugaccauauccagagaccaaaaccaaauaauucaauuucaaaacggaagagucacauuagauggccaauuacaaggaacaacaccaaccucgguuucacaacucuguaaaauacgaggaaccacuuaccacgcuacuggaggaaacggaauuaaucuuacagaacucaacggugaacccuaucaugcauuugaaucuccagcaccaaucggauuccccgaucuagguggaugugacuggcauuuaacagcuacaccaacucaagcuuucaacgacggagcaaaaguaguaagauuauccguaacucaaggugcagcuuuugccccacaucuagguacaauacacuauacaacuacagauacagacuauucaccaaauacuucaauaauauguacauuagauuggcuaucacaaacaacaggacaaagcaauguagaucccuggcaaauaccgacauauggcuccacucuaaccgaagcagcacaacuugcuccaccaauauuuccaccuggauucggagaaacacuuguuuucuuuuuaagugauuuucccauaucuaauggcaaaaacggacuaucagucccauguacacuaccccaagaauuugucacccacuuuguuaaugaacaagcuccaauaagaggagaagcagcgcuacuccacuacguugaccccgacacucacagaaauuuaggugaauucaaacuauacccagaagguuuuaugacuugugucccuaacacuucaggaggaggaccccaaacacuaccuauaaacggaguauuuguauuuguaucauggguaucaagauuuuaucaauuaaaaccaguaggaacagcuggagcugcuagaagacuauaa

SEQ ID NO: 33546 - RNA, 1620 nt, Artificial Sequence
  derived and/or modified sequence opt6 from VP1__Norovirus_and/or_Norovirus-like__JN699047
augaugauggccucaaaagacgcaccaacaaauauggauggcacaucaggugcaggacaauuaguaccagaagcuaauacugcagaacccauaucaauggacccagucgcuggugccgcaacagcaguagcaaccgcaggacaaauaaacaugauugacccauggaucaugucuaacuuuguccaagcuccacaaggagaauucacuguaaguccgaauaacacaccaggagacguauuauuugaccuacaauuaggcccacaauuaaacccauuuuuagcacaucuagcacaaauguacaacgguugggucgguaacaugagaguaaaaguucuacuagcaggaaacgccuucacagcagguaaaaucauaauaucuugcaucccaccagguuucacaucacaaaauaucucaauagcucaaaugaccauguuuccccaugucauagcagauguucguguacuugagccaauugaaauacccuuagaagauguaagaaauguucuauuucacaccaacgauaacagaccaacaaugagauuaguaugcauguuauacacaccacuuagagcaaacggaucaucaucuggaacagauccauucguaauagccgguagaguauuaacaugcccagacuccaauuucucuuuccucuuucuaguaccacccaaugucgaacaaaaaacaagaccauuuucagucccaaacauaccacuaaauacccuaucuaacuccagaguaccauccuuaauaaaaucaaugaccauaucacgagaucaaaaucaaauaauacaauuccaaaauggccgaguuacauuagacggacaauuacaaggaacaacaccaacuucagucucucaacucuguaaaauccgaggcaccacauaucaugccaccggaggaaauggcauaaaccucacagagcuaaacggcgaaccauaucaugcauucgaaucaccagccccaauaggauucccagacuuaggaggcugcgacuggcaccuaacagccacaccaacacaagcguucaacgauggagcuaaaguaguaagauuaucuguaacucaaggagcugcuuucgcaccccacuuagguacaauucauuauacaacaacagaucacgacuacgauccuaauacauccauaauauguacacuagauugguuaucacaaaccacuggacaaaacaacguagauccauggcaaauaccaacauacggaucaacauuaacagaagcugcccaacuagcuccaccaauauucccaccaggauucggagaaacacuaguauucuuucuauccgauuuucccaucucuaacgguaaaaacggcuuaucuguuccauguacauuaccacaagaauucguaacccacuucguaaaugaacaagcaccaauccguggagaagcagcucuacuacacuacguagauccagauacucauagaaacuuaggagaauucaaauuauauccagaagguuuuaugacaugcguaccaaacacuucaggaggaggaccacaaacucuuccuauuaacggcguauuuguauucgucucauggguaucacguuucuaccaacuuaaaccagucggcacagcaggugcugcaagacgacucuaa

SEQ ID NO: 33547 - RNA, 1620 nt, Artificial Sequence
  derived and/or modified sequence opt6 from VP1__Norovirus_and/or_Norovirus-like__KT781411
augaugauggccuccaaagacgcaccaacaaacauggauggaacaucuggugcaggacaacuaguaccagaagcuaacacugcagaaccuauuucuauggaaccuguagcaggagccgccacagcagccgcaacagccggccaaguaaauaugauagacccuuggauuaugaacaauuacguucaagcuccucaaggagaauucacuauuucuccaaauaacaccccaggugacauauuguuugacuuacaacuaggcccacaucuaaauccauuucucucucauuuagcacaaauguacaacggauggguaggaaauaugaaaguaaaagucuuacuagcaggcaacgccuucacagcagguaaaauaauaauuucaugcauaccaccaggcuucgcaucacaaaauauaucaauagcacaagcaacaauguuuccccauguuauugcagauguacgaguuuuagaaccaauagagguaccacucgaagauguaagaaacguauuguuucauaacaaugauaacucaccaacaaugagacuaguauguaugcuauacaccccauuaagagcaucaggaucuucuucugguacagacccuuucguaauagcaggaagaguacuaacauguccaucaccagacuuuuccuuccuauuuuuaguaccccccaauguugaacaaaaaacaaaaccauucucuguuccaaaucuaccauuaaauacauuaucaaauucacgagucccaucacuaauuaaugcuaugaugauaucaagagaccauggacaaaugguucaauuucaaaacggaagaguaacccuugauggacaacuucaaggaacaaccccuacaucauuaagucaauuauguaaaauaagaggaaaaguauuccuagcaucaggaggaaauggauuaaauuuaacagaauuagacggaucagcauaucaugcuuuugaauccccugcaccuaucgguuuuccagauauaggagacugugauuggcacaugaacgcaacagcuacaaguaauuuuaccggaucaaaugacgaacaucaaauauuaguaaaacaagaaucaacauuugcaccacauuuaggccaugugcaagcagaucauuuaccagaaguagcuaauacagaccuaaugguuucuuuauccuggauuucuccaguaucagaucaacauagaagagacguugauccauggguaauaccacguuacgguucaacacuaacagaagcugcacaauuagccccaccuauauauccgccuggauucggagaagcaauaguauucuucaugucagauuuuccuguuguauccggaguaaauggaaugagaauaccauguacauuaccacaagaauauguugcacauuuuguaaaugaacaagccccaacacgaggugaagcagcauuauuacauuauguagaucccgauacacaucgaaacuuaggagaauuuaaaauauauccugaaggauuuaugacaugugucccaaacaguucggguacuggaccccaaacauuaccaauaaacggaguuuuuacauucguuucuuggguaucaagauuuuaucaacuaaaaccuguaggaacugcaggaccagcuagaagauuauaa

SEQ ID NO: 33548 - RNA, 1620 nt, Artificial Sequence
  derived and/or modified sequence opt6 from VP1__Norovirus_and/or_Norovirus-like__U04469
augaugauggcaucaaaagaugcaccaacaaacauggauggcacuaguggagcaggucaauuaguuccagaagcaaauacugccgaaccaauuucaauggaaccaguagcuggagcagcaacagccgcagcaacagcuggacaaguaaacaugauagacccauggauaaugucaaauuauguacaagccccccaaggagaauucaccauuucaccaaauaauacaccaggugauauucuauuugaccuacaacuuggaccacacuuaaacccauuuuuaagucauuuagcacaaauguauaacggauggguagguaacaugagaguuaaaguauuauuagccgguaaugcauucaccgccgguaaaauaauaauuucauguauaccacccgguuuugccgcacaaaauauaucuauagcacaagcaacaauguucccucauguaauagccgacguaagaguacucgaaccaaucgaaguaccauuagaagauguaaggaauguauuauuccauaauaacgacucaucaccaaccaugaggcucgucuguaugcuauacacaccacuaagagcaucagguucaucaucaggaacagacccauuuguuauagcaggaagagucuuaacauguccuucaccagacuuuucauuucuauuuuuaguaccacccaauguagaacaaaaaacaaaaccauuuucagucccaaaucuaccauuaaauacacuaucaaauucaagaguccccucucuaauaaacgccaugaugauaucaagagaucauggacaaaugguacaauuucaaaauggacguguuacacuagacggacaauuacaaggaacaacaccaacaucacucucacaacucuguaaaauaagaggcaaaguauuucaugcauccggagguaauggacuuaaccuaacagaauuagauggaucagcauaucaugcuuucgaaaguccagcaccuaucggauuuccugacauaggugacugugauuggcauaugucugcaacagcaacaaacaacuuuacuggaucaucaaacgaauaucaaauucuuauaaaacaagaaucagcauucgccccucauuuaggacauguccaagcagacaacuuaagcgcuggagcuaauacagaccuaauaguaucacuauccuggauaucaccagucuccgaucaacauagacaugauguagauccauggguuauaccacgauauggaucaucuuuaaccgaagcagcacaauuagcuccaccaauuuauccuccaggauucggagaagcgauaguauuuuuuaugucagacuucccaguaguaucaggaguaaaugguaugaggauaccaugcacacuaccacaagaauacguagcacauuucguuaaugaacaagcaccaacacgaggagaagcagcccuuuuacauuauguagauccagacacacaucgaaaucucggagaauuuaaaauguauccagaaggauuuaugacauguguaccuaauucaucaggaucaggcccacaaacuuuaccaauuaacgguguauuuacauucguaucauggguaucacgauucuaccaauuaaaacccguagguaccgcaggcccagccagacguuuauaa

SEQ ID NO: 33549 - RNA, 1620 nt, Artificial Sequence
  derived and/or modified sequence opt6 from VP1__Norovirus_and/or_Norovirus-like__JN699049
augaugauggcuucuaaagacgccccuacuaacauggauggaacaucaggugcaggucaacucguuccagaagccaacacagcagaaccaauuucaauggaaccaguagcaggagccgccacggcagcagcuacugcaggacaagucaauaugauagaccccuggauaaugaacaauuauguacaagcaccacaaggagaauuuacaauaucaccuaacaauaccccuggagauauauuauucgacuuacaacuaggaccucaccuaaacccauuucuaucacaucucgcccaaauguacaacggauggguuggaaauaugaaaguaaaaguccuauuagcagguaaugcauuuacagcaggaaaaauaauaauauccuguauaccaccuggauuugcaucacaaaacauaucuauagcacaagcaacaauguucccucacguaauagcagauguaagaguacuagaaccaauagaagucccacuagaagauguacgaaacguacuauuucacaauaaugauaacacaccaacaaugagacuaguauguaugcucuauacaccacuacgagcuucaggaucuucuucaggaaccgauccauuuguaauagcaggaagaguacuaacaugcccaucaccagauuuuucauucuuauuccuaguaccacccaauguugaacaaaaaacuaaaccauuuuccguaccuaaucucccauuaaacguacucucaaauucacgcguuccaucauuaauaaaauucaugaugguaagucaagaccauggucaaaugguacaauuucaaaacggacgaguaacauuggaugggcaacuacaaggaacaacaccaacaucagcaagucaauuauguaaaaugagaggaacaguauaccaugcaucagguggucaaggcuuaaaccugacagaaauugauggaacuccauaucaugccuucgaaucaccagcaccaauagguuuuccagacuuaggagauuccgauuggcauauaaacgcaucaccagcaacuaccuuuaacacaggugaaucaguaaaacguuuagacauggaacaaggauccucauuugcuccccaccuaggaacaguacauuauaccaacgcugauuaugaugcaaauacagaucuaaucugcagucuagaauggcuaucaccaccaucaggcgguacaccaaacaaaguaaacccaugggccauaccacguuacggaucaacacuuacugaagcagcacaacuagcaccaccaauuuauccuccaggauuuggagaagcaauaguauucuucaugucugacuuucccauugcaaauggucaagauggucuaaaaguucccuguacaauaccucaagaauucguaacacacuuugucaacgaacaagcuccuacuagaggugaagcagcacuucuucauuacguagauccagauacucauagaaacuuaggagaauucaaacuuuauccugaaggauuuaugacauguguaccaaauucaucaggcaguggaccacaaacauuaccaauaaauggcguauucaccuuuguaagcuggguuucuagauucuaucaacuuaaaccuguaggaaccacaggacccguaagaagauuauaa

SEQ ID NO: 33550 - RNA, 1620 nt, Artificial Sequence
  derived and/or modified sequence opt6 from VP1__Norovirus_and/or_Norovirus-like__GQ856473
augaugauggcaucuaaagaugccccaacaaacauggauggaacaagcggugcaggacaauuaguaccagaagcaaauacugcagaaccaaucucaauggaaccaguagcaggagcagcaacagccgcugcaacagcaggacaaguuaauaugauugaucccuggauuaugaauaauuauguccaagcaccacaaggagaauuuacaauaucuccaaauaauaccccaggagauauuuuauucgauuuacaauuaggaccccacuuaaauccuuuuuuaucucaucuagcucaaauguacaauggaugggugggcaauaugaaaguaaaaguauuacucgcaggcaaugcauucacagcaggaaaaauaauuauuucauguauuccaccuggauuugcagcacaaaacauaagcauagcacaagcuacuauguuuccacauguaauagcagauguaagaguacuugaaccaauugaaguuccacucgaagauguaagaaauguauuauuccacaacaaugauaacucaccaacaaugagauuaguuuguauguuauauacaccacuacgugcaucgggaucuucaucuggcacagauccauucgucauagcaggcagaguucuuacaugucccucuccagauuuuucuuuucuuuuuuuaguuccaccaaacguagaacaaaaaacaaaaccuuucucaguaccaaaucuaccacuuaauacauuaucaaacucgagaguaccuuccuuaauaaaugcaaugaugauaucaagagaucauggacaaaugguacaauuccaaaauggaagagucacuuuagauggacaacuacaaggaacuacuccuacaucauuaucucaauuaugcaaaauaagagguaaaguauuccaugcaucuggaggaaaugguuugaauuuaacagaacuagauggcucugcauaccacgcauuugaaagccccgcaccaauagguuucccagauauaggugaaugcgauuggcacaugaaugccacagccacaucuaauuuuacaggaucaaacgaugaauaucaaauacuaguuaaacaagaaucaacauuugcaccucacuuaggacacguucaagcagauucuuuaucagcagaugcaaauacagaucuaaugguaucacuuagcuggauuuccccaguuucugaucaacacagaagagacguugauccauggguuauaccaagauauggauccucucuuacagaagcugcacaacuagcuccacccaucuacccuccuggauucggugaagcaauaguauuuuuuaugucagauuuuccaguaguaagcgguguaaauggaaugcgaauuccauguacauuaccucaagaauauguagcacauuuuguaaaugaacaagcaccuacaagaggagaagcagcauuauuacauuauguugauccagauacacauagaaauuuaggcgaauuuaaaauguauccagaaggauuuaugaccugugucccaaauuccucuggaucagguccacaaacacuuccuauaaauggaguauuaacuuuuguaucauggguaucaagauuuuaccaacuaaaaccaguaggcacagcaggaccagcucgacguuuauaa

SEQ ID NO: 33551 - RNA, 1620 nt, Artificial Sequence
  derived and/or modified sequence opt6 from VP1__Norovirus_and/or_Norovirus-like__JN699050
augaugauggcuaguaaagaugccccaacaaauauggacggaacuucuggugcaggacaacuaguaccagaagccaauacagcagaaccaauaucaauggaaccaguugcaggagcagcaacugcugcagcaacagcaggacaaguaaacaugauagauccauggauuaugaauaacuauguucaagccccacaaggagaauuuacuauaucaccaaacaauacaccaggagacauauuauuugacuuacaauuagggccacaccuaaauccauuuuuaucacacuuagcacaaauguauaauggauggguaggaaauaugaaaguaaaaguuuuacuagcgggaaaugcauuuacagccggcaaaauaauuaucucguguauucccccaggauuugccucccaaaauauaucuauagcacaagcaacaauguucccucacgucauugcagacguacgaguacuagaaccaauugaaguaccuuuagaagacguacguaacguauuauuccacaauaacgacaauacaccuacaaugagguuaguaugcauguuauacacaccacuaagagcaucaggaagcucaucuggaacagacccauucgucaucgcaggaagaguucuaaccugucccucaccagauuuuucuuucuuauuucuuguaccacccaauguugaacaaaaaacaaaaccauuuucaguaccaaauuuaccuuuaaauguacuuucaaauucaagaguaccaaguuuaauaaaaucaaugauggucucccaagaccauggacaaaugguacaauuucaaaacggacgagugacacuagauggccaacuacaagguacaaccccaacuucagcaucucaauuauguaaaaugagaggaacaguauaucacgcaucuggaggacaaggacuaaacuuaacagaaauugacggaacaccauaucaugcauucgaaucaccagcaccaauugguuuuccagacaucggagauuccgauuggcauaucaaugcauccccagcuacaacauucgauucaggagaaucaauaaaaagauuagauauggaacaagguucuucauuugcaccacaccucggaaccguccauuacacaaacgcagacuaucccgcaaacacagaccuaauauguucacuugaaugguuaucaccacccucaggagguacaccaaauaaaguaaauccuuggacaauaccuagauauggauccacccuaacagaagcagcccaacuagccccacccauauacccuccaggauuuggugaagcaauaguuuucuuuaugucagauuuuccaauagcaaauggacaagacggauuaaaaguuccuugcaccauaccacaagaauuugucacacacuucguaaacgaacaagcuccaacuagaggcgaagcugcacuacuucauuauguagauccagacacacacaggaacuuaggcgaauucaaacucuauccagaagguuucaugacaugcguaccaaauagcuccggaucaggaccacaaacacuaccaaucaaugguguauuuacauucguauccuggguaucacgauucuaucaauuaaaaccgguuggaacaaccggaccaguacgaagauuauaa

SEQ ID NO: 33552 - RNA, 1620 nt, Artificial Sequence
  derived and/or modified sequence opt6 from VP1__Norovirus_and/or_Norovirus-like__GQ856472
augaugauggcaucaaaagacgcaccuacaaauauggacggaacuagcggagcuggacaauuaguaccagaagcaaauacugcagaacccaucucaauggacccaguagcuggugcagcaacagcaguagccaccgcaggacaaauaaacaugauagauccauggauaaugucaaauuuuguccaagccccacaaggagaauuuacugucucuccaaauaacacaccaggugauguacuauuugaccuacaacuaggaccacaauuaaacccauuuuuagcacacuuagcacagauguacaacggaugggucgguaauaugagaguaaaaguacucuuagcaggaaacgcauucaccgcagguaaaauuauaauaucuuguauaccaccaggcuucaccucacaaaauauaucaauagcacaaaugacuauguuuccacacguaauagcagacguacgaguauuagaaccaauagaaaucccauuagaagacguaagaaauguauuauuccacacaaaugacaaccgcccaaccaugagauuaguauguaugcuauacacaccacuacgagcaaauggaucaucaaguggaacagacccuuucguaauagcaggacgugucuuaacauguccagauucaaacuucucauuuuuauuccuaguaccucccaacguugaacagaaaacucgacccuuuucaguaccaaacauuccacuaaacacacucucuaacucacgaguuccaucauuaaucaaaucaaugacuaucucaagagaucaaaaccaaauaauacaauuucaaaacggcagaguaacauuagauggacaauuacaagguacaacaccaacaucaguaucacaacuauguaaaauacgaggcacaacuuaccacgcaacaggcggaucaggaauaaacuuaacagaacuaaacggcgaaccauaucaugcauucgaaucaccagcacccauaggcuucccagacuuagguggaugcgauuggcaccuaacggccacaccaacacaagcauucaaugacggugcaaaaguaguaagacuaucaguaacacaaggagcugcauuugcaccacaccuaggcacaauacauuauaccacaacagauacagacuauaauccaaauacaucuauaaucugcacuuuagauugguuaucacaaacaacuggacaaucaaacguagauccauggcaaaucccaacuuauggcucagcauuaacagaagcagcucaacucgcaccacccauuuuuccuccagguuuuggagaaacccuaguauucuuucuuucagacuuuccuauaagcaauggcaaaaauggauuaucagucccauguacacuaccucaagaauuuguaacacacuucguaaaugaacaagcaccaauacgcggagaagccgcauuacuccauuauguagacccagauacucacagaaaucuaggagaauuuaaacuauaccccgagggauuuaugacuuguguuccuaacaccucaggaggaggaccacaaacauuaccuauaaauggagucuucguauuuguaucaugggucagucguuuuuaucaacucaaaccuguagguacugcuggagcagcaagaagacucuaa

SEQ ID NO: 33553 - RNA, 1620 nt, Artificial Sequence
  derived and/or modified sequence opt6 from VP1__Norovirus_and/or_Norovirus-like__GQ856471
augaugauggcaaguaaagacgcaccaacaaacauggacggcacuucaggagccggccaauuaguucccgaagcaaauacagcugaaccaauuucaauggaccccguagcaggagcagcaacagcaguagcaacugcaggccaaauaaacaugauugauccauggauaaugucaaacuuuguacaagcaccacaaggagaauuuacaguaucaccaaacaacacaccaggagauguuuuauucgaucuacaacuagguccacaacuaaaucccuuucuagcucauuuagcacaaauguauaacggauggguuggaaauaugagaguuaaagucuuacuagcaggaaacgcauuuacagcugguaaaauaaucauaucaugcauaccaccaggauuuacaucucaaaauauaucaauagcacaaaugaccauguucccccacgucauagcagauguacguguacuagaacccauagaaauuccucuagaagacguuagaaacguauuauuccacacaaacgacaaccgcccaacaaugcgucuaguauguaugcuuuauacuccauuacgagcaaauggcuccaguucuggaacugacccauucguaauagcaggacgagucuuaacuugucccgauuccaauuuuaguuuccuauuucuagucccuccaaauguagaacaaaagacacgaccauucagcguacccaauauacccuuaaauacacuaaguaauucccgaguaccaucacuaauaaaaagcaugacaauauccagagaccaaaaucaaauaauacaauuccaaaacggaagaguaacacuagacggacaauuacaaggaacaacccccacaucuguaucccaacuaugcaaaauaagaggcacaacguaucaugcuacaggcggauccggaauaaauuuaacagaauuaaacggagaaccauaucacgcauucgaaucaccagcaccuauaggauucccagacuuaggaggaugugauuggcacuuaaccgccacaccaacacaagcauucaaugacggugcaaaaguaguuagauuaucuguaacacaaggcgcugccuuugccccucaccuugguacuauccauuacacaaccacugacacagacuauaaucccaacacgucaauaauaugcacauuggacuggcuaagucaaacaaccggacaauccaacguugacccuuggcaaauccccacauaugggucaacauuaacagaagccgcacaauuagccccaccaauauuuccaccagguuucggagaaacucuaguauucuuuuuaucagacuucccaauuucaaauggcaaaaacggacucuccguaccuugcacacuuccacaagaauuuguaacacauuucguaaacgaacaagcaccaauacgaggagaagcagcacuacuccauuacgcugaccccgauacacacagaaacuuaggagaauuuaaacucuauccagaaggauucaugacuugcguccccaauacaucuggaggaggaccucaaacacuaccaauaaacggaguauucguauuuguaucauggguaucuagauucuaccaacuaaaaccaguuggaacagcuggugcagcuagaagauuauaa

SEQ ID NO: 33554 - RNA, 1620 nt, Artificial Sequence
  derived and/or modified sequence opt6 from VP1__Norovirus_and/or_Norovirus-like__JQ911594
augaugauggcuucaaaagacgccccaacuaacauggauggcacaagcggagccggacaauuaguuccugaagcuaauacagcagaaccuaucuccauggauccaguugcuggagcagcaacagcaguagcuacagcaggucaaauaaauaugauugauccauggauaaugucgaacuuuguacaagcaccccaaggagaauuuacaguuuccccaaauaacaccccaggagauguacuauucgaucuacaacuaggcccccaacuaaaucccuuuuuagcacaccuagcccaaauguauaacggauggguuggcaauaugagaguaaaaguauuauuagccggcaaugccuuuacugcuggaaaaauaauaauaucaugcauaccaccaggauuuacaucacaaaauauaucaauugcacaaaugacaauguuuccacauguaauagcugacguccgcguucuagaaccaauagaaaucccacuagaagauguccguaauguacuauuucacaccaacgauaauagaccaacaaugcgauuaguuuguaugcuauauacaccucuaagagcaaacggcaguucaucaggaacagauccauucgucauagcaggccgaguacuaacauguccagacucgaacuuuucauuuuuauuccuaguacccccaaauguagaacagaaaacaagaccauucuccguaccaaacauaccacuaaauaccuuaucaaacucaagaguaccaucauuaaucaaaucaaugacaauuaguagagaucaaaaucaaauaauacaauuucaaaauggacgaguaacucucgauggucaauuacaaggaacuacaccuacaucaguaucacaauuaugcaaaauaagaggaacuacauaucacgccaccgguggcaauggaauaaauuuaaccgaacuuaauggagaacccuaucacgcauuugaauccccagcuccuauagguuuuccugacuuaggaggcugugauuggcaucuaacagcaacaccaacacaagcauuuaaugauggagcaaaaguaguacgauuaucaguaacacaaggugcagcauuugccccucaucuaggaacaauccauuauacaacaacugacaccgacuauaaucccaacacuucuauaauauguacccuugauuggcuaucacaaacagcaggucaaucaaacguagacccauggcaaauuccuacauaugguucaacauuaacagaagcagcccaacuagcaccucccaucuucccaccuggauuuggagaaacucuaguuuucuuccuaucagacuuccccauaaguaauggcaaaaauggauuaucuguuccuugcacauuaccacaagaauuuguuacacauuuuguaaacgaacaagcucccaucagaggagaagcugcacuucuacauuacguagacccagacacacaucgaaaccuaggagaguucaaauuauauccagaaggauuuaugacauguguuccaaacacaaguggaggaggaccccaaacccuacccauaaacggaguauuuguauucguaucauggguaucacgauucuaccaauuaaaaccaguaggaacagcaggagcagcuagacgauuauaa

SEQ ID NO: 33555 - RNA, 1620 nt, Artificial Sequence
  derived and/or modified sequence opt6 from VP1__Norovirus_and/or_Norovirus-like__GU296356
augaugauggcuucaaaagaugcuacaagcaauauggauggaacaagcggugcaggacaauuaguaccugaaaacaauaauacaucugaaccaauaaacauggaaccaguagcaggagcuguaacagccgccgcaacagccggacaagucaauaugauagaccccuggauaaugaauaauuauguacaagcaccucaaggagaauuuacaauaucaccaaauaacacuccaggcgauauauuauucgacuuacaacuuggaccacauuuaaauccuuuucuagcacaucuaucacaaauguacaacggauggguaggaaauaugaaaguacgaguaguuuuagcaggaaacgcauuuuccgcaggaaaaauuauagucugcuguauaccaccaggauuuucugcaccaaauauaucaauagcacaagcaacaauguuuccccauguaauugcagauguuagaguuuuagaaccaauagacauaccacuugacgauguacguaauguccucuuccauacaaaugacaacggaaaucaaacaaugcgauuauuauguaugcuauacaccccacuacgaagcggaggaacaucuagcggaacagacccauuuguaauugcaggacggguauuaacaugcccaacaccagauuucaacuuuuuauucuuaguacccccaaccguagaacaaaagacuaaacaauuuucaguaccaaauuuaccccuuaauguuaugucaaauagucgaguccccucacuccuaaaugcgaugguaguaucaccagaccaagcacaaguaguucaauuccaaaauggucgauguacauuagacggacaaaugcuaggaacaacaacaguauccgcaucaugcguagcaagauuuagaggaaaaacuuuucaagccccagaugacagauuaggaauaaaucuagcugaaaucucaggagaaccuuaccacgccuuugaaucuccugcaccauuaggauucccagacuuuggugauggagacuggcauguaacagcaacuaaaguagcaccuucacaauuagaagcaaacgauccaguaguaguaggaaauguacaacccuauaauccacaauuugcaccccaucuagguacauuagucgucgaaaauccaacaccaaaucaaguagcaacuggaacagacuuauuauuuaauauuacaugguuaucaaauagagcaaacaaucgauucaaucccuggauaauacccaauuacggauccacauuaacagaagcagcucaacuagcccccucaauauuucccccugguuucggugaaacaauaguauacuuuaauuccacauucccugcaguaggagcaacuacacacgcagcaauaccaugucuauuaccacaagaauuuguugcacacuucguuaaugaacaagcuccaauaagaggcgaagcagcacuacuacauuauauagacccagauacacauagaaauuuaggagaauuuaaaauauauccugaaggauucguaacaugcguaccaaacguugguggaacaggaccacagagcuuaccaacaaacggcauuuuugucuucguuucauggguuaguagauauuaucaacucaaaccuguaggaaccgcauaa

SEQ ID NO: 33556 - RNA, 1620 nt, Artificial Sequence
  derived and/or modified sequence opt6 from VP1__Norovirus_and/or_Norovirus-like__KM461693
augaaaauggcaucuaaugaugccgcuccaucaaaugacggggccgcaaacuuaguaccagaagcaaacaacgaaguaauggcauuagaaccaguuguaggugcaucaaucgcagcuccugucguuggucaacaaaauauaauagacccauggauaagagaaaacuuuguacaagcaccacaaggcgaauuuacagucucucccagaaauuccccaggagaaaugcuacuaaaccucgaacucggaccagaauuaaauccauaucuuucacacuuaucaagaauguauaacggauacgcaggagguaugcaaguccaaguagucuuagcaggaaacgcauuuacugcagguaaaauaauauuugcagcaguacccccacauuuuccaguagacaacaucucagcagcacaaauaacuauguguccacaugucauagucgauguacgccaacucgaaccaguucuccuuccauuaccagacauccgaaacagauucuuucauuauaaucaagaagacaccccaagaaugaggcuaguagcaauguuauacacaccacuccgagcaaauucaggagaagauguuuucaccguuucaugccgaguacuaacaagaccugcacccgauuuugaauuuacauucuuaguaccaccaacaguagaaagcaaaacaaaaccauucacacucccuauacuaacauuaggagaacuaagcaacuccagauucccagcagcaauagauaugcuauacacagacccaaacgaaucaauaguaguacaaccacaaaacggaagaugcacauuagacgguacauuacaaggaacaacgcaauuaguuccaacccaaauuugcgcauucagagguacauuaauaucacaaaaugcaagagcugcagaucuaacagauucuccacaacgagcacguaaucauccacuucauguacaaguuaaaaacuuagacggaacccaauacgaccccacugacgauauaccagcaguauuaggugcaaucgacuucaaaggaaccguauucggagucgcaucucaaagagacguaucaggaacacaagaacaaggacacuaugcaacccgagcacacgaagcacacaucgacacaacugauccaaaauaugcaccuaaacuaggaaccauauuaauuaaaucagaaaguacagauuuuacaacaaaccaaccaauacgauuuaccccaguaggaaugggugauaacaauuggagacaaugggaacuaccugauuacagcggaucacuaacuuuaaauaugaacuuagccccagccguaucuccaucauucccaggagaaagaauauuauucuuccgaucaauaguucccucagcaggaggcuauggcucaggauauaucgacugcuuaauuccacaagaauggguccaacauuuuuaccaagaagccgcaccaucacaaucugcaguagcuuuaguuagauacguaaauccagauacaggaagaaauauuuucgaagcaaaacuccauagagaaggauuucuaacaguagcuaauucaggaaauaauccaauggguguaccacccaauggauacuuuagauuugaagcauggguuaaucaauuuuacacccuagcaccauaa

SEQ ID NO: 33557 - RNA, 1620 nt, Artificial Sequence
  derived and/or modified sequence opt6 from VP1__Norovirus_and/or_Norovirus-like__LC145789
augaaaauggcaucuaacgaugcagcucccucaacagacggugcagccggucuaguuccagaaucaaauaaugaaguaauggcccuugaaccugucgcaggagcagcccuagcagcgccaguaacaggccaaacaaacauaauagauccauggauaagagcaaauuuuguacaagccccaaacggcgaauuuacaguaucaccaagaaacucacccggcgaaguucuauuaaacuuagaauuaggucccgaauuaaacccuuacuuagcacaucuagcaagaauguauaauggauaugcaggaggaauggaaguacaaguuauguuagcaggcaaugcauucaccgcaggcaaacuuguauuugcagcaguuccaccacauuuccccguugaaaacuuaucuccacaacaaauaacaauguucccacacguuaucauagacguuagaacucuggaaccaguacuauuaccacuacccgaugucagaaacaacuucuuucauuauaaucaaaaagaugauccaaaaaugagaauaguagcaauguuauacacaccauuaagaucuaauggaaguggcgaugacguauuuacagucucauguagagucuuaacacgacccucacccgacuuugauuuuaccuaucucguuccucccacaguugaaucuaaaacaaaaccauuuacacucccaauuuuaacucuuggcgaauuaucuaauucacgcuuuccaguaucaaucgaccaaauguacacaucaccaaaugaaguuauuucaguccaaugucaaaauggacguugcacauuagauggcgaauuacaaggaacaacacaauuacaaguaucaggaauuugugcauuuaaaggagaaguaaccgcacaucuucacgacaaugaucauuuauauaauguaacaauaacaaaccuuaauggaucaccuuuugacccuuccgaagacauaccagcacccuuaggaguaccggauuuccaaggaagaguauucggaguaauaucacaacgagacaaacauaauacacccggacauaaugaaccagcaaaucgagcacaugacgcaguagucccaaccuacacagcacaauacacaccuaaacuaggccaaauacaaauuggaacauggcaaacagaugaucuuacagucaaucaaccaguaaaauuuacccccgucggacuaaaugauaccgaucacuucaaccaauggguaguuccacgauacgccggugcacuaaaucuaaacacaaauuuagcaccaucaguagcuccaguauuuccuggcgaaagauuacucuuuuucagaucauauauaccucuaaaaggagguuauggcacacccgccauugacugucuauuaccccaagaauggguacaacacuuuuaccaagaagccgccccaucaaugucugaaguagcauuaguucgauacauaaauccugauacaggucgugcuuuauucgaagcaaaauuacacagagcagguuucaugacaguaaguucaaauacuucagcaccuguaguaguaccagcaaacggauacuucagauucgauucauggguaaaccaauuuuauaguuuagcaccaaugggaacaggaaacggcagacgcuaa

SEQ ID NO: 33558 - RNA, 1617 nt, Artificial Sequence
  derived and/or modified sequence opt6 from VP1__Norovirus_and/or_Norovirus-like__KX171417
augaaaauggccuccaaugacgcagccccaucaaaugacggagccgcaggucuaguacccgaaggaaacaaugaaacucucucacuugaacccguagccggagccgcaauagccgcaccaguaacaggacaaaacaauaucauugauccauggauaagaacaaauuucguucaagccccaaacggagaauuuacaguuuccccaagaaauucaccaggagaaauuuuacuaaaucuagaauuaggaccagaucucaauccauauuuagcacaucuauccaggauguacaacgguuacgcaggaggcguagaaguccagguacuauuagcaggcaaugcuuucaccgcaggaaaaauucuauucgcagcagucccuccaaacuucccaguagaauuucuuucaccagcacaaaucacaauguuaccucaucuaauagucgauguacgaacucuugaaccaauaaugaucccccuaccagacguaagaaauacauucuuccacuacaacaaucaaccaaacucacgaaugagauuaguugccaugcuuuacacaccacuaagaucuaauggauccggagaugauguauuuaccguuagcuguagaguacucacuagaccuacaccagacuuugaauuuacauaccuuguaccaccauccguagaaucaaaaacuaaaccauucagucuaccaauauuaaccuuauccgaauuaacaaauucaagauucccagucccaaucgacucacuguuuacagcucaaaauaacguauuacaaguccaaugccaaaauggaagaugcacauuagacggcgaacuacaaggcacaacacaacuacuaccuuccgguauaugugcauuuagaggaagaguaacagcaaaaacagaccauucagauaaauggcacaugcaauuacaaaauuuaaaugguacuacauacgacccaacagacgacguaccagcaccacuaggaaccccagauuuuaaagguguaguauuuggaguagcaucccaaagaaacgucggaaacgacgccccaggaaguacacgagcacacgaagcaguaaucucuacauacucaccacaauuuguaccaaaacuaggauccguaaauuucagaucaaacgaugaugacuuucaacuacaaccaacaaaauuuacaccaguuuguauaaacgaugacgacgaucacccauuuagacaaugggaacuaccagauuauucaggauuauuaacacuuaacaugaacuuagcgccuccaguagcaccaaauuuuccaggagaacaauuauuauucuuuagaucauucgucccauguaguggaggcuauaaccaaggaauaguagacugucuaaucccccaagaauggauacaacauuuuuaccaagaaagcgcucccucucaaucagaaguagcauuaauaagauacguuaauccagauaccgguagaacacucuucgaagcaaaacuacacagaucuggauauauaacaguugcacacucaggagauuacccauuaguaguaccagcuaacggcuauuucagauuugauaguuggguaaaucaauuuuacagcuuagcuccaaugggaacaggaaauggcagacgcagagcccaauaa

SEQ ID NO: 33559 - RNA, 1617 nt, Artificial Sequence
  derived and/or modified sequence opt6 from VP1__Norovirus_and/or_Norovirus-like__KX171412
augaaaauggcaucaaaugaugcagcaccaucuaacgacggagccgcaggauuaguacccgaagguaauaaugaaacacuaccucucgaaccaguagcaggagcagcaauugcagcacccgucaccggacaaaauaacauaauagacccauggauaagaacaaauuucguacaagcaccaaauggagaauuuacaguaucaccacgaaauuccccaggagaaaucuuacuuaaucucgaauuaggacccgauuuaaauccauaucuagcacaccuaucaagaauguauaacggauaugccgguggcguagaaguucaagucuuacuugcagguaacgcauucaccgcagguaagauacucuucgcagcaguaccaccuaauuucccaguagaauuucuaucaccagcacaaaucaccaugcuaccucacuuaauaguagauguaagaacccuagaaccaaucaugauaccauuaccagacguucgaaauacauucuuucacuacaauaaucaacccaacucaagaaugagauuaguagcaaugcuauauaccccacuaagaagcaacggaucaggagacgacguauuuacagucuccugcagaguccuuacaagaccaaccccagauuucgaauuuacauaucucgucccaccaucaguagaaucaaaaacaaaaccauuuucacuuccaauacuaacuuuaucagaacuaacaaauucaagauuuccaguaccuauagacucauuauuuaccgcacaaaacaacguacuccaaguacaaugccaaaauggaagaugcacacuagacggagaauuacaaggaacaacucaauuacuuccaucaggcauaugcgccuuuagaggucgagucacagcagaaacagaucaucaugauaaauggcacaugcaacuacaaaaucuaaaugguacaacauaugaccccacagaugacguaccagcaccauuaggaaccccagacuucaaaggcguugucuucggagucgcaucacaacgaaauguggguaaugacgcacccggaucaacaagagcacaugaagcugucauaucuaccuacagcccacaauuuguuccaaaacuagguucaguaaauuuccgaucuaacgacgaugacuuucaauuacaaccaacaaaauucacacccguaggaauaaaugaugauggugaccauccauucagacaaugggaacuucccgacuacuccggccuguuaacccuaaacaugaauuuagcacccccgguagcaccaaauuuuccuggagaacaauuacuauuuuuccgaucauuuguuccaugcucaggaggauauaaucaagguauaguagacugucucauaccacaagaauggauacaacacuucuaccaagaaucagccccuucucaaucagauguagcccuaauuagauacguaaauccagacacaggcagaacuuuauuugaggccaaauuacacagaucagguuauaucacaguagcacacagcggagauuauccauuaguaguaccagcaaacggcuacuuucgauucgacucauggguaaaucaauuuuauucacuugcacccaugggaaccggaaacggaagaagacgagcucaauaa

SEQ ID NO: 33560 - RNA, 1617 nt, Artificial Sequence
  derived and/or modified sequence opt6 from VP1__Norovirus_and/or_Norovirus-like__KU557839
augaaaauggcaucaaaugacgcagcccccucauccgauggagcugcaggucucguuccugaagguaacaaugaaacucuuccacuagaaccaguagcaggagcugcaauugcagccccaguuacaggacaaaauaacauaaucgauccauggaucagaacaaacuuuguucaagcaccaaauggagaauuuaccguuucaccaagaaauucuccaggagaaauccuauuaaacuuagaacuaggaccugaucucaauccuuacuuagcacauuuaucucguauguacaauggauaugcugguggaguagaaguacaaguacuacuagcagguaacgcauuuacagcaggcaaaauacucuucgcagcaguacccccaaacuuuccagucgaauuucuaucacccgcacaaauaacaaugcuaccccaccuaauaguugauguacgaacauuagaaccaauaaugauuccauuacccgacgucagaaauacauucuuccauuauaacaaccaaccuaauucacgaaugagauuagucgcaaugcuauauacaccacuaagaucuaauggaucaggagaugauguauucacaguauccugccgaguauuaacacgaccaaccccugauuucgaauuuaccuacuuaguuccacccucaguagaaucaaagacaaaaccauucucauuacccauauuaacauuaucagaauuaacaaacucaagauuucccguaccuauagauucacuauuuacagcacaaaauaauguucuccaaguacaaugucaaaacggacguugcacauuagauggcgaauuacaaggaacaacacagcucuuaccaucaggaauuugugcauucagaggaagaguaacagcagaaacagaucacagagacaaauggcauaugcaacuacaaaauuuaaaugguacaacuuacgacccaacugacgacguuccugcuccuuuaggcacaccagacuuuaaaggagucguuuucggcguagccucacaaagaaauguaggcaaugacgcuccagguuccacacgagcacaugaagcuguaauauccacauauucaccacaauucgucccaaaacuggguucaguaaacuuuagauccaaugacaacgacuuucaauuacaaccaaccaaauucacaccaguagguauaaacgaugacggagaucacccauuuagacaaugggaauuaccagacuacucuggacucuuaacuuuaaacaugaaucuagcaccaccaguugccccaaauuuuccaggagaacaauuacuauucuuccguucauucguaccauguucaggcggauacaaccaagguauaguagauugcuuaauuccccaagaauggauacaacacuuuuaccaagaaucagcuccaucacaaucagauguugcuuuaauaagauacguuaauccagauacuggucgaacauuauuugaagcuaaauuacacagaucugguuacauaacuguagcgcacucaggugacuauccuuuaguaguaccagcuaaugguuauuuuagauuugauucaugggucaaucaauuuuauucacucgcaccaaugggaacaggaaacgguagaagacgagcacaauaa

SEQ ID NO: 33561 - RNA, 1617 nt, Artificial Sequence
  derived and/or modified sequence opt6 from VP1__Norovirus_and/or_Norovirus-like__KP902564
augaaaauggcuucaaaugacgccgccccaucaaacgacggagcagccggauuaguaccugaaggaaacaacgaaacuuuaccccuagaaccaguagcuggagcagcgauagcugcaccaguuacuggacaaaacaauauaauagacccuuggauuagaacuaacuuuguacaagcacccaacggcgaauuuacagucuccccacgaaauucaccuggagaaauacuccuaaaccucgaacuaggcccagaucuuaacccauauuuagcacacuuaucacgcauguauaacggauacgcaggaggagucgaaguacaaguacuuuuagcaggaaacgcauucacagcaggaaaaauccuauucgcagcaguucccccaaacuuuccuguagaauuucuaucaccagcacaaauaacuaugcuaccacaucuuaucguugacgucaggacucuugaaccaaucaugauuccauuaccagaugucagaaauacauucuuccacuauaauaaucaaccaaauagcagaaugagauuagucgccauguuauacacuccacuuagaucaaacggcucuggggaugacguauucacagucucauguagaguacuuacaagaccuacgccugauuuugaauuuacauaucuagugccaccaagcguugaaucaaaaacaaaaccauucucuuuaccaauauuaacauuaagugaacuaacaaacucacgauucccaguuccaauagacucacuauuuacagcucaaaacaacguuuuacaaguucaaugucaaaacggaagauguacucuugacggagaauuacaaggaacaacacaacuacuaccuucaggaauaugugcauuuagaggacgaguuacagccgaaacagaccauagagauaaauggcacaugcaauuacaaaaucuaaauggaacaacauaugauccaacagaugauguacccgccccacuaggaacaccagacuucaaaggaguaguauuuggcguagcaucacaaagaaauguaggaaacgacgccccagacucaacaagagcacaugaagcaguaauaucaaccuauucaccccaauuugucccaaaacuaggaucaguuaauuucagaucaaaugacaaugacuuucaacuacaaccaacaaaauuuacacccguaggaauaaaugaugacggugaucauccauuuagacaaugggaacuaccagacuauucaggucuacuaaccuuaaauaugaaccuagccccuccaguagcaccaaacuuuccuggugaacaacucuuauucuuucguuccuuuguuccaugcucagguggcuauaaccaaggaauaguagauugcuuaauaccccaagaauggauucaacauuucuaccaagaaagugcaccaagucaaucagacguagcacuaaucagauacguaaaccccgacacaggaagaacacuauucgaagcuaaauuacacagauccggauacaucacugucgcacacucaggagauuacccauuagucguaccagcaaauggcuauuucagauuugacucuuggguaaaucaauuuuacucauuagcuccaaugggaacaggaaacggacgaagacgagcucaauaa

SEQ ID NO: 33562 - RNA, 1617 nt, Artificial Sequence
  derived and/or modified sequence opt6 from VP1__Norovirus_and/or_Norovirus-like__KU587625
augaaaauggcaagcaaugacgcagccccaaguaacgauggagcagcugguuuaguaccagaaggaaacaacgaaacauuaccacuagaaccaguagcuggagcugcaauugcagccccaguaacaggccaaaauaacaucauagacccuuggauaagaacuaacuucguccaagcaccaaacggagaauuuacaguaucaccccgaaauucaccaggcgaaauacugcuaaauuuagaauuaggaccagaucuaaauccauaucuagcacacuuaaguagaauguauaacggauacgccgguggaguugaaguacaaguuuuacucgcaggaaacgcauuuacagcaggaaaaauucuauuugcagcaguaccacccaacuucccaguagaauuucuaucaccagcccaaaucacaauguuaccucacaucauaguagauguucgaacacuagaaccaauaaugaucccucuaccagauguccgaaacacuuucuuucauuacaauaaccaacccaacuccagaaugcgccuaguagcaaugcucuacacaccacuaagaucaaauggaucaggagacgauguauuuacaguuucuuguagaguacuaacaagacccacaccagacuuugaauuuacuuaucuagucccaccaucaguagaauccaaaacuaaacccuucucacuaccaauauuaacacuaucagaauuaacaaacucacgauucccaguaccaauagacagcuuauuuacagcacaaaauaauguacuucaaguacaaugucagaauggacgauguacauuagauggagaauuacaaggaacuacacaauuacuaccaucaggaauaugcgcauuuagaggaagaguuacagcagaaacugacaacccugacaaauggcauaugcaacuccaaaaucuaaauggcaccacauacgauccaacagacgacguaccagcaccccuuggcaccccagauuucaaagguguuguauucggaguugcaagucaaagaaacguuggcaaugacgcuccuggaucuacaagagcucaugaagcaguuauaucuacauauucaccaaaauuuguuccaaaacucggaucaguaaauuuuagauccaacgacgaugacuuucaauuacaaccaacuagauuuacaccaguaggaaucaaugaugauggcaaccauccauuucgacaaugggaacuaccagauuacuccggaguauuaacacuaaauaugaacuuagccccacccguagccccaaacuuuccaggugaacaacuucuacuauuucgauccuuuguaccauguucaggcggauacaaccaaggcauaauagauugucuaauaccacaagaauggauacaacauuuuuaucaagaaucagcccccucucaaucagacguagcacuuauaagauacgucaacccagacacaggacguacauuauucgaagcuaaacuacaucgaucaggauauauaacaguagcucauucuggagauuacccccuaguaguaccagcaaauggauauuucagauucgauucuuggguaaaucaauuuuacucccuagcuccaaugggaacugguaauggaagacguagagcacaauaa

SEQ ID NO: 33563 - RNA, 1617 nt, Artificial Sequence
  derived and/or modified sequence opt6 from VP1__Norovirus_and/or_Norovirus-like__KX171413
augaaaauggcuagcaaugaugcagcaccuucaaaugacggcgcagcaggauuaguaccagaagguaauaaugaaacuuuaccacuagaaccaguagcuggagcagccauagcagcaccagucacaggacagaauaauauaauagaccccuggauaagaacaaauuucguacaggccccuaauggagaauuuacaguuuccccaagaaauucucccggagaaauacuucuaaaccuagaacucggaccugaucucaauccauauuuagcacaccuuucuagaauguauaauggauacgcaggaggagucgaaguucaaguauuacucgcaggaaaugcauucacugcaggaaaaauauuauuugcugcaguacccccaaauuucccaguagaauuucuaucaccagcacaaauuacaaugcuaccacaccuuauaguagacguuagaacucuagaaccaauuaugauuccucugccagacguucgaaacacauucuuucauuacaacaaccaaccaaacucaagaaugagauuaguugcaaugcuauacacaccacuacguucuaacggcucaggugacgacguauuuaccguuucaugcagaguucuaacucgaccaacaccagacuucgaauuuacauauuuaguaccaccauccguugaaucaaaaacaaaaccauuuucuuuaccuauucuaacuuuaagcgaacuaacaaacucucgauuuccaguuccaauagauucacuuuuuacagcacaaaacaauguacuacaaguacaaugccaaaacggcagauguaccuuagacggagaacuacaagguacuacacaacuacuaccauccggaauaugugcauuuagaggaagaguaacaacagaaacugaucauagagacaaauggcacaugcaacuacaaaauuuaaauggaacaacauaugacccaacggacgauguuccagcacccuuaggaacaccagacuucaaaggaguuguauuuggaguagccucucaaagaaauguaggaaacgacgcaccaggaagcacaagagcacacgaagcaguuauauccacauauucaccacaauuugucccuaaauuaggaucuguaaauuuucgauccaaugacgacgauuuucaacuucaaccaaccaaauucacacccguaggaauuaacgacgacggagaccacccuuuccgccaaugggagcuuccagacuauucuggcccccucacacuaaacaugaaucuagcacccccaguagccccaaacuucccaggugaacaacucuuauuuuucagaaguuuuguaccauguucagguggauauaaccaaggaauaguugacugcuuaauaccucaagaauggauucaacauuuuuaucaagaaucggcaccaucacaaucagaugucgcauuaaucagauacguaaauccagauacaggcagaacauuauucgaagcaaaacuucauagaucagguuauaucacuguagcacauucaggagauuauccauuaguuguaccagcaaauggauacuucagauuugauuccuggguaaaucaauuuuauucacuagcuccaaugggaacuggcaacggaagaagacgagcacaauaa

SEQ ID NO: 33564 - RNA, 1617 nt, Artificial Sequence
  derived and/or modified sequence opt6 from VP1__Norovirus_and/or_Norovirus-like__KP902565
augaaaauggcauccaacgacgcagcaccaucaaaugacggagccgcuggcuuaguccccgaaggaaacaaugaaacucuuccauuagaaccuguagcuggugcagcaauagcagcaccaguaacaggacaaaacaauauaauagauccuuggauaagaacaaacuuuguacaagcaccaaacggcgaauuuacuguuuccccacgaaauuccccaggagaaauacuacucaaccuagaacuaggaccagaucuuaaucccuauuuagcacauuuaagucgaauguacaacggauaugcaggaggaguugaaguccaaguacucuuagcaggcaacgccuuuacugcaggaaaaauacuauuugcagcaguaccuccuaacuuuccaguagaauuucuaucaccagcccaaauaaccauguuaccccaucuaauaguagacgugagaacacuugaaccaauuaugauaccucuaccugauguaagaaauacauuuuuccauuauaacaaccaacccaacaaucgaaugcgcuuaguagccaugcuuuauacuccauuacgaucgaacggcucaggugacgauguauuuacagucucaugucgaguuuuaacccgaccuacuccagacuucgaauuuacauaucuuguaccacccuccguagaaucaaaaacuaaaccauuuucauuaccaauuuuaacauuaucagaacuaacaaacucacgauuuccaguaccaauagauucuuuauuuacugcucaaaauaacguauuacaaguacaaugucaaaauggacgauguacuuuagauggugaacuacaaggaacaacucaauuacuaccaucaggcaucugugcauuccgaggacgaguaacagccgaaacagaucacagagauaaauggcacaugcaauuacaaaauuuaaaugguacaacauacgaucccacagacgauguaccagcaccauuaggaacaccugacuucaaaggagucguauuugguguugcaucacaacgaaacguaggaaacgacgcaccaggcucaacucgagcacacgaagccguaauaucaacauauuccccucaauuugucccaaaauuaggcucaguaaauuucagaucaaaugauaacgacuuccaauuacaaccaacaaaauucacaccaguaggcauaaacgaugacggcgaccaccccuuuagacagugggaacuuccagauuauucaggacuauuaacauuaaacaugaaccuagcaccaccaguagccccuaacuuuccaggugaacaauuacuauucuuuagaucauuuguaccauguucagguggcuauaaccaagguauuguagacugcuuaauaccacaagaauggauacaacacuucuaucaagaaucagcaccaucacaaucagacgucgccuuaaucagauauguaaacccugauacagguagaacacuauucgaagcaaaacuacaucgaucaggauauauaacaguagcccacucaggcgauuacccacucguaguaccagcuaacggauacuucagauucgauucauggguuaaucaauucuacucccuagcaccaauggguacaggcaacggcagacgcagagcccaauaa

SEQ ID NO: 33565 - RNA, 1617 nt, Artificial Sequence
  derived and/or modified sequence opt6 from VP1__Norovirus_and/or_Norovirus-like__KX171416
augaaaauggcaagcaaugacgccgcccccucaaacgacggagcagcagguuuagucccagaaggaaauaaugaaacacuaccauuagaaccuguagcaggagcagcaauagcagcaccaguaacaggacaaaacaauauuauagacccauggauuagaacaaauuucguacaggcaccaaacggagaauuuacaguauccccuagaaacagcccaggcgaaauacuacuaaaucuagaacuuggacccgaucucaauccauaucuagcccaccuaucaagaauguacaacggauacgcaggaggaguagaaguccaaguccuacuugcuggaaaugccuuuacagcaggaaaaaucuuauuugcagccguuccaccaaacuucccaguagaauuucuuucaccagcucaaauaaccaugcucccacaccucauaguagacguccgcacccuagaaccaauuaugauaccacuaccagauguaagaaauaccuucuuucacuauaauaaccaaccaaauaauagaaugagauuaguugcaaugcucuauacaccuuuacgaucaaacgggucaggugacgaugucuuuacuguuucauguagaguacuaacacgaccaacaccagauuuugaguucacauauuuaguuccaccauccguagaaucuaaaacaaaaccauuuucacuuccuauacuuacacucagcgaauuaaccaacucaagauuuccaguaccaauagacucacuauuuacugcacaaaacaauguucuacaaguccaaugucaaaauggcagaugcacccuagacggugaacuccaagguacaacacaacuacuaccuuccggaauuugugcauuucgaggcagaguaacugcagaaacagaccaucgagacaaauggcacaugcaauuacaaaaucuaaauggaaccaccuacgauccaacagaugacguaccagcuccacuaggaacacccgauuuuaaaggaguuguauucggaauagcaagccaaagaaacguuggaaaugaugcaccagguaguacaagagcacacgaagcaguaauaucaacauauucaccacaauuuguaccaaaacuaggaucuguaaauuucagaaguaaugacaaugauuuccaauuacaacccaccaaauucacaccuguaggaauaaacgaugauggugaccacccauuuagacaaugggaauuaccagacuauucaggacuuuuaacacuaaacaugaaucuggccccaccuguagcaccaaauuuuccaggugaacaacuacuauucuuccgaucauuuguacccuguaguggcggauauaaccaagguauaguagacugcuuaauaccacaagaauggauacaacauuucuaccaagaaucagcaccaagccaauccgaugucgcauuaauaagauacguaaacccagauacaggaagaaccuuauuugaagcaaaacuacacagauccggcuacauuacagucgcacauucaggagauuauccucuaguaguuccagcaaacggcuauuuccgauuugacucuugggucaaccaauucuauucacucgcaccaauggguacaggaaacggaagaaggagagcccaauaa

SEQ ID NO: 33566 - RNA, 1617 nt, Artificial Sequence
  derived and/or modified sequence opt6 from VP1__Norovirus_and/or_Norovirus-like__KU561250
augaaaauggccucaaaugacgcugcaccaucaaacgauggugcugcuggucuaguuccagaaggaaauaaugaaacucuaccacuugaaccaguagcuggugcugcaauugccgcuccaguuacuggccaaaauaacauaauagauccuuggauaagaacuaacuucguacaagccccaaacggagaauuuacaguaucaccaagaaauucacccggagaaauacuuuuaaaucuagaauuaggacccgauuuaaaucccuauuuagcacaccuaucccgaauguauaacggauacgcaggagguguagaaguacaaguucuuuuagcaggaaacgcuuuuacagcaggaaaaauucuauuugcagcugugccaccaaacuuccccguagaauuuuuaucuccagcacaaauaacaauguuaccgcacuuaauaguagaugucagaacccuugaaccaauaaugaucccuuuacccgauguuagaaauacauuuuuccacuacaauaaucaaccaaacucacgaaugagauuaguagcaaugcuauacacaccauuaagaucaaacgguuccggagaugauguauucacuguuucauguagaguccuaacaagaccuacaccagauuucgaguucaccuaucuaguaccaccuucaguagaaucaaaaacaaaaccauuuucacucccuauacuuacauuaagcgaacuaacaaacucaagauucccaguaccaauagacuccuuauucacagcacaaaauaauguacuacaaguccaaugccaaaacggaagauguacacuagacggagaacuacaaggaacuacacaauuacuucccucuggaaucugugcauuccgaggaagaguuacugcagaaacagaccauagagacaaauggcacaugcaacuacaaaaucuaaacggaacaacuuaugacccaacagacgacguaccugcuccauuaggcacaccagauuucaaaggaguaguauuuggaguagcaucucaaagaaacguaggcaaugaugcuccuggauccacaagagcacaugaagcagcaaucaguaccuauucaccacaauucguaccaaaauuaggaucuguaaacuucagaucaaaugacaaugauuuucaacuacaaccaacaaaauuuacaccaguuggaauaaacgacgauggugaccacccuuuucgccaaugggaauuaccagacuauagugggcuauuaacuuuaaacaugaacuuagcaccaccaguagccccaaauuuucccggagaacaacuauuauucuucagaucauuuguaccauguucagguggcuacaaccaaggaauaguugacugcuuaauaccucaagaauggauacaacauuucuaucaagaaucagcaccuucacaaucagacgucgcauuaauaagguacgucaauccagacacaggucguacacucuucgaagccaaacuacauagaucaggauacauaacagucgcucauucaggugauuauccccuaguaguaccagcaaauggauacuuucgauucgacucauggguaaaccaauuuuacucacuagcaccaaugggcacagguaauggccgacgcagagcccaauga

SEQ ID NO: 33567 - RNA, 1617 nt, Artificial Sequence
  derived and/or modified sequence opt6 from VP1__Norovirus_and/or_Norovirus-like__KU561251
augaagauggccucaaaugaugcagcaccaucuaaugacggagcagcagguuuaguaccugaaggaaauaaugaaacuuuaccccuugaacccguagcaggagcagcuauagcagcacccguuacaggacaaaauaauaucauagauccauggauaagaacaaacuucguacaagccccaaacggugaauuuacagucucuccaagaaacaguccaggagaaauucuacucaaccuugaacuugguccagaucuaaauccauaucuagcucauuuaucacgaauguacaauggauaugcaggcggagucgaaguacaaguacuacuagccggaaacgcauucaccgcaggaaaaauacuauucgcagcuguaccaccaaauuuuccuguagaauuucucucaccagcccaaauaaccaugcuaccacacuuaaucgucgauguaagaaccuuagaaccaaucaugauaccauuacccgauguuagaaacaccuucuuccacuauaacaaccaaccaaacucaagaaugcgauuaguugcuaugcuauauacuccacuaagaucaaauggaucaggagacgauguauuuacaguuucauguagagugcuaacaaggccaacaccagacuucgaauuuacauaccuaguacccccaagcgucgaaucaaaaacaaaaccauuuucauuaccaaucuuaacauuaucugaacuuacaaacucuagauuuccagucccaauugacucauuauuuacagcccacaauaauguauuacaaguacaaugucaaaacggacguugcacauuagacggagaauuacaaggaacaacacaacuuuuaccuucaggaauaugugcauuccgaggacgaguaacugcagaaacagaccauagagauaaauggcauaugcaacuccaaaaucucaaugguaccaccuaugacccaacagacgacguacccgcaccacuaggaacucccgacuucaaaggaguaguuuuuggaguagcaucacaaaggaacguuggcaaugaugcacccggaucaaccagagcccacgaagcaguaaucuccacauacucaccacaauuuguaccaaaacucggaucaguaaauuuccgaucaaaugauaacgacuuccaauuacaaccaacaaaauucacaccaguaggaauaaacgaugauggagaucaccccuuucgacaaugggaacuaccugacuacuccggauuacuuacucuaaacaugaaucuagcuccuccuguagcacccaauuuuccuggugaacaacuccucuucuuuagaucuuuuguaccuuguucaggaggauauaaucaaggaauaguagauuguuuaauaccacaagaauggauacaacauuuuuaucaagaauccgcuccaucccaaucagacguggcucuaauucgauacgucaacccugauacaggaagaacauuauucgaagcaaaauuacauagauccgguuauauaaccguagcacacucaggagauuauccuuuaguagucccagcaaauggauauuucagauucgacucauggguaaaucaauuuuacucacuagcccccaugggcacagguaauggaagaagaacagcacaauaa

SEQ ID NO: 33568 - RNA, 1617 nt, Artificial Sequence
  derived and/or modified sequence opt6 from VP1__Norovirus_and/or_Norovirus-like__AB810014
augaaaauggcaucaaacgaugcagcaccaucaaaugacggagcagccuccuuaguacccgaagcaauaaaugaaacaaugccauuagaaccgguagcaggagcaucaaucgccgcaccaguugcaggacaaacaaauaucauagaucccuggaucagaacaaauuucguacaagccccaaauggagaauuuacaguuucccccagaaauaguccuggcgaaauacuacuaaaucuagaacuuggccccgaucuuaauccauaucuagcacacuuaucaagaauguauaacggcuacgcuggagguguagaaguacaaguauuacuagcaggaaaugccuuuacagccggaaaaauacuauuugcagcuauaccuccuaacuuuccaguagacaugauaucaccagcacaaauaacaaugcucccccauuuaauaguagauguaagaacacuagaaccaauuaugauaccauuaccugauguuagaaacguauucuaucauuuuaauaaucaaccacaaccacguaugagauuaguagccaugcuauacacuccuuuaagaucaaacggaucaggagacgacguauuuacagucucaugcagaguucugaccagaccaacaccagacuuugaauuuauauaccuaguaccacccucaguagaaagcaaaacaaaaccauucacuuuaccaauacucacaauaucagaacuaacaaacucccgauucccuauccccauugaacaacuauauacagcaccaaaugaaaacaacguaguacaaugucaaaacggcagaugcacauuagauggagaacuccaaggcacaacacaauuacuauccucagcaguauguucauacagagguagaacuguagcaaacaguggcgacaacugggaucaaaacuuacuucaauuaacuuacccuucaggugcaagcuacgauccaacugacgaaguaccagccccucuagguacccaagauuuccgaggcauacucuauggaguacuaacacaagacaauguaucugaaggaacaggagaagccaaaaacgcaaaaggaguauauauaucaacaacaucuggaaaauucacacccaaaauaggcuccauuggauuacauucaauaacugaaaauguacauccaaaucaacaaucaagauuuaccccaguugguguagcacaaaacgaaaauaccccauuucaacaauggguucuaccacauuacgcaggagcauuagcccuaaacacaaauuuagcacccgccguugcaccuaccuuucccggagaacaauuauuauucuucagaucacgcguaccaugcguacaaggacuuagaggacaagacgcauuuauagauugccuucuaccacaagaauggguaaaccacuuuuaucaagaagcagcaccaucacaagcagauguagcccucauaagauacguaaaccccgacacaggcagaacacuauucgaagcuaaauuacauagauccggauucauaaccguaucccauaccggcgcauacccucuaguaguaccaccaaacggacacuuuagauuugacucauggguuaaccaauuuuacucacuagcaccaauggguacuggaaacggcagauaa

SEQ ID NO: 33569 - RNA, 1617 nt, Artificial Sequence
  derived and/or modified sequence opt6 from VP1__Norovirus_and/or_Norovirus-like__AB809985
augaaaauggcgucaaacgaugcagcaccaucaaaugauggagcagcaucauuaguuccagaagcuauuaaugaaacaaugccauuagaaccuguugcaggagcuucaaucgcagcucccguagcaggacagacaaauauaauagaccccuggauaagaacaaauuucguacaagcaccuaacggagaauuuacaguaucaccacgaaacucaccaggagaaauacuacuaaaucuugaauuaggaccagacuuaaaucccuaccuagcacacuuaucacgaauguacaacggcuaugccgguggaguagaaguucaaguacuauuggcaggaaaugcauucacugcugguaaaauuuuauuugcugcgauaccacccaauuucccagucgauaugauaucucccgcacaaauuacaaugcuaccacauuuaaucguagacguaagaacauuagaaccaaucaugauaccacuaccugauguaagaaacguauuuuaccauuucaauaaccaaccacaaccacgcaugcgccuaguagcaaugcuauauacaccacuucgauccaacgguuccggagaugauguauucacaguaucauguagaguacuaacucgacccacgccagauuuugaauuuauauauuuagucccaccaucaguagaaucaaaaacaaaacccuucacacuacccauccuaaccauaucagaacuaacaaauucacgauucccaauaccuauagaacaauuauauacagcaccaaaugaaaacaacguuguccaaugucaaaauggcagauguacauuagauggagaacuacaagguacuacacaauuauuauccucugcaguauguuccuacagaggucgaacuguagccaacuccggugacaauugggaucaaaaccuauuacaauuaacauauccaucaggagcaagcuacgacccaacugaugaagugccagcaccauuaggaacacaagacuucucaggaauacuauaugguguucuuacacaagacaauguuucugaaggaacaggugaagccaaaaaugcaaaggguguauauaucagcacaacauccggaaaauuuacuccaaaaauuggaucaauaggacuacauucaauaaccgaaaauguucauccaaaucagcagucacguuucacaccaguugguguagcacaaaaugaaaauacacccuuucaacaauggguccuuccacacuaugccggugcacuagcauuaaacacaaauuuagcacccgcuguagcacccacauucccaggagaacaacuucucuucuuuagaucaagaguaccauguguccaaggucucagaggacaggaugcauucauagauugcuuauuaccacaagaauggguaaaucauuuuuaucaagaagcugcacccucccaagcugauguagcauuaauaagauauguaaacccagauaccggacguacacuauuugaagcaaaacuucaccgaucagguuucauaacaguaucacauaccggagccuauccauuaguuguaccaccuaauggacacuucagauuugauucauggguaaaucaauuuuacagcuuagcaccaauggguacaggaaacggaagguaa

SEQ ID NO: 33570 - RNA, 1617 nt, Artificial Sequence
  derived and/or modified sequence opt6 from VP1__Norovirus_and/or_Norovirus-like__AB810003
augaaaauggcaucaaaugaugcagcaccuuccaacgacggcgcagcaucucuagucccagaagcaauaaaugaaacaaugccauuagaaccaguagcuggugcaucaaucgcagcaccaguagcaggccaaacaaauauaauagauccauggauuagaacaaauuuuguucaagcaccaaauggagaauuuacaguauccccuagaaauucaccaggugaaauucuauuaaacuuagaacuuggucccgaccuaaacccauacuuagcacauuuaucaagaauguauaacggauacgccggaggaguagaagugcaaguacuacuagcaggaaaugcauucacagcaggaaaaauacucuucgcagcuauaccaccuaacuucccaguagauaugauaucaccagcacaaauaacaaugcuaccucaccuuauaguagacguacgaacauuagaaccaauaaugauaccacuaccugauguaagaaacgucuuuuaccauuucaacaaucaaccacaaccucgaaugagacucguagcaaugcuuuacacuccauuaagaagcaacggaucaggagaugauguauuuacaguaaguugcagaguacuaacacgacccacaccagauuuugaauuuauauauuuaguaccaccauccguugaaucaaaaaccaaaccauucacauuaccaauuuuaacaauaucagaauuaacaaauuccagauucccaauaccaauagaacaauuauacacagccccaaaugaaaauaacgucguucaaugucaaaauggccgaugcacccuugacggagaauuacaaggaacaacucaauuauuaucaucugcaguauguucauauagaggcaggacuguagcaaaccgaggagauaacugggaccaaaaccucuuacaauuaacauacccaucaggcgcauccuacgacccaacagaugaagucccagcaccauuaggaacacaagacuucuccggaauccuauauggcguccuaacacaagacaauguuagugaaggaacgggagaagcuaaaaacgcaaaaggcguuuauauuucaacaacauccggaaaauucacaccaaaaauagguucaaucggguuacacucaaucacugaaaauguccacccuaaccaacaaucccgauuuacaccaguugguguagcacaaaaugaaaauacuccauuccaacaaugggucuuaccacacuaugccggugcauuagcacuaaacacuaaucuagcuccagcaguugcaccaacauucccaggcgaacaacuuuuauuuuucagaaguagagucccauguguacaaggcuuacgaggacaagacgcauucauagauuguuuauuaccucaagaauggguuaaucauuucuaucaagaagcagcaccuucacaagcagacgucgcacuuauuagauacguaaacccugauacagguagaacauuauuugaagcaaaauuacaucgcagcggauucauaacaguuucacauacaggcgcuuauccauuagugguacccccaaacggacacuucagauucgauucaugguuuaaucaauucuauucacucgccccaaugggcacaggaaacggacguuaa

SEQ ID NO: 33571 - RNA, 1617 nt, Artificial Sequence
  derived and/or modified sequence opt6 from VP1__Norovirus_and/or_Norovirus-like__AB809975
augaaaauggcaucaaacgacgcugccccaucaaacgacggagcugccucauuaguuccugaagccauaaaugaaacaaugccccuugaaccaguagcuggugcaucuauagcagcaccaguagcaggacaaacaaauauaauagauccuuggauaagaacaaauuuuguucaagcaccaaacggagaauuuacaguuucaccacguaauucacccggagaaauauuauuaaauuuagaauugggaccagacuuaaauccuuaccuagcacaccucucacgaauguacaacggcuacgccgguggaguagaaguacaaguacuauuagcaggcaaugcauucacagccggaaaaauacuauuugccgcaauaccaccaaauuucccaguagauaugauaucacccgcccaaauaacaaugcuaccacaucuaauaguagacguaagaacauuagaaccaaucaugauaccauuaccugauguaagaaacguauucuaccauuuuaacaaucaaccacaaccaagaaugcgucuaguagcaaugcuauauacacccuuaagauccaaugguucaggagacgauguauuuacuguaucaugcagaguacuuacaagaccaacacccgacuucgaauuuauauaccucguacccccaucaguagaaucuaaaaccaaacccuucacucuacccauacuaacaauaucagaacuaaccaacuccagauucccaauaccaauagaacaauuauacaccgcaccaaaugaaaacaauguaguucaaugccaaaacggucgaugcacuuuagauggagaacuacaaggcacaacacaauuauuaaguucugccguuuguuccuacagaggaagaacaguagcaaacuccggagauaacugggaccaaaacuuacuacaacuaaguuacccauccggagcaucauacgauccaacagaugaagucccugcaccacuaggaacacaagacuuuagcggaauauuauacggagucuuaacccaagauaacguuucugaacgcacuggagaagccaaaaacgcaaaaggaauauauaucaguacaacauccggaaaauuuaccccuaaaauuggaucaauuggcuuacacucuaucacagaaaauguucauccaaaucaacaaucacgauuuaccccaguaggaguagcacaaaacgaaaauacuccuuuccaacaauggguucuaccacacuacgcuggugcacuugcacucaacacuaacuuagcaccggcaguugccccaaccuuuccgggagaacaauuauuauucuuuagaagcagaguaccuugcguucaaggacuccaaggacaagaugcauuuaucgacugccuauuaccacaagaauggguaaaucauuuuuaccaagaagcagcaccuucccaagcagacguugcacuaauuagauauguuaaucccgacaccggucgaacauuauucgaagcaaaauuacacagauccggauucaucacaguuucucacaccggagcauauccauuaguaguaccaccaaacggacacuuccgauucgacucauggguaaaucaauucuauucacuagcaccaaugggaacuggaaacggacgauaa

SEQ ID NO: 33572 - RNA, 1617 nt, Artificial Sequence
  derived and/or modified sequence opt6 from VP1__Norovirus_and/or_Norovirus-like__JX401280
augaaaauggcuucuucugaugccaauccaucagauggaucaucagccaaccuaguaccagaagucaauaaugaagucauggcauuagaaccugucguaggagcagccauagcugccccaguagcaggucaacaaaauauaauagaccccuggauaagaaacaauuuuguacaagcaccuggaggagaauuuacggucucaccacgcaaugcacccggagaaauacuauggucagcaccauuaagcccagaccuaaacccauaccuuucacauuuaucccgcauguauaauggauaugcuggaggauuugaaguacaaguaauauuagcaggaaaugcauuuacagcaggaaaaauaguuuucgcagcaguacccccaaauuuuccaacagaaggacuuuccccaucacaagucacaauguuuccccauauaauaguagauguaagacaauuagaaccuguucuaauaccccuaccagacguacgaaauaauuuuuaucauuauaaucaagcaaaugacucaacauuaaaacuuauagccaugcuauacacaccacuacgagccaacaacgcaggagacgauguauuuaccguaagcugcagagucuuaacacguccaucgccagauuuugauuucaucuuuuuaguaccaccaacaguagaaucaagaacaaaaccuuuuacaguaccuguccucacaguagaagaaaugacaaauucccgcuuuccaauaccauuagaacgacuauuuaccggcccaucuacugcuuucguuguucaaccccaaaauggccguuguaccacagauggaguuuuacuagguacuacacaacuaucugcaguuaacaucugcaauuuuagaggagaaguuaaccacauagcaggaacacaugacuacacaaugagacucacaucacaaaauuggaauaauuacgacccaacagaagaaauaccagcaccacuaggaacaccagauuucguuggaaggauucaagguguauuaacucaaacaacacgaucugaugguuccacccgcucacacaaggcaacaguaucaacaggaucaguacauuuuacaccaaaacuaggauccguacaauuuacaacagacacuacaaacgacuugaacgccggacaaaauacuaaauuuacuccaguaggaguagaacaaacaucaggagaucaucaauccgaaccacaacaauggacuuuaccaaauuauucaggaacaccaaaccacaauguacauuuagcuccugcaguagcaccuacauuccccggagaacaauuacuauucuuuagauccacccuacccggauguggagguuacccaaacaugaauuuagauuguuuacuaccucaagaauggguuuuacacuuuuaccaagaagcugcuccagcacaaucagacgucgcauuacuaagauucgucaauccggauacaggcagaguacucuuugaaugcaaacuccauagaucuggauucaucacaguagcacacucagguagucaugaccuugucauaccuccaaauggauauuucagauuugacaguuggguaaaucaauuuuauacacuagcaccaaugggaaauggaucaggaagaagaagaguauaa

SEQ ID NO: 33573 - RNA, 1617 nt, Artificial Sequence
  derived and/or modified sequence opt6 from VP1__Norovirus_and/or_Norovirus-like__KC962462
augaaaauggcaucuucagacgccaacccaucagauggaucagcagcuaauuuaguaccagaaguaaacaaugaaguaauggcacuagaaccaguagucggagcugccauugcagcuccaguagcaggacaacaaaauguaauagaccccuggauacgcaauaacuucguacaagcaccaggaggagaauuuacaguaucaccaagaaaugcacccggagaaaucuuauggucugcaccacuagguccagaucuaaacccauauuuaucacaccuagcacgaauguacaaugguuacgccgguggauucgaaguucaaguaauacuagcaggaaacgcauuuacagcaggaaaaauaauauuugcagcaguaccgccuaacuuuccuacagaaucccuaucaccaagucaaguaacaauguucccacacauaauaguagauguacgacaauuagaaccuguuuuaauaccacuuccugacguacgaaauaacuucuaccacuacaaucaaucaaacgacccuacaauaaaacuaauagcaaugcuauacacaccacuccgagccaacaacgcuggagaugacgucuuuacaguaucuugcagagucuuaacaagaccuucacccgauuuugauuucauauuuuuaguacccccuaccguagaaucccguacuaaaccauucagcguaccuauuuuaaccguagaagaaaugacaaacucaagauucccaauuccacucgaaaaauuauuuacuggcccaucaucugcauucguaguccaaccacaaaacggaagauguaccauugacggaguccuucuaggaaccacacaauuaucaccugucaacauaugcacauuuagaggugacguuacacacauagcaggaacacacaacuauacaaugaauuuagcuacacaaaauuggaacucauaugauccaacagaagaaauacccgcacccuuaggaacacccgacuuuguaggaaaaauacaaggaguacuuacacaaacaacaaaaacagacggaucaaccagaggacauaaagcaacaguaugcauagguucagcagauuuugcccccaaauuaggccguguacaauuugaaacagauaccaauaaugaucuugaaacaaaucaaaauacaaaauucacaccaguaggaguaauacaaaacggcgaaacagcucauagaaacgaaccucaacaauggguccuacccucauacucuggaagaaauacuccuaacguacaccuagcaccagccguugcaccaacauucccaggagaacaauuauuauucuuccgaucaacaaugccaggaugcucaggcuauccaaauauggaccuagauugccuauuaccucaagaauggguucaauacuuuuaccaagaagcagcuccagcccaaucugacguagcauuauuaagauucguaaauccagauacuggcagaguucuauucgaaugcaaacuacauaaaucuggauaugucacaguagcccacaccggaagccaugauuuaguaauaccuccaaaugguuauuucagauuugauucauggguaaaucaauuuuauacacuagcaccaaugggaaacggcacagguagacgacgcuaa

SEQ ID NO: 33574 - RNA, 1617 nt, Artificial Sequence
  derived and/or modified sequence opt6 from VP1__Norovirus_and/or_Norovirus-like__KX353974
augaaaauggcuucaaaugaugcaaacccuucagauggaucugcagcaaauuuaguaccagaaguaaauaaugaaguaauggcacuagaaccagugguaggagcagccauagcagccccaguagcuggucaacaaaacguuauagauccauggauaagaucuaauuucguacaagcaccaggcggugaauuuacaguaucaccacguaaugcaccaggagaaauacuauggagugcaccuuuaggccccgaccucaauccauaucuaucucaccuagcaagaauguauaacggcuaugcuggcgguuuugaaguucaagucauucuagcaggaaaugcauucaccgcaggaaaaauaauuuuugcugcuguucccccuaauuuuccaacagaaggauuaaguccaucucaagucacaauguuuccacacauaauaguugauguaagacaacuugaaccuguacucauaccacuaccagauguaagaaacaauuucuaucauuauaaccaaaguaaugauucaacaauaaaacuuauagcuaugcuauauacaccauuacgagcuaauaaugcuggugacgauguuuuuacagucucauguagaguucuaaccagaccaucaccagauuuugacuuuauauuucuaguucccccaacuguagaaucacgaacaaaaccuuuuacaguacccauacuaacaguagaagaaaugacaaacaguagauucccaauuccuuuagaaaaauuauucacagguccaucaucagcauucguaguacaaccacaaaacgguagauguacaaccgacggaguauuacuagguacuacacaauuaucaccaguuaauauauguacauuuagaggugauguaacucacauagccggaucaagaaauuacacaaugaaccucgcgucauuaaacuggaacaauuaugauccuacagaagaaauaccugcaccuuuagguacaccagauuuuguaggaaaaauucaaggaguccuaacucaaacaacaaaaggugauggaucaacaaggggacacaaagcaacaguuuauacaggaagugcagauuuuacaccaaaacuaggaucaguccaauucgguacagacacagaaaacgauuucgaaauacaccaaaauacacgauuuacuccuguaggcgucauccaagaugguuccacaacacauagaaaugaaccccaacaaugggucuuaccaucauauucaggaagaucuguacauaacguucaccuagccccugcagucgcaccaaauuuuccaggugaacaacuauuauucuuuagauccacaaugccaggaugcaguggcuauccaaauauggacuuagacugccuauuaccacaagaauggguccaacacuucuaucaagaagcagccccggcacaaagugacguagcauuauuaagauucguaaacccagacaccggcagaguacucuuugaauguaaacuacauaaaucaggauacguaaccguagcacacacuggacaacaugauuuaguuauaccaccuaaugguuauuucagauuugauucauggguaaaucaauucuacacuuuagcaccaaugggaaacggaacuggcagaagaagauga

SEQ ID NO: 33575 - RNA, 1617 nt, Artificial Sequence
  derived and/or modified sequence opt6 from VP1__Norovirus_and/or_Norovirus-like__KF060122
augaaaauggcuuccucggaugcaaauccaucugaugguucugcagcuaaucuuguaccugaaguaaacaacgaaguaauggcacuugaaccuguaguaggagcagcaauagcagcaccaguagcuggacaacaaaaugucauagauccauggauuagaaacaauuuuguacaagcacccggaggagaauuuaccguaagcccaagaaaugcacccggcgaaauauuauggucagcaccacuuggaccagacuuaaaccccuacuuaucacacuuagcucgaauguacaaugguuacgcaggaggauucgaaguucaaguaauucuagcaggcaaugccuuuaccgcaggaaaaauaauauuugcagcaguaccaccaaacuuuccaaccgaaggauuauccccuucacaaguaacaauguuuccacacauaauaguggauguucgacaauuagaacccguucuaauaccucuaccagacguaagaaacaacuucuaccauuauaaccaaaguaacgauccaacaauuaaacuaauagccaugcuuuacaccccucucagagcuaacaacgcaggcgacgauguauuuacaguuuccugucgaguauuaacacgaccaucaccugauuuugacuuuauauuucuaguaccaccaacaguagaaucaagaacaaaaccauucucuguaccuguauuaacagucgaagaaaugacuaacagccgauuuccaguaccauuagaaaaacuauuuacagguccaucauccgcauucguuguacaaccacaaaacggaagauguacuacugauggaguauuacugggaacaacacaauuaucuccuguaaauauauguacauuucgcggugauguaacacauauuacaggcucucacaacuacacaaugaauuuagcuucccaaaacuggaacucauaugauccaacagaagaaauccccgcccccuuaggaacaccagacuuuguaggaaaaauacaaggaguacuaacacaaacaacuagagcaaacggaucuacaagaggucauaaagcaacugucuauacugguucagcagacuuugcuccaaaauuaggcagaguacaauuugccacagacacaaauaacgauuucgacgcaaaucaaaauacaaaauuuacaccuguaggcguaauacaagacggagacacugcacauagaaacgaaccacaacaauggguucuaccuucauacucuggaagaaauagucauaacguacacuuagcaccagcaguagcaccaacauuuccaggugaacaauuauuauucuuuagaucuacaaugcccggaugcucaggcuauccgaauauggauuuagauugucuauuaccgcaagaauggguccaauauuucuaucaagaagcagcuccagcacaaucagauguagcauuauuaagauuuguaaacccugacacaggaagaguuuuauuugaauguaaacuucauaaaucaggauacguaaccguagcacacaccggacaacaugauuuaguaauaccaccaaauggauauuucagauucgauucauggguuaaccaauuuuauacauuagcuccaaugggaaacgguacaggcagaagaagauaa

SEQ ID NO: 33576 - RNA, 1617 nt, Artificial Sequence
  derived and/or modified sequence opt6 from VP1__Norovirus_and/or_Norovirus-like__KR904234
augaaaauggcgucaucagaugcaaaccccucagacgguucaacagcuaauuuagucccugaaguaaacaacgaaguaauggcucuagaaccagucgucggagccgcuauagcagcaccugucgcaggacaacaaaauguuauugacccauggauaagaucaaacuuuguucaagcuccaggaggugaauuuaccguaucaccacgaaacgcucccggcgaaauauuauggucugcacccuuaggaccugaucuaaauccauaucuaucucauuuagcaagaauguacaacggauacgcaggagguuuugaaguacaagucauauuagcaggaaaugccuucacagcaggcaaaauaauauucgcugcaguuccaccuaacuuucccacagaaggacucucuccaucucaaguaacaauguucccacacauaaucguagacgucagacaacuagaaccaguauuaauaccacucccugauguuagaaauaauuuuuaucacuacaaucaaaguaaugaccccacuauuaaacuaaucgcuauguuauacacaccccuacgagcaaacucugcaggagacgacgucuucaccguaucauguagaguacuaacaagaccauccccagacuuugauuuuaucuuuuuaguacccccaaccguagaaucaagaacaaaaccauuuucaguuccaauccuaacaguagaagaaaugacaaauucuagauucccuauaccccuagaaaaacuauucacaggaccaucuagcgcauuuguaguacaaccacaaaacggacgaugcacaacugacggaguacuacuagguacaacucaacuauccccaguaaacauauguucauuuagaggagacgucacacauauagcaggaucucgaaauuacacaaugaacuuagcaucacaaaauuggaacucauaugaucccacagaagaaauaccugcaccuuuaggaacucccgauuuuguaggaaaaauacaaggaguauuaacacaaacaacaagaaccgacggcucaacacgaggacauagagcaacaguauauacaggcagcgcagacuucucaccaaaacuaggaagaguucaauuugcaacagauacagauaaugacuucguagccaaucaaaauaccaaauucacuccuguaggaguaauacaagauggugauacagcacauagaaaugaaccacaacaaugggucuuaccaagcuauucaggaagaaacauacauaacguacaccuugccccugcaguagcaccaaccuuccccggagaacaacuauuauucuuccgcagcacaaugccaggauguucaggauauccaaauauggaccucgauuguuuacuaccucaagaauggguacaacacuucuaucaagaagcagcaccagcacaaucagauguagcacuauuacgcuuugucaacccagauacaggaagaguacucuucgaaugcaaacuccauaaaucagguuauguaaccguagcacauacaggccaacacgauuuaguaauaccaccuaaugguuauuuucgauucgauuccuggguaaaccaauucuacacccuagcuccaaugggaaacggcacaggaagacguagauaa

SEQ ID NO: 33577 - RNA, 1617 nt, Artificial Sequence
  derived and/or modified sequence opt6 from VP1__Norovirus_and/or_Norovirus-like__KR131769
augaaaauggcaucaaaugacgcaaacccuuccgauggcucuacagcaaaccuuguaccagaagugaauaacgaaguuauggcacuugaaccuguuguaggagcagcuauagcagcaccaguagcaggucaacaaaauguaauagaccccuggauaagaaauaacuuugugcaagccccaggaggagaauuuacagucucaccuagaaaugcaccaggagaaauucuaugguccgcaccauuaggaccagauuuaaauccuuaccuaucccauuuagcaagaauguauaacggauaugcaggaggauuugaaguucaaguuauauuagccggaaaugccuuuacugcaggaaaaauaaucuuugccgcuguaccaccaaacuuuccaacugaaggauuaucaccaucacaaguaacaauguucccccacaucauaguagacguaagacaacuagaaccuguauuaauaccauuaccagacguaagaaacaauuucuaucacuauaaccaaucaaaugacccaaccauuaaauuaaucgcaauguuauacacuccauuaagagcuaacaaugcuggagacgacgucuuuacaguuucauguagaguacuaacccgacccagcccagauuuugacuucauauuucucguaccaccaacaguagaaucaagaaccaaaccauuuacuguaccaauacuuacaguagaagaaaugacaaacucuagauucccaauuccacucgaaagacucuacacaggaccaaguucagcaauaguaguacaaccacaaaacggaagaugcacaacagauggaguccuucucggaacaacacaacuaucagcaguaaauaucugcacauuuagaggugauguaacacacauagcaggcucacgcaacuacacaaugaacuuagcuucucaaaauuggaauaauuacgauccgacagaagaaaucccagcaccauuaggaaccccagacuuuguggguaaaauacaaggcauguuaacacaaacaacaagaucagacggaaguacaagaggacacaaagccacaguauuaacaggaucagcagacuuugcaccaaaacuuggaagaguacaauucgcaacagacacagacaacgauuuugaaucaggacaaaauacaaaauucacaccaguaggcguuauacaagacggaucaacaacacaccgaaaugaaccacaacaauggguacuaccaaauuacucagguagaacaggacauaauguccacuuagcuccugcaguagcaccaaccuauccaggcgaacaauuacuauucuuucgcucuaccaugcccggaugcucuggauauccaaacauggacuuagauugcuuacuaccccaagaauggguucaacauuuuuaccaagaagcagcaccagcacaaagugaugucgcacuauuaagauucguaaacccugacacaggaagagucuuauuugaauguaaacuacauaaaaguggauacguaacaguagcacacacaggucaacacgauuuaguuauuccaccaaauggauacuuuagauucgacucauggguuaaucaauucuauacacuagcaccuaugggaaaugguacaggaagaagaagauaa

SEQ ID NO: 33578 - RNA, 1617 nt, Artificial Sequence
  derived and/or modified sequence opt6 from VP1__Norovirus_and/or_Norovirus-like__KR131764
augaaaauggcaucaaaugacgcaaauccaucagauggaucaacagcaaauuuaguaccagaaguaaauaacgaagucauggcacuagagccaguaguaggagcagcuauagcugcaccuguugcaggccaacaaaaugucaucgauccauggauacgaaauaacuuuguacaagcuccaggaggagaauuuacaguuucuccucgaaaugcaccaggagaaauauuauggucugcaccacucggcccagauuuaaauccauauuuaucacauuuagcaagaauguacaacggauacgcuggagguuuugaaguacaaguaauacuagcaggaaaugcauucacugcaggaaaaauaauauucgcagcaguaccaccaaacuuccccacagaaggacuaucaccuucucaaguaacaauguuuccacauauaauaguugauguccgacaacuagaaccaguccuaauaccacuuccagacguaagaaauaauuucuaucauuauaaccaaagcaaugauccaacaaucaaacuaaucgcaauguuauacacaccacuaagagcaaacaaugcgggcgacgacguauuuacaguaucauguagaguccuaacaagaccaagcccagauuuugauuuuauauuccuuguaccaccaacaguugaaucacgcacaaaaccauuuacaguuccaauucuaacaguugaagaaaugacaaacucaagauuuccuauaccauuagaacgucuauauacuggacccucaucagcauucguaguacaaccucaaaacggucgcuguacaacagauggaguauuacuaggcacaacacaacuuuccgcuguuaacauuugcacauuucguggugacguaacgcauauugcaucuucuagaaauuacacaaugaauuuagcaucacaaaacuggaauaauuacgauccaacagaagaaauuccagcuccuuuaggaacaccugacuucguaggaaaaauacaaggaaugcuuacccaaacuacgaaaucugacggaucaaccagaggacacaaagccacaguacuaacaggaucagccgacuucgcaccuaaauuaggcagaguacaauucgcuacagacacagauaacgauuucgaaucaggacaaaauacaaaauucacuccagucggaguuauacaagacgguuccaccacacacagaaaugaaccacaacaauggguucucccaaacuacuccggaagaacuggucauaauguacaucuagcuccugcaguagccccaacauauccaggcgaacaauuauuauucuuuagaucaacuaugccaggauguucuggauacccaaauauggaucuagauugucuucucccacaagaauggguacaacauuuuuaucaagaagcugcaccagcacaaucggacguagcacuacuacgauucgucaauccugacacaggacgaguacuauucgaaugcaaauuacauaaaucagguuaugucacaguagcacacacaggucaacacgauuuagucauaccaccuaacggcuacuuuagauucgauaguugggucaaccaauucuauacacucgcuccuaugggaaauggaacaggaagacgaagauaa

SEQ ID NO: 33579 - RNA, 1617 nt, Artificial Sequence
  derived and/or modified sequence opt6 from VP1__Norovirus_and/or_Norovirus-like__GU390901
augaaaauggcuuccaacgaugcaaccccaagcgacggaucaacugcaaacuuaguaccagaaguaaacaaugaaguaauggcucuagaaccaguaguaggagccgcaauagcagcgccuguagcaggacaacaaaauguaaucgacccauggaucagaaauaauuuuguacaagcacccggaggugaauuuacugucucaccuagaaacgcaccaggagaaaucuuauggucagccccacuaggacccgauuuaaauccauaucucucacaucuagcaagaauguauaacggauacgcaggaggauucgaaguucaaguaauacuugcaggaaaugcauuuaccgcuggaaaaaucauauucgcagcaguaccaccaaacuuuccaacagaaggauuaucaccaucacaaguaacaauguuuccacacauaauaguagacguaagacaauuagaaccaguacuaauuccauuaccagauguaagaaacaauuucuaucacuacaaccaaucaaaugauccuacaauaaaauuaauagcaauguuauauacaccccuuagagcaaacaaugcaggagacgacguauuuaccguuucaugucgaguauuaacuagaccuucacccgacuucgauuuuauauuuuuaguacccccuacaguugaaucaaggacuaaaccuuucucaguaccaauauuaacaguugaagaaaugaccaauucuagauuuccgauaccacuugaaaaauuauucacaggcccaucaucugcauuuguaguacaaccacaaaauggcagaugcacaacugauggaguauuacuuggaacaacccaauuauccccuguaaauauauguaccuuuagaggugacgucacacauauuacaggauccagaaacuauacuaugaauuuagcaacacaaaacuggaacagcuaugacccaacggaagaaauaccagcuccacuaggaacccccgacuuuguaggcaaaauucaaggaguccuaacacaaacuacuagagcugaugguucaacacgaggacauaaagcaacaguuuauacagguucugccgacuuuucaccaaaacucggacgaguucaauucgcuacagauacugauaaugauuuugacgcaaaucaaaauacaaaauucacaccagugggaguaauucaagauggcgacacagcacacagaaaugaaccacaacaauggguacuacccucauacuccggaagaaacucgcauaauguucaccuagcuccagcaguugcaccaacuuucccaggagaacaauuauuauucuuuagaucaacaaugcccggaugcucuggcuacccaaauauggauuuagauuguuuacucccacaagaauggguacaauauuuuuaccaagaagcagcuccugcccaaucagacguugcacuacuacguuuuguaaauccagacacaggaagaguauuauuugaaugcaaauuacauaaaucaggauacguaacaguagcacacacaggacaacaugauuuaguaauaccaccaaauggauauuuuagauucgauucauggguaaaccaauuuuacacucuagcaccaaugggaaauggcacuggaagaagaagauaa

SEQ ID NO: 33580 - RNA, 1617 nt, Artificial Sequence
  derived and/or modified sequence opt6 from VP1__Norovirus_and/or_Norovirus-like__EU078408
augaaaauggcaagcaaugaugccucaccuucugacggcucaacagcaaacuuaguaccagaaguuaacaaugaaguaauggcacuagaaccaguaguaggagcagcuauagcugcuccuguagcuggacaacaaaaugucauagaccccuggauacgaaauaacuucguccaagcaccaggcggagaauuuacaguauccccaagaaaugcaccaggcgaaauacuuugguccgcaccauuaggaccagauuuaaauccauaucuaucacaccuagccagaauguacaaugguuaugcugguggauuugaaguucaaguaauacuagcaggaaaugcauucacagcaggcaaaauaauuuucgcagcaguaccaccuaacuuuccaacagaaggacucucaccuucucaaguaacaauguucccacauauaauaguagacguaagacaguuagaaccuguauugauaccauuaccagauguaagaaauaauuucuaccacuacaaccaaucuaaugauccuacaauaaaauuaaucgcaaugcuauacacaccccucagagcuaacaaugcaggagacgacguauuuacaguaucaugcagaguucuuaccagaccaucacccgauuucgauuuuauauuuuuaguuccaccaacaguagaaucuagaacaagaccauucacaguaccaauauuaacaguagaagaaaugacuaacucucgauucccaauaccacuagaaaaacuuuuuaccgguccaucaggagcuuucguaguacaaccacaaaauggccguugcacaacagacggaguccuacuagguacaacacaacuuucuccaguaaauaucuguacauucagaggagauguaacacauauagccggaacacacgauuacacuaugaaucuugccucccaaaacuggaauaauuacgauccaacagaagaaauuccagcaccacuaggaacaccagacuucgucgguaaaauucaaggaguacuaucucaaacaacucguggagacggaagcacaagaggacacaaagcuacaguaucaacaggaagcguacauuucacaccaaaauuaggaucaguacaauucacaaccgacacaaauaacgaucuagaaacuggacaaaauacuaaauucacaccuguuggcguuguucaagacggaaacucaacacaucaaaaugaaccccaacaauggguacuaccaaacuauuccggaagaacaggacacaauguacaucuagcaccagcaguugcuccaacauuuccaggugaacaacuacuauucuuucgcucaacaaugcccggauguucaggauacccaaauaugaaucuugacugccuacucccacaagaaugggugcaacauuuuuaucaagaagcagcucccgcccaaucagauguagcacuacucagauuuguaaauccagauacaggaagaguucucuucgaaugcaaauuacacaaaucaggcuauguaacaguagcucacaccggacaacacgaccuaguuauaccaccuaauggauauuuucguuucgauuccuggguaaaucaauucuacacucuugcaccuaugggaaauggagcagguagaagaagauaa

SEQ ID NO: 33581 - RNA, 1617 nt, Artificial Sequence
  derived and/or modified sequence opt6 from VP1__Norovirus_and/or_Norovirus-like__AB933676
augaaaauggcauccaacgaugcaaauccaagcgauggaucagcagcuaaccuaguaccugaaguuaauaacgaaguaauggcucucgaaccuguuguuggagcagcuauagcugccccaguagcuggacaacaaaauguaauagauccauggauuagaaauaauuuuguacaagcaccaggaggagaauuuacaguaucaccaagaaaugccccaggagaaauccuauggucugcccccuuaggaccagauuuaaauccauaucuaucgcacuuagcaagaauguauaacggauacgcaggcggcuuugaaguacaaguaauacuagcaggaaaugcuuucacagcagguaaaauaauauucgcagcaguaccuccaaacuucccuacagaaggacucucacccucacaaguaacaauguucccacacauaaucguugacguccgacaauuagaacccguuuuaauaccauuaccagacguaagaaauaacuuuuaucacuacaaucaaucaaaugacucaacaauuaaacucauagcaaugcuuuacaccccucuaagagccaauaaugcaggagaugauguauuuacuguaucuugccgaguacuaacacguccuucaccugacuucgacuuuaucuuuuuaguaccaccuaccguugaaucucgaacuaaacccuucacuguaccaauacuuacaguagaagaaaugacuaacucucgcuuuccaauaccucuagaaaaauuauuuacaggaccaucuucugcauucguaguacaaccacaaaacggacguugcaccacagacggaguauuacuaggaaccacgcaauuaucaccaguaucuauauguacauuuagaggagacguuacacacauagcugguucacgugauuacacuaugaauuuagcaucccuaaacuggaauaauuacgauccaacagaagaaauaccugcaccauuaggcacaccugacuucguaggaaaaauacaaggaguucuaacacaaacaaccaaaggugauggcucaacucgaggacauaaagcaacgguuuauacaggauccgcaccauuuacaccaaaacucggaucaguccaauuuucaacagauacugaaaacgauuucgaaacacaucaaaacaccaaauucacacccguagguguuauucaagauggaucaacagcccaccguaacgaaccucaacaauggguacuuccaucauauucggguagaaacguacaaaauguacaucuagcgccagcaguagcaccuaccuucccaggugaacaauuacuauucuuuagaucaacuaugccaggaugcagcgguuacccaaauauggaucucgauugccuccucccacaagaauggguacaacauuuuuaucaagaagcagccccagcccaaucagauguagcccuuuuaagauuuguaaauccagacacaggaagaguauuauuugaauguaaguuacauaaaucaggauauguaacuguagcucacaccggacaacaugaccuuguaauaccaccaaaugguuacuuuagauuugauuccuggguaaaucaauuuuauacacucgcuccaaugggaaacggaacaggaagacgaagauaa

SEQ ID NO: 33582 - RNA, 1617 nt, Artificial Sequence
  derived and/or modified sequence opt6 from VP1__Norovirus_and/or_Norovirus-like__KX354082
augaaaauggcaaguaaugacgcaaacccaucagauggaucagcagcaaaccuaguaccugaaguuaauaacgaaguaauggcacucgaaccugucguaggagccgccauagcagcacccguagcaggucaacaaaauguaauagacccuuggauuagaucuaauuuuguacaagccccuggaggagaauuuacaguuucaccucguaacgcacccggagaaauacuauggucagcaccauuaggacccgaucuuaacccuuacuuaucacaccuagcaagaauguauaauggauaugcaggcggauucgaaguacaaguuauauuagcaggaaacgccuucacagcaggaaaagucauauucgcagcaguuccaccaaacuucccuacagaaggauuaucaccaucacaaguuacuauguucccacacauaauuguagacguaagacaauuagaaccaguccuaauaccauuaccagauguaaggaacaauuuuuaccauuauaaucaauccaacgacucuacaauaaaacucauagcaauguuauauacuccacucagagcuaacaaugcuggugaugacguuuuuacaguaucaugcagagucuuaacucgaccuucacccgauuucgacuuuauauuccuuguuccacccacaguagaaucacgaacaaaaccuuuuaccguucccauauuaaccguagaagaaaugacaaacuccagauucccaauaccacuagaaaaauuauuuacaggaccaucaucagcauucguuguccaaccucaaaacggaagaugcacaacagacggaguauuacuaggaacaacacaauuaaguccaguaaacauauguacuuucagaggagacgucacucacaucgcaggaucucgaaacuauacaaugaaucuagcaucauuaaauuggaacaauuacgacccaacugaagaaauaccagcaccauuaggaacuccagauuucguaggaaaaauucaaggaguacuaacacaaacaacaaaaagagaugguucaaccagaggacauaaagcaacugucuauaccggauccgcagauuuuacaccaaaauuaggaucaguacaauucggaacagacacagaaaaugacuucgaaacacaucaaaauacaagauuuacaccaguagguguaauacaagaugguucaacaacacauagaaaugaaccacagcaauggguacuuccaucauauucagguagaaauguucauaacguacacuuagcaccagccguagcuccaaacuuuccaggugaacaacuacuuuucuuuagauccacaaugccagguugcucugguuauccuaauauggaccuagauugccuccuaccucaagaauggguucaacauuuuuaucaagaagcagcuccugcacaaucagacguugcauuacuacgauuugucaacccagacacaggcagaguacuauucgaauguaaacuacauaaauccggauaugucacuguagcacauaccggccaacaugaccuaguaauaccuccaaauggauauuuuagauucgauucaugggucaaucaauucuauacauuagcaccaaugggaaacgguacaggcagaagaagguaa

SEQ ID NO: 33583 - RNA, 1617 nt, Artificial Sequence
  derived and/or modified sequence opt6 from VP1__Norovirus_and/or_Norovirus-like__KJ407076
augaaaauggcaucaaaugacgcaaguccaucagacggaucaacagcaaaucuuguuccagaaguuaauaaugaaguaauggccuuagaaccaguuguaggugcagcaauagcugcuccgguagcaggacaacaaaacguaaucgauccauggauaagaaacaauuuuguucaagcaccaggaggagaauuuacaguuucaccacgaaaugcaccaggagaaauacuauggucugcaccacuaggaccugauuuaaacccuuaucuuucacauuuagcaagaauguacaauggauaugcaggaggauucgaaguccaaguaauauuagcaggaaaugcauucacagccggaaaaauaauauuugcagcaguaccucccaacuuucccacugaaggccucagcccaagccaaguuacaauguuuccacauauaauugucgacguaagacaacucgaaccaguacuaauuccauuaccagauguaagaaauaauuuuuaucacuauaaccaaucuaacgauaguacaauaaaauuaauagcaaugcuauacacaccacuuagagcaaauaaugcaggcgaugacguauuuacaguauccuguaggguuuuaacacgaccaucaccagauuuugauuuuauauuccuaguaccaccaacuguagaaucaagaacaaaaccauuuacaguuccaauucuaaccguagaggaaaugucaaacucaagauucccuaucccauuagaaaaacuauacacaggaccauccucagcauuuguaguucaaccacaaaacggacguugcacgacagacgguguucuucuagguacaacacaacuaucagccguaaacaucuguacauucagaggagacguaacccauauagcaggaucacaugacuauaccaugaaucuagcaucucaaaacuggaacaacuacgacccuacugaagaaauaccagcaccauuaggaacaccagauuuuguagguaaaauacagggaauguuaacucaaacaacaagagaagacggcucaacacgcgcccauaaagcaacuguauccacuggaucaguccauuuuacaccaaaacuaggaaguguacaauauaccacagauacuaauaacgauuuucaaacaggacaaaacacaaaauuuacuccaguuggcguuauacaagauggaaauaaucaucaaaaugaaccacaacaauggguauuaccaaacuauuccggaagaacaggacacaauguccaccuagcaccagcaguagcacccacauucccaggagaacaauuacuauucuuuagaucaacaaugccugguuguucuggauacccaaauaugaaucuagauugcuuacucccacaagaauggguccaacauuuuuaccaagaagcagcaccagcacaaucugaugucgccuuauuaagauuuguaaacccagauacaggccgaguauuauucgaauguaaauuacauaaaucugguuacguaacaguagcacacacaggaccucaugauuuaguuauaccaccuaacggauauuuucgauucgacagcuggguaaaucaauuuuauacacucgcaccuaugggcaauggcgcaggccgacguagagucuaa

SEQ ID NO: 33584 - RNA, 1617 nt, Artificial Sequence
  derived and/or modified sequence opt6 from VP1__Norovirus_and/or_Norovirus-like__JX459636
augaaaauggcaagcaaugacgcaaguccaucagauggauccgcggcaaacuuaguuccugaagucaauaaugaaguuauggcauuagaaccuguaguuggugcagcuauagcagcaccaguagccggacaacaaaauguaauagaccccuggauaagaaauaauuucguucaagcaccagguggagaauuuacaguaucaccuagaaacgcaccaggagaaauauuaugguccgcaccacuuggaccagauuuaaauccauauuugucccaccuagccaggauguauaauggauacgcaggcggauuugaaguccaaguaauacuagcaggaaaugcuuucacagcuggaaaaauaauauucgcugcagucccaccaaacuuuccaacagaaggacuuuccccaucacaaguaacaauguuuccacacauaauaguagauguaagacaacuagaaccuguucuaaucccauuacccgauguaagaaacaauuucuaccacuacaaccaaucaaaugacucaacaauaaaacuaauagcaaugcuauacacuccauuaagagcuaauaacgcaggagaagaugucuuuacaguauccuguagaguacucaccagaccuagcccagacuucgacuuuauuuucuuaguuccaccaaccguugaaucaagaacaaaaccauuuacuguaccuauauuaacagucgaagaaaugacuaacucuagauuuccaauaccacucgaaaaacuauucacagguccaucaucugcauucguuguacaaccacaaaacggaagauguacaacugacgguguccuucuaggaacaacccaauuaaguccaguaaacauauguacuuuucgaggugacgucacacauauagcuggaucaagagauuacacaaugaacuuagcaucauuaaacuggaauaacuaugauccaacagaagaaauaccugcaccccuaggaaccccagauuuugucggcaaaauacaagguguacuaacccaaacaacaaaaggagacgguuccacucgaggacauaaagcaacuguauacacagguucagcaccauuuacaccaaaauuaggaucaguccaauuuucaaccgauacagaaaacgacuucgaaacacaucaaaauacaaaauuuacaccaguaggaguaauacaagacggaucuacaacacacagaaacgaaccucaacaauggguacuaccaucauauucaggacgaaauguacagaauguccacuuagcaccagcaguagcaccuacauuccccggagaacaauuacuuuucuuuagaucaacaaugcccgguuguucaggauauccgaacauggaucuagauugccugcuaccacaagaauggguacaacauuuuuaucaagaagcagccccagcacaaucagaugucgcauuacuacgauuuguaaauccagacacaggucguguauuauucgaaugcaaauuacacaaaucuggauaugucacaguagcucacacaggccaacaugauuuaguuaucccaccaaauggauauuuuagauucgauucauggguaaaucaauuuuacacucuagcaccaaugggaaauggaacuggaagacgaagauaa

SEQ ID NO: 33585 - RNA, 1617 nt, Artificial Sequence
  derived and/or modified sequence opt6 from VP1__Norovirus_and/or_Norovirus-like__JX445161
augaaaauggccucaaaugacgccacuccuucagauggcucuacagcuaaccuaguuccagaaguaaacaaugaaguaauggcauuagaaccuguaguaggagccgcaauagcugcaccuguagccggacaacaaaaugucaucgauccauggauccgaaacaacuucguacaagccccaggaggagaauuuacaguaucaccaagaaaugcuccgggagaaauauuauggucagcaccacuaggaccagaucuaaauccauauuuaucucacuuagcucgaauguacaauggauaugccggaggauucgaaguacaagucauucuagcuggaaaugcauuuacagcaggcaaaauaauuuuugcagccguaccacccaauuucccaacugaaggauuaucaccaagucaaguuacaauguucccucacauuauaguagauguuagacaacuugaaccaguucuaauaccacuaccagauguaagaaacaacuucuaucacuauaaccaauccaaugacccaacuauaaaacuaauagcuauguuauauacaccauuaagagcaaacaaugccggugaugacguauuuaccguuucaugccgagucuuaacaagaccuucaccugacuuugauuuuauauuucuaguacccccuaccguagaaucacgaacuaaaccauucucaguacccauacuaacagucgaagaaaugacaaacucaagauuuccaauaccauuagaaaaacuauuuacaggaccauccucugcauucgucguacaaccucaaaauggacgaugcacaacagauggaguccuauuaggcacaacacaauuaucaccuguaaauauuuguacauuuagaggugacguuacucauauaaccggcagccgcaauuacacaaugaaucucgcaacacaaaauuggaacuccuaugauccaacagaagaaauaccagcaccauuaggcacaccagauuuuguaggaaaaauacaaggaguauuaacacaaacaacacgagcagauggauccacaagaggccacaaagcaacaguauauaccggaucugcagacuuugcaccaaaauuaggcagaguacaauuugcaacagacacagacaacgauuuugaugccaaccaaaauacuaaauucaccccagucggaguuauacaagauggagacacagcacauagaaaugaaccacaacaauggguuuuaccaucauauucaggaagaaauucacacaauguacauuuagcuccagcuguagccccaacauuuccuggugaacaacuauuauucuuuagaucaacuaugccaggcugcucugguuacccaaauauggaccuagacugccuuuuaccacaagaauggguacaauacuuuuaucaagaagccgcgccagcacaaucagacguagccuuacuaagauuugucaauccggacaccgguagagucuuauucgaaugcaaacuucacaaaucaggauauguaacagucgcccauaccggucaacaugacuuaguaauaccaccaaaugguuauuuccgauucgauucaugggucaaucaauuuuauacacuagcaccaaugggaaauggaacugguagaagaagauga

SEQ ID NO: 33586 - RNA, 1617 nt, Artificial Sequence
  derived and/or modified sequence opt6 from VP1__Norovirus_and/or_Norovirus-like__EU876888
augaaaauggcaucaucggacgcuucaccuagcgaugguucagcagcuaacuuaguaccagaaguaaauaaugaaguuauggcucuagaacccguuguuggagcagcaauagcagcaccaguagcaggucaacaaaauauaauagacccuuggauaagaaacaacuucguucaagcgccaggcggagaauuuacugugucaccacgaaacgcaccaggagaaauacucuggagugcaccuuuaggccccgaccuaaauccauauuuaucgcaccuaucaagaauguauaacgguuacgcaggaggauucgaaguacaaguuauacuagcaggaaaugccuuuacagccggcaaagucauauucgcagcaguaccaccaaauuucccuacagaaggucuaucaccaucucaaguaaccauguucccacauauaauaguagauguaagacaacuagaaccaguacucaucccauuacccgauguaagaaauaauuuuuaucacuauaaccaaacaaaugauccaacaaucaaauuaauagcuaugcuuuauaccccacuucgagcaaacaacgccggagacgacgucuuuacagugucauguagaguccuaacuagaccaucaccugauuucgacuuuauuuuucuuguaccaccaacaguagaaucacgaacaaaaccauucacaguaccuauauuaacuguugaagaaaugaccaauucaagauuucccauuccauuagaaagacuuuacacaggaccaucuucagcuuucguaguacaaccacaaaacggaagauguacaacagacggagucuuguuaggaacuacacaauuaagugcaguaaacauauguacauuuagaggagauguaacacauauagcaggaucuagaaauuacacaaugaauuuagcaagccaaaacuggaacaacuaugauccaacagaagaaauaccagcaccacuaggaacaccagacuuuguaggcaaaauacaagguauguuaacacaaacaaccagaggugacgguucaacaagaggucacaaagcaacaguauauacaggaucagccgacuuugccccaaaauuaggaagaguccaauucgcaaccgauacugauaacgacuucgaaagcaaccaaaauacaaaauuuacucccguaggaguaauacaagacggaaauacaacccauagaaaugaaccacaacaauggguacuaccagguuauucaggaagagauggacauaauguacacuuagccccugcaguagcaccaacauauccaggagaacaacucuuauuuuuccgaucuaccaugcccggauguucuggauauccuaacauggacuuagauugucuuuuaccacaagaauggguucaacauuucuaucaagaagcugcaccagcacaaucagaaguagcacuauuaagauuuguaaacccugacacagggagaguccucuucgaaugcaaacuacauaaaucaggguauguaaccguagcacacacaggacaacaugauuuaguaauaccaccaaauggauauuuuagauucgauuccugggucaaccaauucuauacccuugcuccaaugggaaacggagcagguaggagacgauaa

SEQ ID NO: 33587 - RNA, 1617 nt, Artificial Sequence
  derived and/or modified sequence opt6 from VP1__Norovirus_and/or_Norovirus-like__EU839584
augaaaauggcuuccaaugacgcaacaccuuccgauggaucaacagcaaacuuaguaccagaaguaaacaaugagguaauggcauuagaaccagucgucggagcugcaauagcagcaccaguagcuggacaacaaaauguaauagacccuuggauaagaaacaacuuuguccaagcaccaggaggagaauuuacaguuuccccaagaaacgcaccuggagaaauccucuggucagccccucuuggaccugaucucaaccccuaucuaucccauuuagcaagaauguacaacggauacgcuggaggguucgaaguucaaguaauacuagccgguaaugcauuuacagcaggaaaaauaauuuucgcagcaguaccaccuaauuuccccaccgaaggauuaucacccucucaaguaacaauguucccacauaucauaguagacguuagacaacucgaaccaguccucauacccuuacccgauguaagaaacaacuuuuaccauuauaaucaauccaaugacccuacaauaaaacuaaucgcaaugcuuuacaccccacuaagagcaaauaacgcaggagacgacguauucacaguuuccugcagaguacuaacacgacccucucccgacuuugacuuuauauucuuaguuccaccaacuguagaaucuagaacaaaaccauucucaguaccuauauuaacaguagaagaaaugacuaacucuagauuucccauaccacuagaaaaauuauuuacaggaccaagcucugcuuucguaguacaaccccaaaacggaagaugcacaacagacggaguacuacuaggaacaacacaacuuucuccaguaaauauaugcacauucagaggugacguaacucacauagccggaacacaaaauuauacaaugaaucuugcaucacaaaacuggaauaauuaugaccccacagaagaaauacccgccccacuaggaacaccagacuuuguaggaaaaauacaaggaguauuaacacaaacuacaaaaagagacggaucaacccgaggacauaaagcuaccguaucuacagguucaguccacuuuacuccaaaauuaggaucuguacaauuuucaaccgauacaaguaacgacuucgaaauaggacaaaauacucgauucacucccguaggaguuguccaagauggauccacuacacaucaaaaugaaccucaacaauggguauuaccaaacuauucaggcagagauggucauaauguucauuuagccccggcaguagcaccuacauucccuggagaacaauuacuuuucuuuagaucaacuaugccagguugcagcggauacccaaacaugaaucuagauugccuauuaccacaagaauggguacaacacuucuaucaagaaucagcaccagcucaaucagacguagcacuacuacguuucguaaauccagauacaggcagagcauuauuugaaugcaaacuacacaaaucaggauaugucacaguagcacacacaggacaacaugaccuaguaaucccacccaaugguuauuucagauuugacucauggguaaaucaauuuuauacacuagcaccaaugggaaacggagcaggacguagaagauaa

SEQ ID NO: 33588 - RNA, 1617 nt, Artificial Sequence
  derived and/or modified sequence opt6 from VP1__Norovirus_and/or_Norovirus-like__KX354090
augaaaauggcaucuaaugacgcuaaccccucagacggaucggcugcaaaccuaguaccagaaguaaauaaugaaguaauggcauuagaacccguaguaggggcagcaauagcagcaccaguagcaggccaacaaaacguaauagauccauggauaagaucaaacuuuguacaagccccaggcggcgaauuuacaguaucaccccgaaacgcaccaggagaaauauuauggucugccccuuuaggaccagaucuuaauccauaucucucacauuuagcaagaauguauaauggauaugcaggaggauucgaaguacaaguuauacuagcaggaaaugcuuuuacagcaggaaaaauaauauucgcagcaguaccaccaaacuuccccaccgaaggacuauccccaucucaagucacaauguucccccauauaauaguagacguaagacaauuagaacccguucuaauaccauuaccagauguaagaaacaacuuuuaucacuacaaccaauccaaugauucaacuauaaaacuaauagcaaugcuauacacccccuuaagagcaaauaacgcaggcgaugacguauuuaccguuuccuguagagugcuaacuagaccaucacccgauuuugacuuuauauuucuagucccacccacaguagaaucuagaacaaaaccauuuacaguaccaauauuaacuguagaagaaaugacaaacagcagauuuccaauaccauuagaaaaauuauucacagguccaucuucagcuuucguaguacaaccacaaaaugguagaugcaccacagaugguguuuuacucggaacaacacaauuaucaccagugaauaucugcacauucagaggagacguuacacauauagcaggauccagaaacuacacaaugaaucuagcaaguuuaaacuggaauaauuacgacccaacugaagaaauaccugcaccauuaggaacgccugacuucguagguaaaauacaaggaguacuuacucaaaccacgaaaggagauggaucuacaagaggacacaaagccaccguauauaccgguagugcagacuuuacaccaaaacucggaucuguacaauuuggaacagauacugaaaacgauuuugagacacaucaaaauaccagauucacaccgguaggcguaauucaagauggaucaacuacacauagaaaugaaccucaacaauggguacuaccuucauacucagguagaaauguucauaacguacaucuugcucccgcaguagccccaaauuucccuggugaacaauuauuauucuuuagaucaacaaugccagguuguucaggauauccaaauauggaucuugauugccuacuaccacaagaauggguacaacauuuuuaucaagaagcugcaccagcacaaucagauguagcauuacucagauucguaaaccccgacacaggacgaguauuauucgaaugcaaacuacauaaaucaggauaugucacuguagcucacacaggucaacaugaccuaguaauaccuccuaauggauacuuucgauucgauucguggguaaaccaauucuauacucuagcaccaaugggaaacggaacuggcagaagaagauaa

SEQ ID NO: 33589 - RNA, 1617 nt, Artificial Sequence
  derived and/or modified sequence opt6 from VP1__Norovirus_and/or_Norovirus-like__KF060124
augaaaauggcaucaagcgaugcaaacccaucagauggaucugcugcaaaucuuguaccagaaguuaacaaugaaguaauggcacuagaaccaguaguuggagcugcaauagcagcaccaguugcaggccaacaaaauguaauagacccauggauaagaaacaacuucguacaagcaccuggaggagaguucacaguaucaccaagaaacgccccuggagaaauacuauggucagcaccucucggucccgauuuaaaccccuaucuuucucaccuugcaagaauguauaacggcuacgcaggaggauucgaaguucaaguaauccuugccggcaaugcauucacugcaggaaaaauaauauuugcagcagucccaccaaauuuuccaacugaaggacuaucacccucucaaguaacaauguucccucauauaauaguagauguuagacaauuagaaccaguauuaauaccuuuaccugacguaagaaacaacuuuuaccauuacaaccaaaguaacgacccuacaauuaaacucauagccauguuauauaccccacuacgugcaaacaaugcuggagacgauguuuucacuguaucuuguagaguacuaacacgacccucucccgauuuugauuuuauauuuuuaguuccuccaacaguugaaucucguacaaaaccauucucuguaccaguucuaacaguggaagaaaugacaaacucaagauuucccguaccacuagaaaaacuauuuacaggcccaucuagcgcauuuguuguacaaccacaaaauggacgcuguacuacagacggaguauuacuaggaacuacacaauuaucaccuguuaauauaugcacauucagaggagaugucacacauauaacaggcucacauaauuacacuaugaaucuagcaucacaaaauuggaacucauaugacccaacagaagaaauaccugcaccacuaggaaccccugauuucgucggcaaaauacaagguguacuuacacaaacgacaagagcugauggaagcacaagaggacacaaagcaacaguauauacaggaucagccgacuuugcaccaaaauuaggcagaguucaauuugcuacagauaccaacaacgacuuugaugcuaaucaaaauaccaaauucacaccaguaggcguaauacaagacggugacacagcacaucgaaaugaaccucaacaauggguauuaccaucauauagcggcagaaacucucauaauguucacuuagcuccagcaguagcaccuacauuuccaggagaacaacuauuauucuuuagaucaacaaugcccggauguaguggauaucccaauauggauuuagauugcuuacuaccucaagaauggguacaauacuucuaccaagaagcugcuccagcacaaucugauguugcacuacuaagauucguaaauccagacacaggacgaguuuuauucgaauguaaacuucauaaaucuggauacguaacaguugcacacacaggacaacaugaucucgucauaccuccaaauggauauuuuagauucgauucauggguaaaucaauuuuauacacuagccccaaugggaaacgguacaggacgacgaagauaa

SEQ ID NO: 33590 - RNA, 1617 nt, Artificial Sequence
  derived and/or modified sequence opt6 from VP1__Norovirus_and/or_Norovirus-like__JX439826
augaaaauggcaagcagcgaugcaaauccuuccgaugguucugcagcaaacuuaguaccagaaguaaauaaugaaguuauggcauuagaaccaguaguuggugcagcaauugccgcaccuguagccggacaacaaaauguaauagacccauggauaagaaauaacuucguacaagcaccaggcggagaauuuacaguuucucccagaaacgcaccaggcgaaauacuauggucagcaccacuaggcccagauuuaaacccauaucuaucacacuuagcacgaauguauaacggcuacgccggagguuucgaaguacaaguuaucuuagcaggaaacgccuuuacugcaggaaaaauaauauucgcugcaguuccacccaauuuuccaaccgaaggacuaucucccucucaaguuacaauguucccacacauaauaguagacguaagacaacuugaaccaguacucauacccuuacccgauguacgcaauaacuucuaucacuauaaccaaucuaaugauccuacaauaaaacuuauagcuaugcuuuacacacccuuaagagcuaacaacgcuggugacgaugucuucacagucucaugccgaguccuaacaagaccaucaccagacuucgacuuuauauuuuuagucccaccuacaguugaaucucguacaaaaccauuuucgguaccaauauuaacaguagaagaaaugacaaauuccagauuucccauaccacuugaaaaauuauucacaggaccaucauccgcauucguugugcaaccacagaauggaagauguacuacagacggaguacuauuagguacaacucaacuaucacccguaaauauaugcacauuucguggagacguaacccauauaacaggauccagaaauuacacaaugaaucuagcaacacaaaauuggaacucuuaugauccaacagaggaaauuccagcuccauuagguaccccagauuucgucggaaaaauacaaggaguacuaacacaaacaacaagagcugauggcuccacaagaggacacaaagcuacaguauauacuggaucagcugauuuugcaccaaaauuaggucguguacaauuugcuacagauacugacaacgacuucgaugcaaaccaaaacacaaaauucaccccaguaggaguuauacaagacggagauacagcccaccgaaaugaaccacaacaauggguccuuccaucauauucuggucguaacagccauaacguacauuuagccccagcaguugcaccaacauuuccaggagaacaacucuuauucuuuagauccacaaugccuggauguucuggcuauccaaacauggaucuugauugucuuuuaccacaagaauggguacaauauuucuaucaagaagcagcuccugcacaauccgacguagcauuacuaagauucguaaacccagacacaggcagaguucucuucgaaugcaaauuacacaaaucaggauauguaacaguagcacacacaggucaacaugaucuaguaauuccuccaaacggauauuuccguuucgauagcuggguaaaucaauucuauacacuagcacccaugggaaacgggacaggacgaaggcgauaa

SEQ ID NO: 33591 - RNA, 1617 nt, Artificial Sequence
  derived and/or modified sequence opt6 from VP1__Norovirus_and/or_Norovirus-like__JX439815
augaaaauggcuucuaaugaugcaaacccauccgauggauccacagcaaacuuaguaccagaaguuaauaaugaaguuauggcauuagaaccaguagucggugcagcaaucgcagcaccaguagcuggacaacaaaauguaauagauccuuggauacgaaacaacuuuguccaagcaccuggaggagaauuuacaguaucaccaagaaaugccccaggagaaauucuauggucagcaccccucgguccagaucuuaacccguaucuaucacaucuagcacgaauguauaacggauacgccggcggauuugaaguacaaguuauacucgcaggaaacgccuuuacagcaggcaaaaucauuuucgcagcaguaccaccaaacuuccccacagaaggacuuucacccucacaaguaaccauguucccucacauaauaguagacguuagacaacucgaaccaguucuaaucccauuaccugacguacgaaacaauuuuuaucacuauaaucaaucuaacgauccuacaauaaaauuaauagcaauguuauacaccccauuaagagcaaauaacgcaggagaugauguauucacaguauccugccgaguauuaacacgacccucaccagauuuugacuucaucuucuuaguaccacccacagucgaaucacguacaaaaccuuucucuguacccauucucacaguagaagaaaugacaaauaguagauuucccauacccuuagaaaaauuauuuaccgguccaucaagugccuuuguaguacaaccccaaaacggcagauguacaaccgauggaguauuacucgguacaacacaauuaucaccuguaaauauaugcacauuccguggugacguaacccauauaacaggaucaagaaacuauacaaugaaucuagccacacaaaacuggaacucauaugacccaacugaagaaauaccugcaccauuagguacaccagacuuuguugguaaaauucaaggaguauuaacacaaacaaccagagcugacggaucaacaagaggucacaaagcuacagucuauaccggaucagcagacuucgcaccaaagcuaggaagaguacaauucgcaacagauacagauaaugauuuugaugcuaaucaaaacacaaaauucaccccaguaggcguaauacaagauggagacacagcacacagaaaugaaccacaacaauggguacuaccuucauauucagguagaaauucacacaauguacaccuagcacccgcaguagccccaacauuccccggagaacaauuacuauucuuuagaucuacuaugccaggaugcucaggauacccaaauauggaccuagauuguuuacucccacaagaauggguucaauauuucuaucaagaagcagcaccagcacaaucagacgucgccuuacuuagauucgucaauccagacacuggaagaguauuauuugaauguaaauuacauaaaucaggauaugucaccguagcacauacaggacaacaugaucuagucauacccccaaacggauauuucagauucgauuccuggguaaaccaauucuacacccuagcaccaauggguaauggcacaggaagaagaagauaa

SEQ ID NO: 33592 - RNA, 1617 nt, Artificial Sequence
  derived and/or modified sequence opt6 from VP1__Norovirus_and/or_Norovirus-like__KC576912
augaaaauggccagcaaugacgcaaaccccucagauggaucugcugcaaacuuaguaccugaaguaaauaaugaaguaauggcauuagaaccaguagucggagcagcuauugccgcaccaguagccggacaacaaaauguaauagauccauggauaagauccaacuucguacaagcaccuggaggagaauuuacaguaucaccaagaaacgcaccuggagaaauauuaugguccgcaccauuaggaccagauuuaaauccauauuuaucacaccuagcaagaauguacaacggauacgcaggagguuuugaaguccaaaugaucuuagcaggaaaugcuuucacagcuggaaaaauuauauucgccgcuguaccacccaauuucccaacugaaggacuaucaccaucacaaguuacaauguucccacacauaauagucgacguaagacaacuugaaccaguauuaauacccuuaccagaugucagaaacaauuuuuaccauuacaaccaauccaaugaccccaccauaaaauuaauagcaaugcuauacacaccauuaagagcaaacaaugcaggcgacgauguauucacaguaucuuguagaguauuaacaagaccaucuccagauuuugacuuuauauucuuaguaccuccuaccguagaaucuagaacaaaaccauucacuguaccagucuuaacaguagaagaaaugacaaauucuagauuuccaauaccacuugaaaaauuauuuaccgguccaucuuccgcauuuguaguucaaccccaaaacggaagauguacaacagacggaguuuuacuaggcacaacacaauuaagcccaguaaauaucuguacauuuagaggcgacguuacacauaucgcuggauccagaaacuacacaaugaaucucgcaucucucaacuggaauaacuacgaccccacagaagaaauaccugcacccuugggaacaccugauuuuguaggcaaaauacaagguguacucacacaaacaacuaaaggcgacggaucuacaagaggacacaaagcaacagucuauacuggaucagcagacuuuacaccuaaauuaggaucaguacaauucgguacagacaccgauaacgacuucgaaacacaccaaaauacaagauuuacacccguaggaguaauucaagauggagcaacaacacauagaaaugaaccacaacaauggguccuaccaucauacucuggaagaaauguacauaacguacauuuagcacccgcaguugcaccaaacuuuccaggagaacaauuauuauucuuuagaucaacaaugccaggcugcuccggauacccaaacauggauuuagacuguuuacucccacaagaauggguccaacauuucuaucaagaggcugcaccagcacaaagugacguagcauuacuucguuucguaaaccccgauacaggcaggguccuauucgaauguaaacuacacaaaucaggauauguaacaguagcacacacaggacaacacgaucuaguaauaccaccuaauggauauuucagauuugauucauggguaaaucaauuuuacacucuagcaccaaugggcaaugguacaggcagaagacguuaa

SEQ ID NO: 33593 - RNA, 1617 nt, Artificial Sequence
  derived and/or modified sequence opt6 from VP1__Norovirus_and/or_Norovirus-like__GQ845368
augaaaauggcaucaucugaugcaucaccaucagacggaucugcugccaaccuaguaccagaaguaaacaacgaaguaauggcacuggaacccgucguaggugcugcuauugcagccccagucgcaggacaacaaaauauaauagacccauggauacgcaacaacuuuguacaagcaccuggcggcgaauuuacaguaucaccuagaaaugcacccggcgaaauauuauggucagcaccuuuagguccagauuuaaauccauacuuaucacaucucucaagaauguauaauggauaugcaggaggauuugaaguccaagucauacuugcagguaacgcauuuacagccggaaaaguaauauuugcagcuguaccaccaaacuuccccacagaaggucuaucaccuucucaagucacuauguuuccacacauaauagucgacguuagacaauuggaacccguauuaauaccauuaccagauguucgaaauaauuucuaucacuacaaucaaacuaaugacccaacaauaaaauuaauagcaaugcuauacacaccauuaagagcaaacaaugcaggagaugauguauuuacaguaucaugucgaguacuaacacgaccauccccagauuuugacuuuauauuuuuaguuccaccaacaguagaaucuagaacaaaaccguucacagucccaauauuaacaguugaagaaaugacuaacucuagauucccaauaccauuagaaagacuauauaccggaccaagcucagcauuuguuguacaaccucaaaacggacgauguaccacagacggaguuuuauuagggacaacucaacuauccgccguaaauaucugcacauuccgaggagauguaacucacaucaccggcucaagaaauuacacaaugaaccuggcaucgcaaaauuggaacaacuacgauccaacagaagaaauaccagcaccccuaggcacaccagacuuuguaggaaaaauacaaggaaugcuaacacaaacuacacgaggagaugguucaacacgaggacauaaagcaacaguauauaccggaucagcagacuucgccccuaaauuaggacgaguucaauucgcaaccgacacagacaaugauuuugaaucaaaccaaaacacaaaauuuacaccuguaggaguaauccaagacggaaacacaacccaucaaaaugaaccacaacaauggguucuaccuggcuacucaggucgagauggucauaauguacacuuagccccugcaguagcaccuacauauccaggagaacaacuauuauucuuccgaucaacaaugccaggaugcucaggauauccuaauaugaaucuagauugcuuacuaccacaagaauggguucaacauuuuuaucaagaagccgcuccagcacaaucagaaguagcacuacuaagauucguaaaucccgauacuggucgaguccuauucgaaugcaaacuacauaaaucaggauauguuacuguagcacauacaggacaacaugaucuuguaauuccaccaaaugguuauuucagauuugacucauggguaaaucaauuuuauacucuagcaccaaugggaaauggagcaggaagaagaagauaa

SEQ ID NO: 33594 - RNA, 1617 nt, Artificial Sequence
  derived and/or modified sequence opt6 from VP1__Norovirus_and/or_Norovirus-like__AB541249
augaaaauggcaucaaaugaugcuaacccuagcgauggaucagcagcuaauuuagucccagaaguuaauaacgaaguaauggcccuagaaccaguaguaggagcagcaaucgcugcaccaguugcuggacaaacaaacguuaucgauccauggauccguaauaacuuuguacaagcaccagguggagaauuuacaguuuccccaagaaacgcaccuggagaaauauuaugguccgcacccuuaggacccgaccuaaacccauaucuaucacauuuagccagaauguauaacggauacgcaggagguuucgaaguacaaguaauacuagcaggaaacgccuucacagcaggaaaaauaauauucgcagcaguacccccaaacuuuccaacagaagguuuaucaccaucacaaguaacaauguucccacacauuaucguagacgucagacaauuagaacccguuuugauucccuuaccagauguuagaaauaauuucuaucacuauaaccaaucuaaugacucaacaauuaaauuaaucgcaaugcuauauacaccauuaagagcaaacaaugccggagaagacguauucaccguaaguugcagaguacuuacaagaccaucaccagacuuugauuuuauauuucuaguuccgccaacuguugaaucaagaacaaaaccauucacaguaccaauacuuacagucgaagaaaugaccaacucaagauuuccaauuccauuagaaaaauuauucacuggcccaaguggagcauucguuguacaaccccaaaauggaagauguaccacagauggaguacuuuuagguacaacacaauuaucaccuguaaacauauguacauuuagaggagacguaacacauauugcagguucucgugacuauacaaugaaucuugcauccuuaaacuggaacaauuacgaccccacagaagaaauaccagcaccccuaggaacacccgacuuuguaggaaaaauacaaggaguacuaacacaaacaacaaaaggugacggaucaacuagaggucacaaagccacaguauauacaggauccgcccccuuuacucccaaacuaggaucuguucaauucucaacagacacugaaaaugacuuugaagcacaucaaaauaccaaauucacaccugucgguguuauccaagacggauccaccacccauagaaacgaaccucaacaauggguauuaccuucauauucuggcagaaacguacaaaacguucacuuagcaccagcaguagcaccuacauucccaggagaacaacuauuauucuuuagaucuacaaugccagguuguuccggcuacccaaauauggaucuagauugccuauuaccccaagaauggguacaacauuucuaucaagaagcagcuccagcacaaucugacguagcucuacuaagauucguaaaccccgacacuggaagaguucuuuucgaaugcaaauuacauaaaucaggauacguuacaguagcacauacaggacaacacgaccucguaauacccccaaauggauauuuccgguucgacuccuggguaaaucaauuuuacacacucgcaccaaugggaaacggaacaggacguagaagauaa

SEQ ID NO: 33595 - RNA, 1617 nt, Artificial Sequence
  derived and/or modified sequence opt6 from VP1__Norovirus_and/or_Norovirus-like__EU078412
augaaaauggcaucaaacgacgcuuccccuucagacggcucuacagcaaaucucguaccugaaguaaauaaugaaguaauggccuuagaaccaguaguaggagcagcaaucgcugcaccaguagccggccaacaaaacguaauagacccauggauaagaucaaacuuuguucaagccccagguggugaauuuacaguauccccacgaaaugcacccggagaaauacuuuggucagccccauuaggaccagaucuaaauccauauuuaucacaucuagcaagaauguauaacgguuaugcaggcggauuugaaguacaaguaauauuagcaggaaaugcuuucaccgcaggaaaaauuauuuucgcagcuguaccaccuaacuuucccacagaaggacuaucaccaucacaaguuacaauguucccacacauaauaguagauguaagacaauuagaaccaguauuaauaccccuaccagauguaagaaacaauuuuuaccauuacaaucaacuaaaugacccaacuauaaaauuaauagcuaugcuuuacacaccacuuagagcaaacaaugcuggugacgauguuuucacaguuucaugucgaguacuaacaagacccucuccugacuucgacuuuaucuucuuaguaccaccuacaguugaaucaagaacaaaaccauucacaguuccaauacuaacaguagaagaaaugaccaauucuagauucccuauaccauuagaaaaauuauuuacagguccaucaggagcuuucguaguucaaccccaaaacggacgauguaccacugaugguguauuacuaggaacuacucaauuaaguccagucaauauuugcacuuuccgaggcgauguuacacauauugcaggaacucacgauuauacuaugaaccuagcaucucaaaacuggaauaacuacgacccaacagaagaaauaccugcaccauuaggcaccccugauuuuguaggaaaaauucaaggugucuuaacccaaaccacacgaggagacggaucuacaagaggucauaaagcaacugucuccacagguucaguucacuucaccccuaaauuaggcuccguacaauucacuacugauacaaauaacgaucuagaaacaggacaaaacacaagauucacacccguggguguaguucaagacgguaacucaacacaucaaaaugaaccccaacaauggguucuaccaaacuauucagguagagcuggucauaacguacaucucgccccugcaguagcuccaacauuuccaggcgaacaacuauuauucuuuagaucaacaaugcccggaugcucuggauauccaaacaugaauuuagauugccuacucccacaagaauggguacaacauuucuaccaagaagccgcuccugcucaaucagacguugcauuacuuagauuuguuaauccagauacaggccgagucuuauuugaaugcaaacuccauaaaucuggauauguaacaguagcucacacaggacaacacgacuuaguaaucccaccaaacggauauuuuagauuugauucauggguaaaccaauuuuacacacuugcacccaugggaaauggugcagguagaagaagauaa

SEQ ID NO: 33596 - RNA, 1617 nt, Artificial Sequence
  derived and/or modified sequence opt6 from VP1__Norovirus_and/or_Norovirus-like__AB445395
augaaaauggcuucaagugacgcaaauccaucagauggaucuacugcaaaucucguaccagaaguuaacaacgaaguaauggcauuagaaccaguaguaggagcagcaauagcugccccaguagcuggucaacaaaauguaauagauccauggaucagaaacaacuuuguccaagcaccuggaggagaauuuacaguaucaccaagaaacgcucccggcgaaaucuuauggucagccccauuaggccccgauuuaaauccauauuuaucccaucuugcacgaauguauaacggauaugccggaggauucgaaguacaaguaauacuagcgggaaaugccuucacagcaggaaaaauaauauucgcagcuguuccuccaaauuucccaacagaagguuuaucuccaucacaaguaacuauguucccacauauaaucguagacguaagacaacuagaaccuguacuuauaccucucccagacguaagaaacaauuucuaucacuauaaucaaucaaaugacccaacaauaaaacuuauagcaaugcucuacacaccucuacgugcuaauaaugcuggugaugauguauuuacaguaucauguagaguauuaaccagacccucaccagauuuugacuuuauauuucuagucccaccaacaguugaaucaagaacaaaaccauuuucuguaccaauauuaaccguagaagaaaugacaaauucaagauuuccaauaccuuuagaaaaacuauuuacagguccaucaagugcauucguaguacaaccacaaaacggaagauguacaacagacggaguauuacuaggaacaacacaauuauccccaguaaacauauguacuuuuagaggcgacguaacccauaucacaggaucuagaaauuauacaaugaaucuagcaacucaaaauuggaacucauaugauccaacagaagaaauaccagcaccacuaggaacaccagacuuuguaggaaaaauacaaggcgugcuaacucaaacuacaagagcugauggaucaacuagaggacauaaagcaaccguauauacaggaucagcagauuucgcaccaaaacucgguagaguccaauuugcaacagacacagauaaugauuuugaugcuaaccaaaauacuaaauucacacccguaggcguaauacaagauggugauacagcacaucgaaaugaaccucaacaauggguauuaccaucauacucaggcagaaauaaccacaauguccaucuagcaccagcaguugcaccaacauucccaggagaacaacucuuauucuuuagaucaaccaugccaggaugcucuggcuauccaaauauggacuuagauugccuacuaccccaagaauggguucaauauuuuuaucaagaagccgcaccagcacaaucagacguagcacuacuaagauuuguaaauccagauacaggaagaguacuauuugaaugcaaacuccauaaauccggauacguuacugucgcucauacaggacaacaugauuuaguaauaccaccaaauggauauuucagauuugauucauggguaaaccaauuuuauacacuagcccccauggguaauggaacaggaagaagaagauaa

SEQ ID NO: 33597 - RNA, 1617 nt, Artificial Sequence
  derived and/or modified sequence opt6 from VP1__Norovirus_and/or_Norovirus-like__AB933655
augaaaauggcuucaaaugacgcaaacccaucugaugguucagcugcaaaccuagucccugaaguaaacaacgaaguaauggcauuagaacccguuguuggugcagcuauagcagcaccaguagcaggacaacaaaauguaauugauccauggauaagaaacaauuucguccaagcaccaggaggagaauuuacuguuucaccacgcaacgcuccuggagaaauacuauggucugccccacucggaccugaccuaaacccauaucuaucacacuuagcacgaauguauaauggcuaugcaggaggauucgaaguacaaguaauauuagcagguaaugcauucacugcuggaaaaauaauauuugcagcagucccacccaacuuuccaacagaaggccuaaguccaagccaaguaacaauguucccucacauaaucgucgacguuagacaacuagaaccaguacuaauuccacucccagacguacgaaacaacuuuuaccauuacaaucaaagcaacgacucaacaauuaaacuaauagcuaugcuauacaccccacuaagagcuaauaaugcaggagacgauguuuucacuguaucuugucgcguauuaacucgccccucaccagacuuugauuucauauucuuagucccacccaccguagaaucucgaacaaaaccauuuacaguaccaaucuuaacaguagaagaaaugacuaauucaagauuuccuauaccauuagaaaaauuauuuacaggaccauccucugcauucguaguacaaccucaaaauggaagauguacaaccgacggaguauuacuaggaacaacacaacuaucaccaguuaauauauguacauuuagaggagacguuacacauauagcagguaguagaaacuacacaaugaauuuagcuucuuuaaauuggaacaacuacgauccaacagaagaaauaccagcaccacuaggaacaccagauuuuguaggaaaaauacaaggugucuuaacacaaaccacuaaaggugaugguaguacaagaggacacaaagcaacaguguacacaggauccgcagauuuuacaccaaaauuaggauccguacaauucggaacagauaccgaaaacgauuucgaaacacaucaaaauacaaaauucaccccaguaggaguaauacaagauggaucgacaacccaccguaacgaaccucaacaaugggucuuaccuucauauaguggaagaaacguacauaacguccaccuagccccugcaguugcaccaaacuuuccaggugaacaauuacuauuuuucagaucaacaaugccuggaugcucugguuauccaaauauggauuuagauugcuuacucccucaagaauggguacaacacuucuaucaagaagccgcaccagcacaaucagacguugcacuacuaagauucguaaacccagacacaggucguguauuauuugaauguaaacuacauaaaucaggcuauguaacaguagcucacacaggccaacaugaucuaguuauaccaccaaacggauauuucagauucgacucauggguaaaucaauucuacacacucgcacccaugggaaauggaacaggaagaagaagauaa

SEQ ID NO: 33598 - RNA, 1617 nt, Artificial Sequence
  derived and/or modified sequence opt6 from VP1__Norovirus_and/or_Norovirus-like__KM245072
augaaaauggcuucaagugacgcaaacccaucagacggaagcacagcaaacuuagucccugaaguaaacaaugaaguuauggcauuagaaccagucguaggagcagcaauagcagcaccaguagcaggacaacaaaauguaaucgauccauggauaagauccaauuucguacaagcaccaggaggagaauuuacaguaucaccacguaaugcaccuggcgaaauacucuggucagccccacuuggcccagaccucaaucccuaccuaucacaucuagcaagaauguauaacggauaugccggaggauuugaaguacaaguaauauuagcaggaaaugcauucaccgcaggcaaaauaauuuuugcugcaguuccaccuaacuuuccaacugaagguuuaucacccucucaaguaacuauguucccucacauaauaguagacguaagacaacuugaaccaguauuaauaccauuacccgauguaagaaacaacuucuaucacuacaaucaaucaaaugaucccacaauaaaacuaauagcaaugcuuuauacuccacuucgugcaaacaaugcaggagaugauguauucacaguaucaugucgaguacuuacacgaccaucuccagacuuugacuuuauauuuuuaguaccacccacaguagaaucccggacuaaacccuucucaguaccaauacuuacaguagaagaaaugaccaacucaagauuuccaauaccucuagaaaaacuauuuacaggaccaucuucagcauucguaguacaaccucaaaacggccgauguacaacugacggaguacuacuuggaaccacacaguuaucaccaguaaauauauguacauuuagaggagauguaacacacauaacuggauccagaaauuauacuaugaauuuagccacccaaaauuggaacucauacgauccuacugaagaaauaccagccccacuaggaacaccagauuuuguaggaaaaauacaaggaguacucacacaaacaacacgagcugacggaucaacaagaggccauaaagcaacaguauauaccggaucagcagauuuugcaccaaaacuaggaagaguacaauucgcaacagauacagacaaugauuucgacgcaaaccaaaauacaaaauucacacccguuggaguaauacaagacggagauacagcccauagaaaugaaccacagcaauggguucuaccaaguuauucagguagaaauucucauaauguucauuuagcaccagccgucgcaccaaccuuuccaggagaacaacuacuauucuuuagauccacaaugccaggaugcucugguuacccaaacauggaucuagauugcuuauuaccacaagaauggguacaauauuuuuaucaagaagccgcuccagcccaaucagauguagcacuacucagauucguaaacccagauacaggaagagucuuauucgaaugcaaauuacauaaaucuggauaugucacaguagcacauacuggccaacacgacuuaguaauaccaccaaacgguuauuuuagauucgauucauggguuaaccaauuuuauacacucgcucccaugggaaauggaacuggacguagaagauaa

SEQ ID NO: 33599 - RNA, 1617 nt, Artificial Sequence
  derived and/or modified sequence opt6 from VP1__Norovirus_and/or_Norovirus-like__AB541282
augaaaauggcaucaaacgaugcaaacccuucagacggaucagcugcuaaccucguaccagaaguuaauaacgaaguaauggcuuuagaaccaguagucggagcugcaauagcugcaccaguugcaggucaaacaaauguaauugauccauggauaagaaacaauuucguacaagcuccaggaggagaauuuaccguuucccccagaaaugccccaggagaaaucuuauggucugcaccucuagguccugaucuaaauccauaucuaucccaucuugcaagaauguauaacgguuaugcaggaggauuugaaguccaaguuauauuagcuggaaaugcauuuacagcaggcaaaauaauauucgcagcaguaccucccaacuuuccaacagaaggacuaagccccucacaaguuacaauguuuccccacauaauagucgaugucagacaauuagaaccaguacuaauaccauuacccgacguuagaaacaauuucuaucauuacaaccaaucaaaugacucuacaauaaaauuaauagcaauguuauauaccccacuaagagcaaacaaugccggugacgaugucuuuacaguaucuugucgaguacuaacaagaccaucaccugacuuugauuuuauauuucuaguuccaccaacagucgagucucgaacaaaacccuuuacaguaccaauauuaacagucgaagaaaugacuaacucacgcuuucccauuccacuagaaaaacuauuuaccgguccaucuggagcauuugucgugcaaccccaaaacggaagauguacaacagacggaguacuacuuggaacaacucaauuaucaccuguaaauauauguacuuuucgaggagacguaacacacauugcaggcucuagaaacuauacaaugaauuuagcaucauuaaacuggaacaauuacgauccuacugaagaaauacccgcacccuuaggcacaccagacuucguagguaaaauacaagguguauuaacccaaaccacaaaaggagacggaucaacaagaggacacaaagcaacaguauacacuggaagugcaccauucacuccaaaacuaggaucaguacaauuuucaaccgauacagaaaacgauuucgaagcacaucaaaacacaaaauucacuccaguugguguuauacaagauggaagcacaacacaucgaaacgaaccccaacaauggguauuaccuucauacucaggacgaaauguacaaaauguucacuuagcuccugcaguagcaccuacauuucccggugaacaauuacuauuuuuccgaucaacuaugcccggcugcucaggauauccaaacauggauuuagauugccuacuaccccaagaauggguacaacauuucuaucaagaggcagcaccggcacaaucagauguagcuuuacuacgauuuguaaacccagauacaggaagaguacuauuugaaugcaaacuacauaaaucuggauaugucacaguugcacauacuggacaacacgaucuuguaauaccacccaacggauauuuccgauucgauucauggguuaaucaauuuuacacauuagcaccaaugggaaacggaacuggaagaagacgauaa

SEQ ID NO: 33600 - RNA, 1617 nt, Artificial Sequence
  derived and/or modified sequence opt6 from VP1__Norovirus_and/or_Norovirus-like__AB541202
augaaaauggcaucuucugacgcaaacccaucugacggaucuacagccaaccuaguaccagaaguaaacaaugaaguaauggcacuagaaccaguagucggagcagccaucgcugcuccuguagcuggacaacaaaauguuauagacccauggauaagaaacaauuuuguucaagcaccaggaggugaauuuacuguuucaccaagaaaugccccaggagaaauacuauggucagcaccucuuggaccagaucuaaaucccuaucuaucacacuuagcccgaauguacaacggauacgcaggcggauuugaaguacaaguaguuuuagcaggcaacgcauucacagcaggaaaaauaauauucgcugccgucccaccaaacuucccaacagaaggauuaucuccaucacaaguaacaauguucccacacauaauaguugacguaagacaauuagaaccagucuuaauaccuuuaccagaugucagaaauaauuucuaccauuacaaucaaagcaacgauccaacuauaaaacuaaucgcaaugcuauauacucccuuaagagcaaacaaugcaggagaugaugucuucacaguuucaugucgaguauuaacaagaccuaguccugauuucgacuuuauauucuuaguaccaccuacaguagaaucaagaacaaaaccuuucucuguaccuaucuuaacuguagaagaaaugacaaacaguagauucccaauaccacuagaaaaacuuuuuacaggaccaucaucugcauucguaguccaaccacaaaacggaagauguacaacugacggaguccuauuaggaacaacacaauuaaguccaguaaauauuugcacauuucgaggagauguaacucacauuacaggaucaagaaauuacacaaugaaccuagcaacacaaaauuggaacucuuacgacccaacagaagaaauuccagcaccauuaggaacaccugacuucguuggaaaaauacaagguguacuaacccaaacaacaagagcagaugguucaacuagaggacauaaagcaaccguguauacaggaucugcagacuuugcaccaaaauuaggaagaguacaauuugcuacagauaccgauaacgacuuugaugcaaaccaaaauacaaaauucacaccuguaggaguaauucaagacggagacacugcacacagaaacgaaccucaacaauggguacuaccaucauacucagggcguaauaaucauaacguacauuuagcuccugcaguagcaccuacauuuccgggagaacaauuauuauucuuuagaucaaccaugccaggauguucaggauauccuaacauggaucuagauugcuuacuaccgcaagaauggguccaauacuucuaccaagaagcagcaccagcucaaucagauguagcauuauuaagauucguuaacccggacacaggaagaguacuauucgaauguaaacuacauaaaucaggauauguaacagucgcacauacaggucaacaugaucuaguaauaccacccaaugguuacuucagauuugauucauggguaaaucaauuuuacacauuagcaccaauggguaauggaacaggaagaagacgauaa

SEQ ID NO: 33601 - RNA, 1617 nt, Artificial Sequence
  derived and/or modified sequence opt6 from VP1__Norovirus_and/or_Norovirus-like__FJ514242
augaaaauggcaucaaaugaugcaaacccaucagauggcucugcagcuaaccuaguaccagaaguaaauaacgaaguaauggcauuagaaccaguuguaggcgccgcaauagcagcaccagucgcaggucaacaaaauguaauagacccauggauaagaaauaauuuuguacaagcaccaggcggagaauuuacuguaucgccacguaacgcacccggagaaauccucugguccgcuccacuaggaccagauuugaaucccuacuuaucacauuuagcaaggauguauaacgguuacgcaggcggauucgaaguucaagucauacuagcaggaaaugcauuuacagcaggcaaaauaaucuuugcagcaguaccaccaaauuucccaacagaaggacuuucuccaucacaaguaacaauguuuccacauauaauaguagacguacgacaacuagaaccaguacuaauuccauuaccagauguuagaaacaauuuuuaccauuauaaccaaucaaacgacccgacaauaaaacuaauagcaauguuauauacaccauuaagagcaaacaaugcuggagaagacguauucacaguaucaugcagaguccucacaagaccaucuccagacuuugacuuuauauuuuuagucccacccacaguugaaucaagaaccaaaccauucaccguaccaauccuuaccguagaagaaaugacaaacuccagauuuccuaucccauuagaaaaacuauuuacagguccaucaucagcauuuguuguacaaccacaaaauggccguugcacaacagacggaguccuauuagguacaacacaauuaucaccuguuaauauaugcacauuuagaggagauguuacacauauagcuggaucacgaaauuauacgaugaaccuagccucacuuaacuggaacaauuacgauccaacugaagaaguaccagcaccauuaggaaccccagacuuugucggaaaaauacaaggaguccucacucaaacaacuaaaggugacggaucaacuagaggccauaaagcaacaguauauacaggaucagcaccuuucacacccaaauuggguucaguacaauucuccacagacacagaaaacgauuuugaaacacaccaaaauacaaaauucacaccuguaggagucauacaagacgguucaaccacacaucgaaaugaaccacaacaauggguacuaccaucauauucuggaagaaauguacaaaauguacaccuagcaccagcaguagcaccaacuuuuccaggagaacaacuacuauuuuucagauccacaaugccaggauguucaggcuacccuaacauggaucuugacugucuacuaccacaagaauggguccaacauuucuaucaagaagcagcacccgcacaaagcgacguugccuuacuaagauuuguuaacccagacacuggaagaguauuauuugaauguaaacuacauaaauccgguuaugucaccguagcacauacuggacaacacgaucuaguuauaccuccaaauggauacuuucgauuugacucauggguuaaucaauuuuacacucuagcacccaugggaaauggaacuggcagaagaagauaa

SEQ ID NO: 33602 - RNA, 1617 nt, Artificial Sequence
  derived and/or modified sequence opt6 from VP1__Norovirus_and/or_Norovirus-like__KX353976
augaaaauggcuucaaaugacgcaaauccaucagaugguagcgcagcaaauuuaguaccagaaguaaacaaugaaguaauggcauuagaaccuguuguaggagccgcaauagcugcacccguagcuggacaacaaaauguaauugauccauggauaagaaauaacuuuguccaagcaccugguggagaauuuacaguaucaccuagaaaugcaccuggagaaauauuauggucagcaccucuaggaccugacuuaaauccauaucuaucucaccuagcaagaauguauaacggcuaugcaggagguuuugaaguacaagucauacuagcagguaacgccuuuaccgcuggaaaaguaauuuuugcagcaguacccccaaauuuuccuacugaaggccuaucaccaucucaaguaacaauguucccacacauaaucguagauguacgacaacuagaaccuguauuaauaccauuacccgacauaagaaacaauuucuaccacuauaaucaaucaaaugacucaacaauaaaacuaauagcuaugcuauauacuccauuaagagccaauaaugcaggagacgacgucuuuacaguauccugucgaguucuaacucgaccaucaccagauuuugacuuuauauuccuaguaccaccaacagucgaaucuagaacuaaaccuuucacagucccuauacuaacaguugaagaaaugacaaauucaagauucccaauuccauuagaaaaauuauuuacagguccaucaagugcauuuguaguacaaccacaaaacggccgcugcaccacugaugguguacuacuuggcaccacacaacuuucuccugucaacauaugcacauuucgaggcgacguaacccauauagcaggaucaagaaacuauacaaugaauuuagcuagcuuaaauuggaacaauuacgacccaaccgaagaaauuccugcaccauuaggaacaccagacuuuguaggaaaaauccaagguguauuaacacaaaccacaaaaggagacgguuccacuagaggucauaaagccacaguauauacaggaucagccgacuuuacaccaaaacuugguaguguacaauucggaacagauacagauaacgauuuugaaacccaccaaaauacaaaauucacuccagucggaguaauacaagauggaucuacaacucaucguaaugaaccacaacaauggguauuaccaagcuauucaggaagaaacguacaaaaugugcacuuagcacccgccgucgcaccuaauuuccccggugaacaacuauuauuuuuccgaaguacaaugccagguugcucaggauacccaaacauggaucuugauugcuuacucccacaagaauggguacaacacuucuaccaagaagcagcaccagcacaauccgacguagcuuuacuaagauucguaaacccugauacuggacgaguacucuucgaaugcaaacuacauaaaucagguuacguuacaguagcacacacaggacaacaugaucuaguaauaccacccaacggauacuuuagauucgacucuuggguuaaccaauuuuauacacuagcucccaugggaaauggcacaggacgaagaagauaa

SEQ ID NO: 33603 - RNA, 1617 nt, Artificial Sequence
  derived and/or modified sequence opt6 from VP1__Norovirus_and/or_Norovirus-like__KX353952
augaaaauggcuuccaacgaugcuaacccaucagauggaucugcagcaaaccuaguacccgaaguaaacaaugaaguaauggcauuagaaccaguaguuggagcagccauagccgcaccagucgccggacaacaaaauguaauugacccuuggauaagaucuaacuucguacaagccccaggaggugaauuuacagugucaccaagaaaugcaccaggagaaaucuuauggucagcaccacuaggacccgaucuaaaucccuaucuaucucacuuagcaagaauguacaacggauaugcuggcgguuucgaaguucaagucauauuagcagguaacgcauuuacagcaggaaaaaucauauucgcagccguaccuccaaauuucccaaccgaaggacuaucuccaucacagguuaccauguuuccucauauaauaguagacguaagacaacuagaaccagucuuaauuccauuaccagauguaagaaacaauuucuaccacuauaaccaaucaaaugauucuacaauuaaauuaaucgcuaugcuuuacacuccacuacgcgcuaauaacgccggagaugauguauucaccguuucaugucgcguauuaacuagaccuuccccagauuucgauuuuauauuucuaguucccccaacagucgaauccagaacaaaaccauuuacagucccaauacucaccguagaagaaaugacaaacagcagauuuccuaucccacuagaaaaauuauuuacaggaccauccucugcauucguaguacaaccacaaaacggucguugcacaacagacggcguauuacuaggaacaacucaacucucaccaguuaauguauguacauuuagaggugacguuacacauauagcaggaucaagaaauuacacuaugaauuuagcaucucuaaacuggaacaauuaugauccaacugaagaaauaccugccccacuaggaacaccugauuucguaggcaaaauccaagguguauuaacccaaacaacaaaaggugacggaucaacuagaggacauaaagcaacaguauauaccggaucagcagauuuuacaccaaaauuaggaucuguucaauuuggaacagacaccgaaaacgauuucgaaacccaucaaaacacccguuuuacacccguagggguaauacaagacggaucuacuacacauagaaaugaaccacaacaauggguacuuccaucauauucuggaagaaauguucauaacguacaucuugcuccagcuguagcacccaacuuuccaggugaacaacuauuauuuuucagauccaccaugcccggaugcucaggauacccaaauauggaucuagacugucuacuaccacaagaauggguacaacauuuuuaccaagaagcagcuccagcucaaucagacguagcacuucuuagauucgucaaccccgacacagguagaguacucuucgaaugcaaacuacauaaaucaggauaugucacaguagcacacaccggacaacaugauuuaguaauaccaccaaacggauauuucagauuugauucaugggucaaccaauuuuauacacuagcucccaugggaaacggaaccggacgaagaagauaa

SEQ ID NO: 33604 - RNA, 1617 nt, Artificial Sequence
  derived and/or modified sequence opt6 from VP1__Norovirus_and/or_Norovirus-like__KR131771
augaaaauggcuucuaaugacgcuaauccaucagacggcucaacagcuaauuuaguacccgaaguaaacaaugaaguuauggcacuagaaccaguaguaggagcagcaauugcagcaccuguagcaggacaacaaaauguaaucgaucccuggaucagaaacaacuuuguacaagcaccaggaggagaauuuacaguaucaccaagaaaugcaccuggagaaauucuauggucagcaccccucgguccagaccuaaauccuuauuuaucccacuuagcaagaauguauaauggauaugcuggaggcuuugaaguucaaguaauacuagccggaaaugcauuuaccgcaggaaaaauaauauucgcagccguaccaccaaauuuuccaacugaaggccuuucacccucacaaguaacaauguuuccacacauaauaguugacguacgacaauuagaaccaguacuaauaccacuaccagauguuagaaauaauuuuuaucauuauaaccaaucuaacgacccgacaauaaaauuaauagcaaugcuauacacucccuuacgugcaaauaaugcaggagacgauguauuuacaguaucaugucgaguacucacucgaccaucuccugacuucgacuuuauauuuuuaguaccaccaaccguagaaucacgaacaaaaccauucacuguaccaauccuuacaguugaagaaaugacaaacucaagauuuccaauaccauuagaaagauuauauacugguccaucaucagcuuuugucguucaaccucaaaacggccgauguaccacugacggaguccuacuagguacaacacaacuaucggcuguaaauaucuguaccuucagaggcgacguaacacacauagcaggcucaagaaacuauacaaugaauuuagcaucacaaaauuggaacaauuaugauccaacagaagaaauaccagccccauuaggaacaccagauuuugucgguaaaauucaagguauguuaacgcaaacaacacguucagauggaucaaccagaggacacaaagccacugucuuaaccgguuccgcagacuucgcuccaaaacucggaagaguacaauucgccacugauacagauaaugauuucgaauccggacaaaauacaaaauucacaccuguaggcguuauucaagaugguucaacaacacauagaaaugaaccacaacaauggguauuaccaaacuauucuggccgcacaggacauaacguacauuuagccccugcaguugcaccaaccuauccaggagaacaauuacuauucuuuagaucaacuaugccaggaugcucaggauauccuaauauggaucuagauugccucuuaccacaagaauggguacaacauuuuuaucaagaagcagcuccugcacaaucagauguagcuuuacuaagauucguaaauccagauacaggccguguauuauucgaauguaaacuacauaaaucaggauacguuacuguagcacauacuggccaacaugaucuaguaauaccaccaaaugguuauuucagauuugauagcuggguaaaucaauuuuauacauuagccccaaugggcaauggaacaggacgaagaagauga

SEQ ID NO: 33605 - RNA, 1617 nt, Artificial Sequence
  derived and/or modified sequence opt6 from VP1__Norovirus_and/or_Norovirus-like__AB933729
augaaaauggcuucaucagacgcaaacccaucagacggcuccacagcaaacuuaguacccgaaguaaacaaugaaguuauggcauuagaaccaguaguuggugcagcuauagcugcaccaguagcaggccaacaaaacguaauagacccuuggauuagaaauaauuuuguacaagcaccuggaggagaauuuacuguaucuccaagaaaugcaccaggagaaauacuauggucugcaccauuagguccagauuuaaauccauaccuuucacaucuagcucgcauguauaaugguuacgcaggcggauucgaaguucaaguaauuuuagcuggaaaugcauuuacagcaggaaaaauaauuuucgcagcuguaccaccaaauuuccccacagaaggucucaguccaucacaaguaacaauguucccacacauaauaguagauguucgccaacuagaaccaguauuaauuccucuaccagacguaagaaacaauuuuuaccauuacaaucaauccaacgacccaacaauuaaacuaauugcaaugcuauauacaccccuucgagcuaauaaugcaggagacgacguuuuuacaguaucuuguagaguacuaacaagaccaucaccagauuucgacuuuaucuuccuaguaccucccaccguagaaucucgcacaaaaccauucuccguaccaauauuaaccgucgaagaaaugaccaauucaagauucccaauaccacuagaaaaacuauucacaggaccaaguucugcuuucguaguucaaccacaaaacggaagaugcacaacagauggaguucuacuagguacuacacaacuuucaccuguuaauauuuguacauuuagaggugauguaacacauauaacaggaucucgaaacuacacaaugaaccuagcuacacaaaauuggaacucuuacgauccaacugaagaaauaccagccccuuuaggcacucccgacuuuguagggaaaauacaaggaguuuuaacucaaacaacuagagcagauggaucaaccagaggacacaaagcuauagucuauacaggauccgccgacuuugcaccaaaauuaggacgaguccaauucgcaacagauaccgauaaugacuucggugcaaaucaaaacacaaaauucacacccguaggagucauucaagauggagacaccgcacaucgaaaugaaccacaacaauggguacuaccaucauauaguggucgaaauagucauaauguacauuuagcaccagcaguagcuccaacauuuccuggcgaacaauuauuauucuuucgaucuacaaugccaggcugcucaggauaucccaacauggauuuagauugccuauuaccacaagaauggguacaauauuuuuaucaagaagcugcucccgcucaaucagacguagcauuacuaagauucguaaacccagauacuggaagaguauuauuugaaugcaaacuacauaaaucaggauacguaaccgucgcacacacaggacaacaugaucuaguaauuccaccaaauggauauuuccgauuugacuccuggguaaaucaauuuuacacccuagccccuauggguaauggaacagggcgacgcagauaa

SEQ ID NO: 33606 - RNA, 1617 nt, Artificial Sequence
  derived and/or modified sequence opt6 from VP1__Norovirus_and/or_Norovirus-like__AB933646
augaaaauggcaucaaaugacgcaaauccauccgaugguucagccgcuaaccuaguuccagaaguaaacaacgaagucauggcacuagaaccaguuguaggagcagcaauagcugcaccaguagcuggccaacaaaacguaauagacccuuggauaagaaacaacuucguucaagcuccaggaggugaauuuacaguaucaccacgaaaugcaccaggugaaauauuauggucagcaccauuaggaccagaccuaaauccauauuuaucacacuuagcaagaauguauaauggcuacgcaggaggauucgaaguacaggucauucucgcaggaaacgcuuucacagcaggcaaaauaauauucgcagccguaccaccaaacuucccaacugaaggucuaagucccucucaaguuacaauguucccacacauaauaguagauguuagacaauuagaacccguacucauuccacuacccgauguaagaaacaauuucuaccacuauaaucaaagcaaugacagcacaauuaaacuaauagcaaugcuuuacacaccacuaagagcaaacaacgccggugaagaugucuucaccguaucauguagaguauuaacacguccuucaccagauuucgauuuuaucuuucuaguuccaccaacuguagaaucaagaacaaaaccauuuacuguaccaaucuugacaguagaagaaaugacuaacagcagauuuccuauaccauuagaaaaauuauuuacaggaccaucaucagcauucguaguacaaccacaaaacggaagauguacaacagacggaguccuacucggaacaacacaauuauccccaguuaauauuugcacauuucgcggcgauguaacacacauagcagguucaagagauuacaccaugaaucuagcaucauuaaacuggaacaacuaugaccccacagaagaaauaccagcuccacucggaacaccugacuucguaggcaaaauacaaggaguacuaacacaaaccaccaaaggagaugguagcacaagaggacacaaagcaacaguauauacaggcucagcaccauucacaccaaaauuaggcucaguacaauuuucaacagauaccgaaaaugauuucgaaacacaccaaaauaccaaauuuacuccagucggaguuauacaagacggaggaacaacccacagaaaugaaccccaacaauggguacuaccaucauauaguggucgaaacguaccuaauguacauuuagcaccagcuguugccccaacauuucccggagaacaauuacuuuucuuucgaucuacaaugccagguugcucaggcuacccaaauauggaccuagauuguuuauuaccacaagaauggguacaacauuucuaucaagaagcagcaccagcacaaucagaaguagcucuacuacguuuuguaaacccagacacagguagaguccuauuugaauguaaauuacauaaaucuggauauguaacagucgcacacacaggacaacacgaucuaguaaucccuccaaauggauauuucagauucgacucauggguaaaucaauuuuacacucucgcaccuaugggaaacggcacuggaagacgaagauaa

SEQ ID NO: 33607 - RNA, 1617 nt, Artificial Sequence
  derived and/or modified sequence opt6 from VP1__Norovirus_and/or_Norovirus-like__JX155742
augaaaauggcaucuaacgaugcaaauccaucagacggaucagcagcaaauuuagucccagaagucaauaaugaaguaauggcacuagaaccaguaguaggcgcagccauagcagccccuguagcaggucaacaaaaugucauagauccauggauaagauccaauuuuguacaagcuccuggcggagaauuuacaguuucacccagaaacgcuccuggugaaauauuaugguccgcaccacuagguccagauuuaaauccuuaucuaucucacuuagcacgaauguacaacggauacgcaggaggauucgaaguccaaguaauucuagccgguaacgcuuucacagcuggaaaaauaauuuucgcugcaguaccaccaaacuuuccuaccgaagguuuauccccaagccaaguaacaauguuuccacauauaauaguagacguucgacaacuagaaccagucuuaauaccauuacccgauguaagaaacaauuucuaucauuauaaccaaucaaaugacucaaccauaaaacuaauagcaauguuauacacaccccuaagagcaaauaaugcaggagaagauguauuuacaguaaguuguagaguauuaacaagaccaaguccugacuuugauuuuauuuuccuuguaccuccaacuguagaaucaagaacaaagccauuuacaguaccuauauuaacagucgaagaaaugacuaacucuagauuuccaauuccauuagaaaaacuauuuacaggaccaucuucagcauucguaguacaaccccaaaacggccguuguacaacagacggaguauuacuaggaacaacacaacuaucuccaguuaauauuugcacauuccgcggcgauguaacacauauagccggaucaagaaauuacacuaugaacuuagcaucacuaaauuggaacaauuacgauccaaccgaagaaaucccagcaccacuagguacaccagauuuugucggaaaaauucagggaguauuaacacaaaccacaaaaggagacggauccaccagaggacacaaagcaacaguauauacagggucagcuccauuuacuccuaaacuaggaucaguccaauucgguaccgauacagaaaaugacuuugaaacacaucaaaauacaaaauucacaccuguaggaguaauacaagacggaggaacuacacaucguaacgaaccacaacaauggguacuacccuccuauagcggacguaauguaccaaauguacauuuagccccagcaguugccccaacauuuccaggcgaacaacuacucuucuuuagaucuacaaugccaggaugcucaggauacccuaauauggaccuagacugucuacuaccacaagaauggguucaacauuuuuaucaagaagcagcaccagcacaaucugacguugcguuacuacgauucguaaacccugacacaggucguguauuauuugaauguaaacuacauaaaucaggauacgucacaguagcacauaccggccaacacgauuuagucauaccaccaaauggauauuuuagauucgauaguuggguaaaucaauuuuauacauuagcaccaauggguaauggaacuggaagaagaagauaa

SEQ ID NO: 33608 - RNA, 1617 nt, Artificial Sequence
  derived and/or modified sequence opt6 from VP1__Norovirus_and/or_Norovirus-like__JN400614
augaaaauggccucaaaugacgcuaauccaucugaugguucagcagccaacuugguaccugaaguuaauaaugaaguaauggcucuagagccaguugucggagccgcaauugcagcccccguagcaggacaacaaaauguaauagacccauggauacguaauaacuuuguccaagcuccuggaggugaauuuacaguaucaccaagaaaugcaccaggagaaaucuuauggucagcuccccuuggaccagauuuaaauccauaucuaucucacuuagcuagaauguacaacggauacgcuggaggauucgaaguucaaguaauauuagcagguaaugcauucacagcaggaaaaauaauauucgcagcaguaccaccuaauuucccuaccgaaggauuaucaccaucacaaguaacaauguucccacacauaaucguugacguaagacaauuagaaccaguacuaauaccucuaccagacguaagaaauaauuuuuaccacuacaaccaaucaaaugauucaacaauaaaacuaauugcaaugcuauauacaccacuaagagcaaauaacgccggugaugauguauuuacgguaucaugucgaguacuaacaagaccaucaccggacuucgacuuuauauuucuaguaccaccaacaguagaaucaagaaccaaaccauucacaguaccaauauuaaccguugaagaaaugaccaacuccagguuuccaauuccacuagaaaaacuauucacugguccaucuucagcauucgucguacaaccccaaaacggucgaugcacuacugaugguguauuauuaggaacaacacaacuuucccccguaaauauaugcaccuucagaggugauguaacacauauagcuggauccagaaauuacacuaugaaccuagcaagucuuaacuggaacaauuacgacccaacugaagaaauaccugcaccacuaggaacccccgacuuuguaggaaaaauacaaggaguucugacacaaacaacaaaaggugauggaucuacucgaggacacaaagcuacuguauauacaggauccgcaucauucacaccaaaauuaggaucuguacaauuuagcacagauacugaaaacgauuuugaaacacaccaaaacaccaaauuuacacccguaggugucauacaagacggcucaacaacacauagaaaugaaccacagcaauggguauuaccuucuuauucugguagaaauguacacaacguacacuuggcaccagcugucgcaccuacauucccuggagaacaacuuuuauucuuuagaucaacaaugccaggaugcuccggcuauccaaauauggacuuagacugcuuacuaccacaagaauggguacaacauuuuuaucaagaagccgcuccagcacaaucagacguagcacuucuaagauuuguaaacccugauacaggaagaguauuauuugaauguaaacuccauaaaucaggauauguaacagucgcccauacuggccaacacgauuuaguaauaccaccaaacggauauuuucgauuugacucuuggguaaaucaauucuacacacuugcaccaauggguaaugguacaggacgacgaagauaa

SEQ ID NO: 33609 - RNA, 1617 nt, Artificial Sequence
  derived and/or modified sequence opt6 from VP1__Norovirus_and/or_Norovirus-like__JN400601
augaaaauggcaucaaacgaugcaaacccaucagacgguucugcagcaaaccucguacccgaaguuaacaaugaaguaauggcacucgaaccaguagucggcgccgcaauagcagcacccguugcaggacaacaaaauguuauugacccuuggauaagaaauaacuuuguacaggcaccuggaggagaauuuacaguauccccaagaaaugccccuggagaaauauuauggucagcaccacucgguccagauuuaaauccauauuuaucacaccuagcccguauguauaaugguuacgcaggaggauucgaaguacaaguaauacucgcaggcaacgcauuuacagccggaaaaauaauauuugcagcagucccuccaaacuuccccacugaaggacuaucaccaucucaaguaacaauguucccacacauaauaguagauguacgacaacuagaaccuguacuuauaccacuaccugauguucgaaacaauuucuaccauuacaaccaaucaaaugauuccacuauaaaacuuauagcaaugcucuacacaccacuaagagccaacaaugccggagaagauguauuuacuguuucaugucgcguacuaacuagaccaagcccagacuucgauuucauauuucuaguaccuccaacaguagaaucaagaacuaaaccauuuacaguaccaauacuuacaguagaagaaaugaccaacagcagauucccuaucccauuagaaaaauuauucacuggacccuccggcgcauuuguaguucaaccacaaaacggcagaugcacuacagauggcguacugcuaggaacaacacaacucagcccaguaaauauaugcacauuucgaggagacguaacacauauagccggcucacgagacuauacaaugaacuuagcaucacuaaacuggaauaauuaugauccuacagaagaaauaccagcuccauuagguacaccagacuucguaggaaaaauacaaggaguauuaacccaaacaacaaaaggcaacggaucuacuagaggacacaaagccacugucuauacuggaucugcaccauuuacaccaaaauuaggauccguucaauucucaacagacacggaaaacgacuucgaaacacaccaaaacaccaaauucacuccaguuggaguaauacaagauggaucuaccacccauagaaaugaaccacaacaauggguucucccaucauauucaggaagaaauguucacaacguacaccuugcaccagccguugcacccacauuuccuggagaacaacuauuauucuuuagaucaacaaugcccggaugcucaggauauccaaauauggaucuagacugccuacuaccccaagaauggguucaacauuuuuaucaagaagcagcccccgcccaaucagacguagcauuacuaagauucgucaacccugacacaggucgagucuuauuugaaugcaaauuacauaaauccggauauauaacaguagcacauacuggccaacaugaucuagucauuccacccaauggauauuuucguuucgauucauggguaaaucaauuuuacacauuagcaccaaugggcaauggaacuggaagaagaagauaa

SEQ ID NO: 33610 - RNA, 1617 nt, Artificial Sequence
  derived and/or modified sequence opt6 from VP1__Norovirus_and/or_Norovirus-like__JQ613538
augaaaauggcaucaucagaugcaaacccuagugauggaucuacagccaaucuuguaccagaaguaaacaaugaagucauggcuuuagaaccaguugucggagcugcaauagcagcaccagucgcuggacaacaaaacauaauagauccauggauaagaaacaacuuuguacaagccccuggcggugaauuuacagucuccccaagaaaugcacccggagaaauacuaugguccgcccccuuaggaccagaccuaaaccccuauuuaucacacuuagcaagaauguauaauggcuaugcuggcggauuugaaguacaagucauacuagcagguaaugcauuuacagcaggaaaaauaguuuucgcugcaguaccaccuaacuucccaacagaaggacuaucccccucacaaguaaccauguucccucauauuauaguugauguaagacaauuagaacccguacuaauaccauuaccagauguaagaaauaauuucuaucacuauaaccaaaguaaugacccaaccauaaaauuaauagcaaugcuauacacaccauuacgugccaacaaugcuggagaugauguauuuacaguaucaugcagaguucuaacaagaccaucacccgauuucgacuucaucuucuuaguaccaccaacaguugaaucaagaacuaaaccuuucucaguaccaauacuaaccguagaagaaaugacaaauucaagauuuccaauacccuuagaaaaauuauucacaggacccucaucugcauucgucguucaaccacaaaauggacgauguaccacagauggaguacuauuagguaccacacaauuaagcccuguuaauauauguacauuucgaggagauguaacacauauagccggaucacauaauuacaccaugaaucuagcaucucaaaauuggaacucuuacgaucccacagaagaaauaccagcaccucuagguaccccugacuucguaggcaaaauacaaggaguacucacacaaaccacaaggaccgauggaucaacucguggccauaaagcuacaguauacacaggaucagcagaauuuucaccaaaauugggcagaauacaauucgcuacagauacaaauaaugauuucgaugcuaaucaaaacacaaaauuuacuccaguuggaguaauacaagacggaggcacaacacauagaaaugaaccucaacaauggguauuaccaucauauucaggacgaaacacucacaacguacacuuagcccccgcaguagcaccaacauuuccaggagaacaauuacuauucuuuagauccacacucccaggaugcucuggauauccuaacauggaccuagacugccuauuaccacaagaauggguucaauauuucuaccaagaagccgcacccgcucaaucugacguagcauuauuaagauuuguaaauccugacacuggaagaguucuauucgaauguaaacuacauaaaucaggauauguuacaguagcucauacuggacaacacgauuuaguaauaccaccaaauggcuauuucagauuugauucaugggucaaucaauuuuauacacuugcacccaugggaaauggaaccggaagaagacgauaa

SEQ ID NO: 33611 - RNA, 1617 nt, Artificial Sequence
  derived and/or modified sequence opt6 from VP1__Norovirus_and/or_Norovirus-like__HM802543
augaaaauggcaucuaacgacgcuacuccaucugacggcucaacagcaaaccuaguacccgaaguaaacaaugaaguaauggcauuagaaccaguaguaggagcagcuauagcugcaccugucgcaggacaacaaaaugucauagacccauggauacguaauaacuuuguacaagcccccggaggagaguucacaguuaguccaagaaaugcuccaggagaaauauuauggucagcuccacuaggucccgaucucaauccauaccuaucacaccucgcacgaauguacaacggauaugccggugguuucgaaguacaaguaauauuagcaggaaaugcauuuacugccggaaaaauaauauuugccgcaguuccaccuaacuucccaacagaaggacuuuccccuucacaaguaacaauguuuccacauauaauaguugaugucagacaauuagaaccaguauuaauaccauuaccagacguaagaaauaauuucuaucacuauaaccaauccaacgacccaacaauaaaacucauagcuaugcuauacacaccauuaagagcaaauaacgccggagaugaugucuucaccguuuccuguagaguauuaacaagaccauccccagauuuugauuucauauuucuuguuccaccaacaguagaaucaagaacaaaaccauucucaguaccaauacuuacaguagaagaaaugacaaauucuagauuuccuauaccacuugaaaaacuauuuacuggaccaucaucugcauucguaguucaaccacaaaauggaagguguacaaccgacgguguacuccuagguacaacacaacuaucaccugucaauauauguacauuuagaggagacguaacacacauagcuggaacacaaaauuacacaaugaaucuagcaucccaaaauuggaauaauuaugauccuacagaagaaauaccagcaccacuaggaacuccagauuucguaggaaaaauacaaggaguacuaacacaaaccacacgaagagacggaucaaccagaggacauaaagcuaccgugucuacaggaucaguucauuuuaccccaaaauuaggcucuguucaauuuuccacagauacaucaaacgauuucgaaacaggucaaaacacaagauuuacaccuguaggcgucguacaagacggagauacaacacaucaaaaugaaccacaacaauggguauuacccgauuauucaggaagagauucucauaacguacacuuagcaccagcaguagccccaacauuccccggugaacaauuauuauucuucagaucuacaaugccagguuguucaggauauccaaauaugaacuuggacugccuuuuaccacaagaauggguucagcauuucuaucaagaauccgcaccagcacaaucagauguagcacuauuaagauucguaaauccagauacuggcagaguacuauuugaaugcaaacuacacaaauccggauauguaacgguagcacacacuggacaacacgauuuaguaauaccuccuaaugguuacuucagauucgauucauggguaaaucaauuuuacacacuugcuccaauggguaacggugcaggacgaagaagauaa

SEQ ID NO: 33612 - RNA, 1617 nt, Artificial Sequence
  derived and/or modified sequence opt6 from VP1__Norovirus_and/or_Norovirus-like__AB541337
augaaaauggcaucaaaugacgcuaauccauccgauggaucagcagcaaaucuugucccagaagucaauaaugaagucauggcacuagaacccguuguuggcgcggcaauagcagcaccaguagcaggacaaaccaacguaauagacccauggauaagaaauaacuuuguccaagcaccuggaggagaauuuacaguaaguccuagaaaugcaccaggcgaaauacuauggucagcuccacuaggaccagaccuaaauccuuauuuaucacaucuagcaagaauguauaacggauacgcuggagguuucgaaguacaaguaauucuagcaggaaaugcauuuacagccggaaaaauuauauucgcagcaguaccuccuaacuuuccaacagaaggucucucaccaucacaaguaacaauguucccacacauaauaguagacguaaggcaauuagaaccaguucucaucccauuaccugauguaagaaacaauuuuuaucacuacaaccaaucuaacgacucaaccauaaaauuaauugcaaugcuauauacaccucuaagagcaaauaaugcaggagaagauguauuuacagucucuugcaggguacucacaagaccauccccagauuuugacuucauauuucuaguaccacccacaguagaaucacgaacaaaaccauucacuguaccuauacuaacagucgaagaaaugacaaauucaagauuucccauaccauuagaaaaacuauuuacgggaccuuccggcgcauuuguuguacaaccccaaaacggcagauguacaacagacgguguauuacuaggaaccacacaacuauccccaguaaauauauguacauuuagaggcgauguaacccacauagcaggaucaagagauuacacaaugaaccuagcaucauuaaacuggaauaauuaugaccccacagaagaaauacccgcaccacuaggaacaccugauuucgucggaaaaauucaaggcguacuaacacaaacaacaaaaggagacgguucaacaagaggacauaaagcaacagucuacacaggaucggcuccuuuuacaccaaaacuaggauccguacaauucucaacagauacugaaaacgauuucgaaacccaccaaaauacuaaauuuacaccagucggcguaauacaagacggcggaacaacacacagaaaugaaccccaacaauggguauuaccaucuuacucaggacgaaauguacacaacguccacuuagcaccagcaguugcuccaacauuuccaggcgaacaacuauuguuuuucagauccacuaugccuggaugcucuggcuauccaaacauggauuuagauuguuuauuaccccaagaauggguacaacauuuuuaucaagaagcagcaccagcacaauccgacguugcacuauuaagauuuguaaauccagauaccggaagaguacuauucgaauguaaauuacauaaaucaggauaugucaccgucgcacauacaggccaacaugaccuaguaauaccaccaaacggauacuucagauucgacucguggguaaaccaauuuuauacucuagcaccaaugggaaauggaacggguagacgaagauaa

SEQ ID NO: 33613 - RNA, 1617 nt, Artificial Sequence
  derived and/or modified sequence opt6 from VP1__Norovirus_and/or_Norovirus-like__AB541252
augaaaauggcaucaaaugacgcuaauccaucugauggaucagcagcaaacuuaguaccagaaguaaacaaugaaguaauggcauuagaaccaguugucggcgcugcuauagcagcacccgucgcaggccaacaaaauguaaucgaucccuggauaagaaauaacuucguacaagcuccaggaggagaauuuacagucuccccaaggaaugcaccuggcgaaauacuauggucagcaccacuuggaccagaucuaaauccauaucuaucacaucuagcaagaauguauaauggauacgcaggggguuucgaaguacaaguaauauuagcaggaaacgcauuuacagcaggaaaaaucauuuuugccgccguuccuccuaauuuuccaacagaaggauuaucaccaagucaaguaacaauguucccacacauaaucguagacguaagacaauuagaaccaguacuaauuccacuaccagauguaagaaauaauuucuaucauuauaaccaaucaaacgauuccacaauaaaacuaaucgcaaugcuuuacacaccacuuagagcaaacaacgcaggagaugauguauucacaguaucaugucgaguucucacaagaccauccccagauuuugacuucauauuucuaguuccaccaacaguagaaucccgaacaaaaccauucacaguaccaauuuuaacaguagaagaaaugacaaauucucgauucccuauuccauuagaaaaacuauuuacaggcccaucaucagcauuuauaguacaaccacaaaacggaagauguacaacagacgguguacuuuuaggcacaacacaacuaaguccagucaacauaugcacauuuaggggugauguuacacauauagcaggaucaagaaacuacacaaugaaucuagcauccuuaaacuggaacaauuaugauccaacagaagaaauaccagcuccauuaggaaccccagacuuugucggaaaaauacaaggaguauuaacacaaaccacaaaaggcgacggauccacacgaggacacaaagcuacaguuuauacaggaagugcugauuuuacaccaaaauuaggaucaguucaauuuggaacugacacagaaaaugacuucgaaacacaucaaaauacaaaauuuacuccuguaggagugauccaagacggaucaacuacccaucgaaaugaaccccaacaauggguuuuaccaucuuauucuggaagaaauguacauaacguacaccuagcuccagcaguugcaccaaacuucccaggugaacaacuauuauucuuuagaucaacaaugccaggaugcucaggauauccaaacauggaucuagauugucuauuaccucaagaauggguacaacauuucuaucaagaagcugcaccagcacaaucagacguugcauuauuaagauucguuaacccagacacaggcagaguccuauucgaauguaaacuacacaaaucaggauauguaacaguagcacauacuggacaacaugaucuaguaauuccuccaaauggcuauuucagauuugauagcuggguaaaucaauucuacacacuugcaccaauggguaauggaacaggaagaagacgauaa

SEQ ID NO: 33614 - RNA, 1617 nt, Artificial Sequence
  derived and/or modified sequence opt6 from VP1__Norovirus_and/or_Norovirus-like__GU270580
augaaaauggcauccaaugaugcuacaccaucagacggaucaacagcuaaccuaguaccagaagucaacaaugaaguaauggcacuagaaccaguaguaggagccgccauagcagcaccagucgcaggacaacaaaaugucauugauccauggauaagaaauaacuuuguacaagccccaggaggugaauuuacuguaucaccaagaaaugcacccggcgaaauacuuuggucagcuccacuaggaccagaucuaaauccauaucucucacacuuagcacguauguacaacggauaugcaggcggcuucgaaguccaaguaauccuagcaggcaaugcauuuacagcaggaaaaauaauuuucgcagcaguacccccuaacuuuccuacagaaggucucucaccaucucaaguaacaauguucccacacauaaucguagacguaagacaauuagaaccaguuuuaaucccuuuaccugaugucagaaacaacuucuaucacuauaaccaaaguaaugaucccacaauuaaacuaauagcaaugcucuauacaccauuaagagcaaauaaugccggugacgauguauuuaccguaagcugccgaguacuuacccgcccuucacccgacuuugacuuuauuuuucuaguacccccaacaguugaaucccguacaaaaccauucucuguaccaauccuaacaguagaagaaaugacaaacucccgauucccuauaccucuagaaaaacuauuuacaggaccaucuucagcauuuguaguacaaccccaaaauggaagauguacaacugacgguguacuucuaggaacaacacaauuaucccccgucaauauaugcaccuuucgcggugauguuacccauauagcuggcucuagaaacuacacaaugaaccuagccacacaaaacuggaacucauaugacccaaccgaagaaauacccgcaccacuaggaacaccagacuuugucggaaaaauucaaggaguauuaacacaaacaacaagagcagaugguucuacgagaggccacaaagcaacaguauacaccggauccgcagacuuuuccccaaaauuaggaagaauacaauucgcuacagauaccgauaacgacuuugaugcaaaccaaaauaccaaauucacacccguuggaguaauacaagacggaaauacagcccaccguaaugaaccucaacaauggguacucccaucauauuccggaagaaauucacacaacguacacuuagcucccgccguagcaccaacauucccaggugaacaacuacucuucuucagaucaacuaugccaggcugcucaggcuauccaaauauggaucuugauugucuacuaccacaagaauggguacaauacuuuuaucaagaagccgcaccagcucaaucugauguagcacuauuacgauuuguaaauccugauacuggaagaguacuauuugaaugcaaacuacauaaaacaggauauguaacagucgcacacacaggacaacacgauuuaguaauaccaccaaacggauauuuuagauuugacucaugggucaaucaauucuacacccuagccccaaugggaaauggaacugguagaagaagauaa

SEQ ID NO: 33615 - RNA, 1617 nt, Artificial Sequence
  derived and/or modified sequence opt6 from VP1__Norovirus_and/or_Norovirus-like__EU876882
augaaaauggcuucaaacgaugcuaauccaucagauggcucuacagcaaacuuaguaccagaaguuaacaacgaaguaauggcucuagaaccaguaguaggugcagcaauagcagccccaguagcaggacaacaaaaugucauagacccauggauaagaaauaacuuuguacaagcaccuggaggagaauuuaccguaucaccaagaaaugcuccaggagaaauauuauggucagcuccauugggaccagaucuaaauccauaucuaucacauuuagcaagaauguacaauggauacgcaggcggauuugaaguacaagucauacuagcaggaaaugcauuuacagcaggaaaaauaauauuugcagcagucccaccaaacuuuccaacagaaggacuuucaccaucacaaguaacaauguuuccacauauaauaguagacguuagacaacuagaacccguacuaauuccauuaccagaugucagaaacaauuuuuaccacuacaaccaaucuaacgacccaacuauaaaacuuauugcaaugcuuuauacuccuuuaagagcaaacaaugcaggagaugacguauuuaccguuuccuguagaguacuaacuagacccuccccugauuucgauuucauauuucuaguacccccuacaguagaaucaagaacaaaaccauuuaccguaccaauccucacaguagaagaaaugacaaacucucgauucccaauaccuuuagaaagacuauacacaggucccucauccgcauucguaguacaaccacaaaacggaagaugcaccacagauggaguucuauuagguacaacacaacuuucagccguaaauauaugcacuuuccgaggagacguaacccauauugcuggaucaagaaauuacacuaugaaucuagcaucacaaaauuggaacaacuacgacccaacagaagaaauacccgcuccacuaggaacacccgacuucguuggaaaaauacaaggaaugcuaacacaaaccacaagaucugacgguucaacaagaggucacaaagcaacaguauuaacaggaagcgcagacuucgcaccaaaacuuggaagaguacaauucgcuacggauacagauaacgacuucgaaucaggccaaaauacaaaauuuacaccaguuggaguaauacaagaugguagcacaacucaccgaaaugaaccucaacaauggguacuaccaaauuauucaggaagaacuggacauaauguucaucuugccccugcaguagcaccaacauauccaggagaacaacuauuauucuuucgaucaacaaugcccggaugcucaggauauccuaauauggaucuagacugcuuauuaccucaagaauggguacaacauuuuuaucaagaagcagcacccgcacaaucugauguagcauuacuucgcuucgucaauccugacacugguagaguauuauucgaauguaaauuacauaaaucaggauauguaaccguagcacauacaggacaacacgauuuaguaauaccaccaaauggauauuuuagauuugacucaugggucaaucaauuuuacacauuagcaccaaugggaaauggagcuggcagaagaagauaa

SEQ ID NO: 33616 - RNA, 1617 nt, Artificial Sequence
  derived and/or modified sequence opt6 from VP1__Norovirus_and/or_Norovirus-like__AB933649
augaaaauggcuucaaaugacgcaaauccaucagacggaucugcagcaaauuuaguaccagaagucaacaacgaaguaauggcccuagaaccaguaguaggagccgccauugcggcuccagucgcaggacaaacuaaugugauagacccauggauaagaaauaacuuuguccaagcacccggaggagaauuuacagucuccccaagaaacgcaccaggcgaaauacuauggucagcaccauuaggaccagauuuaaauccauauuuaucacacuuagcccgaauguauaaugguuacgcuggcggauuugaaguucaagucauauuagccgguaaugcauucacagcagguaaaauaauauuugcagcaguuccaccaaacuuucccacagaaggcuuaaguccaucucaaguaacaauguucccucacaucaucguagacguaagacaacuagaaccaguucuaauuccauuaccagacguaagaaauaauuucuaucacuauaaucaaagcaaugauucaaccauaaaauuaauagcaauguuauacaccccucuaagagcaaauaaugccggcgaagauguauuuacaguaucauguagaguacuuacaagacccuccccagauuuugacuucauauuucuaguaccaccaacaguagaaucaagaacaaaaccuuucacuguaccaaucuuaacuguagaagaaaugacgaacaguagauuucccauaccacuagaaaaacuuuucacaggaccaucuggugcuuuuguaguacaaccacaaaauggaagaugcacuacagacggaguucuacuaggcacaacacaacuuucuccugucaacauauguaccuuccgaggugaugucacacacauagcagguucucgaaauuacaccaugaaucuagcaucauuaaauuggaauaauuacgauccaaccgaagaaauccccgcuccauuaggaacuccugacuucguagguaaaauacaaggcguacucacacaaacaacaaaaggagauggaucaacuagaggacacaaagccacaguauauacagguagcgcccccuuuacaccuaaacuuggaucaguacaauuuuccacugauacagaaaacgacuucgaagcacaucaaaauacaaaauucacacccguuggcguaauccaagacggaucaacaacacacagaaaugaaccacaacaauggguacuaccuucauauucaggaggcaauguacaaaacguccacuuagcaccagcuguagcaccaacauuuccaggagaacaauuauuauucuuuagaucuaccaugccaggaugcagcggauauccaaauauggaucucgacugcuuauuaccacaagaauggguacaacauuuuuaucaagaagccgccccagcacaaucagaugucgcucuauuacgauuuguaaacccagacacaggaagaguuuuauucgaaugcaaauuacauaaaucgggauauguuacaguagcacacacaggccaacacgacuuaguuaucccaccaaacgguuacuuucgcuucgacucauggguaaaucaauucuacaccuuagcacccaugggaaaugguacaggaagacgaagauaa

SEQ ID NO: 33617 - RNA, 1617 nt, Artificial Sequence
  derived and/or modified sequence opt6 from VP1__Norovirus_and/or_Norovirus-like__JX439816
augaaaauggcuuccucugacgccaacccuucagacggcuccaccgcaaaccuuguaccagaaguaaacaaugaaguuauggcacuagaaccaguagucggagccgccauagccgcaccuguagcuggccaacaaaauguaauagauccauggauacgaaauaacuucguacaagcccccggaggagaauuuacaguuucaccaagaaacgcaccaggggaaauacuuugguccgcaccucuaggaccagauuuaaacccauaucucucacaccuugccagaauguauaauggauacgcaggaggauucgaaguucaagucauacuagccggaaaugcauucaccgcaggaaaaauaauuuuugcagcaguaccaccaaacuucccaacagaaggccuaucucccucacaaguuacaauguucccacacauaauaguagacgucagacaauuagaacccguucucauaccauuaccagauguaagaaacaauuucuaucauuacaaccaaucaaaugacccaaccauuaaacuaauagcuauguuauacacaccacuaagagcaaauaaugcuggagacgaugucuuuaccguaaguuguagaguucuaacucgcccauccccagacuuugauuuuauauuucuaguacccccuacaguagaaucaagaaccaaaccauucucaguaccaauauuaaccguagaagaaaugacaaacucaagguuuccaaucccucuagaaaaauuauuuacaggaccaucaucagcauucguaguacaaccacaaaacggacguuguacaacagacggaguuuuauuaggaacaacucaacucucaccaguaaauauuuguaccuuucgaggagacguaacacauauaacaggaucuagaaacuacacuaugaacuuagcaacacaaaacuggaacaguuacgauccuacagaagaaauaccugcaccacuaggaacaccugacuuuguugguaaaauacaaggaguacuaacacaaaccacacgagcugacggaucaacuagaggacacaaagcaacuguauauacuggauccgcugauuucucuccaaaauuaggacgaguacaauucgcuacugauacagauaaugauuucgacgcaaaucaaaauacaaaauucacaccuguaggaguaauacaagauggagacacugcucauagaaaugaaccucaacaauggguauuaccaaguuauucaggaagaaauucacauaacguacacuuagcaccagcaguagcaccaacuuucccaggagaacaauuauuauucuuuagaucaacaaugccagguugcucaggauauccaaauauggacuuagacuguuuauuaccacaagaguggguacaauauuucuaucaagaagccgcuccagcacaaagcgauguagcauuacuaagauucguuaauccugacacaggccgcguacuuuucgaaugcaaauuacacaaaucagguuaugucacaguagcacauacaggacaacaugauuuaguuauaccaccaaauggauauuuccguuuugauaguuggguaaaccaauuuuauacauuagcaccaaugggaaauggaacaggacgaagaagauaa

SEQ ID NO: 33618 - RNA, 1617 nt, Artificial Sequence
  derived and/or modified sequence opt6 from VP1__Norovirus_and/or_Norovirus-like__JX155739
augaaaauggcaucaaaugacgcaaacccauccgauggauccgcagcuaaccuuguuccugaaguaaacaaugaagucauggcacuagaaccaguaguaggagcugcaauagcagcaccagucgcaggucaacaaaauguuauagaccccuggauaagaaauaauuuuguacaagcccccgguggagaauuuacaguuucaccaagaaaugcaccaggagaaauauuaugguccgcuccucuaggcccagaucuaaauccauaccuaucacauuuagcccguauguauaaugguuacgccggcggauucgaaguacaagucauucuagcaggaaaugccuuuacagccggcaaaauaauauuugcagcagucccaccuaauuuucccacagaaggacuaucaccaucucaaguaacaauguuuccacacauaauaguugacguacgacaacuagaaccuguacuaauaccauuacccgauguaagaaacaauuucuaccacuauaaucaaucaaacgacucuacaauuaaauuaauagcaauguuauauacaccauuaagagcaaacaaugccggagaugauguauuuacaguaucauguagaguacuaacaagaccaucacccgacuucgacuuuauuuuucuaguaccaccuacaguugaaucaagaacaaaaccauuuaccgucccaauccuaaccguagaagaaaugacaaacucccgauuuccuauaccauuagaaaaacucuuuacaggaccaucuucagcauucgucguacaaccacaaaacggaagauguacaacugacggcguauuauuaggaacuacacaacuaucuccagucaacauuuguaccuuucgcggagauguaacucacauugcagguuccagaaacuacacaaugaaccuagcuagcuugaacuggaacaauuacgauccaacagaagaaauuccugcaccacuagguaccccagauuucguaggcaaaauacaaggaguacuuacucaaacaacaaaaggagacggaagcacuagaggacacaaagcaaccguauacacagguagcgcaccuuucacacccaaauuaggaucaguucaauuuucaaccgacaccgaaaacgauuuugaaacccaucaaaauacaaaauucacuccaguaggaguaauacaagacggaucuacaacacauagaaaugaaccacaacaguggguucuaccuucauauucaggacgaaacguacagaauguccacuuagcuccagcaguagccccaaccuucccaggagaacaacuuuuauucuuucgcucaacaaugccagguuguucaggauacccaaacauggacuuagauugcuuacugccacaagaauggguucaacauuucuaccaagaagcagcuccagcacaaucugacguugcauuauuaagauucguaaacccagauacuggccgaguacuauuugaauguaaacuacauaaaagcgguuauguaacaguagcacauacuggacaacaugauuuaguaauaccaccaaacgguuacuucagauucgauuccuggguuaaucaauucuauacauuagcuccaauggguaacggaacaggaagacgacgauga

SEQ ID NO: 33619 - RNA, 1617 nt, Artificial Sequence
  derived and/or modified sequence opt6 from VP1__Norovirus_and/or_Norovirus-like__HQ456338
augaaaauggcaucaaaugaugcaucaccaagugauggcucagcagcaaauuuaguuccugaaguaaacaacgaaguuauggcacuagaaccagucgucggagcagcuaucgcugcaccaguagcaggccaaaaaaauguuauagauccauggauaagaaauaacuucguacaagcaccaggcggugaauuuacaguaucuccaagaaaugccccaggagaaauauuauggucugccccacuaggaccagaucucaaccccuaucuaucacauuuagcacguauguacaacggauaugcuggaggauucgaaguacaaguaauacuagcaggaaaugcauucacugcaggcaaaauaauauucgcagcuguaccaccuaacuucccuacugaagguuuaucuccaucacaagucacaauguucccucacauaauaguagauguaagacaauuagaaccaguauuaauaccccuaccagacguccguaauaauuuuuaucauuauaaccaaucaaaugacucaacgauaaaacuuaucgcaaugcuauacaccccacuacgagcaaacaaugcuggagaagaugucuuuacuguaucaugucguguuuuaacaagaccaucacccgacuuugacuucauauuucuagucccaccaacagucgaaagcagaacaaaaccauucacaguaccaauacuaacugucgaagaaaugaccaauucacgauuuccuauaccauuagaaaaacuauucacaggaccaucuggagcuuucguuguccaaccacaaaacggaagaugcacaacagauggaguacuauuaggaaccacucaauuaucacccguaaauauaugcaccuucagaggagaugucacacauauagcaggcucuagaaacuacacaaugaaucuagccgccuuaaacuggaacaauuaugauccaacugaagaaaucccugccccuuuagguacaccagacuuuguaggaaaaauacaaggaguucuaacacaaacaacuaaagcugacgguuccacaagaggacacaaagcuacaguauacacagguagugcagacuuuacucccaaacuaggaucaguacaauuuucuacagauaccgaaaacgauuucgaaacacaccaaaauacaaaauuuacaccaguaggaguaauccaagacggcucuacaacacauagaaaugagccacaacaauggguauuaccaucauauagcgguagaaauguacauaauguucaccuugcuccugcaguagcaccaacuuucccaggagaacaacuauuauucuuucgaucuacaaugccaggaugcucagguuauccaaauauggauuuagauugcuuacuaccucaagaauggguacaacauuucuaucaagaagcugcacccgcacaaucagacguagcauuauuacgauucguaaacccugacacaggaagaguucuauucgaauguaaauuacacaaaucaggcuauguuacaguagcccacacaggacaacaugaucuaguuauaccaccaaauggauauuuuagauuugauuccuggguaaaucaauuuuacacauuagcaccaaugggaaauggaacaggaagaagacguuaa

SEQ ID NO: 33620 - RNA, 1617 nt, Artificial Sequence
  derived and/or modified sequence opt6 from VP1__Norovirus_and/or_Norovirus-like__AB541359
augaaaauggcaucuaacgaugccaacccauccgauggaucagcagcuaaccuaguaccagaaguuaauaacgaaguaauggcacuagaaccaguagugggagcagcaauagcagcaccaguagccggacaaacaaacguaauagauccauggauucgaaauaauuucguccaagcccccggaggugaauuuacaguauccccacgcaacgcacccggagaaauccucugguccgcuccauuagguccagacuuaaauccauauuuaucacacuuagcaagaauguacaacggauacgcaggcgguuuugaaguucaaguaauacuagcaggaaaugcauucacagccgguaaaaucaucuucgcugcaguaccaccaaacuuuccaacagaaggauuauccccuucacaaguuacuauguucccacacauaauaguagacguacgacaguuagaacccgucuuaauaccauuaccagauguucgaaauaauuucuaucauuauaaucaaucaaaugacucuacaauaaaacuaauagcuaugcucuauacaccacucagagccaacaaugcuggugaagauguauuuacaguauccugucguguacuaaccagaccaucaccagauuuugacuuuauauucuuaguacccccaacagucgagucaagaacaaaaccauucaccguaccuguauuaacaguagaagaaaugacaaacucuagauuuccuauuccauuagaaaaacuauuuacuggacccuccggagcauuuguuguacaaccacaaaacggacguuguacaacugauggaguauuacuaggaaccacacaauuaucaccagucaauauauguacauuuagaggagacgucacccacaucgcuggaucuagaaauuacacaaugaaccuagcauccuuaaauuggaauaauuaugacccaacugaagaaauucccgcaccacucggaacaccugacuuuguuggaaaaauacaaggagucuuaacacaaacaacuaaaggagacggcucaaccagaggacacaaagccacagucuauacaggaucagcaccauuuacuccaaaacucggaucaguacaauucuccacagauacagaaaacgauuucgaaacccaucaaaauacaaaauucacaccuguaggaguuauacaagacgguucaacaacacacagaaacgaaccccaacaauggguucuaccaucauauucagguagaaauguacauaacguucacuuagcaccagcaguagcaccaacuuuuccaggagaacaacuacuauuuuucagaucuacaaugccaggaugcucaggauacccaaauauggacuuagauugccuucuuccacaagaauggguacaacacuuuuaucaagaagcagccccugcacaaucugaaguugcauugcuuagauucgucaacccagauacaggacggguccuuuucgaauguaaacuucauaaaucaggauauguaacagucgcucacaccggccaacacgaucuaguuauaccaccaaacgguuacuucagauuugauucauggguaaaucaauucuacacucuagcaccaauggguaauggaacaggacgucgaagauaa

SEQ ID NO: 33621 - RNA, 1617 nt, Artificial Sequence
  derived and/or modified sequence opt6 from VP1__Norovirus_and/or_Norovirus-like__AB541280
augaaaauggccucaaaugacgcuaauccuuccgacggaucagccgcaaacuuaguaccagaaguuaauaacgaaguaauggcauuagaacccgucguaggagcagccauagccgcacccgucgcaggacaaacaaacguaauagacccauggauaagaaauaacuuuguccaagcaccaggaggugaauuuacaguaucuccaagaaacgcaccaggcgaaauauuauggagugcugcauuaggaccagacuuaaauccauaucuaagucauuuagcacgaauguauaacggauacgcaggagguuucgaaguacaagucauacuugcuggcaacgcauucacugcuggaaaaauaaucuucgcugcaguaccaccuaacuucccaacagaaggauuaucaccuucgcaaguuacaauguucccacacauuauuguagauguaagacaacuagaacccguucuaauaccucuaccugauguaagaaacaauuucuaucauuauaaucaaucaaacgacucaacaaucaaauuaaucgccaugcuauacacaccacuccgggcaaacaaugcaggagaagacguauuuaccguaucauguagaguccuaacaagaccuuccccagauuuugacuuuauauuccuaguacccccaacaguagaauccagaacuaaaccauucacaguaccaauauuaacaguugaagaaaugaccaacagucguuuuccaauuccauuagaaaaauuauuuacaggaccaucuggagcauucguaguacaaccacaaaacggacgauguacaaccgauggaguccuccuaggaacuacacaacuaucuccuguuaauauaugcacauuuagaggagacguuacacacaucgcagguucuagaaauuauacaaugaaucuagcauccuuaaauuggaacaauuaugaucccacagaagaaauaccagcaccccuaggaacgccagacuuuguaggaaaaauacaaggaguauuaacacaaacaacuaaaggcgauggaucaacaagaggacauaaagccacugucuauacaggauccgcacccuuuacaccaaaauuaggcucuguacaauuuuccacagauaccgaaaaugacuucgaaacacaccaaaauacaaaauucacaccuguuggaguuauucaagacggaucaacuacacaccgaaaugaaccacaacaauggguccuaccaucauauucuggcagaaauguucauaacguacaccuagcaccagcaguagcaccaacauuuccaggagaacaauuacuauucuuuagaaguacaaugccaggaugcucagguuacccuaacauggaucucgacugccuacuaccacaagaauggguacaacauuucuaucaagaagccgccccagcacaaucagacguugcucuauuacgguucgucaacccagacacuggaagaguacuauuugaaugcaaacuacauaaauccggauauguuacaguagcucacacgggacaacaugacuuaguaauacccccaaaugguuauuuuagauuugauucaugggucaaucaauuuuauacuuuagcaccaaugggaaacgguaccggaagaagaagauaa

SEQ ID NO: 33622 - RNA, 1617 nt, Artificial Sequence
  derived and/or modified sequence opt6 from VP1__Norovirus_and/or_Norovirus-like__AB541244
augaaaauggcaaguaaugacgcaaacccuagcgauggaucagccgcuaacuuaguuccagaaguaaauaaugaaggaauggcauuagaaccuguaguaggugcugcuaucgcagcaccaguagcaggucaaacuaauguaauagaccccuggauacgaaauaauuuuguacaagcaccaggaggagaauuuacagucagcccacgaaaugcaccuucagaaauacuuuggucagcaucauuagguccagaucuaaacccauaucuaucucacuuagccagaauguauaauggcuacgcugguggauucgaaguacaaguaauuuuagcuggaaaugcauuuaccgcagguaaaauaauuuuugcagcuguuccaccaaauuuuccaacugaaggucuaagccccucucaaguaacaauguucccacacauaauagucgacguaaggcaacuagaaccaguacuaauaccacuaccagacguacgaaauaauuucuaccacuauaaccaaucaaaugacucuacaauuaaacucauagcaaugcuuuauacaccccuaagagcaaauaaugcuggagaagauguauuuacuguuucauguagaguacuaacaagaccaucuccagacuuugacuucauauuuuuaguaccacccaccguagaaucaagaacaaaaccuuucacaguaccaauacuaacaguagaagaaaugacaaacuccagauuccccauaccacuagaaaaacuauuuacuggaccaucuggagcuuucgugguacaaccucaaaacggaagauguaccacugacggaguauuacuaggaacuacacaacuaucaccagucaauauauguacauucagaggugacguuacacauauagcuggaucuagaaauuacacaaugaaucuagcauccuuaaacuggaacaauuacgauccaacugaagaaauaccagcaccacuaggaacaccagauuuuguagguaaaauccaaggagucuuaacacaaacuacuaaaggaaauggaucaacaagaggccauaaagcaaccguauauaccggcucagcuccuuucacuccaaaacuuggcucaguacaauucucaacugauacagaaaaugauuucgaaacacaccaaaauacaaaauuuacaccuguaggaguaauacaagacgguagcacuacucauagaaaugaaccacaacaauggguucuaccauccuacucuggcagaucaguacauaauguacaucucgcaccagcaguugcaccaaccuuuccaggagaacaauuauuauucuuucgaucaaccaugccaggcuguucagguuacccaaauauggaccuagauugcuuauuaccucaagaauggguacaacauuucuaccaagaagcagcuccagcucaauccgacguagccuuauuaagauucgucaaccccgacacaggaagagucuuauucgaauguaaacuucauaaaucuggauauguuacaguagcucacacuggacaacacgaucuaguaauaccaccaaauggcuauuucagauucgauuccuggguaaaucaauucuacacucuagccccaaugggaaauggaacuggacgaagaagauaa

SEQ ID NO: 33623 - RNA, 1617 nt, Artificial Sequence
  derived and/or modified sequence opt6 from VP1__Norovirus_and/or_Norovirus-like__AB541203
augaaaauggcauccaaugaugcaaauccauccgacggauccgccgcaaauuuaguaccagaaguaaauaaugaaguaauggcacuagaaccaguaguaggugcagcaauugcagcaccugucgcaggacaaacaaauguaauugauccauggauacgaaauaauuuuguucaagcaccaggaggcgaauuuacaguaaguccaagaaacgcuccaggugaaauauuauggagugcaccacuagguccugaucuaaaucccuacuuaucccaccuugcaagaauguauaacggauacgcaggcggauucgaaguacaaguaaucuuagcagguaaugcauuuacagcagguaaaauaauauuugccgccgucccaccuaacuuuccaacagaagguuuaucaccaucacaaguaaccauguuuccacauauaauagucgacgucagacaauuagaacccguacuaauuccccuaccagacguaagaaacaauuucuaucauuacaaucaauccaaugacucuaccauaaaauuaauagcaauguuauauacaccccuaagagcaaacaaugcuggagaagauguauucaccguuucauguagaguacuaacaagaccauccccugauuuugacuuuauauuccuggucccaccaacaguagaaucuagaacuaaacccuuuacaguacccauauuaacaguagaagaaaugacaaauuccagauuucccauuccccuagaaaaacuauuuacaggaccauccggugccuucguaguacaaccacaaaauggaagaugcacaacagauggaguacuacuaggaacaacacaacucaguccaguaaacaucuguacauuuagaggugauguaacccacauaguaggaucuagaaacuacaccaugaacuuagcaucauuaaauuggaauaauuaugaucccacagaagaaauaccagcaccauuagguacaccagacuuugucggaaaaauucaaggaguccuaacacaaacaacaaaaggagacggaucuacacgaggucauaaagcaaccguauauacaggcagcgcaccauucacacccaaauuagguucuguacaauucucaacagauacagaaaacgauuuugaagcacaccagaacacaaaauuuacaccagucggaguaauacaagacggauccacuacccaucgaaaugaaccacaacaauggguauuaccaagcuauucaggaagaaauguacaaaacguacauuuagccccagcaguggcuccuacauuuccaggagaacaacuauuauuuuucagaucuacaaugccaggcuguucagguuauccuaacauggaucuugacugccuacuaccucaagaauggguacaacacuucuaucaagaagccgcaccagcacaaucugauguagcauuacuaagauucguaaacccugacacaggaagaguacuauucgaaugcaaacuucauaaaagcggauauguaacaguagcacacacaggccaacaugauuuaguaauaccaccaaauggcuacuuucgauucgauucuuggguaaaucaauucuacacucuagcaccaaugggcaacggaacaggccgaagacgauaa

SEQ ID NO: 33624 - RNA, 1617 nt, Artificial Sequence
  derived and/or modified sequence opt6 from VP1__Norovirus_and/or_Norovirus-like__GQ850882
augaaaauggcaucuaaugaugcuaacccaucagacggaucaacagcaaacuuaguaccagaagucaacaaugaaguaauggcauuagaaccaguagucggcgcagcaauugcagcuccagucgcaggacaacaaaauguaauagauccauggauaagaaauaacuucguacaagcaccaggaggagaauuuacaguauccccacguaaugcaccaggagaaauauuguggucagcaccauuaggaccagaccuaaauccauaucuaucccacuuagcccgaauguauaacggcuaugcuggaggauucgaaguacaaguaauauuagcaggaaaugcuuucacagcaggaaaaauaaucuucgcugcaguacccccaaacuuuccaacagaaggacuaucuccaucucaagucacuauguuuccucauauaauaguagauguacgacaauuagaaccaguuuuaauaccauuaccugauguaagaaacaauuucuaucacuauaaccaaucaaacgacccuacaauaaaacuaaucgcaaugcuauacacuccacuuagagcuaauaaugcaggagacgauguauuuacaguaucaugucgaguacuaacaagaccaucuccagauuuugacuuuaucuucuuaguuccaccaaccguagaaucacgcacuaaaccauucacaguuccaauauuaacaguugaagaaaugaccaacuccagauuuccuauuccacuggaaagacuauauacaggaccaucuucagcauucguuguccaaccacaaaauggacgcuguacaacugacggagucuuacucgguacaacacaauuaucagcaguuaauauauguaccuucagaggagacguuacucauauagcaggaucaagaaauuacacaaugaaccuagcaagccaaaacuggaauaauuacgauccaacagaagaaauaccagcuccucuaggaacuccagauuuuguaggaaagauacaaggaaugcucacccaaaccacuagaucagaugggagcacccgaggccacaaagcaaccguuuucaccgguucagcagacuucgcaccuaaacuuggaagaguacaauucgcuacagauacagauaacgauuucgaaucuggacaaaauacaaaauuuacaccaguuggaguaauucaagacggcucaacuacccacagaaaugaaccacaacaauggguuuuaccuaacuacucuggacgaacaggacacaacguacaucuagcaccagcaguagcccccacauacccaggagaacaacuauuguuuuuccgaucaaccaugccuggcuguucaggcuauccaaacauggacuuagauugccuccuaccucaagaauggguucaacauuucuaccaagaagcagccccagcacaaucagacguagccuuauuaagauucguaaauccagacacuggcagagucuuauucgaaugcaaauuacauaaaucaggauacgucacaguagcccacacaggucaacacgaucuaguaauaccaccaaauggauauuuccgcuucgauagcuggguuaaucaauuuuacacacuagcaccaaugggaaacggaacaggaagaagaagauaa

SEQ ID NO: 33625 - RNA, 1617 nt, Artificial Sequence
  derived and/or modified sequence opt6 from VP1__Norovirus_and/or_Norovirus-like__KR131772
augaaaauggcaucaaacgacgcuacacccucugauggcucuaccgcuaacuuaguaccugaaguuaauaacgaaguuauggcuuuagaaccaguaguaggagcagcuauagcagcacccguagccggccaacaaaauguuauagacccauggauccgcaauaauuuuguacaagccccaggaggagaauuuacaguauccccacgaaaugcaccaggagaaauacuauggucugcaccuuuaggaccagauuuaaauccauaucuuucacaucuugcccgaauguauaacggauacgcaggagguuucgaaguucaaguaauacuagcuggaaaugcuuuuacugcgggaaaaauaauauuugcagccguuccuccaaauuuuccaacugaaggccucucaccaagucaaguaaccauguuuccucacauuauuguagauguacgccaauuagaaccaguccuaauuccccuacccgauguaagaaauaacuuuuaucacuauaaccaauccaaugaccccacaauaaaauuaauagcaauguuauacacacccuuaagagcaaacaaugcuggcgacgauguauuuaccguaucauguagaguacuaacuagaccuaguccagacuuugauuuuauauuccucguaccaccaaccguugaaucucgcacaaaaccauucucaguuccaauauuaacaguagaagaaaugacuaacucuagauuuccaauaccauuagaaaaacuauuuacaggcccaucaagugcauuuguaguccaaccacaaaacggacgauguacaacagaugggguacuuuuaggaacuacccaauuaucacccguaaauauauguacauuucgcggagacguaacucauaucacuggaucaagaaacuacacuaugaauuuagcaacccaaaauuggaacuccuacgauccuacugaagaaauaccagcaccacuagggacaccagacuuuguaggaaaaauacaaggaguccuaacacaaacaacacgcgcagauggaucaacacgaggacauaaagccacaguauauacaggaucugccgacuuugcacccaaacuaggucguguucaauuugcuacagauacagauaaugauuucgaugcaaaccaaaauaccaaauuuacuccagucggcguaauucaagacggaaacacagcucacagaaacgaaccccaacaauggguucuaccaucauauucugguagaaacucacauaauguacacuuagcuccugcaguagcgccaaccuucccaggagaacaacuccuauucuuuagaucaaccaugccaggcuguucugguuacccaaacauggaucuagacugcuuacucccacaagaauggguacaauauuuuuaucaagaagcagcaccagcacaaucagacguugcacuucuacgauucguaaacccugauacagguagaguauuauuugaaugcaaauuacauaaaaguggauacgucacaguagcacauacaggacaacaugaucuaguaauaccuccuaauggauauuuccgauucgauucauggguaaaucaauuuuacacacuagcaccaaugggaaauggcacaggcagaagaagauaa

SEQ ID NO: 33626 - RNA, 1617 nt, Artificial Sequence
  derived and/or modified sequence opt6 from VP1__Norovirus_and/or_Norovirus-like__KR904215
augaaaauggcauccucagacgcuaacccaagcgauggaucagcagcaaaucuaguacccgaagucaacaaugaaguaauggcucuugaaccaguaguaggagcagcuauagcugcaccaguagcaggacaacaaaauguaauugacccauggauaagaaauaacuuuguacaagcacccgguggugaauuuacaguauccccuaggaacgcaccuggagaaauuuuauggucagcaccucucggacccgaucucaaucccuauuuaagccaccuagcacgaauguauaacggauaugcuggaggauuugaaguacaaguaauauuagcaggaaacgccuuuacagcuggaaaaaucauauuugcggcuguacccccaaacuuuccaacagaagguuuaaguccuucacaagucacaauguuuccacauauaauuguagacguacgacaacuagaaccaguauuaaucccauuaccagacguuagaaauaauuucuaccauuauaaccaaucaaaugacccaacaauuaaacuaauagcaauguuauacacaccauuaagagcaaacaacgcaggagaugauguuuuuacagucucauguagagucuuaacuagaccaucuccagacuucgacuuuauauuucuagucccaccuaccguagaaucucgcacuaaaccuuucucuguaccuauacuaaccguagaagaaaugacaaacucuagauuccccauaccuuuagaaaaauuauuuacaggcccaucaagcgcauuuguaguucaaccacaaaacggccgaugcacaacagacggaguauuacucggaacaacucaacuaucuccugucaacauauguacauucagaggagauguuacacacacaacaggaucccacaauuacacuaugaaucuagccacacaaaacuggucaucauacgauccuacagaagaaauacccgcaccauuaggcacaccagauuuugucggaaaaauacaagguguacuuacucaaacaacaaaaacagauggaucaacaagaggucacaaagcuaccguauacacagguucagccgacuuugcaccaaaauuaggcagaguucaauuugcaaccgacacugauaaugauuuugaagcaaaccaaaauacuaaauucacacccguagguguaauccaagacggaaacacugcucauagaaaugaaccacaacaauggguauuaccaagcuauucaggacgaaacacacacaacguucauuuagccccagcaguagcaccaacuuuuccuggagaacaacuguuauucuucagaucaacaaugccagguugcuccggauacccaaauauggaucuagacugccuucuaccucaagaauggguacaauauuuuuaccaagaagcagcaccagcacaaagugacguagcacugcuaagauuuguaaaccccgacaccggacgaguauuauucgaauguaaauuacacaaaucaggauauguaacugucgcacacacaggaccccaugaucuaguaauaccaccaaauggauauuuuagauucgauucauggguaaaccaauuuuauacacuugcaccuaugggaaacggaacaggaagacgaagauaa

SEQ ID NO: 33627 - RNA, 1617 nt, Artificial Sequence
  derived and/or modified sequence opt6 from VP1__Norovirus_and/or_Norovirus-like__AB933715
augaaaauggcaagcaacgaugcaaaccccagugacggaucugccgcaaaccuuguacccgaaguaaacaaugaagucauggcauuagaaccaguaguaggagcagcaaucgcagcaccaguugccggacaacaaaauguaauugaccccuggaucagaaacaacuuuguacaagcaccaggaggggaauuuacaguuuccccaagaaaugccccaggagaaauacuauggucagcaccauuagguccugaucuuaacccuuauuuaucacaucuagcaagaauguacaacggauacgcaggagguuuugaaguacaaguuauauuagcagguaaugcauuuaccgcaggaaaaauaauauuugccgcaguacccccaaacuucccaacagaaggucuaucaccaucacaaguaacaauguuuccacauauaauuguugauguaagacaacuagaaccaguacucauaccacuaccagacguaagaaauaacuuuuaucauuauaaccaaucaaacgacaguacaauaaaauuaaucgcuauguuauacacaccuuuaagagcuaacaaugcaggagaagacgucuuuacaguaucauguagaguucuuacuagaccaucaccagacuuugauuucauauuuuuaguaccuccuacaguagaaucuagaacaaaacccuucacaguaccaauacucacaguagaagaaaugacaaacucaagauuuccaauuccauuagaaaaauuauuuacaggaccuaguucugccuuuguaguacaaccacaaaacggacgauguacuacugauggaguauuauuaggaacaacacaacuaagcccaguaaacaucuguacauucagaggagacguaacccauauagcaggcucaagaaacuacacaaugaaucuagcaucauuaaauuggaacaauuacgauccaaccgaagaaauaccugccccacuagggacaccugacuuugucggcaaaauccaaggaguauuaacacaaacaacaaaaggagacggaucaacacgaggacauaaagcaacaguauauacuggcucagcaccuuucacccccaaacuagguucaguacaauuuggaacagauacagaaaaugacuuugaaacacaucaaaauaccaaauucacaccugucggcguaauacaagacggaggaacaacccacagaaaugaaccacaacaauggguauuaccaucuuacucaggaagaaauguucccaacguacacuuggcaccagcaguagcaccaacuuuuccuggagaacaauuauuauucuuuaggucaacaaugccuggauguucaggauacccaaacauggaccuagacugucuuuuaccacaagaauggguacaacacuuuuaucaagaagcagcaccagcacaaucagacguagcauuauuacgauuuguaaauccagauacaggaagaguacuauucgaauguaaacuucacaaaucaggcuacgucacuguagcucacacaggacaacacgaucuaguaauaccacccaacgguuauuuucguuucgauaguuggguuaaucaauucuacacccuagcaccaauggguaauggaacaggaagaagacgauaa

SEQ ID NO: 33628 - RNA, 1617 nt, Artificial Sequence
  derived and/or modified sequence opt6 from VP1__Norovirus_and/or_Norovirus-like__AB933695
augaaaauggcauccaaugaugcuaauccauccgauggcucugcagccaaucuaguacccgaaguuaacaacgaaguaauggcauuagaaccaguagucggggcagccauugcagcaccaguagcaggucaacaaaauguaaucgacccauggauaagaaauaacuuuguacaagcaccaggaggagaauuuacuguaaguccaagaaaugccccuggcgaaauauuauggucugcaccucuaggaccagauuuaaauccuuaucuaucacauuuagcaagaauguauaauggauaugcaggcggauuugaaguacaaguaauacuagcaggaaacgcauuuacugcagguaaaaucauauucgcagcaguaccuccaaauuuuccaauugaagguuuaucacccucucaagucacaauguuuccacacauaauaguugauguaagacaacuagagccaguccuaauaccauuaccagauguaagaaacaauuuuuaccacuauaaccaguccaaugacucaacuaucaaacuaauagcuauguuauauacaccacuacgagcaaacaacgcaggagaagacguauucacuguuuccugccgcguauuaacuagaccaucaccagauuuugauuucauauuccuaguaccaccaacaguagaaucaagaacaaaaccauuuacuguaccaauacuuacaguugaagaaaugacaaacagucgcuuuccaauuccccuagaaaaauuauuuacaggaccaucuucagcauucguaguccaaccccaaaauggaagaugcaccacugacggcguauuacuagguaccacacaacuaagcccaguaaauauaugcacauuucgaggagacguaacacauauagcuggaucacacaauuauacaaugucacuagcuucuuuaaacuggaacaauuacgauccuacagaagaaauuccugcaccacuaggaaccccagacuuuguagguaaaauacaaggaguauuaacacaaacaacaaaaggagacggcaguaccagaggucauaaagcaacaguuuauaccggaucugcacccuuuacuccaaaauuaggaucaguacaauucucaacagauacagaaaacgauuucgaaacccaccaaaauacaaaauuuacacccguaggaguaauacaagacgguggcacaacucauagaaaugaaccacaacaauggguauuaccaucauauucaggaagaaaugucccaaacguccacuuagcaccggcaguagcaccaaccuucccuggagaacagcuauuauucuuuagaucaacaaugcccggaugcucaggauauccaaauauggauuuagauugccuauuaccacaagaauggguacaacauuuuuaccaagaagcagcacccgcacaauccgauguagcauuacuccgauucguuaauccagauacuggucgaguauuauuugaauguaaacuacacaaauccgguuacgucacaguugcucacacaggacaacacgaucuuguaaucccaccaaacggauauuuucgauucgauucuuggguuaaucaauuuuauacacuugcuccaaugggaaauggaacagguagacgaagauaa

SEQ ID NO: 33629 - RNA, 1617 nt, Artificial Sequence
  derived and/or modified sequence opt6 from VP1__Norovirus_and/or_Norovirus-like__AB933681
augaaaauggcaucaaaugaugcaaaccccuccgacggaucagccgccaauuuaguaccagaagucaauaaugaaguaauggcauuagaaccaguaguaggugcagcaauagcugccccaguagcaggacaacaaaauguaauagauccauggauuagaaauaacuuuguacaagcaccaggcggcgaauuuacaguuucacccagaaaugcaccuggcgaaauccucuggucugcaccauuaggaccugaucuaaauccauauuuaucacacuuagcaagaauguauaacggauacgccgguggauuugaaguacaaguaauauuagcaggaaaugcauuuacagcaggaaaaauaauuuucgcagcgguaccuccaaacuuucccacagaagguuuaaguccaucacagguaacaauguuuccacauauaauaguugacguaagacaauuagaaccaguucuaaucccacuuccagacguuagaaauaauuucuaucauuauaaucaaaguaaugacucuacaauuaaauuaauugccauguuauacacaccacuaagagcuaacaaugcaggagaagauguauucaccguaucuugucguguacuaacacgaccaucuccugacuucgacuuuauauucuuagucccaccaacaguagaaaguagaacaaaaccauucacagucccuauauuaacagucgaagaaaugacuaacucaagauuuccaauuccauuagaaaaacucuucacaggacccuccucugcauucguaguacaaccacaaaacggaagauguacuacugacggcguacuacuaggaacaacacaacucucaccaguaaacauaugcacauucagaggugacguuacacauauagcuggaucaagagauuauaccaugaacuuagccucauuaaacuggaauaacuacgauccaaccgaagaaauacccgcaccuuuagguacaccagauuuuguagguaaaauacaaggcgucuuaacacaaacaacaaaaggagauggaucaacacgaggacacaaagccacaguauacacuggcucagcuccuuucacaccaaaacuaggauccguacaauucagcacagauaccgaaaaugacuucgagacacaccaaaacgcaaaauucacaccagucgguguaauacaagacggaucaacaacacauagaaaugaaccucaacaauggguacuacccucauauucaggaaggaauguaccaaacguucaccuagcuccagcaguagcuccaacauuuccuggagaacaacucuuauuuuuccguucaacaaugccuggaugcuccggcuauccuaacauggaucucgauuguuuauuaccacaagaauggguacaacacuucuaccaagaagcugcuccagcacaaucagacguagcacuacuacguuuuguaaauccagauacaggccgcguucuauuugaaugcaaauuacacaaaucaggauauguuaccgucgcacauacaggacaacaugaccuagucauaccaccgaacggauauuuccgauucgauucauggguaaaccaauucuacacacucgcuccaaugggaaaugguacaggccguagaagauaa

SEQ ID NO: 33630 - RNA, 1617 nt, Artificial Sequence
  derived and/or modified sequence opt6 from VP1__Norovirus_and/or_Norovirus-like__AB933675
augaaaauggcuucaaaugaugccaauccaucagacggaucagccgcaaauuuagucccagaaguuaacaaugaaguaauggcacucgaaccaguaguaggagcagcaauagcagcaccaguagcaggucaacaaaauguaauagacccauggauaagaaacaacuuuguacaagcacccggcggcgaauuuaccgugucaccuagaaaugcaccaggagaaauauuauggucugccccucuaggaccagaccuaaauccauauuuaucacacuuagcacgaauguauaacggcuaugcaggcgguuuugaaguccaaguaauucucgcugguaaugcauuuacagcaggaaaaauaauauucgcagcuguaccaccaaauuuuccuacagaaggauuaaguccaucacaaguaacaauguucccucacauaauaguagacgugcgacaacuagaaccaguacucauaccacuaccagauguaagaaacaauuucuaucacuauaaccaaucaaaugacucaacaauaaaacuaauagcaaugcuuuauacaccauuaagagcaaauaacgcaggcgaagauguauuuacaguuucauguagaguucuaacucgaccaucaccugauuuugauuuuaucuuuuuaguaccaccaacaguugaaucuagaacaaaaccauucacuguuccaguucucacaguagaagaaaugacaaacuccagauuuccaauaccuuuagaaaaauuauucacaggaccuucauccgcuuucguaguacaaccacaaaauggacguuguacaaccgaugguguauuauuaggcacuacacaacuaagcccaguaaauauauguacauuuagaggagacguaacacauauugcaaauucacauaauuauacuaugaacuuagcaaguuuaaauuggaauaauuacgacccaacugaagaaauaccagcaccuuuaggaaccccagacuuuguaggaaaaauacaaggaguacuuacacaaacuacaaaaggugaugguucaacaagaggacacaaagcaacagucuauacaggaagcgcaccauuuaccccuaaauuaggaucaguccaauucucaacagauacugaaaacgacuucgaaacacaucaaaacaccaaauucacuccuguaggaguuauacaagauggaggcacaacacauagaaaugaaccacaacaauggguccucccuucauauucuggaagaaauguacaaaauguacaccuagcucccgcaguagcaccaacauuuccaggugaacaauuacuauucuucagaaguacuaugccaggauguucuggcuacccaaacauggacuuagauugucuucucccucaagaauggguacaacauuuuuaucaagaagccgcacccgcccaaucagauguagcauuauuaagauucguaaauccagauacagggcgaguucuuuucgaaugcaaacuacauaaaucaggauauguaaccguagcacacacuggacaacaugaucuaguaauucccccaaauggauauuucagauuugacucauggguaaaucaauuuuauacauuagcaccaauggguaauggaacagguagaagacgauaa

SEQ ID NO: 33631 - RNA, 1617 nt, Artificial Sequence
  derived and/or modified sequence opt6 from VP1__Norovirus_and/or_Norovirus-like__AB933652
augaaaauggcaucaaacgaugccaacccauccgauggaagugcugcaaaucuaguaccagaaguaaacaacgaagucauggcucucgaaccaguaguaggcgcugccauagccgccccaguagcaggacaacaaaacguaauagacccauggauuagaaacaauuuuguacaagcacccggaggagaauuuacuguuaguccaagaaaugcaccaggagaaauauuaugguccgcgccauuagguccagauuuaaauccuuauuuaucucaucuagccagaauguauaauggauaugcuggaggauucgaaguucaaguaauacucgcaggaaaugcauuuacagcaggaaaaaucauauuugcagcagucccuccaaacuuuccaacagaaggacucucuccaucccaaguuacaauguucccucacauaauaguagauguaagacaauuagaaccaguucuaauaccacuacccgauguccgaaacaauuuuuaucauuauaaccaaucaaaugacucaaccauuaaacuaauagcaauguuauacacuccacugagagccaauaaugcaggcgaagauguauuuacgguaucauguagaguucuaacaagacccucaccagauuuugacuuuauauuuuuaguaccaccaacaguagaaucuagaacaaaaccauuuacugucccaauacuaacaguagaagaaaugacuaauaguagauuucccauaccacuagaaaaacuauucacuggaccaucuaguacauuuguaguccaaccacaaaacggaagaugcacaacagacggagucuuacuaggaacaacacaauuauccccaguuaacauaugcacauucagaggcgacguaacacacauagccggaagucgaaauuacacaaugaacuuagcaucacuaaacuggaacaacuacgauccaacagaagaaauuccagcacccuuaggaacacccgacuuugugggaaaaauacaaggcguacucacacaaacaacaaaaggugacggaucaacaagaggacacaaagcuaccguuuacacaggcucagcacccuucacaccaaaauuaggaucaguacaauuugguacagauacagaaaaugacuuugagacucaucaaaauacaaaauuuacaccagucggaguaauccaagauggugguaccacacauagaaaugaaccacaacaauggguacuaccaucuuacucuggacgaaacguacccaacguacaucuagcacccgcaguagcuccaacauuuccaggugaacaauuauuauucuuucgauccaccaugccaggaugcucuggauauccuaauauggaucuagauugcuuacucccacaagaauggguucaacacuuuuaccaggaagccgccccugcacaaucagacguugcauuauuaagauucguaaacccugacacuggaagaguacuauuugaauguaaacuacacaaaucaggauauguuacaguagcacauacaggacaacaugauuuaguaauaccuccaaacggauauuucagauucgauucuugggucaaucaauuuuauacucuagcucccaugggaaauggaaccggcagacggcguuaa

SEQ ID NO: 33632 - RNA, 1617 nt, Artificial Sequence
  derived and/or modified sequence opt6 from VP1__Norovirus_and/or_Norovirus-like__KF429762
augaaaauggcaucuaaugaugcaaauccaagugacggaucagcagcuaaccuaguacccgaaguaaacaaugaaguaauggcacuagaacccgucguaggagcagcaauagcagccccaguugcuggacaacaaaauguaauagauccauggauaagaaauaacuuuguccaagcuccaggaggagaauuuacaguaucaccaaggaaugcaccaggagaaauacuuuggucagcaccacuaggcccagaucuaaauccuuaucuaucacauuuagcaagaauguauaauggauacgccggugguuucgaaguucaaguaauucuugcaggaaaugcauuuacagcaggaaaaauaauauucgcagcaguaccuccaaauuuucccacagaaggucuauccccaucacaaguaaccauguucccacauauaauuguugacguucgacaacuugaacccguauuaauuccuuuaccagacguaagaaauaauuucuaucacuacaaccaaucuaaugauucuacaauaaaacuaaucgcaauguuauauacaccacuccgagcaaauaaugcaggagaugauguauuuacaguaucauguagagucuuaacuagaccauccccugacuuugauuucaucuuucucguaccaccuacaguagaaucacgaacuaaaccuuucucaguaccaauauuaacagucgaagaaaugacaaauucucgauuuccaauccccuuagaaaaacuuuuuacaggaccaucaucaacauucguaguacaaccacaaaacggaagauguaccacugacgguguacuucuaggaacuacacaauuaucuccaguaaauauauguacauuucgaggagacguaacccauauaaccggaucgcgcaauuacacuaugaacuuagcaucacaaaauuggaacucauacgauccaaccgaagaaauaccagcuccuuuagguacuccagacuuuguaggcaaaauacaaggaguuuuaacacaaacaacacgaacagacgguaguacuagaggucacaaagcuacaguauacaccgguuccgccgacuuuucuccaaaacuuggaagaguacaauuugcaaccgacacagauaaugauuucgaugcaaaucaaaauacaaaauuuacaccugucggaguaauacaagaugguggaacaacacacagaaaugaaccucaacaauggguucuaccuucauauagcggacgaaauacacauaauguacaccuagccccugcuguggcaccaacauuuccuggagaacaacuacuuuucuucagaucaacaaugccagguugcucaggauacccaaacauggauuuagauuguuuauuaccucaagaauggguacaacacuucuaucaagaagccgcuccagcucaaucagacguagcauuacuaagauuuguaaacccugacacaggacgcgucuuauucgaaugcaaauuacauaaaucaggauaugucacuguagcccacacuggacaacacgauuuaguaauaccucccaauggcuauuuccgauuugauucauggguuaaucaauuuuauacucuagcaccaaugggaaauggaacuggaagacgcagauaa

SEQ ID NO: 33633 - RNA, 1617 nt, Artificial Sequence
  derived and/or modified sequence opt6 from VP1__Norovirus_and/or_Norovirus-like__JX644027
augaaaauggcaagcaaugacgccaacccgagugaugguucagccgcaaaucuaguaccagaaguaaauaaugaaguaauggcauuagaaccagucguaggagcugcaauugcugcaccaguagcuggccaacaaaaugugauagacccuuggauacgaaacaacuucguccaagcaccaggaggugaauuuacaguuucaccaagaaaugcaccaggagaaauacuauggucugccccacucggaccagaucucaaucccuaucuaucucaccuagcccgcauguauaauggauacgcuggaggauuugaaguacaaguaauauuagcaggcaaugcauucacugcgggaaaaauaaucuucgcagcaguuccacccaacuuccccacugaaggauuauccccuucacaaguaacuauguucccacacauuauaguagauguacgucaacuagaaccaguacuuauuccucuacccgauguuagaaacaauuuuuaucacuauaaucaaucaaaugacucuacaauaaaacuaauagcaauguuauacacaccauuaagagccaauaaugcaggcgaagauguauucacaguaucaugccgagucuuaaccagaccauccccagauuuugacuucauauuuuuaguuccucccacugucgaaucaaaaacaaaacccuucaccguuccaauccuaaccguagaagaaaugacuaauucuagauuuccuauaccacucgaaaaacucuuuacagguccauccucagccuuugucguacaaccacaaaauggaagaugcacaacagacggcguauuacuagguacaacacaauuaucaccuguaaacauauguacauuuagaggagacguaacccacauugcaggaucaagaaacuacacuaugaauuuagccuccuuaaacuggaacaauuaugauccaacugaagaaauaccagcaccauuaggaacaccagacuucgucggaaaaauacaaggaguacuaacacaaacaaccaagggagacggaaguacaagaggacacaaagcaacaguguauacagguuccgcaccauuuacaccaaaacuaggcucaguacaauucucaaccgauacagaaaacgacuuugaaacucaucaaaauacaaaauuuacaccaguuggaguuauacaagauggaucaacaacacauagaaaugaaccacaacaauggguacucccaagcuauuccggacgaaaugcacaaaacguucauuuagcaccagccguagccccaacauuuccaggagaacaacuacuauuuuucagaucaacaaugccaggaugcucuggcuauccaaacauggaccucgauuguuuauuaccacaagaauggguacaacacuuuuaucaagaagccgcaccagcacaaucagauguagcacuacuaagauucguaaacccagacacaggaagaguauuguucgaaugcaaauuacacaaaucaggcuauguaacaguagcacacaccggacaacaugauuuaguuauaccacccaauggauauuucagauucgacuccuggguuaaccaauucuauaccuuagcaccaaugggaaauggaacaggaagaagaagauga

SEQ ID NO: 33634 - RNA, 1617 nt, Artificial Sequence
  derived and/or modified sequence opt6 from VP1__Norovirus_and/or_Norovirus-like__JN400617
augaaaauggcaucaaacgacgcaucuccaucagauggaucugcagcaaauuuaguaccugaagucaauaaugaagucauggcacuugaaccaguuguaggagcagcaauagcagcacccgucgcaggacaacaaaauguaauagacccauggauucgaaacaacuucguacaagcaccaggaggugaauuuacagucucaccuagaaaugcaccaggagaaauacuauggucagcuccucuaggacccgaucuaaauccauacuuaucacauuuagcacgaauguacaaugguuaugcaggcggauucgagguucaaguaauacuugcaggaaacgcauuuacugcuggaaaaauaauauucgccgccguaccaccuaacuucccaacagaaggauuaucaccaucacaaguaacaauguuuccacauauuauaguagacguacgacaacuagaaccaguacuaauuccacuaccagauguacgaaacaauuucuaccacuauaaucaauccaacgauucuaccauaaaacuaauagcaaugcuauacacaccacuaagagcuaacaaugcuggugaagacguauuuacuguuucaugucggguacuaacuagaccaucaccagauuuugacuucauauuucuaguuccaccaacaguugaaagucgaacuaaaccauucaccguacccauacuaacaguugaagaaaugacuaauucacgcuuuccaauaccucucgaaaaacuauuuacagguccaucaggugccuucgucguacaaccacaaaacggccgauguacaaccgauggaguacuacucgguacaacucaacuaagcccaguaaacaucuguacauuuagaggagacguaacucauauagcuggaagcagaaauuauacuaugaaccuagcagcauuaaacuggaacaauuacgacccuacugaagaaauccccgcacccuuagguaccccugauuuugucgguaaaauacaaggaguauuaacacaaacaacaaaagcggauggcucaacaagaggacauaaagcaacugucuauacaggaucagccgacuuuacuccuaaauuaggaucaguucaauucucaacagauacagaaaaugacuucgaaacacaccaaaauacaaaauucacaccgguaggaguaauacaagacggaucaacuacucauagaaaugaaccacaacaauggguucuaccuucauauuccggacgaaauguacaaaacguucacuuagcaccagcaguagcaccuacauucccaggagaacaacuacuuuucuuuagaucaacaaugccagguugcucaggcuauccaaacauggaucuagauugucucuuaccacaagaauggguucaacacuucuaucaagaagcugcgccugcccaaucagauguagcuuuacucagauucguaaacccagauacaggaagaguacuuuuugaauguaaauuacauaaaucaggauauguaacaguagcacacacuggccaacaugaccuaguaaucccacccaauggauauuuuagauucgauuccugggucaaucaauuuuacacacuagcaccuaugggaaacggaacaggaagacgccguuga

SEQ ID NO: 33635 - RNA, 1617 nt, Artificial Sequence
  derived and/or modified sequence opt6 from VP1__Norovirus_and/or_Norovirus-like__JQ613519
augaaaauggcuucuaaugacgcaucacccucagauggaucagcagccaacuuaguaccagaagucaacaaugaaguaauggcauuagaaccaguaguuggugccgcaaucgcagcaccaguagcaggacaacaaaauguaauagacccauggauaagaaauaauuuuguacaagcacccggaggagaauuuacagucucaccucgcaacgcccccggagaaauacuauggucagcaccacuaggacccgauuuaaauccauauuuaucacaucuugcacgaauguacaauggauaugcaggaggauucgaaguacaagucauauuagcaggaaacgcauucacugcaggaaaaauaaucuuugcagcaguaccaccaaauuuccccacagaaggacuuucaccuucucaaguaaccauguucccacacauaauaguugacguuagacaacucgaaccaguuuuaauuccauuaccagauguuagaaacaauuuuuaucacuauaaccaaucaaaugacaguacaauaaaauuaauagccauguuauacacaccacuacgagcuaauaacgcaggagaagauguauuuacaguaucaugcagaguacuaacacgaccaucaccagacuucgacuucaucuuccuaguaccuccaacaguugaaaguagaacuaaaccauucacaguaccuauauuaaccguagaagaaaugaccaacucuagauuuccaauaccauuagaaaaauuauuuacugguccaucaggagcuuuuguuguccaaccucaaaauggaagauguacuacagacggaguacuauuaggaaccacacaacuaucuccaguaaacaucuguacauucaggggagacguaacccauauagccggaucuagaaauuauacaaugaacuuagcagcauuaaacuggaacaacuacgauccaaccgaagaaauucccgcaccacuagguacuccagacuucguaggaaaaauucaaggagucuuaacacagacaacaaaagcagacggaucaacgagaggucauaaagcaacaguauauacaggaagugcagacuuuacacccaaacuuggaucuguacaauucucuaccgacacagaaaacgauuucgaaacucaucaaaauacuaaauucacaccuguagguguaauacaagauggcaacacaacacauagaaaugaaccacaacaauggguuuuaccaucauauucaggaagaaauguacauaauguacaccuagcuccagcagucgcaccuacauuuccaggugaacaauuacuauucuuuagaucuaccaugccagguuguucaggcuacccaaauauggaucuagauugccuacuaccacaagaauggguucaacauuucuaccaagaagcagcccccgcucaauccgacguagcacuccuucgauuuguaaauccagacacuggccgaguauuauucgaauguaaauuacauaaaucaggauacguaacaguagcacauacuggacaacaugauuuaguaauaccuccaaauggauauuucagauuugauucuugggugaaccaauuuuacacuuuagcaccgaugggaaauggaacaggacgucgaagauaa

SEQ ID NO: 33636 - RNA, 1617 nt, Artificial Sequence
  derived and/or modified sequence opt6 from VP1__Norovirus_and/or_Norovirus-like__HQ456341
augaaaauggcaucauccgaugcaaauccauccgauggaucaacagcaaacuuaguuccugaaguaaauaaugaaguaauggcuuuagaaccaguaguuggagcugcaauagcugcaccuguagcaggccaacaaaacguaauagacccauggaucagaagcaacuuuguacaagcaccaggcggcgaguucacaguaucaccacgaaacgcaccuggagaaauucuauggucagcaccucuaggacccgaucuaaacccauauuuaucgcaucuagccagaauguauaauggauaugcaggaggcuucgaaguacaaguaauauuagcaggcaaugcauucacugcaggaaaaauaauauuugcugcaguuccaccaaacuuuccaacugaaggacuauccccaucucaaguaacaauguuuccucauauaauaguagauguacgacaacucgaaccaguucuaauuccgcuuccagauguuagaaauaacuucuaccauuauaaucaauccaaugaccccacaauaaaauuaauagccaugcucuacacaccacuacgagcaaacaaugcaggagacgauguauuuaccguuucauguagaguauuaacacgaccaucaccagacuuugacuuuauauuucuaguaccuccaacaguggaaucccgaacaaaacccuucuccguaccuauacuaacaguagaagaaaugacaaauucccgauuuccaauaccauuagaaaaauuauucacagguccuucaucugcauuuguaguucaaccccaaaacggucgcuguacuacagauggugucuuccuaggaacuacacaacuaucaccaguaaauauauguacuuuuagaggagacguuacccauauaacaggaucucgaaauuacacaaugaacuuagcuacacaaaacuggaacucuuacgauccaacugaagaaauacccgcaccauuagggacaccagacuuuguaggaaaaauacaagguguacuaacacaaacaacuagagcggauggaucaacuagaggccauaaagcaacaguauauaccggcucagcagauuuugcaccaaaacucggaagaguacaauuugcuacagacaccgacaacgacuuugaugcaaaccagaacacaaaauucacaccuguuggagucauacaagauggagacaccgcucauagaaaugaaccacaacaauggguacuaccauccuauucagguagaaauucacauaacguccauuuagcuccagcuguugccccaaccuucccaggagaacaacuauuauucuuuagaucaacuaugccuggauguucuggauacccaaauauggaucuugacugucuacucccucaagaauggguacaauacuucuaucaagaagccgcuccagcacaaucagauguugcucuacucagauucgucaacccugauacuggaagaguacuauuugaaugcaaacuucauaaaucagguuacguuacuguagcacacacaggacaacacgaucuaguaauaccacccaaugguuacuuucgauucgauucauggguuaaccaauuuuacacacuagcacccaugggaaauggaacaggaagaagacgauaa

SEQ ID NO: 33637 - RNA, 1617 nt, Artificial Sequence
  derived and/or modified sequence opt6 from VP1__Norovirus_and/or_Norovirus-like__HM802540
augaaaauggcaucgaaugaugccacuccuucugauggaucaacagcaaacuuaguaccagaaguuaauaaugaaguaauggcacuagaaccuguaguaggagcagcaauugcagcaccaguagccggacaacaaaaugucauagacccauggauaagaaacaauuuuguacaagcaccaggaggugaauuuacaguaucaccuagaaaugcuccaggagaaauacuauggucagcaccauuaggaccagaccuuaauccauaccuuucucacuuagcaagaauguauaaugguuaugcaggaggauucgaaguacaaguuauuuuagccggaaacgcauucacugcaggaaaaauaauuuuugccgcaguuccuccuaacuuccccacugaaggacucucaccaucucaaguuacaauguucccccacauuauagucgacguaagacaacuugaaccaguuuuaauuccacuuccagauguaagaaauaacuuuuaucauuauaaucaauccaaugacccaacaauaaaacuaauagcuauguuauauacaccucuuagagccaauaacgcuggugaugacguauuuacaguaucuugucgaguuuuaacaagaccaucaccugauuuugacuucaucuuuuuaguaccacccacaguagaaucaagaacaaaaccauucucaguaccaauacuaacaguagaagaaaugacaaacucaagauucccaauaccauuagaaaaauuauuuacuggaccaucaagugcauucgucguacaaccucaaaaugguagauguacaacugacggaguucucuuaggaaccacacagcuaagcccuguaaauauaugcacauuucgcggugacguuacgcauauagcaggaacucaaaauuauacaaugaaucuagcaucccaaaacuggaacaacuaugaucccaccgaagaaauuccagcaccucuugguacaccugacuuuguaggaaaaauacaaggaguauuaacccaaacaacaagaagagauggaagcacacgaggacauaaagcaacuguauccacagguucaguucacuuuacaccaaaacuaggcaguguccaacuaucuacagauaccaguaaugacuuugaaacuggucaaaauacaagauucacaccagucggaguaguacaagacgguucaacuacucaucaaaaugaaccacaacaauggguacuaccagacuauucaggacgugauucacauaacguccauuuagcaccagcaguagcaccaacauucccaggagaacaacuauuauucuuuagaagcacuaugccugguugcucuggcuauccaaacaugaauuuagacugccuucuaccacaagaauggguacaacauuuuuaucaagaauccgcuccagcacaaucugauguagcauuacuaagauuuguuaauccugauacaggaagaguauuauucgaaugcaaacuucacaaaagcggauaugucacagucgcccauacaggacaacacgauuuaguaauuccucccaauggauauuuccguuuugacagcuggguuaaccaauucuacacucucgcaccaaugggaaacggagcuggaagaagaagauaa

SEQ ID NO: 33638 - RNA, 1617 nt, Artificial Sequence
  derived and/or modified sequence opt6 from VP1__Norovirus_and/or_Norovirus-like__AB541257
augaaaauggcaucaaaugacgcuaauccuucagacggcucagccgcaaaccuaguaccugaaguaaacaaugaaguuauggcucuagaaccaguaguaggugcagcuauagcagcaccaguugcaggacaaacaaacguaauagaucccuggauaagaaauaauuucguacaagcaccgggaggagaguucacuguaucuccaagaaaugccccaggcgaaauuuuauggucagcaccacuagguccugaccuaaauccauaccuaucucacuuagcaagaauguacaacggcuaugcaggcggcuuugaaguucaaguaauauuagcuggaaacgcauucacugcagguaaaauuauauucgcugcaguaccaccaaacuucccaacagaaggacuuucaccaucucaaguaacaauguuuccacauauuauaguagacguccgacaacuagaacccguuuuaauaccauuaccagauguaagaaauaauuucuaucacuacaaucaaucaaacgacucaacuaucaaauuaauagcaauguuauacacaccauuaagagcaaauaacgcaggagaagauguauuuacaguaucauguagagucuuaacaagaccaucuccagacuuugauuucauauuucuaguaccaccaacuguagaaucuagaacuaaaccauuuacaguccccauccuaacagucgaagaaaugaccaacucacgauucccaauccccuuagaaaaacuauuuacagguccaucaggagcauucguuguacaaccucaaaauggaagauguacaacagacgguguauuacuuggaacuacacaauuaucaccaguaaacauauguacauuucgcggugacguaacacauauugccggaucuagaaacuauacuaugaauuuagcuucuuuaaauuggaacaacuacgacccaacagaagaaauaccagccccucuaggaacaccugacuuuguaggaaaaauucaaggaguauuaacccaaaccacaaaaggagacggaucaacaaggggacacaaagcaacaguauauaccggaagugcuccauuuacaccaaaauuaggaucaguucaauucaguacagauacagaaaaugauuucgaagcacaccaaaauaccaaauucacaccaguuggcgucauacaggacgguucaacaacacauagaaacgaaccacaacaauggguacucccauccuacucaggcaggaaugcacaaaauguucacuuagcacccgcaguugcaccuaccuuuccaggagaacagcuauuauucuuucgauccaccaugccagguuguucagguuauccaaauauggaucucgauugccuacucccacaagaauggguacaacauuucuaucaagaagcagcacccgcacaaucagacguagcuuuacuucgauuugucaauccagauacuggaagaguauuauuugaaugcaaauuacacaaaucaggauacguaacaguagcacauacaggccaacacgaccuaguaauaccuccaaacggauacuucagauuugauucauggguaaaucaauuuuacacuuuagcuccaauggguaauggcacuggccgaagaagauaa

SEQ ID NO: 33639 - RNA, 1617 nt, Artificial Sequence
  derived and/or modified sequence opt6 from VP1__Norovirus_and/or_Norovirus-like__AB541242
augaaaauggcauccaaugacgcuucuccaucagauggaucugccgcaaaucucgucccagaagugaauaaugaaguaauggcccuagaaccaguuguuggagcugcaauugcagcuccaguugcuggacaacaaaacguaauugauccauggauccgaaauaacuuuguacaagcaccaggcggagaauuuacaguaucaccaagaaaugcaccuggagaaauacuuuggucagccucacucggaccagaucuaaauccauauuuaucucauuuagcacgaauguauaacggauacgcaggagguuucgaagugcaaguaauucuugcuggaaacgcauucacagcugguaaaauaauauuugccgcaguuccacccaauuuuccaacagaaggucuaucucccucacaaguuacaauguuuccacacauaauaguagauguaagacaauuagaaccaguacuaauuccauuacccgauguaagaaacaauuuuuaccacuauaaccaauccaaugacucaacaauaaaauuaaucgcuauguuauacacaccauuaagagcaaauaaugcaggagaagauguuuucacaguauccuguaggguucuaaccagaccaucaccugacuuugauuuuauuuuucuaguaccaccaacaguagaaucaaggacaaaaccuuucacuguaccaauauuaaccgucgaagaaaugacaaacucaagauuuccaauuccacuagaaaaacucuucaccgguccaucauccgcauucgugguacaaccacaaaacggaagaugcacaacagacggaguauuacuaggcacaacacaauuaucuccagucaacauauguacauuuagaggagauguaacucauauagcaggaucuagaaauuacacaaugaaucucgcauccuuaaauuggaacaauuacgaucccacagaagaaauaccagcaccauuaggaacaccagacuuuguuggaaaaauacaaggaguacuuacccaaacuacaaaaggagacggaucaacacgaggucacaaagcuacaguauacacaggauccgcuccauucacacccaaacucggaucaguacaauucucaacagacacagaaaaugauuucgaaacacaucaaaauacaaaauuuacaccaguagguguaauacaagauggaggaacaacacauagaaaugaaccucaacaauggguucuuccaaguuauucuggaagaaacguacaaaauguacauuuagcuccagcuguagccccaacauucccaggugaacaacuacuauucuuuagauccacuaugccuggauguucaggauauccaaauauggaccuagauugucuuuuaccacaagaauggguacagcauuucuaucaagaagcagcacccgcacaaucugaugucgcacuucuacgauucguaaacccagauacaggaagaguccuauucgaaugcaaauuacauaaauccggauaugugacaguagcacacacaggacaacaugaccuuguaauaccuccaaaugguuauuuccgcuuugacucaugggucaaucaauuuuacacauuagcuccaaugggaaauggaacugguaggagaagauaa

SEQ ID NO: 33640 - RNA, 1617 nt, Artificial Sequence
  derived and/or modified sequence opt6 from VP1__Norovirus_and/or_Norovirus-like__AB541225
augaaaauggcuucuuccgaugcaaauccuucagacggaucagcagcaaauuuaguucccgaagucaauaaugaaguuauggcucuugaaccaguaguaggagcugcaauagccgcaccaguagcaggucaacaaaauguaauagacccauggauacgaaacaacuuuguccaagcaccaggaggagaauuuacaguuucaccaagaaaugcaccaggcgaaauauuauggucugcaccccuaggaccagaucucaacccauaucuuucucaucuagccagaauguauaauggcuaugcuggcggauucgaaguacaaguuauuuuagcuggaaaugcauuuacagcuggaaaaauuaucuucgcagcuguuccuccaaacuucccaacagaaggacuaucacccucacaaguaacaauguuuccacacauaauuguugacguacgacaacuagaaccuguacuaauuccacuacccgauguaagaaacaacuuuuaucauuauaaccaaucaaaugacucaacaaucaaacuaauagcuauguuauacacaccauuacgcgcaaacaacgcuggagaagacguauucacuguaucuugucgaguauuaaccagaccaucaccagacuuugauuucauauuuuuaguaccaccaacagucgaaucaagaacuaaaccuuucacuguuccaauauuaacgguugaagaaaugacaaacuccagauuccccauaccacuagaaaaacuuuuuaccggaccaucauccgcuuuugucguacaaccacaaaacgguagauguacaacagacgguguuuuauuaggcacuacacaacucucaccaguaaauauauguacauuuagaggagauguaacacauauagcaggaucaagagacuauacaaugaaucuagcaaguuuaaauuggaacaauuaugacccaacagaagaaauaccagccccacucggaaccccagacuucguaggaaaaauacaaggcguuuuaacucaaacaacaaaaggcgauggaucuacucgaggucacaaagcaacuguauacacaggaucagccccauuuacaccuaaauuagguucuguccaauuuucuaccgauaccggagacgauuuucaaacccaucaaaacacaaaauucacuccaguaggaguaauucaagacggaggaacaacccaucgaaaugaaccacaacaauggguucucccaucuuacagcggacguaacguaccuaacguacauuuagcacccgccguagcuccaacauuuccaggugaacaacuacuuuucuuuagaucuacaaugcccggaugcucagguuacccaaauauggaucuagacugccuacuuccacaagaauggguacaacacuuuuaccaagaagcagcaccagcacaaucugauguagcauuacuaagauucguaaauccagacacaggaagaguauuauucgaaugcaaauugcauaaagcuggauacguaacaguagcucauacaggacaacacgaucuuguaauaccaccaaauggauauuucagauucgauucauggguaaaucaauuuuacacacuagcacccaugggaaauggaaccggaagaagacgauaa

SEQ ID NO: 33641 - RNA, 1617 nt, Artificial Sequence
  derived and/or modified sequence opt6 from VP1__Norovirus_and/or_Norovirus-like__AB541190
augaaaauggcaucaaaugaugcaaauccaagugauggaucaacagcuaauuuaguccccgaaguuaacaacgaaguaauggcauuagaaccaguaguaggagcagcaaucgcagcaccaguagcaggucaacaaaauguaauagauccauggauuagaaacaacuuuguacaagccccaggaggagaauuuacaguaucuccaagaaaugcacccggugaaauauuauggucagcaccuuuagguccugaccuuaauccauaccuaucucaccuggccagaauguauaauggauaugcaggaggauucgaaguacaaguaauacuagcuggcaaugcauucaccgcagguaaaauaaucuucgcagcaguucccccaaacuuuccaacagaaggacuaucaccaucucaaguuacaauguuuccucacauaaucguagauguacgccaauuagaaccaguauuaauaccccuaccagauguucgaaauaauuucuaucacuauaaccaauccaaugacccaacaauuaaacucauagcaaugcuauacacaccauuaagagcaaacaacgcaggagacgauguauuuacaguaucauguagaguucuaacaagacccagcccagauuuugauuuuauauuucucguaccaccuacaguugaaucaagaacaaaaccauucacagucccaaucuuaacaguugaagaaaugacaaacucacgauucccaauaccuuuagaacgacuauauacuggaccaucaucugcauucguaguacaaccacaaaacggacgauguacaaccgacggaguauuacuaggaaccacacaauuaagugcuguaaauauaugcaccuuucgaggagacgugacccauauagcggguagccgaaacuacacaaugaaucuagcaagccaaaauuggaacaauuacgauccuacagaagaaauaccagcaccucuagguacaccugauuuugucggaaaaauacaaggaauguuaacacaaacaacucgaucagacggauccacacgcggacacaaagccacuguauuaacaggaagugcagauuuugcaccaaaauuaggucgaguucaauucgcaacagacacugauaaugacuucgaaucaggacaaaauacaaaauuuacacccguaggaguuauacaagaugguuccacuacacauagaaaugaaccacaacaauggguauuaccgaacuacagcggacgaacaggccacaauguacacuuagcaccagccguagcaccaacauaucccggugaacaacuauuauucuuucgaucaacaaugccaggauguucaggauauccaaacauggaccuagauugccuacuaccucaagaauggguacaacacuuuuaucaagaagcagcaccagcacaaucagacauggcccuacuacgcuucguuaacccagauacaggaagaguauuauuugaaugcaaauuacauaaauccggauaugucacaguagcacacacaggacaacaugauuuaguaauacccccaaacggauauuucagauucgauucauggguaaaucaauucuauacacuugcaccuaugggcaauggaacaggaagaagaagauaa

SEQ ID NO: 33642 - RNA, 1617 nt, Artificial Sequence
  derived and/or modified sequence opt6 from VP1__Norovirus_and/or_Norovirus-like__AB492092
augaaaauggccucuaaugacgccacccccagcgaugguucuacagcaaacuuagucccugaaguaaauaaugaaguaauggcacuagaaccagucgucggugcagcaauagccgcaccaguagcaggacaacaaaaugucauagacccauggauaagaaacaacuucguacaagcaccuggaggagaauuuacuguuucacccagaaaugcaccuggagaaauacuauggucugcaccucuaggaccagacuuaaacccauaccuaucacacuuagcacgaauguauaaugguuacgcuggaggauucgaaguucaaguaauauuagcagguaaugcauuuaccgcaggaaaaauaauauuugcagcuguaccaccaaacuuuccaacugaagguuuaucaccaucacaagugaccauguucccucacauuauaguagaugucagacaacuugaacccguuuuaauaccauuaccagacguaaggaauaauuuuuaucacuauaaccaaucaaacgacccaacaaucaaacuaauagcuauguuauacacaccacuuagagcaaauaacgcaggagacgauguauuuacaguuucauguagagucuuaacucgaccaucccccgacuucgauuuuaucuuuuuaguaccaccaacaguugaaucaagaacaaaacccuucucuguaccaauauuaacaguagaagaaaugacaaauucccgcuucccuauaccauuagaaaaacuuuucacaggaccuucaucagcuuucguaguacaaccccaaaacggacgauguacaacagacggaguacuacuagguacaacccaacuaucaccuguaaauaucugcacuuucagaggagauguaacacauauuucaggcucaagaaacuauacuaugaacuuagcaacucaaaauuggaacucauacgauccaacagaagaaauaccagcaccccucggaaccccagacuucguagguaaaauacaaggaguacuaacacaaacaacccgagccgauggauccacaagaggacacaaagcaacuguauauacugguucagccgauuucgcaccuaaauuaggaagaguucaauuugcaacugacacugauaaugacuucgaugcaaaccaaaacacaaaauucacuccaguaggaguuauacaagacggaaacacagcacauagaaaugaaccccaacaauggguauuaccaucuuacuccggacgaaauucacauaacguacaccuugcaccagcaguugcuccaaccuuucccggagaacaacuauuauucuuccgaucaaccaugccgggauguucuggauauccaaauauggaccuagauugccuacuaccucaagaauggguucaauauuuuuaccaagaagcagcucccgcacaaucagauguugcacuauuaagauucguaaaucccgauacaggaagagucuuauucgaaugcaaacuacauaaaucaggauauguaaccguagcacacacaggacaacaugaucuaguaauaccuccaaaugguuacuucagauucgacagcuggguaaaccaauucuauacccuagcaccaaugggaaacggaacuggaagacgaagauaa

SEQ ID NO: 33643 - RNA, 1617 nt, Artificial Sequence
  derived and/or modified sequence opt6 from VP1__Norovirus_and/or_Norovirus-like__EU916956
augaaaauggcaucaaaugaugccaccccaucugauggaucaacagccaacuuaguaccagaagucaacaaugaaguaauggcacuagaacccguaguaggugccgcaauagccgcaccuguagcuggccaacaaaacguaauagauccauggauacgaaauaauuuuguacaagcacccggaggagaauuuacugucucaccaagaaacgccccuggagaaauuuuauggucagcuccucuaggaccagaccuaaacccauaucuaucacauuuagcaagaauguacaauggcuacgccggugguuucgaaguacaaguaauauuagcaggaaaugcauuuacagcagguaaaauuauuuucgcagcaguaccaccuaacuuuccaacugaaggauuaucaccuucccaaguuaccauguucccacacauuauaguagauguuagacaacuagaaccaguucucauuccauuaccagacguacgaaauaauuuuuaucacuauaaucaaucaaacgacccaaccauaaaauuaauagcuauguuauauacacccuuaagagcaaauaacgcaggcgaugacgucuuuacagucucuuguagaguacucacaagaccuucaccugauuucgacuuuauauuuuuaguaccaccuacagucgaaucccguacaaaaccauucuccguaccuauacuaacuguagaagaaaugacaaacucaagauuuccuauuccauuagaaaaacuuuuuacaggccccucuucagcauucguaguacaaccacaaaauggacguugcacaacagacggaguacuucucggaacaacacaacuaucaccugucaauauauguacuuuccgaggagacguaacccauauagcuggaacacaaaacuacacuaugaaccuagcuagucaaaacuggaacaacuacgauccaacagaagaaauaccagcaccacuaggaacacccgacuuuguuggaaaaauacaagguguauuaacacaaaccacuagaagagaugguucaacuagaggucauaaagcaacaguaucaacagguucaguucauuucacacccaaauuaggaucaguccaauucucaacugacaccucaaacgauuucgaaacaggccaaaacacaaaauuuacaccaguaggagugguucaagauggauccacaacacaucaaaaugaaccacaacaauggguacuacccgacuauucaggaagagauucccauaacguacaucuagcuccagcuguagccccaaccuuucccggugaacaauuacucuucuuucgaucaacaaugccaggauguaguggcuacccaaauaugaacuuagauugcuuacuuccacaagaauggguacaacauuuuuaucaagaaagugcaccagcucaaucagauguagcacuauuaagauucguaaacccagauacaggacgaguuuuauucgaaugcaaacuacauaaaucuggauaugucacaguagcacacacaggccaacacgaucucguuauaccuccaaaugguuauuuuagauuugacucauggguaaaucaauuuuacacauuagcaccuaugggaaacggcgcuggaagaagaagauaa

SEQ ID NO: 33644 - RNA, 1617 nt, Artificial Sequence
  derived and/or modified sequence opt6 from VP1__Norovirus_and/or_Norovirus-like__EF126962
augaaaauggcaucaaaugaugcaacacccucagauggaucaacugcaaaucuaguaccagaaguaaacaaugaaguaauggcauuagaaccaguaguaggggcagcuauagcagcaccaguugcaggacaacaaaauguaauugauccauggauccguaauaacuucguucaagcaccuggcggagaauuuaccguauccccuagaaacgcacccggagaaauacucuggucugcaccccuaggacccgacuuaaacccauaccuaucucaccuugcaagaauguauaauggauacgcaggagguuucgaaguacaaguuauccuagcuggaaaugcauucacagcagguaaaaucaucuucgcagccguaccaccuaacuuuccaacagaaggacuaucacccucacaagucacaauguucccacauauaauaguagacguacgucaacuagaacccguacuaauuccccuuccagaugucaggaauaauuuuuaucauuauaaccaaucaaacgacccaacaauacgauuaauagcaauguuauauacaccauuacgagcaaacaaugcuggugacgaugucuuuacaguaucaugcagaguacuaacacgaccauccccagacuucgauuucauuuuucucguaccacccacaguagaaucaagaacuaaaccauucucuguaccaauauuaaccguagaagaaaugacuaauucaagauuuccaauaccacuagaaaaacucuuuacaggaccaaguucagccuucguaguccaaccacaaaauggaagauguacaacagacgguguauuauuaggaacaacccaacuuucaccaguuaauauauguacauuuagaggagacguaacacauauagcaggaacacaaaauuauacaaugaaccuagcaucacaaaauuggaauaacuacgauccaacugaagaaguuccugcaccucuuggaaccccagauuuuguuggaaagauacaaggaguuuuaacacaaacaacuagaggagauggaagcacucgcggacauaaagcaacagucucaaccgguucuguucacuuuacacccaaauuagguucaguacaauucucuacagacacaucaaaugauuucgaaacaggacaaaauacaagauucacacccguaggcguaguacaagacgguucaacaacccaucaaaaugaaccucaacaauggguacuaccagauuauucaggacgagauaaucauaacguacacuuagccccugcagucgcaccaacauuuccaggagaacaauuauuauucuuuagaagcacaaugccaggaugcucaggauacccaaauaugaauuuagauugccuucuuccacaagaauggguacaacauuuuuaccaagaaucagcaccagcacaaucagauguugcauuacuccgauuuguaaauccagacacuggacguguacuauucgaauguaaacuacacaaaucaggauacguaaccguagcacacaccggacaacaugaucuaguuaucccaccaaacggauacuucagauuugauucauggguaaaucaauucuauacacucgcuccaaugggaaauggagcaggaagaagaagauaa

SEQ ID NO: 33645 - RNA, 1617 nt, Artificial Sequence
  derived and/or modified sequence opt6 from VP1__Norovirus_and/or_Norovirus-like__AB663687
augaaaauggccucaaaugacgcaaaccccucagauggcucagcagccaauuuaguacccgaaguaaauaaugaaguaauggcuuuagaaccaguuguaggagcagcuauagcagcacccguagcaggccaacaaaauguuauagacccauggauaagaaauaacuuuguacaagcaccuggaggagaauuuacuguaucaccaagaaaugcaccuggagaaauuuuauggagcgcaccccuagguccagaucugaacccauaucuuucccauuuagcaagaauguauaacggauacgccggaggauucgaaguacaaguaauacuagcagguaacgcauuuacagcuggaaaaauaauauucgcagcaguacccccaaacuucccaacagagggccuaaguccaucacaaguaacaauguucccucacauaauaguugacguaagacaauuagaaccaguacuaauaccgcuuccagaugucagaaauaauuucuaccacuacaaccaauccaaugauucaaccaucaaacuaauagcaauguuauacacuccacucagagcaaacaacgcaggagacgacgucuuuacuguaucuugcagaguucuuacaagaccaucaccagacuucgacuuuaucuuuuuaguaccaccaacaguagaaagcagaacaaaaccuuucacaguaccuauuuuaacuguugaagaaaugacaaauaguagauuuccaaucccacucgaaaaacucuucacagggccaucauccgcauuuguaguucaaccacaaaacggaagauguacaacugacggaguacuucuaggcaccacucaacucucaccaguuaauauauguacauuuagaggugauguaacucauauagcaggaaguagaaacuauacaaugaaucuagcauccuuaaacuggaauaauuacgacccaacagaagaaauaccugcaccacuagggacaccagauuuuguaggaaaaauacaagguguacuaacacaaacaacaaaaggugacggaucaacaagaggacacaaagcaacuguuuauacaggaucugcagauuuuacaccaaaauuaggcucaguccaauuuggaacugauacagaaaaugauuucgaaacacaucaaaacacaaaauucacaccaguaggcguaauccaagaugguucaacaacucaucgaaaugaaccucaacaauggguacuacccucuuauucagggcgcaauguccauaauguacaucuagcacccgcuguagcacccaauuuuccaggagaacaauuucuauucuucagaucaaccaugccaggaugcucugguuauccaaauauggauuuagauugcuuacuaccacaggaauggguacaacacuucuaccaagaagccgcuccugcacaaucagacguagcauuauuaagauucguaaauccugauaccggucgaguacuuuucgaaugcaaauuacacaaauccggcuauguaacaguagcacacacaggucaacacgacuuaguaauuccacccaauggauauuuucgcuucgauucauggguaaaucaauuuuacacauuagcaccaaugggaaauggaacaggaagaagaagauaa

SEQ ID NO: 33646 - RNA, 1617 nt, Artificial Sequence
  derived and/or modified sequence opt6 from VP1__Norovirus_and/or_Norovirus-like__AB933759
augaaaauggcaucaucagacgcaaaccccagcgacggaucaacugcaaauuuaguaccagaaguaaauaacgaaguaauggcccuggaaccaguaguaggugcagcaauagcagcaccaguugcuggacaacaaaaugucauagauccauggauaagaaauaacuuuguccaagcaccaggaggagaauuuaccguaucaccaagaaaugcaccaggagaaauccuuuggucagcaccacuaggaccagaucuaaauccauauuuaucacacuuagcacguauguauaacgguuaugcaggaggcuuugaaguacaaguaauacucgccggaaaugcuuucaccgcaggcaaaauaaucuucgcagccguaccaccaaacuuuccaacagaagguuuaucacccucucaaguaaccauguuuccacacauuauaguagacguuagacaacuagaaccaguacuuauaccucuacccgauguacgcaauaauuucuaccacuauaaccaauccaaugacccaacaauaaaauuaauagcaaugcuauauacaccauuacgagcaaauaaugccggugacgaugucuucacuguaucaugcagaguauuaacaagaccauccccagauuuugacuuuaucuuuuuaguacccccaaccguagaaucuagaacaaaaccauuuucaguaccaaucuuaacaguagaagaaaugacaaacucacgcuuuccaauaccuuuagaaaaacuauucacuggaccuucaucagcauucguaguacaaccacaaaauggcagaugcacuaccgacgguguauuauuagguacaacacaacuaucuccaguaaauauaugcacauuucgaggagacguaacucauauaacaggaucccgaaacuacacaaugaauuuagcaacacaaaacuggaauaguuacgacccaacagaagaaauucccgcacccuuaggcacaccagacuucguaggaaaaauacaaggaguauuaacacaaacaacacgagcagacggaucaaccagaggacacaaagcaacaguauauacaggaucagcagauuuugcaccuaaauuaggaagaguacaauucgcaacagacaccgauaacgauuucgacgcaaaccaaaacacaaaauucacaccaguaggaguaauccaagacggagauacagcccaucgaaaugaaccucaacaauggguacuaccaucuuacucaggaagaaauucccauaauguacauuuagccccugcaguagcaccuacauucccaggugaacaauuauuauucuucagauccacuaugccagguuguucaggauauccuaauauggauuuagacugucuacuaccacaagaauggguacaauacuucuaccaagaagcagcaccagcacaaucagauguugcauuauuaagauucgucaauccagacaccggccgagucuuauucgaauguaaacuacauaaaucaggcuauguuacaguagcacauacuggccaacacgauuuagucaucccaccaaacggauauuucagauuugacucauggguuaaccaauuuuacacccuagcacccaugggaaaugguaccggcagaagacgauaa

SEQ ID NO: 33647 - RNA, 1617 nt, Artificial Sequence
  derived and/or modified sequence opt6 from VP1__Norovirus_and/or_Norovirus-like__AB933755
augaaaauggccucaucugacgcaaacccaucagaugguucaacagcuaauuuagucccagaaguaaauaaugaaguaauggcauuagaaccaguaguaggagcagccauagcagcacccguagcaggucagcaaaaugucauagacccuuggauaagaaacaacuuuguacaagcaccaggaggagaauuuaccguaucaccuagaaaugcaccaggugaaaucuuauggucugcaccacuagguccagaucucaacccuuaccuaucucaccuagcacgaauguauaauggcuacgcgggagguuucgaaguccaagucauacucgcuggaaaugcauuuacagcaggaaaaauaauuuucucagcaguuccuccaaacuuuccaacagaaggauuaucuccaucacaaguuacuauguucccacacaucauaguugacgucagacaauuagaaccaguucuaauaccacucccagauguacguaacaauuuuuaccauuauaaucaauccaaugacccaacaauaaaauuaauagcaauguuauacacuccccuacgagcaaacaacgcaggagacgacgucuucacaguaucaugucgaguacuaaccagaccaagcccagauuuugacuuuauuuuucuaguaccaccaacaguagaaucaagaacaaaacccuucucaguaccaauccuaacaguagaagaaaugacaaauucucgauucccaauuccccuagaaaaacuauuuaccggacccucaucaacuuucguaguacaaccccaaaacggaagauguaccaccgacggaguacuacuaggaacaacacaacuaucaccaguaaauauaugcaccuuuagaggugacguaacacacauaacaggaucucauaauuacacaaugaaucuagcaucccaaaauuggaacucauaugauccaaccgaagaaauaccagcaccacuaggcacaccagauuuuguagguaaaauacaagguguauuaacacaaacuacacgaacagacggaucaacaagaggacacaaagccacaguauauacaggaucagcagaauuuagcccuaaauuaggacgcguacaauuugcuacagacacaaauaacgacuucgaugcaaaucaaaacacaaaauucacaccaguaggaguuauucaggauggaggcacaacacauagaaaugaaccacaacaaugggucuuaccaucauauucagguagaaauacucauaacguacaccuagcaccagcaguagcaccaacauucccaggagaacaauuauuauuuuucagaucuacaaugcccggaugcucaggcuauccaaauauggaccuagacugccuucuaccacaagaauggguacaacauuucuaucaagaagcagcuccagcacaaucagacguagcauuauuacgauucguaaacccagacacaggcagaguacuuuuugaaugcaaacuacauaaaucaggcuauguaaccguagcacauacuggacaacacgaucuaguaauaccaccaaacggcuauuuccgauucgacucauggguaaaccaauuuuacacauuagccccaaugggaaauggaacaggccgaagaagauaa

SEQ ID NO: 33648 - RNA, 1617 nt, Artificial Sequence
  derived and/or modified sequence opt6 from VP1__Norovirus_and/or_Norovirus-like__AB933677
augaaaauggcaaguaaugaugcaaaccccucugauggauccgcagcaaauuuagucccugaaguaaacaacgaaguaauggcauuagaacccguagucggagcugcaaucgcagcaccaguagcaggacaacaaaacguaauagauccauggauaaggaauaacuuuguacaagcaccuggcggcgaauuuaccgucucaccacgaaaugcaccaggcgaaauauuaugguccgccccuuuagguccagaucuaaauccauaccuaagucaccuagcaagaauguauaauggauacgcaggagguuuugaaguacaaguaauauuagcaggcaaugcauuuacagcaggaaaaauaauauucgcugcaguaccaccuaauuuccccauagaaggacuaucacccucacaaguuacaauguuuccucacauuaucguugacguaagacaacuugaaccaguacuuauaccauuaccagauguuagaaauaauuuuuaucauuauaaucaaucuaaugauuccaccauaaaacuuaucgcaauguuauauaccccacuaagagcaaauaaugcaggagaagacguuuuuacaguuucaugcagaguacuaacaagaccaucaccugauuuugauuuuauauuucucguaccucccacaguagaaucacgaacaaaacccuucacaguaccaaucuuaacuguugaagaaaugacaaacucacgauuccccauaccacuagaaaaauuauuuacaggaccaagcucagccuuuguaguucaaccacaaaacggaagauguacaacagauggaguauuauuaggaacaacucaacuaucaccuguuaauauauguacauuuagaggagacguaacacacauugcaucaucuagaaauuacacuaugaaccuugcaucucuuaacuggaauaauuacgacccaacagaagaaauacccgcaccccuaggaacaccugacuucgucgguaaaauacaaggaguccuaacucaaacaacaaaaggagaugguucaacacgcggacacaaagcaacaguauauacaggaucagcaccauuuacacccaaacuaggaucaguacaauucucaacagauacagaaaacgacuucgaaacacaucaaaauacaaaauuuacucccguuggaguaauacaagacggcggcacaacccauagaaaugaaccgcaacaauggguacuucccucauauaguggacgaaauguuccaaauguacacuuagcuccugcaguagcaccuacauuuccuggugaacaauuacucuucuuuagaucaaccaugccaggaugcucaggauauccaaauauggauuuagauuguuuacuaccucaagaauggguacaacauuucuaucaagaagccgcuccagcacaaucugacgucgcacuacuucgauucguaaacccagacacaggucgaguacuauucgaauguaaacuacauaaauccggauacguaacaguagcacacacaggacaacaugaccuagucauaccaccaaacggauacuucagauucgauuccuggguuaaucaauuuuauacccuagcaccaaugggaaacggaacggguaggagaagauaa

SEQ ID NO: 33649 - RNA, 1617 nt, Artificial Sequence
  derived and/or modified sequence opt6 from VP1__Norovirus_and/or_Norovirus-like__AB933650
augaaaauggcaucaaaugacgccaauccaucagacggaucagcagcaaaccuuguuccagaaguuaauaaugagguaauggcauuagaaccaguaguaggagcagcaauagcagcaccuguagcaggucaaacaaauguaauagauccauggauacgaaacaauuucguccaagcaccuggcggugaauuuacaguaucuccacgaaaugcaccaggagaaauauuauggagugccccauuaggaccagaucuaaauccauaucuaagccaccuagcaagaauguacaacggauaugcuggaggcuucgaaguccaaguaauauuagcaggaaaugcauucacagccggcaaaauaauuuuugcugcaguaccacccaacuucccaacagaaggauuaucaccaucacaaguaacaauguucccucacauuauaguagauguacgacaacuagaaccaguacuaauaccauuaccggaugucagaaauaauuucuaucacuacaaucaaucaaacgacucuacaauaaaauuaauugcaaugcuauacacuccacuaagagcaaacaaugccggagaagauguuuuuacaguaucuugucgaguacuaacuagacccagucccgacuuugacuucaucuucuuaguaccaccuacaguagaaucucgaacgaaacccuuuacaguaccaauacuuacaguagaagaaaugaccaacucaagauuuccaauuccauuagaaaaacuauucacaggaccaucaggagcauucguaguucaaccacaaaacggcagauguacuacugauggaguauuacuaggaacaacucaauuaucaccaguaaacauauguaccuuuagaggagacgucacacauauugcaggaucccgaaauuauacuaugaaucuagcaucacuaaacuggaacaacuaugauccaacagaagaaauacccgcaccccuaggaacaccagacuucguaggaaaaauacaaggaguauuaacacaaacaaccaaaggugacggauccacaagaggucauaaagcaacagucuauacaggaucugcacccuuuacaccaaaacuuggaucaguacaauuuucaacagauacugaaaaugauuucgaagcucaucaaaauacaaaauuuacaccaguuggaguaauacaagauggcucuacaacacauagaaaugaaccccaacaauggguacuacccuccuauucaggaagaaauguccaaaacguacaucuagcaccagcaguagccccuacuuucccaggagaacaauuauuauucuuuagaucuacaaugccuggcugcagcggauauccaaacauggaccuugauugccuauuaccccaagaauggguucaacauuucuaucaagaagccgcaccagcacaaucagacguagcacuacuaagauucguaaauccagauacaggaagaguacuauuugaauguaaauuacauaaaucaggauauguaacaguagcacacacaggucaacacgauuuaguaauaccaccaaauggcuauuuccgauucgauucauggguaaaucaauuuuacacucucgcaccaaugggaaauggcacaggcagaagacgauaa

SEQ ID NO: 33650 - RNA, 1617 nt, Artificial Sequence
  derived and/or modified sequence opt6 from VP1__Norovirus_and/or_Norovirus-like__KM245071
augaaaauggccuccaaugaugcaucuccgucagacggcucagcagccaaccuaguaccagaaguuaacaaugaaguuauggcauuagaaccaguaguaggugcagcaauagcugcaccaguagcuggccaacaaaauguuauugacccuuggauuagaaacaacuuuguucaagcacccggcggagaauuuacagucucaccuagaaacgcaccuggcgaaauacuauggagugccccacuagguccugauuuaaauccauaccuaucacaucucgcuagaauguauaauggcuacgcaggaggcuucgaaguacaaguaauauuagcagguaaugcuuuuacugcaggaaaaauaaucuuugcugcuguuccacccaauuuucccacagaaggauuauccccaucacaaguaacuauguucccacacauuauaguagauguacgacaauuagaaccaguauuaauaccauuacccgauguaagaaacaauuucuaccauuacaaucaaucaaaugauucaacaauaaaacucauagcaauguuauacacuccacuaagagcaaacaacgcaggagaagacguauuuacaguuucaugcagaguacuaacaagaccaucaccagacuuugacuucauauuucucguaccaccaacaguagaaucacgcacuaaaccuuucacaguaccuauauuaaccguagaagaaaugacaaacucaagauucccaaucccacuagaaaaacucuuuacagguccaucaggagcauuuguuguacaaccccaaaacggccgauguacaacagaugguguacuauuagguacuacacaauuaucaccagucaauauaugcacauuuagaggagacguuacccauauagcaggaucucgcaauuacacaaugaaccuagcugcuuuaaacuggaacaacuaugacccaacagaagaaaucccagccccucuaggcacaccagacuuugucgguaaaauacaaggcguacuaacacaaacaaccaaagcagauggaucuacaagaggucacaaagccacaguauauaccggaucagcugacuucacaccaaaauuaggaucaguacaauuuucuaccgacacagaaaacgacuucgaaacacaucaaaauacaaaauucacuccaguuggcguuauacaagacggaaguacuacacauagaaaugaaccccaacaauggguccuaccuucuuauucaggccgaaacguacacaauguacauuuagccccugcaguagcaccaacauucccaggagaacaauuacuauucuuucgaucaacuaugccaggcuguuccgguuaucccaauauggauuuagauugccuacuuccacaagaauggguacaacauuuuuaucaagaagccgcgcccgcucaauccgacguagcacuucuaagauuuguaaacccagauacaggaagaguacuuuuugaaugcaaauuacauaaaucaggauauguaacagucgcacacaccggccaacacgacuuaguaauaccuccaaauggcuauuucagauuugauucaugggucaaucaguuuuacacacucgcccccaugggaaaugguacaggaagaagacguuaa

SEQ ID NO: 33651 - RNA, 1617 nt, Artificial Sequence
  derived and/or modified sequence opt6 from VP1__Norovirus_and/or_Norovirus-like__KF712497
augaaaauggcuucaucagacgcaaacccaucagauggaucagcagcaaacuuaguaccagaaguaaauaaugaaguaauggccuuagaaccaguaguuggagccgcaauagcugccccugucgcuggccaacaaaauguuauugacccuuggauaagaucaaacuucguacaagcaccuggaggagaauuuaccgucaguccgcgaaaugcaccuggagaaauccuauggucugcaccacuaggucccgaccuaaauccauaucuaucucaucuagcccguauguauaacggauaugcuggaggauucgaaguacaaguaauccuagcaggaaaugcauuuacagcaggcaaaauuauauucgccgcaguaccaccaaacuuuccaacagaagguuuaucccccucacaaguaacaauguuuccccacaucauaguagacguucgccaacuagaaccaguacuaauuccuuuaccagauguacgaaacaauuuuuaucacuacaaucaaucaaacgacucuacaauuaaauuaauugcaauguuguacacaccacuuagagccaauaacgcuggagacgacguauuuacaguuucuuguagaguacuaacaagaccaucccccgacuuugacuuuauauuucuaguaccuccaacaguagaaucaagaacaaaaccauucacuguaccaauuuuaaccguagaagaaaugacaaacucacgauuuccaauaccacuagaaaaacucuuuacaggacccucuucagcuuucguaguacaaccacaaaacggacgaugcacaaccgacgguguacuacuaggaacaacacaacuaucaccaguuaacauauguacauuucgaggagaugucacacauauagcagggucaagaaacuacacaaugaaucuagcaucucucaauuggucaaauuaugauccuacagaagaaauaccagcaccacuuggaacuccagacuuuguaggaaaaauacaaggcguauuaacacaaacaaccaaaggcgacggauccacaagaggucauaaagcaacgguauauacaggaucagcagacuuuaccccaaaauuaggaucaauacaauucgccacagauacagaaaacgacuuugaaacacaucaaaauacuagauuuacaccaguaggaguaauccaagacggagguacaacacauagaaaugaaccacaacaauggguuuuaccaucuuacucaggaagaaauguucacaacguacaccuagcacccgcaguagccccaaauuuuccuggagaacaauuauuauuuuuccgaucaacuaugcccggaugcucuggauaucccaauauggaccuagauugcuuauuaccacaagaauggguucaacauuucuaccaagaagcugcaccagcacaaagcgacguggcauuacuaagauuuguaaauccugauacuggaagagucuuauucgaauguaaacuccacaaaucaggcuauguaacuguagcacacacaggacaacacgauuuaguuauaccaccaaauggauauuucagauucgauuccuggguaaaccaauucuauacauuagcaccuaugggcaacgguacaggacgaagaagauaa

SEQ ID NO: 33652 - RNA, 1617 nt, Artificial Sequence
  derived and/or modified sequence opt6 from VP1__Norovirus_and/or_Norovirus-like__KC990829
augaaaauggcaucaaacgaugcaaacccaucagauggauccgcagcaaauuuaguaccagaaguaaacaaugaaguuauggcacuugaaccaguaguaggcgcagcaauagcagcuccaguagcaggacaacaaaauguuaucgacccauggauucgaaauaacuuuguacaagccccaggcggagaauuuacaguaucaccaagaaaugcuccaggagaaauacucuggucagccccuuuaggaccagaccuaaauccauacuuaucacacuuagcaagaauguauaacggauacgccggaggauuugaaguucaagucauacuugcuggaaaugcauuuacagcaggaaaaauaaucuuugcagcaguaccaccaaauuuucccacagaaggucuaucuccaagucaaguaacaauguucccucauauaauaguagauguacgacaacuagaaccuguucuaauuccauuaccagauguacgaaauaacuucuaucacuauaaucaaucaaaugauucaacuauaaaacucauagcaaugcuuuacacaccacuaagagcuaacaacgccggagaugauguauuuacaguuucaugucgaguauuaacacgcccuucaccagacuuugacuucauauuuuuaguaccaccuacagucgaaucacgaacuaaaccuuuuacaguaccaauauuaacaguugaagaaaugacuaacagucguuucccaauaccauuagaaaaacuauuuacaggaccuucaucagcauuugucguacaaccccaaaacggacguuguacaacagaugguguacuauuaggaacuacacagcuauccccaguaaacaucuguacauuuagaggagacguuacccauauagcgggaucacgaaauuacacaaugaaucuagcuucucuaaauuggaacaauuacgauccaaccgaagaaauacccgccccucuuggaacaccugacuuuguaggaaaaauacaaggugucuuaacacaaaccacuaaaggcgacggaucaacaaggggccacaaagcuacaguauacacaggaucagcugauuucacaccuaaauuaggaucagugcaauuugcaacagauacagaaaaugacuucgaaacacaucaaaacacaaaauucacuccaguaggcguuauacaagauggaucaacaacacacagaaaugaaccucaacaauggguuuuaccuuccuacucagguagaaauguacauaauguccaccucgcuccugcaguagcaccuaauuuuccaggagaacaacuacuuuucuuccgaucuaccaugccagguugcuccgguuacccaaauacagaucuagauugucuacuaccacaagaauggguacaacauuuuuaucaagaagcagcaccagcacaaucagaugucgcauuauuaagauuuguaaacccagacacuggucgugucuuauuugaaugcaaauuacacaaaucaggcuauguaacaguagcacacacuggucagcacgaccucgucaucccacccaauggauauuucagauuugacucaugggucaaucaauucuacacacucgcaccaauggguaauggaaccggaagaaggagauaa

SEQ ID NO: 33653 - RNA, 1617 nt, Artificial Sequence
  derived and/or modified sequence opt6 from VP1__Norovirus_and/or_Norovirus-like__JX439843
augaaaauggcauccaaugacgcauccccaucagauggaucagcagcuaaccuaguaccugaaguaaauaacgaaguaauggcauuagaaccaguaguaggagcugccaucgcugcaccagucgcaggacaacaaaaugucauagauccauggauaagaaauaacuuuguacaagcaccaggaggugaauuuacaguuagcccaagaaaugcaccaggagaaauccuauggucagcaccauuaggucccgaucuuaacccauauuuaucacauuuagcaagaauguacaacgguuacgcuggugguuuugaaguacaaguaauucuagcaggaaacgcauuuacagcaggcaaaauaaucuucgcagcaguaccaccuaacuuuccaacugaaggucucucaccuucccaaguaacaauguucccucacauaauaguagauguacgacaauuagaaccaguauuaaucccauuaccagacgucagaaacaauuucuaccacuacaaccaaucaaacgauucaacaauaaaauuaauugcaaugcuauacacaccacuaagagcaaacaacgccggugaagaugucuucacaguaucaugccgcguccuuacacgaccuucaccugacuuugacuucauauuuuuaguaccaccaacaguagaaucucguacuaaaccauucaccguaccaauauuaacaguagaagaaaugacaaauucucgauuuccaauaccuuuagaaaaacuauucacaggaccauccucugcauucguaguucagccacaaaacggaagauguacaaccgacgguguuuuacuuggaacaacacaacuaccaccaguaaauauauguacauucagaggagacguaacucauauugcuggaucacguguauacacaaugaaccucgcuucauuaaacuggaacaauuaugacccaacugaagaaauaccagcaccccucggaacaccagacuuuguaggaaaaauucaaggaguucuaacacaaacaaccaaagaagacggaucaacacgagggcauaaagcuacaguauacacaggauccgcuccauuuacuccaaaacuaggcaguguacaauuuucgacagauaccgaaaacgauuuugaaacacaccaaaauaccaaauuuaccccaguaggaguaauacaagacggaggaacaacccaucgaaaugaaccacaacaauggguacuacccucauauucaggacgaaaugcaccaaauguacaucucgcaccagcaguagcaccaacauuucccggagaacaauuacuuuucuucagaucaacaaugccuggauguucaggauaucccaauauggaccuagauugcuuauuaccccaagaauggguacaacauuuuuaucaagaagcagccccagcacaaucagacguagcucuacuacgauucguaaauccagauacaggacgaguauuauuugaaugcaaacuacauaaaaguggcuauguaacaguagcacauacaggacaacacgaccuaguuauuccaccaaacggauacuucagauuugauaguuggguaaaccaauuuuauacucucgcuccuaugggcaacggaaccggaagacgacgauaa

SEQ ID NO: 33654 - RNA, 1617 nt, Artificial Sequence
  derived and/or modified sequence opt6 from VP1__Norovirus_and/or_Norovirus-like__JX439841
augaaaauggcaaguaaugaugcaucaccaucugacggcuccgcugcaaauuuaguuccagaaguaaacaaugaaguaauggcucuagaaccaguaguaggagcugcaauagcagcaccaguagcaggucaacaaaaugucauugauccauggauaagaaauaauuuuguccaagcccccggaggagaguucaccgucucaccaagaaacgcccccggagaaauauuauggucagcaccucuaggaccagacuuaaauccauauuuaucacauuuagcacgcauguauaacggauaugcaggcggauuugaaguacaagucauauuagccggaaacgcauuuacagcuggaaaaauaauuuuugcugccguaccaccuaacuucccaacagaaggucuuucuccaucacaaguaacaauguuuccacauauaauaguugacguaagacaacuagaaccaguacuuauaccuuuacccgauguacgaaauaauuucuaucacuacaaucaaagcaaugacucaacuauuaaauuaauagcaaugcuauauacacccuuaagagcaaauaaugcaggagaagauguuuuuaccguauccugucgaguacuaacacgaccuucaccagacuuugacuuuauauuucuaguaccaccaacaguugaaucaagaacaaaacccuuuacaguuccaauauuaacaguugaagaaaugacaaacucacgcuucccaauacccuuagaaaaacuuuuuacuggaccaucaucagcauucguaguacaaccacaaaacggaagaugcacaacagauggaguacuacuaggaacaacacaauuaucacccgucaauauauguacauuuagaggagacguaacacauauagcuggcucaagagauuacacaaugaaccuagcaucacuaaacuggaauaauuacgauccaacagaagaaauaccagcaccacuuggaacaccagauuuuguaggaaaaauacaaggaguuuuaacacaaaccaccaaaggagacgguucuacaagaggacacaaagccaccguauacaccggaucaacaccauucacaccaaaauuaggaucaguccaauuuucaacagacacagaaaacgacuuugaaacccaucaaaauacuaaauucacaccaguuggaguaauccaggacggaggaacgacacauagaaacgaaccucaacaauggguucuaccaucauauuccggacgaaacguacaaaauguccaccuggccccagccguugcucccacuuucccaggagaacaacuauuauucuucagaucgaccaugccaggaugcuccggauauccaaauauggaucuagauugccuauuaccccaagaauggguacaacauuuuuaucaagaagcugcaccagcacaaucugacguagcucuuuuaagauucguaaauccagacacaggcagaguacuauuugaauguaaauuacauaaaaguggauauguaacaguagcacauaccggacaacaugaucuaguuauaccuccaaauggcuauuuccgauuugauucaugggucaaucaauuuuauacauuagcccccaugggcaacggaacaggacgcagacgauaa

SEQ ID NO: 33655 - RNA, 1617 nt, Artificial Sequence
  derived and/or modified sequence opt6 from VP1__Norovirus_and/or_Norovirus-like__JX439830
augaaaaugggaucaaacgacgccaacccuucugacggaucaacugcuaauuuaguaccagaaguuaacaacgaaguaauggcauuagaaccaguaguaggagcagcaauagccgcaccaguagcuggacaacaaaaugugauugaccccuggauaagaaauaacuuuguacaagcaccaggaggagaauuuaccguaucuccaagaaacgcaccaggagaaauauuaugguccgccccacuuggccccgaucuaaauccauauuuaucacaucucgcuagaauguacaacggauacgcuggcgguuuugaaguacaaguaauacuagccggaaaugccuuuacagcaggaaaaauuauuuuugcagcuguaccaccaaacuucccaacagaaggucuaucaccaucacaaguaaccauguucccacacauuauaguagacguaagacaauuagaacccguauuaauuccacuuccugauguaagaaauaacuuuuaucacuauaaucaauccaacgacccuacaauaaaacuaauagcaauguuguacaccccauuacgagcaaacaaugccggagaugacguauuuacugucucaugcagaguuuuaacuagaccuucaccagacuucgauuuuauauuucuaguacccccaacaguagaaucaagaaccaaaccuuucucagucccuauauuaacaguagaagaaaugacuaauucaagauucccaauaccucuagaaaaacuauucacaggacccucuucagccuuuguaguacaaccacaaaacggaagaugcacaacggacggugucuuauuaggaacaacacaacucagucccguaaacauauguacauuuagaggugauguuacacauauaacuggcucucgaaacuacacaaugaacuuagcaacacaaaauuggaacucuuaugauccaacagaagaaaucccagcaccauuaggaacuccagauuuuguuggaaaaauacaaggaguacuuacacaaacaacaagagcagauggcucuacaagaggacauaaagcaacaguauauacaggcuccgcugauuuugcaccaaaacucggaagaguacaauucgcaacugauacagauaaugauuucgaugcuaaccaaaauaccaaauuuacacccguagguguaauacaagacggagacacagcucauagaaaugaaccucaacaauggguucuuccuucauacucaggaagaaauucucacaauguacaccucgcuccagccguagcaccaacauuuccaggugaacaacuauuauuuuuccgauccacaaugccagguugcagcgguuaucccaacauggaucuugauuguuuacucccacaagaauggguucaauauuucuaccaagaagcugcaccagcacaaucagauguugcauuacuuagauucguaaaucccgacacaggacgaguucuauuugaaugcaaauuacauaaaucagguuauguaacaguagcccauaccgggcaacacgaucuuguaauaccaccaaauggauacuuccgauuugauucuuggguaaaucaauuuuacacacuagcaccaaugggaaauggaacuggaagacgccgauaa

SEQ ID NO: 33656 - RNA, 1617 nt, Artificial Sequence
  derived and/or modified sequence opt6 from VP1__Norovirus_and/or_Norovirus-like__JX439828
augaaaauggcaucuuccgacgccaacccaucugauggaucaacagccaaccucguaccagaaguaaacaacgaaguaauggcuuuagaaccaguagucggagcagccauagcugcaccaguagcuggacaacaaaauguaauagauccauggauaagaaauaacuuuguacaagcuccugguggugaauuuacaguaucaccacgaaaugccccaggcgaaauacuaugguccgcaccucuaggaccugaucuaaauccauauuuaucacauuuagcaagaauguauaacgguuacgcaggagguuucgaaguucaaguuguacuugcaggaaaugccuucacagcaggaaaaauaauauuugcagcuguaccaccaaacuucccaaccgaaggacuaucaccaucccaaguaaccauguuuccacauauaauaguugacguaagacaauuagaacccguucuaauaccauuaccagauguaagaaacaauuucuaucacuauaaccaaucaaaugacccaacaauaaaauuaauugcgauguuauacacaccauuaagagccaacaaugccggagacgauguauuuacaguaucaugcagaguucuaacacgaccguccccugacuuugacuuuauauuccucguuccaccaacaguagaaucuagaacaaaacccuucucaguaccaauauuaacaguagaagaaaugaccaauucacgauuuccaaucccacuagaaaaacuuuuuacuggaccaucauccgcauucguaguacaaccacaaaacggucgaugcacaacagacggaguauuauuagguaccacucaacuuucaccuguaaauauauguacauuuagaggugacguaacacauaucacaggcucccgaaacuacacaaugaauuuagcaacacaaaacuggaacucauacgacccaacagaagaaauaccagccccauuagguacaccugacuuugucgguaaaauucaaggaguauuaacucaaacaacucgugccgauggaucuacacgaggacacaaagcuacuguauacacagguucugcagacuuugcaccaaaauuaggacguguccaauuugcuacagacaccgauaaugauuucgaugccaaucaaaauacaaaauucacaccaguuggcguaauacaagauggcgauacagcacaucgaaaugaaccacaacaauggguacuaccaucuuauucaggucgaaacucucacaacguacaccuugcaccagccguugcaccaacauucccaggugaacaacuauuauucuuuagaucaacaaugcccgguuguagugguuauccaaauauggaucuagacugccuacuaccacaagaauggguacaauacuuuuaucaagaagccgcaccagcccaaucagacgucgcccuacuucgcuucguaaacccggacacuggaagaguacuuuuugaaugcaaacuccacaaaucuggauacguaacuguagcacauacaggacaacaugauuuagucauuccaccaaacggauacuuccgauucgauucauggguaaaucaauucuacacauuagcuccaaugggcaauggaacaggccgaagaagauaa

SEQ ID NO: 33657 - RNA, 1617 nt, Artificial Sequence
  derived and/or modified sequence opt6 from VP1__Norovirus_and/or_Norovirus-like__JX445153
augaaaauggcaucaaaugaugcuacaccaucagauggaucuacagccaaccuaguaccagaaguaaacaaugaaguaauggcauuagaaccaguaguaggugcagccauagcagcaccaguagcaggucaacaaaauguaauagauccauggauaagaaacaacuuuguccaagcaccuggaggugaauuuacuguaagcccccgaaaugcacccggagaaauacuauggucagcaccacuaggaccugaucuaaacccauacuuaagucacuuagcacgcauguauaauggcuaugcuggaggcuucgaaguacaagucauacuagcagguaaugcuuucacagcaggaaaaauaauuuucgcagcaguaccaccaaacuuucccacagaaggauuaucaccaucacaaguuaccauguucccucauaucauaguugauguacgacaacuagaaccuguacuuauaccauuaccagaugucagaaauaauuucuaucacuacaaccaauccaaugacccaacaauuaaacuuauugcaauguuauauacacccuuaagagcuaauaaugcaggagacgacguauuuacagucucaugcagaguucuuacacgacccucaccugacuucgacuucauauuuuuaguaccuccaacagucgaaucaagaacaaaaccauucucaguccccauccuaacaguagaagaaaugacaaacucaagauuuccuauaccauuagaaaaauuauucacaggcccaaguucagcauucgucguucaaccacaaaauggcagaugcacuacagacggcgucuuacuuggaaccacacaauuaucuccaguuaauaucuguacauuuagaggugacguaacacacauugcagguacacaaaauuacacaaugaauuuagcaucgcaaaacuggaacaauuacgauccaaccgaagaaauaccugccccauuaggagcaccagacuuuguagguaaaauucaaggcguacuaacucaaaccacaagaggugauggaucaacaagaggccauaaagcaacaguaucaacaggcaguguucacuucacaccaaaacuugguucaguacaauucucaacugauacuucaaaugaucuagaaacaggacaaaauacaagauucacuccagucgguguaguacaagauggauccacaacacaccaaaacgaaccucaacaauggguauuaccuaauuauucaggacgagauucacauaauguucaccuagcuccagcaguagcucccacauucccaggagaacaauuacuuuucuuucgcuccacaaugcccggaugcagcggauauccaaauaugaauuuagauuguuuauuaccacaagaauggguacaacacuucuaucaagaaucagcaccagcucaaucugacguagcacuauuacgauuuguaaauccagacacaggaagaguccuauucgaaugcaaacuacauaaaucaggcuaugucacaguagcacacacuggccaacacgacuuaguaauaccaccuaacggauauuucagauucgauucauggguaaaucaauucuauacacuagcaccaauggguaauggagccggaagaagaagauaa

SEQ ID NO: 33658 - RNA, 1617 nt, Artificial Sequence
  derived and/or modified sequence opt6 from VP1__Norovirus_and/or_Norovirus-like__JX155754
augaaaauggcuucaaaugacgcaaauccaucagacggcucugcagcuaacuuaguaccagaaguaaauaacgaaguaauggcgcuagaacccguuguuggagcagcuauagcagcaccagucgcuggacaacaaaauguaauugacccauggauaagaaauaacuuuguacaagcuccugguggagaauuuacaguaucaccaagaaaugcaccaggagaaauacuauggucagcaccacuaggaccagacuuaaacccauaccucucacaucuugcaagaauguauaacgguuacgcaggaggauucgaaguacaagucauuuuagcaggaaaugcauuuacagcagggaaaauaauauucgcagcaguuccaccuaacuuuccaacagaagguuuaucuccaagccaaguaacaauguucccacauauaauaguggacguacgacaacuagaaccaguacuaauaccguuaccugaugucagaaacaauuucuaucacuacaaccaaucuaacgacccuacaauuaaacuaauugcuaugcuauauacaccacuacgagcaaacaaugcaggagaagaugucuuuacagugucaugcagaguacuaacaagacccagcccagacuuugacuucauauuucuaguucccccaaccguugaaucuagaacaaaacccuuuacaguuccuauauuaacaguagaagaaaugaccaauucuagauuuccuauaccauuagaaaaacuauucacagguccaucaucagcauucguaguacaaccacaaaacggaagauguacaacagauggaguacuacuaggcacaacucaauuaucaccaguaaauauauguacauuucgaggcgacguuacacauauagcaggauccaggaacuacacuaugaaucuagcaucacuaaauuggaauaauuacgaucccacugaagaaauaccagcaccauuaggcacacccgauuuuguaggcaaaauucaagguguacuaacacaaacaacaaaaggagacgguaguacucguggacauaaagcaacaguauauacuggauccgcacccuuuacaccuaaauuagguucaguacaauucucuacagacaccgaaaacgauuucgaaacucaccaaaauaccaaauuuacucccguuggaguaauacaagacggaggaacaacucacagaaaugaaccacaacaauggguccuaccaucauauagcggacgugaugucccaaacgcacacuuagcuccugcaguagcuccaacauuuccuggagaacaacuucuauucuuuagaucuaccaugccaggaugcucaggauauccaaacauggaccuugauugccuacuuccacaagaguggguucaacauuucuaucaagaagcagccccagcucaaucugacgucgccuuacuuagauuuguuaacccagauacaggaagaguacuauuugaauguaaauuacacaaaaguggauauguaacaguagcacacacuggacaacaugaucuugucauuccuccaaacggauauuuuagauucgacuccuggguuaaucaauuuuacacucuagcaccaaugggaaacggcacuggaagaagaagauaa

SEQ ID NO: 33659 - RNA, 1617 nt, Artificial Sequence
  derived and/or modified sequence opt6 from VP1__Norovirus_and/or_Norovirus-like__JN400608
augaaaauggcuucaaacgaugcaaacccaucagauggaucagccgcuaaucuaguaccagaagucaauaacgaagucauggcuuuagaaccagucguaggagcagcaauagcugcaccaguagcaggucaacaaaacguaauagauccauggauaagaaauaacuuuguccaagcaccaggaggagaauuuacaguaucaccuagaaaugccccaggagaaauacuauggucagcaccuuuaggucccgaucuaaauccauauuuaucacacuuagcacgcauguacaacggauacgcugguggauucgaaguacaaguaauauuagcagguaacgcauuuacagcuggaaaaaucauauucgcagcaguaccaccaaauuuuccuacggaaggacucucuccaucucaaguaacaauguuuccacacauaaucgucgacguucgacaauuagaacccguacuuauaccacuaccggauguacgaaauaauuucuaucacuacaaucaaucaaaugacucaacuauuaaauuaauagcaauguuauacacaccauuaagagccaacaaugccggcgaagaugucuuuacuguaucuuguagaguauuaacuaggccuuccccugauuuugacuuuauuuuucuaguuccuccaacaguugaaucuagaacaaaaccauucacaguaccuaucuuaacaguagaagaaaugacuaauaguagauucccaauaccacucgaaaaacuauucacaggaccaagcucagcauuugucguacaaccccaaaaugguagauguacaacagauggagucuuauuaggaaccacacaauuaucaccaguaaauauaugcacauuuagaggagauguaacacacauagccggaucccacaauuauaccaugaaccuugcuucuuuaaacuggaauaauuacgauccaaccgaagaaauaccugcuccacucggaacuccugauuuugucggaaaaauacaaggaguacuaacacaaacaaccaaaggagacggauccacuagaggacauaaagcaacagucuacacaggaucugcaccauuuacaccaaaacuaggaucaguacaauucucaacagauacagaaaacgacuuugaaacacaucaaaacaccaaauucaccccaguaggaguuauucaagacggaaguacaacacauaggaacgaaccacaacaauggguacuaccaaguuacaguggcggaaauguacauaacguacauuuagcaccagcuguagcaccaacauuccccggcgaacaacuauuauucuuuagaucaacaaugccaggaugcucaggauauccaaauauggaccuagacugccuacuaccccaagaauggguucaacacuuuuaucaagaggcagcacccgcacaauccgacguagcauuauuacguuuuguaaauccugacaccggaagaguucuauucgaaugcaaacuacauaaaucaggauacguaacagucgcucauacaggccaacaugauuuaguaauaccacccaacggauauuuuagauuugauucuuggguuaaucaauucuacacucuagcacccaugggaaauggaacaggacgaagaagauaa

SEQ ID NO: 33660 - RNA, 1617 nt, Artificial Sequence
  derived and/or modified sequence opt6 from VP1__Norovirus_and/or_Norovirus-like__EF187497
augaaaauggcaucaucagacgcaaauccaucagacggaucaacagcaaacuuaguuccagaaguuaauaaugaaguaauggcucucgaaccaguaguaggagccgcaauagcagcaccuguagccggccaacaaaauguaauagauccauggauaagaaauaauuuuguucaagcaccaggaggagaauuuacaguaucuccaagaaacgcaccaggugaaauauuauggucugcaccauuaggaccagaccuuaauccguaucuaagucacuuagcaagaauguacaacggauacgcaggcgguuucgaaguacaaguaauacuugcaggaaaugcauuuaccgcaggaaaaauaguuuuugcugccguuccaccaaauuucccaacugaaggacuauccccuucacaagucacaauguucccacacauaauaguagacguacgacaacuagaaccaguucucauaccacuaccagauguucguaauaauuucuaucacuauaaccaaagcaaugauccaaccauuaaacuaauagcaaugcuuuacacaccacuuagagccaacaaugcaggagaagauguauuuaccguaaguuguagaguauuaacaagaccuucaccagacuuugacuuuauauuuuuaguaccaccuacaguagaaaguagaaccaaaccuuucucaguaccaauccuaacuguagaagaaaugacaaauuccagauuuccuauaccacuugaaaaacuauucacugguccaucaucaacaaucgucguucaaccacaaaacggacgauguacaacagacggcguauuauuaggaacuacacaauuaagucccguaaauaucuguacauucagaggagacguuacccauauagcaggaacccaagaauacacaaugaauuuagcaucacaaaacuggaacaacuaugacccaacagaagaaauaccagcaccauuagguacaccugacuuuguaggcaaaauacaaggaguauuaacucaaacaacacgccgagaugguucaaccagaggacacaaagcaacaguuucaacaggaaguguaaauuuuacccccaaacuaggccgaauacaauucuccacagauaccucaaacgacuucgaaacaggccaaucuacaagauucacaccaguuggaguaguacaagauggaucaacaacacaccaaaaugaaccacaacaauggguacuaccagauuauucaggaagagacucccauaacguacacuuagccccagcuguugcaccuucguucccaggugaacaacuacucuucuuuagaucaacuaugccaggcugcucaggauauccaaauaugaaucuagauugucuccuaccacaagaauggguacaacauuuuuaucaagaagcagccccagcacaaucugauguagcacugcuaagauuuguaaacccugacacaggaagaguauuauuugaaugcaaacuccacaaaucugguuacguuacaguugcacacacaggacaacacgauuuaguuauuccaccuaauggcuacuucagauucgacaguuggguaaaccaauuuuacacacuagcaccaaugggaaaugguacaggucgaagacgauaa

SEQ ID NO: 33661 - RNA, 1617 nt, Artificial Sequence
  derived and/or modified sequence opt6 from VP1__Norovirus_and/or_Norovirus-like__AB668028
augaaaauggcuucaaacgaugccaguccuucagauggaucagcagcaaacuuagucccagaaguaaauaacgaaguaauggcacuagaaccuguaguuggagcagcaauagcagcacccguugcaggacaacaaaaugucauugacccauggauuagaaauaacuuuguucaagcaccaggaggagaauuuacaguaucaccaagaaacgcaccaggagaaauacucuggucggcuccccuagguccagaucuaaauccauauuuaagucacuuagcacguauguauaacggcuacgcaggaggauucgaaguccaaguaauuuuagcaggaaacgcauuuaccgcaggaaaaauaaucuucgcagcaguucccccaaauuuucccacagaaggucuaucaccaucacaaguaacaauguucccacauauuauaguagacguacgacaacuagaaccaguauuaauaccacuaccagauguacguaacaauuuuuaucacuauaaucaaucaaaugacucuacaaucaaacuaauagcaaugcuauauacaccauuaagagcaaacaaugcaggcgaagaugucuuuacaguaucaugcagaguacuaacaagaccuuccccugauuucgacuuuauauuccuaguaccaccuacuguagaaucacgaacaaaaccauuuacuguaccaauauuaaccguagaagaaaugacuaauucccgauucccuauaccacuagaaaaauuauuuacaggccccucaagcgccuucguaguucaaccacaaaacggaagauguacaacagacggaguauuacuagguaccacucaauuaucaccuguaaauauauguaccuuucgaggcgauguaacacacauagcaggaucuagaaauuauacaaugaaccuagcaucacucaauuggaacaauuacgaucccacagaagaaauaccagccccacuuggaacuccagacuucguaggaaaaauacaaggaguacucacacaaaccacaaaaggagacggaucuacuagaggccacaaagcaacuguauacaccggaucagcuccuuuuacuccuaaacuaggaucaguucaauuuucuacugacaccgaaaaugauuucgaaacacaccaaaauacaaaauucacacccguaggaguaauacaagaugguucuacaacacauagaaaugaaccacaacaauggguauuaccaucuuauagcggacgcaacguucauaauguacaccuagcuccagcaguagcaccaacuuuuccaggugaacaacuauuauucuuuagaucuacuaugcccgguuguucuggauaucccaauauggaucuagauugucuccuaccacaagaauggguucaacauuuuuaccaagaagcagcaccagcccaaucagacguagccuuacuaagauuuguuaacccugacacaggacguguauuauuugaaugcaaacuacacaaauccggauacguuacaguagcucauacuggucaacacgaccuuguuauuccaccaaacgguuacuuucgauucgauuccuggguaaaucaauucuacacacuagccccaaugggaaaugguacaggacgcagaagauaa

SEQ ID NO: 33662 - RNA, 1617 nt, Artificial Sequence
  derived and/or modified sequence opt6 from VP1__Norovirus_and/or_Norovirus-like__HM802542
augaaaauggcauccaaugacgcuaccccaagugauggaucaacagcaaaccuaguccccgaagucaacaaugaaguaauggcuuuagaaccaguuguaggagcagcaauagcagcccccguagcaggccaacaaaauguaauagauccauggauuagaaauaacuuuguccaagcaccagguggagaauuuacaguaucuccaagaaaugccccaggagaaauauuauggucugcaccacucggaccagaucucaacccauauuuaucacaccuagcccgaauguauaacggauaugccggaggauucgaaguccaagucauucuagcuggaaaugcuuucacugcuggcaaaauaauauucgcagcuguuccuccaaacuuucccacugaaggucuuucuccaucacaaguaacaauguucccacauauaaucguagauguacgacaacuugaaccaguacuaauaccauugccugauguaagaaacaacuucuaucacuauaaucaaucuaaugacccgacaauaaaauuaauagccaugcuauauacaccacuuagagcaaacaacgcaggcgacgauguauuuacaguaucaugucgcguacuaacccgaccaucaccagacuucgacuuuauauuucuuguacccccaacaguagaaucucgaacuaaaccuuuuucaguaccuauauuaaccguagaagaaaugacaaauucuagauuuccaaucccauuagaaaaacucuucacuggacccucaagugcauucgucguccaaccacaaaauggaagauguacaacagacggaguuuuauuaggaacuacacaauuaucuccaguaaacaucugcacuuuucgaggagacguaacacacauagcaggaacacaaaauuacacaaugaaucuagcaucacaaaacuggaacaacuaugaucccacagaagaaauaccugcaccauuagguacacccgauuucguaggaagaauacaaggaguauuaacacaaacaacucgacgagacgguucaacacgaggacacaaagcaaccguaucaacugggucaguucacuuuacaccaaaacuuggaucaguucaauucuccacagauacaucaaacgauuuugaaacaggacaaaauaccagauuuacuccuguaggaguaguacaagacggaucaacaacacaucaaaaugaaccacaacaauggguauuacccgauuacaguggacgagauucacacaacguacacuuagcccccgcaguagcaccaacuuuuccuggagaacaacuacuauucuuuagaaguacaaugcccggauguaguggauaccccaauaugaauuuagauuguuuacuaccucaagaauggguacaacacuuuuaucaagaaagcgcucccgcacaaucagacguagcacuacuacgcuuuguaaacccagauacaggaagaguauuauuugaaugcaaauuacauaaaucaggauauguaacaguagcacacacuggccaacacgauuuaguaauuccaccaaauggauacuuccgauuugacuccuggguuaaucaauucuacacuuuagcccccaugggaaauggagcaggucgcagaagauaa

SEQ ID NO: 33663 - RNA, 1617 nt, Artificial Sequence
  derived and/or modified sequence opt6 from VP1__Norovirus_and/or_Norovirus-like__HQ009513
augaaaauggcaaguaaugaugcuaacccaucugacggaucuacagcgaauuuaguaccagaaguaaacaacgaaguaauggcacucgaaccaguaguaggcgccgccaucgccgcaccagucgccggccaacaaaauguaauagacccauggauacgaaacaauuuuguacaagcaccaggcggcgaauuuacuguauccccacguaaugccccaggagaaauauuauggucagcaccauuaggcccagauuuaaaccccuaccuaucacaccuagccagaauguauaacggauacgcuggagguuucgaaguccaaguaauauuagcagguaaugcauucaccgcaggcaaaauaauauuugcagcaguaccaccaaauuuuccaacagaaggacuaucaccaucucaaguaacaauguuuccucauauuauaguagauguaaggcaauuagaacccguacuuaucccacuaccagauguaagaaacaauuuuuaucauuacaaccaaagcaacgacccaacaauaaaacuaauagcaaugcuauacacaccucuaagagcuaacaaugcaggagacgacgucuuuacuguaucuuguagaguacugacaagaccaucaccagauuuugauuucauauuucuaguaccaccaacaguagaaucccguacaaaacccuucuccguaccaauucuaaccguagaagaaaugacaaauucaagauuuccaauaccauuagaaaaacuauuuacaggaccaucuucagcauuugucguacaaccacaaaauggccgauguaccacagacggcguacuauuagguaccacacaacuauccccaguaaauauaugcacauuucgaggagaugucacacacaucacagguucuagaaauuauacaaugaaccuagcaacacaaaacuggaacucauaugacccuaccgaagaaauuccagcaccacuaggaacaccagacuucguaggaaaaauucaaggaguacuaacccaaacuacacgagcagacgguucaacaagaggacauaaagccaccguauauacaggaucagcugacuuugcacccaaauuaggaagaguacaauucgcaacagauaccgauaacgauuucgaugcaaaccaaaauacaaaauuuacccccguuggcguaauacaagacggaaauacagcacaccgaaaugaaccacaacaauggguauuaccaucauauucagggagaaauucacauaauguacaucuagcaccagccguagcaccaacauucccaggugaacaacuauuauucuucagauccacaaugccagguugcucaggauaucccaauauggauuuagacuguuuacuaccacaagaauggguacaauauuucuaccaagaagcagccccagcucaaagcgacguagcucuacucagauucguaaacccugauaccggcagaguauuauucgaauguaaacuacauaaaagcgguuauguaacaguagcacauacaggacaacaugaucuaguaauaccaccaaauggcuauuucagauucgauucauggguuaaucaauucuacacucuagcacccaugggcaacggaacaggcagaagaagauaa

SEQ ID NO: 33664 - RNA, 1617 nt, Artificial Sequence
  derived and/or modified sequence opt6 from VP1__Norovirus_and/or_Norovirus-like__AB541322
augaaaauggcaucaucagaugcaaacccaucagauggaucaacugcaaauuugguaccugaaguaaacaacgaaguuauggcauuagaaccaguagucggagcagcaauagcugcaccaguagcaggccaacaaaauguuauagaccccuggauaagaaauaauuuuguacaagcaccaggaggugaauuuacaguauccccaagaaaugcaccuggagaaauacuaugguccgcaccacuaggaccagacuuaaauccauaucuuucacaccuagccagaauguauaacggauacgccgguggauucgaaguacaaguaauauuagcaggcaaugccuuuacagcaggaaaaauaauauucgcagcaguaccuccaaacuuuccaacugaaggccuaaguccaucucaaguaacaauguucccacauauaaucguagacguacgacaauuagaaccaguauuaaucccauuaccugacguuagaaacaacuucuaucauuauaaccaaucaaaugacccaacaauaaaacuaauugcuauguuauacacaccacuaagagcaaacaaugcuggugacgacguauuuaccguauccugucgaguucuuacaagaccuucaccagacuuugauuuuauauuccuuguaccaccaacaguagaaucacgaacaaaaccauucucagucccaauucuuacaguugaagaaaugacaaauucaagauucccuauaccauuagaaaaacuuuuuacaggaccaucaucugcauucguaguccaaccacaaaacggaagauguacaacugacggaguauuauuaggaaccacacaauuaucaccaguaaauauuugcacuuucagaggagaugucacacauauaacaggcucuagaaauuacacaaugaauuuagcaacacaaaacuggaacucauaugaucccaccgaagaaauuccagcaccuuuaggaacuccagauuuuguaggcaaaauucaagguguacuaacacaaacaacuagagcagacggaucaacaagaggccacaaagcuacaguauauaccgguucugcagacuuugcuccaaaauuaggaagaguccaauuugcuaccgauacagauaaugauuucgacgcuaaccaaaauacaaaauucacaccaguaggcguaauacaagauggugauacugcacacagaaaugaaccacaacaauggguauuaccaucauauucaggccgaaauucacacaacguucauuuagccccaacaguugcuccaacauuuccaggagaacaauuacuuuucuuucgaucuacaaugccaggauguucaggcuauccaaacauggaccuggacugucuacucccacaagaauggguacaauauuucuaccaagaagcagcacccgcacaaucugacguagcauuauuaagauucguaaaucccgacacggguagagucuuauuugaauguaaauuacacaaaucaggauaugucacagucgcacacaccggucaacacgaucuaguaaucccaccaaacggcuauuucagauucgacagcugggucaaccaauucuacacacucgcaccaauggguaacggaacaggaagacgaagauaa

SEQ ID NO: 33665 - RNA, 1617 nt, Artificial Sequence
  derived and/or modified sequence opt6 from VP1__Norovirus_and/or_Norovirus-like__AB541321
augaaaauggcaaguaacgacgcuaauccaucagacggaucaacugcuaaucuuguaccugaaguuaacaaugaaguaauggcacuagaaccuguaguaggugcagccauagcagcaccaguugcaggucaacaaaauguuauagacccauggauaagaaauaacuuuguacaagcaccaggaggcgaauuuacaguuucuccacaaaaugcaccaucagaaauacuuuggucagcaccucuaggaccagaucucaaccccuaucuaucacacuuagcaagaauguauaacgguuacgcaggaggauucgaaguccaaguaauacuagcaggaaaugcauucaccgcaggaaaaauuauauucgcagcaguaccaccuaacuuuccaacagaaggacuaucacccucacaaguuacaauguucccccacauaauaguagauguccgacaacucgaacccguacuaauaccuuuaccagacguaagaaacaauuuuuaucacuacaaccaaucgaacgauccuacaauaaaauuaauugcaauguuauauacaccauuaagagcaaacaaugcuggugacgauguauuuacaguaucgugucgaguacuaacacgucccuccccagacuuugacuucauauuccuaguaccuccaacaguagaaucaaggaccaaaccauuuacagucccaauauuaacaguagaagaaaugacaaacucacgauucccaauaccccucgaacgacuauacacaggaccaucuucagcauucguaguacaaccacaaaauggacgaugcacaacagacgguguccuucuggguacaacucaauuaucagcaguaaauaucuguacauuccgaggagacguaacccauauagcaggaucaagaaauuacacaaugaauuuagcaucucaaaacuggaacaauuacgaucccaccgaagaaauaccagcuccauuaggaacuccagacuuuguagguaaaauucaagguaugcuuacacaaacaacuagaucugacggaucaacaagaggacacaaagcaacaguauuaacaggcuccgcagacuuugcaccaaaauuaggacgaguacaauuugcaaccgacaccgacaacgacuuugaaucuggacaaaauacaaaauuuacaccuguuggaguaauacaagauggaucaacuacacauagaaacgaaccccaacaauggguauuacccaacuauuccggaagaacuggacauaauguucacuuagcaccagccguugcaccaacauauccaggagaacaacuacuuuucuuccgaaguacaaugcccggauguucaggcuauccuaauauggauuuagauugccuauuaccucaagaauggguucaacauuuuuaucaagaagcagcaccagcccaaucagauguugcacuacuaagauuugucaaucccgacacuggcagaguuuuauucgaauguaaacuacauaaaagcggauacguaacaguagcacauacaggccaacacgaccuagucauaccaccaaauggcuacuucagauucgauucaugggucaaccaauucuauacauuagcaccaaugggaaauggcacaggacgcagaagauaa

SEQ ID NO: 33666 - RNA, 1617 nt, Artificial Sequence
  derived and/or modified sequence opt6 from VP1__Norovirus_and/or_Norovirus-like__AB541253
augaaaauggcaucaaaugacgcaaauccuucagacgguuccgcugcaaacuuaguacccgaaguaaauaacgaaguuauggcauuagaaccaguugucggcgcagcuauagcagcaccuguagcaggacaacaaaauguaauagauccuuggauacgaaauaacuuuguucaagcuccugguggagaauuuacagucucaccaagaaaugcaccaggugaaauacucugguccgcaccucuaggaccugauuuaaauccauaucuaucacacuuagcucguauguauaacggauacgccggcggauucgaaguacaaguaauuuuagcaggaaacgcuuucacagcagguaagauaauauucgcagccguaccaccaaacuuuccuacagaaggauuaucaccaucacaaguuacaauguuuccucauauaauaguagauguccgacaauuagaacccguauuaauaccauuaccagauguaagaaacaauuucuaccacuauaaccaaucaaacgauucaacaauaaaauuaauagcaauguuauacacuccauuacgagcaaauaaugccggagacgacguauucacaguaucuuguaggguauuaaccagaccaucaccagacuuugauuucauauuccuaguuccaccaacagucgaaucacguacaaaaccauuuaccguaccuaucuuaacaguagaagaaaugacaaauuccagauuuccuauuccuuuagaaaaauuauuuacagguccauccucagcauuuguaguucaaccacaaaauggcagauguacaacagacggaguauuacucgguacaacacaacuauccccaguaaauauauguacauucagaggagacguaacacacauagccggcucaagaaacuauacaaugaaccucgcuucauuaaauuggaauaauuaugauccaacagaagaaauacccgccccacuaggaacacccgauuuuguaggcaaaauucaaggaguacuuacacaaacaacaaaaggagacggaucaacaagaggacacaaagcuacuguauacacuggcuccgcaccauuuacuccaaaacuugguucaguacaauucucaacagacacagaaaacgacuuugaaacacaucaaaauacaaaauucacaccaguagguguaauacaagauggaucaacaacacauagaaaugaaccacaacaauggguuuuaccauccuauucaggaagaaacguucauaacguucaucuugcaccagccguagcaccaacuuuuccaggugaacaacuauuauucuucagaucaacaaugccuggaugcucuggcuauccaaacauggaucuagauuguuuacuaccucaagaauggguucaacauuucuaccaagaagcugcucccgcacaaagugauguagcacuucuaagauucguuaacccagauacagguagaguacucuucgaaugcaaacuccacaaaucaggauauguaacuguagcacacacaggacaacacgacuuaguuaucccacccaacggauauuuccgguucgauucauggguaaaucaauuuuauacauuagcaccaaugggaaauggaacaggaagaagaagguaa

SEQ ID NO: 33667 - RNA, 1617 nt, Artificial Sequence
  derived and/or modified sequence opt6 from VP1__Norovirus_and/or_Norovirus-like__AB541250
augaaaauggcaucuaaugacgcauccccaucagauggaucugcugcaaaucuugucccugaaguaaauaaugaaguaauggcauuagaaccaguggucggugcugccauagcagcuccaguagcaggacaacaaaacguuauagacccauggauaagaaauaauuucguacaagcuccagguggagaauuuaccguaucaccaagaaaugccccaggcgaaauuuuaugguccgcaccauuaggaccagaucuaaauccauauuuaucucacuuagcaagaauguacaacggcuaugccggcggcuucgaaguacaaguaauacuagcaggcaaugcauuuacagcuggaaaaauaaucuucgcagcagucccacccaacuuuccuacugaaggauuaucacccucucaaguaacaauguuuccacauauaauaguugacguaagacaacuagaaccaguauuaaucccauuacccgacgugagaaauaauuucuaccacuauaaucaaucaaaugauuccaccauuaaacuaauagcaaugcuuuacacaccauuacgagcaaauaaugcuggugaagauguauuuacagucucaugccguguucuuacaagaccaagcccagacuucgauuuuauauuccuuguaccacccacaguagaaagucgaacuaaacccuuuacaguaccaauacuuacaguagaagaaaugacuaacucacgauuuccuauaccauuagaaaaacucuuuacagguccuucaucagcauuugugguacaaccucaaaacggaagauguacaacagacggaguacuucucggcacaacccaacuauccccaguuaauaucuguaccuuucgcggcgacguaacucauauagcaggaucacgcaauuauacuaugaauuuagcaucauuaaauuggaacaauuacgaucccacugaagaaauaccagcaccucuaggaacaccagacuuuguaggaaaaauacaaggaguuuuaacacaaaccacaaaaggagacgguucaacucgaggacacaaagcaacagucuacaccggaucagcuccuuuuaccccgaaacuaggaucaguacaauuuucaacagauacugaaaacgacuuugaaacacaccaagauacaaaauucacaccaguaggaguuauacaagacggaggaacaacacaccgaaacgaaccacaacaauggguauuaccaucauauucaggaagaaacguacaaaauguccacuuagcccccgcuguagcuccuacauucccaggagaacaauuauuauuuuucagaucaacaaugccuggaugcucuggauaccccaauauggauuuagauugccuccucccacaagaaugggugcaacauuuuuaucaagaagcagcacccgcacaaucugauguugcacuauuacgauucguaaauccugacacagguagagucuuauucgaaugcaaacuacauaaaucaggauacgucacuguagcccacacaggccaacacgacuuaguaauaccuccaaacggcuacuuccgauuugacucauggguaaaccaauucuauacauuagcaccaaugggcaauggaacaggaagacgaagauaa

SEQ ID NO: 33668 - RNA, 1617 nt, Artificial Sequence
  derived and/or modified sequence opt6 from VP1__Norovirus_and/or_Norovirus-like__AB541211
augaaaauggccucaaaugaugcaaacccuucagacgguucggccgcuaauuuaguaccagaaguaaacaacgaaguaauggcacuagagccagucgucggagcagcaauagcagcaccuguugcuggacaacaaaacguaauagacccauggauaagaaacaauuuuguacaagcaccugguggagaauuuaccguuucaccucgaaaugcaccuggggaaauccuauggucugcaccauuaggcccagaucuuaacccuuaucuaucacacuuagcaagaauguauaauggcuaugcaggaggauuugaaguacaaguaauacuagcaggaaacgcauuuacagcaggaaaaauaauauuugccgcaguacccccuaauuuuccaacagaaggucuaucaccaucacaaguuaccauguuuccucauauaaucguagacguaagacaacuagaaccaguacucauaccucuaccagacguaagaaacaacuucuaucauuauaaccaaucaaaugauaguacuauaaaauuaauagcaauguuauauacaccccuaagagcaaauaacgcaggagaagaugucuuuacagugucaugccgaguauuaacacgaccaucaccugauuuugauuucaucuucuuaguaccaccaacuguagaaucaagaacaaaaccuuucacaguaccuauacucacuguagaagaaaugacaaacuccagauuuccaauacccuuagaaaaauuauucacaggaccaucauccgcauuuguaguccaaccacaaaauggaagaugcacaacugaugguguauuauuaggcacaacacaacucuccccaguuaacauauguacauucagaggugaugucacacauauugcaggaagucgcaauuacauaaugaaucuagcaucucuaaauuggaauaauuacgauccaacagaagaaauaccagccccauuaggaacaccagacuuugucgguaaaauacagggcgucuuaacucaaaccacaaaaggugaugguuccacaagaggacauaaagcaacaguauauacaggaucagcaccuuucacaccaaaacuaggaucaguacaauucuccacugacacugaaaacgacuucgaaacacaucaaaauacaaaauuuacaccugucgguguaauacaagacggaucaacaacgcauagaaaugaaccccaacaauggguauuaccuucuuacucuggaagaaacguacauaauguucaccuugccccagccguagcucccacuuuuccaggagaacaacuacuauucuuuaggucaaccaugccagguuguuccggauacccaaacauggauuuagauugcuuauuaccccaagaauggguacaacacuucuaucaagaagcagcacccgcacaaagcgacguagcuuuauuaagauucguaaauccugacacuggacgaguauuauucgaauguaaauuacauaaaucaggauauguaacaguagcacacacuggucaacacgauuuaguaauaccaccaaauggauauuuuagauucgacucuuggguaaaucaauuuuauacauuagcaccaaugggaaacggaacaggcagaagaagauaa

SEQ ID NO: 33669 - RNA, 1617 nt, Artificial Sequence
  derived and/or modified sequence opt6 from VP1__Norovirus_and/or_Norovirus-like__GQ246797
augaaaauggcaaguucagaugcuaauccuucagaugguuccacagcaaacuuagucccugaaguaaauaacgaaguaauggcacuugaaccuguaguaggagccgcaauagcagcaccuguugcaggucaacaaaauguuauugacccauggauacgaaauaacuucguccaagcccccggaggagaauuuaccguuuccccuagaaaugcaccuggugaaauacuauggucagcaccauuagguccagauuugaaucccuacuuaucacaccuagcaagaauguauaacggauaugcaggaggcuuugaaguacaagucauauuagcaggcaaugcauuuacugcaggcaaaauuauauucgcugcaguuccaccaaauuuucccacagaaggcuuaucaccaucacaaguaacaauguuuccucauauaauagucgauguacgacaacucgaaccuguccucauaccacuuccugauguaagaaauaacuuuuaucauuacaaucaaagcaacgacccaacaauaaaauuaaucgcaaugcuuuauacuccuuuaagagcaaacaacgcuggugaugaugucuucacagucucaugucgaguacuaacacguccaucccccgauuuugacuuuauauuccuaguaccaccaacaguagaaucccgaacuaaaccauucuccguaccaauccucacaguagaagaaaugacuaacucucgauuccccauaccacuagaaaaacuauuuaccggaccaucuucagcauuuguaguacaaccacaaaauggaagaugcacaacugauggaguacuacucggaacaacacaauuaucaccuguaaauauuuguacauucagaggcgauguaacucauauagcaggaucaagaaauuauacuaugaaucuagcaacacaaaauuggaauagcuaugacccaacugaagaaaucccagcaccacuaggaacaccagauuuuguaggaaaaauacaagguguauuaacucaaacaacuagagcagauggaucaacccgaggucauaaagcaacuguuuauacagguucugcagacuuugcaccaaaacuaggacgaguacaauuugcaacagauacagacaaugauuuugaugcaaaccaaaauacaaaauuuacuccaguaggagucauccaagacggagauacagcacauagaaaugaaccacaacaauggguucuacccucauacucaggaagaaacucccauaauguacaucuagcaccagcagucgcaccaacuuuuccaggugaacaacucuuauucuuuagaucaacgaugccaggaugcucuggcuaccccaacauggaucuugauugcuuauuaccccaagaauggguccaauauuuuuaccaagaagccgcuccugcacaaagcgauguugcacuucuaagauucguaaauccagauacuggacgaguucuauuugaaugcaaacuacacaaauccggauacguaacaguagcacauacaggacaacacgaccuuguuauaccaccuaacggauacuuuagauucgauucauggguaaaucaauucuacacauuagcuccaaugggaaauggcacaggaagaagaagauaa

SEQ ID NO: 33670 - RNA, 1617 nt, Artificial Sequence
  derived and/or modified sequence opt6 from VP1__Norovirus_and/or_Norovirus-like__GQ246794
augaaaauggcaucaucugacgccaacccgucagacggaucaacagcuaaucuagucccugaaguaaauaacgaaguaauggcauuagaaccaguaguaggugcagcaauugcagcaccaguagcuggacaacaaaaugucauagacccuuggauaagaaauaacuucguacaagcacccggaggagaauuuacagucaguccaagaaacgcaccuggagaaauacccuggagugcaccauuagguccagauuuaaaucccuaucuaucacaccuugcacgaauguauaacggauacgccggagguuuugaaguacaagucauacuugccggaaaugcauuuacagcuggaaaaauaauauucgccgcaguaccaccaaacuuucccacagaaggauuaucaccaucacaaguuacaauguucccacacaucauuguugauguacgacaacuagaaccuguacuaaucccauugcccgauguccgaaacaacuuuuaucacuauaaccaaucaaaugaucccacaauaaaacuaauagcuaugcucuacacaccacucagagcaaauaaugcaggagacgauguauucacaguaucaugucgcguuuuaacuagaccuagcccagacuucgacuuuauauuuuuaguuccaccaacuguagaaucaagaacgaaaccauuuucaguacccauucuaacaguagaagaaaugacuaacucuagauucccaauaccacuugaaaaacucuuuacaggaccaucaucugccuucguaguccaaccacaaaacgguagaugcacaacagacgggguauuacuaggaacaacacaauuaagcccaguaaauaucuguacauuuagaggagacguaacacauauaacaggaucucggaauuauacaaugaaucuagcaacucaaaacuggaacucuuacgacccaaccgaagaaaucccugcaccauuaggcacaccagacuucgucgguaaaauccaaggaguacuaacacaaaccacaagagcagacggaucaacaagaggacauaaagcaacuguauauacaggauccgcugauuucgcaccaaaacuaggacgaguacaauuugcaacagacacagauaacgauuucgaugcaaaccaaaacacaaaauucacacccguaggaguaauacaagacggagauacagcacauagaaaugaaccucaacaauggguccuaccaucuuacucagguagaaauucucacaauguacaccuagcaccagcaguagcaccaacauuucccggagaacaauuauuauucuuuagaucaacuaugccaggaugcucaggcuauccaaauauggaccuagacugccuucuuccacaagaauggguccaauauuucuaucaagaagcagcccccgcccaaagugacguugcacuacuccguuuuguuaauccugacacagguagaguucucuucgaauguaaacuacacaaaucaggauauguaacaguagcacacacuggucaacaugacuuaguuauaccaccaaauggauauuuucguuucgauucauggguaaaucaauucuacacacuagcuccaaugggaaacggaacagguagaagaagauaa

SEQ ID NO: 33671 - RNA, 1617 nt, Artificial Sequence
  derived and/or modified sequence opt6 from VP1__Norovirus_and/or_Norovirus-like__EU876884
augaaaauggccucuaacgacgcaaauccaagcgaugguucaaccgcuaacuuaguacccgaaguaaacucugaagucauggcauuagaaccaguaguaggugcagcuauagcagcuccaguagcaggacaacagaaugucauagauccauggauacguaauaacuuuguucaagcaccugguggcgaauuuaccguaucaccaagaaaugcaccaggugaaauauuauggucagcaccucuaggaccagaucuaaauccuuaucuaucacacuuagcuagaauguauaacggauacgcuggcggauucgaaguacaagucauacuagcuggaaaugcuuucaccgcaggaaaaauaauauuugccgcaguaccaccaaauuucccaaccgaaggacuaucuccaucacaaguuacaauguuuccccauauaauaguugacguacgacaacuagaaccagucuuaauaccacucccagaugucagaaacaauuucuaccacuacaaccaaucaaaugauccuacaaucaaauuaauugccaugcuauacacaccacuucgcgcuaauaacgcaggagacgacguauucacagucuccuguagaguauuaacuagaccauccccagacuuugauuuuauuuuucuaguuccaccaacaguagaaucucgcacaaaaccauuuacagucccaauauuaaccguagaagaaaugacaaacucaagauucccuauaccauuagaaagacuauacacuggaccaucaucagcuuucguaguacaaccacaaaauggaagaugcacaacagauggaguacuucuaggaacaacacaacuauccgcugucaauauauguacauuccgcggugacguuacacauauagcaggaucaagaaauuauacaaugaaucuugcaucacaaaacuggaauaauuacgauccuacagaagaaauuccagccccuuuaggaacaccugacuuugucggaaaaauacaagguaugcuaacucaaaccacaagaucagauggcuccacaagaggacacaaagcaacaguacuuacagguagcgcagacuuugccccgaaacuuggaagaguacaauucgcuacagauacagauaaugacuuugaaucuggacaaaauacaaaauuuacaccaguuggagucauacaagacggaucaacaacccaccguaaugaaccccaacaauggguucuuccuucauauucaggaagaacuggucauaauguucaucuagccccugcaguagcacccacauaccccggagaacaacuacuauucuuuagaucuaccaugcccgguugcucaggauacccuaauauggaccucgauuguuuacucccacaagaauggguacaacacuuuuaucaagaagcagcuccugcacaaucagacguagcauuauuaagauuuguaaauccagauacaggccgaguauuauuugaaugcaaauuacacaaaucaggauaugucacaguagcacauacaggacaacaugaucuagucauaccuccaaauggauauuuccgcuuugacucuuggguaaaucaauuuuacacacuagcaccaaugggaaacggagccggcagaagacgauaa

SEQ ID NO: 33672 - RNA, 1617 nt, Artificial Sequence
  derived and/or modified sequence opt6 from VP1__Norovirus_and/or_Norovirus-like__FJ411170
augaaaauggcuuccaaugaugcuucuccaucugaugguuccaccgcuaaccuagucccagaaguaaauaaugaaguaauggccuuagaaccaguaguaggugcagcaaucgcagcaccuguagcuggacaacaaaauguaauagacccuuggauaagaaauaacuucguacaagcuccaggaggcgaauuuaccguuucaccuagaaaugccccaggugaaauccuaugguccgcuccauuaggucccgaucuaaaucccuaccuaagucacuuagcccguauguauaacggauaugcgggagguuuugaaguacaagucauauuagcaggaaacgcauuuaccgcaggaaaaauuauauuugcugccguuccaccuaauuuuccaacugaaggacuaucaccuucucaaguaacaauguucccccacauaauuguagauguaagacaacuagaaccaguacucauaccauuaccagauguaagaaauaauuucuaucauuacaaccaaaguaacgacccaaccauaaaacuaaucgcaauguuauauacaccauuaagagcaaacaaugccggagaagauguauuuacaguauccugcagaguuuuaacaagaccaucaccagacuuugacuuuaucuuccuaguaccaccuacaguagaaucacgaacaaaaccuuuuacuguuccaauauuaacaguagaagaaaugacuaacucaagauuuccaauaccacuagaaaaacuuuuuacaggaccaucuggagcauuuguuguucaaccacaaaauggucgcuguacuaccgacggaguauuacuaggaacaacgcaacuaucuccaguaaauauauguacauucagaggagacguaacacauauagcaggaacucacgauuacacaaugaaccuagcaucccaaaacuggaauaacuaugauccaacggaagaaauuccagcaccucuaggaacaccagauuucguuggaaagauucaaggagucuuaacacaaacaacaagaggagacgguucuacaagaggacauaaagccacaguaucaacagguucaguacauuuuacaccaaaacuaggaucuguacaauucacuacagauacaaauaaugauuucgaaacaggacaaaauacaaaauucacaccaguaggaguuguacaagauggaaacagcacucaucaaaacgaaccacaacaauggguauuacccaauuauucaggaagaacaggucauaauguacacuuagcaccagccguagcaccuacauuuccaggugaacaacuauuauucuuuagaucaacuaugcccggauguucaggauacccaaauaugaaccucgauugucuacuaccucaagaguggguacaacauuuuuaucaagaagcagcaccagcucaaucagacguugcacuucuccgcuuuguaaauccugacacaggacguguauuauuugaaugcaaacuccacaaaucaggcuauguaacugucgcacacacaggacaacaugauuuaguaaucccuccaaacggauacuucagauuugauucauggguaaaucaauuuuacacuuuagcaccaaugggaaauggagcaggaagacgcagauaa

SEQ ID NO: 33673 - RNA, 1617 nt, Artificial Sequence
  derived and/or modified sequence opt6 from VP1__Norovirus_and/or_Norovirus-like__EU839589
augaaaauggcauccaaugacgcuaauccauccgauggaucugcagcaaacuuaguaccagaaguaaacaaugaaguaauggcacucgaaccaguugucggagcagcaauagcugcuccagucgcaggccaacaaaauguaauagauccauggauacgcaacaacuuuguacaagcaccaggcggagaauuuacaguaucccccagaaaugcuccaggagaaauacuauggucagcuccacuuggaccggaucuaaauccauaccucucacaucuagcaagaauguauaacgguuacgcaggaggauucgaaguacaaguaauauuagccggcaaugcauuuaccgcaggcaaaauaaucuucgcagcuguaccaccaaauuucccaacugaaggacuuucuccaucacaaguuacaauguucccacauauaauaguugacguacgccaacuagaaccaguacuaauaccauuaccagacguaagaaacaauuucuaccacuacaaccaauccaacgacucaacaaucaaauugauagccauguuauacacuccccuaagagccaauaaugcaggagacgaugucuuuacaguuucaugucgaguacuaacacgaccaucaccugauuuugauuuuauauuccuaguacccccaaccguagaaucuagaacaaaaccauuuacaguucccaucuuaacaguugaagaaaugacaaauuccagauuucccauaccauuagagaaauuauuuaccggacccucaggagccuucguuguacaaccacaaaauggaagaugcacuacugauggaguauuacuaggaaccacacaauuaucuccaguaaauaucuguacauuucguggagacgucacacauauagcuggaucacgagauuacacaaugaaucuagcaucuuuaaacuggaauaauuaugaucccacagaagaaauuccugcaccuuuaggaacaccagacuucguaggaaaaauucaaggugucuuaacacaaacaacaaaaggagacggaucuacaagaggucauaaggcaaccguauauacaggaucagccccauuuacaccuaaacuagguucuguacaauucagaacagacacagaaaacgauuucgaaacccaccaaaacacuaaauucacaccuguaggaguaauacaagacggaucaacaacccacagaaaugaaccacaacaauggguacuacccuccuacucaggacguaauguacauaauguacaucuagcacccgcaguagcuccaacuuuuccaggcgaacaguuacuauucuuuagaucaacaaugccaggauguucaggauauccaaacauggaucuugacugccuccuaccgcaagaauggguacaacauuuuuaucaagaagcagcacccgcucaaucagacguagcacuccucagauuugucaauccagauacagguagaguuuuauuugaauguaaacuacacaaaucaggauacguaacagucgcacacacuggucaacaugaucuaguaauaccaccaaacggauauuuucgauuugacucaugggucaaucaauucuacacccuugcaccaaugggaaaugguacuggacgacgacgauga

SEQ ID NO: 33674 - RNA, 1617 nt, Artificial Sequence
  derived and/or modified sequence opt6 from VP1__Norovirus_and/or_Norovirus-like__KX353961
augaaaauggcaucaucagaugcaaauccaucagauggaucaacugccaaucuaguaccugaaguaaacaaugaaguaauggcuuuagaacccguaguuggagcagcaauagcagcaccagucgcaggacaacaaaaugucauagacccauggauaagaaauaacuucguacaagcaccaggaggagaauuuaccguaucaccaagaaaugcaccaggagaaauauuauggucagcaccauuaggaccagauuuaaauccauaucuaucacacuuagcuagaauguauaaugguuaugcaggcgguuucgagguacaaguaauauuagcaggaaacgcauuuaccgcaggaaaaauaauauucgcugcaguuccaccaaauuuuccaacagaaggucuauccccaucacaaguaacaauguuuccacacauaauagucgaugucagacaacuagaacccguacuaauaccauuaccagacguuagaaacaauuuuuaucacuauaaccaauccaacgauccaacaauaaaacuuauagcaauguuauacacaccacuacgagcaaacaaugccggagacgacguauucacuguaucauguagaguauuaacacgaccaucuccagauuucgauuuuaucuuuuuaguacccccuacagucgaaucaagaacuaaacccuucucaguacccauauuaacaguagaagaaaugacuaacuccagauuuccaauuccauuagaaaaauuauuuacaggaccaaguucaacauucguaguccaaccacagaaugguagauguacaaccgauggcguacuacuagguaccacgcaauuaucuccuguaaauauauguacauuccgaggagaugucacacacauugcaggaucacgcaauuacacaaugaaucuagcaucacaaaacuggaacucuuacgauccuacagaagaaauuccagcuccccuaggaacaccugacuuuguugguaaaauccaaggagucuuaacccaaacaacaagaacagacggauccacucgaggccacaaagcuacaguuuauacagguuccgcugauuuuucaccaaaauuaggaagaguacaauucgcuacagacaccgauaacgauuuugaugcaaaucaaaauacaaaauucacaccaguaggaguaauacaagacggugacacagcucacagaaaugaaccacaacaauggguuuuaccaucauacuccggaagaaauacucauaacguacaccuugcaccagccguagccccaacauuucccggagaacaacuuuuauucuuuagaucaacaaugccaggaugcucaggcuauccaaauauggaccuagauuguuuacuaccacaagaauggguacaauauuuuuaucaagaagcagcuccagcacaaucagacguggcauuauuacgauuuguaaacccugauacaggaagaguucuauuugaaugcaaacuucacaaauccggauauguaacuguagcacacacaggacaacacgauuuaguaaucccaccaaacggauauuucagauuugauucauggguaaaucaauuuuauacauuagcaccaauggguaauggaacaggaagaagaagauaa

SEQ ID NO: 33675 - RNA, 1617 nt, Artificial Sequence
  derived and/or modified sequence opt6 from VP1__Norovirus_and/or_Norovirus-like__AB933757
augaaaauggcauccuccgacgcaaacccaucagacgguucuacagcaaacuuaguaccagaagucaacaaugaagucauggcacuggaacccguaguaggagcagcaauagcagcuccuguagcaggacaacaaaauguaauagaucccuggauaagaaacaacuuuguacaagcaccaggaggagaauuuacaguaucuccuagaaaugcaccaggagaaauucuuuggucugcaccucucggcccagaucuaaacccauacuuaagucaucuagcuagaauguacaacgguuacgcaggagguuuugaaguacaaguaauucuagcuggaaaugcauuuacagcaggcaaaauaauauuuucagcaguacccccaaauuuuccaacagaaggucuaucaccaucacaaguaacgauguucccccauauuauaguugacgucagacaacuagaaccaguauuaauaccuuuacccgauguccgaaauaauuuuuaucacuauaaucaaucaaaugauccaacaauuaaauuaauagcaaugcucuauacaccacuaagagcaaauaaugccggagaugauguauuuacaguaucuuguagaguccuaacuagacccucaccagacuuugauuucauauuucuaguaccacccacaguugaaucaagaacaaaaccuuucaguguaccuauuuuaacagucgaagaaaugacaaacucaagauucccuacgccacuugaaaaauuauuuacaggacccucaucaacauucguaguccaaccccaaaaugguagauguacaaccgacggaguccuauuaggaacaacacaacuaucaccaguaaauauauguacauuuagaggagauguaacccauauaacaggaucacacaauuauacaaugaaucuagcuucacaaaacuggaacuccuacgacccuacagaagaaauuccagcaccauuagguacaccagacuucguaggaaaaauacaaggaguauuaacacaaacaacaagaacagacggaucuacucgaggacauaaagcaacaguauauacuggaucugccgaauuuucuccuaaacucggcagaguacaagucgcuaccgacacaaauaaugacuucgaugccaaucaaaauaccaaauuuacucccguaggcguuauacaagacggaggaacaacacauagaaacgaaccacaacaauggguccuuccaucauacucagggcguaaugcacacaacguacaccuagcaccagcaguagcaccaacuuuuccaggugaacaauuauuguucuucagauccacaaugccgggaugcucaggauauccaaacauggaucuagacugcuuauuaccccaagaauggguacaacauuucuaucaagaagcagcaccagcacaaucagacguugccuuacuccguuuuguaaaucccgauacugguagaguacucuuugaaugcaaauuacauaaaucaggauauguaacaguagcacauacaggacaacacgauuuaguaauaccuccaaacggauauuuuagauucgauucauggguaaaucaauuuuauacauuagcaccaaugggaaaugguacaggcagacgaagauaa

SEQ ID NO: 33676 - RNA, 1617 nt, Artificial Sequence
  derived and/or modified sequence opt6 from VP1__Norovirus_and/or_Norovirus-like__KM245074
augaaaauggcuucaaaugaugcaaauccuucugauggaucagccgcuaaucuuguaccugaaguaaauaacgaagucauggcucucgaaccaguuguuggagccgccauagcagcaccaguagccggacaacaaaaugucauugacccuuggaucagaaacaauuucguacaagcaccaggcggagaauuuacaguuucaccaagaaaugcacccggagaaauacuuuggucagcaccauuagguccagaucuaaacccauaucuaucccauuuagcacgaauguauaaugguuaugccggaggauucgaaguccaaguaauacuagcagguaacgcauuuacagcuggaaaaauaauauucgcugccguaccacccaauuuuccaacagaaggauuaucacccucccaagucacaauguucccacacauaauaguagauguuagacaacucgaaccaguauuaauaccauuaccugauguucgaaauaauuucuaucacuauaaccaaucaaaugacucaacaaucaaauuaauagcuaugcuauauacaccacuccgcgcaaacaaugcaggagacgauguauuuacagugaguugcagaguucucacacgucccagcccagauuucgauuuuauauuucuaguuccaccaacaguugaaucacgaacaaaaccuuuuacuguaccaaucuuaacuguagaagaaaugacaaauucaagauuccccaucccacuagaaaaacuauuuacagguccaucaucagcauucguuguccaaccacaaaacggaagaugcacaacagauggaguccuacucgguacuacacaacucuccccuguaaacauauguacauucagaggagacguaacacacauagcaggauccagaaauuauacaaugaauuuagcaucucuaaacuggaauaauuacgacccaacagaagaaauacccgcaccacuaggaacaccugauuuuguaggcaaaauacaaggagucuuaacacaaacaacaaaaggcgacggaaguacacgaggacacaaagcaacagucuauacugguucagcggacuuuacuccaaaauuaggcucuguacaauucgcuaccgauacagaaaacgauuucgaaacccaucaaaauacaaaauuuacucccguaggcguuauacaagauggaucuaccacacacagaaacgaaccacaacaauggguacuaccaagcuauucagguagaaauguacauaauguucauuuagccccugcaguagcaccaaacuucccaggagaacaauuacuuuucuuucgaucaacaaugccaggauguuccggauauccaaacauggauuuagauugccuauuaccacaagaauggguacaacauuuuuaucaagaagcagcuccugcacaaucugaugucgcacuacuacgcuucguaaauccugacacaggaagaguuuuauucgagugcaaauuacacaaaucuggauauguaacaguagcccacaccggucaacaugaccuagucauaccaccuaauggcuacuuucguuucgauucuuggguaaaucaauuuuauacauuagcaccaaugggaaaugguaccggaagacgaagauaa

SEQ ID NO: 33677 - RNA, 1617 nt, Artificial Sequence
  derived and/or modified sequence opt6 from VP1__Norovirus_and/or_Norovirus-like__EU921368
augaaaauggcaucuaacgaugcuacaccaucagaugguucuacugcaaauuuaguaccagaagucaacaacgaagucauggcacuagagccaguaguaggcgccgcaaucgcugcaccaguagcuggacaacaaaaugucauugauccuuggauuagaaauaacuucguacaagcuccaggcggagaauuuacaguaucaccacgaaaugcgccaggugaaaucuuauggucagccccacuaggaccagaccuaaaucccuacuuaucacacuuaaguagaauguauaauggauacgccggagguuuugaaguccaagucauacuagcaggcaacgcuuuuacagcagguaaaauaauuuucgcagccguacccccuaacuuuccuacagaaggacuaucuccaucacaaguuacaauguuuccucacauaauaguugauguuagacaauuagaacccguuuuaauaccauuacccgauguccgaaauaacuuuuaucauuacaaucaaucaaaugauccaacaauaaaauuaauagcaaugcuauauacaccauuaagagccaauaaugcaggagaugaugucuuuacaguaaguugcagagucuuaacucgaccaucaccugauuucgauuucauauuucuaguaccaccuacuguugaaucacgaacaaaaccauucuccguaccuauauuaacagucgaagaaaugacaaacagucgcuuucccauuccauuagaaaaacuauuuacaggaccaucaucagcuuucguaguccaaccucaaaauggccgauguacaacugacggaguauuauuaggaacaacacaauuauccccagucaauaucuguacuuuccgaggaaacgucacaaauauugccgguucacaaacauauaccaugaauuuagccucacaaaauuggaauaauuaugacccaacagaagaaaucccugcaccauuaggaacuccagauuuuguaggaaaaauacaagguguacucacucagacuacaaaaggugacgguuccacaagaggucacaaagcaacaguguccacaggauccgcacaauuuacaccuaaacuaggcucuguacaauuuucuaccgauacauccacagauuucgaaacuggucaaaauacuagauucacaccaguaggaguuauccaagacggaucaacaacccauaaaaacgaaccacaacaauggguucuuccaucguauucaggaagagauucccauaauguacauuuagcacccgccguagcaccaacauuuccaggagaacaaauacuauuuuucagaucaacuaugcccggaugcucuggauauccaaauauggaucucgauugcuuauuaccacaagaauggguacaacauuucuaucaagaaucagcucccgcacaaucagauguagcauuacuuagauuugucaaucccgacacagguagaguacuauucgaauguaaacuacauaaaucaggcuauguaacuguagcucauacuggacaacacgauuuaguaauaccaccaaacggauauuuuagauucgauucauggguaaaucaauuuuauacacuagcaccaauggguaacggagcaggaagacgcagauaa

SEQ ID NO: 33678 - RNA, 1617 nt, Artificial Sequence
  derived and/or modified sequence opt6 from VP1__Norovirus_and/or_Norovirus-like__EU921338
augaaaauggccuccaacgacgcaacaccaucagauggaucaacagcuaauuuaguaccugaagucaacaaugaaguuauggcauuagaaccagucguaggagcagcaaucgcagcaccugucgcaggccaacaaaacgucaucgacccauggauaagaaauaacuuuguccaagccccaggaggagaauuuacaguauccccaagaaaugccccaggugaaauacuauggucagcaccauuaggaccagacuuaaaucccuaucuaucacaccuagcccgaauguacaauggauaugcuggagguuucgaaguacaaguuauacucgcuggaaaugcauucacagcagguaaaauaauauucgcugcaguaccaccuaacuucccaacagaaggacuaucaccaucacaaguaacuauguucccacacauaauagucgauguaagacaacuagaaccaguacuaauacccuuacccgauguaagaaauaauuuuuaccacuacaaccaaucaaacgacccaacuauaaaauuaaucgcaaugcuuuacacaccauuaagagcaaacaacgccggugaugauguauucacaguuuccugucgaguauuaacucguccuuccccagacuucgacuuuauauuucuagucccaccaacuguagaaucaagaacaaaaccauucucaguaccaauacuuacaguagaagaaaugacaaacucaagauucccuauuccauuagaaaaauuauuuacaggcccaucaucagcauucguuguucaaccacaaaacggaagaugcacuacagacggaguacucuuaggcacaacacaauugucuccaguaaauauuuguacuuuucguggagacgucacacacauugcaggaacacaaaacuauaccaugaaucucgcuucacaaaauuggaacaauuaugauccaacugaggaaauaccagcuccacuaggaaccccagacuuuguaggaaaaauucaagguguucuaacucaaacaacccgaggagauggaucuacacgcggacacaaagcuacaguaucaacaggaucuguacacuuuacaccaaaauuaggauccguccaauuuucaacugauacaucaaacgauuucgaaacaggacagaauacaagauucacaccaguuggcguaguacaagacggaucaacaacacaccaaaaugaaccacaacaaugggucuuaccugcauacucaggaagagacaaccauaacguucaccuugcacccgccguagcaccaacauuuccaggagaacaacuauuauucuuucgaucuacaaugccuggaugcucaggauauccaaacaugaaucucgacuguuuauuaccacaagaauggguucaacauuuuuaucaagaaucagcacccgcacaaucugacguagcucuauuaagauuuguuaacccugauacaggaagagucuuauucgaaugcaaauuacauaaaucuggauacguaacaguagcacauacuggacaacaugaucuaguaauaccaccuaauggauauuuuagauuugacucauggguuaaucaauuuuacacauuagcaccaaugggaaacggagcaggaagaagaagauaa

SEQ ID NO: 33679 - RNA, 1617 nt, Artificial Sequence
  derived and/or modified sequence opt6 from VP1__Norovirus_and/or_Norovirus-like__LC005708
augaaaauggcaucaaacgaugcaagccccucugauggaucagcagccaacuuaguaccugaaguaaacaaugaaguaauggcccuagaaccaguagucggagccgcaauagcagcaccaguagcaggacaacaaaaugucauagacccauggauucgcaauaauuuuguacaagcuccgggaggagaauuuacaguuucccccagaaaugccccuggagaaauauuauggucggcaccacuaggaccagaccuaaauccauaccuaucucaccuagcacgaauguauaacggauacgccgguggauuugaaguucaaguaauuuuagcaggcaaugccuucacagcaggaaaaauuauauucgcagcaguuccuccuaacuuccccacagaaggacuaaguccaucacaaguaacaauguuuccacacauaauaguagauguuagacaacuugaaccaguauuaauacccuuaccagauguuagaaacaauuuuuaucacuauaaucaauccaacgauucaacaauaaaacuaauagcaaugcuauauaccccacucagagcuaacaaugcuggggaagacguauuuacaguaucuugcagagucuuaaccaggccaucaccagacuucgauuuuauauuuuuaguacccccaaccguagaaaguagaacaaaaccauuuacaguaccaauacuuacaguagaagaaaugacaaacucuagauuuccaauaccauuagaaaaacuauucacuggaccuucauccgcuuuuguuguacaaccacaaaacggacgcuguacaacagacgguguauuacuuggaacuacacaauuaucccccguaaauauauguacauuuagaggagacguaacacauauugcaggaucaagaaauuacacaaugaaucuugcaucucuaaacuggaauaauuacgauccaacagaagaaauucccgccccucucggaacaccagauuuuguaggaaaaauacaaggaguacuuacucaaacaacaaaaggagaugguucaaccagagggcauaaagcaaccguauauacaggaucagcaccauuuacuccaaaauuagguaguguccaauucucaaccgauacagaaaacgacuucgaaacccaucaaaacacaaaauuuacaccaguaggugucauacaagacggugguacaacacauagaaaugaaccacaacaauggguucuaccauccuacuccggaagaaacguacaaaacguacaucuagccccagcagucgccccaacauuuccaggagaacaacuccuauucuuuagaucaacuaugccagguuguucuggcuauccaaauauggaucuagauugccuacuaccccaagaauggguucaacauuucuaccaagaagcagcaccagcacaaucagacguugcauuacuacgcuuuguaaauccagauacaggacgaguauuauucgaauguaaauuacacaaaucaggcuaugucacuguagcacacacuggacaacacgaccuaguaauaccaccaaauggauauuuuagauucgauucauggguaaaucaauuuuacacacuagcuccuaugggcaacggaacagguagacgaagauaa

SEQ ID NO: 33680 - RNA, 1617 nt, Artificial Sequence
  derived and/or modified sequence opt6 from VP1__Norovirus_and/or_Norovirus-like__LC005704
augaaaauggcuucaaaugaugcuaauccaucagauggaucagccgcaaaccuagucccagaaguuaacaaugaaguaauggcacuagaacccguaguaggagcagcaaucgcagcaccagucgcuggacaaacaaaugucaucgacccauggauaagaaacaacuucguucaagcaccagguggugaauuuacaguaucaccaagaaaugcaccuggagaaauccucuggucugcaccuuuagguccagaucucaauccauaucuaucccacuuagcaagaauguacaacggcuacgcaggaggauucgaaguacaaguaauauuagcaggaaaugcauucacagccggaaaaauuauauucgcugcaguaccuccaaauuucccuacagaaggcuuaucaccaucacaaguaacaauguucccacauauaaucguagacguaagacaauuagaacccguccuaauaccacuuccagacguaagaaauaauuucuaucauuauaaucaaucaaaugacucaacaauaaaacuaauagcuaugcuauauacccccuuacgagcaaacaacgcaggagaagaugucuuuacaguaaguugccgaguccuaaccagaccaucaccagacuucgacuuuauuuucuuaguaccaccaacaguagaaucaagaaccaaaccauucacaguuccuauccuaacaguugaagaaaugacaaacagucgauuucccauaccucuagaaaaacuauuuacaggaccaucaggcgcauucguaguacaaccacaaaaugguagauguacaacagauggcgucuuacuaggaaccacacaauuaucaccaguaaauaucuguacuuuucgaggugacguaacacauauugcaggcucuagaaacuacacaaugaaucuagcaucacucaacuggaacaacuacgauccaacagaagaaauuccagcaccauuagguacaccagacuucguagguaaaauacaaggugucuuaacacaaacaacaaaaggagaugguucaacacgaggccacaaagcaacuguauauacuggaucugcuccauuuacaccaaaauuaggaagcguucaauuuucaacagauaccgaaaaugacuucgaaacacaucaaaacacaaaauuuacaccaguaggaguuauacaagauggaucaacuacacauagaaaugaaccucaacaauggguuuuaccuucauauucaggaagaaacguacauaacgugcaucuagcaccagcagucgcaccaacuuuccccggugaacaauuacuauuuuucagaucaacaaugcccgguugcucaggauauccaaauauggaucucgauugcuuacuuccucaagaauggguacaacauuucuaccaagaagcugccccugcacaaucugauguagcacuauuaagauucgucaauccagauacuggacgaguauuauucgaaugcaaacuacauaaaucaggauauguaacaguagcacacacaggacaacaugaucuaguuauacccccaaacggauauuuuagauucgauucauggguaaaccaauucuacacacuugccccaaugggcaauggaacaggcaggagacgauaa

SEQ ID NO: 33681 - RNA, 1617 nt, Artificial Sequence
  derived and/or modified sequence opt6 from VP1__Norovirus_and/or_Norovirus-like__KF429777
augaaaauggcaucuucugaugcaaacccaucagauggauccgcagcaaauuuaguaccagaagucaacaaugaaguaauggcuuuagaaccaguaguuggagcagcuauagcagcaccaguagcaggacaacaaaacguaauagacccuuggauacgcucaaauuuuguacaagccccaggcggagaauuuacaguauccccaagaaaugcacccggagaaauauuauggucugcacccuuaggaccagaucuuaauccauauuuaucucaccuagcaagaauguauaacggauaugcugguggauuugaaguacaaguaauauuagcagguaaugcauuuacugcaggaaaaaucaucuuugcagcaguuccucccaauuuucccacugaaggacuaucuccaucacaaguaacaauguuuccucacauaauagucgacguaagacaauuagaaccugucuuaauaccccuacccgauguacgaaacaacuucuaucacuauaaccaauccaaugacucaacaauaaaauuaauagcaauguuauacacaccgcuaagagcaaauaaugcaggcgaugaugucuucacaguaucauguagaguacuaacacguccaucaccagauuucgauuuuauauuccuuguaccaccuacaguugaaucuagaacaaaaccauucacuguaccaauuuuaaccguagaagaaaugacuaauucuagauuuccaauaccauuagaaaaauuauuuacaggaccaucaagugcauucguaguacaaccacaaaacggaagguguacaacagacggaguauuacuugguacaacacaauuaucaccagucaauauauguacauuuagaggugauguuacucauauagcaggcagccgaaauuauaccaugaaccuagcaaguuuaaauuggucaaauuaugauccaacagaagaaauaccagcuccacuagguacgccagacuuuguaggaaaaauucaaggaguccuaacccaaacaacaaaaggugauggcuccacaagaggacauaaagccacaguauauacaggaucagcagacuucacgccaaaacuaggaucaguacaauucgcuacagacacagaaaaugacuuugaaacacaucaaaauacacgauuuacucccguaggaguaauacaagacggaggaacuacccauagaaaugaaccacaacaauggguccuaccaucuuauagcgguagaaauguacauaacguucaucuggcacccgcaguugcaccaaauuuuccaggugaacaacuucuauuuuucagaucaacuaugcccggaugcucagguuacccaaauauggaucuugacugccuacuaccacaagaauggguacaacauuucuaccaagaagcagcacccgcacaaucagacguagcacuauuaagauuuguuaacccagacacaggacgaguauuauucgaaugcaaauuacauaaaucaggcuacguaacaguugcacacacaggucaacaugauuuaguuauaccaccaaauggauauuuccgauucgauucauggguaaaucaauuuuacacacuagccccaaugggaaacggaacaggaagaagaagauaa

SEQ ID NO: 33682 - RNA, 1617 nt, Artificial Sequence
  derived and/or modified sequence opt6 from VP1__Norovirus_and/or_Norovirus-like__JX439840
augaaaauggcauccaaugacgccagccccagugauggaucugcagcaaauuugguaccugaagucaauaaugaaguuauggcacuagaaccaguugucggagcagcaauagcugcaccaguagcaggucaacaaaauguaauagauccauggauaagaaacaacuuuguacaagcaccuggaggagaauuuacaguuuccccaagaaaugcucccggagaaauucuauggucagccccauuagguccagaucuaaauccauaucuuucucauuuagcuagaauguauaacgguuacgcuggagguuucgaaguccaagucauauuagcaggaaaugcauuuacagccggaaaaauaauauucgcagcaguacccccaaauuuuccaacagaaggacuaucaccaucacaaguuacaauguucccacacauaauuguagacguuagacaacuagaaccaguauuaauaccacuaccagauguaagaaacaacuucuaucacuacaaccaaucaaaugauaguaccauuaaauuaauagccaugcuauacacaccacuaagagccaacaaugcaggagaagauguauuuacaguauccuguagaguucuaacaagaccaucaccagauuuugauuuuaucuuucuaguuccuccaacaguagaaucacguacaaaaccauuuacaguaccaaucuuaaccguagaagaaaugacaaacucaagauucccaauaccccucgaaaaacuauuuacaggaccaucaggagcauucgugguccaaccacaaaacggccguuguacaacugauggagucuuacuaggaacaacacaacuauccccuguaaauaucuguacauuccgaggugacguaacacacaucgcaggaucacgaaacuacacaaugaaucuagcaucacuaaauuggaauaacuacgauccuacagaagaaauaccggcacccuuagguauaccagacuuuguuggaaaaauacaaggaguacuaacccaaacaacaaaaggcgacggcucuacucgaggucauaaagcuacaguauacacagguucugcuccauuuacuccuaaauuaggcucaguucaauuuucaacugauacagaaaacgauuucgaaacacaccaaaauacuaaauucacaccuguaggaguaauacaagauggaggaacuacacaucgaaaugaaccacaacaauggguacuuccaucauauucuggucgaaauguccaaaauguccaccuagccccugcaguagcaccuacauuuccaggagaacaacucuuauucuuuagauccacaaugccuggauguucuggauauccaaauauggaucuagauugcuuacuuccacaagaauggguacaacauuucuaucaagaagcugcaccagcacaaucugacguugcauuacucagauuugucaauccagacacaggacguguacuauucgaaugcaaacuacacaaaucaggauauguaaccguagcacauacaggccaacacgaccuaguaauacccccaaacggauauuucagauucgauuccuggguuaaccaauuuuauacauuagcaccaaugggcaauggcaccggaagaagaagauaa

SEQ ID NO: 33683 - RNA, 1617 nt, Artificial Sequence
  derived and/or modified sequence opt6 from VP1__Norovirus_and/or_Norovirus-like__JX644026
augaaaauggcaucaaaugaugccaacccaucagaugguucugccgcgaaucuaguaccagaaguuaauaaugaaguuauggcucuugaaccaguagucggugccgcaauugcagcucccgucgccggacaacaaaauguaaucgauccauggauaagaaauaacuuuguacaagccccaggaggagaauuuacaguaucaccccgcaacgcaccaggagaaaucuuaugguccgcaccuuuaggacccgaccuaaaucccuauuuaucacacuuagcacgaauguacaauggauaugccggaggauucgaaguucaaguaauacuagcaggaaaugcauucaccgcaggaaaaauaauauuugcagcaguuccaccaaauuucccaaccgaaggacucucaccaucucaaguaacaauguuuccacacauuaucguagauguaagacaacuagaaccaguacucauucccuuacccgauguacgaaauaacuucuaccauuauaaccaaucaaacgacucaacaauuaaauuaauagccaugcuuuauacaccauuaagagcaaacaacgccggagaagauguauuuacaguuucauguagaguauuaacaagaccauccccagacuucgacuuuauauuuuuaguaccacccacaguugaaagcagaacaaaaccuuuuacugucccaauacucacaguagaagaaaugacaaacucaagauuuccaauaccauuagaaaaacuauuuacaggaccaucuagugcauucguaguucaaccucaaaauggacgcuguacaacugacggaguacuacucggaacaacccaacuuuccccagucaauaucuguacauucagaggagauguuacacacauagccggaucaagaaacuacacaaugaaccuagcaucuuuaaacuggaacaauuacgauccaacagaagaaauacccgcaccauuaggaacaccagauuuuguugguaaaauacaaggaguacuaacucaaaccacaaaaggugacggaucaacucgcggacauaaagcaacaguauacacaggcagcgccccuuucacuccaaaacucggaucaguacaauucucaacugacacagaaaacgauuucgaaacacaccaaaacacaaaauuuacuccaguaggaguaauccaagacggaaguacaacacacagaaaugaaccacaacaauggguacuaccuucauauuccgguagaaaugcacaaaacguacauuuagcacccgcaguagcuccaacuuuuccaggcgaacaauuacuauucuuccgaucuacuaugccuggaugcucaggauaccccaauauggaucuagauugcuuacucccucaagaauggguacaacauuucuaccaagaagcagcaccagcacaaucagaugucgcucuuuuacgauuuguuaacccagauacagguagaguauuauucgaaugcaaacuucauaaaucaggauauguaacagucgcacauacagggcaacaugauuuaguuauuccaccaaacggcuacuucagauucgacucauggguaaaccaauuuuauacacuugcaccaaugggaaauggcacuggaagaaggagauaa

SEQ ID NO: 33684 - RNA, 1617 nt, Artificial Sequence
  derived and/or modified sequence opt6 from VP1__Norovirus_and/or_Norovirus-like__JX459906
augaaaauggcaucaaaugacgcaaaccccucagauggauccgcagcaaauuuaguucccgaaguaaacaaugaagucauggcacuagaaccaguuguaggcgcagcaauagcagcaccaguagcaggacaacaaaaugucauagacccauggauaagaaauaacuucguacaagcaccaggaggugaauuuacuguuucaccaagaaaugcaccaggagaaauauuauggagcgcaccacuuggacccgaccuaaauccauauuuaagccacuuagcaagaauguacaacggcuacgcaggaggauucgaaguacaaguaauacuagcuggaaaugcauuuaccgcuggaaaaauaaucuuugcagcaguucccccaaacuuuccuacagaaggacuauccccaagccaaguaacaauguucccucauauaauuguagauguaagacaacuagaacccguauuaaucccauuaccagauguaagaaauaacuucuaccacuauaaucaaucaaaugacagcacaauaaaauuaauagccaugcuauacacaccauuaagagcaaacaaugcuggagaagauguauucacaguuucguguagaguacuaaccagaccaucaccagacuucgacuuuauauuuuuaguaccaccuacagucgaaucacgaacuaaaccauuuacagugccuauacuaacuguugaagaaaugacaaacucaagauuuccaauccccuuagaaaaguuauucacaggaccauccucagcauucguaguacaaccacaaaacggaagauguaccacagacggaguuuuauuaggaaccacccaauuaucuccagucaauauauguacuuuuagaggagauguaacccauauagcaggcucuagaaauuauaccaugaacuuagcaucacuuaacuggaacaauuaugaccccaccgaagaaauaccagcuccuuuaggaaccccagauuuugucggcaaaauacaagguguacuaacacaaacuaccaaaggagacggaucuacuagaggacacaaagcaacuguuuauacaggaucagcacccuuuacgccaaaacuuggaucaguccaauuuggaacagauacagaaaaugauuucgaaacacaucaaaauacaaaauucacuccagucggcgucauccaagacggaggaacaacucaccgaaacgaaccucaacaauggguacuaccuucauauucagguagagauguaccaaacguacacuuagccccggcugucgcaccaaccuuuccaggagaacaacuauuauucuuuagaucuacaaugccugguugcucaggauauccaaacauggaucuagauugucuuuuaccacaagaauggguacaacacuucuaccaagaagcagcaccagcacaaucagacguagcuuuauuaagauucguaaacccagacacaggaagaguacuauuugaauguaaacuacauaaaucagguuauguaacagucgcacacacaggucaacacgacuuaguaauaccaccuaauggcuacuuuagauuugauuccugggucaaccaauuuuauacauuagcuccaauggguaacggaacaggaagacgcagauaa

SEQ ID NO: 33685 - RNA, 1617 nt, Artificial Sequence
  derived and/or modified sequence opt6 from VP1__Norovirus_and/or_Norovirus-like__JX459597
augaaaauggccucaaacgacgcuacaccuucagacggaucuacagcaaauuuagucccagaaguuaacaaugaaguuauggcucuagaaccagucguaggagcugcaaucgcagcuccaguagcaggacaacaaaauguaauagauccuuggauacgaaacaauuucguacaagcaccuggcggugaauuuaccguaucaccacgcaaugcaccaggagaaauacuuugccaugcaccuuuaggaccugauuuaaaucccuaucuaagucaccuagcuagaauguauaaugguuacgcuggaggauucgaaguacaagucauacuagcuggcaaugcauucacagcuggaaaaauaauauucgcagcuguuccaccuaauuucccaacugaaggcuuaucuccuucacaaguaacaauguuuccucacaucauuguagacgucagacaacuagaaccaguucucauucccuuaccugauguaagaaauaauuucuaucacuacaaccaaucaaaugacccaaccauaaaauuaauagcaaugcucuauacaccauugcgagccaauaacgcaggagacgauguauucacaguuagcugccgaguccucacaagaccauccccagacuuugacuuuauauuccuaguaccaccaacuguagaaucaagaacaaaaccauuuucaguaccaaucuuaacagucgaagaaaugacaaacucaagauucccaauucccuuagaaaaacuauuuacagguccaucauccgccuucguaguucaaccacaaaacggaagauguacaacugacggaguuuuauuaggaaccacucaacuaucaccuguaaauaucugcaccuuucgaggagacgucacccacauagcaggaacacaaaauuacacaaugaaccuugcaagccaaaauuggaauaauuacgacccuacugaagaaauccccgcaccuuuaggcacuccugacuucgucggacgcauacaaggaguccuaacacaaaccacacgacgagacggaucaacaagaggacauaaagcaacacucuccacaggcucaguacauuuuacaccaaaacuaggaucaguacaauucucaaccgauacuucaaacgauuucgaaacaggacaaaauacaagauucacaccaguuggcguaguacaagacggauccacaacacaucaaaacgaaccucaacaauggguauuacccaacuauucaggaagagacagccacaacguacaccuagcaccagcaguagcaccuacauuucccggugaacaacucuuauucuucagaucuaccaugccaggaugcuccgguuauccuaauaugaacuuagacugccuacuaccacaagaauggguacaacauuuuuaucaagaaucagccccagcucaaucugauguagcauuacucagauuuguuaacccagauaccggaagaguauuauuugaauguaaacuacauaaaucaggcuauguuaccguagcacacacuggccaacaugauuuaguaauaccaccaaauggauauuuuagauucgauuccuggguuaaucaauuuuacacucuugcaccaaugggaaauggagcaggcagaagacgauaa

SEQ ID NO: 33686 - RNA, 1617 nt, Artificial Sequence
  derived and/or modified sequence opt6 from VP1__Norovirus_and/or_Norovirus-like__HQ456334
augaaaauggcaucuaacgaugcaucaccauccgauggaucggcagcaaauuuagucccagaaguuaacaaugaagucauggcucuggaaccaguaguuggagcagcaauagcagcuccaguagcaggacaacagaauguaauagacccauggauaagaaacaauuucguccaagcacccggaggagaauuuacaguaucaccaagaaacgcaccuggagaaauauuauggucugcaccacuaggcccggacuuaaauccauaucucucucacuuagcacguauguauaaugguuacgcaggcggauucgaaguacaagucauuuuagcaggaaaugcauucacagcagguaaaauaauauucgcagcaguacccccaaacuucccaacagaaggacuaucuccuucucaaguaacaauguuuccacacauaauagucgacguaagacaauuagaaccaguauugauucccuuacccgacguacgaaacaauuucuaucacuauaaccaaucaaaugauucaacaauuaaacuaaucgccaugcuauacacaccacuuagagcaaauaaugccggagaagaugucuucacagucucauguagaguauuaacacgaccauccccagacuuugauuuuauauuccucgucccaccaacuguagaaucacguacaaaaccuuucacaguaccaauacuuaccguagaagaaaugacaaacucuagauucccaauuccccuagaaaaacuauuuaccgguccuucuggagcuuucguuguacaaccacaaaauggaagaugcacaaccgaugguguccuacuagguacaacacaauuaagcccaguaaacaucuguacauucagaggagauguaacccacauagcaggcucuagaaacuauacaaugaaccuagcagcacuaaauuggaauaacuacgaucccacagaagaaaucccugccccacuaggaacaccagacuuuguaggaaaaauacaagguguacuaacccaaaccacaaaagcagauggaaguacaagaggacauaaagcaacaguauacacaggauccgccgacuuuacaccaaaauuaggaucaguacaauucaauacagauacugaaaacgacuuugaaacccaucaaaauacaaaauuuacaccugucggaguaauccaagacgguucaacaacacauagaaaugaaccacaacaauggguccuaccaucauauuccggaagaaauguucauaauguacacuuagcaccagcaguugccccaacauucccuggagaacaacuauuauuuuucagaucaacaaugccuggcugcucaggauauccaaauauggauuuagauugcuuacuuccacaagaauggguucaacacuuuuaucaggaagcagcacccgcacaaucugacguugcauuauuacgauucguuaacccagacacuggaagaguccuauuugaaugcaaacuacauaaaucaggauaugucacaguagcccacacagggcaacaugaucuagucauaccaccaaacggcuauuucagauuugauucauggguuaaucaauuuuacacauuagcucccaugggaaauggaacaggaagacguagauaa

SEQ ID NO: 33687 - RNA, 1617 nt, Artificial Sequence
  derived and/or modified sequence opt6 from VP1__Norovirus_and/or_Norovirus-like__HM802553
augaaaauggcuucaaaugacgcaucaccaucagacggcucagcagcaaauuuaguaccagaaguaaauaacgaagucauggcuuuagaaccuguagucggagcagcuauagcagcaccaguagcaggacaacaaaaugucauagaccccuggaucagaaauaacuuuguccaagcccccggcggugaauuuacaguuucaccacgaaaugcaccaggagaaauacuuuggucagcacccuuaggaccagacuuaaauccuuauuuaucacauuuagcaagaauguauaauggauaugcaggaggauucgaaguacaaguucuauuagcuggaaacgcauuuacagcaggaaaaauaauauucgcagccguaccaccaaccuucccaacagaagguuuaaguccaucacagguuaccauguuuccccacauaauugucgauguaagacaacuagaaccuguacuaaucccacuaccagauguaagaaacaauuuuuaucacuauaaccaauccaaugauucuacuauuaaacucguagcaaugcuauacaccccacuacgagcuaacaacgccggugacgauguauucacaguuucauguagaguucuaacaagacccucccccgacuuugacuucauuuuucucguuccaccaaccguagaauccagaaccaaaccauuuacagucccaauccuuacaguagaagaaaugacuaacucaagauuuccaauuccacuagaaagauuauucacuggaccaucaucugcauucguaguacaaccacaaaacggucgaugcacuacugacggcguacuauuaggaacaacacaacuaucaccagucaacauaugcacauuucgaggagauguuacaaauauaccaggaucaagaacauaccgaaugaaccuagccagucaaaauuggaauaauuacgacccuacagaagaaauaccagcaccucuaggaacacccgauuuuguaggaaaaauacaagguguucuaacacaaacuacaaaaggagauggaucaacuagaggacauaaagcaacaguaagaacuggaucagcagacuuuaccccaaaauuaggaucaguacaauuugcuacagacacagauaaugauuuuguuacaggucaaaacacuagauuuaccccagugggcguaauacacgacggcucaucugcacacagaaaugaaccucaacaauggguacuaccugaauauucuggucgaucaguucacaacguacauuuagccccugcaguugcaccuacauuuccaggagaacaacuauuauucuuucgaucaacaaugccaggaugcucaggauauccuaauauggaccuagauugucuacucccacaagaauggguucaacacuucuaucaagaagcagccccaucacaauccgacguagcccuauuacgauuuguaaauccugacacaggaagaguacuauucgaauguaaauuacacaaagcaggauauguuacaguugcucacacaggccaacaugauuuaguaauuccuccaaauggcuacuuucgauuugauucauggguaaaucaauuuuauacacucgcuccaaugggaaauggagcaggccgaagaagauaa

SEQ ID NO: 33688 - RNA, 1617 nt, Artificial Sequence
  derived and/or modified sequence opt6 from VP1__Norovirus_and/or_Norovirus-like__HQ008055
augaaaauggcuucaucagaugccaacccaagcgauggaucaacagcuaauuuaguaccagaaguaaacaaugaagucauggcacuagaaccuguaguuggagcagccauagccgcaccagucgcaggacaacaaaacguaauagacccauggauaagaaauaacuuuguacaagcaccuggaggugaauuuacaguuucuccaagaaaugcaccuggagaaauacucuggucagcuccacucggaccggauuuaaacccauaccuaucccaccuagcucgaauguacaacggauaugcugguggauucgaaguacaagucauacuagcaggaaaugcauuuaccgcaggcaaaaucauauuugcagccguacccccaaacuuuccaacagaaggccuaucaccaucgcaaguaacaauguuuccucacauaauaguagauguaagacaacucgaaccuguacucauuccucuaccugauguuagaaacaauuucuaucauuauaaccaacuaaaugacccaacaauaaaauuaauagcaauguuauacacaccacuaagagcaaauaaugcaggcgaugacguauuuacagucuccugucgaguucuaacacgaccaucaccagauuuugacuuuauauuucuaguaccaccaacuguugaaucaagaacaaaacccuucucaguacccauauuaacugucgaagaaaugacuaacuccagauuccccauuccacuagaaaaauuauuuacagguccuucuucagcuuucguuguacaaccacaaaacggccgcuguacaacugacggaguacuauuaggaacuacacaauuauccccuguaaauauauguacauucagaggcgacguaacccacauaacaggaucucacaauuacacaaugaaccuagcaagucaaaacuggaacuccuaugacccaacagaagaaauaccagcaccauuaggaacaccagauuucguugguaaaauacaaggcguauuaacacaaaccacacgagcugaugguucaacaagaggacacagagccacaguauauacaggaagugcagaauuugccccaaaguuaggcagaguacaauucgcuaccgauacagaaaaugauuuugacacuaaucaaaauacaaaauucacaccaguuggcguaauacaagauggaaauacuacacaucgaaaugaaccacaacaauggguauuacccuccuauucaggaagaaauucacauaacguacaucuagccccugcaguagcaccaacauuuccaggagaacaacuauuauucuuuagaucaaccaugccugguuguaguggauacccuaaccuagauuuagacugccuuuuaccacaagaauggguacaacauuuuuaucaagaagcagcuccugcacaaucagacguagccuuacuaagguucguaaacccagauacagguagaguauuauucgaaugcaaauuacauaaaucagguuauguaacaguagcucauacaggacaacacgauuuaguuauaccucccaauggauauuucagauuugacucaugggucaaucaauuuuacacuuuagcaccuaugggaaauggaacaggaagaagaagauaa

SEQ ID NO: 33689 - RNA, 1617 nt, Artificial Sequence
  derived and/or modified sequence opt6 from VP1__Norovirus_and/or_Norovirus-like__AB541360
augaaaauggcaucaaaugacgcaaaccccucugauggcucugccgcuaaccuagugcccgaaguaaauaaugaaguuauggcucuagaaccaguaguaggugcagcaauagcagcaccuguagcaggccagcaaaacgucauagacccauggauaagaaauaauuuuguucaagcucccggaggagaguucacaguuucacccagaaaugccccaggcgaaaucuuaugguccgcaccacuaggaccagacuuaaauccauaccuaucucaucucgcaagaauguauaacggauacgcaggcggauucgaaguacaaguaauacuagccggaaacgcauuuacugcaggaaaaauaauauuugcugccguaccaccaaacuuucccacugaaggcuuaaguccaagucaaguuacuauguucccccauauaauagucgacguaagacaacuagaaccuguauuaauuccauuacccgauguaagaaacaauuucuaucacuauaaucaaucaaacgacucaacaauuaaacuuauagccaugcuauacacaccacuuagagcuaacaaugccggagaagauguauuuacgguauccugcagaguacuaacucgaccaagccccgacuuugacuuuauauuucuugucccaccaacaguagaauccagaacaaaaccauuuacuguaccuauacuaaccguugaagaaaugacaaacaguagauuuccaauccccuuagaaaaacuauucaccggucccagcucagcauuuguaguucaaccccaaaacggaagauguaccacagauggaguacuucuaggaacaacacaacuauccccaguaaacauuugcacauuccgaggagacguaacacauauagcggguucacgcaauuacacaaugaauuuagcaucacuuaauuggaacaauuacgacccaacugaagaaauccccgcaccacuaggaacuccagauuucguaggaaaaauacaaggaguuuuaacacaaacaacaaaaggagacggaucuacaagaggacacaaagccacuguuuauacaggaucagcuccauucacaccaaaauuaggaucaguucaauuuaguaccgacacagaaaacgauuuugaaauacaucaaaauacaaaguucacaccaguaggcgucauucaagauggaucuacaacacauagaaacgaaccacaacaauggguauuaccaucauauuccggaagaaauguacauaacguacacuuagccccagcagucgcaccaacauuuccaggagaacaacuauuauucuuuagauccacaaugccaggaugcucaggauacccuaauauggaucuagauugucuucuaccacaagaauggguacaacauuucuaucaagaagcagcuccugcacaaucagacguugcuuuauuaagauucguaaaucccgauacaggaagaguauuauucgaauguaaacuacauaaaucaggcuauguaacaguagcauauacaggacaacaugacuuaguaauaccaccaaauggcuacuuuagauucgauuccuggguaaaucaauucuacacuuuagcaccaaugggcaauggaacaggacgccguagauaa

SEQ ID NO: 33690 - RNA, 1617 nt, Artificial Sequence
  derived and/or modified sequence opt6 from VP1__Norovirus_and/or_Norovirus-like__AB541262
augaaaauggcuucaaaugaugcaaacccaucagauggcucagcagcuaaucuaguaccagaaguaaauaacgaaguaauggcacuagaaccaguagucggagcugcuaucgcugcaccaguugcuggccaacaaaaugucauagacccguggauaagaaacaauuucguacaagcaccaggaggagaauuuacaguuucaccacguaacgccccaggagaaauauuauggucugcaccauuagguccagaccuaaaucccuauuuaagccacuuagcaagaauguacaacggauacgcuggaggauucgaaguacaaguuauacuagcaggaaaugcuuuuacagcaggaaaaauaaucuuugcagcagucccucccaacuuucccacagaaggauuaucuccaucacaaguuacuauguuuccccacauaaucguagauguaagacaauuagaaccuguuuuaauaccauuaccugauguaagaaacaauuucuaucacuauaaccaaucaaacgauucaacuauaaaacuaauagcuaugcuauacacuccacuaagagcuaacaacgcuggagaagauguauuuacgguuagcuguagaguauuaacaagaccaucuccagauuucgacuuuauuuuccuaguaccuccaacagucgaaucacgaacaaaaccauucacaguaccaauauuaaccguagaagaaaugacuaauucaagauuucccauaccacuugaaaaacuauucacaggaccuucuucugcuuuugucguucaaccacaaaacggaagauguacaacugacggaguucuauuagguacaacucaacuaucaccuguuaacauauguacuuuuagaggugacguaacacacguagcaggcucacggaacuauauuaugaaucuagcaucguuaaacuggaacaauuacgauccuacagaagaaauaccagcaccacuaggaacuccagauuuuguaggaaaaauacaaggaguacuaacacaaacaacaaaaggagacggaucaacucguggacauaaagcuacagucuauacaggaucagcuccauucacuccaaaauuaggauccguacaauucucgacagauacagaaaaugacuuugaaacccaucaaaacacuaaauuuacacccguaggaguuauacaagacggcucaacaacacaccggaaugaaccucaacaauggguacuaccaucuuauucaggacgaaauguacacaacguacaucuagcaccagcaguagcaccaacauuuccaggagaacaacuacucuucuuuagaucaacgaugccagguugcuccggauacccaaauauggaccuugacugucuacuaccacaagaauggguucaacacuucuaucaagaagcagcaccagcucagucagauguugcccuauuaagauuuguaaacccagauacaggaagaguccuauuugaauguaaacuucauaaaucagguuauguuacaguagcucacacuggacaacaugauuuaguaauaccaccgaauggauauuucagauuugauucuuggguaaaucaauuuuauacuuuagcaccaaugggaaauggaacaggaagaagacgguaa

SEQ ID NO: 33691 - RNA, 1617 nt, Artificial Sequence
  derived and/or modified sequence opt6 from VP1__Norovirus_and/or_Norovirus-like__AB541231
augaaaauggcuagcaacgacgcaaaccccucagauggcagcgcagcaaaccuaguuccagaaguaaacaacgaaguaauggcauuagaacccguaguaggugcugcuauugccgcaccaguugccggucaacaaaacgucauagauccauggauucgaaacaacuuuguacaagccccaggaggagaauuuacaguaucaccuagaaacgcuccaggagaaaucuuauggucugcaccacuagguccagaccuaaauccauaucucagucauuuagccagaauguauaacgguuaugcaggaggauuugaaguccaaguuauauuagccggaaaugcauuuacagcuggaaaaauaauuuuugcagccguaccaccaaauuuccccacagaaggauuaucacccucacaaguaacaauguuuccacauauaauaguugaugucagacaauuagaacccguucuaauaccucuacccgacguacguaacaauuucuaucacuauaaccaaucaaacgacucuacuauaaaacugaucgcaauguuauacacaccauuacgugcaaauaacgcuggagaagauguauucacaguaucauguagaguauuaacaagaccauccccagauuuugauuuuauauuccucguaccaccaacaguugaaagucgaacaaaaccauuuacaguacccauauuaacagucgaagaaaugacaaauucacgauuucccauuccacuagaaaaacuuuuuacaggaccuucaagugcauuugcaguacaaccacaaaauggacguuguacaacugacgguguauuauuaggaaccacccaauuaucuccaguuaacaucuguaccuuucgaggugauguaacacauauagccggcucuagaaacuauacuaugaaucuagcaucacuuaauuggaauaacuacgauccaacagaagaaauuccagcuccauuagguacacccgauuuugucggaaaaauacaagguguucuuacacaaacaacaaaaggagauggaucaacuagaggccauaaagcaacuguauauacaggaucagccccauuuacaccuaaacucggaucaguccaauuuagcacagauacagaaaaugauuucgaaacccaccagaauacaaaauuuacaccaguuggaguaauacaagacggcuccacaacacaucguaaugaaccacaacaauggguauuacccaguuauucaggaagaaauguaccaaauguacaccuagcaccagcuguagccccaacauuuccaggagaacagcucuuauucuuuagaucaacaaugccaggauguucaggauauccaaauauggauuuagauugcuuauuaccacaagaauggguucaacacuucuaucaagaagcagcuccagcccaaucagauguagcucuacuaagauucguaaauccggacacaggaagaguacuauuugaaugcaaacuacauaaaucugguuauguuacaguugcucacaccggccaacaugaucucguaauuccaccuaacggcuacuucagauuugacucauggguaaaucaauuuuacacauuagcaccaaugggaaauggaacaggaagacgcagauaa

SEQ ID NO: 33692 - RNA, 1617 nt, Artificial Sequence
  derived and/or modified sequence opt6 from VP1__Norovirus_and/or_Norovirus-like__GQ246792
augaaaauggcaaguucagacgcaaacccaagcgauggcucuacagcaaauuuagucccagaagucaacaaugaaguaauggcacuagaaccaguuguaggagcagcaauagcagcacccguggcaggacaacaaaauguuauagacccuuggauaagaaauaacuuuguacaagcaccaggaggugaauuuacagucucuccaagaaacgcacccggagaaauauuauggucagccccucuaggucccgauuuaaauccauaccuuucccaccuagcaagaauguauaacgguuaugcaggaggauucgaaguacaaguuauacuugcuggcaaugcauuuacagcaggcaaaauaauauucgcagcaguaccaccaaacuuuccuacugaaggauuauccccaucucaaguaacaauguucccacacauaauaguugacgucaggcaauuagaaccuguauuaauaccauuaccugauguacgaaauaacuucuaucauuauaaccaaucuaaugaccccaccauaaaauuaauagcuaugcuauauacaccauuacgagcuaauaaugcaggagacgacguauuuaccguauccuguagaguuuuaaccagacccucuccagacuuugacuuuauauuccuuguacccccaaccguugaaucaaggacaaaaccauuuucaguaccaauauuaacaguagaagaaaugacaaacucaagauuuccuauaccucuagaaaaauuauuuacaggaccaucaucagcuuucguuguacaaccacaaaacggacgauguacaaccgacgguguacuacuaggaaccacacaacuaucacccguaaauauauguacuuuuagaggcgacguaacacauauaacaggaucaagaaauuacaccaugaauuuagcaacacaaaacuggaacucauacgauccaacagaagaaauaccagcaccacuaggaacuccagauuucgucgguaaaauucagggcguauuaacacaaaccacaagagcugauggaucaacaagaggccacaaagcaaccguauauaccggaucagcagauuucacaccaaaauuaggaagaguccaauuugcaacagauacagauaacgacuucgaugcuaaucaaaacaccaaauucacaccaguaggaguaauucaagacggaaauacagcacacagaaaugagccccaacaauggguauuaccaucauacucaggccgaaauucacauaacguacaccuagcaccagcaguagcaccuacauuuccaggagaacaauuauuauucuucagaucaacaaugccaggaugcuccggauauccaaauauggaccucgauugccuacuaccacaagaauggguucaauauuuuuaccaagaagcagcaccagcacaauccgacguugcccuauuaagauuugucaacccagauacaggcagaguuuuauucgaaugcaaauuacauaaaucagguuacguaaccguagcacacacaggacaacaugaucuaguaauaccaccaaauggauauuucagauuugauuccuggguaaaucaauuuuacacucucgcacccaugggaaauggaacugguagaagaagauaa

SEQ ID NO: 33693 - RNA, 1617 nt, Artificial Sequence
  derived and/or modified sequence opt6 from VP1__Norovirus_and/or_Norovirus-like__AB504329
augaaaauggcaagcaaugaugcaaauccuucagauggauccgcagcaaacuuaguuccagaaguaaauaaugaaguuauggcacuagaaccuguuguaggagcagcaauagcagcacccguagcuggucaaacaaauguaauagaucccuggaucagaaauaauuuuguccaagcucccgguggcgaauuuacaguaaguccacgaaaugcaccaggagaaauacuaugguccgcaccauuaggucccgauuuaaauccuuaccuaagucacuuagcaagaauguacaaugguuaugcaggaggauuugaaguacaaguaauauuagcaggaaaugcauuuacagcaggaaaaauaauauuugcagcuguucccccaaacuuuccaaccgaaggauuaucaccaucucaagucacaauguucccacacauuauugucgacguccgccaacuagaaccaguacuaauucccuuaccagaugucagaaauaauuuuuaucauuauaaucaaucaaacgacucaacaaucaaauuaauagcaaugcuuuacacuccacuaagagcuaacaaugcaggagaagacguauuuacaguaucauguagaguacuaacccgaccaucaccugacuuugauuucaucuuucugguacccccaacaguagaaucacgcacaaaaccauucacaguaccaauauuaacgguugaagaaaugacuaauucacguuucccaauaccauuagaaaaacuauucacaggaccaucaggagccuucguaguccaaccccaaaacggacgauguacaacagaugguguacuuuuagguacaacacaacuaucuccaguaaacauauguacauuuagaggagauguuacacacaucgcaggauccagaaacuauacaaugaaucucgcaucucucaacuggaacaauuaugacccaacagaagaaauaccagcaccucuaggaacaccagacuuugucggcaagauucaaggaguacucacccaaacaacuaaaggagauggauccacaagaggacauaaagcaacaguauauacuggaucagcaccuuuuacaccuaaauuagguucaguucaauuuucaaccgauacugaaaaugauuuugaaacacaucaaaauacaaaauucacucccguaggaguaauccaagacggaggcacaacacaucguaaugaaccacaacaauggguuuuaccaucuuacagcgguagaaauguucauaauguacaccuagcaccagcaguagccccaacauucccuggagaacaacuauuauucuuucguucaacaaugccagguugcucaggauaucccaauauggauuuagauuguuuacucccacaagaauggguacaacacuuuuaucaagaagcagcuccagcucaaucagacgucgcuuuacuaagauuuguuaauccugauacaggaagaguucuauuugaauguaaauuacauaaaucuggauauguaacaguagcccauacaggccaacacgaucuaguuauaccuccaaauggauauuucagauucgacaguuggguaaaucaauucuacacauuagcaccaauggguaacggaacuggucgaagaagguaa

SEQ ID NO: 33694 - RNA, 1617 nt, Artificial Sequence
  derived and/or modified sequence opt6 from VP1__Norovirus_and/or_Norovirus-like__AB504306
augaaaauggcaucuaacgacgcuaauccaucagacggaucaaccgcuaaucuuguaccagaaguaaauaacgaaguaauggcauuagaaccaguaguuggagcagcaaucgcagccccuguagcaggacaacaaaauguaauagaucccuggauacguaacaacuuuguucaagcaccaggcggagaguucaccguaucaccaagaaacgcaccaggagaaauauuauggagugcaccauuaggacccgaccuaaauccguaucuuagccaucuagccagaauguauaaugguuaugcaggaggauuugaaguacaagucaucuuagcaggaaaugccuucacagcagguaaaauaauuuucgcagcaguaccaccaaauuucccaacagaaggacuaucuccuucacaaguaacaauguucccucacauaauaguagaugucagacaacuagaaccuguacuaaucccauuacccgacguacgaaauaauuucuaccacuauaaucaaucaaacgauucaaccaucaaauuaauagccauguuauauacaccauuaagagcaaauaaugcaggagacgauguauuuacaguaucaugcagaguuuuaacaagaccaaguccagauuucgauuuuaucuucuuaguaccuccaacaguugaaucaagaacuaaaccuuuuacuguaccaauacuaacagucgaagaaaugucuaaauccagauuuccaauuccacuagaaaaauuauauacugguccuuccucagcauucguaguacaaccgcaaaauggccgaugcaccacagacggcguacuauuagguacaacacaauuaucaguaguaaauauaugcaccuucagaggagauguuacacacauagcaggaucacaugauuacacuaugaauuuagcuucacaaaacuggaauaacuaugauccuacugaagaaauaccagcaccacuaggaacuccugauuuuguagguaaaauacaaggaaugcuuacacaaacaacaagagaagacggaagcacaagagcacacaaagcaacagucucaacugguucaguacacuuuacaccaaaauuaggaucaguacaauacacaacagauacaaauaaugacuuccaaacaggacaaaacacaaaauucacaccaguaggaguaauacaagacggaaauaaccaccaaaacgaaccccaacaauggguuuuaccaaauuacucaggaagaacuggacauaacguucacuuagcuccagcaguagcaccaacauuuccuggcgaacaauuauuauucuuuagaucuacaaugccuggauguucaggauacccuaacaugaauuuagauugccuauuaccucaagaauggguacaacacuuuuaccaagaagcagcuccagcacaaucagacguugcauuauuaagauucguaaacccagauaccggcagauuccuauucgaaugcaaacuacacaaaagcggauacguuacaguagcccauacuggaccccacgauuuaguaauaccaccaaaugguuacuuuagauuugacucauggguuaaucaauucuacacacuagcaccaaugggcaacggcgcaggccgaagacgcguauaa

SEQ ID NO: 33695 - RNA, 1617 nt, Artificial Sequence
  derived and/or modified sequence opt6 from VP1__Norovirus_and/or_Norovirus-like__GQ303445
augaaaauggcaaguuccgacgcaaacccaucugaugguucaacagcaaauuuaguaccagaaguaaacaaugaaguaauggcacuagaaccaguuguaggagcagcaauagcugcaccuguugccggacaacaaaauguaauugacccauggauuagaaacaauuuuguacaagcaccaggaggagaauuuacaguaucuccaagaaaugccccaggagaaauauuauggucagcaccacuaggaccugaucuaaauccauaucuaucacacuuagcgagaauguauaacggauacgcuggagguuucgaaguacaagucauauuagcaggcaacgcauuuaccgccgguaaaauaauauuugcagcaguacccccaaacuuuccaacugaaggcuuaaguccaucacaaguaacuauguuuccacauauaauaguagacguuagacaacuugaaccaguacuaauaccccucccagauguacgaaauaauuucuaucauuauaaccaaucaaaugacccuacaauaaaauuaauagccaugcucuacacacccuuaagagcaaauaacgcaggagaugauguauucacuguaagcugccgaguacuuacuagaccaucacccgacuuugauuuuaucuuucuaguaccucccacuguagaaucucgaacuaaaccauucucaguuccaauacuaacugucgaagaaaugaccaacucuagauuuccaauacccuuagaaaaacuauuuacaggucccucauccgcauuuguuguacaaccacaaaaugguagauguacaaccgacggugucuuacucggaacuacccaacuaucaccaguaaacauaugcacauuuagaggagauguaacacacauaacagguagucgcaauuacacuaugaauuuagccacacaaaacuggaacucauacgauccuacggaagaaauaccagcaccacuaggaaccccagacuuuguaggaaaaauacaaggcguacuuacacaaaccacacgagcagauggauccacaagaggacacaaagccacaguauauacaggaucggcagacuuugcacccaaauuaggacgaguacaauuugcaacagauacugaucacgacuucgaugcaaaucaaaauacaaaauucacaccaguuggaguuauacaggacggugauacagcacaucgaaacgaaccacaacaauggguauuaccaucauauagcggcagaaauucacacaauguucacuuagccccagcuguagccccuacuuuuccaggagaacaauuacuauucuuuagauccacaaugcccggauguuccggauauccuaauauggauuuagauuguuuauuaccacaagaauggguacaauacuuuuaccaagaagcugcaccagcacaaucagacgucgcauuacuuagauuuguaaacccggauacaggacgcguuuuauucgaaugcaaacuccacaaaucaggcuaugucacaguagcacauacaggucaacacgaccuaguaauaccuccaaauggcuauuuuagauucgauucaugggucaaucaauuuuauacucucgcaccaaugggaaauggaacaggacgaagacgcuaa

SEQ ID NO: 33696 - RNA, 1617 nt, Artificial Sequence
  derived and/or modified sequence opt6 from VP1__Norovirus_and/or_Norovirus-like__EU839588
augaaaauggcauccaaugaugccaacccaucagauggcuccgcagcuaaucuugucccugaaguuaacaaugaagucauggcacuugaaccaguaguaggagcugcaauugccgcacccguagcaggucagcaaaauguaaucgauccauggauaagaaauaacuuuguacaagcaccugguggugaauuuacuguauccccaagaaaugcuccaggagaaauacuuuggucagcuccccuaggaccagauuuaaauccauauuuaucacacuuagccagaauguauaacgguuaugcuggaggauuugaaguacaaguaauucuagcaggaaaugcuuucacagcaggaaaaauuauauucgcugcagucccaccaaauuuuccaacugaagguuuaucaccaucucaagucaccauguucccacacaucauaguagacguaagacaacuagaaccaguucuaauaccauuaccagauguuagaaacaauuuuuaccauuauaaucaaagcaacgacuccacaauaaaacucauagcaauguuauauacuccauuaagagcaaacaaugccggagaagacguauucacaguauccuguagaguauuaacuagaccaucacccgacuuugacuucauauuccuaguacccccaacaguagaaucaagaacaaaacccuuuacugucccaauauuagcaguagaagaaaugacaaauucucgauuuccaauaccccuugaaaaacuuuuuacaggaccaucauccgcauuaguaguacaaccacaaaauggaagauguacaacagacggggucuuacuaggaacaacacaacuauccccaguaaauaucuguacauuuagaggagacguaacacauauagcaggcuccagaaauuacacaaugaacuuagcauccuuaaacuggaacaacuaugauccaacugaagaaauaccagccccauuaggaaccccagauuuuguuggcaaaauacaaggaguacuaacacaaacaacaaaaggagacggaucaacaagaggacauaaagccacaguauauacagguucagcaccauuuaccccaaaacuuggcucaguccaauucggaacugauaccgaaaaugacuuugaaacucaucaaaauacuaaauucacacccguaggaguuauacaagacggaucaacuacacaucgcaaugagccucaacaauggguuuuaccaucauauuccggacgcaauguucauaacguccacuuggcaccagcaguagcaccuacauuccccggagaacaacuacucuucuuuagaucaaccaugccuggaugcucagguuacccuaauauggacuuagauuguuuauuaccccaagaauggguccaacacuuuuaccaagaagccgcuccagcucaaucugacguugcauuacuucgauuuguaaacccagauacaggaagaguauuauuugaaugcaaauuacacaaaucuggauauguaacaguagcacacacaggacaacacgaucucgucauaccaccaaacgguuauuuuagauucgacucuugggucaaccaauucuauacacuagcucccaugggcaauggaacuggaagacgaagauaa

SEQ ID NO: 33697 - RNA, 1617 nt, Artificial Sequence
  derived and/or modified sequence opt6 from VP1__Norovirus_and/or_Norovirus-like__DQ364459
augaaaauggcuucaaaugacgcaucauccucugauggaucaacagcaaacuuaguacccgaagucaacaaugaaguuauggcauuagaaccaguuguaggagcagcaauagcugccccaguagccggacaacaaaauguuauagacccuuggauuagaaacaacuuuguacaagcaccugguggagaauuuacaguaucaccacgaaaugcuccuggagaaauauuauggucugccccuuuagguccagauuuaaaccccuaucuaucucaucuagcaagaauguauaacgguuacgccggaggauucgaaguacaaguaauuuuagccgguaacgccuucacagcuggcaaaaucauauucgcagcaguaccaccaaauuuuccaacugaaggacucucaccaucacaaguuacaauguuuccucacauaaucguagauguaagacaauuagaaccaguauuaauaccacuaccagacguaagaaacaauuuuuaccauuauaaccaauccaaugauccaacaauaaaauuaaucgcaaugcuuuauacaccccuacgugcuaauaaugccggugacgaugucuuuacaguaucauguagaguacuaacacgcccaucaccagacuuugacuucauauuuuuaguaccaccuacaguagaaucuagaacuaagccauucaccguaccaauauuaacaguugaagaaaugacaaacucaagauuucccauaccccuagaaaaauuauuuacaggcccaucauccgcauucguaguucaaccucaaaauggacgcuguacaacagacggcguacuucuaggaacaacacaacuaucaccaguaaauauauguacauucagaggcgacguaacacauauagcuggcacucacgacuacacaaugaaucuagcuucacaaaacuggaauaauuaugauccaacugaagaaauucccgcaccacuaggaacuccagacuuugucggaaaaauacaagguguucuaacacaaacaacuagaggagacgguaguacacgaggacacaaagccacuguaucuacaggauccguacacuuuacaccaaaauuaggcucuguacaauucacaacagacacuaacaacgacuuugaaacaggacaaaauaccaaauucaccccaguaggagucguacaagacggaaacucuacacaucaaaaugaaccacaacaauggguauuaccaaauuauuccggucguacaggacacaacguccaccuagccccagcaguagcccccacauuuccuggagaacaacuacuauuuuucagauccaccaugccuggaugcucaggauauccaaauaugaaucuagauugucuacucccacaagaauggguacaacacuucuaccaagaagcagcccccgcacaaucagacgucgccuuauuaagauucguaaaccccgauacaggacgcgucuuauuugaauguaaauuacauaaauccggauauguaacuguagcacacacaggacaacacgaucucguaauaccaccaaacggauacuuucgcuucgauucauggguaaaucaauuuuauacacucgccccaaugggaaacggagcuggaagaagacguuga

SEQ ID NO: 33698 - RNA, 1617 nt, Artificial Sequence
  derived and/or modified sequence opt6 from VP1__Norovirus_and/or_Norovirus-like__KY628449
augaaaauggcuucaucagaugcaaacccaucugacggaucagcagcaaauuuaguaccagaagucaauaaugaaguaauggcucuagaacccguaguaggagcagcaauugccgccccaguagcuggacaacaaaauguaauagacccauggauaagaaauaacuuuguccaagcaccaggaggagaauuuacaguaaguccaagaaaugcaccaggcgaaauauuauggagcgcaccacuaucaccugaucuaaauccauacuuaucacaccuagcaagaauguauaauggauacgcaggagguuucgaaguacaaguaauacuagcaggaaaugcauucacagcugguaaaguaauauucgcagcaguuccaccaaacuucccuacagaaggauuaucaccuagucaaguaaccauguuuccacacauaguuguagacguucgccaauuagaaccaguuuuaauaccucuaccugaugucagaaacaacuuuuaucacuauaaccaaucuaaugacaguacgauaaaacuaauagccaugcuauauacaccacuacgagcaaacaaugcaggcgaugaugucuuuacaguaucauguagaguuuuaacucgccccucuccugauuuugacuuuauauuucuagucccaccaacaguagaaucaagaacaaaaccauuuucaguaccuguucuaaccguagaagaaaugacuaauucaagauuuccuauaccccuugaaaaacuauucacaggacccucaucagauuucgcaguacaaccacaaaacggaagaugcacaacagacggaguauuauuaggaaccacucaauuauccccuguuaacaucugcacauuucgcggagauguuacucacauaaauggcucaucaaauuacaaaaugaaucuagcaaaucaaaacuggucuaauuaugacccuacagaagaaauuccagcaccauuaggagcaccugacuuugucggaaaaauacaaggugucuugacacaaacaacaaaagaagacggaaguacaagaggucauaaagcuacgguauauaccggcucagcugacuuugccccaaaacuaggacgaguacaauuugaaacagauacagaccacgaucuugaaauagaucaaaauacaaaauuuacuccaguaggagucauucaaaacggaggaacaacacauagaaacgaacccaaacaauggaugcucccaucauacucaggaagaaauacuccaaauguacacuuagcaccagcaguagcaccaacuuuucccggagaacaauuauuauucuuuagaucaaccaugccaggauguucaggcuauccuaauauggacuuagauugcuuauuaccacaagaauggguacaacauuucuaccaagaagcagccccagcccaaucugacguagcacuauuaagauucguaaacccagacacaggaagaguauuauuugaaugcaaacuacacaaaucagguuauguaacagucgcacauucaggccaacaugaucuaguaguaccaccaaauggauauuuccgauuugauucauggguaaaccaauucuacacuuuagcuccaauggguaauggaucgggaaggagacgauaa

SEQ ID NO: 33699 - RNA, 1617 nt, Artificial Sequence
  derived and/or modified sequence opt6 from VP1__Norovirus_and/or_Norovirus-like__KX371608
augaaaauggcuuccaacgacgcuaaccccucagauggcucagcagccaaccuuguacccgaaguuaauaacgaaguuauggcauuagaaccaguaguaggugcagcuauugcugccccuguagcuggacaacaaaauguaauagacccuuggauaagaagcaauuuuguccaagcuccuggaggagaauuuacaguaucaccaagaaacgcaccaggagaaauauuauggucagcaccacuaggaccagaucuaaauccuuauuuaucacaccuugcaagaauguauaaugguuacgcaggcgguuucgaaguacaagucauucuagcagguaacgcauucacagcaggcaaaaucauuuucgcagccguaccgcccaauuucccaaccgaaggguuaucaccaucccaaguaacaauguucccucauauaaucguagacguuagacaacuugaacccguacuaauuccauuaccagaugucagaaacaacuuuuaccacuauaaucaaaguaaugauuccacaauaaaacuaauagcuaugcuuuauacaccauuaagagccaacaacgcaggagacgacguuuuuacaguuucaugucgaguucuaacuagaccaucaccagauuucgacuucauauucuuaguaccaccuacaguagaaaguagaacaaaaccuuuuacuguuccuauacuaaccguagaagaaaugacaaacucuagauuuccaaucccccuugaaaaauuauuuaccggcccaucauccgcauuuguuguacaaccacaaaaugguagauguacaacagaugguguauuacuaggaacaacacaacuaucaccagucaauauuuguacauucagaggagacguuacacauauugcuggaucacacaauuauacaaugaaccuagccucacuaaauuggaauaauuaugaucccacugaagaaauaccggcaccauuaggaacaccagacuuuguaggaaaaauacaaggaguacucacacaaauaacaaaaggugacgguucaacuagaggacacaaagccacaguauauacaggcucugcagauuuuacaccaaaauuaggaucuguacaauucgcaacagauacagaaaacgacuuccaaacacaucaaaacacaagauuuacaccaguaggcguaauucaagacggaggaacaacacaccaaaaugaaccccaacaauggguucucccaagcuauucaggacgaaacguucauaauguacacuuagcaccagccguagcaccaaacuuuccuggugaacaauuauuauucuuuagaucaacaaugccagguugcucaggauauccaaauauggauuuagacuguuuacuaccccaagaauggguacaacauuucuaucaagaagcagcaccagcacaaucugacguagcccuucucagauuuguuaacccagacacuggaagaguccuauuugaaugcaaauuacauaaaucaggauauguaacaguagcacacacaggccaacacgaucuaguaaucccacccaacggcuauuuccgauuugauucauggguaaaucaauuuuacacauuagcacccauggguaauggaacaggaagaagaagauaa

SEQ ID NO: 33700 - RNA, 1617 nt, Artificial Sequence
  derived and/or modified sequence opt6 from VP1__Norovirus_and/or_Norovirus-like__KX354089
augaaaauggcuucaaaugacgcuaaccccucagacggcuccgcagccucgcuaguuccagaaguuaacaaugaaguaauggcauuagaaccaguuguaggugcagcuauagcagcuccaguagcaggucaacaaaauguaauugauccuuggauaagaaauaauuuuguacaagcaccaggaggcgaauuuaccguaucaccaagaaaugcaccaggagaaauauuauggucagcaccacuaggaccagaucuaaacccauaccuuucacauuuagccagaauguauaauggauacgcaggaggauuugaaguucaagucauacuugcaggaaaugcauuuacagcuggcaaaauaaucuuugcagccguaccaccaaacuucccaacagaaggauuaucaccaucccaaguuacuauguuuccucauauuauaguagauguacgucaauuagaaccaguacuaauaccacuaccagauguaagaaacaacuuuuaucacuacaaccaaaguaaugacaguacaauaaaacuaaucgcaauguuauauacaccacuuagggcaaacaaugcaggagaugauguauuuacagucagcuguagaguuuuaacaagaccuagcccugauuuugauuuuauauucuuaguaccaccaaccguagaaucaagaacaaaaccauucacaguaccaauauuaaccguagaagaaaugacuaacucacgauucccaaucccguuagaaaaacuauuuacagguccuuccucagcauucguuguacaaccacaaaacggucgauguacaacagacggaguauuauuagguacaacacaacuaucaccaguaaauauuugcacauuucgaggagauguaacucauaucgcuggaucaagaaauuauacuaugaauuuagcaucacuaaacuggaacaauuaugacccaacggaagaaauuccagcaccacuaggaacaccagacuuuguaggaaaaauucaaggaguacuaacacaaacaacaaaaggagacggaagcacaagaggacauaaagcaacaguauauacaggcucagcagacuuuacaccaaaauuaggcucaguacaauucgccacugauacagaaaacgacuucgaaacacaucagaacaccaaauuuaccccagucggaguaauucaagauggcggaacaacacaucguaacgaaccacaacaauggguucuaccauccuauucaggacgaaauguacauaauguucauuuagcaccagcuguagcuccaaacuuucccggagaacaauuauuauucuuuagaaguacuaugcccggaugcaguggauaucccaauauggaucuagauugucuguuaccccaagaauggguacaacauuuuuaccaagaggcagccccagcucaaucagauguagcauuauuaagauuuguuaaccccgauaccggaagaguacuauuugaaugcaaauuacacaaaucaggcuacguaacuguagcacacacuggacaacacgaccuaguaauaccaccuaaugguuauuucagauucgauucauggguaaaucaauuuuauacacuagcaccaaugggcaauggcaccggucgaagaagauaa

SEQ ID NO: 33701 - RNA, 1617 nt, Artificial Sequence
  derived and/or modified sequence opt6 from VP1__Norovirus_and/or_Norovirus-like__KX354001
augaaaauggcuuccaaugacgcaaaccccucagacggauccgcagcaaacuuaguaccagaaguaaacaacgaaguaauggcacuagaaccaguagucggagcagcaauagccgcaccaguagcuggccaacaaaaugucaucgaucccuggauccgaucaaacuucguucaagcaccuggaggagaauuuacuguauccccacgaaaugcaccaggagaaauauuauggucagccccacuuggaccagauuuaaauccauauuuaucacacuuagcaagaauguauaauggauaugcaggaggauucgaaguacaaguaauauuagcaggaaaugcauuuacugccggaaaaauaaucuucgcugccguacccccaaauuuuccaacugaaggacuaucaccaucacaaguaacuauguucccgcacaucauagucgauguaagacaauuagaacccgucuuaauacccuuacccgauguaagaaacaauuuuuaccacuauaaccaauccaacgacucaacuauaaaacucauagcuaugcuauacacaccacuuagagcaaauaacgcaggcgacgacguauuuacaguuucauguagaguauuaacaagaccaagcccagacuucgauuuuauauuucuaguaccacccacaguagaaucucgaacaaaaccauuuaccguaccaauacuuacaguugaagaaaugacuaacucuagauuccccauaccacuagaaaaacucuuuacagguccaucuucagcuuuuauaguacaaccacaaaauggaagauguacaacagacgguguucuccuaggaacaacacaacuaucaccaguaaacauauguacauucagaggagacguaacacacauugccggaucaagaaauuauacaaugaacuuagcaucuuuaaauuggaacaauuaugauccaacagaagaaauaccugcaccacuagguacaccugacuucguaggaaaaauacaaggaguauuaacccaaacuacaaaaggagauggaucuacuagaggacauaaagcaacaguuuacacaggaucagcagacuucaccccaaaauuaggcucuguacaauucgcaacugauacugaaaaugauuuugaaacucaucaaaauacaagauucaccccagucggugucauccaagacggaggaacaacucauagaaaugaaccccaacaauggguauuaccaucauauaguggucgaaauguacacaacguacaucucgcaccagcagucgccccuaauuuucccggagaacaacucuuauucuucaggucaacaaugccaggcuguucaggauacccaaauauggacuuagauuguuuacuaccacaagaauggguacaacauuuuuaucaagaagcagcaccagcacaaucagauguugcacuccuaagauuuguaaacccagauacaggaagaguacuauucgaauguaaauuacacaaauccggcuacguaacuguagcccauacaggacaacaugaccuaguuauaccaccaaauggcuauuucagauucgauuccuggguuaaucaauuuuauacccuagcacccaugggaaauggcacaggcagacgacguuaa

SEQ ID NO: 33702 - RNA, 1617 nt, Artificial Sequence
  derived and/or modified sequence opt6 from VP1__Norovirus_and/or_Norovirus-like__KX353971
augaaaauggccucaaacgacgcaucaccauccgauggaucaacagcaaacuuaguaccagaaguuaauaaugaaguaauggcauuagaaccaguaguaggagccgcaaucgcagcaccaguugcuggacaacaaaaugucauagaccccuggauaagaaauaacuucguacaagcuccuggcggugaauuuacaguuucaccaagaaaugcuccaggagaaauuuuauggucugccccacuuggacccgaccuaaacccauacuuaucacaucuagccagaauguacaacggauaugcaggaggauucgaaguacaaguaauacuagcaggaaaugcauuuacagcuggaaaaauaauauucgcagccguuccaccgaauuuuccaacugaaggacucucacccucccaaguaacaauguucccacauauaauaguagaugucagacaacuugaaccaguauuaauaccacuaccugauguaagaaacaacuucuaucauuauaaccaaucaaacgauccaacaauaaaauuaauagcaaugcuauauacucccuuaagagcuaacaacgccggagacgaugucuuuacaguaucuuguagaguacuaaccagacccagcccugacuuugacuuuauauuuuuaguaccaccaacagucgaaucaagaacaaaaccauuuucaguaccaguacuaacaguggaagaaaugaccaauucuagauuucccauuccccuugaaaaacuauucacagggccaucuucagcauucguuguacaaccacaaaaugguagauguaccacagacggaguacuauuaggaacaacucaauuaucaccuguuaauauaugcaccuuucgaggagacguaacccacauaacaggcucucgaaauuauaccaugaaucuagccucacaaaauuggaacucauacgacccaacagaagaaauuccagcaccacuagguaccccagacuucguaggcaaaauccaagguguucucacacaaaccacuagaaccgacggaucaacacgaggacauaaagcaacuguauacacugguagcgcugacuucucaccuaaacuagguagaguacaauucgcuaccgauacagauaacgacuucgaaaccaaucaaaauacuaaauucacuccaguagguguuauacaagauggaggaacgacacaucgaaaugaaccacaacaauggguacuaccaucuuauucaggaagaaauacacauaauguucauuuagcaccagcaguagcaccuacauuuccaggagaacaauuacuauucuucagauccacaaugccagguugcuccggauauccaaauauggaucuagauugccuucuaccacaagaauggguacaauauuuuuaccaagaagcagcucccgcacaaucagacguugcccuauuacgauucguuaacccugacacuggcagaguauuauucgaauguaaauuacauaaaucaggauauguaacuguugcucauaccggacaacacgaucuuguaauaccaccaaauggauauuuuagauuugauuccuggguaaaucaauuuuauacacucgcacccaugggaaauggaacagguagaagaagauaa

SEQ ID NO: 33703 - RNA, 1617 nt, Artificial Sequence
  derived and/or modified sequence opt6 from VP1__Norovirus_and/or_Norovirus-like__KR131766
augaaaauggcaucaaacgaugcaaauccauccgaugguagcacugccaauuuaguaccagaaguaaacaaugaaguaauggcuuuagaaccagucguaggagcagcuauagcagcaccaguagcaggacaacaaaauguaauugacccguggauaagaaauaacuuuguacaagcaccagguggagaauuuaccguuucuccaagaaacgcaccuggagaaauauuauggucagcaccauuaggaccagauuuaaaucccuaucuuucacaucuagccagaauguauaauggauacgcuggaggauucgaaguacaaguaauacuugccggaaaugcauucacagcuggcaaaauaauauuugcagcaguaccaccaaauuuuccaacagaaggacuuucuccaucucaaguuacaauguuuccccauaucauuguagacguaagacaauuagaaccaguccuaauaccccuuccagacguucgcaacaauuucuaccacuauaaccaaucaaacgacucuacaaucaaacuuauugccauguuauacacuccacuaagagcaaauaaugcaggagacgauguauuuacaguaucauguagaguauuaacaagaccaagcccagauuuugauuuuaucuuucuaguaccaccaacuguagaaucccgcaccaaaccauucacaguuccaauacuaaccguagaagaaaugacaaauucaagauuccccaucccgcuugaaagauuauauacaggaccuucuucagcauuuguaguacaaccacaaaauggacgcuguacaacagauggaguauuauuagguaccacacaauuaucagcagucaacauauguacauuuagaggagauguaacacauauagcagguucacgaaauuacacaaugaauuuagcaagucaaaacuggaacaauuacgauccaacagaagaaauaccugcaccacuaggaacaccagacuuuguaggaaaaauucaaggaauguuaacacaaacaacaagaucagauggaucuacacgaggucauaaagcaaccguccucacaggcucagcagauuuugcaccaaaauuaggaagaguacaauucgcuacagauacagauaacgacuucgaaucuggacaaaacacaaaauucacgccaguaggaguaauacaagacgguuccacaacacacagaaaugaaccacaacaauggguacucccaaacuacucuggaagaaccggacauaauguucaccuagcacccgcaguagcaccaacauauccaggagaacaacuauuauuuuucagaucaacaaugcccggaugcagcggauauccaaacauggaccucgacugccuacuaccucaagaauggguccaacauuuuuaucaagaagccgcaccagcacaaucagacguagcccuacucagauucguaaacccagacacuggaagaguacuauuugaaugcaaauuacacaaaucugguuauguaacaguugcacacacaggacaacacgauuuagucauuccaccaaacgguuauuuuagauuugacucauggguaaaucaauucuacacacuagccccaaugggaaauggaacaggacgaagacgauaa

SEQ ID NO: 33704 - RNA, 1617 nt, Artificial Sequence
  derived and/or modified sequence opt6 from VP1__Norovirus_and/or_Norovirus-like__AB663685
augaaaauggcaucaaaugacgcaaacccuucagauggaagcgccgccaaccucguuccagaaguaaauaacgaaguaauggcuuuagaaccaguaguuggagcagcuauagcugcgcccgucgcuggccaacaaaauguaauagauccauggauacguaauaacuuuguccaagcaccugguggagaguuuacaguuucuccaagaaaugcacccggagaaauucuauggucagcuccacuugguccagaucuaaauccauauuuaucucacuuagcucguauguacaaugguuaugcaggaggcuucgaaguacaaguaauacuagcagguaacgcauuuacagcagguaaaauuauauucgcugcaguaccaccaaacuucccuacugaaggauuaucgccaagucaaguaacaauguucccacauauaauaguggauguaagacaacucgaaccuguucuaauuccacuuccagauguacgaaacaauuuuuaucacuacaaccaaucuaacgauucuaccauuaaauuaauagcuauguuauacacaccauuaagagcaaauaacgccggagaugauguauuuacagucucaugucgcguucuaacuagaccaucaccagauuuugacuucauuuuucuaguuccaccaacaguagaauccagagcaaaaccauuuacaguaccuauacuaacaguagaagaaaugaccaacucuagauuuccaauuccauuagaaaaacucuucaccggaccaucaagcgcuuucguagugcaaccucaaaauggaagauguacaacugacggaguccuacuaggaaccacacaauuaucaccaguuaacauauguacauuuagaggugauguaacccauaucgccggaucacgaaacuauacaaugaaccuagcaucauuaaacuggaauaauuaugauccaacagaagaaauaccagcaccacuaggaacaccagacuuuguaggaaaaauacaaggaguuuuaacccaaacaacuaaaggagauggcucaacaagaggucauaaagcuacuguuuauacaggaucagcagacuuuacaccgaaacuaggaucaguacaauucggaacugacacagaaaaugauuuugaaacccaucaaaauacuaaauuuacaccaguaggagucauacaagauggagggacuacacacagaaaugaaccacaacaauggguacuaccuucuuauucuggaagaaacguacacaauguacacuuagccccagcaguugcaccuaacuuuccaggugaacaacucuuauucuuuagaaguaccaugcccggauguaguggauaccccaacauggaucuagauuguuuauuaccacaagaauggguccaacacuuuuaucaagaagccgcccccgcacaaucugacguugcacuacuaagauucguaaacccagauacugguagaguacuuuuugaauguaaacuacacaaaucaggauacgucacagucgcacacacaggacaacacgauuuagucauaccuccuaauggauauuuccguuucgauucauggguaaaucaauucuacacacuugcaccaaugggcaauggaacuggaagaagaagauaa

SEQ ID NO: 33705 - RNA, 1617 nt, Artificial Sequence
  derived and/or modified sequence opt6 from VP1__Norovirus_and/or_Norovirus-like__AB933746
augaaaauggcuucaucugacgcuaacccaucugacggaaguacugcuaaccuaguaccagaagucaacaaugaaguaauggcauuagaaccaguaguaggcgcagcaauagcagccccaguugcaggacaacagaauguaauagacccauggauacguaauaacuuuguacaagcaccaggaggagaauuuacaguaucaccucgcaaugcaccuggagaaauccucuggucagccccauuaggacccgaucucaauccauaucuaucacaucuagcacgcauguauaauggauacgccggaggauucgaaguacaaguaauauuagccggcaaugcauucaccgccgguaaaauaguuuucgcugccguaccacccaacuucccuacagaaggacucucaccaucacaaguuaccauguuuccacacauaauaguagacguacgacagcuagaaccaguauuaaucccccuaccagauguaagaaauaacuucuaucacuauaaccaaaguaaugauccaacaaucaaacuaauagcaauguuauauacaccauuaagagcaaauaaugcaggagaugauguauuuaccguaucaugcagaguauuaacaagaccaucaccagauuucgacuuuauauuucuuguaccaccaacaguagaauccagaacaaaaccuuucucaguaccaauacuaaccguagaagaaaugacaaauucaagauuucccaucccacuagaaaaauuauucacagguccaaguucugcauuuguaguacaaccacaaaacggaagauguacaacagauggaguacuucuaggaacuacacaauuaucaccaguaaauauauguacauuucgaggagacgucacucauauagcaggaucacacaauuauacaaugaacuuagcuucacaaaacuggaacucauacgaucccacugaagaaauaccugcaccauuagguaccccagauuuuguaggaaaaauacaagguguauuaacccaaacgacaagaacugacggaaguacaagaggacacaaagccaccguauacacaggaucagcagaauuuucaccaaaacuaggaagaguacaauucgcaacagauacuaauaaugauuucgaugcaaaccaaaauacaaaauucacaccaguaggaguaauacaagacggagguacaacacacagaaaugaaccacaacaauggguauuaccuucuuauucaggaagaaacacacauaacguacaucuagcacccgccguagcaccaacauucccuggagaacaauuacuauucuuucgcucaaccaugccaggaugcucuggauacccaaacauggacuuagauugucuauuaccacaagaauggguacaauauuuuuaccaagaagcagcaccagcacaaucagacguugcauuauuaagauuuguuaacccagauacaggacguguauuauuugaauguaaauuacauaaauccggauauguaacaguagcacacacuggacaacaugauuuaguaauaccaccaaacggauauuuuagauuugacucauggguuaaccaauuuuauacauuagcacccaugggaaacggcacaggcagaagaagguaa

SEQ ID NO: 33706 - RNA, 1617 nt, Artificial Sequence
  derived and/or modified sequence opt6 from VP1__Norovirus_and/or_Norovirus-like__AB933701
augaaaauggcaucuaaugaugcaaacccuucagacggaucagcagcaaaccuaguaccagaaguaaacaaugaaguaauggcacuagaaccugucgucggagcugcaaucgcugccccuguagcuggucaacaaaacguuauagacccuuggauaagaaauaauuucguucaagcuccaggaggagaauuuacuguauccccucgaaaugcaccaggagaaauccuauggucagcuccucucggaccagaucuaaauccauauuuaucacaccuagcaagaauguauaacggauacgccggaggauucgaaguacaaguaauucuagcaggaaaugccuucacagcaggaaaaaucauuuucgcagccguacccccaaauuuuccaaucgaaggacuuucaccaucacaaguaacaauguuuccccauauuauagucgacguaagacaauuagaaccaguccuaauaccauuaccagauguucgaaacaauuucuaccacuauaaccaaucaaaugauucuaccauaaaacuaauagcuaugcuauacacuccacuucgagcuaacaacgccggugaagauguuuuuaccguuucaugcagaguacuaaccagaccaucuccugacuuugacuuuauauuuuuaguuccaccaacaguugaaucaagaacaaaaccuuuuacuguaccuauucucaccguagaagaaaugacuaacucaagauuuccaauaccacucgaaaaacuauuuacaggcccuucuuccgcauuuguuguacaaccacaaaacggaagauguaccacagacgguguacuacuaggaacaacacaauuaucuccaguaaauauaugcacauuuagaggcgacguuacacauauagcaggaucaagaaacuauacaaugucuuuagcaucuuugaacuggaauaauuaugaccccacagaagaaaucccagcaccacuaggaacaccagauuuugucggaaaaauacaaggcguccuaacacaaacaacuaaaggugauggcuccacuagaggacacaaagcaacugucuauacaggaucugcaccauuuacaccuaaauuaggaucaguucaauuuucaacagauaccgaaaaugauuuugaaacacaccaaaacacuaaauucacaccaguaggaguaauucaagacgguggaacuacacacagaaacgaaccacaacaauggguucuaccauccuauucaggaagaaacguaccuaacguacaccuugcuccugcuguagcaccuaccuuccccggagaacaauuauuauucuuucgaucaacuaugccaggaugcucaggcuaucccaacauggauuuagacugcuuacucccucaagaauggguacaacauuucuaucaggaagcagcccccgcacaaucagacguagcauuacuccguuucguuaacccugacacaggacgaguucucuuugaaugcaaacuacacaaaucuggauauguaacaguagcacacacuggacaacaugauuuaguaauaccuccaaauggcuauuuccgcuuugacucauggguaaaucaauucuauacuuuagcacccauggguaacggcacaggucgaagaagauaa

SEQ ID NO: 33707 - RNA, 1617 nt, Artificial Sequence
  derived and/or modified sequence opt6 from VP1__Norovirus_and/or_Norovirus-like__AB933686
augaaaauggcuucaaaugaugcaaauccaucagacggauccgcagccaaucuaguaccagaaguaaacaaugaaguuauggcacuagaaccaguuguaggcgcagcaauagcagcaccaguagcuggacaacaaaauguuauagacccauggauaagaaauaauuucguucaagcaccuggaggugaauuuacaguuagcccaagaaaugccccaggagaaauucuauggucugcacccuuaggcccagaucuaaauccauauuuaucacaccuagcuagaauguauaacgguuaugcuggcgguuucgaaguccaaguaaucuuagccggcaaugccuuuaccgcaggaaaaauaauauuugcugcaguacccccuaacuucccaauagaaggauuauccccuucacaaguuaccauguucccacacauaauaguagacguaagacaacuagaaccaguacuaauaccauuaccagauguaagaaacaauuucuaucacuauaaccaaucaaacgauaguacaaucaaauuaauugcaauguuauacacaccacuccgcgcaaacaaugcuggagaagauguauuuacaguaagcugucgaguacuaacaagaccuucaccugacuuugacuucauauuuuuaguuccacccacaguagaaucaagaacaaaaccauuuacaguaccaauauuaacaguagaagaaaugacuaauucaagauuuccaauuccacuagaaaaauuauucaccgguccauccagugcuuuugucguacaaccacaaaacggccgaugcacaacagacggaguacuauuaggaacaacacaauuaucaccaguuaauauaugcacuuucagaggagacguaacacauauagcuggaucaagaaauuacacaaugaaucuagcaaguuuaaauuggaauaauuaugacccuacugaagaaaucccagcaccccuaggaacaccugauuuuguaggaaaaauacaaggaguuuuaacccaaacuacaaaaggagacggaucaacaagaggacauaaagccaccguuuauacaggaucagcaccauuuaccccuaaacuaggcucaguacaauucucgaccgacacagaaaaugauuuugaaacacaccaaaauacaaaauuuacacccguaggaguaauacaagauggaggaacaacccauaggaaugaaccacaacaaugggucuuacccucauacagcggacgaaauguaccaaauguacaccuagcaccagccguugcuccaacauuccccggagaacaacuauuauucuuuagaucaacaaugccagguuguucagguuauccuaauauggaucuugauugcuuacuaccucaagaauggguacaacauuuuuaucaagaagcagcaccagcccaaucagacguagcauuacuaagauucguaaauccagacaccggaagaguauuauucgaaugcaaguuacauaaaagcggauaugucaccgucgcacacacaggacaacaugaucuaguuauuccaccaaauggauauuuuagauucgauagcuggguaaaucaauuuuacacacucgcuccaaugggaaacggaacaggacguagaagauaa

SEQ ID NO: 33708 - RNA, 1617 nt, Artificial Sequence
  derived and/or modified sequence opt6 from VP1__Norovirus_and/or_Norovirus-like__AB933680
augaaaauggcaucaaacgaugcaaacccaagcgacgguuccgcagcaaauuuaguccccgaaguaaacaacgaagucauggcauuagaaccagucguaggagcagcaauagcagccccaguagcaggacaacaaaacguaauagauccuuggauaagaaauaacuuuguacaagccccagguggugaauuuaccguuucuccacgaaaugccccaggagaaauacuguggucagcaccacugggcccagaccuaaauccauauuuaucacauuuagcacgaauguacaauggauacgcaggaggauucgaaguacaagucauacuagccggaaaugcauucacagcagguaaaauaauauucgcagcuguaccuccaaacuuuccuaccgaaggauuaagcccaucacaagucacaauguuuccucauauaauaguggacguucgacaauuagaaccaguacuaauucccuuaccagacguaagaaacaauuucuaucauuauaaucaaucuaaugauucaacaauuaaauuaauagcaauguuauacacaccauuaagagcaaauaaugcaggagaagauguauucacaguaucaugucgaguacuaacuagaccaucaccagacuucgacuuuaucuuccuaguaccaccuacaguugaaucaagaacuaaaccuuucacaguuccaauauuaacaguugaagaaaugacaaacucaagauucccaauaccacuagaaaaauuauuuaccggaccauccucagcauuuguaguccaaccacaaaauggaagaugcaccacagacggaguccuauuaggcacaacucaauuaucaccaguaaacauauguacauucagaggagacguuacacauauagcaggaucaagaaacuacacaaugaauuuagcaucccuaaacuggaauaauuaugauccaacagaagaaauaccagcaccauuaggaacaccagauuuuguaggaaaaauacaaggaguacuaacacaaaccacaaaaggugaugguaguacucgaggacacaaagcuacaguuuacacaggaucagcuccauucacaccaaaauuaggcucaguacaauucucuacagauaccgaaaacgacuucgaaacacaucaaaauaccaaauucacacccguaggaguaauacaagauggauccacagcacacagaaacgaaccacaacaauggguacuaccaucauauucaggucgaaauguacaaaacguacaccuagccccagcaguagccccuacauuuccaggcgaacaauuacuuuucuuuagauccacaaugccaggaugcuccggauacccaaacauggaccuagacugucuacuaccacaggaauggguacaacacuucuaucaagaagcugcuccagcucaaagugauguugcuuuacuuagauuuguaaaccccgacacuggaagaguauuauucgaauguaaacuacauaaaucuggauaugucaccguagcacacaccggacaacacgauuuaguaauacccccaaauggcuauuuuagauucgauucauggguaaaucaauuuuauacacucgccccaaugggaaauggaacaggaagacgacgguaa

SEQ ID NO: 33709 - RNA, 1617 nt, Artificial Sequence
  derived and/or modified sequence opt6 from VP1__Norovirus_and/or_Norovirus-like__AB933672
augaaaauggcuucuaacgacgcaaacccaucugauggcagugcugcuaaccuuguucccgaaguaaauaacgaaguaauggcucuagaaccuguagugggagcagcaauagcagcaccaguagcaggccaacaaaauguaaucgacccauggauccgaaacaauuuuguacaagcuccuggaggcgaauuuacaguaaguccacgaaacgcaccaggagaaauauuauggucagcaccauuagguccagaucuaaacccauauuuaagucaucuagcaagaauguacaacgguuacgcaggagguuucgaaguacaaguaauacuagcaggaaacgcuuuuacugccggaaaaaucauauucgcugccgucccuccaaacuuucccacagaaggacuuucaccaucacaaguuacaauguuuccacacauaauaguagacguuagacaacuugaacccguccuaauaccauuacccgacguacgaaacaauuucuaucacuauaaucaaucaaaugacucuacaauaaaauuaauagcgaugcuuuauacuccuuuaagagcuaacaacgcgggugaagauguauucacaguaucauguagaguacuaacccgaccuucaccugacuuugacuucaucuucuuaguuccaccgacaguagaaucucgaacaaaacccuucacagucccaauuuuaacagucgaagaaaugacaaacagcagauucccaauaccacucgaaaaacuauuuacaggaccaucauccgcauucguuguacaaccccaaaacggaagaugcacaacugacggaguacuacuagguacaacacaauuaucaccagucaauauauguacauuuagaggagauguaacacauauagcaggaucacauaauuacacaaugaaucucgcuagucuuaauuggaacaacuaugauccaacugaagaaauaccagcaccucuaggaacuccagacuuuguaggaaaaauacaaggaguauuaacacaaacuacaaaaggcgacggaucaacaagaggucauaaagccacaguguauacgggaucagcacccuuuacacccaaacucggaucgguacaauucagcacagacacagaaaacgacuuugaaacucaucaaaauacaaaauuuacuccaguagguguaauacaagacggugguacugcucauagaaacgaaccucaacaauggguauuaccauccuacucaggacgaaauguacaaaacguacaucuagcucccgcaguagcaccuacauuuccaggcgaacaacuuuuauucuuuagaucaacaaugccaggaugcucaggauauccuaauauggauuuagauugccuauuaccccaagaauggguacaacacuucuaucaagaagcugcaccagcucaaucugacguagcacuauuaagauucguaaacccugacacaggaaggguuuuauuugaaugcaaacuccauaaaucaggcuauguaacaguagcacauacuggacaacacgaccuaguaaucccuccaaauggauauuuccgcuucgauucauggguaaaucaauuuuacacauuagcaccaaugggaaacggcacuggccgaagaagauaa

SEQ ID NO: 33710 - RNA, 1617 nt, Artificial Sequence
  derived and/or modified sequence opt6 from VP1__Norovirus_and/or_Norovirus-like__AB933664
augaaaauggccucaaaugaugccacaccaucugauggcucugcagcaaacuuaguuccugaaguaaacaaugaaguaauggcacucgaaccaguaguaggugcagccauagcugccccaguagcuggacaacaaaacgucauagauccauggauuagaaacaauuucguacaagcaccaggcggugaauuuacuguaucacccagaaaugcaccaggugaaauauuaugguccgccccauuaggaccugaucuaaacccauaccuaucacauuuagccagaauguauaauggauacgcuggcggauucgaaguacaagucauacuagcagguaaugccuuuacugcuggaaaaauaauauucgcggcaguaccucccaacuuccccacagaaggauuaucuccaucacaaguuacaauguucccacacauaauaguagacguccgacaacuagaaccaguauuaauacccuuacccgauguacguaauaauuucuaucacuauaaccaaucuaaugacucaacaauaaaacucauagcaauguuauacacaccauuacgagccaauaacgcaggagaagauguauuuaccguauccugucgaguccugacaagaccaucuccagauuuugauuuuauauuccuaguuccaccaacaguagaaucaagaacaaaaccauucacaguuccuauccucacaguagaagaaaugacuaauucucgauuuccaauaccacuugaaaaacuauuuacaggaccaucuucagcauucguaguacaaccacaaaacgguagauguacaacagacgguguacuacuaggcacaacacaacuaucaccaguuaacauaugcacuuucagaggcgauguaacacauauagcugguucacgcaauuauaccaugaaccuagcaucacuaaacuggaacaacuaugacccaacagaagaaauaccugccccacuagguacaccugacuucguaggaaaaauacaagguguacuaacccaaacaacaaaaggagacgguucaacacgcggacacaaagccacuguauacacuggaucagcaccauucacaccaaaacuaggaucaguacaauuuaauacagauacagaaaaugauuucgaaacccaucaaaauacaaaauucaccccuguaggaguaauacaagauggcucaaccacacauaggaaugaaccccaacaauggguauuacccaguuauucaggcagaaauguuccuaauguucacuuagccccagcuguagcaccaacauuuccaggugaacaacuacuauucuucagaucuacuaugccaggaugcucaggauacccuaauauggacuuagauugcuuauuaccccaagaauggguacaacacuucuaccaagaagccgcccccgcacaaucagauguugcccuucuaagauucguaaacccugacacagguagaguacuauucgaaugcaaacuacacaaaucuggcuauguaacaguagcacauacuggucaacacgaucuuguuaucccacccaauggcuauuucagauuugauucauggguuaaucaauuuuacacauuagcacccaugggaaaugguacuggacgaagacgauaa

SEQ ID NO: 33711 - RNA, 1617 nt, Artificial Sequence
  derived and/or modified sequence opt6 from VP1__Norovirus_and/or_Norovirus-like__AB933662
augaaaauggcaucaaacgacgcaaauccauccgacggaucagccgcaaacuuaguaccagaaguaaacaaugaaguaauggcucuagaaccaguaguaggagcagcaauagcagcaccagucgcuggacaacagaaugucauagacccauggauucgaaauaauuuuguacaagcaccaggaggcgaauuuacaguaucacccagaaacgccccaggugaaaucuuauggucugcaccucuaggaccagauuuaaacccuuaucuaucacacuuagcaagaauguauaauggauaugccggaggauucgaaguacaagucauuuuagccgguaacgccuuuacagccggaaaaaucaucuuugcagcuguacccccaaauuucccaacugaaggauuaucaccuagucaaguuacaauguucccacauauaauaguagauguucgacaauuagaacccguucuaauaccauuaccagauguaagaaauaacuucuaccacuacaaucaaucaaaugauucaacaauaaaauuaauagcaauguuauauacuccacuuagagccaauaaugcuggugaagauguauuuaccguuucauguagaguacucacacgcccaucaccagacuuugauuuuaucuuucuuguaccuccaacaguugaaucuagaacaaaaccauucacuguaccaauccuaacuguagaagaaaugacaaacucucgauucccaauaccauuagaaaaauuauucacaggaccaucaagugcauucguaguacagccacaaaauggaagauguacuacugauggcguucuacuaggaacaacacaauuaucuccaguaaauauauguaccuuuagaggagaugucacucauauagcaggauccagaaacuacacaaugaauuuagcaucccuaaacuggaacaacuaugauccaacagaagaaauaccagcaccuuuagguacaccagauuuuguugguaaaauucaaggaguucuaacccaaacuacaaaaggagauggaucaacaagaggacauaaagcaacuguauacacaggaucagcaccauuuacuccaaagcuaggauccguacaauuuucaaccgauacugaaaacgauuuugaaacacaucaaaauaccaaauucacacccguuggaguuauacaagauggcggcacaacccauagaaaugaaccucaacaauggguucuaccaucauauucaggaagaaacguuccaaacguacaucuagcacccgcaguugcaccaauauuucccggugaacaauuacuauucuuuagauccacaaugccuggaugcagcggauaucccaauauggacuuagacugccuccuaccacaagaauggguccaacauuucuaccaagaagcagcaccagcacaaucagauguugcacuauuaagauucguaaauccagacacaggacgaguccuuuuugaaugcaaacuacacaaauccgguuacguaacaguagcacacacaggucaacaugacuuaguaauaccaccaaacggauauuucagauucgacucauggguaaaucaauuuuauacacuagcaccaaugggaaauggaacaggaagaagacgcuaa

SEQ ID NO: 33712 - RNA, 1617 nt, Artificial Sequence
  derived and/or modified sequence opt6 from VP1__Norovirus_and/or_Norovirus-like__AB933656
augaaaauggcaucaaaugaugcuuccccuuccgacggcucugcagcaaauuuaguaccagaaguaaacaaugaagucauggcucuugaaccuguaguaggagcugcaauagccgcaccaguagcaggacaacaaaauguuauagauccauggauaagaaauaacuuuguccaagcaccaggaggagaauuuacaguuucaccaagaaaugcccccggagaaauacuauggucagcuccacuaggcccagaucuaaauccauaccuaucucaccucgcaagaauguauaauggauacgcaggcggauucgaaguccaaguuauacuagccggaaaugcauuuacagcaggaaaaaucauauucgcagccguaccaccaaacuuuccaacagaaggucuaucuccaucucaaguaacaauguucccccacauaauagucgacguaagacaauuagaaccagucuuaaucccauuaccagauguucgcaacaacuucuaccacuauaaucaaagcaacgacucaacaauuaaauuaauagcuauguuauauacuccacuacgagcaaauaaugcaggagaagauguauuuacugucucauguagaguccuuacucgcccaucaccugauuucgacuucauauuuuuaguaccaccaacaguagaaucaagaaccaaaccuuuuacaguuccaauauuaacaguugaagaaaugacaaauucaagauuccccauaccauuagaaaaauuauucacuggaccaucaucagcauucguuguccaaccccaaaacggacgaugcacaacugacggaguacuucuaggaacaacacaauuaucaccaguaaauauauguacauucagaggagacguaacacauauagcaggaucacgaaauuacacaaugaacuuagcuagccuuaauuggaacaauuacgaccccacugaagaaauaccagcaccauuaggaacaccagauuuuguagguaaaauccaagguguauuaacacaaaccacaaaaggugauggaucaacucgaggucauaaagcaacaguuuauaccggcucugcaccauucacuccuaaacuagguucuguacaauucucaacagauacagaaaaugauuucgaaacacaucaaaauacaaaauucacaccaguuggaguaauacaagauggaggaacaacccaccgaaacgaaccucaacaauggguacuacccucauacucaggaagaaauguacauaacguucaccuugcaccagcaguagcaccaacuuucccuggagaacaauuacuuuucuuuagaucaaccaugccagguugcucaggauauccaaauauggauuuagauugucuauuaccucaagaauggguacaacauuuuuaucaagaagcugcaccagcacaaucugauguugcauuacuacgauuuguaaacccagacacaggccgagucuuauucgaaugcaaacuccauaaauccggauacguaacagucgcacacacuggacaacaugauuuaguuauaccacccaauggauauuuuagauuugauaguuggguaaaucaauucuauacauuagcaccaaugggaaauggaacaggaagaagaagguaa

SEQ ID NO: 33713 - RNA, 1617 nt, Artificial Sequence
  derived and/or modified sequence opt6 from VP1__Norovirus_and/or_Norovirus-like__EU921340
augaaaauggccucuucagacgccaacccuucagacggaucaacugcaaacuuaguacccgaaguuaauaaugaaguuauggccuuagaacccguagugggagcagccauagcagcaccaguagcuggccaacaaaauguuauugacccuuggauucgaaauaauuuuguucaagccccaggaggagaauuuacuguaucaccacgaaaugcacccggagaaauauuauggucagcaccacuaggcccagaucuaaauccuuaucuaucccauuuagcuagaauguauaacggauacgcaggagguuuugaaguacaaguaauacuagcaggaaacgcauuuacagcaggaaaaaucauauucgcagcagucccaccaaauuuuccaacagaaggacuaucuccuucacaaguuacuauguucccacauaucauaguugauguaagacaacuagaaccuguacuaauaccauuaccagacguaagaaacaauuuuuaccauuacaaucaaucaaaugauccaacaauuaaauuaauagcaauguuauacacuccacucagagcaaauaaugccggcgacgacguauucacagucuccuguagagucuuaacacgaccuuccccagauuucgacuucauauuucucguaccuccaacagucgaaucacgaacuaaaccauucucaguacccauacuaaccguagaagaaaugacuaauuccagauuuccaauaccucuagaaaaacucuuuaccggccccucaucugccuucguaguacaaccacaaaauggucgcuguacuacagacggaguauuacucggaacaacucaacuaucacccgucaacauuuguacuuuuagaggcgauguaacacacauagcaggaacccaagaauacacaaugaaucuagcuucucaaaacuggaacaauuacgauccaacagaagaaauaccugcaccucuaggaacaccagacuuuguuggcaaaauacaagguguacuaacacaaacaacacgccgugaugguaguacucguggucacaaagcuacggucuccacaggaucaguacacuucacuccuaaauuaggaagaauacaauucucaacagauacaucgaaugacuucgaaaccggacaaaauacaagauucacaccuguaggaguaguacaagaugguucaacaacacaucaaaaugaaccacaacaauggguccuaccagauuacagugguagagacucccauaacguacaucucgcuccagccguagccccauccuuuccaggagaacaacuacuauucuucagaucuacaaugccuggauguucugguuauccaaauaugaaccucgauugcuuauuaccacaagaauggguacaacacuucuaucaagaagcagcuccagcacaaucagacguagcucuacuaagauucguaaacccugauacaggaagagucuuauucgaaugcaaauuacacaaaucaggcuauguaacaguagcucacacaggucaacacgauuuaguaauuccaccaaauggauauuuucgauucgauucauggguaaaucaauuuuauacauuagcaccaaugggaaaugguacaggcagaagaagauga

SEQ ID NO: 33714 - RNA, 1617 nt, Artificial Sequence
  derived and/or modified sequence opt6 from VP1__Norovirus_and/or_Norovirus-like__KC962453
augaaaauggccuccucagacgcaaacccaucagacggaucaacagcaaacuuagugccagaaguaaauaaugaaguaauggcccuagaaccaguuguaggagcagcuauagcugcaccaguugcaggacaacaaaauguuauagauccuuggauaagaaacaauuuuguacaagcaccagguggagaauuuacaaucucaccuagaaacgcacccggagaaauauuauggucugcaccauuagguccagaucucaauccauaucuaucacaccuugcaagaauguacaacggauacgcaggaggcuuugaaguacaaguaauacucgcuggcaaugcauuuacagcaggcaaaguaauauucgcagcuguaccaccuaacuuuccaaccgaagguuuaucuccaucacaaguaacaauguucccccauauaguuguagacguuagacaacuagaaccaguacucaucccacuuccagacguaagaaacaauuucuaucacuauaaucaauccaaugacccaacaauaaaacuaauagccaugcucuacacacccuuacgcgcaaacaaugcaggagacgacguauucacagugucuuguagaguuuuaacacgcccaucaccagacuucgacuuuauauuuuuaguaccaccuaccguugaauccagaacaaaacccuucucaaucccaguacucacaauagaagaaaugacuaauucucgauuucccauaccacucgaaaaauuauuuacaggaccaucaagugcauucguaguacaaccccaaaauggccguugcuccacugacgguguucuuuuaggaacaacacaacuaagcccaguaaauauauguacauucagaggugacguaacccauaucgcuggcucacauaauuacacuaugaaucuugcuucacaaaauuggaacuccuaugauccaacagaagagauaccagcaccauuagguacacccgacuuugucggaaaaauacaaggaguauuaacacaaacuacucgcgccgauggaucaacgagaggacauaaagccacuguauuaacaggaucugcaaauuuuacaccaaaacuugguagaauccaauucgcuacagauacagauaaugauuucgaaacuaaccaaaauaccaaauuuacuccaguuggaguaauacaagacggcgauacugcacacagaaaugaaccucaacaauggguauuaccaucauauucaggccgcaauacccauaacguacaucuagcuccagcaguagcaccuacuuucccaggagaacaauuauuauuuuucagauccaccaucccuggauguucaggauauccuaauauggaucuagauugucuauuaccacaagaauggguacaauuuuucuaucaagaagcagcaccagcacaaucagacgucgcauuacuucgauuuguaaacccagacacuggcagaguacucuuugaaugcaaauuacauaaaucaggauauauaacaguagcacauaccggacaacacgaccuaguuauaccuccuaauggauacuucagauucgauuccugggucaaccaauucuacacacuugcaccaaugggaaaugguacaggaagaagaagauga

SEQ ID NO: 33715 - RNA, 1617 nt, Artificial Sequence
  derived and/or modified sequence opt6 from VP1__Norovirus_and/or_Norovirus-like__KF712501
augaaaauggccucaaaugaugcaaauccuucagacggaucagcagcuaaccuagucccagaaguaaauaaugaagucauggcacucgaaccuguuguaggagcugcuauagcagcaccaguugccggacaacaaaauguaaucgauccauggauacgaaauaauuucguacaagcaccaggaggagaguucacagucucaccaagaaacgccccaggagaaauacuauggucagccccucuaggaccagaccuuaaccccuaucucucacacuuagcaagaauguacaacggauaugccgguggauucgaaguacaaguaauauuagcaggaaacgcauucaccgcaggaaaaaucauauuugcagcaguaccaccuaacuuuccaacugaaggacuaagccccucacaaguaacuauguucccacacauaauaguagacguccggcaauuagaaccaguacuaaucccacuacccgacguacguaacaauuuuuaccauuacaaccaaucuaacgauagcacaauaaaacuuauagcaaugcuauauacacccuuaagagccaauaaugcaggagaugauguauucacuguuucauguagagucuuaaccagaccauccccagauuuugauuucauauucuuaguaccaccuaccgucgaauccagaacaaaaccauuuucuguaccaauacucaccguagaagaaaugaccaauucaagguucccaaucccacuugaaaaacucuuuacaggaccuucuuccacauucguaguacaaccacaaaauggcagaugcacaacagacggaguccuacuaggaacaacucaacuaucucccguuaauauaugcaccuuuagaggagacguaacacacauaacaggaucccgaaauuacaccaugaauuuagcaucccaaaauuggaacucauacgacccaaccgaagaaauaccagcaccucugggaacaccagacuucguuggaaaaauacaaggagucuuaacacaaacuacacguacagacggaucuacacgaggacauaaagccacaguuuacacaggcuccgcagacuucucaccaaaauuaggcagaguacaauuugcaacagauacagacaaugauuucgacacaaaucaaaacaccaaauucacaccuguaggaguaauucaagacggaggaacaacacacagaaacgaaccacaacaauggguacuaccauccuauucaggaagaaacacacacaauguacaucuagcaccagcagucgcaccaacauucccaggagaacaauuacuauuuuucagaucaacaaugccaggcucaucaggcuacccaaauauggacuuagacugucuccuaccacaagaauggguacaauauuuuuaccaagaagccgcacccgcacaaucagauguagcccuauuacgauucguuaauccagacacaggaagaguacuauuugaaugcaaacuacacaaauccggauacguaacaguagcacacaccggacaacacgaucucguaauaccacccaauggauauuucagauuugacucauggguaaaucaauuuuauacucuugccccuaugggcaacggaacuggaagaagacgcuaa

SEQ ID NO: 33716 - RNA, 1617 nt, Artificial Sequence
  derived and/or modified sequence opt6 from VP1__Norovirus_and/or_Norovirus-like__JX459903
augaaaauggcaucaucagaugcuaacccaucagaugguucaacagcaaaccuaguacccgaaguuaauaaugaaguaauggcucuagaaccuguaguaggcgcagcaauagcagcaccaguugcaggccaacaaaacgucaucgauccauggauacgaaacaauuuuguccaagcaccaggaggagaauuuacaguuucaccaagaaaugcaccaggagaaaucuuauggucagcaccguuaggaccugacuuaaauccauaucuuagccacuuagccagaauguacaacgguuacgcugguggauucgaaguacaaguaauacuagcaggaaaugcuuucacagcaggaaaaauaauauuugcagcaguuccaccuaacuucccaacagaaggacuaaguccaucucaagucacaauguuuccucacauuauaguugauguaagacaauuagaaccaguacuaaucccauuaccagauguuagaaacaacuuuuaucacuauaaccaaucaaaugacccaacuaucaaacucauagcaauguuauacacaccauuaagagcuaauaacgcaggagacgauguauuuacaguaucuugucgaguacuaacuaggccuucaccugauuuugacuuuauauuucuaguaccaccaacaguagaaucaagaacaaaaccauuuucaguuccaauauuaacugucgaagaaaugacaaacucuagauucccaaucccacuagaaaaauuauuuacaggucccucaucagcuuucguuguacaaccacaaaauggacgcugcaccacagacggcguacuacugggaacaacucaauuaucaccaguuaauauauguacuuuuagaggagaugucacacauauaacuggaucccgaaauuacacaaugaacuuagcaacacaaaauuggaacucuuaugauccaaccgaagaaaucccagcuccucuuggaacaccagacuuuguagguaaaauacaagguguacuaacacaaacaacuagagcugacggaucaacaagaggacacaaagcaacaguauauacaggaucagcagacuucgccccaaaacucggacgaguccaauuugcaacagacacagaucacgauuucgacgcaaaucaaaauacaaaauuuacaccaguaggaguaauacaagauggagacacagcacauagaaaugaaccccaacaauggguccuaccaucuuauucaggaagaaacucacacaacguacacuuagcaccuacaguagcuccaaccuucccaggagaacaacuccuauucuucagauccacaaugcccgguugcucaggcuauccaaauauggaucuagacugccuacuuccacaagaauggguacaauauuuuuaucaagaagcagcaccagcucaauccgaugucgcauuauuaagauucgucaacccagauacaggcagaguauuauucgaaugcaaauuacauaaaucaggcuauguaacuguagcccacaccggacaacaugaccuaguaauaccaccaaauggauacuuuagauucgacucauggguaaaucaauuuuacacucuagcaccaaugggaaauggaacaggaagaagacguuaa

SEQ ID NO: 33717 - RNA, 1617 nt, Artificial Sequence
  derived and/or modified sequence opt6 from VP1__Norovirus_and/or_Norovirus-like__JX459629
augaaaauggcaucaaacgacgcaaauccaucagauggaucugcagcaaauuuaguaccagaaguaaacaacgaaguaauggcacuugaaccaguaguaggcgcagcaauagcugcaccaguagcaggccaacaaaauguuauagacccauggauaagaucuaacuuuguacaagcaccaggaggugaauuuacaguaucaccaagaaaugcaccaggagaaaucuuauggucagccccacuaggaccagaccuaaaucccuaucuaucucacuuagcucgaauguauaacgguuacgccggugguuucgaaguucaaguaauauuagcaggaaacgcauuuacagcaggcaaaauaauauucgccgcaguaccuccuaacuucccaaccgaaggauuaucuccaucucaaguaacuauguucccacauauaauaguagacguacgucaacuagaaccaguacuaauaccacuaccagauguaagaaauaacuuuuaccauuacaaucaaucaaaugauucaacaauuaaacucauagcaaugcuauacaccccacuccgagcaaacaacgcaggagaagauguauuuacaguuuccuguagaguucuaacacgacccucaccagacuucgacuuuauuuuucuaguaccacccaccguugaaucacgaacaaaaccauuuacuguaccaauauuaacaguugaagaaaugacaaacuccagauuuccaauaccauuagaaaaacuauuuacaggaccaucuuccgcauucguaguacaaccacaaaacggaagauguaccaccgauggaguauuacuaggaaccacccaacuuucuccagucaacauauguaccuuuagaggagauguaacacauauugcggguucaagaaauuauacaaugaaccuagccagcuuaaauuggaacaauuacgauccaacagaagaaauaccagccccucucgguaccccagauuuuguaggaaaaauacagggcguucuaacccaaacaacuaaaggagacggaucaacacgcggucacaaagcaacaguauacacagguuccgccccauucacaccaaaauuaggaucuguacaguuuucaacagauacugaaaacgauuucgaaacccaccaaaauacaaaauucacaccaguaggaguaauucaggacgguggaacaacccauagaaaugaaccacaacaauggguuuuaccauccuauucuggucgaaaugucccaaacguacaccuagcaccagcaguagcaccgaccuuuccaggugaacaauuauuauucuuuagaucuacaaugccagguugcucaggauauccaaauauggaucuagacugcuuauuaccacaagaauggguucaacauuucuaucaagaagccgcuccugcacagucagacgucgcccuacuuagauuuguaaauccagacacaggacgaguauuauuugaauguaaauuacacaaaucaggcuacguaacaguagcacacacaggacaacacgauuuaguaauaccucccaauggauacuuucgauucgauaguugggucaaucaauucuacacacuagcaccaauggguaauggaacagguagacgacgcuaa

SEQ ID NO: 33718 - RNA, 1617 nt, Artificial Sequence
  derived and/or modified sequence opt6 from VP1__Norovirus_and/or_Norovirus-like__JX445165
augaaaauggcaucaucugaugcaaaccccucagacggaucaacagcaaacuuagucccugaaguuaacaaugaaguuauggcacuagaaccaguaguuggugcugcaauagcagcucccguugcaggacaacaaaacguaauagauccauggaucagaaacaacuuuguacaagcacccggaggagaauuuacaguuucuccaagaaaugcaccaggagaaauauuauggucagcuccucuaggaccagaucuaaacccauaucuaucccauuuagcuagaauguauaauggauaugcaggcggauucgaaguacaagucauauuagcagguaacgcauuuaccgcaggaaaaauaauauucucagcaguuccaccaaacuucccaacugaaggauuaucaccaucacaaguuacaauguuuccucacauaauuguagauguacggcaacuagaaccaguucuaauaccuuuacccgauguaagaaacaacuuuuaccauuauaaucaaucaaaugauccaacuauaaaacuuauugcaauguuauauaccccacuacgagcaaauaaugcaggcgaugacguauucacaguuucauguagaguucuaacacgaccaucucccgauuuugacuuuauauuucuaguaccaccuacaguugaauccagaaccaaacccuuuucagucccaauacucacaguagaagaaaugacuaacaguagauuuccaauuccacuugaaaaacucuuuaccggaccaucaucuacauucgucguucaaccacaaaauggaagauguacaacagacggcguauuacuagguacaacgcaacuaucaccuguaaauauaugcacauuuagaggugacguaacacauaucacaggcucaagaaauuauacaaugaaccuugccucacaaaauuggaacucuuacgacccaacagaagaaauuccugcacccuuaggaaccccagacuuuguaggaaaaauacaaggaguucuaacacaaacaacaagaacagauggcuccacaagaggccauaaagcaacaguauauaccgguucagccgaauuuucuccuaaauuaggacgaguacaauucgcaacagauaccgacaacgauuuugacgcaaaucaaaauacaaaauucacaccaguaggcguuauacaagacggaggaacaacacauagaaaugaaccccaacaauggguacuaccaucuuacucugguagaaacacccauaauguucaccuagcaccagcaguagcuccaacauuuccaggagaacaacuauuauucuuuagauccacaaugccaggauguucaggauacccaaauauggaccucgauuguuuacuaccucaagaauggguucaacauuuuuaucaagaagccgcaccagcacaaucagacguagcacuucuaagauucguaaauccagacacaggaagaguccuauucgaaugcaaacuacauaaaucaggauacguaacagucgcacauacaggccaacaugaccuaguuauaccaccaaacggauauuuuagauucgauucaugggucaaccaauucuacacauuagcuccaaugggaaauggaacaggacgaagacguuaa

SEQ ID NO: 33719 - RNA, 1617 nt, Artificial Sequence
  derived and/or modified sequence opt6 from VP1__Norovirus_and/or_Norovirus-like__HM635156
augaaaauggcaaguucugaugcaaacccaucugauggauccaccgcuaaccuaguaccugaaguaaauaacgaaguaauggcucuagaaccaguaguaggugcugcuauagccgcaccaguagcaggacaacaaaauguaauugauccuuggauacguaauaauuucguacaagcuccagguggugaauuuacuguuucaccaagaaaugcacccggagaaauauuauggucagccccacuuggaccagaucuaaauccauaucuaucacauuuagcacgaauguacaacgguuaugcaggaggauuugaaguacaaguaauucucgcaggaaacgcauuuacagcaggaaaaauaaucuuugcagcaguaccaccuaacuuuccaacagaaggucuaucuccaucacaaguaacuauguuuccccauauuaucguagauguaagacagcuagaaccaguccuaauaccauuaccagacguaagaaauaacuuuuaucacuauaaccaaagcaaugacccuaccauaaaacuaauagcaaugcuauauacaccauuaagagcuaauaaugcuggagaugauguauuuacagucucaugcagaguacucacaagaccaucuccugauuuugacuuuauauuucucgucccaccaaccguagaaucucgaacaaaaccauucucaguuccaauacuaacuguagaagaaaugacuaacagcagauuuccaaucccacucgaaaaacuauuuacaggacccaguuccgccuucguuguccaaccacaaaacggacgauguaccauagauggagucuuacuaggaaccacacaacuaucuccaguaaauaucugcaccuucagaggagauguuacccauaucacuggaucuagaaauuacacuaugaaucuagcaacacaaaacuggaacucuuacgauccaacagaagaaauaccagcuccauuaggaacacccgauuuuguagguaaaauacaagguguacuaacacaaacaacaagagcugaugguucaacaagaggccauaaagccacagucuauacaggaucagcagacuuugcaccaaaacuaggaagaguacaauuugcaacagacacagauaaugauuucgaugcaaaucaaaacacaaaauuuacaccaguuggcguaauacaagauggaaauacugcacauagaaaugaaccucaacaauggguauuaccaucauauucagguagaaauucacacaacguacauuuagcaccagcuguagcaccaacauuuccaggagaacaacucuuauucuucaggucaacuaugccaggcugcucuggauauccaaauauggaucuagauugucuauuaccacaagaauggguacaauauuuuuaccaagaagcugcaccagcucaaucagacguagcauuacuaagauuuguuaacccagauacaggcagaguauuauucgaaugcaaacuacacaaaagugguuauguaacaguagcacacacaggacaacaugaccuaguaauacccccaaauggcuacuuccgauuugacucauggguaaaucaauuuuacacuuuagcacccaugggaaauggaaccggaagaagacgauaa

SEQ ID NO: 33720 - RNA, 1617 nt, Artificial Sequence
  derived and/or modified sequence opt6 from VP1__Norovirus_and/or_Norovirus-like__JQ622197
augaaaauggcaucaaacgaugcaaaucccagugauggaucagcagcaucccuaguaccagaagugaauaacgaaguaauggcacuugaaccaguuguaggagccgcaauagcugcuccugucgccggacaacaaaacguaauugaccccuggauacgcaauaacuucguacaagcaccaggaggcgaguuuacaguaucaccucgaaacgcaccaggagaaauuuuauggucugccccuuuagguccagaucuuaacccuuauuuaucacaccuagcaagaauguauaacgguuacgcaggcggcuuugaaguccaagucauacuugcaggaaaugcauucacugcuggaaaaauaauauucgccgcaguaccaccuaacuucccaacagaaggucucucaccaucgcaaguaacaauguuuccacauauaauuguugauguaagacaauuagaacccguccuaauaccuuuaccugauguacgaaacaauuucuaucauuacaaccaauccaacgacucuacuauaaaacuuauagcaaugcuauacaccccacuacgagcuaauaaugccggagaagacguauuuacaguaucuuguagaguucuaacaagaccauccccagauuucgauuuuauauuucuaguacccccaacagucgaaucaagaacaaaacccuucacagucccaauauuaacuguagaagaaaugacaaacucuagauuuccuauaccacuagaaaaauuauucacaggaccaucaucagcauucguuguacaaccacaaaacggacgauguacaacagacggagucuuacuugguacaacacaacuuucaccaguaaauaucuguaccuucagaggagauguuacacauauagcagguucaagaaauuauacuaugaauuuagcuucuuuaaacuggaauaacuacgaucccacagaagaaauaccagcaccacuagguacuccagauuuugucggaaaaauacaaggaguacuaacacaaacaacuaaaggcgacggaagcacuagaggacauaaagccacaguauacaccgguucagcaccauucacaccaaaauuaggaucaguacaauucucaacugauacagaaaaugacuucgaaacacaucaaaacacaaaauucacacccguaggcguaauucaagacgguaguacaacucauagaaaugaaccacaacaauggguauuaccuucuuacucagguggaaauguccauaauguacauuuagccccugcuguagccccaacauuucccggcgaacaacuacuauucuuuagaucaacaaugccaggauguucaggcuauccaaauauggauuuagauugccuauuaccacaagaauggguccaacauuuuuaccaagaagcagcuccagcacaauccgauguagcacuauuaagauucguaaacccugacacuggaagaguacuauucgaauguaaacuacauaaaucaggauauguaacuguagcccauacaggccaacacgaucuaguuaucccaccaaacggauauuuccgauuugauuccuggguaaaucaauucuauacccuagcaccaaugggaaauggaacaggacgacgaagauaa

SEQ ID NO: 33721 - RNA, 1617 nt, Artificial Sequence
  derived and/or modified sequence opt6 from VP1__Norovirus_and/or_Norovirus-like__JQ613520
augaaaauggcaucaaacgaugcaaauccaucagauggcucagcagcaaaccuaguaccagaaguaaacaaugaaguuauggcauuagaaccaguaguaggagcagcaauagccgcacccguagcaggacaacaaaacguaauagauccauggauaagaaacaacuuuguccaagcacccggcggugaauuuacaguaucaccacgaaacgcaccaggagaaauacuuuggagcgcaccucuaggaccagaucuuaauccauauuuaucucauuuagcacguauguauaacggauacgcugguggauuugaaguucaaguaauucuugcagguaaugcauuuacagcaggaaaaauaaucuucgcagcaguaccaccaaacuuuccaacagaaggccuaucucccucacagguaacuauguucccacacaucauaguagauguacgacaacucgaaccaguccuaauaccauuacccgauguaagaaacaacuucuaucacuauaaucaaucaaaugacucuacuaucaaauuaaucgcaaugcuauauacuccucuacgcgcaaacaacgcaggagaagacguauuuacaguaucuugcagaguacugaccaggccaucaccagacuucgacuucauuuuucuaguucccccaacaguagaaucacgaacuaaaccauuuacaguaccaauauuaacuguagaagaaaugacaaauucuagauuuccuauaccauuagaaaaacucuuuacaggaccaucuucagccuucgucguacaaccacaaaacggacgauguacuacugacggaguauuacucggaacaacacaacuaucccccgucaauauauguacuuuucgaggagacguuacacauauagcagguaguagaaauuacacaaugaaucucgcaucccuaaauuggaacaacuaugaccccacagaagaaauaccagcaccccuaggaacaccagacuucguagguaaaauacaaggagucuuaacacaaacuacaaaaggagaugguucuacuagaggccauaaagcaacaguauauaccggcucagcaccauuuacacccaaauuaggaucaguacaauuuucaacagauaccgaaaaugauuucgaaacacaucaaaacacaaaauucacaccagucggaguaauacaagaugguggcacaacucauagaaaugaaccacaacaauggguacuaccaucuuauucuggaagaaauguaccaaacguucaucuugcuccagcagucgccccuacuuuuccaggugaacaauuacuauucuucagaucaacaaugcccggcuguaguggauacccuaauauggacuuagacuguuuacuaccucaagaauggguucaacauuucuaucaagaagccgccccagcccaaucugacgucgcuuuauuaagauucguuaaucccgauacaggacgaguacuuuuugaaugcaaacuacauaaaaguggcuauguuacugucgcacacacuggacaacacgaucuaguaauaccaucaaauggauacuuccguuuugauucuuggguaaaucaauuuuauacacuugcaccaaugggaaauggaacuggccgaagaagauaa

SEQ ID NO: 33722 - RNA, 1617 nt, Artificial Sequence
  derived and/or modified sequence opt6 from VP1__Norovirus_and/or_Norovirus-like__HQ456320
augaaaauggccaguaacgacgccacaccuucagauggaucaacagcaaauuuaguaccugaaguaaauaaugaaguuauggcauuagaaccaguaguaggagcagcaauugcggcuccaguagcaggacaacaaaauguaauagacccauggauccgcaauaacuucguacaagcaccaggaggcgaauuuacaguaucaccaagaaaugcacccggagaaauauuauggucagcuccacuagguccagauuuaaaccccuauuuaucacacuuagcacguauguauaauggauacgccggcggcuuugaaguacaaguaauacuagcaggaaaugcauuuaccgcuggaaaaauaauauuugcagcaguaccacccaacuuuccaacagaaggacuaucaccaucucaaguaacaauguucccucauauuaucguagacgucagacaacuagaaccaguccuaauaccacuaccagauguaagaaacaauuucuaucacuacaaucaaucuaaugacccuacaauaaaacuuaucgcaaugcuuuacacaccccuaagagcaaacaacgcaggcgacgacguauucacuguaaguugcagaguauuaacaagaccauccccagacuuugacuuuauuuuucuaguaccucccacuguagaaucacgaacaaaacccuucucaguaccaaucuuaacaguagaagaaaugacuaacucacgauucccaauaccuuuagaaaaauuauuuacuggaccaucuuccgcauucgucguccaaccacaaaacggaagauguacaacagauggaguucuacuagguaccacacaacuaucccccguaaauauauguaccuuucgaggagacguaacacauauagcaggcacccaaaauuacacaaugaauuuagcaucacaaaauuggaauaauuacgacccaacagaagaaauaccagcuccauuaggaaccccagacuuuguaggaaaaauucaaggaguauuaacacaaacaacaagacgagacggauccacaagaggucauaaagcaacuguuucaacaggaucaguccacuucacaccaaaacugggauccguacaauucuccacagauacaucaaacgauuuugaaacaggucaaaacacacgauuuacucccguaggaguaguccaagauggcucaacaacacaucaaaaugaaccacaacaauggguauuacccaauuauucuggaagagacucacacaauguacacuuagcaccagcaguagcaccaacuuuuccaggagaacaacuacuauucuuuagauccacaaugccuggauguucuggcuauccaaacaugaaucuagacuguuuacuaccacaagaauggguccaacacuuuuaccaagaaucugcacccgcacaaucugauguugcuuuauuacgauucguaaauccagacaccggaagagucuuauucgaaugcaaacuacacaaguccgguuaugucaccguagcucacacaggacaacacgauuuaguaauaccuccaaauggcuauuuccgauucgacucauggguuaaucaauuuuauacacuagcuccaaugggaaauggagcuggacgacgaagauga

SEQ ID NO: 33723 - RNA, 1617 nt, Artificial Sequence
  derived and/or modified sequence opt6 from VP1__Norovirus_and/or_Norovirus-like__AB541353
augaaaauggcaucaaaugacgcauccccaagcgauggcucagcagcaaaucuaguaccugaaguuaacaacgaaguaauggcuuuagaacccguuguuggagcagcaauagcugcuccuguagcaggacaacaaaauguaauagacccauggauaagaaacaacuuuguacaagcaccaggaggagaauuuacaguaucucccagaaaugcaccuggagaaauauuauggucugccccacuaggaccugaucuaaacccauaucuuucucaccuugcaagaauguauaacggauaugccggaggcuucgaaguacaaguaauuuuagcuggaaaugcauuuacagcuggaaaaauaauuuucgcagcaguaccaccaaauuucccaacagaaggacucucuccaucacaaguaacuauguuuccucacauuauaguugacguaagacaacuagaaccaguacuaauaccauuaccagauguaagaaacaauuucuaccacuacaaccaauccaacgauucaacaauaaaacuuauagcuaugcuauacacacccuuacgagcaaacaaugcaggagaagacguuuucacaguaucaugcagaguacuaacaagaccaucuccagacuucgacuuuauauucuuaguacccccuaccguagaaucuagaacaaaaccauucacaguaccuauacuaacaguagaagaaaugacuaauucuagauucccaauaccuuuagaaaaacuauuuaccggaccaucaucugccuuuguaguacaaccccagaacggaagauguacaacagacggaguacuacuagguaccacccaacuaucaccuguaaacauauguacauuucgaggcgacguaacccacauagcaggcucuagaaauuauacaaugaaucucgcaucucuaaauuggaauaauuacgauccaacagaagagauaccagcaccauuaggaacaccugauuuuguaggaaaaauucaaggaguauuaacacaaacaaccaaaggagacggaucaacaagaggacacaaagcaacaguauacaccggaucagcuccuuuuacaccaaaauuaggauccguccaauucucaaccgauaccgaaaacgauuuugaaacccaucaaaacacaaaauucacaccaguaggcguuauacaagauggaggaacaacucaccgaaacgaaccacaacaauggguacuaccaucuuacucagguagaaacguaccaaauguucaucuagccccugcaguagcaccuacuuuucccggagaacaauuauuauucuuucgaucaaccaugccaggaugcaguggauacccaaauauggaucuagauugccuacuaccacaagaauggguacaacauuuuuaucaagaagcagcuccugcacaaucagacguagcauuacuacguuucgucaauccagacacaggaagaguacuauucgaauguaaacuacauaaauccggauauguuacaguggcacacacuggccaacaugaccuaguuaucccaccaaaugguuauuuccgauuugauuccuggguaaaucaauucuacacauuagcaccuaugggaaaugguacaggacggcgacgauaa

SEQ ID NO: 33724 - RNA, 1617 nt, Artificial Sequence
  derived and/or modified sequence opt6 from VP1__Norovirus_and/or_Norovirus-like__AB541348
augaaaauggccuccaaugacgcuaacccaucagacggcucagccgcaaauuuaguaccagaaguaaauaaugaaguaauggcucuagaaccaguaguuggagcagcaauagcagcaccaguagcuggucaacaaaauguaauugacccauggauaagaaauaauuuuguacaagcaccaggaggagaauuuacaguaucuccacgcaaugcaccaggagaaauucuauggucagcaccauugggaccagaucuaaacccauaucuaagucaucuagcaagaauguauaacggauacgcaggaggauuugaaguucaagucaucuuagcaggcaaugcauucacagcaggcaaaauaauauucgcagcaguaccaccaaauuucccaacagaaggacucucaccaagccaaguaacaauguucccacacaucauaguagauguuagacaauuagaacccguguuaauuccacuacccgacguuagaaacaacuucuaucacuauaaccaaucaaaugacucaacaauaaaacuaaucgcaauguuauacacuccacuaagagcuaauaacgcaggagacgaugucuucacaguaaguuguagaguacuaacuagaccaucuccugacuuugauuuuauauuuuuagucccaccaacaguagaaucaagaacaaaaccauucacaguuccaauuuuaacagucgaagaaaugacaaacucaagauucccaauaccguuagaaaaacuauuuacuggucccucaucagcauuuguaguacaaccccaaaauggucgcuguacaacugaugguguauuacuaggaacaacacaacuaucaccaguaaauaucuguacauucagaggagaugucacacauaucgcaggcucaagaaauuacacuaugaauuuagcaucacuaaacuggaacaauuacgauccaacagaagaaauaccugcaccacuagguacaccagauuucgucggcaaaauccaaggaguauuaacacaaaccacaaaaggcgacggaucuacacgcggacacaaggcaacaguauauacaggaucagcagacuucacaccaaaacucgguucaguccaauucgcuacagacaccgaaaaugacuuugaaacccaccaaaauacaaaauucacaccaguaggcguuauacaagacgguggaacaacacauagaaaugaaccacaacaauggguucuccccucauacuccgguagaaacguacauaauguacauuuagccccagcaguagcaccuaacuuuccuggagaacaacuauuauucuuuagaaguacaaugccaggcuguucaggcuauccaaauauggauuuagacugcuuacuaccacaagaauggguacaacauuuuuaccaagaagcugcuccugcccaauccgacguugcccuauuacgauuuguaaauccugacaccgguagaguuuuauucgaaugcaaauuacauaaaucaggauacguuacaguagcccacacaggacaacaugauuuaguuauaccaccaaacggcuauuucagauuugauuccuggguuaaccaauucuacacucuagcuccuauggguaaugguacaggacgaagacgauaa

SEQ ID NO: 33725 - RNA, 1617 nt, Artificial Sequence
  derived and/or modified sequence opt6 from VP1__Norovirus_and/or_Norovirus-like__AB541339
augaaaauggcaagcaacgacgcaaacccaucagacggaucagcagcaaaucucgucccugaaguaaauaaugaaguaauggcuuuagaaccaguaguaggagcagcaaucgcagcaccaguugcaggacaacaaaaugucaucgacccauggauacgaaauaacuuuguacaagcaccaggcggugaguucacaguaucaccacgaaacgcucccggagaaauucucuggucagcaccacuaggaccagaucucaauccauaucucucacauuuagcacgaauguauaauggauaugcaggaggauucgaaguacaaguuauuuuagccggaaacgccuuuacagcagguaaaauuauauuugcagcaguuccaccaaauuuccccacagaaggcuuaucaccaucucaaguuacuauguuuccacacauaauaguagacguaagacaauuagaaccaguacuaauaccauuacccgauguccgaaauaauuucuaccauuacaaucaaucaaaugauucuacaauaaaacuaauagcaaugcuauacacaccuuuaagagcuaacaaugcaggagaggaugucuuuaccguauccuguagaguacucacacgaccuucaccagauuucgacuucaucuuucuaguucccccaacaguugaaagcagaacuaaacccuucacagucccaauucuaaccguugaagaaaugacaaacucccgauucccaauaccauuagaaaaauuauuuacaggaccauccucugcauucgucguccaaccucaaaauggacgauguaccaccgacggcguauuauuaggaacaacccaauuaucaccaguaaacauaugcacauuuagaggagacgucacccauauugccggaucaagaaauuauacaaugaauuuagcaucauuaaauuggaacaacuaugaucccacagaagaaauaccagcgccacuagguacacccgacuuuguaggaaaaauacaaggaguauuaacacaaacaacaaaaggcgauggcuccacuagaggucauaaagcaaccguauauacaggaucagcaccauucacaccaaaauuagggucaguccaauucucuacagauacagaaaacgacuucgaaacacaccaaaacacaaaauuuacaccaguaggcguaauacaagacggaaauacaacacacagaaaugaaccacaacaauggguacuaccaucauauucaggacgaaacguacaaaauguacaucuagcaccagccguagccccaacauuuccaggagagcaacuccucuucuuuagaucaacuaugccaggaugcucaggauauccaaauauggaucuagauugcuuacuaccucaagaauggguccaacauuucuaucaagaagcagcacccgcacaaucugauguugcauuauuaagauucgucaacccugauaccggcagaguauuauuugaauguaaacuacauaagucaggcuauguaacaguagcccauacaggacaacacgauuuaguaauaccaccuaauggauauuuccgauuugauucauggguaaaucaauucuauacacuagccccuaugggcaauggaacaggaagaagacguuaa

SEQ ID NO: 33726 - RNA, 1617 nt, Artificial Sequence
  derived and/or modified sequence opt6 from VP1__Norovirus_and/or_Norovirus-like__AB541303
augaaaauggcaucaaaugacgcauccccuucagauggcucugccgcaaacuuaguaccugaaguuaacaaugaaguaauggcauuagaaccaguuguuggugcagcuauagcagcaccaguagcaggacaacaaaauguaauagaucccuggauaagaaacaacuuuguucaagcaccaggaggagaauuuacagucucccccagaaaugccccaggcgaaauauuauggucagcaccauuaggacccgacuuaaauccauaucuaucacacuuagcacgaauguauaaugguuacgccgguggauucgaaguccagguaauacuagcaggaaaugcauuuacagcaggcaaaauaauauucgcagcaguaccaccaaauuucccaacugaaggacuaucccccucacaaguaaccauguucccucacauaauaguagacguuagacaacuagaaccaguuuuaauaccacuaccugacgucagaaauaauuuuuaucacuauaaucaaaguaaugauucaacuauuaaauuaauugcaaugcuauauacaccacuaagagcuaacaacgccggagaagaugucuuuacaguauccuguagaguacuaaccagacccucaccagauuucgauuucauauuucuuguaccaccaacaguagaaucaagaacaaaaccuuucacaguaccaauacuaacuguagaagaaaugaccaacucaagauuuccaauuccacuagaaaaacuauucacaggaccaucaggagcauucguaguacaaccacaaaacggaagauguacaacugauggaguauuauuagguacaacacaauuaucaccugucaauauauguacauuuagaggagacguaacacauaucgcaggaucaagaaauuauacaaugaauuuagcugcacucaacuggaauaauuacgacccaacugaagaaauaccagcacccuuaggaacuccagauuuuguagggaaaauucaaggagucuuaacacaaaccacaaaagcagauggaucaacaagaggucauaaagcaacagucuacaccggaucagccguuuucacaccaaaacuaggaucaguccaauuuucuacugauacugaaaacgauuucgaaacacaucaaaauacuaaauucacaccaguaggaguaauacaagacgguucuacaacacacagaaaugaaccacaacaauggguacuucccucauauuccggacgaaacguucauaauguacacuuagccccugcaguagccccaaccuuccccggagaacaacucuuauucuucagaucuacaaugccaggauguucaggcuacccaaauauggauuuagauugccuacuaccucaagaauggguucaacacuucuaucaagaagcagcuccugcacaaucagacguggcacuccuacguuucgucaauccggauacuggccgcguauuauuugaaugcaaacuacauaaaucuggauauguaacaguagcacacacaggucaacacgaucucguaaucccuccaaauggauauuuuagauucgauucuuggguuaaucaauuuuacacacuugcaccaaugggaaauggcacuggacgaagaagauaa

SEQ ID NO: 33727 - RNA, 1617 nt, Artificial Sequence
  derived and/or modified sequence opt6 from VP1__Norovirus_and/or_Norovirus-like__GQ246799
augaaaauggccucaaaugacgcaaacccuuccgauggcucagcagcaaauuuaguaccugaaauaaacaaugaaguaauggcauuagaacccguaguaggagccgcaauagcagcaccaguagcaggacaacaaaauguaauugacccuuggauuagaaauaauuuuguucaagcaccugguggagaauuuacaguauccccaagaaacgcgccaggagaaauauuauggucugcaccucuuggaccagaucuaaauccauaucucucucacuuagcaagaauguacaacggauacgcaggaggauucgaaguacaaguaauaccagcaggcaacgcauuuacagcaggcaaaauaauauucgccgcuguaccacccaauuuuccuacagaaggauuaucaccaucacaaguuacaauguucccccacauuauaguagacguacgacaacuagaaccaguacuuauuccauuaccagaugucagaaauaauuucuaccauuauaaucaaucaaaugauuccacaauuaaauuaaucgcaauguuauacacaccauuacgagcaaauaaugcaggagacgaugucuuuaccguuucauguagaguacuaacucgacccucaccagacuuugacuuuauauuucuaguaccaccaacaguugaaucaagaacaaaaccuuucacagucccaauauuaacaguagaagaaaugacaaacucaagauuuccaauaccauuagaaaaacuuuuuacuggucccuccucagccuucguaguacaaccccaaaauggacgauguacuacugacggaguacuucucggcacaacucaauuaucaccuguaaauaucugcacauuucgaggugaugucacacauauugcuggaucaagaaauuacacaaugaacuuagcaucccuaaacuggaacaauuacgauccuacagaagaaauaccugcaccauuaggaacaccugacuucgucgguaaaauucaaggagucuuaacacaaacaacuaaagaagauggaucuaccagaggacacaaagcaacaguauacaccggaucagcagacuuuacuccuaaacuaggaucuguccaauucgguacagauacagaaaacgacuucgaaacacaucaaaauacaaaauucaccccaguuggaguuauacaagacggaucaacuacacaucgaaacgaaccacaacaauggguacuaccaucuuauucggguagaaauguacauaauguucauuuagccccagcaguagcaccuaacuucccaggagaacaacuauuauucuuucgaucaaccaugccagguugcucuggauaccccaauauggauuuagacugcuuacuaccacaagaauggguacaacacuucuaccaagaagccgcaccagcucaaucagacguagcauuacuuagauucguaaauccagauacuggaagaguacuuuucgaauguaaauuacauaaaucaggcuaugucacugucgcacacacaggacaacaugacuuaguuauaccacccaauggauauuuccgauucgauucuuggguaaaucaauucuacacacuugcaccuaugggcaauggcaccggacgacgaagauaa

SEQ ID NO: 33728 - RNA, 1617 nt, Artificial Sequence
  derived and/or modified sequence opt6 from VP1__Norovirus_and/or_Norovirus-like__EU876886
augaaaauggcaucauccgaugccaacccuucagacggaucaacugcaaauuuaguaccagaaguaaauaacgaaguaauggcuuuagaaccaguuguuggagccgcuauagcugccccugucgcaggacaacaaaacguaauagacccauggauucgaaauaacuuuguacaagcaccuggaggugaauuuacaguaucuccuagaaaugcaccaggcgaaauacuauggucagcaccuuuaggcccagauuuaaauccauaucuuucacaccuugcacgcauguacaacggauaugcaggaggauucgaaguacaaguaauauuagcaggaaacgcauucacagcaggaaaaauaaucuuugcugccguacccccaaacuuuccaacagaaggcuuaucuccaucacaaguaaccauguuuccacacauaauaguugauguacgacaacuagaacccgucuuaauuccucuaccagacguccgaaacaauuuuuaucauuauaaucaaaguaacgacccaaccaucaaauuaauagcaaugcuuuacacaccguuacgagcaaauaaugcaggagacgauguauuuaccguaucauguagaguauuaacacgaccaucuccagacuucgacuuuauauuucuaguucccccgacaguagaaucaagaacaaaaccauuuucuguuccaauauuaacaguagaagaaaugacaaacucacgauuuccaauaccacuagaaagacuauuuacaggaccaucaucugcauucguuguccaaccccaaaauggcagauguaccacagacggaguuuuauuaggaacaacacaacuauccucugucaacaucuguacauuuagaggugacguaacacacauagcagguacacaagaauauaccaugaauuuagccucacaaaauuggaauaauuaugacccuacagaagagauaccagcaccuuuaggaacaccugauuucguaggaaaaauacaaggagucuuaacacaaaccacacgaagagacggaucuaccagaggccacaaagcaacaguaucuacugguagcguacauuuuacuccaaaauuaggacgaauacaauuuucaacagacacaucaaacgacuuugaaacaggacaaaacacaagauuuacaccaguuggaguaguacaagacggcuccacaacacaucaaaacgaaccucaacaauggguuuuaccaaacuauagcggacgagacggacacaacguacaucuagcaccagcuguugcuccaucauuuccaggagaacaacuacuuuucuuuagaucaacaaugccagguugcucaggauauccaaauaugaauuuagacugucuauuaccacaagaauggguccaacauuuuuaucaagaggcagcucccgcacaaucugauguagcacuacuaagauuuguaaaccccgacacaggaagaguuuuauuugaguguaaacuccacaaaucaggcuaugucacuguugcucacacuggacaacaugauuuaguaauuccacccaaugguuauuuuagauucgacucaugggucaaucaauuuuacacacuagccccaaugggaaauggaacuggaagacgaagauaa

SEQ ID NO: 33729 - RNA, 1617 nt, Artificial Sequence
  derived and/or modified sequence opt6 from VP1__Norovirus_and/or_Norovirus-like__AB385630
augaagauggcaucaaaugacgcuaauccaucugacggauccgcagcuaaucuaguccccgaaguuaacaacgaaguuauggcacuugaaccaguaguaggagcagcaauagcagcaccaguagcaggacaacaaaauguuauagauccauggauuagaaauaacuuuguucaagcaccaggaggcgaauuuacaguauccccuagaaacgcaccuggggaaauuuuauggucugcaccauuagguccagauuuaaauccauaucuaucucaccuagcacgaauguauaauggauaugcuggaggauuugaaguacaagucauacucgcuggcaaugcauucaccgcaggaaaaauaauuuuugcagcaguaccaccaaacuuuccaacagaaggauuaucaccuucccaaguaacaauguucccacacauuauaguagacguacgacaacuagaaccaguacuaauacccuuaccagauguaagaaacaacuucuaucauuacaaccaaucuaaugauuccacaauaaaacuaauagcaauguuauauacaccacucagagccaacaaugcaggagaagauguauuuacaguaucauguagaguauuaacaagacccucaccagacuucgacuucauuuuccuaguuccaccaacagucgaaucuagaacaaagccauuuacaguaccaauauuaacaguagaagaaaugacaaacucucgguuuccaaucccucuagaaaaacuauuuaccggaccaucaggagcauucguaguacaaccucaaaauggaagauguacaacagauggaguuuuacuaggaacaacacaacuauccccaguaaauauaugcacauuucgaggcgauguaacacacauagccggaucacgcaauuauacaaugaacuuagcaucauuaaacuggaauaacuaugacccaacugaagaaauaccagcaccauuaggaacuccagacuuuguaggaaaaauacaaggaguacuuacccaaacaacaaaagaagauggaagcaccagaggacacaaagcaacagucuauacaggaucagcaccauuuacaccaaaauuaggaucaguccaauucucaacagauacagaaaacgauuucgaaacacaccaaaauacuaaauucaccccaguuggcguaauacaagacggauccacaacgcacagaaacgaaccucaacaauggguacuaccaucuuacagcggaagaaacguacacaacguucacuuagcuccugcaguagcaccaacauuuccaggagaacaacuacuauuuuuccgcucaaccaugcccggcugcucaggauauccaaacauggaucuagauugccuacuaccacaagaauggguacaacauuuuuaccaagaagcugcuccagcucaaucugauguugcauuacuaagauucguaaauccagauacaggucgaguacuuuuugaaugcaaauuacauaaaucuggauaugugacaguagcacacacuggucaacaugaucuagucauacccccuaacggauacuucagauuugacucauggguaaaucaauuuuacacauuagcucccaugggaaacggaacagguagaagacgauaa

SEQ ID NO: 33730 - RNA, 1617 nt, Artificial Sequence
  derived and/or modified sequence opt6 from VP1__Norovirus_and/or_Norovirus-like__KU182483
augaaaauggcaucaaaugaugcaacaccuagugacggcucuacagcaaacuuaguaccagaaguaaacaacgaaguaauggcacucgaaccuguaguaggagcagcaaucgcugcaccaguugcaggacaacaaaacguuauagaccccuggauacgaaauaacuucguacaagcaccuggaggagaauuuacaguuucuccaagaaaugcaccaggagaaauauuauggucagcacccuuagguccagaccuaaauccuuaucuaucacauuuagcaagaauguauaauggcuaugcaggaggauucgaaguacaaguaauauuagcgggaaaugcauucacagcaggaaaaaucauauucgcagcaguuccaccuaauuuucccacagaaggccuaucaccaucacaaguaacaauguuuccacacauaauaguagacguuagacaauuagaaccgguauuaauaccacuaccagacguccguaauaauuucuaucacuauaaccaaucaaacgauccaacuauaaaauuaauagcuaugcuauauacaccacuccgagcuaacaaugcaggcgaugacgucuuuacaguaucaugccgaguucuaacucgaccuucacccgauuucgauuucauauuuuuaguacccccuaccguagaaucgagaacaaaaccuuucuccguaccaauauuaacuguagaagaaaugacaaauucaagauuuccaauaccucuagaaaaauuauuuacaggaccauccucagcauuugucguccaaccacaaaacggaagguguaccacagacggcguccuauuaggaacaacacaacuaucaccagucaacauuugcacuuuuagaggagauguuacucacauugcagguacccaaaauuauacaaugaaucuagcuagccaaaacuggaacaacuacgauccaacagaagaaauuccugcccccuuaggaacaccagacuuuguaggaaaaauacaaggagucuuaacacaaaccacacgaagagacggaucaacccgcggacacaaagcuaccguaucaacuggauccguacacuuuaccccaaaauuaggaaguguacaauuuucaaccgauacaucuaacgacuuugaaacuggucaaaauacuagauucacuccaguuggaguaguucaagauggaucaacaacacaucaaaaugaaccacaacaauggguacuaccagacuauucuggacgagauucacacaacguccaccuagccccugcaguagcaccaacauucccaggugaacaauuacucuucuuuagaucaacuaugccaggauguucagguuauccaaauaugaaucuagacugucuauuaccacaagaauggguacaacacuuuuaccaagaaucagcuccugcacaauccgacguugcacuuuuaagauuugucaauccagacacagguagaguauuauuugaaugcaaauuacauaaaucugguuauguaaccguugcacacacuggacaacaugaucuuguaauaccuccaaauggauacuuucgauuugauucuuggguaaaucaauuuuacacacucgcaccaaugggaaauggcgcaggacgaagaagauaa

SEQ ID NO: 33731 - RNA, 1617 nt, Artificial Sequence
  derived and/or modified sequence opt6 from VP1__Norovirus_and/or_Norovirus-like__AB665364
augaaaauggcaagcaaugacgcuaaucccuccgauggauccgcagcaaauuuaguacccgaaguaaauaacgaaguaauggcauuagaacccgucguaggagcagcuauugcagcuccagucgcaggccaacaaaauguuauugauccauggauaagaaauaauuuuguccaagcaccaggaggagaguucacaguaucaccuagaaaugcucccggagaaauauuauggucugcaccacuuggaccagaucuuaaucccuacuuaucucaccuagcaagaauguacaaugguuaugccggagguuucgaaguacaaguaauacuagcuggaaaugcauucacugcuggcaaaauaauauuugcagcuguaccaccuaauuuuccuacugaaggucuaaguccaucucaaguaacaauguucccacauauuauaguugacgucagacaauuagaaccaguuuuaauaccauuaccagauguaagaaacaauuucuaccacuauaaccaaagcaaugauucaacaauuaaauuaauagcuaugcuauauacaccacuaagagccaauaaugcaggagaagacguauuuacaguaucaugcagaguucuaacaagaccuuccccagacuucgacuuuauauuccuuguaccuccaaccgucgaaucaagaacuaaaccauuuacuguaccaauacuaacaguagaagaaaugacaaauucaagauuuccaauaccacuugaaaaacuauuuacaggccccucaucagcauucguaguacaaccucaaaacggaagaugcacaacagauggcgucuuauuaggaacaacacaauuaucaccuguaaauauuuguacauucagaggagauguaacccacauagcaggaucaagaaauuacacaaugaauuuagcauccuuaaacuggaacaauuacgauccaacagaagaaauuccagccccauuaggaacuccagacuucguaggaaaaauacaaggaguauuaacacaaacuacaaaaggcgauggauccacacgaggacauaaagcuacaguauacaccggaucagcucccuucaccccuaaacuaggcuccguacaauucucaacagauaccgaaaaugauuucgaaacccaucaaaacacaaaauucacuccaguaggaguaauacaagacggaucaaccacacacagaaaugaaccacaacaauggguauuaccaucauacucaggaagaaauguacaaaauguucauuuagcaccagcaguagcaccaaccuuuccaggagaacaacuacuuuucuuuagaucaacuaugccaggauguagcgguuauccaaauauggaucuugauugcuuacuaccacaagaauggguacaacacuucuaucaggaagcagcuccagcacaaucagacguagccuuauuaagauucgucaauccugacacugguagaguauuauuugaauguaaacuacauaaaucaggauauguuacagucgcucauacuggccaacaugaucuagucauaccacccaauggcuauuuccguuucgauucauggguaaaucaauuuuacacacuagccccaaugggaaacggcacaggaagacgaagguaa

SEQ ID NO: 33732 - RNA, 1617 nt, Artificial Sequence
  derived and/or modified sequence opt6 from VP1__Norovirus_and/or_Norovirus-like__AB663686
augaaaauggcaucuaaugaugcuaacccaucagacggaucugcagcaaacuuaguccccgaagucaacaaugaaguaauggccuuagaaccagucguaggagccgccaucgcagcaccagucgcuggacaacaaaauguuauagacccuuggauaagaaauaacuuuguacaagcaccuggaggugaauuuacaguaucucccagaaacgcaccaggagaaaucuuauggucugcaccauuagguccagauuuaaauccauauuuaucacauuuagcucgaauguacaacggauacgcuggaggauuugaaguacaaguaauauuagcuggaaaugccuucacagccgguaaaauaauuuuugcugcuguaccucccaacuucccaauagaaggucuaucaccaucucaaguaacaauguuuccacacauaaucguagacguaagacaacuagaaccaguauuaaucccucuaccagacguaagaaacaauuucuaccacuauaaccaaucuaaugauuccacaauaaaauuaauagccauguuauacacaccucuacgagcaaauaacgccggugacgauguauuuacaguaucauguagaguucuuacacgaccaucaccugauuuugacuuuauauuuuuaguacccccuacaguugaaucuagaaccaaaccuuuuacaguaccaauauuaacaguagaagaaaugacaaauucucgauuuccaauaccauuagaaaaauuauuuacagguccaucaucagcuuucguaguacaaccucaaaauggaagauguacaacugacggagucuuauuagguacaacucaauuaagcccuguaaauauauguacauucagaggagacguuacucauauugcuggcucacgaaacuauacaaugaaucuggcaucacuaucauggaauaacuacgacccaacagaagaaauaccagccccacuaggcacaccugauuuuguaggaaaaauacaaggaguauuaacacaaacaacuaaaggagauggaucuacccgcggccacaaagcaacaguuuauacuggaucagcacccuucacaccaaaauuaggaucaguacaauucucaacugauacagaaaaugauuucgaaacucaucaaaacacgaaauuuacaccaguaggaguuauccaagacggaggaacaacccauagaaacgaaccacaacaauggguauuaccuucuuauucuggaagaaauguccccaacguacauuuagcaccagcaguagccccaacuuucccaggugaacaacuauuauucuuucgaucuacaaugcccgguugcucaggauacccaaauauggauuuagacuguuuauuaccacaagaauggguccaacauuucuaucaagaagcagcaccagcacaaucagauguagcauuacuacgauucguaaacccagauaccgguagaguuuuauuugaauguaaauuacacaaaucaggauacguaacaguagcucacacuggacaacacgaucuaguuauaccaccaaauggcuauuucagauucgauuccuggguaaaucaauuuuacacccucgcuccuaugggcaacgguacugguagaagaagauaa

SEQ ID NO: 33733 - RNA, 1617 nt, Artificial Sequence
  derived and/or modified sequence opt6 from VP1__Norovirus_and/or_Norovirus-like__AB933702
augaaaauggcauccaaugacgcaaaccccucagauggaucagccgcaaacuuagucccagaagucaauaaugaagucauggcucuugaaccagugguaggugccgcaauugccgcaccaguagcaggccaacaaaacgucauagacccauggauaagaaauaacuuuguccaagcuccaggaggugaauuuacuguaucaccacgcaaugcaccaggagaaauauuauggucagcaccccuagguccagaccuaaauccauaucuaucacacuuagcccgaauguacaaugguuaugcaggcggauucgaaguucaaguaauacuagcagguaaugcauucacagcugguaaaauaauuuucgcagcuguaccaccaaacuuuccuacagaaggacuuucaccuucacaaguaacaauguuuccacacauaauaguagacguacgacaacuagaaccaguacuaauaccacuaccagacgucagaaauaacuucuaucacuauaaccaaucaaacgacucaacaauuaaauuaauagcaauguuauacacaccauuacgagcaaauaaugcaggagaagaugucuuuacaguaucauguagagucuuaacacgcccaucaccugauuuugacuucauauucuuaguaccuccuacaguugaaucaagaacaaaaccuuuuacagucccuauacuuacaguugaagaaaugaccaauaguagauuuccaauaccauuagaaaaauuauuuacaggacccucaucagcauuuguaguccaaccacaaaacggucgauguacaacagacggaguacuacuuggaacaacacaacuaucacccguaaauauauguacauuuagaggcgacguaacacauauagcaggaucacgcaauuacacaaugaaucuagccuccuuaaauuggaauaauuaugauccaacugaagaaauaccagcaccucuaggaacaccagacuuugucggaaagauacaagguguccuaacacaaacuacaaaaggugacgguucaacacgaggacacaaagcuacuguauacacaggaucagcuccauuuacaccuaaauuaggcuccguccaauuuucuacagauacagaaaacgauuucgaaacacaccaaaauaccaaauucacaccugucggcguaauucaagauggauccacaacacaccgaaacgaaccucaacaauggguacuaccaucuuauucaggaagaaauguacccaauguacauuuagcaccagcaguagcaccaacuuuuccaggugaacaauuauuauuuuucagaucaacaaugccaggaugcucuggauauccuaauauggaucuagauuguuuauuaccacaagaauggguucaacauuuuuaccaagaagcagcaccagcacaaucugauguugccuuacuaagauuuguaaacccagauacaggaagaguccuauucgaaugcaaacuacacaaaagcggauauguaacuguagcacauacaggacaacacgaucuaguuauaccacccaacggauauuucagauuugauucaugggucaaccaauucuacacauuagcuccaaugggcaauggaaccggaagaagaagguaa

SEQ ID NO: 33734 - RNA, 1617 nt, Artificial Sequence
  derived and/or modified sequence opt6 from VP1__Norovirus_and/or_Norovirus-like__AB933685
augaaaauggccucaaacgacgcuaauccaagcgauggcucagcugcaaacuuaguaccagaaguaaauaaugaaguaauggcccuagaaccuguaguaggcgcagcaauagcagcaccaguagcaggucaacaaaaugugauugacccuuggauacguaauaacuucgugcaagcaccaggaggagaauuuaccguuucaccaagaaaugcacccggagaaauacuuuggucagcaccacucggcccagauuugaacccauaccuuucacaucuagcaagaauguacaacggauacgcaggcggauucgaaguacaaguaauacucgcaggaaaugcauuuacugcuggaaaaauaauauucgcugcaguaccaccaaacuuuccaacagaaggauuaucuccaucacaaguaaccauguucccacacauaauaguugacguaagacaauuagaacccguacuaauaccauuaccagauguaaggaacaauuucuaccacuauaaccaaucaaacgacucaacaauaaaacuaauagcaauguuauauacaccacuaagagcuaacaaugcaggagaagaugucuucacagucucaugcagaguauuaaccagaccaucaccagacuucgauuuuaucuuucucguacccccuacaguagaaucccgaacaaagccauucacaguaccaaucuuaacuguugaagaaaugaccaauucacgauuuccaauuccauuagaaaaauuauucacagguccauccuccgcuuucgucguacaaccccaaaacggacguuguacaacagacggaguacuauuaggaacaacacaacucucaccaguaaauaucugcacauuucgaggagacguaacucauauagcagguucacgugauuacacuaugaaccuagcaagccucaacuggaauaauuacgaucccacugaagaaauaccagcaccacucggaacacccgacuucguaggaaaaauucaaggaauguuaacacaaacaacaaaaggcgacggcuccacaagaggacacaaagcaacagucuauacuggaucugcacccuuuacaccaaaacuaggaucaguaagauucucaacagacacagaaaaugacuucgaaauacaucaaaauacuaaauucacacccguaggaguaauacaagacggaagcaccacacaucgaaacgaaccacaacaaugggucuuacccucauacucaggaagagaugcccauaacguacacuuagcacccgcaguagcuccuaccuuuccaggugaacaacuauuauucuuucgcucuacaaugccagguugcaguggauauccuaauauggaccuagauuguuuacuaccacaagaauggguacaacauuuuuaucaagaagcagcacccgcucaaucagacguugcucuuuuaagauucguuaacccagauacaggacgaguauuauuugaaugcaaacuacacaaauccggauacguuacaguagcacauacuggacaacacgaucuuguuauaccaccaaacggauauuucagauucgauucauggguaaaccaauuuuacacccuagcaccaauggguaauggcacuggacgacgaagauaa

SEQ ID NO: 33735 - RNA, 1617 nt, Artificial Sequence
  derived and/or modified sequence opt6 from VP1__Norovirus_and/or_Norovirus-like__AB933645
augaaaauggcaucaaaugacgcaacaccaucagauggaucagcugcaaauuuagucccagaaguuaacaacgagguaauggcucuagaacccguaguaggcgcagcaauagcugcaccaguagcaggacaacaaaauguaauagacccauggauaagaaauaacuuuguccaagcaccaggcggagaauuuacgguuucaccuagaaaugcaccaggcgaaauacucuggucagcaccacuaggaccugaccuaaauccuuaucucucacauuuagcaagaauguauaacggauaugcuggcggauuugaaguacaaguaauucuagccggaaacgcuuuuaccgcuggaaaaauaauauuugcagccgucccaccaaauuuuccuacggaaggacuaucuccaucccaaguaacuauguuuccccacauuauaguagaugucagacaacucgaaccaguauuaauaccuuuaccagauguaagaaauaauuuuuaucacuacaaccaaagcaaugauucaaccauaaaauuaauagcaaugcuauacacccccuuaagagcuaacaacgcaggagaagaugucuuuaccgucucauguagaguacucacacgaccuuccccugauuucgauuucauauuucuuguaccaccuacaguagaaucaagaacaaaaccauuuacagucccaauauuaacuguggaagaaaugacaaauucaagauuucccauuccauuagaaaaacuauucacaggcccaucaucagcauuuguuguacaaccacaaaacgguagauguacaacugauggagucuuauuaggcacaacacaacuuucaccaguaaacauaugcacauuuagaggagacgucacucauauagcaggcucaagaaacuauaccaugaaucuagcaucauuaaacuggaacaauuaugacccaacugaagaaauuccagcaccuuuaggaacaccagauuuugucgguaaaauacaagguguacuaacacaaacaacuaaaggagacggaucaacacgaggucauaaagccacagucuauacagguucugcaccauuuaccccaaaacucggaucaguacaauucucaacagacacagaaaaugauuucgaaacacaccaaaacacaaaauucacaccaguaggcguuauacaagauggaggaacaacacaucgaaacgaaccacaacaauggguauuaccaucauauucuggcagaaauguaccuaacguucaccuagcuccagcagucgcuccaacauuuccaggugaacaacuacuuuucuuuagaucaacaaugccuggaugcucaggcuauccaaauauggauuuagacugcuuacuaccacaagaauggguacaacauuuuuaucaagaagcagcaccagcccaaucagacguugcacuucuacgcuucguaaacccagauacagguagaguuuuauucgaauguaaacuacauaaaucaggauacguaacuguagcacacacaggccaacacgaucuuguaauaccaccaaauggauauuuucgcuucgauucauggguaaaucaauuuuacacauuagcaccaaugggaaacgguacaggccgacgaagauaa

SEQ ID NO: 33736 - RNA, 1617 nt, Artificial Sequence
  derived and/or modified sequence opt6 from VP1__Norovirus_and/or_Norovirus-like__LC005706
augaaaauggcaucaaaugacgccaacccuucagaugguucagcagcuaauuuaguacccgaaguaaauaaugaagucauggcauuagaaccaguaguaggugcagcaaucgcagcaccaguagcaggacaacaaaacgucauagauccuuggaucagaaauaacuucguacaagccccagguggagaauuuacaguuuccccaagaaaugcaccaggagaaauauuauggucagcaccacuagguccagaucuaaauccauauuuaagccauuuagcaagaauguacaacggauacgcaggaggauucgaaguacaagucauauuagcuggaaaugcauuuaccgcaggaaaaaucauauuugcugcagucccaccuaacuuucccacagaaggacuaucaccaucacaaguaacaauguucccacacaucaucguugauguuagacaauuagaaccuguacuaauuccacuaccagauguacgaaauaauuucuaucacuauaaucaaucaaaugauucaacaauuaaacuaauagcaaugcuauauacaccacuaagagcuaacaaugccggagaagauguauuuacaguuuccugccguguuuuaacucgaccauccccagauuuugacuuuauauuucuaguaccaccaacaguagaaucgagaacuaaaccauucaccguaccuauacuaacaguagaagaaaugaccaacucaagauuucccauuccauuagaaaaacuuuucacaggaccaucuucagcauuuguaguacaaccacaaaauggaagauguacaacagauggaguacuucuaggcacuacacaauuaucacccguaaacauauguacauuuagaggcgacguaacccauauagccggaucuagaaauuacacaaugaaucuagcaucuuuaaacuggaauaauuaugauccuacagaagaaauuccugcaccacuaggaacaccagauuuuguaggaaaaauacaaggaguacuaacacaaacaacaaaaggugacggaaguaccagaggacauaaagcaacaguuuacacaggaucagcaccauucacaccaaaauuagguuccguucaauucuccaccgacacagaaaaugauuuugaaacacaucaaaauacaaaauucacaccaguaggcguaauacaagacgguucuacaacacauagaaaugaaccacaacaauggguacuaccaucauacucggguagaaacgcacauaacguucacuuagcacccgcaguagcaccaacauucccaggugaacaacuauuguucuuucggucuacaaugccaggaugcucaggauacccuaacauggaucuagauugccuauuaccacaagaauggguacaacauuucuaccaagaagccgcccccgcacaaucagacguagccuuacuaagauuuguaaauccugacacaggacgaguauuauucgaauguaaacuacauaaaucgggcuauguaacuguugcacacacaggucaacacgauuuaguaauaccaccaaauggauauuuuagauucgacucauggguaaaucaauuuuacacacuagccccaaugggcaacggaacgggaagacgacgauaa

SEQ ID NO: 33737 - RNA, 1617 nt, Artificial Sequence
  derived and/or modified sequence opt6 from VP1__Norovirus_and/or_Norovirus-like__KM198562
augaaaauggcaucaaaugacgcaaacccaucagacgguucggcagcaaaccuaguaccugaaguuaauaaugaaguaauggcuuuagaaccuguuguaggagccgcaaucgcagcuccuguugcaggacaacaaaaugucauagacccauggauuagaaauaacuuuguacaagcaccugguggagaauuuaccguaucaccacgaaacgcaccaggagaaauauuauggucagcaccuuuaggacccgaccuaaauccuuaucucucucauuuagccagaauguacaacggauaugcugguggauucgaaguccaaguaauauuagcaggaaaugcauucacagcagguaaaaucauauuugcagcagucccaccaaauuuuccaacagaaggacuaucaccaucacaaguaaccauguucccacacauaauaguagacguacgacaauuagaacccguucucauacccuuaccagauguacgaaacaacuuuuaccauuauaaccaaucaaaugacucaacuaucaaacuaauagcaauguuauacacaccauuacgagcaaacaaugcaggggaagauguauucacaguaucaugucgaguauuaacucgaccuucuccugauuuugacuucauuuuucucgucccaccuaccguagaaagcagaacaaaacccuucacagucccaauacuaaccguagaagaaaugacaaacucacgcuuuccaauaccauuagaaaaacuuuucacaggaccaucaggcgcauucauuguucaaccucaaaacggacgauguacaacugauggaguauuacuagggacuacucaauuaucaccgguuaacauauguacauuucgaggugacguaacucauauagcaggauccagagauuauacuaugaauuuagcaucacuuaauuggaauaauuaugaccccacugaagaaauacccgcuccuuuagguacuccagauuucgucggaaagauacaaggcguccuaacucaaacaacaaaaggagacgguucuacaagaggacacaaagcuacaguauauaccgguucugccccuuucacaccaaaauuaggaucgguacaauucucaacagacacagaaaacgauuucgaagcccaucaaaauaccaaguucaccccaguagguguaauacaagaugguggaacaacacacagaaaugaaccacaacaauggguauuaccaucauauucuggccgagauguacauaauguccacuuagcaccagcaguugcaccaacuuuucccggagaacaacuuuuauucuuuagaucaacaaugccaggauguaguggauauccaaacauggacuuagacugccuauuaccacaagaauggguucaacauuucuaucaagaagcagcuccagcacaaucagauguagcacuauuacgauucguaaacccagauacuggacgaguauuauucgaauguaaacuucauaaaucaggauauguaacuguagcucacacuggacaacacgaccuaguaauaccaccuaauggauacuucagauuugauucauggguaaaucaauuuuacacauuagccccaaugggaaacggaacagguagaagaagauaa

SEQ ID NO: 33738 - RNA, 1617 nt, Artificial Sequence
  derived and/or modified sequence opt6 from VP1__Norovirus_and/or_Norovirus-like__KC409311
augaaaauggcuucaucagacgcaaaucccucagauggaaguacagcaaaccucgucccagaaguuaacaaugaaguaauggcacuugagccuguaguaggagcagccaucgccgccccagucgcaggucaacaaaauguaauagacccuuggauccgcaauaauuuuguccaagcuccuggaggagaauuuacaguaucaccacgaaaugcaccaggagaaauauuauggucagcaccccuaggacccgaucuaaacccauaucuaucucaccuagcaagaauguauaacggauacgcaggagguuuugagguccaaguuguacuagcaggaaaugcauucacagcuggaaaaauaauauuugcugcaguaccuccaaacuucccuacagaaggucucucaccaucacaaguaaccauguuuccacacaugauuguagacguaagacaauuagaaccaguacuaauuccauuacccgacguacgaaacaacuucuaucacuauaaucaaucuaaugacccaacaauaaaacuaauagcaauguuauauacaccauuaagagccaacaaugcuggugacgaugucuuuacaguuucaugucgcguauuaacuagaccauccccugacuucgacuucauauuccuaguacccccaacuguagaaucacgaacuaaacccuucucaguaccaauauugacaguagaagaaaugacaaauucucgauuuccaauuccacuugaaaaauuauuuacaggaccaucaucugcauucguaguucaaccacaaaauggacgauguaccacagauggcguacuauuaggaacaacucaauuaucaccugucaauauaugcacuuuucgaggagacgucacccauauaacuggaagccauaauuacacaaugaaucuugcaacacaaaauuggaacucuuaugauccaacagaagaaauuccagccccuuuaggaacuccagauuucguaggcaaaauacaagguguauuaacacaaacaacacgagcagauggaucuacacgaggacacaaagcaacaguauacacagguucagccgauuucgcaccuaaacucggcagaguacaauuugcaacagauacaaauaacgaucucggugcaaaucaaaacacaaaauucacaccaguaggaguuauacaagacggagguacagcacacagaaacgaaccucaacaauggguacuuccaucauauucaggccgaaacucacauaacguccaucuagcuccugcaguagcacccacauuuccuggugaacaacuauuauucuuuagaucaacaaugccagguugcucaggauauccaaacauggaccuagauugucuacuaccucaagaauggguccaauauuucuaucaagaagcagcaccagcacaaucagauguugcauuauuaagauuuguaaacccagacaccggcagaguauuauuugaaugcaaacuacauaaaucaggauauguaacuguagcgcauacaggccaacaugacuuaguaauaccaccaaauggauauuuuagauuugacucauggguaaaccaauuuuacacacuagcaccaaugggaaauggaacuggacgaagaagauaa

SEQ ID NO: 33739 - RNA, 1617 nt, Artificial Sequence
  derived and/or modified sequence opt6 from VP1__Norovirus_and/or_Norovirus-like__KC409263
augaaaauggccuccaacgacgcaaauccuuccgacggaucagcagcaaaucuaguaccagaaguaaacaacgaaguaauggcauuagaacccgucguuggugccgcaauagcagcuccaguagcuggucaacaaaauguaauagacccauggauaagaaacaauuuuguucaagcuccugguggagaguucacaguaucuccaagaaaugcgccaggagagauacucuggucagcaccgcuaggaccagacuuaaauccauaccuaucacaucuagcaagaauguacaacgguuaugcuggaggcuucgaaguccaagucauauuagcugguaaugcauuuacagccggaaaaaucauauucgcagcaguaccaccaaacuuuccuacugaaggacuaucaccgucucaaguuacaauguuuccccacauaauaguagacguaagacaauuagaaccaguacuaauaccauuaccugacgucagaaacaauuucuaucacuauaaccaaucaaacgauucaacaauaaaauuaaucgccauguuauauacuccccuaagagcuaauaaugcaggagaagauguauuuacagucucauguagagucuuaacuagaccuucaccagauuucgacuuuauauucuuaguaccaccaacaguagaaucaagaacuaaaccauuuacaguaccaauccucacaguugaagaaaugacaaacucacgauuuccuauaccacuagaaaaacuauuuacuggaccaucaggugcuuucguuguacaaccacaaaacgguagaugcacaaccgaugguguacuauuaggcacaacacaauuaucaccuguaaauauauguacuuucagaggagacguuacacacauagcuggaucaagagacuauacaaugaauuuagcaucauuaaacuggaauaauuaugauccaacagaagaaauaccugcuccauuagguacaccagacuucguagguaaaauacaaggaguauuaacccaaacaacaaaaggagaugguucaacuagaggacacaaagccacaguauauacagguuccgcaccuuucacaccaaaauuaggaucaguacaauucucaaccgauacagaaaaugauuuugaagcacaucaaaauaccaaauuuacaccaguuggaguaauacaagauggaggaacuacacaccguaaugaaccucaacaauggguacucccuucauauucaggcagagauguucauaacguucauuuagccccugcaguagcaccaacuuuuccaggugaacaauuacuauucuuucgcucaacaaugccuggaugcucuggcuacccuaauauggaccucgauugucuacuaccucaagaauggguucaacauuuuuaucaagaagcagcaccagcccaaucagacguagcccuuuuaagauuuguuaauccagauacaggaagaguccuuuuugaaugcaaauuacacaaaagcggauauguaacaguagcacauacaggacaacaugauuuaguaauacccccaaauggauauuucagauucgacucaugggucaaucaauuuuauaccuuagcuccaaugggaaauggaacaggaagaagaagauaa

SEQ ID NO: 33740 - RNA, 1617 nt, Artificial Sequence
  derived and/or modified sequence opt6 from VP1__Norovirus_and/or_Norovirus-like__JX459900
augaaaauggccucaaaugacgcaaauccuagcgauggaagcgccgcaaacuuaguaccagaaguuaacaaugaaguaauggccuuagaacccguaguaggcgcagcaauagccgcaccaguagcaggacaacaaaacguaauugacccauggauuagaaacaauuuuguacaagccccaggcggagaauuuacuguaucaccaagaaacgcaccaggagaaauucuauggucagcaccauuaggaccagaucucaacccauacuuaucacacuuagccagaauguauaacggauacgcaggaggauuugaaguacaaguaauccuagcaggcaaugcuuuuacagcaggaaaaauaauauucgcagccgucccuccaaacuuuccaacagaaggacuaucuccaucacaaguaacaauguucccucauauaauaguugacgucagacaacuagaaccaguacuuaucccuuuaccagauguaagaaauaauuuuuaucauuauaaccaauccaacgacucuacaauuaaacucauugcaauguuauauacaccacuacgagcaaacaaugcuggugaugauguauuuacaguaagcugccgaguauuaacaagaccaucacccgacuuugacuuuauauuucuaguacccccaacagucgaaaguagaaccaaacccuuuucagucccuauauuaacaguagaagaaaugacaaacucuagauuuccaauaccauuagaaaaacuauuuacaggaccaucaucaacauuugucguacaaccccaaaauggucgauguacaacagauggcguccuuuuaggaacaacacaauuaucaccuguaaauaucuguacauuuagaggugauguuacccacauugcaggaucacgaaacuacacaaugaaucuagcaucucaaaacuggaacucauacgacccaacagaagaaauuccugccccucuaggaacaccagauuuuguaggaaaaauacaagguguccuuacacaaacaacacgaacagacgguucaacacgaggacacaaagcaacgguauauaccggauccgccgauuuuagucccaaacuaggacgaguacaauucgccaccgauacagauaacgauuucgacgcuaaccaaaacacaaaauuuacaccaguaggaguaauacaagacgguaacacugcccauagaaaugaaccacaacaauggguucuuccuuccuauucaggacgaaacacacauaacguacaccuugcaccagcaguagcgccaacauucccaggugaacaacucuuauucuucagaucaacaaugcccggaugcucaggauauccaaauauggaucuugacugccuacuaccccaagaauggguacaauauuuuuaucaagaagcagcaccagcacaaucagacguagccuuacuacgauucguaaauccagauacaggcagagucuuauucgaaugcaaacuacauaaaucaggauaugugaccguugcucacacaggacaacacgauuuaguaaucccaccaaauggcuauuuuagauucgauucaugggucaaucaauuuuacacuuuagccccaaugggaaauggaacaggcagacgaagauaa

SEQ ID NO: 33741 - RNA, 1617 nt, Artificial Sequence
  derived and/or modified sequence opt6 from VP1__Norovirus_and/or_Norovirus-like__JX459617
augaaaauggcaucaaacgaugccaauccaagcgauggauccgcagcuaacuuaguaccugaaguaaacaaugaaguaauggcacuugaaccaguaguuggagccgcaauagcagcaccuguagcaggucaacaaaauguaauagauccuuggauaagaaauaacuuuguacaagcaccagggggagaauuuacaguaucaccuagaaacgccccaggugaaauauuauggucggcaccauuaggaccagaucuaaauccauaucuaucccauuuagcccgaauguacaacggauacgcaggaggauucgaaguacaaguuauacuagccggaaaugcauuuacagcagguaaaauaauauucgcagcaguucccccaaauuuuccaacugaaggacuaucuccaucacaaguaacaauguucccccacauaaucguugauguuagacaauuagaaccaguauuaaucccuuuaccagauguaagaaauaauuucuaccacuauaaccaauccaacgacaguacaauuaaacuaauagcaaugcuauacacaccauuacgagcaaauaaugcaggagaagauguauuuacaguaucaugcagaguacuaacacgaccauccccagauuucgacuuuauauuuuuaguuccuccaacaguagaaucuagaaccaaaccauuuacuguaccuauucuaacagucgaagaaaugacaaauucaagauuuccaauaccauuagaaaaacucuuuacuggaccaagcuccgcuuuuguaguacaaccacaaaacggaagauguacaacagauggaguauuacuaggaacaacacaauuaucaccaguaaacaucuguaccuuucgaggagacguaacucacaucgcaggaucaagaaauuauacaaugaaucuagcuucucuaaauuggaacaacuaugacccuacagaagaaauaccggcaccucuugguacuccagauuucguuggaaaaauacaaggcguuuuaacccaaaccacaaaaggagauggcucaacaagaggacauaaagccacugucuacacuggaucagcaccuuuuacaccaaaauuagguucaguacaauuuucaacagauacagaaaacgauuucgaaacacaccaaaauacaaaauucacaccagucgguguaauacaagauggauccacaacacacagaaaugaaccccagcaauggguccuuccaucuuauuccggcagaaauguacauaacguacacuuagccccugcaguagcaccaacuuuuccaggagaacaauuacuauuuuucagaucaacaaugccaggauguuccggauauccuaauauggaucuagauugccuuuuaccacaagaauggguacaacauuuuuaucaagaagcagccccugcacaaucagacguagcauuacuaagauucgucaauccagacacaggucgaguuuuauuugaaugcaaauuacauaaaucuggauaugucacuguagcacauacaggacaacaugaccuaguaauaccgccuaacggauacuuucgauucgauucauggguuaaccaauucuauacacuagcaccaauggguaauggcacaggaagaagaagauaa

SEQ ID NO: 33742 - RNA, 1617 nt, Artificial Sequence
  derived and/or modified sequence opt6 from VP1__Norovirus_and/or_Norovirus-like__GQ845366
augaaaauggccucaaaugacgcuaauccuucagauggaucagcagcgaaccuagucccagaaguaaauaaugaaguuauggcacuagaaccuguaguaggagcagcaauugccgcaccaguagcaggacaacaaaacguaauagacccuuggauccgaaauaauuuuguacaagcccccgguggagaauuuacaguaucuccaagaaaugcuccaggagaaauacuuuggucugcaccucuuggaccagacuuaaaccccuacuuaucacacuuggcaagaauguauaacgguuaugcuggaggauucgaaguucaaguaauacuugcaggaaaugcauucacagcaggcaaaaucaucuuugcagcaguuccuccaaauuucccaacagaagguuuaucaccaucacaaguaacaauguucccacacauaauagucgacguacgacaauuagaaccugucuuaauaccacucccagacguuagaaacaauuucuaucacuacaaccaaaguaaugauaguacaauaaaacuaauagcuauguuauauacaccauuaagagcaaauaaugcaggagaagauguauuuacaguaucaugucguguccuaacaagaccaucaccagauuucgauuucaucuuccucguuccaccaacaguagaaucaagaacaaaaccuuuuaccguaccaauacuaacaguugaagaaaugacaaacucucgauucccaauuccucuagaaaaacucuuuacaggacccucaucagcauucguaguacaaccacaaaauggaagaugcacaaccgacggaguacuauuagggacuacucaacuaaguccagucaauauauguaccuuucgaggagacguuacacacauagcaggcuccagaaacuauacaaugaaucucgcaucacuaaacuggaacaauuacgaucccacagaagaaauaccagcaccacucggaacaccagacuuugucggaaaaauucaaggcguacucacacaaacuacaaaaggagaugggagcacacgaggacauaaagccaccguauauacaggaucagcuccuuuuacaccaaaacuaggaucagugcaauucagcacagauacagaaaaugauuucgaaacacaccaaaacacaaaauucacuccaguuggaguuauacaagacggaggaaccacccaucgaaaugaaccacaacaauggguuuuaccaaauuauucaggaagaaauguaccaaauguacaucuagccccagccguagcuccaacauuucccggagaacaauuacuauucuuuagaucaacaaugccagguuguucaggauacccuaacauggauuuagauuguuuacuaccacaagaauggguacaacacuuuuaucaagaagcagcaccagcccaaagcgacguagccuuacuuagauuuguuaacccugauacaggaagaguauuauucgaaugcaaacuacauaaauccggauauguaacaguugcacacacaggucaacacgauuuaguaauaccguccaauggauauuucagauuugacucuuggguaaaccaauuuuauacacuagccccaauggguaacggcacaggcagacgacguuaa

SEQ ID NO: 33743 - RNA, 1617 nt, Artificial Sequence
  derived and/or modified sequence opt6 from VP1__Norovirus_and/or_Norovirus-like__GQ845345
augaaaauggcaucaucagacgcaaauccaucagauggaucaacagcaaauuuaguacccgaaguuaauaaugaaguaauggcuuuagaaccaguagucggagcagccaucgcagcaccuguagcaggccaacaaaauguaauagacccauggauaagaaauaacuuuguucaagcaccaggaggagaguucacaguaucaccaagaaaugcaccaggugaaauauuauggucagcaccuuuaggacccgacaugaauccauauuuaucacauuuagcaagaauguauaacgguuacgcuggcggauuugaaguccaaguaauauuagcagguaaugcauuuacagcaggaaaaauuauuuuugcugcaguacccccaaacuuucccacagaaggauuaucucccucacaaguaaccauguucccacacauaauaguagauguaagacaauuggaaccaguacuaauaccccuaccugauguaagaaauaauuuuuaucauuauaaucaaucaaaugauccuacuauaaaacuaauagcaaugcuuuacacuccauuaagagcuaacaaugcaggagacgauguauucacaguauccuguagaguacuuacaagaccauccccagauuuugacuucauauucuuaguacccccuacaguagaauccagaacuaaaccauuuucaguaccaauauuaacuguagaagaaaugacaaacucaagauucccuauuccauuagaaaaacuauuuaccggaccaaguuccgcauucguaguacaaccccaaaauggaagauguacaacagauggaguacuacuaggaacaacacaauuaucacccgucaauauuugcaccuuuagaggcgacguaacccauauagcaggcucacgaaacuauaccaugaauuuagccucacaaaacuggaacucauaugacccaaccgaagaaauaccugcuccauuaggaacaccagacuucguaggaaaaauacaaggaguucuaacccaaacaacccgaacugaugguuccacuaggggacacaaagccacaguauacacaggaucugcggacuuuucccccaaauuaggaagaguacaauuugcaacagacaccgauaaugauuucguagcaaaccaaaauacaaaauuuacaccaguaggaguuauacaagauggaaauacagcucacagaaaugaaccacaacaauggguucuaccaucuuauucaggacgaaauacacauaauguacauuuagccccugcaguagcaccaacauuccccggagaacaauugcuuuucuuuagaucaacaaugccagguugcucuggauauccaaacauggaucuagacugccuacucccacaagaauggguccaauacuuuuaucaagaagcagcaccagcacaaagcgauguagcauuauuaagauucgucaauccagauaccggaagaguucuauuugaaugcaaacuacauaaaucaggauacguaacuguugcacauacuggacaacaugaccucguuauacccccgaauggcuauuucagauucgacaguuggguaaaucaauuuuauacacuagcucccaugggaaacggaaccggaagaagaagauaa

SEQ ID NO: 33744 - RNA, 1617 nt, Artificial Sequence
  derived and/or modified sequence opt6 from VP1__Norovirus_and/or_Norovirus-like__GQ845341
augaagauggccucaaacgaugcaaacccaucugauggaucugcagcaaacuuaguaccagaaguaaacaaugaaguaauggcucucgaaccaguuguaggagcugcuauagccgcuccagucgccggacaacaaaauguaauagacccuuggauaagaaacaacuuuguacaagcaccaggaggugaauuuaccgugucaccaagaaaugcaccaggagaaauccuaugguccgcaccccucggaccugacuuaaauccauaucuaucacaccuagcacguauguacaaugguuaugcaggaggauucgaaguccaaguaaucuuagcaggaaaugcauuuacugccgguaaaauaaucuuugcagccguaccaccaaacuucccaacagaaggacuaagucccucucaaguaacuauguucccacacauaauaguagauguaagacaacuagaaccaguacuaauuccacuaccagauguaagaaauaauuucuaucacuauaaccaaucaaaugauaguacaauaaaacucauagcuauguuauauacaccauuaagagccaauaaugccggugacgauguauuuacaguaucuugcagaguucuaaccagaccaucaccagauuuugauuucauauuuuuaguuccaccgacagucgaaucucgaacaaaaccauuuacaguacccauauuaacagucgaagaaaugacaaauucacgcuucccuauaccauuagaaaaauuauuuacagguccaucaggagcauucguagugcaaccccaaaauggcagauguacaacugauggaguauuacuaggaacuacucaacuaucuccaguaaacaucugcacauuuagaggugauguaacacauaucgccggaucaagagauuacaccaugaaucuagcuuccuuaaacuggaacaauuaugauccaacagaagaaauaccugcaccacuuggaacaccagacuucguaggcaaaauacaaggaguauuaacucaaacuacagaaggugauggaucaacucgaggacacaaagcuacaguauauaccgguucagcacccuuuacaccaaaauuaggaucaguacaauucuccacagauacagaaaacgacuucgaaacacaucaaaauacaaaauucacuccaguagguguaauacaagacgguucaacaacacaucgaaaugaaccacaacaauggguucucccaucuuauuccggaagaaauguucauaauguacauuuagccccugcaguagcaccuacuuuccccggagaacaauuauuauucuuuagaucaacaaugccuggaugcucuggauauccaaauauggauuuagauuguuuauuaccacaagaauggguucaacauuuuuaucaagaagcagcaccagcacaaagcgauguagcucuuuuaagauuuguuaacccugacaccggacgaguauuauucgaaugcaaauuacauaaaucuggauacguaaccguagcacacacuggacaacacgaucuaguaauaccaccaaaugguuauuucagauuugauuccuggguaaaucaauucuauacauuagcaccaaugggaaauggcacaggaagaagaagauaa

SEQ ID NO: 33745 - RNA, 1617 nt, Artificial Sequence
  derived and/or modified sequence opt6 from VP1__Norovirus_and/or_Norovirus-like__HQ005292
augaaaauggcuuccucagacgcaaacccaucagacggauccaccgccaauuuaguaccagaaguaaacaacgaaguaauggccuuagaacccguugucggagcagcaauagcagcaccaguugcaggacaacaaaaugucauagacccauggauaagaaacaauuuuguacaagcacccgguggagaauuuacaguuucaccuagaaacgcacccggagaaauacucuggucugccccucuaggaccagacuuaaacccauauuuaucacaccuugccagaauguauaauggauaugccgguggcuucgagguacaaguaauccuagcaggaaaugcauucaccgcagguaaaauaauauuugcugcaguaccaccuaauuuuccuacagaaggccuaucuccaucucaaguaacaauguucccacacauaauagucgaugucagacaauuagaacccguucuaauaccacuccccgaugucagaaacaauuuuuaucauuauaaucaauccaaugauccaacaauaaaacuaauugcaauguuauacacaccacuaagagccaacaaugccggagacgacguuuucacaguaucuuguagagugcuuacaagacccucaccagauuucgacuuuauauuuuuaguuccaccaacuguugaaaguagaacaaaaccauucucaguuccaauccuaacaguagaagaaaugacuaacucuagauucccaauaccacuagaaaaauuauucacaggaccaagcagcgcuuucguuguacaaccucaaaacgguagaugcacaacagacggaguauuacuuggaacaacacaacuauccccaguaaauauauguacauuuagaggagacguaacccauauagcaggcucaagaaauuauacuaugaaccuagcaacacaaaacuggaacucauaugauccaacagaagaaauaccagcaccacucggcaccccagauuuugucggaaaaauucaaggagucuuaacacaaacaacaagagcagacggaucaacaagaggacauaaagcaacuguauacacaggaucagcugauuuuucaccuaaacuaggccgaguacaauucgcuacugauacagacaacgacuuugaugcaaaucaaaauacaaaauucacaccaguaggaguaauacaagacggaaauaccgcacaucgaaaugaaccacaacaauggguuuuaccaucauacucuggccgaaacucacacaacguacacuuagccccugcaguagcacccacauuuccaggugaacaacuccuauucuuuagaucaacuaugccuggaugcucaggauauccuaauauggaccuagauugcuuauuaccacaagaauggguacaauauuucuaucaagaagcagccccugcacaaucagacguagcauugcuaagauucguaaaccccgacacaggacguguauuauucgaaugcaaauuacauaaaucuggauauguaacaguagcccacacaggacaacacgaucuaguuauuccacccaauggauacuucagauucgacucuuggguaaaucaauucuacacacuagcucccaugggaaauggcacaggucgccguagauaa

SEQ ID NO: 33746 - RNA, 1617 nt, Artificial Sequence
  derived and/or modified sequence opt6 from VP1__Norovirus_and/or_Norovirus-like__HQ456321
augaaaauggcaucaaacgaugcaacacccuccgauggaaguaccgcaaauuuaguaccagaaguaaauaaugaaguaauggcacuagaacccguaguaggagccgcuaucgcagcacccguagccggacaacaaaauguuauagacccauggaucagaaauaauuuuguacaagcaccuggaggagaauuuacaguuucaccuagaaaugcaccaggcgaaauccuauggucugccccuuuagguccugaucuaaauccuuaccuaucccaccucgcaaggauguacaauggauacgcugguggauucgaaguacaagucauauuagcaggaaaugcauuuacagccggcaaaauaauuuucgcagcaguaccgccaaacuuucccacugaaggacuaucaccaucacaaguaaccauguucccacacauaauaguugauguucgacaacuugaaccaguacucauuccauuaccagauguaagaaauaacuuuuaccacuauaaccaaucaaaugauccaacaauaaaacuaauugcaaugcuauacacaccucuaagagcaaacaacgccggugacgaugucuuuacuguaucuuguagaguacuaacacgaccaucaccagauuuugauuuuauauuccuaguaccaccuacaguagaaucucgcacaaaacccuuuaguguaccaauauuaacaguagaagaaaugacaaacucucgauuuccaauaccucuagaaaaacuauuuacuggaccauccucagcauucguaguucaaccccaaaacggaagauguacuaccgauggaguccuccuuggaacaacacaacuauccccaguaaauauauguacauuuagaggagacguaacacauauagcaggaacacaaaauuauacagucaacuuagcaucacaaaauuggaacaauuaugauccaacagaagaaauaccagcaccacuuggaacaccugauuucguaggaaaaauucaaggaguauuaacacaaacaacaaggagagacgguucaacacgaggucacaaagcaacuguaucuacuggaagcguacacuuuaccccaaaauuaggaucaguacaauuuucaaccgauacaucaaaugauuucgaaacuggacaaaacacaagauucacaccaguaggcguaguucaagacggauccacaacucaccaaaaugaaccacaacaauggguacuaccaaacuauucaggaagagauucucauaacguucaucuagccccagcuguagcaccaacauuuccaggugaacaacuauuauucuuuagaucuacaaugccaggauguucaggcuauccaaacaugaaccuagacuguuuacuaccacaagaguggguacaacacuucuaccaagaaucagcuccagcacaaagugacguagccuuacuacgauucguuaauccugacacuggaagaguauuauuugaaugcaaacuucauaaaucaggcuauguaacaguugcacauacaggacaacacgaucuaguuauaccaccuaauggauauuucagauucgauucauggguaaaucaauuuuacacauuagcaccaaugggaaacggagcuggaagaaggcgcuga

SEQ ID NO: 33747 - RNA, 1617 nt, Artificial Sequence
  derived and/or modified sequence opt6 from VP1__Norovirus_and/or_Norovirus-like__AB541326
augaaaauggcaucaaaugaugcaaaccccucagaugguucugcagcaaauuuagucccagaaguaaauaaugaagucauggcacucgaaccaguagucggagcugcaauagcagccccaguagcuggccaacaaaauguaauagauccauggauccgaaacaacuuuguccaagcacccgguggagaguucacuguaucaccacgaaaugcaccaggagaaauacuauggucagcaccccuaggcccagaucuuaauccauaucuaucucacuuagcaagaauguauaacggauaugcuggaggauucgaaguacagguuauauuagcaggaaaugcauuuacagcugguaaaauaauauucgccgcagucccuccuaacuucccaaccgaaggacuaucaccaucccaaguaacaauguuuccacacauaauagucgacguaagacaacucgaaccaguacuaauaccauuaccugacguaagaaacaauuucuaccauuacaaucaaucaaacgauucaaccauuaaauuaaucgcaaugcuauacacaccacuaagagcaaacaaugcaggagacgauguauuuacaguaucuugccgaguacuaacaagaccauccccagauuucgauuuuauauuucuaguaccaccaacagucgaaucacgcacaaaaccauuuacagucccaauucuaacaguugaagaaaugacaaacuccagauucccuauuccacuagaaaaacuauuuacaggaccaucuucagcuuuuguaguccaaccacaaaauggaagauguacaacugacggaguacuauuagguacuacucaacuaucaccuguaaauauauguacauuucgaggcgacguaacucauaucacaggcucuagaaacuauacaaugaacuuagcaucccuuaacuggaauaauuaugacccaacagaagaaauuccagcaccucuagguacaccagacuucguaggaaaaauacaaggagucuuaacucaaacaacaaaaggagauggcuccaccagaggacacaaagccacaguauauaccggauccgcugauuucacuccaaaauuaggaucaguacaauuugccacugacacagaaaacgauuuugaaacacaucaaaauacaaaauucacuccaguaggaguuauacaagacggaggaacaacccauagaaaugaaccacaacaauggguacuacccucauauucagguagaaauguacauaacguacaucuagcacccgccgucgcaccaaacuuuccaggagaacaauuacucuuuuucagaucaacaaugcccggaugcucagguuauccaaauauggaccuagauugcuuacuuccucaagaauggguacaacauuuuuaucaagaagcagcacccgcacaauccgacguugcacuacuuagauucgucaauccugauacaggcagaguuuuauuugaaugcaaauuacauaaaucaggcuacgucacugucgcacacacaggacaacaugaccuuguaauuccaccaaauggauauuuuagauuugacuccuggguaaaucaauuuuacacuuuagcacccauggguaacgguacgggaagaagaagauga

SEQ ID NO: 33748 - RNA, 1617 nt, Artificial Sequence
  derived and/or modified sequence opt6 from VP1__Norovirus_and/or_Norovirus-like__AB541251
augaaaauggccucaaacgacgcaaguccaagugauggaucagcagccaaccuaguuccagaagucaauaaugaaguaauggcacuagaaccaguagucggagcugcaaucgcagcaccaguagcaggucaacaaaaugucauagacccuuggauaagaaauaauuuuguucaagcaccaggcggagaguucacagucuccccaagaaacgcaccuggagaaauacuauggucagcaccccuaggcccagaucuuaauccauauuuaucacacuuagcccgaauguauaauggauacgcaggaggcuucgaaguacaaguaauacuagccggaaaugcauucacagcaggcaaaauaauuuuugcagccguuccaccaaauuuucccacagaaggauuaucaccaucacaagucacaauguuuccacacauaaucguagauguuagacaacuagaaccuguauuaauaccacuaccagacguaagaaauaauuucuaucacuacaaccaaucuaaugauucaacuauuaaacuaauagcaaugcucuacacaccacucagagcuaauaaugcaggagaagacgucuuuacaguaucauguagaguucuaacaagaccuucaccagacuuugacuuuauauuucuaguaccaccaacuguagaaucuagaaccaaaccauuuacuguaccuauacuaaccguagaagaaaugacuaacucacgcuucccaauacccuuagaaaaauuauuuacuggacccucuuccgcauuugucguucaaccacaaaacggcagauguacaacagacgguguacuauuaggaaccacacaauuaucaccagucaauauauguacauuuagaggugacguaacacacaucgcagguucacguaauuauacaaugaauuuaguaucacuuaacuggaacaacuacgacccaacagaagaaaucccagcaccacuaggaacacccgacuuuguaggaaaaauacaaggaguacuuacucaaaccacaaaaggagacgguucuacaagaggacacaaagccaccguauacacagguucagcaccauucacacccaaauuaggaucaguacaauucagcacagacacagaaaaugacuucgaaacccaucaaaauaccaaauucacaccaguaggaguuauacaagacggaucaacaacacaccgaaaugaaccacaacaauggguccuaccaucauauucagguagaaacguucacaacguucaccuugcaccagcaguagcaccaacauuuccuggagaacaacuauuauuuuuccguucaacuaugccagguuguaguggcuauccaaacauggaucuugauugccuauuaccucaagaauggguacaacauuuuuaucaagaagcagccccagcccaaucugacguagcauuauuacgauucgucaacccagacacaggaagaguauuauucgaaugcaaauuacauaaaucuggauauguaacaguagcauauaccggacaacacgacuuaguaaucccuccuaauggauacuuccgauucgauucauggguaaaucaauucuauacucuagcucccaugggaaacggaacaggaagacgacgcuaa

SEQ ID NO: 33749 - RNA, 1617 nt, Artificial Sequence
  derived and/or modified sequence opt6 from VP1__Norovirus_and/or_Norovirus-like__AB541241
augaaaauggcaucaaaugacgcuaauccaucagauggaucagcugcuaaccuaguaccagaaguaaauaaugaaguaauggcauuagaacccguaguaggagccgcaauagcagcaccagucgcaggacaacaaaauguaauagaccccuggauucgcaacaacuuuguacaagccccaggaggagaauuuacaguuucaccuagaaaugcccccggcgaaauauuauggucugcaccacuuggaccagacuuaaauccuuaucuuucucauuuagcuagaauguauaacggauaugcaggcggguucgaaguacaaguuauucuagcaggaaaugccuucacugcaggaaaaauaaucuucgcagcaguuccaccaaauuucccaacagaaggacuaaguccaucccaaguuacuauguucccacacauaaucguagauguuagacaacucgaaccaguacuaauaccacuaccagacguuagaaauaacuuuuaucacuauaaucaaucaaaugauuccacaauaaaauuaauagcaaugcucuacacuccuuuacgagcaaacaaugcaggagaagauguuuuuacagucucaugccgaguauuaacaagaccaucaccagauuuugauuucauauucuuagucccaccaacuaucgaaucaagaacaaaaccuuucacaguaccuauacucaccguagaagaaaugacuaauucacgauuuccaauaccuuuagaaaaacuauuuacugguccaucuggagcauuuguaguacaaccacaaaacgggcgauguacaacugauggcguacuacuagguacaacacaauuaucaccuguaaacauuuguacauucagaggcgacguaacccauauagcuggaucucgagauuacacuaugaauuuagcaucccuuaauuggaacaauuacgauccgacugaagaaauaccagccccacuaggaacaccagacuucguaggaaaaauacaagguguauuaacccaaacaacaaaaggagacggaucaacaagaggacauaaagcuacaguauacacaggaucugccccauucacaccaaaacuuggaucaguacaauucucaacagauacagaaaacgauuucgaaacccaucaaaauaccaaauucacuccuguaggcguaauacaagacggaucaacaacacaccgaaaugaaccucaacaauggguacuacccuccuauucaggccgaggaguacauaacguacaucuagcaccagcaguagcaccuacauuuccaggugaacaauuacuuuucuuuagaucaacaaugcccggauguucaggauacccaaauauggaucuagauugccuacucccacaagaauggguucaacauuuuuaucaagaagcagccccagcacaaucagacguagccuuauuacgauuuguuaauccagauacuggaagaguauuauucgaaugcaaacuacauaaaucaggauacguaacagucgcacauacaggucaacacgacuuaguaauaccaccaaaugguuauuuucguuuugauucauggguaaaucaauucuauacucuagcuccaaugggaaauggaacagguagaagaagauaa

SEQ ID NO: 33750 - RNA, 1617 nt, Artificial Sequence
  derived and/or modified sequence opt6 from VP1__Norovirus_and/or_Norovirus-like__AB541216
augaaaauggcuucaaacgacgcuaacccuucagacggcuccgcagcaaaccuaguuccugaaguaaacaacgaaguuauggcacuagaaccaguuguaggugcagcuauugcugcuccaguagcuggacaacaaaauguaauugauccuuggauaagaaacaauuucguacaagcaccaggaggagaauuuacaguuucaccuagaaaugccccaggagaaauauuaugguccgcaccucuaggaccagauuuaaauccauauuuaagccaccuagcacguauguacaacggcuacgcaggcggauuugaaguacaaguaauucuagccggaaacgccuuuacagcaggaaaaauaauauucgccgcaguaccaccaaacuucccaacagaaggacugucacccucacaaguuacaauguucccacauaucauaguugacguaagacaacuagaaccaguauuaaucccauuaccagauguaagaaacaacuuuuaccauuacaaucaaucaaaugacucaacaauaaaacuuauagcaauguuauauaccccacuccgagcuaauaacgcaggagaagauguuuuuacagucucauguagaguacuaacaagaccaucaccagacuuugacuucauauucuuaguaccuccaacuguagaauccagaacaaaaccauucacuguccccauauuaaccguagaagaaaugacaaauucacgauuuccaauaccacuagaaaaacuuuuuacuggaccauccucagcuuucguaguccaaccacaaaacgguagaugcacaacagacggcguccuauuaggaacaacacaacuauccccagucaacauauguacauuucguggugauguuacacacauagcaggaucuagaaacuauacaaugaaucuugcauccuuaaacuggaacaacuaugauccaacagaagaaauaccagccccacuaggaacaccagacuuuguuggaaaaauacaagguguauuaacucaaaccacuaaaggugacggaagcacaagaggccacaaagccacaguauacacaggcuccgcagacuucacaccaaaauuaggaucaguacaauuuucaacagacacagaaaacgauuucgaaacacaccaaaacacuaaauuuacacccguagguguaauacaagacggaggaacaacacacagaaaugaaccacaacaaugggucuuaccuucauauucaggcagaaacguacacaauguucacuuagcacccgcaguagcaccaacuuucccaggagaacaauuacuauucuuuagaucaacaaugccagguuguucaggauacccuaauauggauuuagauugcuuauuaccacaagaauggguacaacauuuuuaccaagaagcagcaccagcacaaucagacguugccuuacuaagauuugucaacccagacacgggaagaguauuauuugaaugcaaacuacauaaaucaggauaugucacagucgcacauacaggacaacacgaucugguaauaccaccaaauggauauuuuagauuugacucauggguaaaucaauuuuacacauuagcuccaaugggcaauggaacagguagaagaagauga

SEQ ID NO: 33751 - RNA, 1617 nt, Artificial Sequence
  derived and/or modified sequence opt6 from VP1__Norovirus_and/or_Norovirus-like__EU876885
augaaaauggcaaguucugaugcaaauccaucagacggauccacagcuaaccuagucccggaaguuaauaacgaaguuauggcauuagaaccaguaguaggagcagcuauagcagcaccaguagcaggucaacaaaacgucauagauccauggauaagaaauaauuuuguucaagcccccggaggagaauuuacaguaucaccacgaaaugcacccggagagauauuauggucugcaccacuuggaccugacuuaaauccauaucuaucacaccuagcccguauguauaacggauacgcaggaggauuugaaguucaagucauacuagcugguaaugcauuuaccgcagguaaaauaauauuugcagcaguaccaccuaauuuucccacagaaggcuuaucaccaucacaagucacaauguucccucauaucauagucgacguacgucaacuugaaccaguacuaauaccauuaccagauguccgaaacaauuuuuaucauuauaaccaaucaaacgaucccaccaucaaacuaauagcuauguuauacacaccauuaagagccaauaaugccggagaugauguauuuacaguaucaugcagaguauuaaccagaccauccccagauuuugauuucauauuuuuaguaccaccaacaguugaaucacgaacaaaaccuuucucaguaccaauucuaacaguagaagaaaugacaaacucaagauuuccaauaccauuagaacgauuauuuaccggaccaucauccgcuuucguaguacaaccacagaacggacgcugcacaacagauggcguccuauuaggaaccacacaauuaucuccagcaaacauauguacauucagaggagauguaacacauauagcuggaacacaagaauacacaaugaaucuugcuucacaaaacuggaacaauuacgauccuacugaagaaauaccagccccucuaggaaccccagauuucguaggcaaaauccaaggaguucuuacacagacaacucgaagagacggaucuacuagaggacauaaagcaacaguaucaacaggauccguacauuucacaccaaaauuaggcagaauacaauuuucaacagauacaucaaaugauuuugaaaccggacaaaauaccagauucacaccaguuggagucguacaagauggaggaacaacucaccaaaaugaaccacaacaauggguccuaccaaacuacucaggaagagacggucauaauguacauuuagcaccagcaguagcuccaucuuuucccggagaacaauuauuauucuuuagaucaacaaugccugguuguuccggcuauccaaauaugaauuuagauugcuuacuaccucaggaauggguacaacacuucuaucaagaagcagcacccgcacaauccgauguugcacuucuaagauuuguuaauccagauacugguagaguacuauuugaauguaaauuacauaaaucaggauauguaacaguugcucacacaggacaacaugauuugguaaucccaccaaaugguuacuuuagauuugacucaugggucaaccaauucuauacacuagcaccaaugggaaauggaacaggcagaagacguuaa

SEQ ID NO: 33752 - RNA, 1617 nt, Artificial Sequence
  derived and/or modified sequence opt6 from VP1__Norovirus_and/or_Norovirus-like__AB447435
augaaaauggcaucaaaugacgcaaaucccucagacggaucugcugcuaacuuagucccagaagucaacaaugaaguuauggcauuagaaccaguagucggcgcugcuauagccgcccccguagcaggacaaacaaaugucauagacccauggauaagaaauaauuuuguccaagcacccggaggcgaauuuacugucucaccaagaaaugccccuggagaaauauuauggucagcaccacuaggaccagauuuaaauccauacuuaucacaccuagcccguauguacaacggauacgcuggaggauucgaaguccaagucauucuagcagguaaugcauuuacagccggaaaaauaauauuugcugccguacccccaaacuucccaacugaaggucuauccccaucucaaguuacaauguucccccauauaauagucgacgucagacaacuagaaccagucuuaauaccacucccagauguaagaaauaauuuuuaucauuauaaccaacuaaacgacuccacuauaaaauuaauagccaugcuuuacacaccauuaagagcaaacaaugccggugaagacguauuuacaguauccugccgagucuuaacaaggccaucaccagauuucgacuuuauauuuuuaguaccaccaacaguagaaucuagaacaaaaccauuuacuguaccaauacuuacaguagaagaaaugaccaacuccagauuuccaauaccauuagaaaaauuauuuacaggaccaucaggcgcauuuguuguacaaccacaaaauggaagaugcacaacagauggaguacuauuaggaacuacacaauuaucaccugucaauauaugcacauuuagaggcgacguaacacauauagcaggcaguagaaauuauacuaugaauuuagccucacuuaauuggaacaauuacgaucccacugaagaaauacccgcaccucuagguacaccagacuucguaggaaaaauacaaggaguuuuaacacaaaccacaaaaggagacggauccacaagaggacacaaagccacaguauauacaggaagcgcaccuuuuaccccaaaacuaggaucuguccaauucagcaccgacacagaaaaugacuuugaaacgcaucaaaauaccaaauucacaccaguaggaguaauacaagacggaucuacaacacauagaaacgaaccucaacaauggguauuaccaagcuauucagguagaaauguacacaauguacaucucgccccagcaguugccccaacauucccaggagaacaacucuuauuuuuccgaucaaccaugccaggauguucuggauauccaaauauggauuuagauugucuacuaccacaagaauggguacaacauuuuuaccaagaagcagcacccgcacaaucagauguugcauuauuacgauucguaaacccugacacaggcagaguacuauucgaauguaaacuacauaaaucaggauauguaacugucgcucauacuggccaacaugaucuaguaauaccaccaaauggauauuuccgauuugauucauggguaaaucaauuuuacacacucgcacccauggguaacgguacagguagacgacguuaa

SEQ ID NO: 33753 - RNA, 1617 nt, Artificial Sequence
  derived and/or modified sequence opt6 from VP1__Norovirus_and/or_Norovirus-like__KX354073
augaagauggcuuccaaugacgcaaacccuucagauggaucagcagcuaacuuaguaccagaagucaacaacgaaguuauggcauuagaaccaguaguuggugccgccauagcagcaccuguagcaggacaacaaaauguaauagacccuuggauuagaaauaauuuuguacaagcaccuggaggagaauuuacgguaucaccaagaaaugcaccaggagaaauacuauggucagccccacuaggaccagaccucaacccauaucuaucacacuuagcacgaauguauaauggauaugcaggcggauucgaaguacaaguaauucuagcaggaaaugcauuuaccgcaggaaaaaucauauuugcagcaguaccaccuaacuuuccaaccgaaggucuaucuccaucucaaguuaccauguucccucacauaauaguagauguuagacaacuagaaccaguguuaauaccacucccagauguaagaaacaauuucuaccauuacaaucaaucaaaugacucaaccauaaaacuaauagcuaugcuuuacacuccauuaagggccaacaaugcuggugaugauguauucaccguauccuguagaguauuaaccagaccaucaccugacuuugauuucauauuucucgucccaccaacaguagaaucaagaacaaaaccauucacuguaccuauauuaacaguagaagaaaugacuaacucaagauuuccaaucccccuagaaaaacucuuuacaggaccaucaagcgcauucguaguacaaccacaaaacggcagauguacaacagauggaguacuauuaggaacaacacaacuuucuccuguaaacauuugcaccuuuaggggcgauguaacucacauugcaggaucuagaaauuacacuaugaaucucgcaucauuaaacuggaauaauuaugauccaacugaagaaauaccagcaccacuagguacaccagauuucguaggaaaaauucaaggaguauuaacucaaacaacuaaaggcgacgggucaacuagaggacacaaagcaacaguauauacaggaucugcagacuuuacaccaaaauuaggaaguguucaauuugcaacugauacagaaaaugauuucgaaacacaucaaaauacacgauucacaccaguuggcguaauacaagacggcaguacuacacaucgaaacgaaccacaacaauggguucuaccaucuuacucaggacgaaauguacauaacguacacuuagcaccagcaguugcaccuaacuucccaggagaacaacuuuuauucuuucgcucaacaaugccuggcuguucaggauauccaaacauggaccuagauugcuuauuaccacaagaauggguacaacauuucuaccaagaagcagcuccagcacaaucugacguugcacuauuacgauucguuaauccagauacuggacgcguauuauucgaauguaaacuacacaaaucagguuauguaacaguagcucauaccggucaacacgaucuaguaaucccaccaaaugguuacuuuagauucgauuccuggguaaaucaauuuuauacacuagcaccaaugggaaacggaacaggacgaagacgauaa

SEQ ID NO: 33754 - RNA, 1617 nt, Artificial Sequence
  derived and/or modified sequence opt6 from VP1__Norovirus_and/or_Norovirus-like__KX353981
augaaaauggcaagcaacgacgcuaauccaucagacgguucagcugcaaaucuagucccagaaguaaauaacgaaguuauggcacuagaacccgucguaggagccgcaauagcagcuccaguagcaggccaacaaaauguaauagacccauggauaagaaacaacuucguacaagcacccggaggagaauuuaccguauccccacgaaaugccccaggagaaauacuaugguccgcuccccuuggaccagauuuaaacccauacuuaucacaccuagcaagaauguauaauggauaugcaggaggauucgaaguccaaguaauacuagcaggaaacgccuuuaccgcaggcaaaaucauauucgcagcaguaccacccaauuuccccacagaaggacuaucacccucacaaguaacaauguucccucacauaauuguagacguacgccaacuagaacccguacuaauaccacuaccagauguaagaaauaacuucuaucacuauaaucaaucaaacgauagcacuauaaaacuaauagcaaugcucuacacccccuuaagagcaaauaacgcaggagaagacgucuuuacaguauccugcagaguccuaacaagaccaucuccagauuucgacuucauauuccuaguuccaccaacaguagaaaguagaaccaaaccauuuaccguacccauauuaacaguagaagaaaugaccaacagcagauuuccaauaccacuagaaaaauuauucaccggcccaucauccgcauucguaguccaaccucaaaauggaagaugcacaacagacggaguacuccuagguacuacacaauuaucccccguaaacauuuguaccuucagaggagauguaacacacauagcaggaucaagaaauuacacaaugaaccuugcuucuuuaaacuggaacaacuaugacccaacagaagaaaucccagcaccuuuaggaacaccagauuucguaggaaagauacaaggaguacuaacacaaacaacaaaaggagacgguucaacccgcggccacaaagcaacugucuacaccggaucagcaccuuucacaccuaaauuaggcucaguacaauuuucaacagauacagaaaacgacuucgaaacucaucaaaauacaaaauuuacaccuguaggaguaauacaagacggaggaacuacccaccgcaaugaaccucaacaauggguauuacccucuuauuccggaagaaauguacaaaacguacacuuagcaccagcaguagccccaacuuuuccaggagaacaauuacuauuuuucagaucaacaaugcccggaugcucugguuacccaaacauggaccuagacugucuauuaccacaagaauggguacaacacuucuaucaagaagcagcuccugcacaaucugauguagcauuacuucgauuuguaaacccagauacagguagaguauuauucgaaugcaaauuacacaaaucaggauauguaacaguagcacacacaggacagcacgauuuaguaaucccacccaauggauauuucagauucgauucauggguaaaccaauucuauacacuagcaccuaugggaaacggaacuggacguagaagauaa

SEQ ID NO: 33755 - RNA, 1617 nt, Artificial Sequence
  derived and/or modified sequence opt6 from VP1__Norovirus_and/or_Norovirus-like__KU182479
augaaaauggcuuccaaugacgccacuccaucugauggaucaacagcaaaucuuguaccagaaguuaacaacgaaguaauggccuuagaaccaguaguuggcgcagccauagcagcuccagucgcaggucaacaaaauguaauugacccauggauaagaaauaacuucguucaagcucccggaggagaauuuacuguuucuccuagaaaugcaccaggagaaauauuauggucagcaccuuuaggaccagaucuuaauccauacuuaucacaccuugcccgaauguacaacgguuacgcaggaggauuugaaguacaaguaauauuagcaggaaacgcauuuacagcaggaaaaauaauauucgcagcaguuccaccuaacuuuccuacagaaggacucucuccaucacaaguaacaauguucccacacauaauaguagacguaagacaauuagaaccaguauuaauuccauuaccagacguuagaaacaauuucuaucauuauaaccaaaguaaugauccaacaauaaaauuaauagccauguuauauacuccccuaagagcaaauaaugcaggagaugauguauuuacaguaucauguagaguacuaacuagaccuuccccugauuuugauuuuauauuucuaguuccuccaacaguagaaucaagaacuaaaccuuuuucaguaccaauacuaacagucgaagaaaugaccaauucucgauucccaauacccuuagaaaaacuuuuuacaggaccaucaucugcuuucguaguccaaccucaaaacggacgauguacuacagacggaguacuuuuaggaaccacacaacuuagucccguuaacauaugcacauuucgaggagacguaacucauauagcaggcgcacaaaauuacacaaugaaucuagcaagccaaaauuggaauaauuacgauccuacugaagaaauaccagcuccacucgguaccccagacuucguaggaaaaauacaaggaguacugacacaaacaacccgacgagacggaucaacaagaggucauaaagccacugucucaaccggaucaguacauuuuaccccaaaacuaggauccguccaauucucaacagacacaucaaacgauuucgaaacaggacaaaauacaagauucacaccaguaggcguaguacaagacggaucaacaacccaucaaaacgaaccacaacaauggguucuuccugacuauagcggaagagacucacacaacguccauuuagcacccgcuguugcaccaaccuuuccaggugaacaauuauuauucuuucgcucuacaaugccaggcugcucaggauauccuaacaugaauuuagacuguuuacuuccacaagaauggguccaacauuucuaucaagaaagugcacccgcucaaucagauguagcauuauuacgauuuguaaacccagauacagguagaguauuauucgaaugcaaacuccauaaaucaggcuauguaacaguagcacauaccggccaacacgaccuaguaauaccaccaaacggauauuuucgcuucgauuccugggucaaccaauucuauacucuagcaccuaugggcaauggagccgguagaagacgauga

SEQ ID NO: 33756 - RNA, 1617 nt, Artificial Sequence
  derived and/or modified sequence opt6 from VP1__Norovirus_and/or_Norovirus-like__KU182478
augaaaauggcuucaaacgacgcaacuccuucagauggcucaacagcaaaccuaguaccugaaguaaauaaugaaguuauggcccuagaaccaguaguaggagcagcaauagcagcaccaguagcaggacaacaaaacguaauagaccccuggauaagaaauaauuuuguacaagcaccaggaggugaauuuacaguuagcccuagaaaugcaccaggagaaauacuauggucagcuccauuaggaccagaccuaaauccauaucuuucacauuuggcaagaauguauaaugguuacgcaggaggauucgaaguacaaguuauauuagcaggaaacgccuucacagcuggaaaaauuauuuuugcagcaguuccaccaaauuuuccaacugaaggauuaucaccaagucaaguuacaauguucccccauaucauaguagacgucagacaauuagaaccaguauuaauuccacuaccagauguaagaaacaauuuuuaccacuauaaccaauccaaugaccccacuaucaaacuaauagcaauguuauauacaccacuuagagcuaauaacgccggagaugacguauuuacaguaucauguagagucuuaacaagacccaguccagacuucgacuucauauuucuuguaccaccaacugucgaaucucgaacaaaaccauuuucuguacccauuuuaacuguagaagaaaugacaaacucaagguuuccaauaccauuagaaaaauuauuuacaggaccaucaucagcuuucguaguccaaccacaaaaugguagaugcacaacugacggcguacuacuaggaaccacacaacuaucaccaguaaauauuuguacauuuagaggagauguaacccacauugcaggcacacaaaauuacacaaugaacuuagcaucacaaaacuggaacaauuacgauccuacugaagaaaucccagcuccacuaggaacccccgacuucguaggaaaaauucaagguguacuaacacaaaccacaagacgugaugguucaacuagaggacacaaagcaacagucucuacaggaucaguacacuucacuccuaaauuaggaucaguacaauucucaacagauacuucaaacgauuucgaaacaggucaaaauacacgauucacaccaguagguguuguacaagacgguucaacaacccaucaaaaugaaccacaacaaugggucuuaccagauuauucaggaagagauucacacaauguucaucuugccccugcaguagcaccaaccuuuccaggugaacaauuauuauucuuuagaaguacaaugccaggauguaguggauacccuaauaugaauuuagacuguuuauuaccacaagaauggguccaacauuuuuaucaagaaucugcaccagcccaaucagauguugcauuauuacgauuuguuaacccagauacuggaagaguauuauucgaaugcaaacuacauaaaucaggauacguaacaguagcucacacaggacaacacgaucuaguaauaccaccaaacggauacuuucgauucgacucuuggaucaaccaauuuuacacuuuagcaccaauggguaauggcgcaggaagaagaagauaa

SEQ ID NO: 33757 - RNA, 1617 nt, Artificial Sequence
  derived and/or modified sequence opt6 from VP1__Norovirus_and/or_Norovirus-like__AB972501
augaaaauggccucuaacgacgcuaacccaucagauggcucagcagcaaaucuaguuccagaaguuaacaaugaaguuauggcucuagaaccaguaguaggugcagcuauagccgccccaguugcaggucaacaaaauguuauugacccauggaucagaaauaacuucguacaagcuccaggaggagaauuuacaguaucaccacgaaaugcaccaggagaaauauuauggucagcaccucuaggaccugauuuaaacccauacuuaucacaucuugcacgaauguauaacgguuaugccggcgguuucgaaguccaaguaauacuagcuggaaaugcuuuuacagcaggaaaaauaauauucgcagcaguuccaccuaauuucccuacagaaggacuaucaccaucgcaaguaaccauguuuccacacauaaucguagauguucgccaacuagaaccaguauugaucccacuaccagauguucgaaacaauuuuuaucacuacaaucaaucaaacgacucaacuauuaaacuuauagcuaugcuuuauacucccuuacgugcuaacaaugcuggagaagacguuuuuacuguuucaugcagaguccuaaccagaccaagcccugacuuugauuuuaucuuccuaguaccuccaacaguagaaucaagaacaaaaccauucacaguaccuauauuaaccguagaagaaaugacaaacucaagauuuccaauaccacuagaaaaacuauuuaccggacccucuucugcauuuguaguacaaccacaaaacggucgauguacaacagacggaguuuuacuaggaacaacacaauuaucaccagucaauauaugcacauuuagaggcgauguaacccauaucgcaggaucacgaaauuacacaaugaauuuagcaucacuaaacuggaacaauuaugacccaacagaagaaauccccgcuccuuuaggaacaccugacuuuguaggaaaaauacaaggaguucuuacccaaaccacuaaaggagacggauccacaagaggucacaaagccacgguuuauaccggaucugcaccauuuacaccuaaguuaggaucaguucaauuuggaacugauacagaaaacgauuucgaaacacaccaaaacaccaaauucacaccaguagguguaauacaagauggagguacaacacauagaaaugaaccacaacaauggguucuaccaucauauucuggacguaaugucccaaacguacaucucgcuccugcaguugcuccaacauucccaggagaacaauuauuauucuuuagaucaacaaugcccggaugcucaggauaucccaauauggaucuagauugucugcuaccacaagaauggguucaacauuucuaccaagaagcagcaccagcacaaucagacguagcacuacuaagauucguuaauccugacacaggaagaguucuauuugaaugcaaauuacauaaaccuggauacguaaccguugcacauacaggccaacacgauuuaguuauaccaccaaauggcuauuuuagauuugacagcuggguuaaucaauuuuacacucuugcucccaugggaaacggaacaggaagaagacgauaa

SEQ ID NO: 33758 - RNA, 1617 nt, Artificial Sequence
  derived and/or modified sequence opt6 from VP1__Norovirus_and/or_Norovirus-like__KR904214
augaaaauggccucaucagacgcuaacccaucaguagggucagcagcaaauuuaguaccagaagucaauaaugaaguuauggcccucgaaccaguaguaggugcagcaauagcagcaccaguagcaggccagcaaaauguaauagauccuuggauuagaaacaauuucguucaagcaccagguggagaauuuacaguaucaccacgaaaugcaccaggggaaauauuauggucagcaccccuaggaccagacuuaaaucccuaucuaucacaccuagcaagaauguacaacggauacgcaggcggcuucgaaguauuaguaauauuagcuggaaacgcauucacagcaggcaaaauaaucuuugcagcaguaccacccaauuuucccacagaaggacuaucaccaagucaaguaacaauguucccucauauaauaguugacguaagacaauuagaaccaguacuuauaccauuaccagacguuagaaacaauuucuaccacuauaaccaaucaaacgauccuacaauuaaauuaaucgcaaugcuauauacaccacucagagccaacaaugcaggagaugacguauucacaguaucaugucgagucuuaaccagaccaucaccagauuucgauuuuauauuuuuaguuccaccuacuguagaaucuagaacuaaacccuuuuccguaccaauauuaaccguagaagaaaugaccaacucucgauuuccaauaccccuagaaaaacuauuuacagguccaucaucagcauuuguaguacaaccacaaaauggaagauguaccaccgacgguguacuacuugguaccacacaacuaaguccuguaaauauaugcacuuuccgaggcgauguaacacauacaacuggaucccauaacuauacaaugaauuuagcuacacaaaauuggaacucuuaugacccaacagaagaaauaccagccccacuaggaacaccagauuucguagguaaaauucaaggaguacuaacacaaacaacaaaaacagaugguucaacacguggacacaaagcaacaguauauacagguucagcagacuuugcaccuaaacuaggaagaguacaauucgccacagauaccgauaaugacuuugaagcaaaucaaaauacaaaauuuacaccaguaggaguaauacaagauggaggaacugcucauagaaacgaaccccaacaauggguauuaccuaguuacuccggaagaaacacacacaacguccaccuagcaccagcuguagcuccaacauuccccggugaacaacuauuauucuuucgaucaacaaugccagguuguucuggauacccaaauauggaucuagauugccuucuaccacaagaauggguacaauauuucuaccaagaagcagcaccagcacaaucagauguugcauuacucagauucguuaauccagauacaggaagaguauuauucgaauguaaacuacacaaaucaggauaugucacuguugcacacacaggcccacaugaucuuguaauaccaccaaauggauauuucagauucgauagcuggguaaaucaguuuuacacacucgcaccaaugggaaauggaacuggacguaggcguuaa

SEQ ID NO: 33759 - RNA, 1617 nt, Artificial Sequence
  derived and/or modified sequence opt6 from VP1__Norovirus_and/or_Norovirus-like__AB933758
augaaaauggcaucauccgacgcaaauccaucagacggcucaacagcaaauuuaguacccgaaguaaacaaugaagucauggcauuagaaccagucguaggagcugccauagcagcacccguugcuggccaacaaaauguaauagauccauggauaagaaauaauuuuguucaagccccaggaggagaauuuacaguaagcccucgaaacgcaccaggugaaaucuuauggucagcaccacucgguccagauuuaaaucccuaccuaucacaccuagcaagaauguauaacggauacgcuggcggauucgaaguacaaguuauacuagccggaaacgcuuucacagcuggcaaaauaauauuugcagcagucccaccuaauuucccaaccgaaggauuaucaccuucacaaguaaccauguuuccacacauaauaguagauguacgacaacuagaaccaguauuaauaccauuaccagauguuaggaacaacuucuaucacuauaaucaguccaaugacccaacaauaaaauuaauagcaauguuauacaccccuuuaagagcaaauaaugcaggagacgacguauucacaguuucaugccguguauuaacacgaccaucaccagauuuugauuuuauuuuucuaguuccaccuacaguagaaucaagaacuaaaccuuucucuguaccuauacuaacaguggaagaaaugacaaauucaagauuuccaaucccauuagaaaaacuauuuacaggaccaucaucagcauucguaguacaaccacaaaauggaagauguacaacagacgguguauuauuaggaacaacacaauuaucaccaguaaacauauguacauuuagaggagauguaacacauauagcuggcucacauaauuacacaaugaauuuagcuucgcaaaauuggaacucuuaugauccuacagaagaaauaccagcaccacuaggaacaccagacuuuguagguaaaauacaaggcguacuaacacaaacuaccagaacugauggcagcacacgaggacacaaagcaacaguuuauacaggaucggcagaauuuuccccaaaauuaggaagaguacaauucgcaacugauacuaauaacgacuucgaugcaaaccaaaacaccaaauucaccccaguagguguaauacaagacgggggaacaacccacagaaaugaaccacaacaauggguauugccaucuuauucaggaagaaauacccacaauguacacuuagcaccagccguagcaccaacauucccuggagaacaacuauuauucuuucgaagcacgaugcccggcugcucuggcuauccaaauauggaucuagauugccuacuaccacaagaauggguucaauacuuuuaccaagaagcagccccugcacaaucggauguagcauuacuaagauucguaaaucccgacacaggccgaguauuauuugaaugcaaauuacauaaaucagguuaugucacuguagcacacacuggacaacaugacuuagucauaccaccaaauggauauuucagauucgauucaugggucaaucaauucuacacacuagcaccaaugggaaauggaacagguagacgcagauaa

SEQ ID NO: 33760 - RNA, 1617 nt, Artificial Sequence
  derived and/or modified sequence opt6 from VP1__Norovirus_and/or_Norovirus-like__AB933698
augaaaauggccucaaacgacgcaaauccaucagacgguucagccgccaaccucgucccagaaguuaauaaugaaguaauggcauuagaaccagucgucggagcagcaauagcugcaccaguagccggacaacaaaauguaauagacccuuggauaagaaauaauuuuguacaagcaccuggaggagaauuuaccguaucaccacgaaaugccccaggagaaauacucuggucagcaccauuaggacccgaucuaaacccauaucuaucccauuuagcaagaauguauaauggauacgcuggaggauuugaaguccaagucauauuagcaggaaaugcauuuacugcaggaaaaauaauuuuugcagcagucccacccaacuuuccaacugaaggccuaucccccucucaagucaccauguucccacacauaauagucgacguaagacaacuagaacccguacuaauacccuuaccagauguacgaaacaauuucuaucauuauaaccaaucaaaugacaguacaauuaaacucaucgcaauguuauacacaccacuucgagcuaauaaugcaggcgaagacgucuucacuguaucaugucgaguacuaacaagaccaucaccagacuuugacuuuauauuccuaguuccacccacaguugaaucaagaacaaaaccauuuacagucccaauccuaacaguagaagaaaugacaaauucuagauuuccaaucccauuagaaaaacuauuuaccggaccaucaggagcauucguuguacaaccacaaaacggcagauguaccacagauggaguauuacuagguacaacacaauuaagcccaguaaacauauguacauuuaaaggagacguaacacauauagcuggaucuagaaauuacacaaugaaucucgcaucccugaacuggaauaauuaugacccuacagaagaaauaccagcaccacuagguacaccagacuuuguaggaaaaauacaagguguauuaacgcaaacuacaaaaggagacggaucgacucgcggacacaaagcaacaguauauacaggaucagcuccauuuacaccaaaauuaggauccguacaauucucuacagacacagaaaaugauuucgaaacccaccaaaacacaaaauucacccccguaggaguaauacaagaugguggaacuacucaucaaaacgaaccacaacaauggguauuaccuucauacaguggucgagaugucccaaacguccaccuagccccagccguagcaccuacauuuccaggugaacaacuacuauucuuuagaucaacaaugccaggauguaguggcuacccaaauaugaacuuagacugucuauuaccacaagaauggguacaacauuuuuaccaagaagcagcaccagcacaauccgacguugcacuucuacgauucguaaacccugacaccggccgaguacucuucgaauguaaauuacauaaaucaggauauguaacagucgcucauacuggacaacacgauuuagucauaccaccaaauggcuacuuucgguuugacucauggguaaaucaauucuacacauuagcacccaugggaaauggaaccggacgucgaagauaa

SEQ ID NO: 33761 - RNA, 1617 nt, Artificial Sequence
  derived and/or modified sequence opt6 from VP1__Norovirus_and/or_Norovirus-like__KJ678141
augaaaauggcuucaucugacgcaaacccaucagauggaucagcagcuucuuuaguaccagaaguaaacaaugaagucauggcacuagaaccaguuguaggagcagcaauagcagcaccuguagcaggucaacagaauguaauagacccauggauaagaaacaauuuuguacaagcuccaggaggcgaguuuacaguuucacccaggaaugcaccaggagaaauauuauggucagccccauuaggucccgauuuaaauccuuauuuaucucacuuagcuagaauguauaacggauacgcaggaggauucgaaguucaaguaauacuagcaggaaaugcauucacagccggaaaaguaauauucgcagcagucccuccaaacuuuccaaccgaagguuuaucaccaucucaaguuacuauguucccccauauaguaguagacguacgucaacuagaaccaguacuaaucccacuuccagacguacgaaacaauuucuaccauuauaaucaaucaaacgacccaacaauuaaacuaauagcaaugcuuuauaccccacuaagagcuaacaaugcuggugaugauguauuuacagucagcugucgaguucucacaagaccauccccugauuuugauuucauuuuccuaguaccaccaacaguagaauccagaacaaagccauucucaguaccagucuuaaccguagaagaaaugacaaacucacgauuccccauaccauuagaaaaacuauuuaccggcccaucaucugcauuuguuguccaaccccaaaacggcagaugcacaaccgacggcguauuauuagguacuacccaauuaucacccguaaauauauguacauuuagaggagauguaacacauaucacaggaucucauaauuauacaaugaauuuggcaagucaaaacuggucaaauuacgaucccacugaagaaauaccagcaccacuaggaacaccagacuuuguaggaaaaauacaaggcguacuuacacaaacaacucgaacuaacggaagcacuagaggacauaaagcaacagucuacgcaggaagcgccaacuuugcaccaaaauuaggaagaguccaauuugaaacagauaccgaucacgauuuagaagcuaaucaaaacacaaaauucaccccuguuggcguuauccaagaugguaacacaacacauagaaaugaaccacaacaauggguauuacccaguuauuccggaagaucaacaccaaauguacaccuugcucccgcaguagcaccaacauuuccgggagaacaacuacucuucuucagaucaacaaugccaggauguucuggauauccaaauauggaucuagauuguuuacuaccacaagaauggguucaauauuucuaccaagaagccgcaccagcacaaucagauguagcauuauuaagauucguaaacccagacacaggacgaguccuauuugaaugcaaauuacauaaaucaggauauguaacuguugcacacacaggccaacacgaucuagucauuccaccaaauggauacuucagauuugauucauggguaaaucaauuuuauacacuagcgccaaugggaaauggaacaggacgaagaagauaa

SEQ ID NO: 33762 - RNA, 1617 nt, Artificial Sequence
  derived and/or modified sequence opt6 from VP1__Norovirus_and/or_Norovirus-like__EU921347
augaaaauggcaucuucugaugcaaacccuucagacggaucaaccgcgaauuuaguaccugaaguaaauaaugaaguuauggcacuugaaccaguagucggugcagcaauagcagcuccaguugcaggacaacaaaacguuauagacccuuggauucgcaauaauuuuguacaagcaccaggcggugaauuuacaguaucaccaagaaaugcaccaggagaaauacuauggucugcaccauuagguccugaucuaaacccuuaccuaucacauuuagcccgaauguauaauggauacgcuggaggauuugaaguccaaguacuucucgcaggaaaugccuuuaccgcaggaaaaauuaucuucgcugcuguaccaccuaacuuuccaacagaaggacuaucuccaucucaaguuacaauguucccacauauaauaguagauguuagacaauuagaacccguucuaauaccauuaccagauguacgaaauaauuuuuaucacuauaaucaaucuaaugauccaacaauaaaauuaauagcaauguuauauacucccuuaagagccaacaacgcuggugaugauguauuuacuguuucauguagagucuuaacacgccccuccccagauuuugauuuuaucuuucuaguacccccaacuguugaaucaagaacuaaaccuuuuucaguaccaauauuaacaguagaagaaaugacaaauucacgcuuuccaauaccauuagaaagacuauucacagguccaucaucugcauuugucguacaaccucaaaacggacguuguacaacagauggaguauuacuaggaacaacacaacucaguccagucaauauaugcacauuuagaggcgacgucacucacauagcaggaacucaagaauacaccaugaaucuugcaagucaaaacuggaauaacuacgaccccacagaagaaauaccagcaccacucggcacaccagacuuuguuggcaaaauacaagguguacuaacacaaacaacaaggagagauggauccacucgaggccacaaagcaaccguaucuaccggaucaguccacuuuacucccaaauuaggacgaauccaauuuucaacagauacaucaaacgacuuugaaacaggucaaaauacuagguuuacaccaguuggaguaguacaagacggaggaacaacacaccaaaacgaaccacaacaauggguuuuacccgauuacuccggacgugauucacacaauguacacuuagcuccagcuguugcuccuucguuuccaggagaacaacuacuauucuuuagaucaacaaugccuggaugcucaggauauccaaauaugaacuuagauugucuauuaccacaagaguggguacaacauuuuuaccaagaagcagccccugcacaaucagauguagcucuauuaagauuuguaaauccagauacaggaagaguauuauuugaauguaaauuacauaaaucagguuauguaacuguugcccacacaggucaacaugacuuaguaauaccaccaaauggauauuuuagauuugacucauggguuaaccaauucuauacucuagccccaaugggaaacggaacaggaagaagacgauaa

SEQ ID NO: 33763 - RNA, 1617 nt, Artificial Sequence
  derived and/or modified sequence opt6 from VP1__Norovirus_and/or_Norovirus-like__JX459628
augaaaauggcauccaaugaugcaaauccaucagaugguucagcagcuaacuuaguacccgaaguaaacaacgaagucauggcauuagaaccuguugugggagccgcaauagccgcuccaguugccggacaacaaaauguaauagacccauggauaagaaauaauuucguccaagcaccaggaggcgaauuuacaguaucaccacgaaaugccccaggagaaauacuauggucggcuccucuaggaccagaucuaaauccauaucuaucacacuuagcaagaauguauaacgguuacgccgguggauucgaaguucaaguaauacuagcagggaaugcauucacagcaggaaaaauaauauuugcagcaguaccaccaaauuuuccaacagaagguuuaucaccuucacaagucacuauguucccacacauaauuguagacguuagacaauuagaaccaguauuaauaccucuuccagauguacgaaauaauuuuuaucauuauaaucaaucaaaugauucaacaaucaaauuaauagcuaugcuauacacaccacuaagagccaauaaugcuggagaagaugucuuuacuguaucaugucgaguacucaccagaccaucaccugauuucgacuuuauauuuuuaguaccaccuaccguagaaucacguacaaaaccauucacaguaccaauacugacuguagaagaaaugacaaauucacgauucccaauacccuuagaaaaauuauuuaccggaccaaguggugcauucguuguacaaccacaaaacgguagaugcacaacugauggaguauuacuaggaaccacucaacuauccccaguaaacauauguacauuuagaggagauguuacucauauagcaggcucuagaaauuacacaaugaauuuagcagcacuuaacuggaauaauuaugacccaaccgaagaaauuccagcuccauuaggaacaccagacuuuguaggaaaaauucaaggaguauuaacacaaaccacaaaaggcgacggaucaacaagaggucacaaagcaacaguauauacaggaucagcagauuuuacaccaaaacuuggcuccguccaauuuucaaccgauacugaaaaugauuuugaaacacaucaaaauaccaaauucacuccaguagguguuauccaagauggaaguacaacacauagaaaugaaccccaacaauggguauuaccuucauacuccggaaggaauguacacaacguacacuuagcgccugcaguagcaccaacauucccuggagaacaacuauuauucuuucgauccacuaugcccgguuguucaggauacccaaacauggauuuagauuguuuacuuccacaagaauggguacaacauuucuaccaagaagcagcaccagcacaaucagauguagccuuacuaagauucguaaauccagacacuggucgaguacuauucgaaugcaaacuacauaaaucagguuaugugacaguagcacauaccggacaacaugauuuagucauaccacccaacggcuauuuucgauucgauucauggguaaaucaauuuuauacucuagcaccaauggguaacggcacaggccgcagaagauaa

SEQ ID NO: 33764 - RNA, 1617 nt, Artificial Sequence
  derived and/or modified sequence opt6 from VP1__Norovirus_and/or_Norovirus-like__JQ613564
augaaaauggcauccucagaugcaaacccauccgauggcucuacagccaaucuuguaccagaaguuaacaaugaaguaauggcacuugaaccaguagucggagcagcaauagcagcaccaguagcaggacaacaaaauguaauagacccuuggauacgaaauaauuucguacaagcaccagguggagaauuuacagucucaccacgcaaugcuccaggcgaaauacuauggucagcaccccuaggaccagaucuaaacccauacuuaucacaccuagccagaauguacaacgguuaugcaggaggauucgaaguacaaguaauacuagcagguaacgcuuucacagcaggaaaaauaauauucgcagcaguaccaccaaacuucccaacagaaggcuuaucuccuucacaaguaacaauguuuccacauauaauagucgacguuagacaguuagaacccguauuaauaccuuuaccagauguccgaaauaauuucuaucacuauaaucaaucaaacgauccuacuauaaaacuaauagcuaugcuuuauacccccuuaagagcaaauaacgcaggagaugacgucuuuacaguuuccuguagaguacuaacuagaccaucaccugauuuugacuucauauuucuagucccaccuacuguagaaucaagaacaaaaccauuuuccguaccaauuuuaacaguagaagaaaugacaaacucacgauuuccaauaccauuagaaaaacuuuuuacaggaccaucuuccgcauuuguuguacaaccacaaaaugguagaugcacaacagacggaguauuauuaggaaccacacaacuaucaccagucaacauauguacuuuuagaggugauguaacacacaccgccggaucacacaauuauacaaugaauuuagccagucaaaauuggaacuccuacgauccuacugaagaaauaccagccccacuagguacacccgauuuuguuggaaaaauacaaggaguacucacccaaacuacaagagcagauggaucaacaagaggccauaaagcuacaguauauacuggaucagcagaauuuucacccaaacuuggcagaguacaauucgcuacagauacagauaacgauuucgaugccaaucaaaauacaaaguucacaccaguagguguaauacaagauggaggaacuacacauagaaaugaaccccaacaauggguuuuaccauccuacucaggaagaaauacccacaacguacauuuagcaccagcaguggcaccaacauuccccggagaacaacuccuauuuuucagaucaacaaugcccgguuguucuggcuaucccaauauggacuuagauuguuuacuuccacaagaauggguucaauauuuuuaucaagaagcagcuccagcacaaucagacguagcccuucuucguuucgucaacccugauacaggccgaguuuuauucgaauguaaacuccacaaaucaggauauguaacagucgcacauacaggacaacacgauuuaguaauaccaccaaacggcuauuucagauuugauuccugggucaaucaauucuacacacuagcaccaaugggcaauggaacaggcagaagaagauaa

SEQ ID NO: 33765 - RNA, 1617 nt, Artificial Sequence
  derived and/or modified sequence opt6 from VP1__Norovirus_and/or_Norovirus-like__GQ845332
augaaaauggcuucaaacgacgcuaacccaucuaauggaucugcagcaaaucuaguucccgaaguuaacaaugaaguaauggcacuagaaccaguaguaggagcagcaauagcagcaccagucgcaggacaacaaaaugucauagacccauggauaaggaauaacuuuguucaagccccaggaggagaauuuacuguauccccuagaaaugcuccaggagaaauauuauggucagcaccacuaggaccagaccuaaauccauaccuaagccacuuagcacgaauguacaacggauacgcaggaggauuugaaguccaagucauauuagcagguaaugcauuuacagcugguaaaaucauauuugcagcaguaccuccaaacuuucccacagaaggccucucaccaucucaaguaacaauguucccccauauaauagucgacguaaggcaacuagaaccaguucuaauaccucuacccgauguuagaaauaacuucuaucauuauaaucaaucaaaugacucaacuauaaaauuaauagcaaugcuauacaccccacuuagagccaauaaugccggagaagaugucuuuacaguaucauguagagucuuaacgcgaccaucuccagauuucgacuuuauauuucuaguuccaccaacuguagaaagccgaacuaaaccuuucacaguaccaauccuaacaguugaagaaaugacaaacucuagauuuccaaucccauuagaaaaauuauucacuggaccaucaucagcauucguaguacaaccccaaaacggaagauguacuacagauggugucuuacuaggaacaacucaauuaucuccaguaaauauauguacauuuagaggagauguuacacauauagcaggaucaagaaauuacacaaugaaccuagcaucacuaaacuggaauaauuacgaucccacagaagaaauacccgcaccacuaggcaccccugauuuugucggaaaaauacagggaguacuaacucaaacgacaaaaggagacggaucuaccagaggacacaaagcaacaguauacacaggaucagcaccauucacaccuaaacuaggaucuguacaauuuucaacagacacagaaaaugacuucgaaacacaccaaaauacaaaauuuacaccaguagguguaauccaagacggaggaacaacucauagaaaugaaccacaacaauggguauugcccucauacucagguagaaauguuccaaauguacaccuugcaccagcagucgcaccaacuuuuccaggugaacaacuacuauucuucagaucaacaaugccaggcugcucuggauacccaaauauggacuuagauugcuuauuaccacaagaauggguccaacauuuuuaucaagaagccgcaccagcacaaucugauguugcacuauuacgauucgucaacccagacaccggucgcguauuauucgaauguaaauuacauaaaucaggauacguuacaguagcucacacaggacaacacgauuuaguuauuccaccaaauggauauuuccgcuuugauaguuggguaaaccaauucuauacacuagcucccauggguaauggaacagguagacgacgauaa

SEQ ID NO: 33766 - RNA, 1617 nt, Artificial Sequence
  derived and/or modified sequence opt6 from VP1__Norovirus_and/or_Norovirus-like__GQ856461
augaaaauggcaaguaaugaugcaaacccuucagauggcuccgcagcaaacuuagucccugaaguaaacaacgaaguaauggcacuagaaccaguaguaggagccgccauagcagcaccuguugcaggacaacagaaugucauagauccuuggauacgaaacaacuucguccaagccccaggcggagaauuuacaguaucaccccgaaaugcaccaggagaaaucuuauggagugcuccacuugguccagaucuaaaccccuauuuaucacacuuagcaagaauguauaacggauaugcaggaggauuugaaguacaaguuauucuagcaggaaaugcuuuuaccgcuggcaaaauaauauucgcagcaguaccaccaaauuuuccaacagaaggacuaucucccucccaaguaacaauguucccacacauaauagucgacguacgacaacuagaaccaguauuaauaccacuaccagacguaaggaauaacuucuaucacuauaaccaaucaaaugacucgaccauaaaauuaaucgcuauguuauacacuccacuccgcgccaacaacgcaggcgaagacguauuuacaguaaguuguagaguacuuacaaggccaucuccagacuuugacuuuauauuuuuaguaccuccaacaguugaaucuagaacaaaaccauucacaguaccaauacuaacaguagaagaaaugacuaacucucgauuuccaauuccacucgaaaaacuauucacuggaccuucaagcgccuuuguaguccaaccacaaaacggaagauguacaacagauggcguacuacuaggaaccacacaauuaucuccaguaaauauuuguacauucagaggagacguaacacauaucgcagguucucguaauuauacaaugaaucuagcauccuugaacuggaauaacuaugacccaacagaagaaauuccagcuccccuagguacuccagacuuuaugggaaaaauacaaggagucuuaacacaaacaacaaaaggugauggaucaacuagaggacauaaagccacuguuuauaccggaucagccccauuuacaccaaaauuaggaaguguucaauucuccacagauacagaaaaugauuuugaaacucaucaaaauacaaaauucacaccaguaggaguaauccaagacggaggaacaacccaccgaaacgaaccacaacaauggguauuaccaucauauucaggaagaaacguacccaauguucauuuagcaccagcaguagcaccaaccuuuccaggagaacaacuauuauucuuuagaucaacaaugccaggaugcucaggcuauccaaauauggaccuagauuguuuacuaccacaagaauggguacaacauuuuuaucaagaagcugcucccgcacaaagcgauguagcccuucuuagauuuguaaacccugauacaggaagaguccuauucgaaugcaaguuacacaaaucuggauauguuacagucgcucauaccggacaacaugauuuaguuaucccacccaaugguuauuuuagauucgauaguuggguaaaucaauucuauacacuagccccuaugggaaacgguacagguagaagaagauaa

SEQ ID NO: 33767 - RNA, 1617 nt, Artificial Sequence
  derived and/or modified sequence opt6 from VP1__Norovirus_and/or_Norovirus-like__AB541245
augaaaauggcaucaaaugacgcuaauccaucagacggaucagcagcuaacuuaguaccagaaguuaauaaugaagucauggcacucgaacccgucgucggagcagcaauagcagcaccaguagcaggacaacaaaaugucauagaccccuggauaagaaauaacuuuguacaagcaccugggggagaauuuacaguaagcccaagaaaugcaccaggagaaauucucuggucagcaccauuaggcccagaccuaaaucccuaucuaucacacuuagcccgaauguauaacgguuacgcaggaggauucgaaguacaaguaauacuagcaggaaacgcauuuacagcuggaaaaauaauauucgcagcagucccaccaaauuucccaacagaaggacuaucaccaagucaaguuacaauguucccacacauaauaguugauguaagacaacuagaacccguacuaaucccauuaccagacguacgaaauaauuuuuaucacuacaaccaaucaaaugauucuacaauaaaauuaaucgccaugcuauacacacccuuaagagcaaacaaugcaggagaggacguauuuacaguauccuguagaguacuaacaagacccucaccagacuucgauuuuauuuuucuaguaccuccuacaguagaauccagaacuaagccauucacagucccuauccuaacaguugaagaaaugacaaauucacgauucccuauaccuuuagaaaaacuauucacugguccaucaucagcauuuguaguacaaccccaaaacgguagauguacaacagauggaguauuauuaggaacuacacaacucucaccaguaaauauauguacauuucgaggugacauaacgcauauagcaggauccagaaauuacacaaugaauuuagcaucauuaaacuggaacaauuacgaucccacagaagaaauccccgcaccacuaggaacaccagacuuuguaggaaaaauucaaggaguauuaacucaaacaacuaaaggcgacggaucuacacgaggucacaaagcaacagucuauacuggaucugcacccuucacaccaaaauuaggaucuguccaauucucuacagacacugaaaacgauuucgaaacacaucaaaacacaaaauucaccccaguagguguaauccaagacggaucaacaacccauagaaaugaaccacaacaaugggucuuaccaucuuacucuggacgaaaugcacauaacguucauuuagcacccgcuguugcaccuaccuuuccaggugaacaacuauuauucuucagaucuacaaugccaggauguucaggauaucccaauauggaucuagauuguuuacuaccacaagaauggguacaacacuuuuaucaagaagcagcuccagcacaaucagacguugcacucuuacgauucguaaacccugacacaggaagggucuuauucgaauguaaacuacacaaaaguggauacgucacaguagcccacacaggacaacaugacuuagucauuccaccaaacggauauuucagauucgacuccuggguaaaccaauucuauacuuuagcuccaaugggaaauggaacaggaagaagacgauaa

SEQ ID NO: 33768 - RNA, 1617 nt, Artificial Sequence
  derived and/or modified sequence opt6 from VP1__Norovirus_and/or_Norovirus-like__AB541229
augaaaauggccucaaaugaugcaaacccaucagaugguagugccgcaaaccuaguuccagaaguaaacaaugaaguaauggcauuagaaccaguaguaggagcagcuauagcagcaccaguagcuggccaacaaaacguaauagaccccuggauacgaaacaacuuuguacaagcuccaggaggagaauuuacgguaucaccaagaaaugcuccaggagaaauacuuuggucagcaccauuaggaccagauuuaaacccuuauuuaucacauuuagcaagaauguauaauggauacgcaggaggauucgaaguccaaguaauacuagcuggaaaugcauuuacagcgggaaaaauaauauucgcugcaguaccucccaauuuuccaacagaaggauuaaguccaagucaaguaacuauguuuccacacauuauaguagauguaagacaauuagaacccguacuaauaccacuaccugauguacgaaacaauuucuaucacuauaaccaaaguaaugacagcacaauuaaacuaauagcuauguuauacacaccccuucgagcuaacaaugcaggcgaagacguuuucaccguaucaugucgagucuuaacaagaccaucuccagacuucgauuucauauuuuuagucccuccaacagucgaaucaagaacaaaaccauucacaguaccuauacuaacuguugaagaaaugacaaacucuagauuccccauaccuuuagaaaaauuauuuacaggaccuucuucagcuuuuguaguacaaccgcaaaaugguagauguacaacagacggaguauuacuaggaacuacacaauuaucacccguaaauauauguacauuuagaggcgacguaacccauaucgcaggaucaagaaauuauacaaugaauuuagcaucauuaaauuggaacaacuacgauccuacagaagaaauaccugcaccacuugguaccccagacuucguugguaaaauucaagguguccuuacccaaaccaccaaaggagauggauccaccagaggacauaaagcaacagucuauacuggaucagccccauuuacaccaaaauuaggaaguguccaauucucaacagauacagaaaacgauuuugaaacccaucaaaacaccaaauucacaccaguagguguaauacaagacgguucaacuacucaucgcaacgaaccacaacaauggguacuaccuucuuauuccggucgaaacguacaaaauguucaccuagcaccagcaguagcuccaaccuucccaggagaacaacuucuauucuuucgaucaacaaugcccgguuguucaggcuauccaaauauggaccucgacugcuuauuaccucaagaauggguacaacauuucuaccaagaagcagcaccagcccaaagugacguagcacuacuaagauuuguaaacccagauacaggcagaguacuauuugaaugcaaacuccacaaaucaggauacguuacagucgcacacacuggacaacaugauuuaguaaucccacccaauggauauuuccgauucgauagcuggguaaaucaauucuauacuuuagcaccuaugggaaauggagcugguagacgacgauaa

SEQ ID NO: 33769 - RNA, 1617 nt, Artificial Sequence
  derived and/or modified sequence opt6 from VP1__Norovirus_and/or_Norovirus-like__AB541226
augaaaauggcauccaacgacgcuaacccaucagacggaucagcagccaacuuaguccccgaaguaaacaaugaaguaauggcccuagaacccguaguaggagcugcaauagcugcaccgguagcuggucaacaaaacguaauagacccauggauacgcaauaauuuuguccaagccccuggcggagaauuuacaguauccccacguaaugcaccaggagaaauacuauggucagcaccauuaggaccagaucuaaauccauauuuaucucaccuugcucgaauguauaacggauacgcaggaggauuugaaguacaaguaauacuagcuggaaaugcauuuacagcaggaaaaaucauauucgccgcugucccaccaaauuuucccacagaaggacuaucaccaucacaaguaacaauguucccucauauaauaguagacguuagacaacuagaaccaguacuaauaccacuaccagauguaagaaauaacuucuaccauuacaaucaaucaaaugacucuacaauuaaauuaauagcaauguuauauacaccauuaagagccaacaaugcgggugaagacguauuuacaguuucauguagaguauuaacaagacccucaccugacuucgacuuuauauucuuaguucccccuacagucgaaucaagaacaaaaccauuuacaguaccuauauuaacaguagaagaaaugacaaacucaagauucccaauuccauuagaaaaauuauucaccggacccucaagugccuucgugguacaaccacaaaacgguagauguacaacagacggaguucuuuuaggaaccacacagcuuucaccagucaauauauguacauuuagaggagacguaacacauauagcuggaucaagaaauuacauaaugaaucuagcaucacuaaacuggaacaauuacgauccaacugaagaaauaccagcaccauuaggaacaccagacuuuguaggaaaaauucaaggaguacuaacacaaacuacaaaaggagacggaucuacgagaggucacaaagcaacagucuauacaggaucagcacccuucaccccaaaacuaggaucaguacaauuuucuacagauacagaaaacgacuucgaaacucaccaaaacacaaaauucacaccaguuggcguaauacaagacgguaguacaacacaucgaaacgaaccacaacaguggguuuuaccaucauacucaggcagaaauguacacaacguacaccuagcaccagcaguagcaccaacuuuuccaggagaacaauuauuauucuuuagauccacaaugccagguuguucuggcuauccaaauauggaucuugauugucuacuaccacaagaauggguacaacauuuuuaucaagaagcagcaccagcacaaucagacguagcauuauuaagauuuguaaacccagauacuggacgaguccucuucgaaugcaagcuacacaaaaguggauauguaaccgucgcacacacaggacaacacgauuuaguuauuccaccaaacggcuauuucagauuugacucaugggucaaccaauucuauacacuaacaccaaugggaaaugguacaggaagaagaagauaa

SEQ ID NO: 33770 - RNA, 1617 nt, Artificial Sequence
  derived and/or modified sequence opt6 from VP1__Norovirus_and/or_Norovirus-like__DQ078814
augaaaauggcuucaaaugacgccacaccuucagauggcaguacagcuaacuuaguaccagaaguuaauaaugaaguuauggccuuagaaccaguuguaggagcagcuauagcagcaccaguagcaggacaacaaaauguuauagacccauggauaagaaacaacuuuguucaagcaccaggaggugaauuuacaguaucuccaagaaaugcaccaggugaaauacuaugguccgcaccucucggaccugaccuaaauccauacuuaucacauuuagcaagaauguacaacggauaugccggaggcuucgaaguacaaguaauacuagccgguaaugcauuuacagcuggaaaaauuaucuucgccgcagucccaccaaacuuuccaacagaaguauuaucaccaucccaaguaacaauguucccacacauaauaguagauguaagacaacucgagccaguacuaauaccacuuccagauguaagaaacaacuuauaccacuauaaccaaucuaaugacccaaccauuagacuaauagcaauguuauauacaccccuaagagcaaacaacgccggagacgacguuuucaccguauccugcagaguacucacaagaccaucaccagacuuugacuuuauauuucuaguuccaccaacugucgaauccagaacuaaaccauuuucaguacccauauuaacaguagaagaaaugacuaauucaagauuuccaauuccacuugaaaaauuauuuaccggacccucuuccgcauucguaguacaaccacaaaauggacgcuguacaacagauggagucuuacuaggaacaacacaauuaagcccaguaaauauauguaccuuuagaggcgaugucacacauauagccggaacccagaacuacacaaugaaccuagccucacaaaacuggaacaauuacgauccuacagaagaaauuccagcaccccuaggaacaccagauuuuguaggacgaauacaaggaguacucacacaaaccacacgaagagacgguucaacacgaggacacaaagcaacaguuaguaccggaucaguacauuuuacuccaaaacuuggaucaguacaauucucaaccgauacaucaaaugacuucgaaacuggucaaaauaccagauucaccccuguaggaguuguccaagauggaucaaccacacaccaaaaugaaccccaacaauggguccuaccagacuauagcggcagagauucucauaacguacacuuagcaccagccguagcuccaacauuucccggagaacaacucuuauucuuucgaucaacaaugccagguugcucugguuauccaaauaugaauuuagauuguuuacuaccucaagaauggguacaacauuuuuaucaagaaucugcaccggcucaaucagacguugcauuacucagauuuguuaacccagauacaggacgagucuuauuugaauguaaauuacauaaaucaggcuauguuacaguagcucacacaggacaacacgaucuaguaauaccaccuaauggcuauuuucgauucgauucaugggucaaucaauuuuauacauuagcaccgaugggaaauggagcgggccgacgaagauaa

SEQ ID NO: 33771 - RNA, 1617 nt, Artificial Sequence
  derived and/or modified sequence opt6 from VP1__Norovirus_and/or_Norovirus-like__EU078416
augaaaauggcaucuaaugacgcaaacccuucagauggaucagcugccaauuuaguaccugaaguaaacaacgaaguaauggcauuagaaccaguaguaggagcagcuauagcugccccagucgcaggacaacaaaauguuauagauccauggauacgcaauaacuucguacaagcaccuggcggugaauuuacagucucuccccgaaacgcacccggcgaaauacuauggucagcaccauuagguccagaucuaaaucccuauuuaagccacuuagcaagaauguauaaugguuaugccgguggauuugaaguacaaguaauacuugcaggaaacgcauucacagcaggcaaaauuauuuucgcagcaguaccuccuaacuuuccaacagaaggucuaucaccaucucaaguuacaauguucccacacauaauaguagacguuagacaacuagaaccaguuuuaauuccucuaccagacguuagaaacaacuucuaucacuauaaccaaucaaacgauucuacaauaaaacuaauagccaugcuauauaccccuuuacgagccaacaacgcuggugaagacgucuucacaguuucauguagaguuuuaacccgaccaucaccugauuuugauuucauauuuuuaguaccaccaaccguugaaagcagaacaaaaccauucucuguuccaauauuaacagucgaagaaaugacaaauucaagauuuccaauaccacuugaaaaacuuuucaccggaccaucaucagcauucguaguccaaccacaaaauggcagauguacuacagauggaguauuacuaggaacuacacaacuaucuccaguuaauauuuguacauuucgaggagauguaacacacauagcaggaacacaagaauacacaaugaaucuagcaucucaaaacuggaacaauuacgauccaacagaagaaauacccgcaccauuaggaacuccagacuuuguaggaaaaauccaaggaguacuaacucaaacaacacgcagagacggauccacacgaggacacaaagccacuguaucaacaggaucaguacauuucacaccaaaacuaggacguauacaauucuccaccgacacaucgaacgauuuugaaacaggacaaaacaccagauucacaccaguagguguaguacaagacggaucuacaacacaucaaaacgaaccucaacaauggguauuacccaacuauucaggacgcgacucacauaacguacaucuagccccugcaguagcaccaucauuuccaggagaacaacucuuauucuuuagauccacaaugccaggaugcucuggauacccaaacauggauuuagacugcuuauuaccacaagaauggguacaacacuuuuaccaagaagcagcaccagcacaaucagacguugcccuuuuaagauuuguuaauccagauacagguagagucuuauucgaaugcaaacuucauaaaucaggauacguaacaguugcacauacaggacaacaugaucuaguaauaccaccaaacggauauuuuagauucgacucauggguuaaucaauuuuauacucuagcaccaaugggaaacggaacaggcagaagacgauaa

SEQ ID NO: 33772 - RNA, 1617 nt, Artificial Sequence
  derived and/or modified sequence opt6 from VP1__Norovirus_and/or_Norovirus-like__EU839590
augaaaauggcaucaaaugaugcuaacccuucuggaggaucagccgcaaaccuaguacccgaaguuaacaaugaaguaauggcucuugaaccagucguaggagcugcuauugccgcaccagucgcuggccaacaaaauguuauugauccauggauaagaaauaacuuuguacaagcaccuggaggagaauuuaccguaagcccuagaaaugcaccaggagaaauauuauggagcgcaccauuaggucccgaccuaaauccauacuuaucucaccuugcuagaauguauaacgguuaugcugguggcuucgaaguacaaguaaucuuagcaggaaaugcauucaccgcaggaaaaauaauauuugcagcaguaccaccaaauuuuccaacugaaggacuaucuccuagucaaguaaccauguuuccucacauaauuguagacguaagacaacuagaacccguuuuaauaccauuacccgauguaagaaacaacuucuaccauuacaaucaauccaaugauucuacuaucaaacuaaucgcaauguuauacacaccauuaagagcuaauaaugcuggcgaagacguuuucaccguaucaugucgaguacucacacgaccaucaccagacuuugauuuuauauuuuuaguaccacccaccguagaaagcagaacuaaaccauucaccguaccaauacuuacagucgaagaaaugaccaacucaagauucccaauaccacuugaaaaacuauuuacaggaccaucaucagccuucguaguacaaccucaaaacggacguugcacaacagacggcguuuuauuaggaaccacccaacuaucaccaguaaauauauguacauuuagaggagacguaacacauauagcuggaucacgaaauuacacaaugaacuuggcuucauuaaacuggaacaauuacgauccaacagaagaaauaccugcaccauuaggcacaccagacuucgucgguaaaauccaaggaguucuaacacaaacaacaaaaggugacggaucaacaagaggucauaaagcuacugucuauacaggaucagcaccauuuacaccaaaacuaggaucaguacaauuuucaaccgacacagaaaaugauuuugaaacccaucaagauacaaaauucacuccaguuggaguaauacaagauggcgguacaacacauagaaacgaaccacaacaauggguauuaccuucuuauucuggcagaaacguccaaaacguucaccuagcaccagcaguugcaccaacauuuccaggagaacaacuauuauucuuccgaucaacaaugccaggauguucaggauauccaaauauggaucuagacugucuacuuccacaagaauggguacaacauuuuuaccaagaagccgcaccagcacaaucagacguugcauuauuaagguuuguaaaccccgacacuggcagaguacuauuugaaugcaaacuacauaaaucaggauauguaaccguagcccauacaggacaacaugaucucguaauaccaccuaauggcuauuuuagauuugauucauggguaaaccaauucuauaccuuagcaccaaugggaaacggaacuggcagaagacgauaa

SEQ ID NO: 33773 - RNA, 1617 nt, Artificial Sequence
  derived and/or modified sequence opt6 from VP1__Norovirus_and/or_Norovirus-like__AB294783
augaagauggcaucuaacgaugcuacaccaucagauggaucuacagcaaacuuagucccagaaguaaauaaugaaguuauggcuuuagaaccaguaguuggugcugcaauugcugcaccaguagcaggacaacaaaauguaauagacccauggauucgaaacaacuuuguacaagcccccggcggagaauuuacaguuucuccaagaaaugcaccuggagaaauacuauggucagcaccacucggaccagaucugaauccauaccucucacacuuagcccguauguauaacggauacgcaggaggauucgaaguccaaguuaucuuagcagguaaugccuucacagcaggaaaaauaauuuuugcagcaguaccaccuaauuuuccaacagaaggucuaucaccaucacaaguaacuauguuuccacauauuauaguugacguuagacaacuagaaccaguauuaauaccuuuaccagacguuagaaauaauuucuaucauuauaaccaaucaaacgacccuacaauuaaauuaaucgcaaugcuauacacacccuuaagagccaauaaugcaggagaugauguauucacuguuagcugccgcguacuaacacgcccauccccagauuucgacuuuauauuuuuaguacccccaacagucgaaucucgaacaaaaccauucucaguaccaauuuuaacaguugaagaaaugacuaauucacguuucccaauaccacuagaaaaauuauuuaccggaccauccuccgcauucgucguacaaccacaaaacggacgauguacaacagacggagucuuacuaggcacaacccaauuaucacccguaaauauaugcacauuucgaggagacgucacacauauagcaggaacacaaaacuacacaaugaauuuagcuucacaaaauuggaacaauuacgacccaacugaagaaauccccgcaccacuuggaacaccagacuuuguugguaaaauacaaggugucuuaacccaaaccacucgaggagacggaucaacaagaggacauaaagcaacagucucaaccggaucaguacauuuuaccccaaaauuaggaucaguacaauucucaacagauacaucaaacgauuucgaaacaggacaaaacacuagauuuacuccagucggaguaguacaagacgguucuaccacucaccaaaacgaaccacaacaauggguacuaccaaacuacucaggcagagacagccauaacguucaucuagcuccugcaguagcaccaacauuuccaggugaacagcuccuauuuuucagauccacuaugccaggaugcucuggauaccccaauaugaaccuugauuguuuauuaccacaagaauggguacaacauuuuuaccaagaaucugccccugcacaaucugacguagcacuucuaagauucguaaauccagacacaggucgaguauuauucgaaugcaaacuacacaaaucaggauauguaaccguugcacacacaggccaacaugaucucguuauaccacccaaugguuauuucagauuugacucauggguaaaucaguuuuauacauuagcccccaugggcaauggugcaggacgacgucgauaa

SEQ ID NO: 33774 - RNA, 1617 nt, Artificial Sequence
  derived and/or modified sequence opt6 from VP1__Norovirus_and/or_Norovirus-like__AB303941
augaaaauggcauccaaugaugcaacaccaucagaugguucaacagcuaaccuaguacccgaaguaaacaaugaaguaauggcuuuagaaccaguuguaggagcagcaauagcagcaccaguugcaggacaacaaaacguaauagauccauggauacgaaacaauuuuguacaagcaccaggaggcgaauuuacagucuccccaagaaacgcaccaggugaaauauuaugguccgcaccacuaggaccagacuuaaauccauaccuaagucaucucgcaagaauguauaacgguuacgccggcggcuucgaaguacaaguaauacuugcagguaaugcauuuacagcaggaaaaauaauuuucgcagcaguacccccaaacuucccuacagaaggauuaucucccucacaaguaacaauguucccacauauaauaguugauguaagacaauuagaaccaguuuuaauaccauuaccugauguaagaaacaauuucuaucauuauaaucaaucaaaugaccccacaauaaaauuaauugccauguuauacacaccacuaagagcaaauaacgccggcgacgauguauucacaguauccugccgaguacuaacaagaccaucaccagacuucgauuuuauauuucuaguuccaccaacagucgaaucaagaacuaaaccauucucuguaccaauacuaacaguagaagaaaugacaaacucaagauuuccaaucccacuugaaaaacuauuuacgggaccgucaucagcauucguaguacaaccacaaaacggaagauguacuacugaugguguacuucuaggaaccacacaacuaucaccuguaaacauauguacauucagaggcgacguuacacauauagccggaacacaaaauuacacgaugaauuuagcaucucaaaacuggaacaauuaugaucccacagaagaaauaccagccccacuaggaacaccagacuucguuggaaaaauacaaggaguuuuaacacaaacaacaagaagagacggcucaacacgaggacauaaagcuacaguaucaacaggaagcauucacuuuacacccaaacuaggaucaguacaauucucuacagacacaucaaacgacuucgaaacaggacaaaacaccagauuuaccccaguaggcguuguacaagacggcucaacaacacaccaaaacgaaccacaacaauggguauuaccagauuauuccggucgagauucgcacaacguacacuuagcaccagcugucgcaccuacauucccaggagaacaacuacuuuucuuuagaucaacaaugccaggaugcucaggauaucccaauaugaaucuagacugucuauuaccacaagaauggguacaacauuuuuaccaagaauccgcacccgcacaaucagacgucgcacuuuuaagauucguuaauccagauacaggaagaguauuauuugaauguaaacuacauaaauccggauauguaacaguagcacauacaggucaacaugacuuaguuauaccaccaaauggcuacuucagauucgacucauggguuaaccaauuuuacacacucgccccaaugggcaauggagcuggaagaagacgcuaa

SEQ ID NO: 33775 - RNA, 1617 nt, Artificial Sequence
  derived and/or modified sequence opt6 from VP1__Norovirus_and/or_Norovirus-like__EF126961
augaaaauggcauccaaugaugcaacuccuuccgauggaucaaccgcaaauuuagucccagaaguaaauaaugaaguaauggcacuagaaccggucguaggagcagcuaucgcagcaccaguugcaggacaacaaaacguaauugauccauggaucagaaauaauuucguacaagcaccaggaggugaauuuacaguaucccccagaaacgcacccggugaaauacucuggucagcuccacucgguccagauuuaaaucccuacuuaucacaccuagcaagaauguauaaugguuaugcaggaggauucgaaguccaagucaucuuagcaggaaaugcauuuacagcaggaaaaauaauauucgccgcaguaccaccaaauuuuccaaccgaaggucuaucuccuucccaaguaacaauguucccacauauaauaguugauguacgacaacuagaaccaguacuuauaccauuaccagauguaagaaauaauuuuuaucacuauaaucaaaguaacgacccaaccauaaaauuaauagcaaugcuuuauacuccucuaagagcaaacaacgccggagacgauguauucacaguuucuugcagaguauuaacaagaccaucccccgacuuugacuuuauauuuuuaguaccaccuacaguagaauccagaacaaaacccuucucaguaccaauauuaacagucgaagaaaugacaaauucaagauuuccaaucccacuugaaaaacuauucaccggaccaucaucugccuuuguuguacaaccacaaaauggaagauguaccacagacgguguucuauuagguacuacccaacuaucuccaguaaauaucugcaccuucagaggagacguaacccauauagcaggaacacaaaauuauacuaugaaucuagcaucccaaaacuggaacaauuaugauccaacugaagaaaucccugcaccauuaggcacacccgacuucguaggaaaaauccaagguguuuuaacacaaaccacaagaagagauggaucaacuagaggacacaaagcaacuguuaguacaggaucaguucacuuuacaccaaaacuaggcuccguacaauucucuacagauacaucaaacgauuucgaagcaggacaaaauacccguuucacacccgucggaguaguacaagacggaucaacaacacaccaaaaugaaccccaacaauggguuuuaccagauuauucagguagagauucacauaacguucauuuagcuccagcaguugcaccuacuuuuccuggcgaacaauuauuauucuuuagaagcacaaugccaggcuguucagguuacccaaacaugaaccuagacugccuuuuaccacaagaauggguucaacauuuuuaucaagaaucagccccagcacaaucugacguagcacuucugagauucguaaauccagauacaggaagaguuuuauucgaauguaaauuacauaaaucaggcuauguaacuguagcauauacuggacaacacgaucuaguaaucccaccaaauggauauuucagauucgauagcuggguaaaccaguuuuacacacuagcaccaaugggaaauggagcaggccgacgaagauaa

SEQ ID NO: 33776 - RNA, 1617 nt, Artificial Sequence
  derived and/or modified sequence opt6 from VP1__Norovirus_and/or_Norovirus-like__LC153749
augaaaauggcaucaaaugacgcaaauccaucagauggaucugcggcaaacuuaguaccagaaguuaacaaugaaguaauggcauuagaaccuguaguaggugcagccauugcagcccccguagcuggacaacaaaauguuauugacccauggauaagaaacaacuuuguccaagccccaggaggcgaauuuacaguuuccccacgaaaugcaccuggagaaauauuauggucagcuccuuuaggaccagauuuaaauccauaccuaucacaccuagccagaauguauaaugguuacgcaggaggauucgaaguacagguuauccucgcuggaaacgccuuuacagcaggaaaaauaaucuucgccgcaguaccaccuaacuuuccaacagaaggacuauccccuucacaaguaacaauguuuccacacauaauaguagacguaagacaacuagaaccaguacucauaccucuccccgauguacguaauaauuucuaucauuauaaucaaucaaaugacucuacaauaaaauuaauagcaaugcuuuacacaccauuaagagcuaacaaugcuggugaagacguauuuaccgucagcugucgaguacucacaagaccaucacccgacuuugacuuuauauuuuuaguucccccgaccguugaaucuagaacaaaacccuuuaccguaccaauauuaacaguagaagaaaugacuaauucuagauuuccaauaccauuagaaaagcuauuuacaggaccauccucagcauuuguaguacaaccacagaacggaagauguaccacagacggaguauuacuuggaacaacucaacuaucuccagucaauauaugcacauuucguggagacguuacacauauagcaggcucaagaaacuauacaaugaaucuagcaucauuaaacuggaauaauuacgaucccacagaagaaauaccagcaccacuaggaacacccgauuuuguaggaaaaauacaaggagucuuaacacaaacaacaaaaggagauggcuccacacgaggacacaaagccacuguauauacagguuccgcaccauuuacuccaaaacuaggaaguguacaauucucaacagauacagaaaaugauuuugaaacucaucaagacacaaaauucacaccuguaggaguuauacaagauggcggaacaacacauagaaacgaaccacaacaauggguccuaccaucauauucaggaagagauguuccaaauguacaucuagccccagccguagccccaacauucccaggagaacaauuacuauuuuucagaucaacuaugccaggaugcucaggauauccaaauauggaucuagacugucuucuaccacaagaauggguacaacauuuuuaccaagaagcagcuccagcucaaucagauguagcacuauuacgauucguaaacccagacacuggaagaguacuauuugaaugcaaacuacauaaaucaggauauguaacaguagcccacacaggacaacacgauuuaguuauaccaccaaauggauacuucagauucgacuccuggguaaaccaauuuuacacauuagcuccaaugggaaauggaacaggcagaagacgauaa

SEQ ID NO: 33777 - RNA, 1617 nt, Artificial Sequence
  derived and/or modified sequence opt6 from VP1__Norovirus_and/or_Norovirus-like__KX371610
augaaaauggcauccucagaugccaauccaucagauggcucagcagcaaacuuaguuccagaagucaauaaugaaguaauggcauuagaaccaguuguaggagcagcuaucgcagcaccuguagccggacaacagaacguaauagauccauggauuagaaauaacuuuguacaagcaccugguggagaauuuacaguaucuccuagaaacgcacccggagaaauauuauggucagcaccauuaggaccugaucuuaauccuuaucucucacaccuagcaagaauguacaauggcuacgcuggaggauucgaaguacaaguaauauuagcaggaaaugcauucacagccggaaaaguuauauucgcugccguaccaccaaacuuuccuacagaaggauuaucaccaucacaaguaacaauguuuccucacauuguuguugauguuagacaacuagagccaguccuuauaccauuaccagauguaagaaacaauuuuuaucacuauaaccaaucuaaugacccuaccauaaaacuaaucgcuauguuauacacaccauuaagagccaauaaugcuggugaugacguauuuacuguauccugcagaguacuaacaagaccuucuccagacuuugauuuuauuuuccuaguaccacccacaguagaaaguagaacuaaacccuucucagucccuguucucacugucgaagaaaugacaaacucaagauuucccauaccauuagaaaaacucuuuacagguccaaguagcgcauuugucguacaaccacaaaacggaagauguacaacagacgguguauuacucggaacaacacaauuaucuccaguuaauauauguacauuuagaggagauguaacacauauaacaggcucacggaauuacacuaugaacuuagcaucacaaaauuggucaaauuacgauccaacagaagaaauaccagcuccauuaggaacaccugauuucguaggcaaaauccaagguguauuaacacaaaccacacgaacagauggaucuacaagaggacauaaagcuacaguauauacaggcucugcagauuuugcacccaaauuaggaagaguacaauucggaacagacacagaucacgauuuugaagcaaaccaaucaaccaaauucacaccaguaggaguaauacaagacggaucuacaacucacagaaaugaaccacaacaauggguucuacccucauauucaggacggaauacuccuaauguacauuuagcacccgcagucgcaccaacauuuccaggagaacaacuauuauuuuucagauccacaaugcccggaugcuccggauacccaaacauggauuuagacugucuucuaccacaggaauggguccaauauuuuuaucaagaagcugcaccagcacaaagugauguagcacuauuacgauucguuaacccagacacuggaaggguauuauucgaaugcaaacuacacaaaucaggauauguaacaguagcacacacaggccaacaugaccuaguaauaccaccaaacgguuauuuuagauuugauucauggguaaaucaauucuacacuuuagcaccaaugggaaaugguacaggaagaagacgauaa

SEQ ID NO: 33778 - RNA, 1617 nt, Artificial Sequence
  derived and/or modified sequence opt6 from VP1__Norovirus_and/or_Norovirus-like__KX354031
augaaaauggcuagcucugacgccaacccuucagacggaucagcagccaaccuuguaccagaaguaaauaacgaaguuauggcauuagaaccaguaguaggugccgcaaucgcagcaccuguagcaggacaacaaaauguaauagacccuuggauacguaacaauuuuguacaagcaccaggaggcgaauuuacaguaucaccaagaaacgcaccaggagaaauccuuugguccgcaccauuagguccugaccuaaauccauaccuaucucaucuagcaagaauguauaacggauaugcaggaggcuuugaaguacaaguuauacuugcaggaaaugcauuuacagcuggaaaagucauauucgcagcuguuccaccaaacuuuccaacagaaggauuaucaccaucccaaguuacaauguucccacauauaguuguagacguacgacaacuagaaccuguacuaaucccacuaccagauguaagaaauaacuucuaucacuacaaucaaucaaaugacccaacaauaaaacucauagcuauguuauauacaccucuuagagcuaacaaugccggugaugauguauuuacaguaucauguagaguauuaacacgaccaucacccgacuuugacuuuauauuccuugucccaccuacuguagaaucacgaacaaaaccauucucuguaccaguucuaacugucgaagaaaugaccaacucaagauuuccaauaccauuagaaaaauuauuuaccgguccaaguucagcauucguuguacaaccacaaaacgguagaugcacaacugauggaguauuauuaggaacaacacaauuaucuccaguaaauauuuguacauucagaggugacguaacacauauuacagguucaagaaacuacacaaugaaccuugcaucacaaaauuggaauaauuacgacccaacagaagaaauaccagcuccuuuaggaacaccagacuuuguuggaaaaauacaaggaguucuaacacaaacaacacgaacugacggaucaacaagaggucauaaagcaacaguuuauacaggaucagcagacuucgcaccaaaacuaggaagaguacaauuugguacugauacagaucacgauuuugaagcuaaucaaaauaccaaauuuacaccaguugguguaauacaagacggaucaacaacgcauagaaaugaaccacaacaauggguacucccaucauacucugguagaaauacucacaacgugcaccuagcuccagcagucgccccuacuuuuccaggcgaacaacuauuauucuuuagaaguacuaugcccgguugcucaggauauccaaacauggauuuagacugucuacucccacaagaauggguacaauauuuuuaccaagaagcagcacccgcccaaucagacguagcauuacuaagauuuguaaaccccgacacuggaagaguucuauuugaaugcaaacuacauaaaucuggauauguaacaguagcucacacaggccaacacgaucuagucaucccuccaaauggcuauuucagauucgacaguuggguuaaucaauucuacacacucgcaccuaugggcaauggcacaggacgaagaagauaa

SEQ ID NO: 33779 - RNA, 1617 nt, Artificial Sequence
  derived and/or modified sequence opt6 from VP1__Norovirus_and/or_Norovirus-like__KX353990
augaaaauggcaagcaacgaugcaaacccaucugauggaucaacugcuaacuuaguuccagaaguaaacaacgaaguuauggcacuagaacccguaguuggugcagcuauagcugcaccagucgccggacaacaaaauguuauagauccauggauaagaaauaacuuuguacaagccccaggcggagaauuuacaguaucacccagaaaugcgccuggagaaauacuauggucagcaccacuaggaccagaucucaacccuuacuuaucacacuuagcaagaauguauaacggauacgcuggaggauucgaaguccaagucauucucgcagguaaugcauuuacagcuggaaaaauaauuuuugcagccguaccaccaaauuuuccaacagaaggacuaucacccucacaaguaaccauguucccacauauaauuguagacguaagacaacuagaaccuguauuaauuccccuaccagacguuagaaauaauuucuaccauuacaaucaaucaaaugacccgacaauaaaauuaauagcuauguuauacacuccccuaagagcuaauaaugccggagaugacguauuuacaguaucuugccguguacucacuagaccaaguccagauuuugacuuuauuuucuuaguaccaccaacugucgaaucaagaacaaaaccauuuuccguaccuguuuuaacaguugaagaaaugacuaacaguagauucccaauaccauuagaaaaacuauuuacaggaccaucaucagcauuuguuguucagccacaaaacgguagauguaccacagacggaguauuauuaggaacaacacaauuaucaccaguaaauauauguacuuuuagaggagauguaacacauauagcaggaucaagaaacuauacaaugaaccucgcaucacaaaauuggaacuccuacgauccaacagaagaaauaccugcaccacuaggaacaccagauuucguaggaaaaauacaagguguauuaacccaaacaaccagaacagacggaucaacucgcggacacaaagcaacaguauacacuggaucagcagauuuuuccccaaaacucggaagaguacaauuugcaacagacaccgacaaugacuuugaaacaaaccaaaauacaaaauucacaccaguaggaguaauacaagauggagguacaacacauagaaaugaaccucaacaauggguacuacccucauauagugguagaaauacacacaauguucauuuagcaccagccguagcuccaacauuuccaggugaacaacuccuuuucuuuagaucaaccaugccagguugcucaggcuaucccaauauggaccuagauugccuauuaccucaagaauggguacaauauuuuuaucaagaagcagcaccggcacaaagugacgucgcacuacuaagauuuguaaauccagacacaggacgaguucuauuugaaugcaaauuacauaaaucagguuauguaacagucgcacacaccggacaacaugaccuaguaauaccuccaaacggauauuuucguuuugauucauggguaaaccaauuuuacacauuagcaccaaugggaaauggaacaggacgaagaagauag

SEQ ID NO: 33780 - RNA, 1617 nt, Artificial Sequence
  derived and/or modified sequence opt6 from VP1__Norovirus_and/or_Norovirus-like__KX353972
augaaaauggccucaaaugacgccaacccaucagauggaucuacagcaaauuuaguaccagaaguaaauaaugaaguaauggcauuagaaccagucguaggugcagcaauagcugcaccaguagcaggacaacaaaauguaauugauccuuggauaagaaauaacuuuguacaagcuccaggcggagaauuuacuguuucaccaagaaaugccccaggcgaaauacuuuggucagcaccacuagguccugacuuaaauccauaucuaucccacuuagcaagaauguauaacggauacgcugguggcuucgaaguacaaguuauacucgcaggaaaugcuuucacagcaggcaaaauaauauucgcagcaguaccaccaaacuuuccaacagaaggacuaucaccuucgcaagucacaauguucccacacaucauaguagacguaagacaauuagaaccaguacuaaucccauuaccagauguacguaauaauuucuaucacuauaaccaaaguaacgauccaaccauaaaacuaauagcuaugcuauacacaccauuacgcgccaacaaugcuggugacgacguauucaccguaucaugcagaguccuuacacgaccaagucccgacuuugauuucauauuucucguaccaccaacaguagaaucaagaacaaaaccauucucaguuccaguacuaacagucgaagaaaugacaaacucucgauuucccauaccucuagaaaaacuauuuaccggaccauccucugcauuuguaguacaaccacaaaacggcagaugcacuaccgauggaguuuuguuaggaacaacacaauuaucaccaguaaauauauguacauucagaggagauguaacacauauaacaggaucaagaaauuacacaaugaaucuagcaucacaaaauuggaacucauaugaccccacagaagaaauaccagcuccauuagguacaccugacuuuguaggaaaaauucaaggaguauuaacacaaaccacucgcacugauggaucaaccaggggucacaaagcaacugucuauaccggaucugcagacuuuucaccaaaauuaggcagaguccaauuugcuacugauacagauaacgacuuugaaacaaaucaaaacacaaaguucaccccagucggcguaauacaagaugguggaacaacucauagaaaugaaccacaacaauggguacucccaucauauucaggaagaaauacacauaauguacaccuagcaccagcaguagcaccaaccuucccaggagaacaacuauuauucuuucgaucuacaaugccaggauguucuggauauccaaauauggaucuugacugucuauuaccacaagaauggguacaauauuuuuaccaagaagcagcuccagcucaaucagauguagcauuauuaagauucguuaacccagauacaggacgaguacuauucgaauguaaauuacauaaaucagguuacgugaccguagcacacacgggccaacacgaccuaguuauaccaccuaauggauacuuuagauucgauuccuggguaaaucaauuuuauacacuugcuccaaugggaaacggcacuggaagaagaagauaa

SEQ ID NO: 33781 - RNA, 1617 nt, Artificial Sequence
  derived and/or modified sequence opt6 from VP1__Norovirus_and/or_Norovirus-like__KX353968
augaaaauggcauccaacgaugccaaccccuccgacggcucagcagcaaacuuaguuccugaagucaacaacgaaguaauggcccuugaacccguaguaggagcagccauagcagcuccaguagcaggacaacaaaacguaauagacccauggauaagaaauaacuuuguacaagcaccagguggagaauuuacuguaucaccacgaaaugcuccaggcgaaauauuauggucagcaccucuuggacccgauuuaaauccauaucuaucacauuuagcaagaauguauaauggauaugcaggcggauucgaaguccaaguaauuuuagcuggaaaugcuuucacagcaggaaaaauaauauucgcugcagucccuccaaauuuuccaacugaaggacuaucuccaucacagguaacaauguuuccucacauaauagucgacguaagacaacuagaaccaguauuaauaccacuaccagaugugagaaacaauuucuaucauuauaaccaaucaaaugacucaacaauaaaacuaaucgcaauguuauauacucccuuacgagcaaacaaugcaggcgacgacgucuucacaguaucauguagaguauuaacaagacccucaccugacuuugauuucauauuuuuagucccuccaacuguagaaucaagaacaaaaccauuuacuguaccaauucuuacaguugaagaaaugacaaauucaagauuuccuauaccauuagaaaaauuauucacaggacccuccucagcauucguuguacagccacaaaacggcagaugcacaacagacggcgucuuauuagguacuacucaacuuuccccuguuaauauauguacauuuagaggagacguaacacauauagcaggcucuagaaauuauacaaugaaucuagcaucauuaaauuggaauaauuacgauccaacugaagaaauaccugcuccauuaggaacaccagacuuuguuggaaaaauacaaggaguguuaacacaaaccacaaaaggagauggaucaaccagaggacacaaagcaacugucuauacaggcuccgcagacuuuacaccuaaauuaggcuccguccaauucgcaacugauacagaaaacgauuuugaaacacaccaaaauacaagauuuacuccaguuggaguaauacaagauggaggaacaacccauagaaaugaaccacaacaauggguacugccaucauauucaggacgaaauauacacaauguacaccuugcacccgccguagcaccaaauuuucccggugaacaauuacuauucuuuagaucaacuaugcccgguuguucaggauaucccaauauggaccuugauugcuuacuuccacaagaauggguacaacacuuuuaccaagaagccgcaccagcacaaucagaugucgcauuauuaagauuuguuaacccugacacaggaagaguauuauuugaaugcaaauuacauaaaucaggauauguaacaguugcacacacuggacaacacgaccuuguaauaccucccaauggauauuucagguucgauucaugggucaaucaauuuuacacucuugcacccaugggaaauggaaccggaagacgaagauaa

SEQ ID NO: 33782 - RNA, 1617 nt, Artificial Sequence
  derived and/or modified sequence opt6 from VP1__Norovirus_and/or_Norovirus-like__KX353967
augaaaauggcauccaacgaugcaaacccaucagaugguucagccgcaaauuuaguaccagaaguaaacaacgaaguaauggccuuagaaccaguaguuggagcagccauagcagcaccuguugcaggacaacaaaauguaaucgauccauggauaagaaacaauuuuguacaagcaccaggaggagaauuuacuguaagucccagaaaugcaccaggagaaauacuaugguccgcaccacucggaccagauuuaaaucccuaucuaucccacuuagcuagaauguauaacgguuaugcaggcggauuugaaguacaaguaauauuagcuggaaacgccuuuacagcaggaaaaaucauauucgcagcaguuccaccaaacuuucccacagaaggccuaucaccaucacaaguaacaauguucccgcacauaauaguagauguaagacaauuagaaccugucuuaauaccacucccagauguaagaaacaauuuuuaucauuauaaccaaucaaaugacucaacaauaaaauuaauugcaauguuauauacaccccuaagagcaaauaaugccggagacgauguauucacuguaucaugcaggguuuuaacccgcccauccccugacuucgacuucauauuccuaguuccaccaacaguagaaucuaggacuaaaccuuucacuguaccaauauuaacaguagaagaaaugacaaacuccagauuucccauaccacuugaaaaacuauucacugguccauccucugcauucguaguacaaccacaaaacggacgaugcacuacagauggaguauuauuaggaacuacucaauuauccccaguaaauauauguaccuuucgaggagaugucacccauauagcaggaucaagaaacuacacaaugaauuuagcuucucuuaacuggaacaauuacgauccaacagaagaaauuccagcaccauuaggaacaccugacuuuguaggaaaaauucaaggcguacuaacacaaacaacaaaaggagacggaucaacuagaggacauaaagcaaccguauauacagguuccgcagacuuuaccccgaaacuaggaucaguacaauuugcuacagauacagaaaacgauuuugagacccaucaaaauacaagauucacaccaguaggaguaauacaagauggaggaacaacacaucgaaaugaaccacaacaauggguacucccaucuuauucugguagaaacauccauaacguccauuuagcaccagcaguggcucccaacuuuccaggugaacaacuuuuauucuuuagaucaaccaugccaggaugcucaggauacccaaacguagauuuagacuguuuauuaccacaagaauggguacaacauuuuuaccaagaagccgcaccagcacaaucugauguagcauuacucagauucguuaauccugauacaggcagaguauuauucgaauguaaauuacacaaaucaggauacguaaccguagcacacacaggacaacacgaccuaguaauaccaccaaauggauauuuuagauucgauucauggguaaaucaauucuauacauuagcaccaaugggcaacggaacaggaagacgaagauaa

SEQ ID NO: 33783 - RNA, 1617 nt, Artificial Sequence
  derived and/or modified sequence opt6 from VP1__Norovirus_and/or_Norovirus-like__KX353966
augaaaauggccucaaaugaugcaaauccuucagacggaucugcagcuaacuuaguaccagaaguaaacaaugaaguuauggcacuagaaccaguaguuggcgcagcaauugcagccccaguagcaggccaacaaaacguaauugauccauggauacgaaacaacuuuguacaagcaccagguggagaauuuacaguuagcccaagaaaugccccaggugaaauccuuuggucugcaccuuuaggacccgaucuaaauccauaucuaucacaccuagcaagaauguauaacggauacgccgguggauuugaaguacaaguaauauuagcagguaaugcauuuacagcaggaaaaauuauauucgcagcaguaccaccuaacuucccaacagaaggccucuccccaucucaaauuacaauguuuccacauaucauaguugauguaagacaauuagaaccaguccucauaccacuacccgacguacguaauaauuucuaccacuauaaucaaucaaaugacucuacaauaaaauuaaucgcaaugcucuacacuccauuaagagcuaauaacgccggugaugaugucuuuacaguuucauguagaguucucaccagaccaucuccagauuuugacuuuauauuuuuaguaccaccaacaguugaaucacgcaccaaaccuuuuaccgucccaaucuuaacaguagaagaaaugacaaacucucgcuucccaaucccucucgaacgucucuuuacaggaccaucaucagcauucguaguacaaccacaaaauggacgauguacaacagacggaguacuacuaggaacaacacaauugucaccaguaaauauauguacauuuagaggugauguaaaccacauagcaggaucaagaaacuauacaaugaauuuagcaucacuaaacuggaacaacuacgaucccacagaagaaacaccagcacccuuaggaacaccagauuuuguaggaaaaauucaaggaguuuuaacacaaaccacucgaggaaacgguuccacaagaggacauagagcaaccgucuauacaggaucagcagacuuuacuccaaaacuagguagaauacaauucgcaaccgauaccgauaacgauuucgaaacacaucaaaauacaaaauucacaccaguaggaguaauacaagacggaaacacaacacacagaaaugaaccacaacaaugggucuuaccaucauauucaggucgaaauguucaaaacguccacuuagcaccagcaguagcaccuaauuuucccggagaacaauuauuauucuuuagaucuacuaugcccggcugcucaggguaccccaacauggaucuagacugucuacucccacaagaauggguucaacauuucuaccaagaagccgcaccagcccaaucagacguagcauuacuaagauucguaaauccagacacaggcagaguacuauucgaauguaaacuacacaaaucaggauuugucacaguagcacacacaggacaacaugaucuaguaauaccaccaaacggauauuuccgauucgauucuuggguaaaucaauuuuacacauuagcaccaaugggcaaaggcacuggccgaagaagauaa

SEQ ID NO: 33784 - RNA, 1617 nt, Artificial Sequence
  derived and/or modified sequence opt6 from VP1__Norovirus_and/or_Norovirus-like__AB663684
augaaaauggcaucaaacgaugcuaacccaucagacggcuccgccgcaaaucuaguuccugaaguaaacaacgaaguaauggcacuagaaccaguaguaggagcugcuauagccgcgccagucgcaggccaacaaaacgucauagacccuuggauccguaauaacuuuguacaagcaccagguggagaauuuacaguaucaccaagaaaugcaccaggagaaauacuauggucugcaccucuaggaccagaucuaaauccauaucuaucacaucuagcuagaauguacaacggauacgcuggugguuucgaaguccaaguaaucuuagcaggaaaugcauucacugcaggaaaaaucauauucgcagcaguaccaccaaacuuuccaacagaaggauuaucccccucacaaguaacaauguuuccucauauuauagucgacguucgacaacuagaaccaguccuaauuccacuacccgauguaagaaacaacuucuaccauuauaaccaaucaaaugacagcacaauaaaacuaauagcaaugcuauauacaccucuaagagccaacaaugcaggagaagauguauuuacaguaucuugucguguauuaacucgaccaucaccugauuuugauuucauauucuuaguuccuccaacaguagaaucacgcacaaaaccuuucacaguacccauauuaacuguagaagaaaugacaaacucaagauucccaauaccuuuagaaaaacuauuuaccggaccuucaucagcauuuguaguccaaccccaaaaugggcgauguacaacagacggagucuuacuaggaacuacacaacuaaguccaguaaacauuuguacauuucgaggagacguuacucacauagcagguucacgaaauuauacaaugaaucuugccucauuaaacuggaacaacuacgauccaacagaagaaauacccgcacccuuaggaacaccugacuucguuggaaaaauacaaggaguauuaacacaaacaaccaaaggagacggauccacacgaggacacaaagcaacaguauacaccggaucagcaccauuuacaccuaaauuagguucaguucaauucucaacagacacagaaaaugauuuugaaacacaccaaaauacaaaauucacucccguuggaguuauucaagacggcggaacuacccacagaaaugaaccacaacaauggguauugccaucauauuccgguagaaauguuccaaauguacacuuagcuccagcaguugcuccaacauucccaggugaacaacuacuauucuucagaucuacaaugccaggaugcuccggauacccaaauauggacuuagacugcuuacuaccacaagaauggguucaacauuuuuaucaagaagcagcuccugcacaaucagauguugcauuacuaagauucguaaacccagacaccggaagaguccuauucgaauguaaacuacauaaaucaggauaugucacaguugcacacacaggacaacaugauuuaguaauuccuccuaauggcuauuuucgauucgacucaugggucaaccaauuuuauacuuuagcaccaaugggaaauggaacaggacgacgaagauaa

SEQ ID NO: 33785 - RNA, 1617 nt, Artificial Sequence
  derived and/or modified sequence opt6 from VP1__Norovirus_and/or_Norovirus-like__KR904209
augaaaauggcuucaucggaugcuaauccaucagacggaucaacugcaaaucuagucccagaaguaaauaaugaaguuauggcucuagaaccaguaguaggagcagcaauagcagccccuguagccggacaacaaaauguaauagaccccuggauacgaaacaacuuuguccaagccccugguggcgaauuuacugucuccccuagaaaugcacccggcgaaauacuauggucugcuccauuaggaccagauuuaaaccccuauuuaucacacuuagcccguauguauaaugguuacgcaggagguuucgaaguucaagucauauuagcuggaaaugcuuuuacagcaggaaaaaucauauucgccgcaguaccaccaaauuucccaacagaaggacucucaccaucacaaguaacaauguucccucauauuauuguagauguacgacaauuagaaccaguucuaauaccacuacccgacguaagaaauaauuuuuaucacuacaaucaaucaaaugacccaacaauaaaauuaauagcaaugcucuauacaccccuacgagcaaacaacgcaggagacgauguauuuaccguaucauguagaguacuaacaagaccauccccagauuucgacuuuauauuuuuaguaccaccaacagucgaaucaagaacaaaaccuuuuucaguaccaauauuaacaguagaagaaaugacuaacucacgauuucccauaccacuagaaaaauuauuuacaggaccaucaucugcuuuuguaguacaaccacaaaauggcagauguacaacagauggaguccuuuuaggaacaacacaauuaagcccaguaaauauauguaccuuucgaggagacguaacacacauagccggaucacacaauuauaccaugaauuuagcaucacaaaacuggaacucauaugaucccacagaagaaauaccugcaccauugggaacccccgacuuuguaggaaaaauccaagguguuuuaacucaaaccacacgagcagacggaucaacaagaggacacaaagcaacagucuauacaggaucagcagacuuuucaccaaaauuaggaagaguacaauucgcuacagauacaaauaacgauuucgacgccaaucaaaacaccaaauucacaccagucgguguaauccaagacggagaaacagcacauagaaacgagccacaacaauggguucuaccaaguuacucaggaagaaauauacauaacguacaccuagcacccgcaguugcaccuacauuccccggagaacaauuauuauucuuucgaucuacaaugccagguugcagugguuauccuaauauggaauuagauugccucaucccacaagaauggguacaauacuuuuaucaagaagcagcaccagcccaaucagauguagcauuacuaagauucguaaacccagacacuggaagaguauuauucgaauguaaacuccacaaaucaggauauguaaccgucgcacauacaggucaacacgacuuaguaauaccaccaaauggauauuuuagauucgauaguuggguaaaucaauuuuacacauuagccccaauggguaauggaacaggaagaagacgauaa

SEQ ID NO: 33786 - RNA, 1617 nt, Artificial Sequence
  derived and/or modified sequence opt6 from VP1__Norovirus_and/or_Norovirus-like__AB933716
augaaaauggcauccaaugacgcaaacccauccgauggcucagcagcaaacuuaguaccagaaguuaauaaugaaguuauggccuuagaaccaguaguuggugccgcaauugcagcaccaguugcuggacaacaaaacguaauugacccauggauaagaaauaacuucguucaagcaccaggaggagaauuuacaguauccccaagaaaugccccaggugaaauauuaugguccgcaccuuuagguccagaucuaaauccauauuuaucucaccuagcucgaauguauaacggauacgccggaggauucgaaguucaaguaauauuagcaggcaaugccuuuaccgcaggaaaaauuauauucgcagcaguaccaccuaauuucccaacagaaggacuaucaccaucucaaguaacuauguucccccacauaauagucgacguaagacaauuagaaccaguacuaauaccauuaccagauguccgaaacaauuucuaucacuauaaccaauccaaugacuccacaauaaaacucauagcaauguuauauacaccacuacgagcaaacaacgcaggagaagauguauuuacaguaucauguagaguacuaacaagaccauccccagacuuugauuuuauauucuuaguaccacccaccgucgaaucaagaacaaaacccuucacaguaccuauccuaacaguagaagaaaugacaaauucccgauuuccuaucccacuugaaaagcuauuuaccggaccaucaucagcauucguuguacaaccccaaaacggaagauguacaacugacggaguucuauuaggcacaacacaacuuucaccugucaacauauguacauuucgaggagacguaacacacauagcuggaucacgaaacuauacaaugaaucucgcaucauuaaauuggaacaauuaugauccaacagaagaaguacccgcaccuuuagguacaccagacuuuguuggcaaaauccaaggcguauuaacacaaacaacaaaaggagacggaucaacaagaggucacaaagcaacaguuuacacaggaucagccccauuuacaccaaaacugggaucuguucaauucucuaccgauacagaaaaugauuuugaaacacaucaaaauacaaaauucacaccagucgguguaauacaagauggauccaccacacaccgaaaugaaccccaacaauggguacugccuucuuauucaggccgugauguaccaaacguacauuuagccccagcaguagcacccaccuuuccuggcgaacaauuauuauucuuuagaaguacaaugccaggaugcucaggauauccuaauauggaucuagauugucuauuaccucaagaauggguacaacacuucuaucaagaagcagcaccagcacaaucugacguagcccuucuucgauucguuaacccagauacaggcagaguacuuuucgaaugcaaacuucauaaaucaggauacguaacuguagcacacacugggcaacacgauuuaguaauaccaccuaauggauauuucagauucgacaguuggguuaaucaauuuuauacucucgcaccaaugggcaauggaacuggucgaagacgcuaa

SEQ ID NO: 33787 - RNA, 1617 nt, Artificial Sequence
  derived and/or modified sequence opt6 from VP1__Norovirus_and/or_Norovirus-like__AB933666
augaaaauggcaucaaaugacgcaaauccaagcgauggaucagcagcaaauuuaguacccgaaguuaacaaugaaguaauggcuuuagaacccguuguaggagcagcaauagccgcaccaguagcuggacaacaaaauguuauagacccauggauaagaaauaacuuuguacaagcaccaggaggagaauuuaccguaucaccaagaaaugcaccaggagaaauacuauggucugcaccacuaggaccagacuuaaaucccuaucuaucacacuuagccaggauguauaauggauaugccggaggauuugaaguacaaguuauacuagcaggaaaugcauuuacagcaggaaaaauaauuuuugcagcaguuccaccaaacuuccccacugaaggccuaucaccaucccaaguuacaauguucccucacauuauugucgauguacgacaacuagaaccaguucuaauaccacuaccagaugucagaaacaauuuuuaccacuauaaucaaagcaaugauuccacaaucaaacuaaucgcuaugcuauauacaccccuuagagccaauaaugccggcgaagauguauucacaguaucauguagaguacuaacaagaccaagcccagacuucgauuuuauuuuucuaguaccuccaacaguagaaucaagaacaaaaccauuuacaguaccuauuuugacaguagaagaaaugaccaacucaagauuuccaauaccauuggaaaaacuauuuacagguccaucaagcgccuucgucguacaaccgcaaaacggcagauguacaaccgacggagucuuauuaggaacuacacaauuaucaccuguaaauauauguacauuuagaggcgacguaacacacauagcuggaucacgaaauuacacaaugaaucuagcaagccuaaacuggaauaauuaugauccaacagaagaaaucccagcaccacuagguacaccagacuucgucggaaaaauacaaggaguauuaacacaaacaacaaaaggugauggaucaacuagaggccacaaagcaacaguauauacuggaucagcaccauucacaccaaaauuaggaucaguucaauuuuccacagauaccgaaaacgacuucgaaacucaucaagauacaaaauucacuccuguagggguuauucaagacggaggaacaacacauagaaacgaaccccaacaauggguacuaccuucauauucaggaagaaauguuccaaacguacacuuagccccugcaguagcccccacauuuccaggagaacaacuuuuauucuucagaucaacaaugccuggaugcucaggauaucccaauauggaucuagacugcuuacucccccaagaauggguacaacauuuuuaccaagaagcagcuccagcacaaucugauguagcauuacuaagauucguuaauccagauacuggcagaguauuauuugaaugcaaauuacauaaaucaggauaugucacuguagcacacacaggccaacacgaucuaguuauaccacccaauggauauuucagauuugacucauggguaaaccaguuuuacacucuagcccccaugggaaauggaacuggaagacgacgauaa

SEQ ID NO: 33788 - RNA, 1617 nt, Artificial Sequence
  derived and/or modified sequence opt6 from VP1__Norovirus_and/or_Norovirus-like__EU921349
augaaaauggcaucauccgacgcaaauccaucugaugguucaacagcuaaucuaguaccagaaguaaacaaugaaguaauggcccuagaacccguaguuggagcugcaauagcagcaccaguugcaggacaacaaaacguaauugacccauggauacggaacaauuucguucaagcaccaggcggagaauuuaccguaucaccccgaaacgccccaggagaaauauuauggucugccccucuagguccagaucuaaaccccuacuuaucacaccuggcuagaauguauaauggauaugcaggaggauuugaaguucaaguuauacuagcuggaaaugcauucacagcaggaaaaauaauauucgcugcuguuccaccaaauuucccuaccgaaggucuaagcccuucacaaguaacaauguuuccacauauaauaguagauguacgacaacuugaaccaguacuaauaccucuaccagacguuagaaauaauuucuaucauuauaaccaauccaaugacccaacaauuaaacuaaucgcaauguuauacacuccucuacgagcuaauaaugcaggagaugauguauucacugugucaugcagaguucuaacaagaccaucaccagacuuugacuucaucuuuuuaguaccaccaacaguugaaucaagaacaaaaccuuuuuccguaccuauucucacaguagaagaaaugacaaauucacgcuuuccuauuccauuagaacgccuauuuacgggaccuuccuccgccuuugucguccaaccacaaaauggaagaugcacaacugacggaguacuauuaggaacaacucaauuaagccccguaaauauauguacauuuagaggagacguaacccauauagccggcacacaagaauauacaaugaauuuagcaucucaaaacuggaauaauuaugauccaacagaagaaauaccagcaccacucggaacaccagacuucguuggaaaaauucaaggaguauuaacccaaacaacacguagagacggaucaacuagaggucacaaagcaaccguaucaacaggcucuguacacuuuaccccaaaacuaggaagaauacaauuuucuacagauacaucaaaugacuucgaaaccggacaaaauacacguuuuacaccaguaggagucguacaagauggaucaacaacacaccaaaacgaaccacaacaauggguacuaccagacuauucaggcagagauucccauaauguacacuuagcuccugcaguagcaccuucauuuccaggagaacaacuuuuauucuuuagaucaacaaugccaggcugcaguggcuacccaaacaugaacuuagauugcuuacuaccacaagaauggguucagcauuuuuaucaagaagcagcaccagcacaauccgaugucgcauuacuaagauucgugaauccugacacaggacgaguacuuuuugaaugcaaacuucacaaaucaggauauguaacaguugcacacaccggccaacaugauuuagucauaccuccaaacggauauuuuagauucgacucauggguaaaucaauucuacacacucgcaccaaugggaaauggaacaggaagacgacguuaa

SEQ ID NO: 33789 - RNA, 1617 nt, Artificial Sequence
  derived and/or modified sequence opt6 from VP1__Norovirus_and/or_Norovirus-like__EU921348
augaaaauggccucaucugacgccaacccaucagacgguucaaccgcaaacuuaguaccagaaguaaauaaugaagucauggcccucgaaccaguuguuggagccgcuauagcagcaccagucgcaggucaacaaaacgucaucgacccuuggauacgaaauaauuucguucaagcaccaggaggcgaauuuacuguaucaccacgaaacgcuccuggagaaauucuuuggucugcaccauuaggaccugaucugaauccauauuuaucccaccuagcaagaauguacaauggauaugcuggaggauucgaaguacaaguaauauuagcaggcaacgcauuuacugcaggaaaaauaauauuugcagcaguuccaccaaauuuuccaacagaagggcuauccccaucacaaguuacaauguuuccacacauuauaguugacguacgacaacuagaaccuguacuuauuccauuacccgauguccguaacaacuuuuaccacuacaaucaauccaacgacccaacaauaaaacuuauagcaauguuauacacucccuuaagagcaaauaaugcuggugaugauguauuuacagucucgugucgcguacuaacaagaccuucccccgauuuugauuuuauauuucuaguaccacccacaguagaauccagaacuaaaccuuuuucagucccaaucuuaacaguagaagaaaugacaaauucccgauuuccuauaccacuagaaagacuuuuuacagguccaucauccgcauuuguaguccaaccucaaaauggaagauguacuacagacgguguacuauuaggaaccacacaauuaucacccguaaauaucugcacauucagaggagauguaacacauauagcaggaacccaagaauacacaaugaaucuagcaucacaaaauuggaauaauuaugauccuacagaagaaauaccugcaccauuaggcacaccagacuucguaggcaaaauacaaggaguauuaacacaaacuacuagacgagacggaucaacaaggggucauaaagcaacaguaucaaccggauccguaaauuucacaccaaaacuaggaagaauacaauucucaacagauacaaguaaugauuucgaaacuggucaaaauacgagauucacaccaguuggaguuguucaagacggaucaacaacccaucaaaacgaaccccaacaauggguacuaccagacuacucaggaagagauucccauaacguacacuuagcaccagcaguagcaccaucauuucccggugaacaacuacuauucuuuagaucuaccaugccuggauguucaggauauccaaauaugaaccuagauugccuauuaccacaagaauggguacaacauuucuaccaagaagcagcacccgcacaaucagacguugcucuacuaagauucguaaaucccgacacaggacgaguauuauuugaaugcaagcuccauaaaucaggauauguaacugucgcacauacaggucaacaugauuuaguaauaccaccaaacgguuauuuuagauucgauucauggguuaaucaauuuuacaccuuagcaccaaugggaaacggcacuggaagaagaagauaa

SEQ ID NO: 33790 - RNA, 1617 nt, Artificial Sequence
  derived and/or modified sequence opt6 from VP1__Norovirus_and/or_Norovirus-like__EU921345
augaaaauggcaucaucggaugcuaauccuagcgauggaucaacugcaaacuuaguaccagaaguaaacaaugaaguaauggcacucgaaccagucguaggugcagcaauagcagccccuguugcaggacaacaaaacguuauagaccccuggauaagaaauaauuuuguucaagcaccaggaggcgaauuuacaguuucaccaagaaacgcuccaggugaaauacuauggucagcuccacuaggcccugauuuaaacccauaucucucucaucuugcucgaauguauaauggauacgccggcgguuuugaaguccaaguuaucuuagcuggaaaugcauuuacugcaggaaaaauuauauuugcagcaguacccccuaauuucccuaccgaaggauuaucaccaucacaaguaaccauguucccucauauaauaguagauguacgacaauuagaaccaguacuaauaccacuaccagacguaagaaauaauuuuuaccacuauaaucaauccaacgauccuacaauaaaacuaauagcaaugcuauacacaccccuaagagcaaauaacgccggagaugacguauuuacaguaucuugucgaguacuaacaagaccaucaccagauuuugauuuuaucuuuuuaguuccaccaacaguagaaagucgaaccaaaccauuuucugucccaauuuuaacuguagaagaaaugacaaauucaagauuuccuaucccauuagaaaggcuauucacaggacccucaucagcauuuguaguacaaccacaaaacgguagauguacaacagauggcguauuacuagguacaacucaauuaucuccaguaaauauuugcacuuucagaggagauguaacacacauagcaggaacacaagaauauacaaugaauuuagccucacaaaauuggaacaauuacgauccaacagaagagauaccagcaccacuaggaacuccagauuuuguaggcaaaauacaaggcguacugacacaaacaacaagacgagacggaucaaccaggggacauaaagccacagucucuacaggaucaguacauuuuacuccuaaauuagguaggauucaauuuucaacugauacaucaaaugauuuugaaacaggccaaaacacacgauucacccccguaggcguaguccaagaugguucaacaacccaucaaaaugaaccacaacaauggguacuccccgauuauucaggacgagacggacacaacguacacuuagcuccagcuguagcaccaucuuucccuggagaacaauuauuauucuuucgcucuacaaugccaggauguucaggcuauccuaacaugaaucuagauugucuccuuccacaagaauggguacaacauuuuuaucaagaagcagcccccgcacaaucagaugucgcauuauuaagauuuguaaacccugacacaggaagagucuuauuugaaugcaaauuacauaaaucaggauacguuacuguagcacauaccggucaacaugauuuagucauaccaccaaacgguuauuuucgauuugauucauggguaaaccaauuuuauacacuagccccaaugggaaaugggacaggccgucgcagauaa

SEQ ID NO: 33791 - RNA, 1617 nt, Artificial Sequence
  derived and/or modified sequence opt6 from VP1__Norovirus_and/or_Norovirus-like__KP698924
augaaaauggcaucauccgacgccaacccuucugacgguucagcugcaaauuuagucccagaaguaaauaaugaaguaauggcccuagaaccaguugucggagcagcaauagcagcaccaguugccggccaacaaaaugucauagauccauggauacgaaacaauuucguucaagccccaggaggcgaauuuacagucuccccaagaaaugcaccaggugaaauccuauggucagcaccacuaggacccgauuuaaacccauaccuuucucaucuagcccgcauguacaaugguuaugcaggaggauucgaaguucaaguaauacucgccggaaaugcauuuacagcaggaaaaguaaucuuugcugcaguaccaccaaacuuuccaacagaaggucuuucuccaucccaaguaacaauguucccacacauaguaguagacguaagacaauuagaaccaguauuaauuccccuuccugauguaagaaauaacuuuuaccacuacaaccaaucaaaugacccuacaauaaaacucauugccauguuauauacaccacuaagagcaaacaaugccggagacgauguauuuacuguaagcuguagaguacucacaagaccuucacccgacuuugauuuuauauuucuaguaccaccaaccguagaaucacgaaccaaaccuuuuucaguuccaguccuaacaguagaagaaaugacaaacucacguuuucccauaccauuagaaaaacuuuuuacaggaccuucaucagcauucguuguacaaccacaaaacggaagauguacaacagacggaguacuauuaggaacaacccaacuaucuccuguaaauauauguacuuuuagaggugacgucacucacauaaccggaucacacaauuauacaaugaaucuagcaagucaaaauuggucaaacuaugauccaacagaagaaauuccagcuccacuagguauuccagacuuuguaggcaagauucaaggaguauuaacacaaacuacacgaacagacggaucaacuagaggacacaaagcaacagucuauacagguucagcagacuucgcaccuaaacuaggucgaguacaauucgaaacagauacuaaucacgacuucgaagcaaaucaaaauaccaaauucacaccaguaggaguaauacaagacggaggaacaacucauagaaacgaaccacaacaauggguuuuaccaucauauucuggaagaaauacaccaaauguacauuuagcaccagcaguugcaccuacauuuccuggugaacaacuacucuucuuucgaucaaccaugccaggaugcucaggcuauccaaacauggaucuagauuguuuacucccacaagaaugggugcaacacuucuaucaagaagccgccccugcccaaucagacgucgccuuauuaagauuuguuaauccagauacaggaagagucuuauucgaaugcaaacuacauaaaucuggauacguuacaguagcacacacaggacaacaugaucuaguaauaccaccaaauggcuauuuucgcuuugauucauggguaaaccaauucuauaccuuagcaccaaugggcaauggaacagguagaagaagauaa

SEQ ID NO: 33792 - RNA, 1617 nt, Artificial Sequence
  derived and/or modified sequence opt6 from VP1__Norovirus_and/or_Norovirus-like__LC005707
augaaaauggcauccaacgaugccucaccauccgaugguagugcagcaaaccuagucccagaaguaaauaaugaaguuauggcacuagaaccaguagucggcgccgcaauagcagcaccugucgcaggacaacaaaauguaauagacccauggauaagaaauaacuuuguacaagcaccuggaggagaauuuacaguuucaccaagaaaugcgcccggagaaauucuaugguccgcaccauuaggaccagaucuaaacccauauuuaucccaccuugcaagaauguauaauggauacgcaggagguuucgaaguucaaguaauacuggcaggaaaugcauucacagccggaaaaauaauauucgcagcaguaccacccaacuuccccaccgaaggauuaucaccaucccaaguaacaauguucccacauauuauagucgauguaagacaacuagaaccaguacuaauaccauuaccagauguacgaaacaauuuuuaccacuauaaccaaucaaaugacucuacaauaaaauuaaucgcuaugcuauacacaccacuaagagcaaauaaugcaggagaagauguauuuacagucucaugucguguacuaacaagaccaucaccagauuuugacuuuauauucuuaguuccaccaaccgucgaaucaagaaccaaaccauuuacaguaccaauauuaacuguugaagaaaugacaaacucaagauucccaauaccacuagaaaaacuuuuuacagguccaucaggcgccuucguaguacaaccucaaaauggaagauguacaacagauggaguacuacuaggcacaacacaacuauccccuguaaauaucugcaccuuucgaggagacguaacacacauagcaggcucaagaaauuauacaaugaauuuagcagcacuaaacuggaauaacuaugacccaacagaagaaauuccugccccuuuaggaacucccgauuuugucggaaaaauacaaggaguauuaacucaaacuacuaaagcagacggaucaacaagaggacacaaagcuacuguuuacacuggaucagcugacuuuacaccaaaacucggcaguguacaauucucaacugauacagaaaacgauuucgaaacacaucaaaauaccaaauucacaccaguuggcguaauccaagacgguucaacaacacauagaaaugaaccacaacaauggguacuuccaucauauuccggaaggaacguacauaauguacauuuagcaccagcaguugcaccaacauucccaggugaacaacuacuauucuuuagaucaacaaugcccgguugcucuggauaucccaauauggaucuagauugucucuuaccacaagaauggguucaacauuuuuaccaagaagcagcuccagcccaaucagacguagcucuccuacguuuugucaacccagaucaaggacgaguacuauuugaauguaaauuacauaaaucuggauaugucacugucgcucacaccggccaacacgaucuaguaaucccaccaaaugguuacuucagauucgauagcuggguaaaucaauuuuacacauuagcaccaaugggcaacggcacaggaagacgacgauaa

SEQ ID NO: 33793 - RNA, 1617 nt, Artificial Sequence
  derived and/or modified sequence opt6 from VP1__Norovirus_and/or_Norovirus-like__KJ541743
augaaaauggcaucuaaugaugcaaacccaucagaugggagugcagcaaaccuaguuccugaaguaaacaaugaaguaauggcucuagaaccaguuguaggagccgcaauagcugccccaguagcuggacaacaaaacguuauagacccauggauuagaaauaauuucguacaagcccccggcggagaauuuacaguauccccaagaaacgcaccaggugaaaucuuauggucagccccucuagguccagauuuaaaccccuaucucucacacuuagcaagaauguacaacgguuacgcaggaggauuugaaguacaaguaauucuugcaggaaaugcuuuuacagcaggaaaaauaaucuuugcagccguaccaccaaacuuuccaacugaagguuuaucuccaucacaaguaaccauguuuccucacauuauagucgacguaaggcaacuagaaccaguucuuauaccuuuaccagauguuagaaacaacuuuuaucauuauaaccagucaaaugacucaaccauaaaauuaauagcaauguuauauacacccuuaagagcaaacaacgccggugaggacguauuuacaguaucauguagaguacuaacaagaccaucaccagacuuugacuuuauuuuucuuguaccucccacuguagaaucuagaacaaaaccauucacaguaccaauacuaacuguagaagaaaugacuaacuccagauucccaauaccauuagaaaaauuauucacaggaccaucaucagcauuuguuguacaaccacaaaauggacgauguacaacagauggcguacuucuagguacuacacaacuauccccuguaaauauaugcacauuuagaggggauguaacacacauagcaggaucuagaaauuauaccaugaaccuagcaucuuuaaacuggaacaauuaugauccaacagaagaaaucccagcacccuuagguacaccugauuucguaggaaaaauacaaggaguauuaacacaaacaacaaaaggagauggcuccacaagaggacacaaagcaacaguauauacgggaucagcaccauuuacaccuaaacucggaucaguucaauucucaacagauacagaaaacgauuucgaaacacaucaaaacacaaaauucacaccaguaggagugauccaagacggagguacuacacauagaaaugaaccacaacaauggguacucccuagcuacucaggucgaaacguacauaacguacaucuagcaccagcaguugcuccaacauuuccaggagaacaacuauuauucuuuagaaguacuaugccagguugcucaggauauccaaauauggaucuagauugccuacuaccacaagaauggguucaacauuuuuaccaagaagcagcacccgcccaaagcgacguagcauuauuaagauuuguuaauccagacacuggaagaguacuuuucgaaugcaaacuacauaaaucaggauacgugacaguagcacauacuggccaacacgauuuaguaauacccccaaacggauauuucagauucgauagcuggguaaaccaauucuacacacucgcaccaaugggaaauggcacagguagaagaagauaa

SEQ ID NO: 33794 - RNA, 1617 nt, Artificial Sequence
  derived and/or modified sequence opt6 from VP1__Norovirus_and/or_Norovirus-like__KF177443
augaaaauggcaaguuccgaugccaacccaucagauggaucugcagcaaaccuaguuccagaaguaaauaacgaagucauggcacuagaaccaguaguaggagcagcaauagccgccccagucgcaggccaacaaaauguaauagacccauggauaagaaauaauuucguacaagcaccaggaggagaauuuacaguaucaccuagaaaugcaccuggcgaaauauuauggucugcccccuuaggaccugauuuaaaucccuauuuaucacaccuagcaagaauguacaauggauacgcuggugguuucgaaguacaaguuauccuagcagguaaugcauucacagcaggaaaaguaauauucgcagcaguaccaccaaacuucccaacagaaggauuaucucccucccaaguaacaauguuuccacacauagucguagauguaagacaacucgaaccaguauuaauaccacucccagauguaagaaacaacuuuuaccacuauaaucaaucaaaugauccaacaauaaaacuuaucgcaaugcuauauacaccauuaagagcaaacaacgcuggugacgacgucuuuaccgucuccuguagaguauuaacaagaccaucaccugauuuugacuuuauauuucuaguaccacccacagucgaauccagaacuaaaccauucuccguccccguucuaacaguagaagaaaugacaaacuccagauucccaauaccacuagaaaaacuauuuacaggacccucauccgcauuuguaguacaaccacaaaacggaagauguacaacagacggaguacuacuaggcacaacucaacuuucgccaguaaauauauguacauuccgcggugacguaacucacaucacaggaucacgaaacuauacaaugaauuuagcaucccaaaauuggaacaauuacgacccaacugaagaaauaccagccccacuagguacccccgauuuuguugguaaaauacaaggagucuuaacccaaacaacacgaacugacggcaguacaagaggacacaaagcaacuguauauacaggauccgcagauuucgcuccaaaacuuggaagaguacaauuuggaacugauacugaucacgacuucgaagcaaaucaaaacacuaaauucacaccaguuggaguaauacaagauggaucuacaacacauagaaaugaaccacaacaauggguuuuacccucauacuccggaagaaauacuccuaauguacaucucgcaccagccguagccccuacauuuccaggagaacagcuacuauucuuuagaucaacaaugcccggcugcucaggcuauccaaauauggauuuagacugccuauuaccucaagaauggguacaauacuuuuaccaagaggcagcuccagcgcaaucugauguagccuuacuaagguucgucaauccagacacaggaagaguauuauuugaauguaaacuucacaaaucaggauacgucacaguugcacauacaggacaacacgaccuaguaauaccaccuaauggguacuucagauucgauucauggguaaaucaauuuuauacauuagcgccaaugggaaauggaacuggacgaagaagauaa

SEQ ID NO: 33795 - RNA, 1617 nt, Artificial Sequence
  derived and/or modified sequence opt6 from VP1__Norovirus_and/or_Norovirus-like__JX439842
augaaaauggcaagcucagaugcaaauccuuccgauggaucagcugcaaacuuaguaccagaaguuaacaaugaaguaauggcucuagaaccaguagucggagcagcaauagcagcaccaguagcaggucaacaaaauguuauagacccauggauacgaaauaacuuuguacaagcuccaggcggagaauuuacaguaagcccaagaaaugcaccaggagaaauucuuuggucagcaccauuaggaccagaucuaaacccauacuuaucacauuuagcaagaauguacaacggauaugcaggaggauucgaaguacaagucauauuagcaggaaacgccuuuacagccggaaagauaauauucgcagcaguuccaccaaacuucccaaccgaaggccuaucucccucacaaguaacuauguuuccucacauaauuguagaugucagacaacuagaaccaguccuaauucccuugccagaugugcguaauaauuucuaccauuacaaccaaaguaacgacaguacaauaaaacucauagcaauguuauacaccccacucagagcaaauaaugcaggagaagauguauuuacaguguccuguagaguccuaaccagaccaucaccagacuucgauuucauauuucuaguaccaccaacuguugaaucaagaacaaaaccauucacaguucccauauuaacaguagaagaaaugaccaauagucguuuuccaauuccucuagaaaaacuauuuacaggcccaaguucugccuucguaguacaaccucaaaacggccgaugcacaacagacggcguacuauuaggaacaacucaacuaucaccaguaaauauauguacauuuagaggagauguaacacauauagcagguucuagagucuacacaaugaaucuugcaucacuaaauuggaacaauuaugauccaaccgaagaaauaccagcaccacuaggaacaccugacuucguaggcaaaauccaaggaguacuuacacaaaccacaaaagaagauggaagcacucgaggacacaaagccacugucuauacaggaagugcuccauuuacaccuaaauuaggaucgguccaauucucuacagacaccgaaaaugauuucgaaacacaucaaaauacaaaauuuacaccugucggaguaauacaagaugguggaacaacacauagaaaugaaccucaacaauggguacuuccaucauacucaggcagaaaugccccaaacguacaccuagcaccagcaguagcaccaacauuuccaggagaacaacuauuauucuuuagaucuaccaugccaggcuguucgggauauccaaauauggaucuagauugucuacuaccccaagaauggguucaacauuuuuaucaagaagcagcaccagcucaaucagacguagcauuacucagauucguaaacccagacaccggaagaguauuauucgaaugcaaacuacauaaaucaggauauguaacugucgcacauacaggccagcacgaucuuguaaucccaccaaauggauauuucagauuugauucguggguaaaccaauuuuacacauuagcucccaugggcaauggaacagguagaagaagauaa

SEQ ID NO: 33796 - RNA, 1617 nt, Artificial Sequence
  derived and/or modified sequence opt6 from VP1__Norovirus_and/or_Norovirus-like__HF952135
augaaaauggcaucauccgaugcaaacccuagugacggaucuacagcaaaccuuguaccagaaguuaauaacgaaguaauggcuuuagaaccaguaguaggugccgcaauagcugcaccaguagcaggucaacaaaauguaauagauccauggauacgcucaaauuuuguacaagcaccaggaggagaguucacaguaucaccacgaaaugccccuggagaaauauuauggucugcaccccuagguccagaucuaaauccauaucuaucacaccuagcuagaauguauaacgguuaugcugguggauucgaaguacaaguuauauuagcaggaaaugcauuuaccgcaggcaaaauaauauuugcagcaguacccccaaauuuccccacagaaggucuaucacccucccaaguaacaauguuuccccauauaauuguugacguaagacaacucgaaccaguucuaauaccauuaccagauguaagaaacaauuucuaccauuacaaucaaucaaacgauccaacaauaaaacuuaucgcuaugcuauauacaccacuccgcgcaaacaaugcaggagacgacguauuuacaguaagcuguagaguucuaacacgaccuucaccagacuucgacuucauauuuuuaguuccucccaccguugaaucaagaacaaaaccuuucucaguaccagucuuaacaguagaagaaaugacaaacucacgauucccuauaccuuuagaaaaacuauuuacuggacccucaucugccuucguaguacaaccacaaaauggcagaugcacaacagacggaguacuacuggguacaacacaacuaucacccguuaauauauguaccuuuagaggagauguuacacacauuucaggauccagaaacuacacuaugaauuuagcagcucaaaauuggaacucauaugaucccaccgaagaaauaccugcaccuuuaggaacaccggacuucguaggaaaaauacaagguguauuaacccaaacaacaaaaacaaauggaucaacaaggggucauaaggcaacaguauauacaggaucagcagacuuuucacccaaauuaggaagaguccaguucgcaacugauacagacaaugauuucgaaaccaaucaaaauaccaaauucacuccaguaggaguaauacaagauggaagcacuacuccaagaaaugaaccucaacaaugggucuuacccucauauuccggacgaaacacucauaacguucaucuagccccugcaguagcaccaacauuuccaggagaacaauuacuauucuuuagaucaacaaugccagguugcucgggauacccgaauauggaucuagauuguuuacuaccacaagaauggguacaauauuuuuaucaagaagcugcaccagcucaaucagacguugcacuacucagauucguaaaccccgacacaggccguguauuauucgaauguaaacuacauaaaucugguuauguuacagucgcacacacaggucaacaugaucuuguaauaccuccaaauggauacuuccgauuugacucguggguaaaucaauuuuacacacucgcaccaaugggaaacggaacagguagaagacguuaa

SEQ ID NO: 33797 - RNA, 1617 nt, Artificial Sequence
  derived and/or modified sequence opt6 from VP1__Norovirus_and/or_Norovirus-like__JX459598
augaaaauggcuucuaaugaugcaacaccuucagauggcucaacagcaaacuuaguucccgaaguuaauaaugaaguaauggcuuuagaaccaguaguuggagccgcuauagccgccccuguagcaggucaacaaaauguuauugacccauggauaagaaauaauuuuguucaagcaccuggaggagaauuuaccguaucaccuagaaacgcaccaggagaaauacuauggcacgcuccuuuaggacccgauuuaaauccauauuuaagucaucuagcccgcauguauaacggauacgcuggcggauucgaaguacaaguaauacuggcaggaaaugcauucacagcuggaaaaauaauauuugcagcgguuccaccaaacuuuccaacagaaggacuaucaccaucacaaguaaccauguucccacauauaauaguagacguaagacaacuagaaccaguccucauaccuuuaccagacgucagaaacaauuucuaccacuauaaucaaucuaaugacccaacaauuaaacuuauagccaugcuauacacuccccuacgugcaaauaacgcaggagacgauguauucacaguaaguuguagaguauuaacccgaccaucuccagacuuugacuucauauuucuagucccaccaacaguagaaucaagaacaaaaccauucucuguaccuauacuaacaguagaagaaaugacuaauucuagauuccccauaccacuagaaaaauuauucacaggaccaucaucagccuuuguaguacaaccacaaaauggccgauguacaacagauggaguuuuauuaggaaccacacaauuaucaccugucaauauauguacauuucgaggagacguuacucauauagcaggaacacaaaauuacacaaugaaucuugcaucacaaaauuggaauaauuacgaucccacagaagaaauaccagccccacuaggaacuccagauuuuguaggaaaaauacaaggaguauuaacacaaacaacaagaagagauggaucuacuagaggacauaaagcaacaguaucaacuggcucaauacacuucacaccuaaauuaggaucaguacaauucucuacagauacauccaacgauuuugaaacaggacaaaacacacguuuuacuccaguaggagucguacaagacggaucaacaacacaucaaaaugaaccacaacaauggguacuaccaaauuacucaggaagagauucccacaacguacauuuagcuccugcaguagcacccacauuuccaggcgaacaacuacuauucuucagaucaacaaugccagguugcucuggauauccuaacaugaaucuagacugccuauuaccucaagaauggguucaacauuuuuaucaagaaucagcaccagcccaaucagacguagcauuacuaagauuuguaaauccagauacaggcagaguucuauucgaauguaaacuccauaaaucaggauauguaacaguagcucauacuggucaacacgacuuaguaauuccaccaaauggauauuuuagauucgauagcuggguaaaccaauucuacacacucgcuccaaugggaaauggagcuggcagaagacguuaa

SEQ ID NO: 33798 - RNA, 1617 nt, Artificial Sequence
  derived and/or modified sequence opt6 from VP1__Norovirus_and/or_Norovirus-like__JX445162
augaaaauggcaagcaaugaugcuaauccaagugauggcucagcugcaaaucucgucccagaaguaaauaaugaaguaauggcacuugaaccaguuguuggugcagcuauagcugcaccaguagcaggucaacaaaacgucauagacccauggauacgaaauaauuuuguccaagcaccuggaggcgaguucaccguauccccaagaaacgcaccuggagaaauacuuuggucagcaccccuuggaccagaucucaauccauaccuaucucaccuagcacgaauguauaauggauacgcaggaggauuugaaguacaagucauucucgcaggaaacgcauuuaccgccggaaaaauuauauuugcagcaguucccccaaacuucccaacagaaggacucucuccaagucaagucacuauguuuccucacauaaucguugauguuagacaacuagaacccguacucauuccauuaccagacgucagaaacaacuucuaucacuauaaccaauccaaugacucuacaauaaaacuaauagcaaugcuauacacaccauuaagagcaaacaaugcaggagaagacguauucacaguaucaugucgaguacuaacacguccuaguccagacuuugacuucauauuuuuaguacccccaacagucgaaagcagaacaaaaccauuuacaguaccaauccuaacaguagaagaaaugacaaacucacgauuuccaauaccacuugaaaaacuauuuacuggaccaucauccgcuuucguaguacaaccacaaaacggacgauguacuacagacggaguacuauuaggcacaacacaacuuucacccguaaauauaugcacauuuagaggcgauguaacucauauagcaggauccagaaacuacaccaugaaccuagcaucauuaaauuggaacaauuacgacccaacugaagaaauaccagcaccacuaggcacaccagauuucguaggaaaaauacaagguguacuuacacaaacaacuaaaggcgacggcuccacaagaggacacaaagccaccguauauacaggaucagcaccauuuacaccaaaacuaggcucaguccaauucucaacagauaccgaaaacgauuuugaaacacaccaaaauacaaaauucacaccaguaggaguaauucaagacggaggcacaacacaucgaaaugaaccacaacaauggguauuaccaucauauaguggaagaaacguacaaaauguacaucucgccccugcaguagcacccacauucccaggagaacaacuacucuuuuucagauccaccaugccuggaugcuccggauauccaaauauggauuuagauuguuuacucccucaagaauggguacaacacuucuaccaagaagcagccccagcucagucagacguagcauuacuaagauucguaaacccugacacugguagaguccuuuucgaaugcaaauuacauaaaucuggauauguaacugucgcccacacaggacaacaugaccuaauaauaccuccaaauggauauuuuagauuugauagcuggguaaaucaauucuacaccuuagcucccaugggaaacggaacuggaagacgaagauaa

SEQ ID NO: 33799 - RNA, 1617 nt, Artificial Sequence
  derived and/or modified sequence opt6 from VP1__Norovirus_and/or_Norovirus-like__JX445154
augaaaauggccucaaacgacgcaacaccauccgauggaagcacagcuaacuuaguacccgaaguuaacaaugaaguuauggcacuugaacccguaguaggagcugccauagcugcaccaguagccggacaacaaaacguaauagauccauggauacgaaauaauuucguacaagccccagguggagaauuuaccguuagcccaagaaaugccccuggagaaauauuauggucagccccuuuaggaccugauuuaaauccauauuuaucccacuuagcaagaauguacaauggcuacgcugguggcuucgaaguccaaguaauacuagcaggcaacgcauuuacagcaggaaaaauaauauucgcagcaguaccacccaacuuucccacagaaggacuuucuccaucucaaguuaccauguuuccucacauuauaguugacguaagacaauuagaaccuguauuaauaccacuaccagacguaaggaauaauuucuaucauuauaaucaaucuaacgauccaaccauuaaauuaauagcaauguuauacacaccacuacgcgcaaauaaugcaggagacgacguauucacaguuucauguagaguuuuaacaagaccaucaccagauuucgauuuuauauuucuaguuccuccaacaguagaaucuagaacaaaaccauucucuguaccaauacuaaccgucgaagaaaugacaaacucaagauuucccauaccauuagaaaaacuauuuacaggaccaucuagcgcauucguaguucaaccacaaaacggaagauguaccacugacggaguuuuauuaggaaccacacaauuaaguccaguuaauaucuguaccuuucgaggugauguuacucacauagccggcacacaaaauuauacaaugaacuuagcaucacaaaauuggaauaauuacgauccaacugaagaaauaccagccccuuuaggaacaccagauuuuguuggaaaaauacaaggggucuuaacacaaacaacuagacgcgauggcagcacucgaggacacaaagcaacaguaucaacaggaucuguacauuuuacaccaaaauuaggaucaguacaauucuccacagacacaaguaacgauuuugaaacaggucaaaauacacgauuuacaccaguaggaguaguacaagacggauccacuacccaucaaaacgaaccccaacaauggguacucccagacuauucagguagagacucccauaauguacacuuagcuccugcaguagcaccuacauuuccaggagaacaacuucuauucuucagaucaacuaugccaggaugcucaggauacccaaauaugaaccuagacugccuauuaccacaagaauggguacaacacuuuuaucaagaaucagcaccagcccaguccgacguugcacuauuaagauuuguuaauccagauacaggaagaguucuuuuugaauguaaacuucauaaaccaggcuauguuacaguagcccauacuggacaacaugaucuaguuauaccaccaaaugguuauuuuagauucgauucauggguuaaucaauuuuacacucuagcaccgaugggaaauggagcuggacgaagaagauaa

SEQ ID NO: 33800 - RNA, 1617 nt, Artificial Sequence
  derived and/or modified sequence opt6 from VP1__Norovirus_and/or_Norovirus-like__JX155752
augaaaauggcaucaaaugacgcaaacccaagugaugguucagcagcaaauuuaguacccgaaguaaauaaugaaguaauggcauuagaaccaguuguaggagcagcuauagcagcuccagucgcuggccaacaaaacguaauugacccauggauaagaaauaacuuuguacaagcuccaggaggagaguucacaguaagcccaagaaaugcaccuggagaaauauuauggucugcaccauuaggaccagauuuaaauccauaucuaucccacuuagcaaggauguauaacggcuaugcaggcggauuugaaguccaaguaauacucgcagguaacgcauucacagcaggaaaaauaauuuuugccgcaguaccaccaaauuuuccaacugaaggacuaucaccaucccaagugaccauguucccacauauaauuguagauguacgacaacuagaaccaguuuuaauaccauuacccgauguaagaaauaacuucuaccacuauaaucaaucaaaugauagcaccauaaaacucauugcaauguuauacacuccauuaagagcaaacaaugcuggugaagacguauucaccguuucauguagaguauuaacuagaccaucaccagauuuugacuucauauuucuugucccaccaacaguagaaucacgcacaaaaccuuuuacaguuccaauauuaacaguagaagaaaugacuaacucuagauuuccuauacccuuagaaaaauuauucacaggcccaucaucagcauucguuguacaaccccaaaacggcagaugcacuacagacggaguacuacuaggaacaacacaauuaaguccagucaauauauguacauuuaggggagacguaacucauauagcaggaucacauaauuacgcaaugaaucucgcaucuuuaaacuggaauaauuacgauccaacugaagaaauaccagcaccucuaggaacuccagauuuuguagguaaaauacaaggcguacuaacccaaacaacaaaaggagacgguucuacaagaggucauaaagcaacaauuuauacaggaucagcaccuuuuacacccaaacuagguucaguacaauucucaacagauacugaaaaugacuucgaaacucaucaaaauacuaaauuuacaccaguaggagucauccaagacgguggaacuacacaucguaaugaaccccaacaauggguacuaccaucauauucaggcagaaauguccccaacguucaucuagcaccagcaguagccccaacuuuuccaggcgaacaacuauuauucuuucguucaacgaugccagguuguucaggauacccaaacauggacuuagacugucuacuaccacaagaauggguccaacacuucuaccaagaagcugcacccgcucaaucagacguagcccuucuaagauucguaaacccagauacaggaagaguccuauucgaaugcaaauuacauaaaucuggauaucuaacaguugcacacacuggucaacaugaccucguaauaccucccaauggcuacuucagauucgauaguugggucaaucaauuuuacacccuagcaccaauggguaauggaacaggaagaagaagauaa

SEQ ID NO: 33801 - RNA, 1617 nt, Artificial Sequence
  derived and/or modified sequence opt6 from VP1__Norovirus_and/or_Norovirus-like__HM748971
augaaaauggcuucaaaugaugcaucuccuucagauggcuccgccgcuaacuuagucccagaagucaauaaugaaguuauggcucuagaaccaguaguaggagcagcaauagcugccccaguagcaggccaacaaaauguaauugacccauggauuagaaauaacuucguacaagcaccaggaggagaauuuaccguuucaccuagaaaugcaccaggcgaaauauuaugguccgcaccacuaggaccugaucuaaacccauaucucucacauuuagcuagaauguauaauggauaugcaggaggauuugaaguacaaguaauacuagcuggaaacgcauucacagcaggaaaaauaauauuugcugcaguuccacccaauuuuccaaccgaaggacuaucuccuucacaaguaacaauguuuccacacauuaucgucgaugucagacaauuagaaccaguacuaauaccacuacccgauguaagaaacaauuuuuaucacuauaaccaaucaaaugacucuaccauaaaauuaauagcaauguuauacacaccccuaagagcaaacaaugcuggagaagacguauuuacaguuaguuguagaguacuuacaagacccuccccagauuuugacuucauauuucucguucccccaacaguagaaucaagaacaaaaccauuuacaguaccaauuuuaaccguugaagaaaugacaaacucacgauuuccaauuccuuuagaaaaacuauucaccggaccaucuuccgccuuugucguacaaccccaaaauggccgaugcacaaccgacggaguauuacuagguacaacccaacuaagcccaguaaauauauguacauucagaggagauguuacccauauagcaggaucuagaaauuacacaaugaaucuagcuucauuaaacuggaauaauuacgauccaacagaagaaauaccagccccauuaggaaccccagacuuugucgguaaaauccaaggaguacuuacacaaaccacuaaaggagacgguagcacaagaggucauaaagcaacaguauacaccgguuccgcacccuuuacaccuaaauuaggaucuguccaauucucaacagacacagaaaacgauuuugaaacacaccaaaauacaaaauuuacuccaguuggcgucauucaagacggaggaacaacccacagaaaugaaccacaacaaugggcauuaccuagcuacucaggacgaaacguccaaaacguacaucuagcuccugcaguugcacccaccuuuccuggagaacaacuacuauucuuuagaucaaccaugccaggaugcuccggauauccaaacauggauuuagauugucuacuuccacaagaauggguacaacauuuuuaucaagaagccgcaccagcucaaucagauguagcauuauuaagauuuguuaaccccgacacaggacguguauuauuugaauguaaacuucacaaauccggauacguuaccguagcucauacuggacaacaugaucuaguaauaccaccaaaugguuauuucagauuugauaguuggguaaaucaauuuuauacacuagcuccaaugggcaauggaacuggccgacgaagauaa

SEQ ID NO: 33802 - RNA, 1617 nt, Artificial Sequence
  derived and/or modified sequence opt6 from VP1__Norovirus_and/or_Norovirus-like__GQ845367
augaaaauggcuucuucagaugcaaaccccucagacggcuccacagcuaaccuaguaccagaaguaaacaacgaaguaauggcacucgaacccguaguaggugcagcaauagcagccccaguagccggacaacaaaacguuauugacccauggauaagaaauaacuuuguacaagcaccaggaggugaauuuacaguaucaccacgaaacgccccaggugagauacuauggucagcaccacuaggccccgacaugaaucccuaccuaucucaccuugcaagaauguauaauggauacgcaggaggauucgaaguacaaguaauucuugcaggcaaugcauuuacagccggcaaaauaauuuucgcagccguuccaccaaacuuuccaacagaaggacucucaccaucgcaaguuaccauguuuccacacauuauuguugacguucgacaacuagaaccaguuuuaauaccacuaccagauguaagaaauaacuuuuaucauuauaaucaaaguaaugauccuacaauaaaacuaauugcaauguuauacacaccccuaagagccaacaacgcaggagacgauguauuuacaguaaguugcagaguacuaacaagaccaucuccugacuucgacuuuauauuuuuaguacccccaacaguagaaucaagaacuaaacccuuuucaguaccaauauuaaccguagaagaaaugacuaacucaagauuuccaauaccccuagaaaaacuauuuacuggacccuccucagcuuucguaguacaaccacaaaacggaagaugcacaacugacggcguauuauuaggaaccacccaauuauccccaguaaauauaugcacauuuagaggugacguuacacauauagcaggaucaagaaacuacacuaugaaucuagcaucucaaaauuggaacuccuaugacccaacugaagagauaccagcacccuuaggcacaccugacuuuguaggaaaaauacaaggaguauuaacccaaacaacaagaaccgacgguaguacccguggucacaaagcaacaguauauaccgguucagcagacuuuuccccaaaauuaggaagaguacaauuugcaacagauacagauaaugauuucgaugcuaaucaaaauacaaaauuuacaccaguaggaguaauacaagacggaaacacagcccauagaaacgaaccacaacaguggguacuaccaucuuacuccggaagaaacacacauaacguccacuuagcuccugcagucgcaccuacauuuccaggagaacaacucuuauucuuuagaucaacuaugccaggauguaguggauauccaaauauggacuuagauugccuacuaccacaagaauggguacaauauuuuuaucaagaagcagcaccagcacaaucagacguugcauuauuaagauucguuaacccagauacaggucgaguauuauucgaauguaaauuacauaaaucaggauacguuacugucgcacacacaggacaacacgaucucguaaucccaccaaauggcuauuuuagauucgauaguuggguaaaucaauuuuauacucuagcaccaaugggcaauggaacaggaagaagacguuaa

SEQ ID NO: 33803 - RNA, 1617 nt, Artificial Sequence
  derived and/or modified sequence opt6 from VP1__Norovirus_and/or_Norovirus-like__GQ856455
augaaaauggcaucaaaugaugccaaccccucagacggcucugcagcaaaccuaguucccgaaguuaauaacgaagucauggcuuuagaaccaguaguaggagcagcaauagcugcaccuguagcuggccaacaaaauguaauugacccauggauaagaaauaacuuuguacaagcuccagggggagaauuuacaguuuccccuagaaaugcaccaggggaaauauuaugguccgcaccacuagggccagacuuaaacccauaccuaagucacuuagcaagaauguauaauggauacgcaggcggauuugaaguucaaguaauuuuagcaggaaaugcauucacagcuggaaaaauaauauuugcagcuguaccuccuaacuuuccaacggaaggacugucuccaucucaagucacaauguuuccucacauuauaguugacguaagacaauuagaaccaguauuaauaccacuuccagauguaagaaacaauuucuaucauuauaaccaacccaaugacaguacaauaaaacuaauagcaaugcuuuauacuccauuaagagcaaacaacgccggagaagauguauuuacaguaucaugucgaguucuaaccagacccucaccagauuuugauuuuauauuuuuaguaccaccaacaguagaaucacgcacaaaaccauuuacaguaccaauauuaacaguugaagaaaugacaaauagucgcuucccaauaccucuagaaaaacuauucacaggaccaucaucagcuuucguaguacaaccacaaaacgguagauguacaacugauggcguacuacuagguacaacacaauuaucacccguaaauauauguaccuuccgcggagacguaacccauauagcuggcucaagaaauuauacaaugaaucuugcaucacucaacuggaacaauuaugauccaacagaagaaauaccagcuccccucggcacaccagauuuuguugguaaaauucaaggaguuuuaacacaaacaacaaaaggagauggaucaacacauggacacaaagcaacuguauacacaggaucagccccuuuuacaccaaaacuuggauccguacaauucucaacugauacugaaaaugauuuugaaacacaccaaaauacaaaauucacuccuguagggguaauacaagauggauccacaacacacagaaaugaaccacaacaauggguucuacccucauauucagguagaaacguucaaaacguacaccuugccccagcaguugcaccaacauuuccaggugaacaacuucuauucuuuagaucuacaaugccaggauguucgggauacccaaauauggaucucgauugucuauuaccacaagaauggguucaacacuuuuaucaagaagcagcacccgcacaaagcgauguugcauuacuaagauuugugaacccagauacuggacgaguacuauuugaaugcaaauuacacaaaucaggauauguaacuguagcacacacaggccaacaugaucuaguuauaccaccuaacggauacuuuagauuugauuccuggguaaaccaauuuuauacauuagcaccuaugggaaauggaacaggaagacgacgauaa

SEQ ID NO: 33804 - RNA, 1617 nt, Artificial Sequence
  derived and/or modified sequence opt6 from VP1__Norovirus_and/or_Norovirus-like__GQ856447
augaaaauggcauccaaugaugcaaaccccuccgauggcucugccgcaaaccuuguuccagaaguaaauaaugaaguuauggcucucgaaccaguaguaggagcagcaauagccgcaccaguagcuggccaacaaaauguaauagauccauggauacguaauaacuucguucaagcaccagguggcgaauuuacagucucaccacgaaacgcaccuggagaaauacuaugguccgcaccacuaggaccagacuuaaauccaaauuuaucacaucuagcaagaauguauaacggauacgcaggaggauucgaaguacaaguaauauuagcgggaaaugcuuucacagcaggaaaaauuauauucgcagcaguaccuccaaauuuuccaacugaaggacuaucaccaucacaaguaacaauguuuccgcauauaauaguugacguccgacaacucgaaccaguucuaauaccauuaccagauguaagaaauaacuucuaccauuauaaucaaucaaacgacucaacuauuaaauuaauagcaauguuauacacuccucuaagagcaaauaaugccggugaagacguauucacugucucuugcagaguacuuacuagaccaucacccgacuuugauuuuauuuuccuaguuccaccaacaguagaaucaagaacaaaaccauucacaguaccuauauuaacaguagaagaaaugacaaauucacguuuuccaauaccacuagaaaaacuauucacaggaccuucaucagcauuugucguucaaccacaaaauggaagaugcacaacagauggaguccuacuaggaacaacacaauuaucuccaguaaauauuuguacauuucgaggugacguaacacacauagcagguucaagaaacuauacuaugaauuuagccagucuaaacuggaauaauuacgauccaaccgaagaaauaccugcaccacuaggaacaccagacuucgucggaaaaauucaaggaguauuaacucaaacaacuaaaggugacggaucaacaagaggacacaaagcaacuguauacaccggauccgcaccauuuacaccuaaauuaggaaguguucaauucucaacagauaccgaaaaugauuucgaaacccaucaaaauaccaaauucacaccaguaggagucauacaagacggaggaacaacacaccgaaaugaaccacaacaguggguacuaccaucauauucuggaagaaauguacaaaacguacaucuagcaccagccguugccccaacauuuccaggcgaacaacuauuauucuuuagaucaacaaugccaggaugcucuggcuaucccaauauggaucuagauugccuacuaccacaagaguggguacaacacuuuuaucaagaagcagcuccagcacaaucugacguagcauuacuaagauuuguaaauccugauacaggacguguuuuauuugaaugcaaacuacacaaauccggauaugugacaguagcccacacaggccaacaugauuuaguaauuccaccaaaugguuacuucagauucgauucaugggucaaccaauuuuacacccuagccccaaugggcaauggaacagguagacgaagauaa

SEQ ID NO: 33805 - RNA, 1617 nt, Artificial Sequence
  derived and/or modified sequence opt6 from VP1__Norovirus_and/or_Norovirus-like__AB541318
augaaaauggcauccucagaugccaauccaucagauggaaguacagcuaauuuaguaccugaaguuaauaaugaaguaauggcauuagaaccuguaguaggcgccgcaauagcugcaccagucgcaggccaacaaaauguaauagauccauggauacgaaauaauuuuguccaagcuccaggcggagaauuuaccguaucacccagaaaugcaccaggagaaauacuuugguccgcaccacuugguccagauuuaaauccauaucuuucacaccuugcaagaauguauaacggauacgcaggaggauuugaaguucaaguaauacuagccggaaaugcauuuacagcagguaaaauaauauuugcagcaguucccccaaauuuuccaacagaaggucuaaguccuucacaagucacaauguucccacacauuauaguagauguaagacaacuugaaccaguuuuaauuccacucccagaugucagaaauaacuucuaccauuacaaccaaucuaacgauccgacaauaaaacuaauugcaaugcuauauacuccacuacgugcaaacaaugcaggagaugacguauuuacaguauccugcagaguuuuaacaagaccaucaccagacuuugacuucauauuucuaguuccaccaacaguagaaucaaggacaaaaccauuuucuguaccaauuuuaacuguugaagaaaugacuaacucuagauucccaauuccauuagaaaaacucuuuacaggacccucaucagcuuucgucgugcaaccacaaaauggcagaugcaccacagacgguguacuacuuggaacaacucaauuaucaccaguaaauauaugcacuuuccgaggagauguaacucauauaacaggcucccgaaacuacaccaugaaucuagcuacacaaaauuggaacucauaugacccaacagaagaaauacccgcaccacuaggaacccccgacuuuguaggaaaaauccaaggaguauuaacgcaaacaacacgagcagauggaucaacacguggacauaaagcaacuguauacacaggaagcgcugauuuugcuccaaaacuuggaagaguacaauucgcuacagauacagacaaugauuuugaugcaaaucaaaauacaaaauucacaccaguaggaguuauacaagacggaaauacagcacacagaaaugaaccacaacaauggguuuuaccauccuauucuggaagaaauucacauaauguacauuuagcuccagcaguagcaccaacauuuccaggagaacaacuauuauucuuuagaucaacaaugccagguugcucaggauacccaaauauggauuuagauugcuuauuaccacaagaauggguacaauauuuuuaucaagaagcugcaccagcccaaucagauguagcacuacuacgcuuuguaaauccagauacaggcagaguauuauucgaaugcaaacuacauaaaaguggcuauguaacuguagcucacacaggacaacacgaccuuguaauaccacccaauggauauuuuagauuugacuccugggucaaccaauuuuacacacuagcaccaaugggcaauggaaccggaagacgaagauaa

SEQ ID NO: 33806 - RNA, 1617 nt, Artificial Sequence
  derived and/or modified sequence opt6 from VP1__Norovirus_and/or_Norovirus-like__AB541307
augaaaauggccucaaaugaugcaaauccaucagaugguucagcagcaaaucuaguaccagaaguuaacaaugaagugauggcacuagaaccagugguuggugcagccauugcagcaccuguagcaggccaacaaaaugucauagacccuuggauaagaaauaauuuuguacaagcacccggaggagaauuuacaguuucaccaagaaacgcuccaggagaaauacuauggagcgcaccauuaggaccagaccuaaacccauaccuaucucacuuagccagaauguacaacggauacgcgggugguuuugaaguucaagucauauuagcaggaaaugcuuuuacagcaggaaaaauaauauucgcugccguaccuccaaauuucccaacagaaggucuaucaccaucacaaguaacaauguuuccacacauaauaguagacguaagacaacuagaaccuguuuuaauaccacucccagauguacgaaacaacuuuuaccacuacaaccaaucaaaugacucaacaaucaaacuaauagcaaugcuauauacuccacuccgagcaaauaaugcuggagaagacguauuuaccguaucuuguagaguucuaacaaggccaucaccagacuuugacuuuauauuucucguuccaccaaccgucgaaaguagaacuaaaccauuuacuguaccaauacuaacaguagaagaaaugacaaauucaagauucccaauaccacucgaaaaauuauuuacaggaccuucaagugcauucguaguucaaccccaaaacggacgcuguacaaccgacggaguauuauuaggaacaacacaacuuucuccuguuaauaucuguacauuuagaggagauguuacucauauagcaggaucacguaauuacacaaugaaccuagcaagccuaaacuggaauaacuacgauccaacagaagaaauaccugcaccucuaggaacuccagacuuuguuggaaaaauacaaggaguacuaacacaaacaacaaaaggagauggcucuacucgcggucauaaggcaacuguuuacacagguuccgcaccauucaccccuaaacuuggcucuguacaauuuucuacagacacugaaaacgacuucgaaacacaucaaaauacaaaauucacaccuguuggcguaauacaagauggagguacaacacauagaaacgaaccacaacaauggguacuaccaucuuacucaggacgaaauguaccaaacguucacuuagcaccagcaguagcuccaacauucccuggugaacaacuuuuauucuuucgaucaacuaugcccggauguagcggauauccaaauauggacuuagacugcuuauuaccacaagaauggguacaacauuucuaccaagaagcagcuccagcacaaucagacguagccuuacuacgauucguaaauccagacacuggaagaguauuauucgaauguaaacuacauaaaccaggauauguuacuguagcccacacaggacaacacgaucuagucauaccaucaaacggcuauuucagauuugacucuuggguaaaucaauuuuauacacuagcaccaaugggaaauggaacaggacgucgcagauaa

SEQ ID NO: 33807 - RNA, 1617 nt, Artificial Sequence
  derived and/or modified sequence opt6 from VP1__Norovirus_and/or_Norovirus-like__AB541254
augaaaauggccagcaaugaugcaaauccuucugauggaucagcagccaaccuaguaccugaaguaaacaaugaaguaauggcuuuagaaccaguaguaggagcagcaauagcagccccagucgcaggccaacaaaacguaauagacccauggauacgaaauaacuuuguuaaagcaccaggaggagaauuuacaguuucuccaagaaacucaccuggagagauauuauggucggcuccauuagguccugaucuaaauccauaccucucucacuuagcacgaauguauaaugguuaugcuggcggauuugaaguacaaguuauccuagcaggaaaugccuucacugcaggaaaaauaauauucgccgccguaccaccuaacuuccccacagaaggucuaucuccuucacaaguuacaauguuuccucacauuauugucgauguaagacaacuagaaccaguauuaauaccauuacccgauguacgaaauaauuucuaucacuacaaccaaucaaacgacuccacaauaaaacuaauagccauguuauauacaccauuaagagcaaacaacgcaggggacgacguuuuuacaguaucaugcagaguacuaacacgacccuccccugauuuugauuuuauauuuuuaguaccaccaacugucgaaucuagaacaaaaccauuuacuguaccaauauuaacaguagaagaaaugacuaauucucgauuuccuauaccauuggaaaaacuauuuacaggcccaucuucagcauucauaguacaaccccaaaauggaagauguacaacugauggaguucuauuaggaacaacacaauuaucaccaguaaauauauguacauuucgaggagauguaacacauaucgcaggaaguagaaauuacacuaugaauuuagcuucacucaacuggaacaacuaugauccaaccgaagaaguacccgcaccacuagguaccccugauuucgucggaaaaauacaaggcguauuaacacaaaccacaaaaggagacggauccacaagaggucacaaagcaacgguauauaccgguagcgcagacuucaccccaaaauuagguaguguacaauucggaacagacacagaaaaugauuuugaaacacaucaaaauaccaaauuuacaccuguugguguaauacaagacggaucaacaacacaccgaaaugaaccacaacaauggguucuaccaucauacaguggaagaaauguacacaacguacacuuagccccugcaguugcaccaaacuuuccuggagaacaauuauuauucuuuagaucaacaaugccagguugcuccgguuacccaaauauggaccuagauugcuuacuaccacaagaauggguacaacauuuuuaucaagaagcagcaccagcacaauccgauguagcacuacuacgauucguaaauccagacacaggaagaguccuuuucgaauguaaacuacauaaaucuggauauguuacaguagcacacacaggacaacaugaccuuguaauaccacccaauggauauuucagauuugauucuuggguuaaucaauucuauacacuagcuccuaugggaaauggaacaggacgaagacgauaa

SEQ ID NO: 33808 - RNA, 1617 nt, Artificial Sequence
  derived and/or modified sequence opt6 from VP1__Norovirus_and/or_Norovirus-like__AB541243
augaaaauggcuagcaaugaugccaauccaucagauggaucagcagcuaaucuuguccccgaaguaaauaaugaaguaauggcacuagaaccaguaguaggagcagcaaucgcugcaccaguagcuggccaacaaaauguaauagauccuuggauuagaaacaacuucguacaagcacccggaggcgaauuuacaguaucaccaagaaaugccccaggagaaauaccauggucugcuccucuaggaccagaucuaaaccccuaccuaucccaucuagcaagaauguacaaugguuacgcaggaggcuucgaaguacaagucauauuagcaggaaaugccuuuacagcaggaaaaauaauauuugcugcaguaccaccaaacuuuccaacagaaggacucucaccaagucaaguaaccauguucccacauauaauaguagacguacgacaauuagaaccaguauuaauaccauuaccugauguccgaaacaauuuuuaucacuauaaccaaucuaaugacucaaccauuaaacuaauagcaaugcuuuacacuccacuucgagcaaauaacgcaggggaagauguauuuacaguauccuguagaguacuaacacgaccauccccagacuuugacuucauauuucuaguuccaccaacaguagaaucaagaacaaaacccuuuacaguaccaaucuuaacaguagaagaaaugacuaauucaagauucccaaucccacuagaaaaacuauuuacaggcccuucaucagcauucguaguacaaccccaaaacggacgcugcacaacagacgguguacuauuagguacaacucaacuaucaccaguaaauaucuguacauuuagaggagacgucacccauauagcaggaucuagagauuauacaaugaauuuagccucauuaaacuggaacaacuaugauccuaccgaagaaauaccagcuccacuagguacuccagacuucguaggaaaaauacaagguguacuaacacaaacaacaaaaggugacgguucaaccagaggacacaaagcaacuguauauaccggcagcgcaccauuuacaccaaaacuagguaguguccguuuuucaaccgauacagaaaaugauuucgaaacccaucaaaauaccaaauucacacccguaggagucauucaagacgguuccacuacacauagaaaugaaccacaacaauggguacuaccuuccuauuccggcagagauguacauaacguccaccuagcaccagcaguagccccuacauuuccaggugaacaacuauuauucuucagaucaacaaugccaggauguucaggguacccaaauauggaucucgauugucuacuaccacaagaauggguucaacauuuuuaucaagaagcagcaccagcucaaucagacguugcacuccuaagauuuguaaauccagacacaggacgaguacuauuugaauguaaacuucacaaaucuggauacguaacuguagcacacacaggccaacaugauuuaguuauaccacccaauggauauuuuagauucgauucaugggucaaucaauuuuacacacuagcaccuaugggcaaugguacaggucgaagaagauaa

SEQ ID NO: 33809 - RNA, 1617 nt, Artificial Sequence
  derived and/or modified sequence opt6 from VP1__Norovirus_and/or_Norovirus-like__AB541232
augaaaauggcuuccaaugacgcaaauccguccgauggcuccgcagcaaacuuaguaccagaaguaaacaacgaaguaauggcucuagaacccguaguaggcgcagcaauagcagcaccaguagcaggucaacaaaauguaauagaucccuggauaagaaacaacuucguacaagcaccuggaggagaauuuaccguauccccaagaaaugccccuggagaaaucuuauggucugcaccuuuaggaccagaucuaaauccuuauuuaucccaccuagcuagaauguauaauggauaugccggcggauucgaaguucaagucauacuagcaggaaacgccuuuacugcaggcaaaauuauauuugcagcuguaccacccaauuuuccuacagaagguuuauccccaucccaaguuacaauguuuccucacauuaucguagacguacgacaacuagaaccagucuuaauaccauuacccgauguccgaaauaacuucuaucauuacaaccaaucaaacgacucaacuauaaaauuaauagcaauguuauacacaccauuaagagcaaacaacgcaggagaagaugucuuuacagucuccuguagaguauuaacaagaccuucaccugacuuugacuuuauauuccuaguacccccaacaguagaaucacgaacaaaacccuuuacuguaccuauuuuaacaguagaagaaaugacaaacagcagauuucccauaccacuagaaaaacuuuucacaggaccaucaggagccuucguaguucaaccacaaaauggaagauguacaacagauggagucuuacuaggaacaacacaacuaucaccugucaauaucuguacauuuagaggugauguaacacauauagcuggcuccagagauuacacgaugaaccuagcaucauuaaauuggaauaacuacgauccaacagaagaaaucccagcaccacuaggaacaccagacuuugucggaaaaauucaagggguucuaacucaaacaacaaaaggagacggaucaacaagaggccauaaggcaacaguuuauacagggucuacuccauucacuccaaaauuaggaucaguacaauuuucaacagauacagaaaacgacuucgaaacacaucaaaauacuaaauuuacaccaguaggaguaauacaagauggaaguacaacucaccgaaacgaaccacaacaauggguauuaccuucauauucuggaagaaauguacaaaauguacaccuagcuccugcaguagcaccaacuuuccccggcgaacaacucuuauucuuuagaucaacaaugccaggaugcucuggauauccaaauauggacuuagacugccuacuaccacaagaauggguacaacauuuuuaccaagaagcagcaccagcacaauccgacguagcacuacuacguuucguaaauccagacacaggaagaguuuuauucgaaugcaaauuacauaaaucaggauauguuaccguagcacacacaggacaacaugauuuaguaauaccaccaaauggcuauuucagauucgauucaugggucaaccaguucuauacucuagcgccaaugggcaauggcaccggaagaagacguuaa

SEQ ID NO: 33810 - RNA, 1617 nt, Artificial Sequence
  derived and/or modified sequence opt6 from VP1__Norovirus_and/or_Norovirus-like__GQ246800
augaaaauggcuucaaacgacgccaacccuucagauggaagcaccgccaauuuaguacccgaaguaaauaacgaaguaauggcauuagaaccaguaguaggugccgcaauagcagcuccaguagcuggccaacaaaauguaauagacccauggauaagaaacaacuucguacaagcaccgggaggagaauuuacaguaucacccagaaaugcaccaggagaaauacuauggagugcaccacuaggccccgaucuuaauccauacuuaucacaccuagcaagaauguauaacgguuaugcaggcggauuugaaguccaaguaauacuagcaggaaaugcauuuaccgcaggcaaaauaauauucgccgcaguaccaccaaacuuuccaacagaaggcuuaucuccaucucaaguaacaauguucccccauauaauagucgacguacgacaacuagaaccaguauuaaucccauuaccagacguaagaaauaauuuuuaucauuauaaccaaucaaacgauccaacaauaaaacuuauugcaaugcuauauacaccccuacgcgcaaauaacgccggagacgauguauuuacaguaucaugccgcguauuaaccagaccaucaccagacuuugauuuuauauuuccaguuccaccaacaguagaaagcagaacaaaaccauucacaguaccuauacuaacaguagaagaaaugacaaacaguagauuucccauuccacuagaaagacuauacaccggaccuucauccgcauuuguaguacaaccacaaaacggaagauguacaacugacgguguauuauuaggaacaacacaauuaucugcaguaaauauauguacauuuagaggagauguaacccacauagcaggcucaagaaauuacacaaugaauuuagcuucacaaaauuggaauaauuacgauccaaccgaggaaaucccagcccccuuaggcacaccagauuuuguagguaaaauacaaggaaugcuaacacaaacaacuagaucagauggaucaacacgcggucacaaagcaacaguauuaaccggaucggcagauuuugcaccuaaauuaggaagaguacaauuugcaacagauaccgacaacgacuuugaaucaggucaaaacacaaaauucacuccaguaggaguuauacaagacggaucaacaacccauagaaaugaaccccaacaauggguacuaccaaauuauuccggaagaacaggccacaauguucaucuagcaccagcaguugcaccaacauaccccggagaacaacuauuauucuucagauccacaaugccaggauguucaggauauccaaauauggauuuagacugucuucuaccacaagaauggguucaacauuucuaccaagaagcagcaccagcccaaucagacguagcccuacuaagauuuguuaacccagauacaggaagaguauuauucgaaugcaaacuacacaaaucaggauauguaacagucgcucauacuggacaacacgaucuaguaauuccuccaaauggcuacuuuagauucgauucaugggucaaucaauuuuacacauuagcaccaauggggaacggaacugguagaaggcgauaa

SEQ ID NO: 33811 - RNA, 1617 nt, Artificial Sequence
  derived and/or modified sequence opt6 from VP1__Norovirus_and/or_Norovirus-like__GU390900
augaaaauggcaucaaaugacgcaaacccaucagauggaucagcagcaaauuuaguaccagaaguaaauaaugaaguaauggcacuugaaccaguaguaggagccgcuauagcugcucccguagccggacaacaaaauguaauagauccuuggauaagaaacaacuuuguucaagcuccuggcggagaauuuacaguuucaccaagaaaugcacccggugaaauacuauggucagcaccucuagguccagauuuaaacccauaccuaucacaccuagcuagaauguacaauggauaugcugguggcuuugaaguucaaguaauacuagcaggaaaugcuuuuacagcuggaaaaauaauauucgcugcuguuccaccaaacuuuccaacagaaggacuuucaccaucacaaguaaccauguucccucauauaaucguagacguuagacagcuagaacccguucuaauaccauuaccagaugucagaaacaauuucuaccacuauaaucaauccucugacaguacaauuaaauuaauagcaaugcuauauacaccucuacgagcaaacaacgcaggcgaagaugucuucacaguaucaugcagaguacucacaagaccaucacccgauuuugacuuuaucuuucuaguuccaccaaccguugaaucaagaacaaaaccauucacaguaccaauacuaaccgucgaagaaaugacuaauaguagauuuccaauaccacucgaaaaacuauuuacaggucccucaucugcauucguuguacaaccacaaaacggcagaugcaccacugauggugucuuacuuggaacaacacaacuaagcccaguaaauaucuguacauuuagaggagauguaacacauaucgccgguaguagaaauuacacaaugaauuuagcuucauuaaacuggaauaacuaugacccaacagaagagauaccagccccacuaggaacaccagauuuuguuggaaaaauacaaggaguauuaacccaaacaacaaaaggugauggaucaaccagaggucacaaagccacaguauauacuggcagugcaccauuuacaccaaaacuaggaaguguucaauuuuccacagacacagaaaaugacuucgaaacacaucaaaauaccaaauucacaccaguaggcgugauccaagacggaggaacaacacauagaaaugaaccacaacaauggguauuaccauccuauucaggaagaaauguacaaaauguacaucuugcuccugcaguagcuccuacauuuccaggagaacaauuacuauuuuucagaucuacaaugccaggaugcuccggauauccaaauauggaucuugauugcuuacuuccccaagaauggguucaacacuuuuaucaagaagcagccccagcacaaagugacguagcacuacuuagauuuguaaauccugacacaggacgaguauuguuugaauguaaacuacauaaaucaggauauguaacaguggcucauacaggacaacacgauuuaguaaucccaccaaacggauauuuuagauuugauucaugggucaaucaauucuacacuuuagcacccaugggaaauggaaccggcagaagaagauga

SEQ ID NO: 33812 - RNA, 1617 nt, Artificial Sequence
  derived and/or modified sequence opt6 from VP1__Norovirus_and/or_Norovirus-like__AB504328
augaaaauggcauccaacgaugcuaauccuucagacggaucagcagcuaaccuagucccagaaguaaacaacgaaguaauggcauuagaaccaguaguaggagcugccauagcugcaccagucgcuggacaacaaaaugucauagaucccuggauacgaaauaacuuuguccaagcaccuggaggagaauuuaccgucaguccaagaaacgcaccuggcgaaaucuuaugguccgcaccacuaggaccagacuuaaauccuuaucuaucccaucuagcaagaauguauaauggauaugcaggagguuucgaaguacaaguaauucuagccggaaacgcauucacugcagguaaaaucauuuuugcugcaguuccacccaacuuccccaccgaaggacuaucaccaagucaaguaacaauguucccacacauaaucguagacguuagacaacuagaaccaguauuaauccccuuaccagaugucagaaacaauuucuaucacuauaaccaaucaaaugacucuacaauaaaauuaauagcuauguuauacacacccuuaagagcaaauaaugcaggagaagauguauuuacaguuagcuguagaguucuaacaagaccaucaccagacuucgauuuuauauuucuaguuccaccaacaguggaaucaagaacuaaaccauucacuguaccaauauuaacaguagaagaaaugacuaacagucgauuuccuauaccacuagaaaaacuauuuaccggaccaucaggugcauuuguuguccaaccacaaaacggacgauguacaacugacggaguauuacuaggaaccacacaauuaagcccuguaaauauauguacauuuagaggagacguaacacauauagcagguaguagaaauuacacaaugaauuuaaccucacuaaacuggaacaauuacgauccaacagaagaaauaccagcaccacuagguaccccagauuuuguaggaaaaauacaaggacuucuaacccaaacaacaaaaggugauggaucaacaagaggacauaaagcaacuguauauacaggaucggcgccauuuacaccaaagcuaggaucaguacaauuuuccaccgacaccgaaaacgacuucgaaacacaucaaaacacaaaauucacaccaguagguguaauccaagacggaucaaccacucaucgaaaugaaccccaacaauggguucuucccucauauucaggaauaaauguacacaauguccacuuagcaccagcagucgccccaacuuuccccggagaacaauuacucuuuuucagaucuacaaugccaggaugcucagguuacccaaacauggaucuagauugccuucuuccacaagaauggguacaacauuucuaccaagaagcagcaccagcucaaucagacguagcccuucuaagauucguaaaccccgacacaggaagaguauuauucgaauguaaauuacauaaaucaggauaugucacaguagcacacacuggacaacacgaucuaguaaucccaccaaauggauacuucagauucgauucauggguaaaccaauuuuauacucuagccccaaugggaaacggaacuggacgaagaagauaa

SEQ ID NO: 33813 - RNA, 1617 nt, Artificial Sequence
  derived and/or modified sequence opt6 from VP1__Norovirus_and/or_Norovirus-like__AB447434
augaagauggcaucaaaugacgcuaauccuucugacggcucagcagcaaaccuagucccagaaguaaauaacgaaguaauggcucuagaaccaguaguaggagccgcaauagcagcaccagucgcaggacaacaaaauguaauagacccuuggaucagaaacaacuucguucaagcuccugguggagaauuuacaguaucaccacgcaacgcaccaggagaaauuuuauggucagcaccacuaggcccagacuuaaauccauaccuaucccaccuagcuagaauguauaacucuuacgcaggcgguuucgaaguccaaguuauacuagccggaaaugccuuuacagcaggcaaaauaauauucgcagcuguaccuccaaacuuuccuacugaaggucucucuccaucucaaguuacuauguuuccucauauuauaguagacguuagacaauuagaacccguacuuaucccacuaccagauguaagaaauaauuucuaucacuauaaccaaagcaaugaccccaccaucaaacuaauagcaaugcuauacacacccuuaagagcaaacaaugcaggagaagauguauuuacaguuuccugucgaguccuaacccgaccuucuccagauuucgauuuuauauuccuaguaccuccaacaguagaaucaagaacuaaaccauucacaguaccuauauuaacaguugaagaaaugacaaacucuagauucccaauaccacuagaaaaguuauuuaccgggcccucaggcgcuuuuguuguacaaccucaaaauggaagaugcacaacagauggaguuuuacuaggaacuacacaauuaucaccaguaaauaucuguacauuccgcggagauguaacacauaucgcaggauccagaaauuacacaaugaaucuagcaucccuaaacuggaacaauuacgauccaacagaagaaauaccagcaccccucggaacaccugauuuuguaggaaaaauacaaggaguuuuaacacaaacaacaaaaggugaugguagcacaagaggacauaaagccacaguauacacuggauccgcuccauucaccccaaaauuagguucuguccaauucucaacagauacugaaaacgacuucgaaacccaccaaaacacaaaauucaccccaguuggugucauacaagacgguucuacuacucauagaaaugaaccacagcaauggguauuaccuucauacuccggucgaaauguacauaacguucaucuagcaccagcaguugccccuacauuuccaggagaacaacuucuauucuuuagaaguacaaugcccggauguuccggauauccaaauauggaucucgauugcuuauuaccucaagaauggguucaacauuucuaccaagaagcagcuccagcacaaucugauguagcacuauuacgauuuguaaauccagacacaggaagaguacuauucgaaugcaaacuucacaaaucaggauacgucacagucgcccacacaggucaacacgauuuagugauacccccaaacggauauuuccgcuuugacucaugggucaaccaauucuauacuuuagcaccaauggguaauggaacaggaagacgccgauga

SEQ ID NO: 33814 - RNA, 1617 nt, Artificial Sequence
  derived and/or modified sequence opt6 from VP1__Norovirus_and/or_Norovirus-like__EU839591
augaaaauggcuucaaaugaugcaaacccaucagacggauccgccgccaaccuugucccagaaguaaacaacgaaguaauggcauuagaacccguaguaggagccgcuauugcagcaccagucgcuggacaacaaaauguaauagacccauggauaagaaacaacuuuguccaagcuccaggaggagaauuuacaguaucaccaagaaaugcaccuggagaaauacuauggucagcaccccuaggaccagauuuaaauccauaccuaagucauuuagccagaauguacaacggauacgcaggagguuuugaaguacaagucauacuagcuggaaaugcuuuuacagcuggcaaaauaauauuugcugcaguacccccaaacuucccuacagaaggacuaucuccuucacaagucacaauguucccccacauaauaguagacguacgacaacuagaaccugucuuaauacccuuaccugacguaagaaacaauuucuaucacuauaaccaaagcaaugauucaacaaucaaacuuauagcuauguuauacacaccccuaagagcaaauaaugcaggcgaagauguauuuaccguuagcugucguguacuaacuagaccauccccagacuuugacuuuauauuucuaguacccccaaccguugaaucaaggacaaaaccauucaccguaccaauauuaacaguugaagaaaugacaaacucaagauuuccaauaccacuagaaaaacuauuuaccggaccaucaucagcauuuguaguacaaccucagaacggaagaugcaccaccgacggaguacuauuaggaacaacccaacuaucuccaguaaauauauguacuuuucgaggagacgucacccacauagcaggaucuagaaacuacacuaugaaucuagcaucacuuaauuggaacaauuaugauccaaccgaagaaauaccagcaccucuagguacaccagauuuuguagguaaaauaagaggugucuuaacacaaacaacuaaaggagacgguucaacuagaggacauaaagcaacuguauacacaggcuccgcuccauuuacaccaaaauuaggaucaguacaauucucaacagauacugaaaacgauuuugaaacacaccaaaauacaaaauuuacucccguaggaguaauacaagacgguggaacaacacauagaaaugaaccucaacaauggguauuaccaucauacucuggucgaaauguucccaacguucauuuagcaccagccgucgcuccaacauuuccaggugaacaacuacuauuuuucagaucaacaaugccagguugcucaggcuauccuaacauggauuuagacugcuuauuaccccaagaauggguucaacauuucuaccaagaagcagcaccagcacaauccgauguugcucucuuacgcuucguaaacccugauacaggucgaguacuuuucgaaugcaaacuacacaaaucaggguauguaacaguagcacacacaggacaacaugaucuaguuauaccaccaaacggauauuucagauucgauucauggguaaaucaauuuuacacauuagcaccaaugggaaauggaaccggaagaagaagauaa

SEQ ID NO: 33815 - RNA, 1617 nt, Artificial Sequence
  derived and/or modified sequence opt6 from VP1__Norovirus_and/or_Norovirus-like__AB291542
augaaaauggccuccaaugaugcuaauccuuccgacggaucagcagcaaaccucguuccagaaguaaacaaugaaguaauggcguuagaacccguuguaggugcagccauagcagcuccaguagcuggccaaacuaauguaauagacccuuggauuagaaauaauuucguacaagccccugguggcgaauuuacaguuucaccacgaaaugcacccggcgaaauauuauggucugccccucuaggcccagaucuaaauccauauuuaagccauuuagcacgaauguauaacggacacgcaggaggauucgaaguacaaguaauacuagcaggaaaugcauucaccgcaggaaaaauaauauuugcugcagugccaccaaacuuucccacagaaggauuaucaccaucucaaguaacaauguuuccacacauaauagucgacguuagacaauuagaaccaguacuaauaccauuaccugacguacgaaacaauuucuaucacuauaaccaaucaaaugacucaaccauaaaauuaauugcuauguuauauacuccuuuaagagcuaauaaugcaggagaagauguauuuacaguaucuugcagaguauuaacucgaccaucaccagacuuugacuuuauauuuuuaguaccuccaacaguagaaagccgaacuaaacccuucacaguuccaauacucacaguugaagaaaugacaaacucacgauucccaauaccauuagaaaaacuauuuacaggaccaucaggugcuuucguuguacaaccacaaaacggacgaugcaccacagauggagucuuauuagguaccacucaacuaucuccuguaaauauauguacuuuuagaggcgacguuacacacauagcaggauccagaaacuacaccaugaaucuagcaagccucaauuggaacaauuacgauccuacagaagaaauaccagccccacuuggaaccccugacuuuguaggaaaaauacaaggaguacuaacacaaacaacaaaaggcgacgguaguacaagaggccacaaagcaacaguauauacaggcucugcaccauuuacuccaaaacuaggaucaguccaauuuucaacugauaccgaaaacgauuucgaaacucaccaaaacacaaaauucaccccaguagguguaauacaagauggaucaacaacucauagaaaugaaccacaacaaugggucuuaccaucuuauucaggcagaaauguccauaauguacaccuagcaccagcaguagccccuacauuuccaggugaacaauuacuuuucuucagaucuacuaugccaggaugcucaggcuacccaaauauggaucuagauugucuacuaccccaagaauggguacaacacuucuaucaagaagcugcuccagcacaaucugacgucgccuuacuaagauuuguaaacccugacacaggaagaguauuauuugaauguaaacuacauaaaaguggauauguaacagucgcacacacaggucaacacgaccuugucauaccaccaaauggauacuuucgauuugauuccugggucaaccaauucuauacucuagcuccaaugggcaaugguacaggaagaagacgauaa

SEQ ID NO: 33816 - RNA, 1617 nt, Artificial Sequence
  derived and/or modified sequence opt6 from VP1__Norovirus_and/or_Norovirus-like__KX354123
augaaaauggcuucaucugaugccaacccuucagauggaucagcagcaaacuuaguuccugaaguaaauaaugaaguaauggcauuagaaccaguaguaggagcagcuauagcugcaccaguagcuggacaacaaaauguaauagaucccuggauacguaacaauuuuguacaagcaccaggaggagaauuuacaguuucacccagaaaugcuccaggagaaauauuauggucagcaccucucgguccugaucuaaauccauaccuaucacacuuagcgaggauguauaacggauacgccggaggcuuugaaguacaaguaauacuagcaggcaaugcauuuacugcaggaaaaguaauauucgcagcaguaccaccuaacuuuccaacagaaggauuaucaccaagucaaguaacuauguuuccacacauaguaguugauguuagacaacuagaaccaguacuaauaccacuuccugaugucagaaauaauuuuuaucacuauaaccaauccaaugauccaacaauaaaauuaauagccaugcuauacacuccauuaagagccaacaacgccggagaugacguauucacaguuucauguagaguacuaacaagaccaucaccagacuuugacuucauauuuuuaguaccuccaacaguagaaucaagaacaaaaccauuuucaguacccguacuaacaguagaagaaaugacaaacuccagauuuccaauaccacuugaaagacucuucaccggcccaucaagugcuuucguuguccaaccacaaaauggaagauguacuacagacggagucuuacuugggacaacucaauuaagcccugucaauauauguacauuuagaggagauguaacucauauaacuggaucccacaauuauacaaugaacuuagccucacaaaauuggaauaacuaugauccaacagaagaaauuccugcacccuuaggcaccccugauuuuguugguaagauacaaggcguacucacccaaacaacuagaacagauggcucaacacgaggacacaaagcaaccuuguauacaggaucggcugaguucgcaccaaaacuuggaagaguacaauuugaaacagauacaaaccacgauuucgaagcaaaucaaaauacaaaauucacaccuguaggaguaauacaagauggaucuaccacacauagaaaugaaccacaacaauggguacuuccuacauauucaggacgcaauacacauaacguacaucuagcuccagcaguagcaccgacuuuuccaggagaacaacuucucuucuuuagaucaacaaugccagguuguagugguuauccaaacauggaccuagacugccuauuaccucaagaauggguacaacauuuuuaucaagaagccgcaccagcucaauccgauguugcuuuacuacgauuuguaaacccagauacuggaagaguccuauuugaaugcaaauuacauaaaagcggauauauaacaguagcucacacaggacaacacgacuuaguaauaccaccaaauggauacuuuagauucgauucauggguaaaucaauucuauacauuagcaccaaugggaaacggaacuggacgaagaagauaa

SEQ ID NO: 33817 - RNA, 1617 nt, Artificial Sequence
  derived and/or modified sequence opt6 from VP1__Norovirus_and/or_Norovirus-like__KX354050
augaaaauggcaucaucggacgcaaacccaucagaugguucagcagcuaauuuaguccccgaaguaaacaaugaaguaauggccuuagaaccagucguaggagcagcaauagccgcaccaguagcaggacaacaaaauguuauugauccuuggauacgaaacaauuuuguacaagcaccggguggagaauuuacaguaucaccacgaaacgcaccaggagaaauacuuugguccgcaccccuaggaccagacuuaaauccauaccuaucacaccucgcaagaauguacaauggcuacgcaggaggucuagaaguacaaguuauauuagcuggaaaugcauuuacagccggcaaaauuauauuugcagcaguuccaccaaacuuuccaacagaaggacuaucaccuucacaaguaaccauguuuccccauauaauaguagacguacgacaauuagaacccguauuaauaccauuaccagauguuagaaacaauuucuaucacuauaaucaaucaaaugacccaacaaucaaguugaucgccauguuauacaccccauuacgagcaaacaaugcgggugacgauguauuuacuguuucauguagaguacuaacaagaccaucaccugacuucgauuuuauauuucuaguaccaccaacaguagaaaguagaacaaaaccuuuuucaguaccuauauugacaguugaagaaaugacaaauucuagauucccaauaccuuuagaaaaacuauuuacagguccuucaagugcauucguuguacaaccacaaaacggucgauguacaacugacggaguacuacuaggcaccacacaacuaucaccagucaauauauguacauucagaggagauguaacacauauaaccggaagcagaaauuacacaaugaaucuugcaucucaaaacuggaauaauuacgaucccacagaagaaauaccugcaccacuaggcacacccgacuucguagguaaaauccaaggcguacuaacacaaacuacuagagcagacggaucaacacgaggacacaaagcaacaguuuacacaggauccgcagauuuugcaccuaaauuaggaagaguacaauucgaaacagacacagaccaugauuuugaagcaaaucaaaacacaaaauucaccccaguaggaguaauccaagauggaggaacuacccauagaaaugaaccucaacaauggguauuaccaucauacucaggaagaaauacacauaacguacacuuagcaccagcaguagcaccaacauuucccggugaacaauuacuauucuuuagaucaacaaugccagguuguucaggauaccccaauauggauuuagacugccuuuuaccacaagaauggguccaauauuuuuaccaagaagcagcaccagcccaaagugacguagcacuacuaagauuuguaaacccagacacaggacguguuuuauucgaaugcaaacuacacaaaucuggauauguaaccguugcacacacaggacaacaugauuuaguaauaccaccaaacggauauuuuagauucgacucaugggucaaucaauuuuauacuuuagcaccaaugggaaauggaacagggagaagaagauaa

SEQ ID NO: 33818 - RNA, 1617 nt, Artificial Sequence
  derived and/or modified sequence opt6 from VP1__Norovirus_and/or_Norovirus-like__AB933717
augaagauggcaucaaacgacgcaaauccaucugauggcucagcugcaaauuuaguacccgaagucaacaaugaaguaauggcucuagaacccguuguaggcgcagcaauagcugcaccaguagcuggccaacaaaauguaauagacccauggauaagaaacaauuuuguacaagcaccuggaggugaauuuaccguauccccacgaaacgcuccaggagaaauauuauggucugcuccucuaggaccagaucuaaauccauaucuaagccacuuagcacgaauguacaacggauacgccgguggauuugaaguacaaguaauacuugcaggaaaugcauuuacagcuggcaaaauaauauucgcggcaguaccaccaaacuuuccuacagaaggauuaaguccaucucaaguaacaauguucccacacauaauuguagauguaagacaacuagaacccguacuuaucccuuuaccagauguaagaaauaauuuuuaucauuauaaccaauccaaugacucuacaauaaaacuaaucgccauguuauacaccccucuaagagcaaacaaugcaggcgaagaugucuuuacaguaucaugccgcguacuaacacgaccauccccagacuuugacuucauauuuuuaguacccccgacaguugaaucuagaacaaaaccauuuacaguaccaauacuaacaguagaagaaaugacaaacucaagauuuccaauaccauuagaaaaacuuuuuacaggcccaaguucugcauuuguaguacaaccccaaaauggacgcuguacaacugauggaguauuacuagguacaacccaauuaucuccaguaaauauaugcacauucagaggagacguaacucauauugcuggaucacguaauuauacaaugaaucuagcaagucuuaacuggaauaacuacgauccaacagaagaaauucccgcuccacuaggaaccccagacuuugucgguaaaauacaaggaguacuuacacaaacaacaaaaggagauggaucaacuagaggacacaaagcaacuguauauaccgguucagcuccauucacuccaaaacuagguaguguucaauucucuacagauacagaaaaugacuuugaaacacaucaaaacaccaaauucacuccaguaggagucauacaagacgguggcacaacacauagaaaugaaccacaacaauggguauuaccaaguuauucagguagagauguaccaaacguccacuuagcaccagcaguugcuccaacauuuccaggagaacaauuauuauucuuuagaaguacaaugccuggaugcuccggcuacccuaauauggauuuagauugccuucuuccacaagaauggguucaacauuuuuaucaagaagccgcccccgcacaaucagacguugccuuacucagauucgucaauccagauacuggaagaguauuauucgaauguaaacuacauaaaucuggauauguaacaguagcacacacuggacaacacgaucuaguaauaccacccaauggauauuuuagauuugauucauggguaaaucaauuuuauacacuagcaccuaugggaaauggaacaggaagaagaagauaa

SEQ ID NO: 33819 - RNA, 1617 nt, Artificial Sequence
  derived and/or modified sequence opt6 from VP1__Norovirus_and/or_Norovirus-like__AB933707
augaaaauggcaucaucagacgcaaauccuucugauggaucagcagcaaacuuaguaccugaaguaaauaacgaaguaauggcauuagaaccuguaguaggagcagcuauagccgcaccaguagcaggacaacaaaauguaauagacccuuggauaagaaauaauuucguccaagcacccggcggugaauuuacuguauccccuagaaaugcaccaggcgaaaucuuauggucagcaccauuaggaccagaucuaaauccauauuugagccauuuagcacguauguauaacggauaugcaggcggauucgaaguccaagucauacuagcagguaaugcauuuacagcaggcaaaauaauauuugcagcaguaccaccuaacuuccccacugaaggcuuaucaccaucacaaguaaccauguuuccccacauaauaguagaugucagacaacuagaaccaguacuuauaccauuaccagacguaagaaacaauuuuuaccauuacaaccaaagcaacgacucaacaauaaaauuaauagcaauguuauauacaccauuacgagccaauaaugcuggagaagacguauuuacuguaucuugcagaguucuaacuagacccucaccagauuuugacuuuauauucuuaguucccccaacaguugaaucacgaaccaaaccauuuacaguaccaauuuuaacaguagaagaaaugacaaauucaagauuuccaauacccuuagaaaaauuauuuaccggaccauccuccgcuuucgucguacaaccacaaaacggaagauguacaacagacggaguauuauuaggaacaacucaauuaucaccuguaaacauaugcacauuucgaggagauguaacacauauugcuggauccagagauuacacaaugaaccuagccucccucaacuggaauaacuaugacccaacagaagaaauuccagcaccauuagguacaccagacuuuguaggaaaaauacaaggaaugcuuacacaaacaacaaaaggagacggaucaacaagaggacacaaagcaacagucuacacaggaucagcuccguuuacacccaaacuaggcucuguacaauuuucuacagauacagaaaacgacuucgaaacacaucaaaauacaaaguucacacccguaggaguaauccaagauggaucaacaacccauagaaacgaaccacaacaauggguuuuaccaucauauagcggacgaaauguuccuaacguacacuuagcgccagcuguagcaccuacauuccccggagaacaacuauuauucuuuagaucaacaaugcccggaugcuccggauauccaaacauggaucuugacugucuucucccccaagaauggguccaacauuuuuaucaagaagcagccccugcacaaucagacguagcacuacuacgcuucguaaauccagacacaggaagaguacuauuugaaugcaaauuacauaaaucaggauauguuacuguugcacacacaggacaacacgaccuaguuauaccuccaaauggauauuucagguucgauucauggguaaaucaauuuuauacauuagcuccaaugggaaacggaaccggaagacguagauaa

SEQ ID NO: 33820 - RNA, 1617 nt, Artificial Sequence
  derived and/or modified sequence opt6 from VP1__Norovirus_and/or_Norovirus-like__AB933705
augaaaauggcauccaaugaugcuaacccauccgacggauccgcagcuaaucuaguaccagaaguaaacaaugaaguuauggcacuagaaccagucguaggcgcagcgauagcagcuccaguagcaggacaacaaaacgucauugaccccuggauacgaaacaacuucguucaagcuccaggaggagaauuuaccguuucaccaagaaaugccccaggagaaacacuauggagugcaccacucgguccugaccuuaauccuuaucuaagccaucuagcaagaauguauaauggauacgcaggaggauucgaaguacaaguuauacucgcaggaaacgccuucacugcuggcaaaauaaucuuugcugcuguaccaccaaauuuuccaacagaaggacuaucaccuucccaaguaacaauguucccacacauaauaguagauguccgacaacuagaaccaguauuaauuccauuaccagacguaagaaauaauuucuaccacuauaaccaaucaaaugacuccaccauaaaauugaucgcaauguuauacacaccacuacgcgcuaacaaugcaggagaagacguauuuacaguaaguugucguguacuuacuagaccaucaccagauuuugacuuuaucuuucuaguacccccaacaguagaaucuagaacaaaacccuucacaguaccaauauuaacaguagaagaaaugacuaacucacgauuuccaauaccauuagaaaaacuuuuuacagguccaucaucagcuuuuguaguacaaccucaaaauggacgauguacaacagauggaguacuacuaggaacaacacaauuaucaccaguaaauauauguacuuuuagaggugacguuacucacauagcaggaucucgaaacuauacuaugaauuuagcaucacuaaauuggaauaauuacgacccaacagaagaaauacccgcuccauuaggaacaccugacuuuguaggcaaaauacaaggaauguuaacacaaacuacaaaaggagauggaucaacaagaggucacaaagcaacagucuauacaggauccgcaccauuuacuccaaaacuaggaucaguccaauuuuccacagacacugaaaacgacuuugaaacucaucaaaauacuaaauucacaccaguagguguaauacaagauggaagcaccacccaucgcaacgaaccacaacaauggguacuacccucauacagcgggagaaacguacccaacguacaccuagcaccagcaguugcacccacauuuccaggugaacaacuacuuuucuuucgaucaacuaugccaggauguucaggguauccuaauauggaucuagauugucuacucccacaagaauggguacaacauuucuaucaagaagcagcacccgcacaauccgacguagccuuacuccgauuugucaacccugacacaggacgaguucuauucgaaugcaaacuacacaaaucuggcuacguaacaguagcacacacaggacaacaugaucuaguaauaccaccaaaugguuacuuccgauuugauucuugggucaaucaauuuuacacauuagcaccuaugggaaauggaacaggaagacgaagauaa

SEQ ID NO: 33821 - RNA, 1617 nt, Artificial Sequence
  derived and/or modified sequence opt6 from VP1__Norovirus_and/or_Norovirus-like__AB933704
augaaaauggcaucaaaugacgcaaauccaucagaugggagugccgcaaauuuaguuccagaaguuaauaaugaaguuauggcauuagaaccaguaguaggagcagcuauagcagcaccagucgcaggacaacaaaacguaauagauccauggaucagaaacaacuuuguacaagcaccaggaggagaauuuacaguuucaccccgaaaugcaccuggagaaauacucuggucagcaccucuaggaccagaucuaaaucccuaucuaucucauuuagcaagaauguauaacggauacgcugguggauuugaaguccaaguaauacuagcaggaaacgcauuuacugcaggaaagauaauauucgcagccguaccuccuaauuuucccacagagggccuaucacccucacaagucacaauguucccacacauuauaguagauguacgacaacuagaacccguccuuauuccauuaccagauguuagaaacaauuucuaucauuauaaucaaagcaaugauucaacaauaaaacuaauagcaauguuauacacuccuuugcgugcaaauaaugccggugaagauguauuuacaguaucauguagaguacuaacaagaccaucuccagacuucgauuucaucuuccuagucccaccuaccgucgaaucaagaaccaaaccuuuuacaguaccuauacuaacaguagaagaaaugacaaauucucgauuccccauuccacuagaaaaauuauuuacaggaccauccucagcauuuguuguacaaccacaaaacggucgaugcaccacagacggaguauuauugggaacuacucaacuaucucccguaaauaucuguacauucagaggagacgucacacacauagcagguucuagaaauuacacuaugaauuuagcuucauugaacuggaauaacuacgacccuacagaagaaauuccagcaccucuaggaacaccagacuuuguaggaaaaauucaaggaguacuaacacaaacaacuaaaggagaugguaguacaagaggacacaaagcaacaguauauacaggaucagcaccauuuacaccaaaacucggaucgguacaauucuccacagacacagaaaacgacuuugaaacacaucaaaauacaaaauucacaccagucggaguaauacaagacggaggaacaacacauagaaacgaaccacaacaauggguacuacccuccuacagcggacgaaauguaccaaacguucaccuggcaccagcaguagcaccaaccuucccaggcgaacaauuauuauucuuucgaaguacaaugccaggcugcucaggauacccaaacauggaucuugacugccucuuaccgcaagaauggguccaacauuuuuaucaagaagcagccccugcacaaucagacguugcauuacuacgcuuuguaaauccagacacaggaagaguacuauuugaaugcaaauuacauaaaucaggcuauguaaccguagcacacacaggccaauaugauuuaguaaucccacccaauggauacuucagauuugauucauggguaaaccaauuuuacacacuagcgccaaugggaaacggaacuggaagacgacgauaa

SEQ ID NO: 33822 - RNA, 1617 nt, Artificial Sequence
  derived and/or modified sequence opt6 from VP1__Norovirus_and/or_Norovirus-like__AB933699
augaaaauggcaucaaaugacgcuaacccaucagacgguucagcugccaaccuagucccagaagucaauaacgaaguaauggcuuuagaaccaguaguuggagcagcaauagcagcaccagucgcuggacaacaaaacguaauugacccauggauccgaaauaauuuuguacaagcaccuggcggcgaauuuacuguaucaccuagaaaugcaccuggcgaaauacucugguccgcuccucuaggaccagaucuaaauccauaucuaucucaucuagccagaauguacaauggauacgcuggaggguuugaaguacaaguuauauuagcaggcaaugcauuuacagccggaaaaauaauauuugcagcaguaccaccuaacuuuccaauagaaggauuaucuccaucucaaguaacaauguuuccucacauaauaguagacgucagacaauuagaacccguacuaauaccauuacccgacguccgaaacaauuuuuaucacuauaaccaacuaaaugacucuacaauaaaauuaauagcuaugcuauacacuccacuaagggcaaacaaugcaggagaagacgucuuuacuguaagcuguagaguacuaacacgaccaucaccagauuuugacuuuauuuucuuaguuccaccuacaguagaaucuagaaccaaacccuuuacgguaccaauacucacagucgaagaaaugacaaacucacgauucccaauaccauuagaaaaacuuuuuacaggaccaucuucagcauucguaguacaaccacaaaauggacgaugcacaacagauggagucuuauuagguacuacacaauuauccccaguaaauauauguacauucagaggagauguaacacacauugcaggaucuagaaauuacacuauguccuuagcaucacuuaauuggaacaauuacgacccaacugaagaaauaccagcaccacuaggaacacccgacuuugucgguaaaauucaaggaguauuaacccaaaccacuaaaggagauggauccacucgcggucauaaagcaacuguauauaccggaagcgcaccuuuuacaccaaaacuaggaucaguacaauuuucaacugauacugaaaaugauuucgaaacacaccaaaauacaaaauuuacacccguuggcguuauacaagacgguggaacuacacaucgaaaugaaccacaacaaugggucuuaccaagcuacucaggccgaaacgucccaaacguacaucuagcaccagccguagcaccaaccuucccaggugaacaacucuuauucuuuagaucaacuaugccaggaugcucuggauauccaaauauggaucucgauugccuauuaccacaagaauggguccaacacuuuuaucaagaagcagcuccugcacaaucagacguagcacuucuacgauuuguaaauccagacacaggacguguauuauuugaauguaaauuacauaaaucgggauacgucacuguagcacauacuggccaacacgauuuagucauaccacccaauggauacuucagauuugauucaugggucaaucaauucuacacccucgccccaaugggaaacggaacaggacgacgaagauaa

SEQ ID NO: 33823 - RNA, 1617 nt, Artificial Sequence
  derived and/or modified sequence opt6 from VP1__Norovirus_and/or_Norovirus-like__AB933679
augaaaauggcaucuaaugaugcaaaccccucagacggcuccgcagcuaaccuaguaccagaaguaaacaaugaaguaauggcacuagaaccaguuguaggagcagcuauagcagcuccaguagcaggucaacaaaaugucauagauccauggauacguaauaacuucguacaagcuccagguggagaauuuaccguauccccaagaaaugcccccggagaaauccuauggucagcaccauuaggaccagauuuaaacccauaucuaucucaucuagccagaauguacaauggcuacgcaggcggauucgaaguccaaguaauucuagcaggaaaugcauuuacagcuggaaaaauaauuuuugcagcaguaccacccaacuuucccacagaaggauuaucuccaucacaaguaacaauguucccucacauaauuguugauguucgacaacuagaaccaguuuuaauaccacuacccgauguaagaaacaauuuuuaucacuauaaccaaagcaaugauucaacaauaaaauuaauagcuauguuauacacaccacuaagagcaaacaaugccggugaagacgucuucacaguaucauguagaguauuaacucgaccaucuccggacuuugauuucauauuucuaguaccaccuacagucgaaucuagaacaaaacccuucacuguaccaauauuaacuguagaagaaaugacaaacucaagauuuccaauuccuuuagaaaaauuauucacaggaccaucuagugcauucauuguacaaccacaaaauggaagauguacaacagacgguguccuauuaggaacaacgcaacuaucuccaguaaauauaugcacuuuuagaggagacguaacccauauugcagguucucguaauuacaccaugaauuuagcaucuuuaaacuggaacaacuaugauccuacagaggaaauaccagcaccacuugguacuccagauuucguuggaaaaauacaagguguuuuaacacaaacaacaaaaggagacggauccacacgcggccacaaagcaacaguauauaccggaucagcaccauucacaccuaaauuaggaucaguacaauucucaacagacacagaaaacgauuuugaaacacaccaaaauacaaaauuuacgcccguuggaguaauacaagauggcggaacaacacaucgaaaugaaccccaacaauggguauuaccaaguuacagcgguagaaaugucccuaauguacauuuagcuccugcaguagcaccaacauuuccaggagaacaauuacuauucuuucgaucaacaaugcccggauguucagguuacccaaauauggaucuagacugcuuauuaccacaagaauggguacaacacuuuuaucaagaagcagcaccagcacaaucagauguagcacuccuacgauuuguuaacccagauacaggacgaguccuauucgaaugcaaacuucacaaaucagguuauguaacuguugcacacacaggacaacacgauuuaguaauaccuccaaauggcuauuuuagauucgauuccuggguuaaucaauuuuauacuuuagcaccaaugggaaauggaacaggacgaagaagauaa

SEQ ID NO: 33824 - RNA, 1617 nt, Artificial Sequence
  derived and/or modified sequence opt6 from VP1__Norovirus_and/or_Norovirus-like__AB933661
augaaaauggcgucaaacgacgcaaaccccucagauggaucugcagcaaaucucgucccagaaguaaacaaugaaguaauggcacuugaaccaguaguuggcgcagcaauagcagcaccaguagccggacaacaaaacguaauagaccccuggauaagaaauaauuuuguacaagccccagguggagaauuuacaguaucaccaagaaaugcaccaggugaaauauuauggagugaaccauuagguccagaccuuaauccuuauuuaucacaucuugcaagaauguacaacggcuacgccggaggguucgaaguacaaguaauacuugccggcaacgcuuucacagcaggaaaaauaauuuuugcagcaguaccacccaauuucccaacagaaggacuaucaccuucacaaguaacaauguucccucacauaauuguagauguaagacaacuggaaccagugcuaauaccauuaccugauguaagaaauaauuucuaucacuauaaucaaucaaaugacucuacuauaaaauuaauagcaauguuauauacuccccuaagagcaaacaacgccggagaagauguauuuacaguaucauguagaguacuuacacgcccuucuccagauuuugacuuuauauucuuaguuccuccuacuguagaaucaagaacaaaaccauucacaguaccuauauuaacaguagaagaaaugacaaauucuagauucccaauuccacuagaaaaacuauuuaccggaccaucaagugcauuuguuguacaaccacaaaacggacguugcacaacagacggaguccuacuaggaacaacacaauuaucuccaguaaacauauguaccuuuagaggagacguaacacacauagcagguucacgaaacuauacaaugaaucucgcaucauuaaacuggaauaauuacgauccaacagaagaaauaccagccccauuagguacaccagacuuugucggaaaaauacaaggaguauuaacucaaacaacaaaaggagacgguucaacacguggacacaaagcaacuguauauacuggaucagcaccuuuuacaccuaaacuaggaucaguccaauucucaacagauacagaaaaugauuucgaaacccaucaaaauacuaaauucacucccguugguguuauccaagacgguggcacaacacacagaaaugaaccacaacaauggguauuaccaucuuauucaggaagaaauguuccaaauguucaucuugcaccagcuguugcaccaacauuuccaggagaacaauuauuauuuuucagaucaacuaugccuggaugcucuggauacccaaauauggaucuugauugcuuacuaccacaagaauggguucaacauuuuuaccaagaagcugcaccagcccaaucagauguagcccuacucagauucguaaacccagacacuggaagaguccuauucgaaugcaaauuacauaaaucugguuauguaacaguagcacacacaggacaacacgauuuaguuauaccgccaaacggauauuuucguuucgacucguggguaaaucaauucuacacucucgcuccaauggguaacggaacaggaagaagaagauaa

SEQ ID NO: 33825 - RNA, 1617 nt, Artificial Sequence
  derived and/or modified sequence opt6 from VP1__Norovirus_and/or_Norovirus-like__KT152148
augaaaauggcuagcaacgacgcaaacccaucagauggaucagcagcaaaccucguaccagaaguuaauaaugaaguaauggcauuagaaccaguugucggugcagcaauagcugcacccguagcaggccaacaaaauguaauagacccauggauaagaaauaacuuuguacaagcaccaggaggagaguucacuguaucaccucgaaacgcaccuggcgaaauacuauggucagcaccauuaggaccugacuuaaauccuuauuuaucucaucuagcuagaauguacaacggauaugcuggaggcuucgaaguacaaguaauacuagcaggaaaugcauucacagccggcaaaauaauuuuugcugcaguaccaccaaauuucccaacagaaggucuuucaccuucccaagucacgauguucccacauaucaucguagacguuagacaauuagaaccaguucuaauacccuuacccgauguaagaaacaauuuuuaucauuauaaucaaucaaaugacucaacaauuaaauuaaucgcaaugcuauauaccccauugcgagcuaacaaugccggagaagaugucuuuacgguuucaugucgaguccuuacaagaccaucaccugauuuugacuuuauauuucuaguaccaccaaccgucgaaucacgcacaaaaccauuuacaguaccaauacuaaccguagaagaaaugacaaauucaagauuuccuaucccacucgaaaaauuauucacaggcccauccggagcauuuguaguacaaccacaaaacggaagaugcaccacugacgguguauuacuugguacaacacaauuaucaccaguuaacauaugcacauuccgaggagauguaacacauauugcaggaucucgaaacuauacaaugaaucuagcaucucuuaauuggaauaacuacgauccaaccgaagaaauaccagcaccacuaggaaccccagacuuuguaggaaaaauacaagguguccuuacacaaacuaccaaaggagauggcucaacacguggucacaaagcaacaguauacacugguucagcuccauuuacucccaaauuaggaucaguccaauucaguacagauaccgaaaacgauuucgaaacccaccaaaacacuaaauuuacuccaguaggaguaauacaagauggaucaacaacucaccgaaaugaaccccaacaauggguacuaccuagcuauucaggaagaaacguccauaacguccaucuagccccagcaguugcuccaacauucccaggagaacaauuauuauucuuuagaucuacaaugccaggaugcucaggauauccaaauauggaucuagauuguuuacucccacaagaauggguacaacauuuuuaucaagaagcagcaccagcucaaucagauguugcauuauuacgauucguaaacccugauaccggaagaguauuauucgaauguaaauuacacaaaucugguuauguaaccguagcccauacaggacaacaugaucuaguaauaccacccaauggcuauuucagauucgauucauggguuaaccaauuuuacacacuagcaccuaugggaaauggaacaggccgaaggcgauag

SEQ ID NO: 33826 - RNA, 1617 nt, Artificial Sequence
  derived and/or modified sequence opt6 from VP1__Norovirus_and/or_Norovirus-like__EU921393
augaaaauggcaucaaaugacgcaaauccuucagauggaucagcagcuaaccuaguacccgaaguaucaaaugaaguaauggcccuugaaccaguuguuggagcugcaaucgccgcaccagucgcaggacaacaaaacgucauugacccauggauacgcaacaauuuuguccaagcacccggaggagaauuuacaguaucaccaagaaaugcaccaggcgaaauacuaugguccgcuccccuuggaccagaucuaaauccuuaucucucacaucuagcaagaauguacaacggauacgcaggaggauucgaaguacaagucauacuagcagguaaugcauucacagcuggaaaaauaauuuucgcagcaguacccccuaacuuuccuaccgaaggauuaucaccaucucaaguuaccauguuuccacacauaauaguggacgucagacaauuagaaccaguacuaauaccauuaccagauguacgaaacaauuuuuaucacuauaaccaauccaaugauucaacaauuaaacuaauagcaauguuauacaccccacuaagagccaauaacgcuggagaagauguauucacaguuucauguagaguauuaacaagaccaucaccugacuucgauuuuauauuuuuaguacccccuacaguugaaucaagaacaaaacccuucacagucccuauauuaaccguagaagaaaugacuaauucuagauuucccauaccauuagaaaaauuauucaccggaccuucaggagcauucguaguacaaccucaaaacggacgauguacaaccgaugguguacuauuaggcacaacacaacuaucaccagucaauauauguacauuuagaggagacguaacacauauugcagguucacacaauuacaccaugaaucucgcaucacuuaauuggaacaacuaugauccaacagaagaaauaccagcuccuuuaggcacacccgacuucguagguaaaauacaagguguauuaacccaaacaacaaaaggagacgguaguacccgcggucauaaagccacuguauauacaggauccgcucccuuuacaccaaaacuaggaucuguccaguucucuaccgauaccgaaaaugauuucgaaacacaucaaaauaccaaauuuacuccuguaggaguuauacaagaugguucuacuacacauagaaaugaaccucaacaauggguacucccaucauauuccggaucaaacguccauaauguucaccuugccccagccguagcacccaccuuuccaggugaacaacuuuuauucuucagaucuacaaugccugguugcucuggcuaccccaauauggauuuagacugccuacucccacaagaauggguacaacauuucuaucaagaagcugcuccagcacaaucagacguagcauuacuaagauucguaaauccugauacaggaagagucuuauucgaaugcaaacuacauaaauccggauaugucacaguagcacacacaggacaacaugaucuagugaucccuccaaauggauauuuucgauuugauuccuggguaaaucaauuuuacacacuagcaccaaugggaaaugguacaggcagacgaagauaa

SEQ ID NO: 33827 - RNA, 1617 nt, Artificial Sequence
  derived and/or modified sequence opt6 from VP1__Norovirus_and/or_Norovirus-like__KM396961
augaaaauggcaucaagcgaugccaauccaucagacggaucagcugcaaaccuaguaccagaaguaaauaacgaaguaauggcauuagaaccagucgucggagcagcaaucgcagcacccguagcaggacaacaaaauguaauagauccauggauaagaaauaauuucguucaagcacccggaggugaauuuacaguaucgccuagaaacgcaccuggagaaauauuauggucugcaccacuaggaccugacuuaaauccuuacuuaucucaucuagcaagaauguauaauggauacgcaggaggauucgaaguacaaguuauacuagcaggaaaugcuuuuacagcagguaaaguuauauucgcagcuguaccaccuaacuuuccaacagaaggacuuagcccuucacaaguaacaauguuuccacauauuguagucgauguaagacaauuagaaccuguucuaauuccacuaccugauguacgcaauaacuucuaucauuauaaccaaucuaaugauccaacaauaaaacuaauagcaaugcuauauacaccuuuacgagcaaauaacgcaggagaugauguauucacuguaucauguagaguuuuaacacggccaucaccagauuuugacuuuauuuucuuaguacccccaacaguagaaagcagaacuaaacccuuuucaguaccaguauuaacaguagaagaaaugacaaacucucguuuucccauaccacuagaaaaacuuuuuacaggaccaucaucagcauuuguaguccaaccucaaaauggacguuguacuacagacgguguucugcuagguacaacacaauuaagcccuguaaacauauguaccuuuagaggagacguuacucauacaacaggaucacacaauuauacaaugaauuuagcaagucaaaauuggucaaauuaugauccaacagaagaaaucccugcuccacuaggaacuccagauuuuguuggcaaaauacaagguguccuuacucaaaccacacgcacagaugguucuacacgaggacacaaagcaacaguaagaacuggauccgcagauuucgcucccaaauuaggacgaguacaauuugaaacagauaccgaucaugacuuugaagcaaaccaaaacacuaaauucacaccaguaggaguaauacaagaugguucaacaacucacagaaaugaaccacaacaauggguacuuccaucuuauucaggucguaauacaccaaacguacauuuagcaccagcaguagcaccuacauucccuggagaacaauuauuauucuuucgaucaacaaugccaggauguucagguuauccaaauauggacuuagauugucuauuaccccaagaauggguacaacacuuuuaucaagaagcagcaccagcacaaucagacguugcacuauuaagauuuguaaauccagauacaggacguguacuuuuugaaugcaaauuacacaaaucaggcuauguaacaguagcccacacaggacaacaugaucuuguuauaccaccaaacggauauuuucgauucgauucauggguaaaccaauuuuauaccuuagcuccaaugggaaauggaacaggacgaagaagauaa

SEQ ID NO: 33828 - RNA, 1617 nt, Artificial Sequence
  derived and/or modified sequence opt6 from VP1__Norovirus_and/or_Norovirus-like__KM198485
augaaaauggccuccaaugacgcaaacccaucugauggaagcgcagcaaauuuaguaccagaaguaaacaacgaagucauggccuuagaaccaguuguaggagcagcaauagcagcaccagucgcuggacaacaaaacguuauugaccccuggaucagaaacaacuuuguacaagcaccagguggugaauuuaccguaucccccagaaaugcaccuggagaaauauuauggucagcaccacucgggccagauuuaaauccauaccuaucacaucuagccagaauguacaacggauaugccggugguuucgaaguacaaguuauucuagcaggaaacgcauuuacagcaggaaaaauaauuuucgcagcaguuccuccaaacuuuccaacagaaggacuaucaccuucucaaguaaccauguucccccauaucauaguugacgucagacaauuagaacccguauuaauaccccuacccgauguuaggaacaacuucuaucauuauaaccaaacaaacgauaguacaauaaaacuaauagcaauguuauauaccccuuuaagagcaaacaaugcaggagaagacguauucacaguaucauguagaguauuaacacguccuucaccagacuuugacuucauauuuuuaguuccuccaaccguugaaagucgaacuaaaccauuuaccguaccaauacuaacaguagaagaaaugacaaauucaagauuuccaauaccauuagaaaaacuauucacgggaccaucuucagcuuuuguuguacaaccacaaaaugguagauguaccaccgacggaguccuauuaggaacaacacaauuaagcccaguaaauauauguacauuuagaggugacguaacacauauagcaggaagcagaaauuauacaaugaaccucgcaucucuaaauuggaauaauuacgauccuacugaagaaaucccagcacccuuaggaaccccagacuucguagguaaaauacaagguguauuaacccaaacaacaaaaggagacggaucaacuagaggucacaaagcaacaguauacacagguuccgcaccuuucacaccuaaacuaggauccguccaauucucaaccgauacugaaaaugacuucgaaacucaccaaaauacaaaauuuacaccaguaggcguaauccaagacggcggaacaacacaucguaaugaaccucaacaauggguauuaccauccuauucgggaagaaauguacacaacguucaccuagcaccagcaguagcuccaacauuuccaggagaacaacuacuauucuuuagauccacaaugccaggaugcucuggauauccaaauauggaccuagauugucuacuaccccaggaauggguucaacacuucuaucaagaagcagcacccgcacaaucagacguagcauugcuacgauucguuaauccagauacuggacgaguauuauuugaaugcaaacuacauaaauccggauacguaacagucgcacacacuggacaacaugaucuaguuaucccacccaauggauauuuuagauucgauucaugggucaaccaauuuuacacacuagcacccaugggaaacggaacuggacgcagaagauaa

SEQ ID NO: 33829 - RNA, 1617 nt, Artificial Sequence
  derived and/or modified sequence opt6 from VP1__Norovirus_and/or_Norovirus-like__KF306214
augaaaauggccucaucagaugcuaacccguccgauggaucagcagcaaaccuuguaccagaaguaaacaacgaaguaauggccuuagaaccaguaguaggugccgcuauagcugccccaguagcaggacaacaaaauguaaucgacccauggauaagaaauaauuucguacaagccccaggaggugaauuuacuguaagcccaagaaaugcaccaggugaaauacuuuggucagcaccucucggaccagauuuaaauccuuaccuaucucaucuagcacgaauguacaacggauaugcaggagguuuugaaguacaaguaaucuuagcaggaaaugcauucacagcagguaaaguaauauucgcagcaguuccaccaaacuucccaacagaaggauuaucaccuucucaaguaacuauguuuccacauauaguaguagacguucgacaauuagaaccaguauuaauuccacuaccagaugucagaaauaauuuuuaucacuauaaccaaucaaaugauccuacaauaaaacuaauagcaauguuauauacaccacucagagcaaacaaugcaggcgacgauguauuuacaguuuccuguagaguacuaacacgaccaucuccagauuuugacuuuauauuuuuaguuccaccaacaguugaaucaagaacaaaaccauuuuccgucccaguauuaaccguugaagaaaugacaaauucucguuuuccaauuccauuagaaaaacuauucacaggacccucuucagcuuucguaguacaaccacaaaacggacgaugcacaaccgacggaguccuacuagguacaacacaauuaucaccuguaaauauaugcacauuccguggagauguuacacauauaacaggaucaagaaauuauacuaugaacuuagccucacaaaacuggaauaauuaugauccaacagaagaaauuccggcaccacuuggagcaccagacuucguaggaaaaauucaaggugugcuaacacaaacaacuagaacagacggaucuacaagaggucacaaagcaacaguauacacagguucagcagacuucgcacccaaacuaggacgaguacaauucgaaacagauacagaucacgauuuugaaguaaaucaaaauacaaaauucaccccaguuggaguaauacaagaugguggaaccacacaucguaaugaaccacagcaauggguacuuccaagcuauucaggaagaaauacaccuaauguucaucuagcacccgcaguagcaccaacauuuccuggagaacaacuucuauuuuuccgaaguacuaugcccggaugcucuggauauccuaauauggacuuagacuguuuacuaccucaagaauggguccaauauuuuuaucaagaagccgcacccgcacaaucugacguagcuuuacuuagauuuguaaacccugauacuggaagaguccuauucgaaugcaaauuacauaaaaguggauauguaaccgucgcccacaauggacaacacgaccuuguuaucccacccaauggauacuuuagauuugacucauggguaaaucaauuuuauacacuagcaccuaugggaaauggaacaggaagaagacgauaa

SEQ ID NO: 33830 - RNA, 1617 nt, Artificial Sequence
  derived and/or modified sequence opt6 from VP1__Norovirus_and/or_Norovirus-like__JX439831
augaaaauggccucaucagaugcaaauccaucagacggaucaaccgcaaaccugguaccagaagucaauaacgaaguaauggccuuagaaccaguuguaggagcagcaaucgcagcaccaguagcaggacaacaaaacguaauugacccuuggauaagaaauaauuuuguacaagcaccagguggugaauuuacaguauccccaagaaaugcaccaggagaaaucuuauggucagccccacuaggaccagaccuaaaucccuaucuaucucacuuagcaagaauguauaacggcuaugcaggagguuucgaaguccaagucauucucgcaggaaaugcuuuuacugccggaaaaauaauauucgcugcaguuccuccaaacuuccccacagaaggacuuucaccuucacaaguaacaauguucccacacauuauuguagauguacgacaauuggaaccuguucuaauaccacuuccagauguucgaaacaauuuuuaccauuauaaucaaucuaaugauccaacaauuaaauuaaucgcaauguuauauaccccauuaagagcaaacaaugcaggagacgauguauucaccgucagcuguagaguauuaacaagaccaucuccugauuuugauuucauauuucuagugcccccuacaguagaaucuagaaccaaaccuuuuucaguaccaaucuuaacaguagaagaaaugacuaauucaagauuuccuaucccauuagaaaaacuauuuacgggacccucauccgcauuuguaguacaaccacaaaacggaagauguaccauagacggagucuuauuagguaccacacaauuaucaccagucaauauuugcacauuuagaggagauguaacacauauaacaggcucuagaaauuauacaaugaauuuagccacacaaaauuggaacucuuacgauccaacagaagaaauaccagcaccauuaggaacaccagacuucguaggaaaaauucaagguguauuaacacaaacaacaagagcagacgguucaaccagaggacauaaagcaacuguauauaccgguucagcagauuuugccccaaaauuaggaagaguccaauucgcaacagauacagacaaugauuucgaugcuaaucaaaauacuaaauuuacuccuguaggagucauacaagacggaaauacagcacauagaaaugaaccacaacaauggguucuaccuuccuauucaggaagaaacagucacaauguccaccuagcuccagccguagcaccaaccuuuccaggcgaacaauuucuauuuuucagaucaacaaugccuggauguucaggauauccaaauauggaccuugacugcuuauuaccacaagaauggguacaauacuuuuaucaagaagcugccccagcacaaucagauguugcucuacuaagauucguuaacccagacacaggacgaguucuauuugaaugcaaauuacacaaaaguggauauguaaccguagcacacacaggacaacacgaucucguaauaccuccuaacggauauuuccgauucgauucauggguaaaccaauuuuauacccuugcuccaaugggaaacggaacaggucgccgcagauaa

SEQ ID NO: 33831 - RNA, 1617 nt, Artificial Sequence
  derived and/or modified sequence opt6 from VP1__Norovirus_and/or_Norovirus-like__KC409281
augaaaauggcuagcaacgaugcuaauccaagugacggcucugcagcaucauuaguaccagaaguuucaaacgaagucauggcacuagaacccguuguaggcgccgccauagcugcaccaguagcuggacaacaaaauguaauugacccuuggauacgaaauaacuuuguccaagcaccaggaggagaauuuacuguaucuccacgaaaugcaccaggagaaauccuauggagcgcaccacuuggaccagacuuaaaucccuauuuaucacauuuagcccgaauguauaacggauacgcugguggauucgaaguacaaguaauacuugcaggaaacgcauucaccgcaggaaaaauaauauucgcagcaguaccaccuaacuuuccaacugaaggacuaucacccucacaaguaacaauguucccacacauaaucguagauguacgacaacuagaaccaguccuaaucccauuacccgaugucagaaacaauuucuaccacuauaaccaaaccaaugaccccacaauaaaacuuauagcaauguuauauacuccccuaagagcuaacaaugccggagaagacguauucacaguaucauguagaguacuaacaagaccaucaccugauuucgacuuuauauuuuuaguuccaccuacaguagaaucuagaacaaaaccuuucacaguaccuauauuaacuguagaagaaaugacaaacucuagauuuccaauaccauuagaaaaacucuuuacuggacccucaggcgcauuuguaguccaaccacaaaauggccgauguacaacagauggcguucuauuaggaacuacucaacuaucaccaguaaauauaugcaccuuuagaggagacguuacucauauagcaggaucaagaaauuacacaaugaauuuagcuucauuaaacuggaacaacuacgauccuacugaagaaauuccagcaccacuagguacucccgacuucguaggaaaaauccaaggcguuuuaacacaaaccacuaaaggugacggaucaacaagaggacacaaagcaacaguauacacaggaucagcaccauucacaccuaaauuaggaucuguacaauuuaguacagauacagaaaacgauuuugaaacacaucaaaauacaaaauucacuccaguagguguaauacaagacggcggcacaacucaucgcaaugaaccacaacaauggguauuaccaucauacucuggaagagacguacacaauguacaucuagcacccgccgucgcaccuacauuuccaggagaacaacuauuauucuuucgaucaacaaugccaggauguucaggcuauccaaauauggauuuagauugccuauuaccucaagaauggguacaacauuuuuaccaagaggcagcaccagcucaaagugacguagcuuuacuacguuucguaaaccccgacacaggaagaguauuauucgaaugcaaacuacacaaaaguggauauguaacuguagcacauaccggacaacacgauuuagugauaccaccuaacggauauuuccgauuugauagcuggguuaaucaauucuacacauuagcaccaaugggaaauggaaccggaagaagaagauaa

SEQ ID NO: 33832 - RNA, 1617 nt, Artificial Sequence
  derived and/or modified sequence opt6 from VP1__Norovirus_and/or_Norovirus-like__JX459639
augaaaauggcaucgaacgacgcaaauccaucugauggaucagcagcaaaccuaguaccugaaguaaacaaugaaguuauggcccuagaaccuguaguaggagcagcuauagcagcucccguagcaggccaacaaaauguuauugacccauggauaagaaauaacuuuguccaagccccaggaggagaauuuacaguauccccaagaaaugcaccuggagaaauauuauggucagcaccucuugguccagaucuaaacccauaucuaucccaccuugcacgaauguauaacggcuacgcaggaggauucgaaguacaaguuauacuagccggaaaugcauucacagcugguaaaauaauuuuugcagcaguaccaccuaacuuuccaaccgaaggacuuucaccuucacaagucaccauguucccacauauuauaguagacguaagacaauuagaaccaguacuaauacccuuaccagauguaagaaauaauuuuuaucauuacaaccaaucaaacgacucuaccauaaaauuaauugcuaugcuuuacacaccacuaagagcaaacaaugcaggcgaagauguauuuacaguaucuugucguguccuaaccagaccaucaccagauuucgacuuuauauuucucguuccaccuacagucgaaucaagaacuaaaccauucacaguaccaauacuuaccguagaagaaaugacaaacucuagauuuccaauacccuuagaaaaacuauuuacaggaccuucuagcgcauucguaguacagccacaaaauggaagauguaccacagacggaguauuacuaggaaccacacaacuaucaccaguaaauauauguacauuuagaggagauguuacacauauagcuggaucuagaaacuauacaaugaauuuagcaucccucaauuggaauaacuacgauccaacugaagaaauuccugcaccccucggaacaccagacuuuguagguaaaauacaaggcauguuaacacaaacaacaaaaggagauggcucaacacgaggucacaaagccacugucuacacaggaucagcccccuuuacaccaaaacuaggauccguccaauuuucaaccgauacagaaaaugacuucgaaacucaucaaaacacaaaauucacaccaguaggaguuauccaagacgguaguaccacacauagaaaugaaccucaacaauggguauuacccucauacagcggaagaaacguacaaaacguucauuuagcaccagcuguagccccaacauuccccggugaacaacuauuauucuuucgcucaacaaugccaggaugcuccggauaucccaauauggacuuagacugcuuauuaccacaagaauggguacaacauuuuuaucaagaagccgcaccagcacaaagugacguagccuuauuacgauuuguuaacccagauacaggaagaguauuauucgaaugcaaauuacacaaaucaggauauguaacaguagcacauacaggucaacacgacuuagucauaccuccuaauggcuacuuuagauuugauucauggguaaaucaauuuuacacuuuagcccccaugggcaacgguacaggacgaagacgcuaa

SEQ ID NO: 33833 - RNA, 1617 nt, Artificial Sequence
  derived and/or modified sequence opt6 from VP1__Norovirus_and/or_Norovirus-like__JX459609
augaaaauggcaucaaacgaugcaaacccaucagauggcucagcagcuaaccucguacccgaaguaaauaaugaaguaauggcucuagaaccaguaguuggagcagcaauagcagcuccaguagccggacaacaaaacguuauagaccccuggauccgcaauaacuuuguacaagcuccuggaggcgaauuuacaguuucaccaagaaaugcuccaggagaaaucuuauggucugccccauuaggaccugauuuaaauccauauuuaucccauuuagcaagaauguauaauggauaugcagggggauuugaaguacaagucauucuagcuggaaaugcuuuuacagcaggcaaaauaauauucgcugcaguaccaccuaacuuuccaacugaaggacuuaguccaucucaaguaaccauguucccacauauaauagucgacguccgccaauuagaacccguauuaauaccauuacccgacguaagaaauaauuucuaucacuauaaccaaucgaacgauucaacaauaaaauuaauagcaaugcuauauacaccauuaagagcaaacaacgcuggugaagaugucuuuacugucucauguagaguucuaacaagaccaucuccagacuucgacuucauauuccuuguacccccaacaguagaaucucgcacaaaaccauucacagucccuauucuaacagucgaagaaaugaccaauucaagauuuccuauaccacucgaaaaauuauuuacaggaccaucaggagcauucgcaguucaaccacaaaacggacgaugcacaacagacggaguauuauuagguacuacccaacuaucaccaguaaauauauguaccuuuagaggagauguaacucauauugcaggaucaagaaauuauacaaugaauuuagcaucacuaaauuggaauaauuacgacccuaccgaagaaauaccugcaccacuaggaaccccagacuuuguaggaaaaauacaaggaguacuaacacaaacaacuaaaggagauggaucaacaagaggacacaaagcaacaguuuauaccggaucagcuccauucacaccuaaacucggaaguguccaauuuucuacagauacagaaaacgacuucgaaacacaccaaaacacaaaauucaccccaguaggaguaauacaagauggaggaaccacccacagaaaugaaccucaacaauggguauuaccuucauauucaggcagaaauguucacaacguacaccucgcaccagcugucgccccuacauucccaggugaacaacuauuauucuuuagaucaacaaugccaggauguucagguuauccaaauauggaucucgauugcuuauuaccacaagaauggguacaacauuucuaucaagaagccgccccagcucaaucugacguagcauuacuacgauuuguaaauccagacacuggcagaguuuuauucgaaugcaaacuacauaaaucuggauacgcaacuguagcacacacaggacaacacgaccucgugauaccuccaaauggauauuucagauucgauucuuggguaaaccaauuuuauacacuagcaccaaugggcaauggcacaggaagaagacgauaa

SEQ ID NO: 33834 - RNA, 1617 nt, Artificial Sequence
  derived and/or modified sequence opt6 from VP1__Norovirus_and/or_Norovirus-like__JN400599
augaaaauggcaucaaaugacgcuacaccuucagacggaucaacugcuaaccucgucccagaaguuaacaacgaaguaauggcacuagaacccguaguaggcgcagcaauagcagcaccuguagcaggacaacaaaauguuauugacccauggauuagaaauaacuuuguccaagcaccaggaggugaauuuacagucagcccaagaaacgcaccuggugaaauucuuuggucugcaccuuuaggacccgaccuaaaucccuauuuaucacaucuugcacgaauguauaacgguuacgccggcggauuugaaguacaaguaauuuuagcaggaaacgcauuuacagcuggaaaaaucauuuuugcugcaguaccaccaaauuuuccaaccgaaggacuauccccaucucaaguaacaauguuuccacauauuauaguagacguaagacaauuagaaccaguccucauaccuuuaccugaugucagaaauaacuuuuaccauuauaaucaaucaaaugauccaacaauaaaauuaauagcaaugcuuuacacaccauuaagagcaaacaaugccggagacgacguauuuacaguuagcugucgaguauuaacacgaccaucaccugauuucgacuuuauauuccuuguaccucccacaguugaaagucgaacaaaaccauuuucaguuccaauuuuaacaguugaagaaaugacuaauucaagguuuccaauaccauuagaaaaacuuuuuacagguccuucaucagcuuucgucguucaaccacaaaauggacgauguacaaccgacggcgucuuauuaggaaccacacaauuauccccaguaaauauauguaccuuuagaggugacgucacacauauagcagguacccaaaacuacacaaugaaucuagcuucacaaaauuggaacaauuacgauccaacagaagaaauaccugcuccacuaggaacaccugacuuuguaggaaaaauacaagguguauuaacacaaacaacaucacgagacggcucaacuaggggucacaaagcaacuguaagcaccggaucaguacauuucaccccaaaacuaggaucaguacaauucucaacagauacaucuaacgauuucgaaacuggacaaaauacacgauucacaccaguuggaguaguucaagacggaucaacaacccaccagaaugaaccacaacaauggguauuacccaacuauucaggucgagauucacauaacguacacuuagccccagccguagcaccaaccuuuccuggugaacaauuacuauucuuuagaucuacaaugccuggcuguucgggauacccaaauaugaacuuagauugucuacuaccacaagaauggguacaacacuuuuaccaagaaucugcuccagcacaaucagacguagcuuuauuaagauuuguaaacccagacacuggacgaguacuauuugaauguaaacuacauaaaccaggauacgucacagucgcacacacaggacaacacgaucuagucauaccaccaaaugguuauuucagauuugauucuuggguaaaccaauuuuacacuuuagcacccaugggaaauggagcuggaagaagaagauaa

SEQ ID NO: 33835 - RNA, 1617 nt, Artificial Sequence
  derived and/or modified sequence opt6 from VP1__Norovirus_and/or_Norovirus-like__JQ613539
augaaaauggcaucaucggaugcaaauccaucagauggcucuacugcaaaccuaguaccagaaguuaacaacgaaguuauggcauuagaaccuguaguaggagccgcaauagcugcuccuguagcaggucaacaaaauguaauagacccuuggauuagaaauaauuuuguucaagcaccagguggugaauuuacaguaagcccuagaaacgcaccaggugaaauauuauggucugcaccauuaggacccgacuuaaauccauaucuaucccaccuagcccgaauguauaacggauacgcuggcggauucgaaguacaagucauacuagcuggaaaugcauuuacagcuggaaaaauaauuuucgccgcaguucccccaaacuuuccaacagaaggccucucaccaucacaaguuaccauguucccucauauaauaguagauguaagacaacucgaaccaguauuaauuccacuaccagacguaagaaauaacuuuuaucauuacaaucaaucaaacgaccccacaauaaaauuaauagcuauguuauauaccccacuuagagcaaacaaugcaggagaugacguauuuaccguaucauguagaguacuaacucguccaucaccagauuuugacuuuauauuuuuaguuccaccuacaguugaaucaagaacaaaaccauuuucuguaccaauauuaacaguagaagaaaugaccaauucccgcuuucccaucccauuagaaaaacuauuuaccggacccucaucaaccuucguaguacaaccccaaaacggacgauguacaacagacggagucuuauuagguacaacacaauuaucaccaguaaauauuugcaccuucagaggagauguaacacacauagccggcucacauaacuacacaaugaaccuagcaagccaaaauuggaacucauacgauccaacugaagaaaucccugcaccauuaggcacaccagacuuuguuggaaagauacaaggcguauuaacacaaacaacaagaacagauggaaguacacgaggacacaaagcaacaguauauacaggaucagcugaauuuucuccaaaauuaggaagaguacaauucgcaacagauacaaacaacgauuucgaugcgaaccaaaauacaaaauucacuccaguaggcguuauucaagauggaggaacuacacacagaaacgaaccacaacaauggguacuuccuucauacucagguagaaauacacauaacguccaucuagcuccugcuguagcaccaacauucccaggugaacaacuauuauucuuccgcucaaccaugccaggaugcucagguuaccccaacauggauuuagacugcuuaauaccccaagaauggguacaauauuuuuaucaagaagcagcuccugcacaaucagauguagcacuucuuagauuuguaaacccagauaccggacgaguuuuauuugaaugcaaacuacauaaaucaggauauguaacaguagcacacacuggccaacacgaucuaguaauacccccaaacggauacuuuagauucgauucuuggguaaaccaauucuacacacuagcacccaugggaaacggaaccggaagaagaagauaa

SEQ ID NO: 33836 - RNA, 1617 nt, Artificial Sequence
  derived and/or modified sequence opt6 from VP1__Norovirus_and/or_Norovirus-like__HQ456329
augaaaauggcaucuaaugaugccaaccccucagauggaucagccgcaaaccuaguaccagaaguaaauaacgaaguuauggcauuagaaccaguugucggugcugcaauagcagcaccaguagccggacaacaaaacguaauugauccauggauaagaaauaauuucguccaagcaccgggcggagaguucacaguaucacccagaaaugcaccaggagaaauauuauggucagcaccauuagguccagaucuuaauccauaucuuucacaccucgcaagaauguauaacggauacgcaggaggauucgaaguacaaguaauuuuagccggaaaugcauucacagcaggaaaaauaauauuugcagcaguaccaccaaauuuucccacagaaggacuauccccaucacaaguaacaauguucccucauauuauagucgacguccgacaauuagaaccaguucuaauaccccuaccagacguaagaaauaauuucuaucacuauaaccaaucaaaugacucaacaauuaaacuaauagcaauguuauauacaccacuaagagcaaacaaugcaggagaagauguauuuacaguaucaugccgaguauuaacacgaccauccccagauuucgacuucauauauuuaguaccaccaacugucgaaucaagaacaaaaccguuuacuguaccaauauuaacaguugaagaaaugacaaauagccgauuuccaauaccuuuagaaaaauuauuuacagggccuaguggagcauuuguaguacaaccccaaaacggacgaugcacaacagacggcguauuauuaggaaccacacaauuaucaccaguaaauauaugcacauuucgaggagacguuacgcacauagcuggaucaagaaacuauacaaugaaccuagcaagucuaaacuggaauaacuaugauccaacugaagaaauaccagcaccucuaggaacgccagauuuuguagguaaaauacaaggaguuuuaacacaaacaacaaaaggugacggauccacaagaggacauaaagcaacaguauauaccggaggagcuccauuuacaccaaaauuaggaucuguucaauucucuacugauacagaaaacgauuucgaaacacaucaaaauacuaaauucaccccaguugguguaauacaagauggaucuacaacacauagaaacgaaccacaacaauggguauugccaucauauuccggaagaaauguacauaacguacauuuagcaccagccguugcaccaaccuuuccaggagaacaauuauuauucuuuagaucaacaaugcccggaugcucaggauauccaaauauggaccuugauugcuuauuaccacaagaauggguucaacacuucuaccaagaagcagcaccagcacagagcgacguagcuuuauuaagauuuguaaauccagauacaggacgaguauuauucgaauguaaacuacauaaaucaggauaugucacaguagcacauacaggacaacaugacuuaguuauuccacccaauggauauuuucguuucgauucuuggguaaaccaauuuuacacacuagcacccauggguaacggaacagggagaagaagauaa

SEQ ID NO: 33837 - RNA, 1617 nt, Artificial Sequence
  derived and/or modified sequence opt6 from VP1__Norovirus_and/or_Norovirus-like__HM802536
augaaaauggcuuccaaugacgcaaacccauccgaugguucugcagcaaaccuaguuccagaaguaaauaaugaaguaauggcauuagaaccaguuguaggagccgcaauagcugcaccaguagcaggacaacaaaacguaauagacccauggauuagaaacaauuuuguacaagcaccuggaggagaauuuacagucucaccccgaaaugcacccggcgaaauccuauggucagccccauuaggaccagaucuaaacccauaucuaagucacuuagcacgaauguauaacggauacgccggaggauuugaaguacaagucauccuugcaggcaacgcuuucacagcaggaaaaauaauauuugcugcaguaccaccuaauuucccuacagaaggacuaucaccaucacaaguaaccauguucccacauauaauaguagacguacgccaacuagaaccaguacuaauuccacuaccagauguaaggaacaauuuuuaccacuacaaccaaucuaaugauucaacaaucaaauuaaucgccaugcuuuauacaccauuaagagcaaauaaugcaggagaagacguauuuacuguuucuuguagaguauuaacaagaccaucaccagauuuugauuuuauauuccuaguacccccaaccgucgaaucaagaacaaaaccauuuacugucccuauauuaacaguugaagaaaugacaaacucaagauuccccauuccauuagaaaaacuauuuacaggaccaaguggcgcauuugucguacaaccacaaaacggcagaugcacaacagauggaguacucuuaggaacaacacaauuaucuccuguuaauauauguaccuuccgaggagaugucacacacauagcaggcucaagaaauuacacaaugaauuuagcaucuuuaaacuggaacaauuacgauccaacagaagaaaucccagcaccucuuggagcaccagacuucguaggaaaaauucaaggaguacuaacacaaacaacaaaaggcgacgguuccacuagaggacauaaagcaacaguauauaccgguucagcaccauuuacaccaaaauuaggauccguacaauuuuccacagacaccgaaaacgauuucgaaacacaucaaaauacaaaauuuacccccguaggcguaauacaagacggauccacaacacauagaaaugaaccacaacaauggguuuuaccaucauacucaggucgaaauguacacaacguacaccuugcaccagcuguagcaccuacuuuuccaggagaacaauuacuauucuuucgaucaacaaugccuggaugcucaggauaucccaacauggaccuugauugccuauuaccccaagaauggguacaacauuucuaucaagaagcagcacccgcacaaucagauguugcacuucuucgcuucguaaacccagacacaggaaggguauuauucgaaugcaaacuacauaagucaggauacguaacaguagcccacacaggucaacacgaucuagucauucccccaaacggauacuucagauuugacucauggguaaaucaauuuuacacacuugcuccaauggguaauggaacagguagaagacgauaa

SEQ ID NO: 33838 - RNA, 1617 nt, Artificial Sequence
  derived and/or modified sequence opt6 from VP1__Norovirus_and/or_Norovirus-like__HM802532
augaaaauggcauccaacgaugcuaacccauccgacggcuccgcagcaaaccuuguaccugaagucaacaaugaaguuauggcucuagaaccaguaguaggagcagcaauagcugcuccagucgcgggacagcaaaauguaauagacccuuggauaagaaauaacuuuguacaagccccaggaggugaauuuacaguaucaccaagaaacgcaccuggagaaauauuauggucagcaccacuaggacccgaccuaaauccauacuuaucucaccuugccagaauguauaauggauaugccggcggauucgaaguacaagucauacuagcagguaaugcuuuuacugcuggaaaaauaauauucgcagcaguaccaccaaauuuuccaacugaaggucuaucacccucccaagucacuauguucccacacauaaucguagauguaagacaauuagaaccaguacuaauaccccucccagacguaagaaacaauuuuuaccacuauaaucaaucaaaugacucaacaauaaaacugauagccauguuauauacaccucuucgcgcaaacaacgcaggcgaagauguauucacaguaucauguagaguacucacaagaccaucaccagacuuugauuuuauauuucuaguaccaccaaccguagaaucacgcacuaaaccauucacuguaccaauacuaacaguugaagaaaugacaaauuccagauuuccaauuccauuagaaaaacuauuuaccggaccuucuggagcauucguaguacaaccacaaaacggaagauguacaacagacgguguacuacuaggaacaacucaauuaucuccaguaaacaucuguacauucagaggcgacguuacgcauauagcuggcuccagaaauuacacaaugucucuagcaucauuaaacuggaauaauuacgauccaacagaagaaauaccugcaccauuagguacaccagacuuuguaggaaaaauacaagguguauuaacucaaacaacaaaaggagacggaucaacacgaggucacaaagcaacaguauauacaggaagcgcaccuuuuacaccaaaacuaggaucaguacaauucucaacagauaccgaaaaugacuuugaaacccaucaaaacaccaaauucacaccaguaggaguaauucaagacggaucaacaacacauagaaacgaaccacaacaauggguauuacccagcuacuccggacgaaauguacauaauguacauuuagccccagccguugcacccacauuuccaggagaacaacuauuauucuuucgcaguacaaugccugguugcucaggauauccaaauauggaucuagauugccuucuaccucaagaauggguacaacauuuuuaucaagaagccgcaccagcucaaagugacguugcacuauuacgauucguaaauccagacaccggacgaguacucuucgaauguaaacuacacaaaucuggauacguaacaguagcccauacaggccaacacgacuuaguaauaccacccaacggcuauuuucgauucgacucauggguaaaccaauuuuacacucuugcaccuaugggaaacggcacuggaagacgaagauaa

SEQ ID NO: 33839 - RNA, 1617 nt, Artificial Sequence
  derived and/or modified sequence opt6 from VP1__Norovirus_and/or_Norovirus-like__AB541341
augaaaauggcaagcaacgaugcaaacccuucagacggaagugcagcaaacuuaguacccgaaguaaauaaugaaguaauggcacuagaaccaguagucggagcagcaauagcagcacccguagccggacaacaaaauguuauagacccuuggauuagaaauaacuucguacaagcaccuggaggugaauuuacaguuuccccacgaaacgccccaggcgaaauacucuggucugcaccacuuggaccagaucuaaauccauaucuaagucauuuagcacgaauguauaacggauaugcaggaggauucgaaguccaaguuauacuagcaggaaaugccuucacagcagguaaaauaauauucgcagcuguaccaccuaauuuuccaacagaaggauuauccccaucacaaguaacaauguuuccacauauuaucguugacguacgacaacuugaacccguauuaauaccauuaccugacguaagaaauaacuucuaucauuauaaccaaucaaaugacucuacaauaaaauuaauagcuaugcuauacacaccauuaagagcaaacaaugcaggcgaagacguuuuuacaguuucauguagaguacucacacgacccuccccagacuucgauuuuauauuucuaguacccccgacaguagaaucaagaacaaaaccauucacaguaccaauacuuacaguagaagaaaugaccaauucaagauuuccaauacccuuagaaaaacuauuuacaggaccaucaucagcauuuguuguccaaccacaaaacggacgcuguacaaccgauggaguauuauuaggaaccacccaacuaucuccaguaaauauauguacauuuagaggagacguuacacauauagcuggaucaagaaacuacacaaugaacuuagcaucacuaaacuggaacaauuacgauccuacugaagaaauuccggcaccuuuaggaacuccagauuuuguaggcaaaauacaaggaaugcucacucaaacaacaaaaggagacggaucaacacguggccacaaagccacuguuuauacuggaucugcccccuuuaccccaaaacuuggcucaguacaauucuccaccgacacagaaaacgacuuugaaacucaccaaaauacaaaauucacaccaguaggaguaauacaagacgguaauacaacacaucgaaaugaaccccaacaauggguacuaccauccuauucugguagaaauguacaaaauguucacuuagcuccugcagucgcaccuacauucccaggugaacaacuacuuuucuuucgaucaacaaugccaggauguucaggauauccaaacauggaucuagauugucuccucccacaagaauggguacaacauuucuaucaagaagcagcuccugcacaaucagacguggcauuacuuagguucguaaacccugacacaggaagaguauuauuugaauguaaauuacauaaaucagguuacguuacaguagcacauacaggccaacacgauuuaguaauaccaccuaauggauauuuuagauuugacucauggguaaaccaauuuuacacccuagcaccaaugggaaauggcacaggaagaagaagauaa

SEQ ID NO: 33840 - RNA, 1617 nt, Artificial Sequence
  derived and/or modified sequence opt6 from VP1__Norovirus_and/or_Norovirus-like__AB541264
augaaaauggcaucaaaugaugcaaacccaucagauggcagugcagccaacuuaguaccugaaguuaacaacgaaguaauggcguuagaaccaguaguaggagcagcuauagcagccccaguagcaggacaacaaaaugucauagauccguggauaagaaauaacuuuguacaagcaccuggaggcgaauuuacaguaucuccaagaaaugcaccaggugaaauacuauggagugcaccacuagguccagaucuuaaccccuaucucagccauuuagccagaauguauaacggauaugccggaggauuugaaguccaaguaauacuagcuggaaaugcauuuacugcaggaaaaauuauauuugcagcuguaccucccaacuuuccaacggaaggccucucaccaucacaaguaacaauguucccacauauuauuguagacguaagacaauuagaaccaguucuuauuccauuacccgauguuagaaauaauuuuuaccauuauaaccaaucaaacgauucaacaauaaaauuaaucgcaauguuauacacuccacuaagagcaaacaaugcaggagaagacguauucaccguaucauguagaguacugacacgaccuuccccugacuuugacuuuauauuucuaguacccccaacagucgaaucccguacuaaaccauucacagucccaguauuaacagucgaagaaaugacaaauucucgauuuccaauaccuuuagaaaaacuauuuacaggcccuuccucagcauucgucguacaaccccaaaauggucgauguaccacagacgguguauuacuaggcacaacacaacuaucaccaguaaauauuugcaccuuuagaggagacguaacccauauagccggaucccgagauuacacuaugaaucuagcaucucuaaacuggaacaauuaugacccaacagaagaaauaccagcaccacuaggaacaccagacuuuguugguaaaauccaaggaguauuaacccaaaccacaagaggagacggaucaacaagaggacacaaagcaaccguauauacaggauccgcuccauuuacaccaaaauuaggaucaguacaauucucuacagauaccgaaaaugauuucgaaacacaccaaaauacaaaauucaccccuguaggcguaauacaagacggagguacaacucauagaaaugaaccucaacaauggguucuaccauccuauucaggaagaaauguaccaaauguacacuuagccccagcaguagcaccuacauuucccggagaacaacuccuguucuuuagaucaaccaugccaggcuguuccggcuauccaaacauggauuuagacuguuuauuaccacaagaauggguacaacauuucuaccaagaagccgcaccagcacaaucugacguagccuuauuaagauuuguuaauccagacacagguagaguucuauuugaaugcaaacuacauaaaucuggauauguaacaguugcacacacaggacaacacgauuuaguuauacccccaaaugguuauuuccgauucgauucauggguuaaccaauuuuacacacuugccccuaugggaaauggaacaggaagaagacgauaa

SEQ ID NO: 33841 - RNA, 1617 nt, Artificial Sequence
  derived and/or modified sequence opt6 from VP1__Norovirus_and/or_Norovirus-like__AB541236
augaaaauggcauccaaugacgcuaauccaucagauggcucggccgccaaccuaguacaagaaguaaacaaugaaguaauggcacuagaacccguaguaggagcugccauagcagcaccuguagcaggacaacaaaauguaauugacccuuggauuagaaauaacuucguacaagccccaggaggcgaauuuacuguaagcccacgaaaugcuccuggagaaaucuuauggucagcaccuuuaggacccgacuuaaaucccuauuuaucacaucuagcaagaauguauaacgguuacgcuggaggauucgaaguacaaguaauauuagccgguaaugcauuuacagccgguaaaauaauauucgcagccguuccaccaaacuuuccaacagaaggauuaucuccaucacaaguuacuauguucccacacauaauaguagacguaagacaacuugaacccguauuaauaccauuacccgacguccgaaauaacuucuaucauuacaaccaaucaaaugacucaacaauaaaacuaauagcaauguuauauacacccuuaagagcaaauaacgccggagaagauguauuuacaguaucauguagaguuuuaacacgaccuucaccagacuucgacuucauauuucuaguaccgccuaccguagaaucacgcacaaaaccauucacaguucccauacuaacaguagaagaaaugacaaacucaagauuucccauuccauuagaaaaacucuuuacuggaccuuccucagcauuuguaguccaaccacaaaauggaagaugcacaacagacggaguacuuuuaggcacaacucaauuaucaccaguaaauaucuguacuuuucgaggagacguaacacauauagcaggaucacgcaauuacauaaugaauuuagcaucauuaaauuggaacaacuacgauccuacagaagaaauaccugcaccacucggaaccccagacuuuguaggaaaaauccaaggaguauuaacacaaacaacaaaaggagauggauccacacgaggccacaaagcaacugucuauacaggcucugcaccuuuuacgccaaaauuagguucuguccaguucaguacagacaccgaaaacgacuuugaaacccaccaaaauacaaaauucacccccguuggaguaauacaagacggaucaacaacccauagaaaugaaccccaacaaugggucuuaccaucauacucaggaggaaauguucauaacguacacuuagcaccagcaguugccccuacauuucccggagaacaauuacuauucuuccgaucaacaaugccaggcuguucagguuaucccaauauggauuuagacugcuuacuuccacaagaauggguacaacauuuuuaccaagaagcagccccugcacaaucagacgucgcauuauuaagauucguaaauccagauacuggaagaguauuauuugaaugcaaacuacauaaaucaggauacgucacaguagcacacacuggacaacaugaucuaguuaucccacccaauggauauuuuagauucgauucaugggucaaucaauucuauacacuagcaccaauggguaacgguacuggaagacguagauaa

SEQ ID NO: 33842 - RNA, 1617 nt, Artificial Sequence
  derived and/or modified sequence opt6 from VP1__Norovirus_and/or_Norovirus-like__AB541208
augaaaauggcaucaaaugacccaucuccuucugacggaucugcagcaaacuuaguaccagaaguaaacaaugaaguaauggcauuagaaccuguaguaggugcagcuauagcagcaccaguagcaggccaacaaaauguaauagacccauggauaagaaacaauuucguacaagcaccaggaggagaauuuacaguuucaccaagaaaugccccaggcgaaauauuauggucagcaccauuaggaccagaccuaaacccauacuuaucacaccucgcaagaauguauaacggauaugcuggagguuucgaaguccaaguaauacuugcaggcaacgcauucacagcagguaaaauaauauucgcagcaguuccacccaacuuccccacagaaggacuaucaccaagccaaguaacaauguuuccacacauaauaguagauguucgacaacuagaacccguuuuaauaccuuuaccagauguaagaaauaauuucuaucacuacaaucaaucuaacgacucaacaauuaaauuaauagcuaugcuuuauacaccacuuagagcaaacaaugcaggagaagauguauuuacaguuucaugcagaguacuuacacguccaucuccugacuuugacuuuauauucuuagucccaccuacaguagaaucaagaacaaaaccauuuacagugcccauacuaacaguugaagaaaugacaaauucaagauuuccaauaccccuagaaaaacuauuuacaggacccagcucagcauucguaguacaaccccaaaacggaagaugcaccacagacggaguacuucuagguaccacccaacuuucaccaguuaauauaugcacauuuagaggagacguaacacacaucgcuggcucaagaaauuauacuaugaaucuagcaucucuaaacuggaauaauuacgauccaacagaagaaauaccagcuccacuaggaacaccagacuuuguagguaaaauucaaggaguacuuacccaaaccacaaaaggagacggaucaacucgaggacauaaagcaacuguauauaccgguucagcaccauuuacaccaaaacuaggaucaguucaauucagcacagacaccgaaaacgauuucgaaacacaucaaaacacaaaauucacaccaguaggaguuauacaagauggcggcacuacacaucgaaaugaaccacaacaauggguucuaccaagcuauucaggaagagauguacaaaauguacauuuagccccagcaguugcaccaacauuuccaggagaacaauuauuauucuucagaucaacaaugcccggaugcucaggcuacccaaauauggauuuagauugucuacuaccccaagaauggguccaacacuuuuaucaagaagcugcucccgcucaauccgacguagcauuacuacgauucguaaaccccgacacaggaagggucuuauuugaauguaaauuacacaaaucagguuauguaacuguagcacacacaggacaacaugaucuaguaauaccaccuaaugguuauuucagauuugauagcuggguaaaucaauucuacacauuagcaccaauggguaauggaacaggucgucgaagauaa

SEQ ID NO: 33843 - RNA, 1617 nt, Artificial Sequence
  derived and/or modified sequence opt6 from VP1__Norovirus_and/or_Norovirus-like__EU876890
augaaaauggcaucaaaugacgcaacacccucagacggauccaccgcaaauuuaguaccagaaguaaauaacgaaguaauggccuuagaaccaguaguuggugcagcuauugcagcgccaguagcaggacaacaaaacguaauagacccuuggauacgaaauaacuuuguacaagcuccaggaggugaauuuacaguuucuccaagaaaugccccaggggaaauauuauggucagcaccccuaggaccugaucucaauccauaucuuucacaucuagcccgaauguacaacggauaugcugguggauuugaaguacaagucauuuuagcaggcaaugcauucacagcaggaaaaaucauauucgcugcuguaccaccaaacuuuccaacagaaggacuaucaccaucucaagucacgauguuuccucauauaauaguugacguacgacaacuagaaccuguuuuaauaccauuacccgaugucagaaauaacuucuaucauuacaaccaauccaacgaucccaccauaaaacuaaucgcaaugcuuuacacuccauuaagagcaaauaaugcaggagacgaugucuuuacuguauccugccgagucuuaacaagaccuuccccagauuuugacuuuauauuuuuaguaccaccaacaguagaaucacgaacaaaaccauuuucuguaccaauacucacuguagaagaaaugacuaauucuagauucccaauccccuuagaaaaacuauuuacugguccuucuuccgccuucguaguacaaccacaaaauggaagauguacaaccgacggaguauuacuaggaacaacacaacuaucuccagucaauauauguacauuccgaggagacguaacacauauagcagguacucaaaauuacacaaugaauuuagcaucccaaaauuggaauaauuaugauccaacugaagaaauaccagcgccuuuaggaaccccugacuucguaggaaaaauacaaggaguacuaacucaaacaacaagaagagauggaucuacuagaggacacaaagcuacuguaucaacaggaucaguacacuucacaccaaaacuaggaucaguucaauuuucaaccgauacuagcaaugauuucgaaacuggacaaaauacaagauucacucccguuggaguaguccaagacggaaguacaacccaucaaaacgaaccacaacaauggguacucccagacuauaguggaagagauucacacaauguacacuuagcaccagcaguagcaccaaauuuuccaggugaacaauuauuauuuuucagaucuacaaugcccggaugcucuggauauccuaacaugaaccuagauuguuuacuaccacaagaauggguacaacacuuuuaucaagaaucagcuccagcacaaucugauguagccuuacuaagauucgucaauccagauaccggaagaguucuauucgaauguaaacuacacaaaucaggguacguaacaguagcucacacaggacaacaugauuuaguaauaccaccuaacggcuacuuccguuucgauucauggguaaaucaauuuuauacacuagcaccuaugggaaacggcgcaggccgacguagguaa

SEQ ID NO: 33844 - RNA, 1617 nt, Artificial Sequence
  derived and/or modified sequence opt6 from VP1__Norovirus_and/or_Norovirus-like__AB385638
augaaaauggcuucaucagacgcuaauccuagcgauggaucuacagcaaaccuaguaccagaaguaaauaaugaaguaauggcucuagaaccgguaguaggagccgccauagcugccccuguagcaggacaacaaaacguaauugacccauggauaagaaauaacuuuguacaagcaccaggaggagaauuuacaguaucaccacguaaugcaccuggugaaauacuauggucugccccauuaggucccgaccuaaauccauacuuaucacaccuugcaagaauguacaacuccuacgcaggcggauucgaaguacaagucauuuuagccggaaaugcauuuaccgcaggaaaaauaauauuugcagcagugcccccuaacuuucccacagaaggauuaucaccaucacaaguuaccauguuuccacauauaauaguugacguucgacaacuagaaccaguacucauaccacuuccagauguaagaaacaauuucuaucacuacaaccaaucaaacgauccaacaauaaaauuaauagcaaugcuuuauacucccuuaagagcuaacaaugcaggagacgauguauuuacaguaucuugccguguauuaacaagaccauccccugacuuugacuucauauuucuugucccuccaacaguugaaucaagaacaaaaccauuuucaguaccaauuuuaacagucgaagaaaugacaaacucacgauuuccaauaccucuagaaaaacuauucacaggaccaucauccgcauucguaguacaaccccaaaacggaagaugcacgacagacggaguacuacucgguacaacacagcuauccccugucaauaucuguacauucagaggagauguaacccauaucgcuaacacucaagaauauacaaugaacuuagccucacaaaauuggaacaacuaugauccaacugaagaaauaccugcuccucuuggcacaccugauuucguaggcaaaauacaaggaguauuaacacaaacaacaagaagagacggaagcaccagaggucacaaagccacaguuucaacaggaucuguccauuucaccccaaaauuaggcagaauacaauucucuacagacacauccaaugacuuugaaacuggacaaaauacaagauucacacccguaggagucguacaagacggauccaccacccaccaaaaugaaccucaacaauggguucuucccaacuauucuggaggagauggucacaacguucaccuagccccagcugucgcaccuucuuuuccuggagaacaacuauuauucuuuagaucaacaaugccaggaugcucuggauauccuaauaugaaucuagauugcuuauuaccucaagaauggguacaacauuucuaucaagaagcagcuccagcacaaucagacguagcauuacuacgauuuguaaacccagacaccggaagaguacuauuugaaugcaaauuacacaaaucuggauacguaacaguagcacacacuggacaacaugaucuaguaauacccccgaacggauacuuuagauucgauucauggguuaaucaauucuacacauuagcacccaugggaaaugguacaggaagacgaagguaa

SEQ ID NO: 33845 - RNA, 1617 nt, Artificial Sequence
  derived and/or modified sequence opt6 from VP1__Norovirus_and/or_Norovirus-like__AB385635
augaaaauggcaucaaaugacgcaacaccauccgacggaaguacagcuaaccuuguaccagaaguaaauaacgaagucauggcauuagaaccaguaguaggugcagcaauagcugcaccaguagccggccaacaaaacgucauagacccauggauucgaaacaauuucguacaagcuccaggaggagaauuuacaguaucaccaagaaaugcaccaggagaaauauuauggucugcuccuuuagguccagauuuaaaucccuaucuaucacaccuugcucgaauguauaauggcuacgcagggggauucgaaguacaaguaauucuagccggaaaugcauucaccgcagguaaaauaauauucgcagccguacccccaaacuuuccaaccgaaggacuaucaccaucacagguaacaauguucccacacauaauuguagacguaagacaacuagaaccaguacuaauaccacuuccugauguaagaaacaauuuuuaucauuauaaucaauccaacgacccuacaauaaaacucaucgccauguuauauacaccacuaagagccaauaaugcaggagacgacguuuuuacagauaguugccgaguacuaacacguccaucuccagauuuugacuuuauauuuuuagucccaccuacaguagaaucacgaaccaaaccauucucaguaccuauccuaacagucgaagaaaugacuaauuccagauucccaauuccucuagaaaaacuauuuacagguccuucaucugcauucguaguacaaccccaaaacggacgaugcacaacugacggaguauuacuaggaacaacacaauuaagucccguuaauauauguacauuccgaggugacguaacacauauagcaggaacucaaaauuacacuaugaauuuagcaucccaaaauuggaauaacuacgacccaacagaagaaauccccgcaccucucgguacaccugacuuuguuggcaaaauccaagguguacuuacacaaacaacucgaagagacggaucuacacgaggacauaaagcaacaguuucaacaggaucaguccacuuuacaccuaaauuaggaucaguccaauuuucaacagauacaucuaaugaucucgaaacaggucaaaauacaagauucacaccuguaggaguaguacaagacggguccacaacucaucaaaacgaaccacaacaauggguacuaccagacuauucaggacgcgacucacauaauguacaucuagcaccagccguagcaccaacauuuccaggcgaacaacuucuauucuuucgaucaacuaugccggguuguaguggcuauccaaacaugaaccuagauugucuauuaccacaagaauggguacaacacuucuaccaagaaucagcuccugcacaauccgauguugcauuauuacgauuuguaaacccagauacaggucguguauuauucgaauguaaauuacauaaaucuggauauguaacagucgcacacacaggacaacaugacuuagucauaccuccaaauggauauuucagauuugauuccugggucaaucaauuuuacacucuagcuccaauggguaacggagcaggccgaagacgauaa

SEQ ID NO: 33846 - RNA, 1617 nt, Artificial Sequence
  derived and/or modified sequence opt6 from VP1__Norovirus_and/or_Norovirus-like__EU366113
augaaaauggcaucuaaugacgcaaauccuuccgauggaucugcagcuaaucuaguaccagaaguaaauaacgaaguuauggcccucgaaccaguuguaggagcugccauagcugcaccaguagcaggacaacaaaauguaaucgacccuuggauuagaaauaauuuuguacaagcaccuggcggugaguuuacagucucaccacgaaaugcuccaggagaaauauuauggucugcaccucuaggacccgaucuaaauccauauuuaucucaccucgcacgaauguacaacggauaugcaggaggauucgaaguacaaguuauacuagcaggaaaugcuuuuacagccggaaaaauaauauuugcagcaguaccaccaaacuuuccaacugaaggacucucuccaucacaaguuacaauguucccacacauaauaguagacguaagacaacuagaaccaguacuaauuccacuaccagacguuagaaauaauuuuuaucacuauaaccaauccaaugacucuacaauaaaauuaaucgcaaugcuuuauacaccacuacgagcuaauaaugcaggagaagaugucuuuacuguaucuugucgaguucucacaagaccaucuccagacuuugauuuuaucuuucuaguuccaccaacaguagaaucucgaacuaaaccuuucacaguaccaauauuaaccguagaagaaaugacaaauucccguuuuccaauacccuuagaaaaacuauuuacaggaccaucaucagcuuucguaguacaaccucaaaauggaagauguacuacagacggaguccuuuuaggaacaacacaacuaucaccuguaaauauaugcacauuuagaggagacgucacucacauagcaggaucaagaaauuacacuaugaacuuagcauccuuaaauuggaacaauuaugacccuaccgaagaaauacccgcaccccuaggcaccccagauuuuguaggaaaaauacaaggaguccuaacucaaacuacuaaaggagacggauccacuagaggacacaaagcaacuguauacaccggauccgcuccauuuacacccaaauuaggaucuguacaaucauccacagauacagaaaacgauuuugaaacucaucaaaauacaaaauucacaccaguaggaguaauacaagacggcucaacuacacaccguaaugaaccacaacaauggguauuaccaucuuauucaggaagaaauguccauaacguacaucuagcaccagccguugcaccuacauuuccuggagaacaacuauuauucuucagaucuacuguaccagguugcagcggauauccuaauauggaucuagauugucuucuaccacaagaauggguucaacauuuuuaccaagaagcagcuccagcacaaagugauguugcuuuauuaagauuuguaaauccagauacuggccguguuuuauucgaaugcaaauuacauaaaucuggauacguaacagucgcucauacaggacaacaugacuuaguaauaccaccaaauggauacuucagauucgacuccugggucaaccaauuuuauaccuuagcaccaauggggaacgguacaggaagaagacgauaa

SEQ ID NO: 33847 - RNA, 1617 nt, Artificial Sequence
  derived and/or modified sequence opt6 from VP1__Norovirus_and/or_Norovirus-like__KX354097
augaaaauggcaucaagugacgcaaacccuucagaugguagugcagccaaccucguccccgaagucaacaaugaaguaauggcauuagaaccaguaguaggugcagccauagcagcaccuguugcuggacagcaaaacguaauagauccauggauuagaaacaauuuuguacaagcuccagguggcgaauuuacaguaucaccuagaaaugcaccuggagaaauauuauggucugcuccauuaggaccagauuuaaaucccuauuuaucacauuuagcacgaauguacaacggcuacgcaggaggauucgaaguacaaguaauacuagcaggaaacgcauuuacagcuggaaaaguaauauucgccgcuguacccccaaacuuuccaacagaagguuuaucaccaucacaagucacuauguucccacauauaguaguagacguaagacaacuagaaccaguauuaauaccuuuaccagauguaagaaauaacuuuuaucauuauaaucaaucuaacgaccccaccauuaaacuaauagccauguuauauacuccacuuagagcaaacaaugcaggagaugacguauuuacaguaucaugcagaguauuaacucgaccaaguccagacuuugauuuuauauucuuaguaccaccgaccguugaaucucgaacaaaaccauuuaguguaccaguccuaacaguagaagaaaugacaaacagccgauuucccaucccauuagaaaaauuauuuacagggcccucuucagcauuuguaguacaaccacaaaauggaagaugcacuacagauggagucuuacuaggaacaacacaauuaucuccagucaauauauguacuuuuagaggugacguaacccauauaacagguagucacaauuacacaaugaaccuugcaucucaaaacuggaacaacuaugacccaaccgaagaaauuccagcaccucuagguacuccagauuucguaggaaaaauccaaggcguauuaacacaaacaacuaagacagacggaucaacacgaggacauaaagcaacaguauacacaggauccgcagauuuugcccccaaauuaggaagaguacaauucgaaacagauacaaaccacgacuuugaagcaaaucaaaauacaaaauucacaccagucggaguaauacaagacggaucaacaacucauagaaaugaaccacaacaauggguacuacccaguuauuccggaagaaacacacacaacguacauuuagccccagcaguagcaccuacuuuuccaggagaacaacuacuauucuuuagauccacaaugccugguugcuccggcuauccaaauauggauuuagauuguuuacuaccacaagaguggguacaauauuuuuaccaagaagcugcaccagcccaaucagacguagcucuauuaagauucgucaauccagacacuggcagaguuuuauucgaaugcaaacuacauaaaucuggauacguuacuguugcacacacuggacaacacgauuuaguaauacccccuaacggcuauuuuagauuugauucuuggguaaaucaauuuuacacacuagcaccuauggguaauggaacaggaagaagaagauaa

SEQ ID NO: 33848 - RNA, 1617 nt, Artificial Sequence
  derived and/or modified sequence opt6 from VP1__Norovirus_and/or_Norovirus-like__AB933727
augaaaauggcaagcaaugaugcaaacccaucagauggauccgcagcaaaccuagucccugaaguaaauaacgaaguaauggcacuagaaccaguagucggagccgcaauagcugcacccgucgcaggacaacaaaacguuauagaucccuggauaagaaacaacuuuguacaagcuccuggaggugaguucacagucucaccuagaaaugcaccaggagaaauauuauggucagcaccacuagguccagauuuaaauccauaucuuucucaucuagcaagaauguauaaugguuaugcuggaggauucgaaguacaaguaauacuagcaggaaaugcauuuacagcaggaaaaauaauauuugcugcaguaccaccaaacuuuccaacugaaggacuaucaccaagccaaguaacaauguuuccccacauuauaguagacguaagacaacuagaaccaguacuaauaccauuaccagacguaagaaauaacuuuuaucauuauaaccaaaguaaugacucaacaauaaaacuaauagcaaugcucuauacuccacuucgagcaaauaaugcuggugaagacgucuuuaccguuucuugcagaguacuuacaagacccucaccagacuuugacuuuauauuuuuaguuccuccgacaguagaaucacguaccaaaccauuuacaguaccaauacucacgguagaagaaaugacaaauucuagguuuccaauacccuuagaaaaacuauucacaggaccaucaucugcauucguaguacaaccacaaaauggaagauguacaacugacggaguauuacuaggcacaacacaacuaucacccguaaauauauguacauuuagaggcgacguaacucacauagcuggaucaagaaauuacacaaugaaucuugcaucacuaaauuggaauaauuacgauccaacagaagaaguacccgcaccacuuggaacaccagacuuuguugggaaaauucaagguguacuaacacaaacuacaaaaggcgauggcuccacaagaggccauaaagcaacagucuauacugguucagcacccuuuacaccuaaauuaggcuccguacaauucucaacagauaccgaaaaugauuucgaaacacaccaaaacaccaaauucacaccaguaggaguaauacaagauggaggaacaacacauagaaaugaaccacaacaauggguacuaccaucauauucuggcagagauguaccaaacguccacuuagcaccagcaguagcaccaacauuccccggagaacaauuacuauucuuuagaucaacaaugccaggaugcucaggauaucccaauauggaucuugauuguuuauuaccacaagaauggguacaacacuucuaucaagaagccgcaccagcucaauccgaugucgcauuacuaagauuugucaacccagauacaggacgaguacuauuugaaugcaaacuacacaaaucaggauauguuacgguagcacacacaggacaacaugacuuaguaauacccccaaauggauauuuccgauuugauucauggguuaaucaauuuuacacauuagcaccaaugggaaaugguacuggaagacgaagauaa

SEQ ID NO: 33849 - RNA, 1617 nt, Artificial Sequence
  derived and/or modified sequence opt6 from VP1__Norovirus_and/or_Norovirus-like__AB933726
augaaaauggcaucaaacgaugcuaaccccucagauggaucagcagcaaaucuaguccccgaaguaaacaaugaaguaauggcauuagaaccaguaguaggagccgcaauagcagcaccagucgcaggacaacaaaaugucauugacccauggauaagaaauaacuuugugcaagcacccggaggagaauuuaccgucucaccuagaaaugcuccaggcgaaauacuauggucugcaccuuuaggcccagaccuaaauccauaucuaucucaccuagcacgaauguauaacggauacgcugguggauuugaaguccaaguaauacuagcaggaaaugcuuuuacagcaggaaaaauaauauucgcagcuguuccaccuaacuuuccaacagaaggacuauccccuucacaaguaacaauguucccccacauuauaguagacguuagacaacucgaacccgucuuaauaccauuaccagauguaagaaauaacuuuuaccauuauaaccaaucaaaugacucaacaauuaaauuaauagcaaugcuauauacuccauuaagagcuaacaacgcaggagaagaugucuucaccguuucuuguagaguacuaacaagaccaucaccugacuucgauuuuauauuccuaguuccuccuacaguagaaucacguacaaaacccuucacuguaccuauauuaaccgucgaagaaaugacaaacagucgauuucccauaccacuagaaaaacuuuucacagguccauccuccgccuuugucgugcaaccacaaaacggucgauguacaacagaugguguacuucucggaaccacacaauuaucccccguaaauauauguacauuuagaggagauguuacacacauagcaggaucuagaaacuacacuaugaaucuugcaucacuaaauuggaauaacuacgauccaacagaagaaauuccugcacccuuaggaacaccagauuuuguagguaaaauacaaggaauguuaacccaaacaacgaaaggagacggaucaacucgaggucauaaagcaacuguauacacugguagugcaccauuuacaccaaaacuaggauccguucaauucucaacugauacagaaaaugauuuugaaacucaccaaaauaccaaauucacaccaguuggaguuauucaagacggauccacaacucaccguaaugaaccacaacaauggguacuaccuucuuauucuggaagaaacgucccuaauguucauuuagccccagcaguagccccuacauuuccuggagaacaacuacuauucuuuagauccacaaugccagguugcucaggauacccaaacauggaucuagauugccucuuaccacaagaauggguccaacauuuuuaucaagaagcagccccagcacaaucagauguugcacuacuaagauucgucaauccagacacaggacguguauuauucgaaugcaaauuacauaaaaguggauacguaaccguagcucacacuggacaacacgaucucguaauaccacccaacggauauuuccgauucgauucauggguaaaucaauucuauacucuugcuccaaugggaaaugguacaggacguagacgauga

SEQ ID NO: 33850 - RNA, 1617 nt, Artificial Sequence
  derived and/or modified sequence opt6 from VP1__Norovirus_and/or_Norovirus-like__AB933720
augaaaauggcaucaucagacgcaaauccuucagauggcucagcagcuaaccuaguaccagaaguaaacaacgaaguaauggcauuagaaccaguaguuggagcugcaauagcagcaccaguugccggacaacaaaacguaauugauccauggauuagaaacaacuuuguacaagcuccaggaggagaauuuacaguuucuccucgaaacgcaccaggcgaaauacuauggucagccccacuaggaccagaccuaaacccauaucuuucucaccuagcaagaauguauaauggcuacgccggaggauuugaaguacaagucauauuagcaggaaaugcauucaccgcagguaaaauuauauucgcagcagucccuccaaauuucccaacagaaggacuaucacccucacaaguaacaauguuuccucauauaauagucgauguaagacaacucgaaccuguucuaauaccccuccccgauguaagaaacaauuuuuaucacuauaaccaauccaaugauucaacaauaaaauuaauagccauguuauacacaccacuuagagccaacaaugcaggagaagacguauuuacagucucaugucgaguucuaacucgaccaagcccugacuucgauuucauauuccuaguaccaccaaccguagaaucaagaacaaaaccauucacuguaccuauauuaaccguagaagaaaugacaaauaguagauucccaauaccacuugaaaaauuauuuaccggaccaucaagcgcauuuguuguccaaccacaaaaugguagauguacaacagacggcguauuacuagguaccacacagcuaucaccaguuaauauauguaccuuuagaggagauguaacacauauagcaggaucacgaaacuacacaaugaaucuugcaucuuuaaacuggaauaacuacgauccaacagaagaaauaccagccccacuaggcacaccagauuuuguaggaaaaguacaaggaguccucacucaaacaacaaaaggagacggaucaacacgaggucacaaagcaacaguauauacagguucagcacccuuuacacccaaacuagguucuguacaauucucuacagauacagaaaacgacuuugaaacacaucaaaauacaaaauuuacaccaguaggaguaauacaagacgggucaacaacacaccgcaacgaaccacaacaauggguacuaccauccuacucaggaagaaacguaccaaacguacauuuagcuccagcaguagcaccuacauuuccaggagaacaguuauuauucuuuagaucaacaaugccaggaugcucaggauaucccaacauggaucucgacugucuacuuccucaagaauggguacaacacuucuaucaagaagcugcuccagcacaaucagauguagcacuauuaagguucguuaacccagacacagguagaguauuauucgaauguaaauuacauaaaucuggcuauguaacaguagcacacacaggccaacacgacuuaguaaucccacccaauggauauuucagauucgauuccuggguaaaccaauuuuacacauuagcaccaaugggaaacgguacuggacgaagaagauaa

SEQ ID NO: 33851 - RNA, 1617 nt, Artificial Sequence
  derived and/or modified sequence opt6 from VP1__Norovirus_and/or_Norovirus-like__AB933691
augaaaauggccucaaaugacgcuaauccauccgauggaucugcagcuaauuuaguaccagaaguuaauaaugaaguaauggcucuagaaccaguuguaggugccgcaauagcagcaccagucgccggccaacaaaauguuauagacccauggauaaggaauaauuucguacaagcaccuggcggagaauuuaccguuagccccagaaacgccccaggcgaaauauuauggucagcaccacuaggaccagauuuaaauccauaucuaucacacuuagcccgcauguacaauggauacgcuggaggauuugaaguacaaguuauuuuagcaggcaacgcuuucacagcuggaaaaauaauauuugcugcaguaccaccaaacuuuccaaccgaaggacuuucaccaucacaaguuacaauguuuccacacauaauaguagauguaagacaauuagaaccaguccuaauucccuuaccagacguaagaaacaauuuuuaucauuauaaucaaagcaacgauucaacaauaaaauuaauagccaugcuauacacaccauuacgugcaaacaaugcuggagaagauguauucacaguuuccugucgaguucucacucguccaucaccagacuucgacuuuauauuuuuaguaccaccaacaguagaaucaagaacaaaaccauuuacagucccaauauuaacaguagaagaaaugacaaacucuagauuuccaauuccccuagaaaaauuauucacagguccgucuucagcauucguuguacaaccacaaaauggaagauguacaacagacggaguacuacuagguacaacccaauuaucaccaguaaauaucugcacauuuagaggugauguaacacauauagcuggaucacgaaauuauacaaugaaucuagcaucacuaaacuggaauaacuacgaccccacagaagaaauaccagcaccccucggcacucccgacuuuguagguaaaauacaaggaaugcuaacacaaacaacuaaaggagacggaucaaccagaggacauaaagccaccguauauacaggaucagcaccauuuacaccuaaauuaggaucaguucaauucucaacugacacagaaaaugauuuugaaacucaccaaaauaccaaauuuacaccaguaggaguuauacaagauggauccacaacacaucguaaugaaccucaacaauggguacuaccaucuuauagcggaagagauguaccuaauguucaccucgcaccagcaguugcccccacauuuccaggugaacaacuucucuucuuuagaucaacaaugccaggauguucagguuaccccaauauggaucuagauuguuuacuaccacaagaauggguucaacacuucuaucaagaagcagcuccagcucaaucagacguagcauuauuaagauucguaaauccagacaccggaagagucuuauuugaaugcaaauuacauaaaucaggauacgucacaguagcacauacaggucaacaugaucuaguaauaccuccaaauggauauuucagauucgauucauggguaaaccaauucuacacacuugcaccaaugggaaacggcacuggaagacgaagauaa

SEQ ID NO: 33852 - RNA, 1617 nt, Artificial Sequence
  derived and/or modified sequence opt6 from VP1__Norovirus_and/or_Norovirus-like__AB933682
augaaaauggcaucaaaugaugcuaacccaucagauggcucaacagcaaacuuggucccagaaguuaacaaugaaguaauggcccuagaaccaguagucggagcugccauagcagcuccuguugcaggccaacaaaauguuauagacccauggauuaggaacaauuuuguacaagcaccaggcggcgaauuuacaguaucaccaagaaaugcaccaggcgaaauacuuuggucagcaccacuaggaccagauuuaaauccauauuuaucacaucuugcacgaauguauaauggauaugcaggaggauucgaaguacaaguaauacuagcagguaacgcauuuacagcuggaaaaauaauauucgcagcggucccaccaaauuuuccaacagaaggacuaucaccaucacaaguaacaauguucccucacauuauugucgacguuagacaacuagaaccaguacuaauaccacuuccugacguaagaaauaauuucuaccauuauaaucaaucaaaugacucuaccauaaaauuaaucgcaaugcucuauacuccucuuagagcaaacaaugcaggagaagacguauuuaccguaucaugcagaguacuaacacgaccuucuccagauuuugacuucauauuucucguaccaccaacaguagaaucacgaacaaaaccauuuacuguuccaauauuaaccguugaagaaaugacuaauucucguuuuccaauaccucuugaaaaacuauucacaggaccuucaucagcauucguaguccaaccacaaaacggaagauguacaacagacggaguacuauuaggaacaacacaacuaucuccagucaauauaugcacuuuucgcggagauguuacacauauagcaggaagccacaacuauaccaugaacuuagcaucauuaaacuggaauaauuacgacccaacagaagaaauaccagcaccuuuaggcacucccgacuuuguaggaaaaauacaagguguacuaacacaaacuacaaaaggcgaugguuccacaagaggacauaaagcaacaguauauacuggaucagcacccuuuacaccaaaacucgguucaguacaauucuccacagauacagaaaaugauuuugaaacacaucaaaauacaaaauucacaccaguaggaguuauacaagacggagguacaacccaccgcaacgaaccccaacaauggguacucccaucauauucaggacgaaauguacaaaacguucacuuagcuccggcuguagcaccuacauuccccggugaacaacucuuauucuuucgaucaacaaugccaggauguucgggauaucccaauauggacuuagauugcuuacucccucaagaauggguacaacauuucuaccaagaagcagcucccgcacaaucugauguagcccuuuuaagauucguaaacccagacacaggaagaguacuuuucgaauguaaacuacauaaaagcggauaugucacugucgcacacacuggacaacacgaucuuguaauaccaccaaauggauauuucagauucgauucauggguaaaucaauuuuacacacucgcaccuaugggaaacggcacaggacguagacgcuaa

SEQ ID NO: 33853 - RNA, 1617 nt, Artificial Sequence
  derived and/or modified sequence opt6 from VP1__Norovirus_and/or_Norovirus-like__KM245069
augaaaauggcuucuagcgacgccaacccaucagacggaucaacugcaaacuuaguccccgaaguaaacaacgaaguaauggcucuagaaccuguugucggagcagcaauugccgcccccguugcaggacaacaaaauguaauagauccauggauaagaaacaacuuuguacaagcaccaggcggggaguucacaguaucuccacgaaacgccccuggagaaauucuauggucugcaccccuaggaccagaucucaauccauauuuaucacauuuagcaagaauguauaacuccuacgcggguggauucgaaguacaaguaauauuagcaggaaaugcauuuaccgcagguaaaaucauauuugcagcaguaccaccaaacuuccccacagaaggauuaucaccaucucaaguaacuauguucccacauauaauaguugacguaagacaacuagaaccaguacuuauuccacuaccugacgucagaaacaauuucuaccauuacaaccaaucaaacgaccccacaaucaaauuaauagcaaugcuguacacaccauuaagagcaaacaaugcaggagacgacguauuuacuguauccuguagaguacuaacaagacccucacccgauuucgauuuuaucuucuuggucccgccaacaguagaaucacgaacaaaaccauucucuguaccuauucuaaccgucgaagaaaugacaaauucaagauuucccauaccauuagaaaaauuauucacaggacccucaucagcauuuguaguacaaccacaaaacggaagauguaccacagacggaguacuacuaggcacaacacaauuaucaccaguaaauauuugcaccuucagaggcgacguaacacacauagcaucaacacaagaauauacaaugaacuuagccucacaaaacuggaauaauuaugacccaacagaagaaauaccagccccacuaggaaccccagauuucguugguaaaauacaagguguauuaacacaaacaacacgacgagauggauccacccguggccauaaagcuacaguauccacuggcucaguccacuucacaccaaaacuaggccgaauacaauucaguacagauacaucaaacgacuucgaaaccggacaaaauacuagauuuacacccguaggaguaguacaagacggcuccaccacacaucaaaaugaaccacaacaauggguucuucccaacuacucaggcagagauucacacaacguacaccuagcaccagcaguagcaccaucauuuccaggcgaacaacuuuuauuuuucagaucuacaaugccaggaugcucagguuacccuaacaugaaucucgauugccucuuaccacaagaauggguacaacacuucuaccaagaagcugcacccgcacaaucagauguagcauuauuaagauucguuaacccagacacaggaagaguacuauucgaaugcaaacuucacaaaucaggauauguuacaguagcacacacaggucaacaugaccucguuauaccaccuaacggauauuucagauuugacucauggguaaaucaauucuauacauuagcaccuaugggaaacggaacaggaagaagaagauaa

SEQ ID NO: 33854 - RNA, 1617 nt, Artificial Sequence
  derived and/or modified sequence opt6 from VP1__Norovirus_and/or_Norovirus-like__LC005717
augaaaauggcaucaaaugacgcaaacccaucagauggcucagcugcaaaccuaguaccagaaguaaauaaugaaguaauggcacucgaaccaguaguaggagcagcuauugcagcaccuguagcaggccaacaaaauguuauagacccauggauuaaaaauaauuuuguacaagccccaggaggagaauuuaccguauccccuagaaacgcaccgggagaaauauuauggucugcaccauuaggaccugaucuaaaccccuacuuaucacacuuagcacguauguauaacggauacgcaggaggauucgaaguucaaguaauacuagcuggcaaugcauuuacagcaggaaaaauaauauuugcugcaguuccaccaaauuuuccaacugaaggacuaucgccaucacaaguaacaauguucccucacauaauaguagacguaagacaauuagaaccuguucugauaccacuaccugacguaagaaauaauuuuuaucauuauaaucaaucuaaugauagcacuauaaaauuaauagccaugcuauacacuccacuaagagccaacaaugcuggugaagauguauuuaccguaucaugucgaguacuaaccagacccaguccagauuuugacuuuauauuccuagucccaccaacaguagagucaagaacaaaaccuuucacaguaccaaucuuaacaguagaagaaaugacaaacuccagauucccuauaccacuugaaaaauuauuuacaggaccaucaggagcauucguaguucaaccucaaaauggccgauguaccacagauggaguauuacuaggaacaacacaacuaucaccaguaaauauuuguacauucagaggagacguaacacauaucgcaggauccagaaauuauaccaugaaucuagcagcacuuaacuggaacaauuacgauccuacagaagaaauaccugcuccacuuggaacaccagacuucguaggcaaaauacaaggaguacuuacacaaacuacaaaaggagauggcucaacacgcggucacaaggcaacaguauauacaggaagcgcagauuuuacaccaaaacuuggcucaguacaauucucuacagauacugaaaaugauuucgaaacacaucaaaauacaaaauucacaccuguaggcguaauacaagauggaucaacgacacauagaaaugaaccccaacaauggguccuacccucauauuccggacgaaauguacauaacguacaccuggcucccgcaguugcaccaacauuucccggcgaacaacucuuauucuucagaucuacaaugcccgguugcagcggauauccaaacauggaucuagauugucuccucccacaagaauggguacaacauuuuuaucaagaagcagcaccagcccaaucagaugucgcccuauuacgcuucguaaauccagauacaggaagaguacuauucgaauguaaauuacauaaauccggauacguuacaguagcacacacaggacaacacgacuuaguaauaccaccaaauggauauuucagauuugauaguuggguaaaucaauuuuauacauuagcaccaauggguaauggcacuggcagaagacgauaa

SEQ ID NO: 33855 - RNA, 1617 nt, Artificial Sequence
  derived and/or modified sequence opt6 from VP1__Norovirus_and/or_Norovirus-like__LC005705
augaaaauggcuucaaacgacgcuaaucccucagauggcucugcagccaaccuaguaccagaaguaaauaaugaaguaauggcacucgaaccaguagucggugcagcaaucgcagcaccuguugcaggacaacaaaaugucauagacccauggauaagaaauaacuuuguacaagccccaggaggcgaauuuacaguuucaccucgcaaugcacccggagaaauccucuggagugcaccauuagguccugaccucaauccauauuuaucacaucuagcaagaauguauaacggauaugcaggcggauuugaaguccaaguaauauuagcaggcaacgcauuuaccgcaggcaaaauaauauucgcagcaguacccccuaauuucccaacugaagguuuaaguccuucccaaguaacaauguuuccacauauaauaguugacguacgacaacuagagccagucuuaauaccacuuccugacguaagaaauaauuucuaucauuauaaucaaucaaaugacucaacuauaaaacuaauugcaauguuauacacaccacuacgagcuaauaaugcaggagaagaugucuuuacaguuucuuguagaguccuaaccagaccuucacccgacuucgacuuuauuuucuuagucccaccaaccguagaaagucgaacaaaaccauucacagucccuauacuaacaguagaagaaaugacaaacaguagauuuccaauaccacuagaaaaacuauuuacagguccaucuggugcauucguaguacaaccucaaaauggaagaugcacaacugacgguguauuacuugguacaacacaacuaucaccagucaauauauguacauuucgaggagacgucacccacauagcuggaucaagaaacuacacaaugaaucuagcaucuuuaaacuggaacaacuacgaccccacugaagaaauccccgcacccuuagguacacccgacuucguaggcaaaauacaagguguacuuacccaaacaacuaaaggagacgguuccaccagaggacauaaagcaacaauauauacaggaagcgcuccuuuuacaccaaaauuaggaucaguacaauucucuacagacaccgaaaacgacuuugaaacucaucaaaauacaaaauucacaccaguaggugucauucaagauggaucaacaacacauagaaaugaaccacaacaaugggucuuaccaucuuauucaggaagaaacguucauaacguacauuuagcaccagcuguagcuccaacuuuuccaggugaacaacuauuauucuucagaucaacaaugccaggaugcucaggauauccaaacauggaucuagauugcuuacuaccucaagaauggguccaacauuuuuaucaagaagcagcuccugcacaaucagauguugcauuacuacguuuuguaaauccugacacaggacgcguacuauuugaaugcaaacuacacaaaucaggcuacgucacagucgcucacacaggccaacacgaucuuguaauaccaccaaaugguuacuuccguuucgauagcuggguaaaucaauucuacacucucgcaccaaugggaaauggaacaggaagaagaagauaa

SEQ ID NO: 33856 - RNA, 1617 nt, Artificial Sequence
  derived and/or modified sequence opt6 from VP1__Norovirus_and/or_Norovirus-like__KC894943
augaaaauggcuucuaacgacgccaaucccucugacggaucagcagcuaacuuaguaccagaaguaaauaaugaaguaauggcauuagaaccaguaguaggugccgcaauagcagcaccaguagccggacaacaaaacguuauagaucccuggaucagaaacaacuuuguacaagcuccaggaggagaauuuaccguaucacccagaaaugcaccuggcgaaauauuauggucagcaccccuagguccagacuuaaacccauaucucagucauuuagcuagaauguacaauggauaugcuggaggauucgaaguacaaguuauacuagcaggaaaugcauucacagcagguaaaauuauauucgcugcaguacccccaaacuuuccaaccgaaggauuaucaccaucacaaguaacaauguuuccacacauaauagucgacguuagacaauuagaaccaguacuuauuccuuuaccagauguacgaaacaauuuuuaccacuauaaucaaucgaaugacuccacaauuaaauuaauagcaauguuauauacaccguuaagagcaaacaaugccggugaagauguauuuacaguaagcugucgaguucuaacuagaccuuccccugacuuugauuucauuuuucuaguuccaccaaccguagagucuagaaccaaaccauucacaguacccauauuaacuguagaagaaaugacuaacucaagauuuccaauaccacucgaaaaauuauuuacaggaccaucaucagcuuuuguaguacaaccacaaaacggaagauguacuacagacggaguauuacuagguacaacccaauuaucaccaguaaacauauguacauuuagaggggacguaacacauauagcuggaucaagaaauuauacaaugaaucuagcuagcuuaaauuggaauaauuacgaccccacagaagaaaucccagcaccccuagguacacccgacuucguagguaaaauacaaggcguacuuacacaaacaaccaaaggagaugguaguacacgaggacauaaagcuacaguauauaccggaucagcaccauuuacaccaaaacuaggaucuguucaauuuucaacagauacugaaaacgauuuugaaacucaccaaaauacaaaguucacaccaguaggaguaauacaagacggcggaacaacacaucgaaaugaaccccaacaauggguuuuaccaaauuauucuggaucagaugucccaaacguacacuuagcaccagcaguugcaccuaauuuuccaggagaacaacuacuauuuuucagaaguaccaugccaggaugcucagguuauccuaauauggauuuagacugcuuacuaccacaagaauggguacaacauuucuaccaagaagcugccccugcacaaagcgacguagcucuacuacgauuuguaaauccagauacaggacgcguauuauuugaaugcaaacuacacaaaucuggauaugucacaguagcucauacaggacaacaugacuuaguaauaccuccaaauggauauuucagauucgacucauggguaaaucaauuuuauacuuuagcuccuaugggaaauggaacaggacgaagaagauaa

SEQ ID NO: 33857 - RNA, 1617 nt, Artificial Sequence
  derived and/or modified sequence opt6 from VP1__Norovirus_and/or_Norovirus-like__KF060023
augaaaauggcuucaucagacgccaacccaucugacggaucugcagcuaauuuaguaccagaaguaaacaaugaaguaauggccuuagaaccaguagucggcgcugcaauagcugcaccaguagcaggccaacaaaacguaauagacccuuggauacgaaauaauuuuguacaagcaccaggaggagaauuuacgguaucaccaagaaacgcaccaggugaaauauuauggucugccccauuaggaccagaccucaauccauauuuaucacauuuagcccgaauguauaauggauaugcaggaggauuugaaguucaagucauuuuagcaggcaaugccuuuacagcuggaaaaguaauauucgcugcaguaccaccaaacuucccaacagaaggacuaucuccaucacaaguaacaauguucccccauauuguagucgauguaagacaacuagaaccaguacuaauacccuuacccgauguacgaaacaauuuuuaccauuacaaccaaagcaaugacccuacaaucaaauuaauagccauguuauauacaccacuuagagccaauaaugcaggcgacgacguauucacaguaucaugucguguacuaacuagaccaucuccagauuuugacuuuauauuccuaguacccccuacaguugaaucaagaacaaaaccauucucaguaccuguuuuaaccgucgaagaaaugacaaauucaagauuuccaauaccacucgaaaaacuuuuuacuggaccaagcucugcauuuguaguccaaccccaaaacggaagauguacaacagauggaguacuacuagguaccacccaauuaucacccguuaacauauguacauucagaggagauguaacacacauuacaggaagcagaaauuacacaaugaacuuagcaucacaaaacuggucaaauuaugauccaacagaagaaauucccgcaccacuagguacaccagauuuuguuggcaaaauucaaggaguauuaacacaaacaaccagaacugacggaucaacuagaggacauaaagcaacaguauauacaggaagcgcagacuuugccccaaagcuaggaagaguccaauucgguacugauacagaucaugauuuugaagcaaaccaaaauacaaaauuuacaccugucggagucauccaagacggcucaaccacgcauagaaaugaaccacaacaauggguauuaccaucuuauuccggccgaaauacaccaaacguccacuuagcacccgcaguugcaccaacauucccaggugaacaauuauuauucuuucgaucaaccaugcccggauguucuggauaucccaauauggauuuagauugcuuauuaccacaagaauggguucaauacuuuuaucaagaagcagcucccgcacaaucagaugucgcauuacuccgauucgucaacccugacaccggaagaguccuuuuugaauguaaauuacauaaaucuggauacguuacaguugcccauacaggacaacacgacuuaguuauaccuccaaauggauauuuccgcuuugauucaugggucaaucaauuuuacacuuuagcaccaaugggaaauggcacuggaagaagacgauag

SEQ ID NO: 33858 - RNA, 1617 nt, Artificial Sequence
  derived and/or modified sequence opt6 from VP1__Norovirus_and/or_Norovirus-like__KC409310
augaaaauggcaucaaacgaugcuaauccaagcgaugguucagcagcaaacuuagucccugaaguaucaaacgaaguaauggcacuagaaccaguagucggagccgcaauagcagcccccguagcaggucaacaaaauguaauagacccauggauccgcaacaauuucguacaagcaccaggaggagaauuuacuguuuccccaagaaacgcaccaggugaaauauuauggucugcaccacuaggaccugauuuaaauccauaccucucucaucuagcaagaauguacaauggauaugcaggcgguuucgaaguacaaguaauuuuagcaggaaaugcauuuacagcaggaaaaauaauauucgcagcuguucccccaaauuuuccaacagaaggacuuucuccaucucaaguaacaauguucccacacauaauaguagacguacgacaacuagaaccuguacucauaccauuaccagauguaagaaauaauuuuuaccacuauaaucaaacaaaugauccaacuauaaaacuaauagcaauguuauacaccccauuaagagcaaacaacgcuggugaagauguauuuaccguaucaugucggguacuaacucgaccaucaccugacuuugauuuuauauuucuaguaccuccaacaguagaaucaagaacaaaaccuuuuacagucccaauauuaaccguagaagaaaugacaaacucaagauuucccaucccauuagaaaaauuguuuacuggaccauccggcgcauuuguuguccaaccacaaaauggucgaugcaccacugauggagucuuacuagguacaacucaauuaucaccuguuaauauaugcacauuuagaggcgauguaacacauauagcaggcucacgaaauuacacaaugaaucuagcaucucuuaacuggaauaauuacgaccccacugaagaaauaccagcaccucuaggaacaccagauuucguagguaaaauacaaggcguucuaacacaaacuacaaaaggagaugguaguacuagaggccauaaagcaacaguauauacaggaucugcuccuuuuacacccaaacuaggaucaguccaauuuucaacagauaccgaaaaugauuucgaaacacaccaaaauacuaaauuuacacccguagguguaauacaagacggaggaaccacccaucgaaaugaaccacaacaauggguacuaccauccuacagcggacgagacguacauaacguucaccuagcuccagccgucgcaccuacauuuccaggagaacaacuauuguucuuucgaucaacaaugccaggaugcuccggcuauccaaauauggauuuagacugcuuacuuccacaagaauggguacaacacuucuaucaagaagcagcaccagcacaaucagauguagcacucuuaagauucguaaauccugauaccggucguguauuauuugaaugcaaacuucauaaauccgguuauguaacaguagcacauacuggucaacaugaucuaguaaucccuccaaauggauacuucagauuugacucauggguuaaccaauuuuauacacuagcaccaaugggcaacggaacaggcagaagaagauaa

SEQ ID NO: 33859 - RNA, 1617 nt, Artificial Sequence
  derived and/or modified sequence opt6 from VP1__Norovirus_and/or_Norovirus-like__JX989073
augaaaauggcuuccaacgacgcuaaccccucugauggcagugccgcuaaccuaguacccgaaguuaacaaugaaguuauggcacuugaacccguaguaggugccgcaaucgccgcuccuguagcaggccaacaaaauguaauagacccuuggauuagaaauaauuuuguacaagcaccugguggagaauuuaccguaucacccagaaacgccccaggcgaaauacuuuggucugccccauuaggaccagauuuaaaucccuacuuaucucaucuagcucguauguacaauggauacgcaggaggauucgaaguacaaguaaucuuagcagguaacgcauuuacagcaggaaaaauaauauucgcagccguacccccaaacuuccccacugaaggccucucuccaucucaaguaaccauguucccacacauaauaguagacgucagacaacuagaaccaguuuuaauaccacuaccagauguacgaaacaauuucuaucauuacaaucaaucaaacgauucaacaauaaaacuaauagcaaugcuauacacaccauuaagagcaaacaacgcuggagaagauguauuuacagucaguuguagaguauuaacaagaccaucaccagacuucgacuucauauuucuagugccaccaaccguagaaucucgaacgaaaccauucacaguccccauauuaacuguagaagaaaugacaaauucuagauuuccaauaccacucgaaaaauuauucacagguccauccucagcauucguaguacaaccacaaaacggaagauguacuacagaugguguacuucuaggaacaacucaacuuuccccaguaaauauauguacauuccgaggagacguaacucauaucgccgguucaagaaauuauacaaugaaccuagcuagcuuaaauuggaacaauuaugaucccacagaagaaauaccagcaccauuagguacaccugacuucguagguaaaauacaaggaauguuaacacaaacuacaaaaggagacggaucaacaagaggucauaaagcaacaguuuauacaggaucagcaccauuuaccccaaaauuagguucaguacaauucagcacagauacagaaaacgacuucgaaacccaucaaaacacaaaauuuacaccaguuggcguaauacaagacggaucaacaacacauagaaaugaaccacaacaauggguacuaccaucauacucaggaagagacauuccaaacguacacuuagccccugcaguagcuccaacauuuccuggagaacaacuacuauucuuuagaucuaccaugcccgguuguuccggcuauccaaauauggacuuagauugucuacuuccacaagaauggguacaacauuucuaucaagaagcagcccccgcacagucagacguagcacuacuacgauuuguuaacccugacacaggacgaguacuauuugaaugcaaacuccauaaaucaggauacguaacgguugcacacacaggacaacacgaucuagucauaccaccaaauggauauuucagauucgauucauggguaaaucaauuuuacacauuagcaccaaugggaaauggaacaggccguagaagauaa

SEQ ID NO: 33860 - RNA, 1617 nt, Artificial Sequence
  derived and/or modified sequence opt6 from VP1__Norovirus_and/or_Norovirus-like__JX459902
augaaaauggccagcagugacgcaaacccaucagaugguagcacagcaaaucuaguaccagaaguaaacaacgaagucauggccuuagaaccaguaguaggugcugcaauagccgcuccaguagcuggccaacaaaauguaauagauccauggauuagaucaaacuuuguacaagccccaggaggugaauuuacaguaucaccacgcaaugccccaggagaaauacuauggucugcaccauuaggaccagauuuaaauccuuaccuaucacacuuagcacgaauguauaacggauacgcaggaggauucgaaguacaaguuauacuugcaggaaaugccuuuacagcaggaaaaauaauauuugcagcaguaccaccaucauuucccauugaaggauuaucucccucacaagucacaauguucccccacaucauaguagacgucagacaacuagaaccuguacuaauaccacuuccugacguacguaacaauuucuaucacuauaaccaauccaaugacccuaccauaaaauuaaucgcaaugcuauacacaccccuacgcgcaaacaaugcaggcgaugauguauuuacaguaucauguagaguucuaacaagaccaucacccgacuuugacuuuauauuuuuagucccaccaacaguagaaucucgaaccaaaccauuuucugucccaguuuuaacagucgaagaaaugacaaacuccagauuuccaauaccucucgaaaaacuauuuaccggcccuucauccgcauucguuguacaaccacaaaauggaagauguacaacugacggaguacuacuaggaacaacacaacuaucaccaguuaauauauguacauuuagaggaaacguuacacacauaucaggaagcagaaacuacacaaugaaucuugcaagccaaaacuggaacucuuacgauccuacagaagaaaucccugcuccacuaggaacaccagacuucguaggaaaaauacaaggaguccuaacccaaacaacaaaaacaaauggaucaacccguggacacaaagcaaccguauauacaggaucagcagauuuuucaccaaaauuaggaagaguacaauucgccacagacacagacaaugacuucgaaacaaaccaaaacaccaaauucacaccuguuggcguaauacaagauggaaguacaacacccagaaacgaaccacaacaauggguacuuccauccuauucaggacgaaauacacauaauguacauuuagccccugcaguagcaccaacauucccaggagaacaauuauuauucuuucgcucuacaaugccaggauguucaggauacccuaacauggaucuagauugcuuacuaccacaagaauggguucaauauuucuaucaagaagcagccccagcacaaucagacguagcuuuacucagauuugucaaccccgacaccggaagaguacucuuugaauguaaauuacauaaaucagguuauguaacaguagcgcacacuggucaacacgaucuaguaauaccuccaaaugguuauuuucgguucgacucaugggucaaucaauucuauacacuggccccaaugggaaacggcacaggcagacgaagauaa

SEQ ID NO: 33861 - RNA, 1617 nt, Artificial Sequence
  derived and/or modified sequence opt6 from VP1__Norovirus_and/or_Norovirus-like__JX459644
augaaaauggcaaguaaugacgcaaacccaagugauggaucagccgcaaauuuagucccagaaguaaacaaugaaguaauggcauuagaaccugucguaggugcagcaaucgcagcaccaguagcaggacaacaaaacguaauagauccauggauaagaaacaacuuuguacaagcaccuggaggagaauuuacaguuaguccucgaaaugcacccggcgaaauacuauggagugccccauuaggacccgaucuuaauccuuaccuaucacacuuagccagaauguauaaugguuaugcaggaggauucgaaguucaaguaauauuagcaggaaacgcauuuacagccgguaaaauaauauucgccgcaguaccaccaaacuuuccuacagaaggauuauccccuucccaaguaacgauguucccacauauaauaguagacguacgacaauuagaaccaguauuaauaccacuaccagauguaagaaauaauuucuaccauuauaaccaaucaaacgauucgacaauaaaacuuauagcuauguuauacacaccauuaagagcuaacaaugcaggagaagauguauuuacaguaucaugccgugucuuaacaagacccucaccagauuuugacuuuauauuucuaguuccacccacaguagaaucaagaacaaaaccauucacaguuccaauuuuaacaguagaagaaaugacuaacucuagauuuccaauaccacuagaaaaauuauuuacaggacccucaggagccuuuguaguacaaccucaaaacggaagauguacaaccgacggaguauuauuagguaccacacaacuaucaccaguaaauauauguaccuucagaggagauguaacacauauagcaggaucuagaaacuauacaaugaaucuagcagccuuaaacuggaacaacuaugauccaacagaagaaauuccagcaccucuagguacaccagacuuugucggaaaaauucaaggaguacuaacacaaacaacaaaaggugacgguucaacucgaggucacaaggcaacaguauauacaggaucagcagauuucacaccuaaauuaggaucaguacaauuuaguacagauacagaaaacgauuucgagacgcaucaaaauacaaaauucacaccaguuggaguuauacaagacggcucuacaacacauagaaaugaaccucaacaauggguacuuccaucuuauucagguagaaacguucacaauguacaccuagcaccagcuguggcacccacauuucccggugaacaacuacuguucuuucgaucuacuaugccaggauguucuggauauccaaauaugaauuuagacugcuuaauaccucaagaauggguucaacauuuuuaccaagaagcagcaccagcacaaucagacguagcacugcuucgcuuuguuaauccagacacaggacgagucuuauuugaaugcaaacuccacaaauccggauacguaacuguagcacacacaggacaacacgaucuaguaauucccccaaaugguuauuucagauuugauucauggguaaaucaauucuacacacucgcaccuaugggaaauggugcaggacgacgacguuaa

SEQ ID NO: 33862 - RNA, 1617 nt, Artificial Sequence
  derived and/or modified sequence opt6 from VP1__Norovirus_and/or_Norovirus-like__JX459610
augaaaauggcaucuaacgacgcucacccaucagauggauccgcagcaaacuuagucccagaagucaacaaugaaguaauggcucuagaaccaguaguaggagcagcuauagcagcaccaguagcuggacaacaaaacgucauagacccauggauacgaaauaacuucguacaagcacccggaggagaauuuacagucucaccucguaacgcaccaggugaaauacuaugguccgcaccucuaggaccagaccuaaauccuuaucuaucacauuuagcccgaauguauaaugguuaugcaggaggauucgaaguacaaguaauauuagcaggcaacgcauucacagcagguaagauaauauucgccgcaguaccaccaaacuuuccaacugaaggacuuucaccaucucaaguaacaauguucccucauauuauaguugacguacgucaacuagaaccaguauuaauaccauuaccagauguccgcaacaacuucuaucauuauaaucaaucuaacgacucaacaauaaaacuaauagcuauguuauacacaccuuuaagggccaauaaugcaggagaagacguuuuuacagucucuuguagaguccuaacuagaccaucaccagauuucgacuucauuuuucuaguucccccaacaguugaaucuagaacaaaaccuuucacugucccaauacucacaguggaagaaaugacaaacucccgcuuucccauuccauuagaaaaacuauucacugguccaucuggagcuuucguuguacaaccucaaaauggaagaugcaccacagaugguguauuacuaggcaccacccaacuaucaccuguaaauauauguacauuuagaggugauguaacccauauagcaggauccagaaauuauacaaugaaucuagcuuccuuaaauuggacaaauuacgacccaacugaagaaauaccagcaccauuaggaacaccagauuuuguaggaaaaauacaaggaguauuaacacaaaccacaaaaggagacgguagcacccgcggacacaaagccacuguauauacuggaucagcaccauuuacacccaaauuaggcucuguccaauuuucuacagauaccgaaaacgauuuugaaacacaucaaaacacaaaauucacaccaguaggaguaauccaagacgguggaaccacccauagaaaugaaccucaacaauggguacucccauccuauucaggaagaaauguacauaacguccacuuagccccagcugucgccccaacauuucccggagaacaacuacuuuucuuuagaucaacaaugccaggaugcaguggauauccuaauauggacuuagacugcuuacuaccucaagaauggguccaacauuucuaccaagaagcagcuccagcacaaucagacguagcauuauuacguuuuguaaacccagacacaggcagaguacuauucgaaugcaaauuacacaaaagcggauauguaacuguagcccacacuggacaacaugaucucguaauaccaccaaauggcuacuucagauucgauucuuggguaaaucaauuuuauacccucgcaccaaugggaaauggaacaggucgcagaagauaa

SEQ ID NO: 33863 - RNA, 1617 nt, Artificial Sequence
  derived and/or modified sequence opt6 from VP1__Norovirus_and/or_Norovirus-like__JX459606
augaaaauggcuuccaaugacgcaaauccaucagauggaucagccgcuaaucuaguacccgaaguaaacaaugaaguaauggcauuagaacccguagucggcgcagcaauagcagcaccuguagcaggacaacaaaauguaauagauccguggauuagaaauaacuuuguacaagcaccagggggugaauuuacagucucaccacguaaugcaccaggugaaaucuuauggagagcaccucuaggacccgauuuaaauccauauuuaucacacuuagcuagaauguauaauggauaugcaggagguuuugaaguacaaguuauauuagcaggaaaugcuuuuacagcaggcaaaauaauauuugcagcaguaccacccaauuuucccaccgaaggacucucaccaucacaaguaacuauguucccacacauaauaguugacgucagacaacuagaaccgguacuaauaccacucccagauguacgaaacaacuucuaucacuacaaccaaucaaaugacagcaccauaaaauuaauagccauguuauauacaccauuaagagcaaacaaugccggugaagauguauucacuguaucaugucgaguccucacaagaccuuccccugauuuugauuuuauauuuuuaguaccaccaacaguagaaucucgcacuaaaccauucacagucccaauacuuaccguugaagaaaugacaaauucuagauucccuauaccacuagaaaaacuauuuacaggaccaucuagugcauuuguaguacaaccacaaaauggucgaugcacaacagacggaguacuucuagguaccacccaacuauccccagugaauauauguaccuucagaggcgaugucacacauauugcaggaucaagaaauuacacaaugaauuuagccucucuaaauuggaacaauuaugauccaacagaagaagucccagcaccccuaggaacuccugauuucguaggaaaaauccaaggaguauuaacucaaaccacaaaaggagacggaucaacaagaggacacaaagcaacuguauauacuggaucagccccuuucacaccuaaacuaggauccguucaauucuccacagacaccgaaaacgauuucgaaacacaccaaaauacaaaauuuacuccaguaggagucauacaagauggcucaacuacacauagaaaugaaccucaacaauggguacuaccuucauauucaggacgaaauguucacaacguucaccuugcucccgcaguugcaccuaccuuuccaggugaacaacuacuauuuuucagaucuacgaugccaggaugcucaggauauccaaacauggacuuagauugcuuauuaccucaagaauggguacaacacuuuuaucaagaagcggcaccagcccaaucagacguagcauuacuaagauuuguaaacccugauacaggaagaguacuauuugaauguaaacuacauaaaucaggauacguaacagucgcccacacaggacaacaugaucuagucauuccaccaaacggcuauuuccgauucgacuccuggguaaaucaauuuuacacuuuagcaccaaugggaaauggaacaggaagaagaagauaa

SEQ ID NO: 33864 - RNA, 1617 nt, Artificial Sequence
  derived and/or modified sequence opt6 from VP1__Norovirus_and/or_Norovirus-like__JX445159
augaaaauggcaucaaaugacgcuaacccuucugauggcucugcagcuaaccucguaccagaaguuaacaaugaaguuauggcauuagaaccuguaguaggugcagcuauagcagcacccguagcuggacaacaaaauguaauagacccauggauaagaaauaacuuuguacaagcuccagguggagaauuuacaguuucaccuagaaaugcaccaggcgaaauucuauggucugcaccauuaggaccagaucuaaaucccuaucuuucacacuuagcaagaauguauaauggguaugcaggaggauucgaaguacaaguaauacuagcuggcaacgcauuuacugcagguaaaauaauauucgcagcaguuccaccuaauuuuccuacugaaggucuaucacccucucaaguaacuauguuuccacauauaauuguugacguucgacaacuugaaccaguauuaauuccacuaccagauguaagaaauaauuuuuaucacuauaaucaaucaaaugacucuacaauaaaauuaauagccaugcuauauacaccacuuagagcaaauaacgcaggagaagauguauucaccguaucauguagaguacuaacuagaccaucaccugacuuugacuuuaucuuccuuguaccuccaacaguugaaucaagaacaaaaccauucacaguuccaauauuaacaguagaagaaaugacuaauucuagguuccccauaccacuugaaaaacucuuuacuggacccucaucugcuuuugucguacaaccacaaaacgguagauguacaacugauggaguacuacuuggaaccacacaacuuucccccguaaacaucuguaccuuccgaggcgacguaacacauauagcagguucuagaaauuacaccaugaaucucgcaucacuuaauuggaacaauuaugaucccaccgaagaaauaccagcaccacuaggcaccccagacuucgucggaaaaauccaaggaguacuuacacaaaccacagaaggagacggaucaacaagaggacacaaagcaacagucuauacaggcucagcacccuucacaccaaaauuagguucaguacaauucuccacggauacugaaaacgauuucgaaacacaucaaaacacaaaauuuacacccguuggaguaauccaagacgguucaacuacacaucgaaacgaaccacaacaauggguccuucccucauauucaggacgaaacguucauaacguacaccuugccccagcaguagcaccaacauucccaggagaacaacuacuauucuuuagaucaacaaugccuggaugcucaggauauccaaacauggaccucgacuguuuacuaccacaagaauggguacaacauuuuuaucaagaagcagcaccagcacaaucagauguagcuuuacuuagauucguuaacccagauacaggaagaguacucuucgaauguaaacuacauaaaucugguuauguaacugucgcacacacuggacaacaugaucucguaauaccaccaaacgguuacuuccgauucgacucauggguuaaucaauuuuauacucuagcuccaaugggaaaugguacuggacgaagaagauaa

SEQ ID NO: 33865 - RNA, 1617 nt, Artificial Sequence
  derived and/or modified sequence opt6 from VP1__Norovirus_and/or_Norovirus-like__JN400606
augaaaauggcaucuaacgacgcaaauccaucagacggaucagcagcaaacuuaguaccagaaguuaauaaugaaguaauggcucuagaaccaguaguaggcgccgccauagccgcaccaguugcuggacaacaaaauguaauagacccauggauaagaaauaauuucguacaagccccaggaggagaauuuacagucuccccacgcaaugcaccgggagaaauacuauggucugcaccucuaggaccggacuuaaauccauacuuaucccacuuagccagaauguauaacgguuaugcuggagguuucgaaguacaaguuauauuagcuggcaaugcauuuacugcaggcaaaauaauauuugcagccguaccaccaaauuuuccaacagaaggucuaucaccuucucaaguaacaauguuuccccacauaauaguagauguccgacaauuagaaccaguccuaauaccacugccagacguaagaaauaacuucuaucacuauaaucaaucaaaugauucuacaaucaaauuaauagcaaugcuauauacccccuuaagagcaaacaacgcaggagaagacguuuuuaccguuucaugcagaguccuuaccagaccauccccagauuuugacuuuauauuucuaguucccccuacuguagaaucaagaacaaaaccuuucacuguaccaauacuaaccguagaagaaaugacaaauucaagauuucccaucccacuagaaaaacuauuuacuggaccaucaucagcauuuguuguacaaccacaaaacggaagauguacaacagauggaguacuacuaggcacaacucaacucucaccaguaaauauaugcacauucaggggcgaugugacacauauagccgguucacgcaauuauaccaugaacuuagcaucauuaaacuggaacaauuacgaccccacagaagaaauaccugcaccuuuaggaacaccggacuuuguaggaaaaauacaaggagucuuaacacaaacaacaaaaggagaugguagcacaagaggucacaaagcaacaguuuacaccggcggagcacccuuuacuccaaaauuaggaucaguacaauuuucaacagauacagaaaaugauuucgaaacgcaucaaaauacaaaauucacaccaguaggaguaauacaagacggaucaacuacacauagaaaugaaccccaacaauggguccuaccgucauauucaggucgaaauguacauaacguacauuuagccccagcaguagcuccaaccuucccuggagaacaauuacuauucuuucgcucuacuaugccaggaugcucagguuacccaaauauggauuuagauuguuuauuaccacaagaauggguacaacauuuuuaccaagaagccgcaccagcucaaucugacguugccuuacuaagauuuguaaauccugacaccggccgcgucuuauuugaauguaaauuacauaaaucaggauauguaaccguagcacacaccggacaacacgauuuaguuaucccaccaaauggauacuuuagauucgauucauggguaaaccaauuuuacacauuagcaccuauggguaauggaacaggaagacgaagauaa

SEQ ID NO: 33866 - RNA, 1617 nt, Artificial Sequence
  derived and/or modified sequence opt6 from VP1__Norovirus_and/or_Norovirus-like__JQ613562
augaaaauggccucaaacgacgcaaacccaucagacggaucagcagcaaaucuuguuccagaaguaaacaacgaagucauggccuuagaacccguuguaggugcggcaauagcugccccuguugcaggacaacaaaaugucaucgacccuuggauaagaaauaacuucguacaagcaccaggaggagaauuuacaguuucaccacgaaaugcaccaggagaaauacuauggucagcaccacuuggaccagaucuaaauccauauuuaucucaccuagcacgaauguauaauggcuaugcaggaggauucgaaguucaagucauccuagcaggaaaugcauuuacagcaggaaaaauaauauucgcagcaguuccaccaaacuucccaacagaaggacuaucacccagccaaguaacaauguucccacacauaauaguagacguccgacagcucgaaccaguacuuauuccacuaccagacguuagaaacaacuucuaucacuauaaccaauccaaugauucaaccauaaaauuaauagcaaugcuauauacaccacuuagagcuaauaaugcaggcgacgauguauuuacagucuccuguagaguauuaacaagaccuucaccugauuuugacuuuauauuccucgucccaccuacugucgaaucaagaacuaaaucuuuuacuguuccuaucuuaacuguagaagaaaugacaaacucuagauuucccauaccacuagaaaaacucuucacuggaccaucaucagcauucguuguccaaccacaaaauggaagauguacaacagacgguguucuauuaggaacaacucaacuaucacccgucaauauauguacguucagaggagacguaacucauaucgcugguucuagaaacuacacaaugaaucuagccucacuaaacuggaacaauuacgacccuaccgaagaaaucccagcaccucuaggaacaccagacuucguagguaaaauccaaggcgucuuaacucaaacaacaaaaggagaugguucaacacguggccauaaagcaacugucuacaccgguagugcagacuuuacaccaaaacuagguucaguucaauucggaacagauacagauaaugacuuugaaacacaccaaaauaccaaauucacaccaguaggaguaauucaagacggcucaacaacacaucgaaacgaaccacaacaauggguucucccauccuacucagguagaaauguucauaauguacacuuagcaccagccguagcaccaaacuuuccaggagaacaauuacuauucuucagaucaacaaugccuggaugcucaggcuauccuaauauggacuuagauugcuuauuaccacaagaauggguccaacacuucuaucaagaagccgcuccugcucaaucagacguagcauuauuaagauucguaaacccagauacaggaaggguauuauucgaauguaaauuacauaaaucaggauauguaaccguagcucauacuggacaacaugaccuuguaaucccaccaaaugguuauuuccgcuucgauuccuggguaaaccaauuuuacacauuagcacccaugggaaauggugccggacgaaaaagauaa

SEQ ID NO: 33867 - RNA, 1617 nt, Artificial Sequence
  derived and/or modified sequence opt6 from VP1__Norovirus_and/or_Norovirus-like__HQ456343
augaaaauggccucaaaugacgcaaacccaucugacggaucagcagcuaaccuagucccugaaguaaacaacgaaguaauggcucuugaacccguagucggagcagcuauagcagccccuguugcaggacaacaaaacguaauagauccauggauaagaaauaacuuuguccaagcuccaggcggugaguuuacuguuaguccaagaaaugcaccaggagaaauacuuuggucagccccacuaggacccgaccuaaauccuuaccuaucucaccuagcaaggauguauaacggauaugccggugguuucgaaguacaaguaauuuuagcaggaaaugcauuuacagcaggaaaaauuauuuucgcagcaguaccaccuaacuuuccuacagaaggacuaucaccuucccaaguaacaauguucccacacauuauaguagacguaagacaacucgaaccaguacuaauaccacuaccagaugucagaaacaacuucuaucacuacaaucaauccaaugacuccacuauaaaacucauagcuaugcuauauacaccacuuagagcaaauaacgcaggagacgacgucuucacaguaucuuguagaguucuaacaagaccaucaccagacuuugacuuuaucuuucuaguacccccaacuguagaauccagaacuaaaccauucacuguaccaauacuaacuguagaagaaaugacaaauuccagauuuccaauaccacuagaaaaacuauuuacagggccaucaucagcuuuuguaguccaaccccaaaauggaagaugcacaacagacggaguacuuuuaggaaccacacaacuaucaccaguaaacaucuguacauucagaggagacguaacccauauagcaggaaguagaaauuacacaaugaacuuagcaucauuaaacuggaacaauuacgauccaacagaagaaauaccagcaccucuagguacaccugauuuugucggaaaaauacaagguguucuuacccaaacaacaaaaggagacgguucaacucgaggacacaaagcaacaguauauacagguucagcagauuuuacaccuaaacuagguuccguacaauucgcaacagacacagaaaacgauuuugagacccaucaaaauacuaaauuuacacccguaggaguuauacaagaugguuccacaacucauagaaacgaaccucaacaauggguacccccauccuauuccggccguaauguacauaacguucacuuagccccagcaguugcaccaaacuucccaggagaacaauuacuauucuuuagaucaaccaugccaggauguagcgguuauccaaacauggaucuagauuguuuauuaccacaagaauggguacaacauuucuaucaagaagcagcucccgcucaaucagacguugcauuacuacguuuuguaaauccagacacaggaagaguuuuauuugaaugcaaacuccacaaaucaggauauguaacagucgcacacacaggacaacacgaucuaguaauacccccaaauggauacuucagauuugacucauggguuaaucaauuuuauacauuagcaccaaugggcaauggaaccggaagaagaagauaa

SEQ ID NO: 33868 - RNA, 1617 nt, Artificial Sequence
  derived and/or modified sequence opt6 from VP1__Norovirus_and/or_Norovirus-like__HQ456342
augaaaauggcaucaucagaugcuaauccuucagauggcuccacagcaaauuuaguaccagaaguaaacaaugaaguaauggcauuagaaccaguaguaggagccgcaauagcagcaccaguagcaggacaacaaaauguaauagaucccuggauaagaaauaauuuuguacaagcuccaggaggcgaauuuaccguaucaccacguaacgcaccaggagaaauauuauggucagcaccuuuaggaccagaucuaaaucccuaucucucccauuuagcaagaauguacaacggauacgcaggaggauucgaaguacaaguuauuuuagccggaaaugcauucacagcaggaaaaauaauauuugcagccgucccaccaaacuucccaacagaaggacuaucaccaagccaaguuacaauguucccacauauaaucguagauguuagacaacuagaaccaguucuaaucccacuacccgacguacgaaauaauuuuuaucauuauaaucaaucaaaugacccuacaaucaaacuaauagcuaugcuauauacaccacuaagagcaaauaacgcaggagacgacguauuuacuguuuccugcagaguauuaacacgaccaucaccagacuucgacuuuauauuucuaguaccaccaacagucgaauccagaacaaaaccauucucuguaccaauuuuaacaguagaagaaaugacuaacucacgcuuuccaaucccucucgaaaaauuauuuacaggcccaucuagcgcauuugucguacaaccccaaaacggaagauguacaacagacggaguacuacuagguacaacacaacuuuccccuguaaacauauguacauuuagaggagacguaacacacauaacugguaguagaaacuacacaaugaaucuugcuacacaaaauuggaacucauacgauccaaccgaagaaauaccugccccucucggcacaccagauuucguagguaaaauacaagguguuuuaacccaaacaacucgagcagacggaucaacaagaggccauaaagccaccgucuacacagguucagcagauuuugcaccaaaacuaggaagaguacaauuugcaaccgauaccgauaaugacuuugacgcaaaucaaaauacuaaauucacaccaguagguguaauacaagacggaggaacugcacauagaaacgaaccucaacaauggguucuaccauccuauagugguagaaauucacacaacguacauuuagcccccgccguagccccaacauuuccaggagaacaacuacuauucuucagaaguaccaugccuggaugcucuggauacccuaauauggacuuagauugccuuuuaccacaagaauggguacaauauuucuaucaagaagccgcuccugcacaaucagacguagcccuccuacgauuuguaaacccagacacaggccgaguauuauucgaauguaaacuacauaaaucaggauacguaacaguagcacauacuggucaacacgauuuaguaauaccaccuaacggauauuucagauucgauuccuggguaaaucaauucuauacccuagcucccauggguaacggaacaggacgaagaagauaa

SEQ ID NO: 33869 - RNA, 1617 nt, Artificial Sequence
  derived and/or modified sequence opt6 from VP1__Norovirus_and/or_Norovirus-like__HQ456340
augaaaauggcuaguaaugaugcaaguccauccgacggcucagcugcaaaccuuguaccagaaguuaacaaugaagucauggcacucgaaccaguuguaggagcagcaauagcagcaccaguagcaggucaacaaaauguaauagacccuuggauccguaacaauuucguacaagcacccggaggugaauuuacaguuaguccaagaaacgcaccaggagaaauacuauggucugcaccucuaggaccugauuuaaauccauauuuaagucacuuagcacgaauguauaacggauacgcaggaggauucgaaguucaaguaauacuagcaggcaacgcauucacagcaggcaaaauaauauucgcugcaguaccaccaaacuuuccaacagaaggccucucaaguucacaaguaacaauguucccacacauaaucguugacguucgucaauuagaaccaguacuaauaccuuuacccgacgucagaaacaauuucuaccacuauaaucaauccucagauucuacaauaaaauuaauagcaaugcuauacacaccauuaagagcaaauaaugcaggcgaagacguuuuuacaguuucauguagaguacuaacuagaccaucuccagauuuugauuuuauauuucucguaccuccuacugucgaaucaagaaccaaaccuuucacgguuccaaucuuaacaguugaagaaaugacaaacucuagauuuccuauaccuuuagaaaaacuauucacagguccaucaggagcauuuguaguacaaccacaaaacggucgaugcaccacagacggcguauuacuagguacuacccaauuaagucccgucaacauaugcacuuuuagaggcgacguaacacauauagcuggauccagaaacuacacuaugaaucuagcagcacuaaacuggaauaauuacgacccaacugaagaaauaccagcaccacuaggaacacccgacuuuguaggaaaaauacaagguguauuaacacaaaccaccaaagcugacggaucaacaaggggacacaaagcaacaguauauacaggcucagcagauuuuacaccaaaauuagguucgguacaauucucaacagauacagaaaacgauuuugaaacacaccaaaacacuaaauucaccccaguaggaguaauccaagauggaucaacaacacauagaaaugaaccccaacaauggguuuuaccaucauauucuggacgcaauguacacaacguacaucuagccccagcaguagcaccaacauuucccggcgaacaauuacucuucuuuagaucuacuaugcccggaugcucuggauauccaaauauggaucuagacugccuauuaccacaggaauggguucaacauuucuaucaagaagcagcaccagcccaauccgacguagcacuucuaagauucguaaauccagauacaggacgaguacuauucgaaugcaaauuacacaaaaguggauauguaacaguagcucauacaggucaacacgaccuaguuauaccuccaaaugguuauuuuagauucgauucauggguuaaucaauucuacaccuuagcuccaaugggaaauggaacaggacgaaggcgauaa

SEQ ID NO: 33870 - RNA, 1617 nt, Artificial Sequence
  derived and/or modified sequence opt6 from VP1__Norovirus_and/or_Norovirus-like__HQ456326
augaaaauggcaucaaaugacgcaaacccauccgacggcucagcagcaaauuuaguaccagaaguaaacaaugaagucauggcacuagaaccaguaguuggugcagcaauagcagcaccagucgcaggucaacaaaaugucauagacccauggauaagaaauaacuuuguacaagcaccaggaggagaauuuacaguaucaccccguaaugcuccaggugaaauacuauggucagcaccacuaggaccagaucuaaauccauacuuaagccacuuagcaagaauguauaacggauaugccggcggauuugaaguccaaguaauucuugccggaaaugccuuuacagcaggcaaaauaauauuugcugcaguuccaccgaacuucccaacagaaggacuaucuccaagucaaguaacaauguucccacacauaguaguagacguacgucaauuagaaccaguacuaauaccuuuaccagaugucagaaacaauuucuaucacuauaaccaaagcaaugauucuaccauaaaacuaauagcaaugcuauacaccccauuacgagcuaacaacgcuggugaagacguauuuacugucucauguagaguacuaacuagaccaaguccagauuuugacuuuaucuuccuaguuccuccaacaguagaaucacggacaaaaccuuuuacaguuccaauauuaaccguagaagaaaugacuaacuccagauuucccauaccuuuagaaaaacuauuuacaggaccaucuggugcauucguaguacaaccucaaaacggucgauguaccacagauggaguauuacuaggaacaacacaauuaucaccaguaaauauauguacauuuagaggagacguaacacacauagcaggaucaagaaauuacaccaugaauuuagcaucccuuaacuggaacaauuacgacccaacugaagaaauacccgcaccauuagguacaccagacuuuguaggcaaaauacaaggaguacuaacacaaacaacuaaaggugacggaucaacaagaggucauaaagcaacuguauauacaggcucugcaccauuuacaccaaaacuaggauccguacaauuuaguacagauacagaaaaugacuucgaaacucaucaaaauacaaaauuuacaccaguaggaguaauacaagacgguagcacuacacauagaaacgaaccacaacaauggguacuaccuuccuacagcggaagaaacguacauaacguacaccuagcaccagcaguugcaccaacguuuccuggcgaacaacuacuuuucuuuagauccacaaugcccggaugcuccggauauccuaauauggauuuagauugcuuacuaccacaagaauggguacaacauuuuuaucaagaagcagcaccagcacaaucugaugucgcacuacuaagauuuguaaacccagacacuggacgaguacuauucgaaugcaaauuacauaaaucaggauacgugacaguagcacacacaggacaacacgaucuagucaucccacccaaugguuauuucagauucgacucauggguaaaucaauucuacacacuagcacccaugggaaauggaaccggaagaagaagauaa

SEQ ID NO: 33871 - RNA, 1617 nt, Artificial Sequence
  derived and/or modified sequence opt6 from VP1__Norovirus_and/or_Norovirus-like__HM802527
augaaaauggcaucaaaugacgcuaauccaucagauggaucagcagcuaauuuaguaccagaaguuaacaaugaagucauggcucuagaaccaguuguuggagcagcaauagccgcaccaguugcaggccaacaaaauguuauagacccauggauacguaauaauuucguacaagcaccaggcggugaauuuacuguaucacccagaaacgcacccggcgaaaucuuaugguccgcaccauuaggaccugaccuaaauccauaccuaucacaucuagcacgaauguauaacgguuacgcaggcggcuucgaaguacaaguaauauuagcugguaaugcauucacagcuggaaaaauaaucuucgcagcaguaccaccaaacuuucccacagaaggauuaucuccaucacaaguaacaauguuuccacacauuauaguagauguucgccaauuagaaccaguauuaaucccauuaccugacguacgaaauaauuucuaucauuauaaccaaucaaaugauucaaccauuaaacuuaucgcuaugcuauauacaccacuacgugcaaauaaugcaggagaagauguuuuuacuguuucauguagaguacuaacucgacccucaccugacuucgacuucauauuccuugucccaccaaccguagaaucccgaacaaaaccuuucacaguuccaauauuaacuguagaggaaaugacaaacucuagauucccaauacccuuagaaaaauuauucacaggcccaucaggagcauuuguaguacaaccccaaaaugguagauguacaacagacgguguacuacuaggaacaacucaauuaucuccaguaaacauauguacauuuagaggugauguaacccacauaucagguaguagaaacuacacaaugaauuuagcaucauuaaauuggaacaauuaugauccuacagaagaaauuccugcaccacuugguaccccagauuucguagguaaaauacaagguguuuuaacacaaacaacuaaaggagacggaucuacaagaggacacaaagcaacaguuuauacaggaucugcaccauuuacacccaaacuaggaucaguacaauuuucuaccgauacagaaaacgauuucgaaacccaccaaaauacaaaauuuacacccguaggaguaacacaagaugggucaacaacccauagaaaugaaccacaacaauggguacuaccaucauauucuggaagaaauguacauaacguucacuuagcacccgcaguugcaccaacauuuccaggugaacaauuacuuuucuuucgauccacuaugcccggauguucaggauauccgaacauggacuuagauuguuuauuaccacaagaauggguacaacacuuuuaucaagaagcagcaccagcacaaucagacgucgcacuuuuacgauuuguaaaucccgacacaggaagaguuuuauuugaaugcaaauuacauaagagcgguuauguaacagucgcucacacuggacaacacgauuuaguuauaccaccaaacggauauuuccgcuucgauucuugggucaaucaauuuuauaccuuagcaccuaugggcaacggaacaggcagaagaagauaa

SEQ ID NO: 33872 - RNA, 1617 nt, Artificial Sequence
  derived and/or modified sequence opt6 from VP1__Norovirus_and/or_Norovirus-like__GQ856448
augaaaauggcuagcaacgacgccaauccauccgaugguucagcagcaaacuuaguacccgaaguaaauaaugaaguuauggcauuagaaccaguaguaggugcugccaucgcagcaccaguagcuggacaacaaaacguaauagaccccuggauaagaaacaacuucguccaagcaccuggaggagaauuuacuguaucaccacgaaacgcaccaggugaaauacuauggucagcaccacuagguccagauuuaaauccauauuuaucacacuuagcaagaauguauaauggauacgcuggagguuucgaaguacaagucauacuugcagguaaugccuuuacagcagguaaaauaauauuugcagccguaccaccaaauuuccccacagaaggacuauccccaucucaagucacaauguucccacauauaaucgucgauguaagacaauuagaaccaguacuaauuccacuuccagauguaagaaauaauuuuuaucacuacaaccaaagcaaugauucaaccaucaagcuaauagcaaugcuuuauacuccucuaagagccaacaaugcaggagaagacgucuuuacagucucaugucgaguacuaacuagaccaucaccagacuuugauuuuauauuucuaguaccaccaacaguugaaucuagaaccaaaccauuuacugugccuauauuaacaguagaagaaaugacaaauagccgcuucccaaucccacuagaaaaacuauuuaccggaccaaguggcgcauucguaguacaaccacaaaacggaagaugcaccacagaugguguauuauuaggaacuacacaacuauccccagucaauauauguaccuuucgaggagauguaacacauaucgcugguucacgcaauuauacaaugaauuuagcuucauuaaacuggaacaacuacgauccaacugaagaaauaccagccccauuaggaacaccagacuucguagguaaaauacaaggcguacuaacccaaacaaccaaaggcgaugguucaacaagaggacauaaagcaacaguauacacaggcucugcacccuuuacaccaaaauuaggaucuguacaauuuucaaccgacacugaaaacgauuucgaaacccaucaaaacacaaaauuuacaccaguaggcguaauucaagacggaucuacaacacacagaaacgaaccucaacaauggguacuaccaucauauucaggaagagauguccauaacguacacuuagcaccagcaguagcacccacauucccaggagaacaauugcuauucuuucgaagcacaaugccaggaugcucugguuauccaaauauggaccuugauugcuuacuaccacaagaauggguccaacacuuuuaccaagaagcagcaccagcacaauccgacguagcuuuauuaagauuuguaaacccagacaccggaagaguauuauuugaauguaaacugcauaaauccggauauguaaccguagcacacacaggucaacacgaccuaguaaucccucccaacggauacuucagguucgacucauggguaaaucaauucuauaccuuagcaccaaugggcaacggaacugguagaagacgauaa

SEQ ID NO: 33873 - RNA, 1617 nt, Artificial Sequence
  derived and/or modified sequence opt6 from VP1__Norovirus_and/or_Norovirus-like__AB541347
augaaaauggcaucaaaugaugccaacccuucagacggaucagcagcaaaucucgucccagaaguaaacaaugaaguuauggcauuagaaccuguaguaggagcagcaauagcagcacccguagcuggacaacaaaauguuauugacccauggauaagaaacaacuuuguacaggcaccaggaggagaauuuacaguauccccuaggaaugcaccuggagaaauauugugguccgccccauuaggacccgaucuaaauccauaucuaucacaccuagccagaauguauaauggauaugcuggagguuuugaaguacaaguaauacuagccggaaacgcauucacagcagguaaaauaauauucgcugcugucccaccuaauuuuccaacagaaggucuuucaccuucccaaguaacaauguuuccucauauaauaguugacguuagacaauuagaacccguauuaauaccacuacccgauguaagaaacaauuuuuaucacuauaaucaaucaaacgacucaacaauaaaauuaauagccaugcuuuacacuccauuaagagcaaacaaugccggugaagauguauuuaccguauccugucgcguacuaacacgaccaucuccagacuuugacuuuauauucuuaguaccaccaacaguugaaucaagaaccaaaccauuuacagucccaauauuaacaguagaagaaaugacaaacucaagauuuccuaucccauuggaaaaacuauuuaccggaccaucuggagcuuuugucguccaaccacaaaacggaagauguacuacagauggaguauuacucgguacaacacaauuaucaccaguaaauauauguacuuuuagaggagacguaacacauauugcaggaucuagagacuacacaaugaaccuagcaucauuaaauuggaauaauuaugauccuacagaagaaauaccagcaccccuaggaacaccugacuuuguuggaaaaauacaagguguauuaacacaaacaacuaaaggagacggcuccacaagaggacauaaagcaacaguauacaccggauccgucccuuucacuccaaaauuaggaucaguucaauucucaacagauacagaaaacgauuucgaaacacaucaaaauacaaaauucacacccguaggaguaauacaagacggaaguacaacacacaggaaugaaccacaacaaugggucuuaccuucguauucaggaagaaauguucauaauguacaccuagcaccagcaguagcaccaacauuuccaggagaacaauuauuauucuuccgaucaacaaugcccggcuguucaggauauccuaacauggaucuagauugucuacuuccacaagaauggguucaacacuucuaucaagaagcagcaccagcacaaucagauguagcauuauuaagauuuguuaacccagauaccggcagaguuuuauucgaaugcaaauuacauaaauccggauauguuacuguagcacacacaggccaacacgaucuaguaaucccacccaacggauauuuucgauuugauucauggguaaaccaauuuuauacacuugccccaaugggaaacggaaccggaagacgcagauaa

SEQ ID NO: 33874 - RNA, 1617 nt, Artificial Sequence
  derived and/or modified sequence opt6 from VP1__Norovirus_and/or_Norovirus-like__AB541298
augaaaauggcaucaaacgacgccaauccaucugauggaucagcagcaaacuuaguucccgaaguaaacaaugaaguaauggcauuagaacccgucguaggagcugcuaucgcagcuccaguugcuggccaaacaaauguaauagaccccuggauacguaauaauuuuguucaagcgcccgguggagaauuuacuguauccccacgaaaugcaccaggagaaauauuauggucagcaccauuaggucccgauuuaaauccuuaucuaucacauuuagcaaggauguauaaugguuacgcaggagguuucgaaguacaaguaauauuagcuggcaaugcauucaccgcaggaaaaauaaucuucgcagccguucccccaaacuuucccacugaaggucuaucacccucacaaguaaccauguucccacauauuauaguagauguuagacaauuagaaccuguauuaauaccccuaccagauguaagaaacaauuucuaucacuauaaccaauccaaugauucaacaauaaaacucaucgcaauguuauacaccccauuacgagcaaauaaugcaggagaagauguauucacagucucauguagaguauuaacaagaccaucacccgacuuugacuucauauuuuuaacucccccuacaguagaaucaagaaccaaaccauuuaccgucccaaucuuaacaguugaagaaaugacaaacucacgauuuccaauuccauuagaaaaacuauucacuggaccuucaggagcauucguuguacaaccacaaaauggacgaugcacaacagacggaguauuauuaggaaccacucaacuaucuccaguuaauauauguacauuuaggggagacguaacacauauagcaggaucgcguaacuacacuaugaauuuagcuucacuuaacuggaacaauuacgauccuaccgaagaaauaccagccccacucgguaccccagauuucguaggaaaaauacaaggaguacucacacaaacaacaaaaggugacggaucuacaagaggacauaaagcaacuguauacacaggcucagcaccauucacaccaaaacuuggaucaguacaauucaguacugacaccgaaaaugacuucgaagcacaucaaaacacuaaauuuacuccuguaggugucauucaagacggaucaacgacacauagaaaugaaccccaacaauggguacuaccaucauauuccggaagaaauguacaaaacguacaccuagcacccgcagucgcgccaaccuuuccaggugaacaacuauuauucuuuagauccacaaugccaggaugcaguggauauccaaauauggaccuagacugccuauuaccacaagaauggguacaacacuuuuaucaagaagccgcacccgcccaauccgauuuagcauuacuaagauucguaaauccagacacaggaagaguacuauuugaaugcaaacuacacaaaucuggcuauguaacaguagcacauacaggacaacaugaucuaguaauaccaccaaauggauacuucagauucgacuccuggguaaaucaauuuuauacacucgcuccaaugggcaaugguacagguagaagaagauga

SEQ ID NO: 33875 - RNA, 1617 nt, Artificial Sequence
  derived and/or modified sequence opt6 from VP1__Norovirus_and/or_Norovirus-like__AB541270
augaaaauggcaaguaaugacgcaaauccuucugacggcucagcugcuaaucuaguaccagaaguuaauaacgaagucauggcacuggaaccaguaguaggugcagcaauagcagcaccaguugcgggccaacaaaauguaauugaccccuggauaagaaacaauuucguccaagcaccaggaggagaauuuacuguauccccacgcaacgcaccuggagaaauauuaugguccgcuccacuaggacccgaccuuaaucccuauuuaucucaccuugcccguauguacaacgguuaugcaggcggauuugaaguccaaguaauacuagcuggaaaugcauucacagccggcaaaauaauauucgcagcaguaccaccaaauuucccaacagaaggacuaucaccaucacaaguuacaauguucccacacauaaucguagauguacgacaauuagaaccaguacuaauuccacuaccagauguacgaaacaauuuuuaucacuauaaccaaucuaaugauucaacuauaaaauuaauagcaauguuauacacaccacugagagcuaauaacgcaggagaagaugucuuuacaguaucaugucgaguacuuacacgaccaucgccugacuuugacuuuauauuuuuaguacccccaacaguagaaucucgaacaaaaccauucaccguaccaauauuaaccguagaagaaaugacaaauucaagauuuccaauaccacuagaaaaacuauuuacaggaccaucaggagcauuuguaguccaaccacaaaacgguagguguacaacagacggaguccuauuaggaaccacucaauuaucaccaguaaauaucuguaccuuuagaggagacguuacacauauagcaggaucacguaacuacacaaugaaccuagcaucccuaaacuggaauaacuaugaucccacugaagaaauaccagcuccucucggaaccccugauuuuguaggaaaaauacaagguguguuaacccaaacaacaaaaggagacggaaguacuagaggacauaaagcaacaguauauacaggaucagcaccauuuaccccuaaacuaggauccguucaauuuucgacagauacagaaaacgauuucgaaacacaucaaaacacaaaauucacuccagucggaguaauacaagacggauccaccacacaucgcaaugaaccacaacaauggguacucccuucauauuccgguagaaacguacacaacguacacuuagcaccagcaguagcuccuacauucccaggagaacaauuauuguucuuuagaucaaccaugcccgguuguucaggguaucccaauauggaucuagacugccuuuuaccucaagaauggguacaacauuuuuaucaagaagcugcacccgcacaaucagaugucgcacuauuaagauuuguaaauccagauacaggucgaguauuauuugaaugcaaacuccauaaaucaggauacguaacaguagcacauacuggacaauaugacuuaguaauacccccaaacggauauuuucgcuucgauucauggguaaaccaauucuauacauuagcaccaaugggaaauggaacaggcagaagaagauaa

SEQ ID NO: 33876 - RNA, 1617 nt, Artificial Sequence
  derived and/or modified sequence opt6 from VP1__Norovirus_and/or_Norovirus-like__AB541263
augaaaauggcaucaaaugacgcuaauccuucagauggcagcgcagcaaaccuaguaccagaaguaaauaaugaagucauggcacuugaacccguaguaggagcagcuaucgcugcacccguagccggucaacaaaauguaauagacccauggauaagaaauaauuucguucaagcaccagguggagaauuuaccguuucaccaagaaacgccccaggggaaauucuauggucagcaccucuuggcccagauuuaaacccauaucuaucacaccuagcaagaauguauaaugguuacgcaggagguuucgaaguccaagucauacuagcaggcaaugcauucacagcagguaaaauaauauuugcugcaguuccaccgaacuucccaacugaaggacuaucaccuucacaaguaacaauguucccacacauaauaguagauguaagacaacuagaaccuguauuaauaccccuaccugacguccgaaauaauuucuaccauuacaaucaaucaaacgauucaacaauuaaauuaauagcaauguuauacacaccacuaagagcaaacaaugcuggugaagacguauucacaguaaguugcagaguacuaacacguccaucaccagacuuugacuucaucuuuuuaguacccccaaccguagaaucuagaacaaaaccauucacaguacccauacuuacaguagaagaaaugacaaauucacgauuuccaauaccacuagaaaaacuauuuacaggcccuucaucagcauucguaguacaaccucaaaacgguagaugcacaacagauggagucuuauuaggaacaacacaauuaucaccaguaaauguaugcacauuuagaggagacgucacacauauagcagguucacgaaauuauaccaugaaccuagcaucauuaaacuggaacaacuacgauccuacagaagaaaucccagcuccacuaggaaccccagauuuuguaggcaaaauacaaggaguauuaacacaaacaacaaaaggagacggcucaacuagaggacacaaagcaaccguauacaccggaagcgcucccuucacuccaaaauuaggaucaguacaauucuccacagauaccgaaaacgauuucgaaacucaucaaaauacaaaauucacccccguaggaguaauccaagacgguggaacuacacacagaaaugaaccgcagcaauggguccuaccauccuauucugguagagacguaccaaacguacaucuagcaccagccguagcaccaacauuuccaggagaacaacuauuauuuuuccgaucaaccaugccagguuguucaggauauccaaauauggauuuagauugcuuacuaccccaagaauggguucaacauuuuuaucaagaagcagcucccgcacaaagcgacguagcgcuauuaagauucguaaauccugacacuggaagaguacuauucgaaugcaaauuacacaaaucaggcuacguaacuguagcacauacaggccaacacgauuuagucauaccacccaauggauacuuucgauuugauuccuggguaaaucaauuuuauacauuagcaccuaugggaaauggaacaggucgaagacgauaa

SEQ ID NO: 33877 - RNA, 1617 nt, Artificial Sequence
  derived and/or modified sequence opt6 from VP1__Norovirus_and/or_Norovirus-like__AB541256
augaaaauggcaucaaaugacgcaaacccaagugauggcucagcugcaaaccucgucccagaaguuaacaaugaaguuauggcucuugaaccaguugucggagcugcuaucgcugcaccuguagcuggacaacaaaauguaauagauccauggauaagaaauaacuucguacaagccccaggaggagaauuuaccgucucaccacgaaacgcaccgggagaaauacuauggucugcaccacuaggacccgacuuaaauccauauuuaagucacuuagcaagaauguauaacggauacgcaggaggauuugaaguucaagucauucuagcaggaaaugcuuuuacagcuggaaaaauaauauuugcagcaguaccaccaaauuuuccaacugaaggacuaucaccaucacaaguaacaauguucccacauauaauugucgacguaagacaauuagaaccuguacuaaucccacuaccagauguacguaauaacuucuaucacuacaaccaauccaacgauucuacaaucaaauuaaucgcuaugcuuuacacaccccugcgagcaaacaacgcaggcgaagauguauuuacaguaucuugucgaguuuuaacacgaccuucaccagacuuugacuuuauauuccuaguaccaccaacaguagaaucacgcacaaaaccauuuacaguaccaauauuaacaguugaagaaaugacaaacucacgauuuccaauaccccuagaaaaacuauucacaggaccaucuggugcauucguaguacaaccacaaaacggacgauguaccacugauggagucuuauuagguaccacucaacuaucaccaguaaacauauguaccuuuagaggagacgucacucauauagcugguucaagaaacuacacaaugaauuuagcagcucugaacuggaauaacuacgaccccacugaagaaauaccugcaccauuaggaaccccugauuuuguaggcaaaauacaaggaguccuuacccaaacuacaaaaggugacggaaguacaagaggacauaaagccacuguauauacagggucagcagacuuuaccccaaaauuaggcucaguacaauucucaacagauacagaaaaugacuuugaaacccaccaaaauacaaaauuuacaccaguaggaguuauacaagauggaucaacaacccaccgaaaugaaccacaacaauggguauuaccaucauauuccggaagaaacguacauaacguacacuuagcaccagcaguagcaccuacauucccuggagaacaacuucuuuucuuccgaucaacuaugccaggaugcucaggauaucccaacauggaccuagauugcuuaauaccucaagaauggguacaacauuuuuaccaagaagccgcaccagcacaaucagacguagcacuacuucgauucguuaacccugacaccgguaggguacuauuugaaugcaaacuacacaaaucugguuaugucacaguagcacacacaggucaacaugauuuaguaauaccaccaaauggauauuuuagauuugauucauggguaaaccaauucuauacacuagcucccauggggaacggcgcuggaagaagacguuaa

SEQ ID NO: 33878 - RNA, 1617 nt, Artificial Sequence
  derived and/or modified sequence opt6 from VP1__Norovirus_and/or_Norovirus-like__AB541240
augaaaauggcuaguaaugacgcaaacccuuccgauggcucagcagcaaauuuaguccccgaaguaaacaacgaaguaauggcuuuagaaccaguuguuggagcugcaaucgccgccccuguagccggccaacaaaauguaauagacccauggauaagaaauaauuuuguucaagcaccaggcggagaauuuacaguuaguccaagaaacgccccaucagaaauccuuuggucagcuccacuugguccugaccuaaaucccuauuuaucccacuuagcacgaauguauaacggauacgcaggcgguuuugaaguacaaguaauacucgcaggaaaugcguucacagcuggaaaaauaauauucgcagcaguaccaccaaauuuuccaacagaaggauuaaguccaucacaaguaacaauguucccccacauaauaguagaugucagacaacuagaaccaguacucauuccucuuccugauguaagaaauaauuucuaccauuauaaucaaucaaaugacucaacaauaaaauuaauagcaaugcuauacacaccucucagagcaaacaacgcuggagaagaugucuucacaguaucauguagaguacuaacacgaccaucaccagauuucgacuucauauuucuaguuccaccuacuguugaaucacgaacuaaaccauuuacuguaccuauauuaacuguagaagaaaugacaaauucuagauuuccuauuccccuagaaaaauuauucacagguccaucuucagcauucguaguacaaccccaaaacggcagaugcacaacugacggcguacuauuaggaacaacucaauuaucaccaguaaauaucuguacauuuagaggagacguaacacauauagcuggaucaagaaauuacacaaugaaccuagcaucaauuaauuggaauaacuacgauccuacagaagaaaucccagcaccacuaggaacaccagacuucguaggaaaaauacaaggaguucuaacucaaacaacaaaaggugacggauccacuagaggucacaaagcaacuguauauacagguucugcaccauuuacaccaaaauuaggcucaguucaauuuuccacggauacagaaaacgauuuugaaacacaccaaaacacuaaauucacucccguaggagugauacaagauggagguacuacucaucaaaaugaaccacaacaauggguucuacccggauauucaggaagaaauguuccaaacguacaccuugcuccagcaguagcaccaaccuuuccaggagaacaacuacuuuucuuuagauccacaaugcccggauguucaggauauccaaauauggaucuagacugcuuacuuccacaagaauggguacaacacuucuaccaagaagcagcaccagcacaaucugauguagcacuauuaagauucguaaaucccgacacaggacgaguacuauucgagugcaaacuacauaaauccggauauguaacaguagcacauacaggacaacaugaucucguaauacccccaaacggauauuucagauuugacucuugggucaaucaauucuacacacuagcucccaugggaaauggaacaggaagaagacgauaa

SEQ ID NO: 33879 - RNA, 1617 nt, Artificial Sequence
  derived and/or modified sequence opt6 from VP1__Norovirus_and/or_Norovirus-like__AB541233
augaaaauggcgucaucagacgcaaauccaucagacggaucugcagcaaauuuaguaccagaaguaaacaaugaaguaauggcccuagaaccaguaguaggagcagcuauagcagccccaguagcaggccaacaaaauguaauagauccauggauaagaaauaacuuuguacaagcuccaggcggagaauuuacaguaagcccccgaaaugcaccaggagaaauacuguggucugccccacuugguccagacuuaaaccccuaucuaucacaucuugccagaauguauaacggauacgccgguggauucgaaguacaaguaauacuagcaggaaacgcauuuaccgccggaaaaauaaucuuugcagcuguuccaccaaacuucccaacugaaggacuaucuccaucacaaguaaccauguucccacauauaauaguagacguaagacaacuugaaccuguacuaauaccacuacccgauguaagaaacaauuucuaucauuauaaucaaucaaaugauucaacuauuaaacuaauugcaaugcuauacacuccauuaagagcaaacaaugccggagaagauguauuuacugucucaugucgaguucuaacccgcccaucaccagacuuugacuuuauauuucucguuccaccaacaguugaaucaagaacaaaaccauuuacaguaccaauuuuaaccguagaagaaaugaccaauucacgauuccccauuccuuuagaaaaauuauucacaggacccucaucagcauuuguuguacaaccacaaaacggccguuguaccacugauggaguacucuuaggcacuacacaauuaucaccaguuaacauuuguacauuucguggagauguaacccauauugccggcucaagaaauuacacuaugaacuuagcaucccuaaacuggaacaauuaugauccuacagaagaaauaccagcaccauuagguacuccagauuuuguaggaaaaauacaaggaguacucacccaaacaaccaaaggcgauggaucaacaagaggacacaaagccacugucuauacaggcucugcaccauuuacaccuaaacuaggaucuguucaauucucaacagauacagaaaacgauuuugaaacacaucaaaauacaaaauuuacaccaguaggaguaauacaagacggaggaacaacacaucguaacgaaccucaacaauggguauuaccaucauauucaggcagaaauguaccaaacguacaccuugcaccagcaguagccccaacauucccuggugaacaacuauuauucuuuagaucuacaaugccaggcuguucaggauauccaaacauggaucuugauugccuacuaccacaagaauggguccaacauuucuaucaagaagcagccccagcucaauccgauguagcauuacuaagauucguaaacccugacacagguagaguguuauucgaauguaaacuccacaaagcaggauauguaacuguugcacacacaggucaacacgaucuaguaauaccaccaaauggauauuucagauucgauucaugggucaaccaauuuuauacacuagcaccaaugggaaauggaacuggccgaagacgguaa

SEQ ID NO: 33880 - RNA, 1617 nt, Artificial Sequence
  derived and/or modified sequence opt6 from VP1__Norovirus_and/or_Norovirus-like__AB541215
augaaaauggcaucaaacgacgcuaacccuucugauggaucagcagcaaacuuaguacccgaaguaaacaacgaagucauggcauuagaaccagucguaggugcagcuaucgcagcaccuguugcaggccaacaaaacguaauugacccuuggauaagaaauaacuuuguacaagcgccaggaggugaauuuacaguuucaccaagaaaugcaccuggagaaauaccauggucggaaccacuaggaccagaucucaacccauaccuaucacacuuagcaagaauguauaacggguaugccggaggauucgaaguacaaguaauacuagcaggaaaugcauuuaccgcuggcaaaauaauauuugcugcaguaccaccaaauuuuccaacugaaggccuaucucccucucaaguaacaauguucccacacauuauaguagacguucgccaacuggaaccaguccucauuccacuuccagauguaagaaauaacuucuaucacuacaaccaaucaaaugacucuacaauaaaacucauagcaaugcucuauacuccauuaagagcuaacaaugcaggagaagauguauucacaguuucauguagaguacuaacucgaccauccccagacuuugacuuuauauucuuaguaccaccaaccguagaaucaagaacaaaacccuucacaguccccaucuuaacaguagaagaaaugacaaacucacgcuucccaauuccauuagaaaaacuauucacugggccaucaucagcauuuguaguccaaccgcaaaacggaagauguacaacagacggagucuuacuaggcacaacacaacuauccccuguaaauauauguacauuucgaggagacguuacacauauagcuggaucuagaaacuauacaaugaacuuagcuucucuaaauuggaacaauuacgacccaacugaagaaauaccagcaccauuaggaacaccagauuuuguagguaaaauacaaggaguacuaacacaaacaacuaaaggagacgguucuacacgaggacacaaagcaacaguauacacaggaucagcagacuuuacaccuaaacuuggcucaguacaauuuucaacagacacagaaaaugauuuugaaacacaucaaaacacaaaauuuacaccaguaggaguaauccaagacggcgguacaacacauagaaaugaaccacaacaguggguuuuaccauccuauucaggacgaaauguacacaacguucacuuagcuccugcaguagcaccaacauucccaggugaacaacuauuauucuuuagaucaacuaugcccggauguucaggauacccaaauauggaucuagauugucuucuaccucaagaauggguacaacacuucuaucaagaagcagcaccagcacaaucagacguugcacuauuacguuucguuaauccagauacugguagaguauuauucgaaugcaaacuacauaaauccgguuacguaacaguugcucacacuggacaacaugauuuaguaauaccaccuaauggauauuuuagauuugauucauggguuaaucaauuuuauacacuagcaccaaugggcaacggcacagguagaagaagauaa

SEQ ID NO: 33881 - RNA, 1617 nt, Artificial Sequence
  derived and/or modified sequence opt6 from VP1__Norovirus_and/or_Norovirus-like__AB541201
augaaaauggcuucaaaugaugcaaacccaucagacggaucagcagcuaaccuuguaccagaaguaaacaaugaaguaauggcacuagaaccaguaguaggugcagcuauagcagccccaguagcuggacaacaaaacgucauugacccauggauuagaaauaauuucguacaagcaccaggaggugaauuuacaguaucaccaagaaacgcuccaggcgaaauauuauggucugcaccauuaggaccagaucuaaauccauaucuaucacaucucgcacgaauguacaauggauacgcuggagguuuugaaguccaaguaauacuagcaggaaaugcuuucacugcagguaaaauaauauuugcagcagucccaccaaauuuuccaacagaaggacuaucaccaucacaaguaacaauguuuccacacauaauagucgacgucagacaauuagaaccaguacucauaccacuuccagaugucagaaacaauuucuaucauuauaaccaaucauccgacuccaccauuaaauuaauugcuauguuauauacaccauuaagagcaaauaaugcuggcgaagauguauucacaguaucauguagaguacuaacuaggcccucuccagacuucgacuuuaucuuucuaguaccaccaacagucgaaucuaggacaaaaccauuuacaguaccuauccucacaguagaagaaaugacuaacucaagauucccaauaccucuugaaaaauuauucacaggaccaucaggagcauucguaguccaaccacaaaauggacgaugcacaacagauggaguacuucucggaacaacacaacuuucaccuguaaauauauguacuuuuagaggagauguaacucauauagcaggaucaagaaauuacacuaugaacuuagcaucacuaaacuggaacaauuacgauccaacugaagaaaucccagcaccauuaggaacaccagacuucguagggaaaauacaagguguacuaacacaaacaacaaaaggagacggaucaacacgaggacacaaagcaaccguauacaccggaucagcaccuuuuacaccuaaacuagguucaguucaauuuucaaccgauacagaaaaugauuucgaaacacaccaaaacaccaaauucacuccaguaggaguaauacaagacgguucaacaacccauagaaaugaaccacaacaaugggugcucccuucauacucagguagaaacguacauaacguacaccucgcaccagcaguagcaccaacuuuuccaggcgaacaacucuuauucuuuagauccaccaugccaggaugcucagguuauccaaacauggaucuagauugccuacuaccacaagaauggguucaacauuuuuaucaagaagcagcccccgcacaaucagauguagcauuacuaagauucguaaacccagauacaggaagaguacuuuuugaaugcaaacuucacaaaucaggauacguaacugucgcacacacaggacaacaugauuuaguaauacccccaaauggauauuucagauuugacucuuggguaaaucaauucuacacauuagcucccaugggaaaugggaccggaagaagacgauaa

SEQ ID NO: 33882 - RNA, 1617 nt, Artificial Sequence
  derived and/or modified sequence opt6 from VP1__Norovirus_and/or_Norovirus-like__FJ411172
augaaaauggcaucaaaugaugcaaauccaucagauggaucaacugcaaaccuaguaccagaaguuaauaacgaaguaauggcucucgaacccguaguaggagcagcuauagcugcuccugucgccggccaacaaaauguuauugauccauggauacgcaauaacuuuguacaagcccccggaggagaauuuacaguaaguccaagaaacgcaccaggugaaauauuaugguccgcaccacucggaccagauuuaaacccauaucuaagccacuuagcaagaauguauaacgguuaugcaggcggauuugaaguccaaguaauacuagcaggcaacgcauucacagcuggaaaaauaauauuugcagcaguacccccaaauuuuccaacagaagggcuaucacccucacaaguaacuauguucccacauaucauuguugauguacgacaauuagaaccaguacuaauuccauuaccagauguaagaaacaauuucuaccauuauaaccaaucaaacgacccaaccauuaaauuaauagcaaugcucuauacacccuuaagagcuaacaaugcaggagacgauguauucacaguuagcugcaggguacuaacaagaccaucucccgauuuugacuuuauauuuuuaguaccaccaacuguagaaagucgaacaaaaccauucacagugccuauauuaacuguugaagaaaugacaaacuccagauuuccaauuccauuagaaagauuauacacagguccaucaucagcauucguaguacaaccacaaaauggaagauguacaacugauggaguuuuauuaggaacaacucaacuaucagcagucaauauauguacauuuagaggagacguaacccauauagcaggaucacgaaauuacacuaugaaucucgccagccaaaacuggucaaauuaugacccuacagaagaaauaccagcaccccuagguacaccagauuucguaggaaaaauacaagguaugcuaacacaaacaacuagaagagauggcagcacacgaggucacaaagcuacuguauuaacagggucagcagauuuugcaccaaaacuaggaagaguacaauucgcaacagacacagacaaugacuuugaauccggagaaaauacaaaauucacucccguaggaguaauacaagacggauccaccacccauagaaacgaaccacaacaauggguacuaccaaauuauucaggaagaacaggacauaauguucaccucgccccugcagucgcaccaacuuauccaggugaacaacuccuauucuuuagaucuacuaugccagguugcucaggauacccaaauauggaucuagauugccuacuaccucaagaauggguaagacauuuuuaccaagaagcagcuccugcacaauccgacguagcauuauuaagauucguaaauccagacacaggacggguacuuuuugaaugcaaacuacauaaauccggauauguaacagucgcacauacaggacaacaugaccuaguaauaccuccaaauggauauuucagguuugauuccuggguuaaucaauuuuacacauuagcacccaugggcaauggagcaggaagaagaagauaa

SEQ ID NO: 33883 - RNA, 1617 nt, Artificial Sequence
  derived and/or modified sequence opt6 from VP1__Norovirus_and/or_Norovirus-like__AB447449
augaaaauggcaucaaaugacgcaaacccaagcgacggaucggccgcuaacuuaguaccagaaguaaacaacgaagucauggcacuagaaccgguaguuggugcagcaaucgcugcuccaguagcaggacaacaaaacguaauagaucccuggauaagaaauaauuuuguacaagcaccaggcggcgaauuuacagucucaccccgaaaugcaccaggagaaauacuauggucugcaccacuaggaccagaucuaaauccauaccuaucacauuuagcacguauguauaauggauaugcaggaggauucgaaguacaagucaucuuagcuggaaacgcauuuacugcaggaaaaauaauuuuugcagcaguaccaccaaacuuccccacugaaggucuaucuccaucucaagucacaauguucccccacauaauaguugauguaagacaacuagaaccaguacuaauaccucuucccgauguaagaaauaauuuuuaucacuauaaccaaucaaacgauucaacaauaaaacuaauagcuauguuauauacaccacuucgugccaauaaugcaggagaagauguauuuacugucuccugcagaguccucacaagaccuuccccagauuuugauuucauauuucuaguacccccaacaguugaauccagaacaaaaccauucacaguaccuauacuaaccguagaagaaaugaccaacuccagauuuccaaucccauuagaaaaacuauuuacaggucccaguggcgcauucgucguucaaccccaaaacggacgauguaccaccgacgguguauuacuaggcaccacccaacuuucaccaguuaauauauguacauuuagaggagacguaacccauauagcuggaucaagagauuacacaaugaaccuagcaucauuaaacuggaacaauuaugaucccacagaagaaauaccagcaccacuaggcacaccagacuuuguaggaaaaauacaaggaguauuaacacaaacaaccaaaggagacggaucaacacgaggacacaaagcuaccguauauacaggaucagcacccuuuacucccaaauuaggaucaguacaauucucaacagacacagaaaacgauuucgaaacucaccaaaauacaaaauucacaccaguaggaguaauacaagaugguucuaccacacacagaaaugaaccccaacaauggguuuuaccaucuuauucaggcagaaauguacauaauguccaucuagcaccagcuguagcaccaacuuuuccaggagaacaacuccuauucuuuagaucaacaaugccuggauguucaggauauccaaacauggacuuagauugcuuacuaccacaagaauggguacaacacuuuuaccaagaagcagcaccagcacaaucagacguugcauuacuaagauuugucaacccagacacuggaagaguauuauucgaaugcaaacuccacaaauccggcuacguaacuguagcucacacaggccaacaugauuuaguaauacccccaaauggauauuuucgauuugacucuuggguaaaccacuuuuauacuuuagcaccuaugggcaauggaacuggaagaagacguuaa

SEQ ID NO: 33884 - RNA, 1617 nt, Artificial Sequence
  derived and/or modified sequence opt6 from VP1__Norovirus_and/or_Norovirus-like__AB447431
augaaaauggcaucaaaugacgcaaauccauccgacggcucuaccgcaaaucuaguaccugaaguuaacaacgaaguuauggcauuggaaccaguugucggcgcagccauugcugcacccgucgcaggccaacaaaauguaauagacccuuggaucagaaacaacuuuguccaagcuccaggaggagaauuuacaguaucuccuagaaacgcaccuggugaaauccuauggucugccccacuaggacccgaccuaaacccauaucucucacauuuagcuagaauguauaauggauacgcaggaggauucgaaguacaaguaauuuuagcaggaaaugccuuuacagcagguaaaauaauauucgcugcuguaccuccaaacuuuccuacagaaggucuuagucccucacaaguuacaauguuuccacacauaauaguagacguuagacaacuagaaccaguauuaauaccauuaccugacguuagaaauaauuuuuaucacuacaaccaaagcaaugauucaacaauaaaauuaauagcaauguuauauacaccauuaagagcaaacaacgccggugacgauguauuuacaguaagcuguagagucuuaacaagaccaucuccagacuuugauuucauuuuccuaguaccacccacagucgaaaguagaacaaaaccauuuacaguaccaauacuaacaguugaagaaaugaccaauucaagauuuccuauuccacuagaaaaacuauucacuggaccaucaucugcauucguaguacaaccacaaaauggaagguguacaacugacgguguucuucuaggcacaacacaacuaucuccaguaaauauauguacauuuagaggcgacguaacacauaucgcaggaucaagaaauuacacaaugaauuuagccucucuaaacuggaacaauuacgauccaacagaagaaauaccagcaccauuagguacuccagauuucguaggaaaaauacaaggaguccucacacaaacuaccaaaggagacggcuccacacgaggacacaaagcaacaguuuauacaggaagugcaccuuuuacacccaaacuaggaucuguccaauucucuacagacacagaaaacgacuuugaaacacaucaaaacacaaaauucacaccgguaggaguaauacaagacgguggaacaacacaucgaaaugaaccacaacaauggguacucccuucauauuccggacgaaauguacacaacguccaccuagcuccugcaguagcuccaacauuucccggcgaacaacucuuauuuuuccgauccacuaugccaggauguagcggcuauccaaauauggaucuagacugccuauuaccacaagaauggguacaacacuucuaccaagaagcagcaccagcacaaucagauguagcucuacuaagauuuguuaacccagacacaggccgaguauuauucgaauguaaacuacauaaauccgguuauguaacaguagcuuacacaggccaacaugacuuaguaauaccacccaacggauacuuucgauucgauucaugggucaaucaauuuuauacucuagcacccaugggaaacgguacuggaagaagaagauaa

SEQ ID NO: 33885 - RNA, 1617 nt, Artificial Sequence
  derived and/or modified sequence opt6 from VP1__Norovirus_and/or_Norovirus-like__EU078415
augaaaauggcaucgaaugacgcaacacccucagauggaucaacagcaaacuuaguuccugaaguaaauaaugaaguuauggcucucgaaccuguaguaggagccgcaauagcugcaccagucgcuggacaacaaaauguaauugaucccuggauaagaaacaauuuuguccaagcuccaggaggugaauuuaccguaucuccacgcaacgcacccggugaaauacucuggagugcuccacuugguccagaccuaaauccauauuuaucucacuuagcacguauguauaaugguuaugcaggaggauuugaaguucagguaauuuuagcaggaaaugccuuuacugcaggcaaaauaauauuugcagccguucccccaaauuuuccaacagaaggacuaucacccucacaagucacaauguuuccacacauaaucgucgaugucagacaacuagaaccaguccuaauaccauuaccugauguuagaaauaauuuuuaucacuauaaucaaaguaacgauccuacaauaaaauuaauugcaauguuauauacaccauuaagagcaaauaaugccggugaugacguauuuaccguauccugcagaguauuaacaagaccaucaccagacuuugacuuuauauuucucgucccuccaaccguagaaucaagaacaaaaccauucucuguacccauacuaaccguagaagaaaugacaaauucuagauuuccaauaccauuagaaaaauuauucacugguccuucaucaucauuuguuguacaaccccaaaacggacguugcacaacagauggaguacuacuaggaacaacacaacuaaguccuguaaauauauguacauuucgcggagacguaacccacauugcaggaacucaaaacuacacaaugaacuuagcaucacaaaacuggaauaauuacgauccaacagaagaaauaccagcaccacuagguacaccugacuuuguugguaaaauacaaggaguauuaacccaaacaaccagaggagacggaagcacacgaggacauaaagcaacgguauccacuggaucaguacacuucacaccaaaauuaggaucuguccaauuuucaaccgacacaucaaaugauuucgaaacuggucaaaauacacgcuucacaccuguagguguaguccaagauggaucgacuacacaucaaaacgaaccacaacaauggguacuaccagacuauucaggaagaaacucacacaauguacauuuagcuccagcaguagcuccaacauuuccuggagaacaacuacuuuucuuuagauccacuaugccagguugcucaggauauccaaauaugaacuuagacugucuacuaccacaagaauggguacaacauuucuaucaagaaagcgcaccagcacaaucagauguagcauuauuaagauuuguaaacccagacacaggaagaguuuuauucgaauguaaauuacacaaaaguggcuauguaacaguugcacauacaggucaacaugaucucguaaucccaccaaauggauauuucagauuugacucauggguaaaucaauucuauacacuagcaccuauggguaacggagcaggaagacguagauaa

SEQ ID NO: 33886 - RNA, 1617 nt, Artificial Sequence
  derived and/or modified sequence opt6 from VP1__Norovirus_and/or_Norovirus-like__AB385643
augaaaauggcaucauccgacgcaaaccccucagaugguuccacugccaaccuaguaccugaaguuaacaaugaaguaauggcuuuagaaccaguaguaggagcagcaauagcagcccccguugcaggccaacaaaauguaauagacccauggauucgaaauaacuucguacaagcaccaggaggagaauuuacagugucaccaagaaacgcuccgggagaaauacuauggagcgccccucuaggaccagaucuaaauccauaucuaucccacuuagcaagaauguauaacgguuaugcuggaggcuucgaaguacaagucauacuagcaggaaacgccuuuacagcuggaaaaaucauauucgcagcaguaccaccaaacuuuccaaccgaaggucuuucccccucucaagucacaauguucccucauaugauagucgacguuagacaacuagaaccaguauuaauacccuuaccagauguuagaaacaacuucuaucacuauaaccaaagcaaugacccuacaauaaaauuaauagcuauguuauacacuccauuaagagcaaacaaugcaggagacgauguauuuacaguauccuguagaguacuaacacgaccaucuccagauuucgacuucauauucuuaguuccacccacuguagaauccagaacaaaaccauucucagucccaauuuuaacuguagaagaaaugaccaacucucgauuccccaucccauuagaaaaacuauucacagguccaucuucagccuucguaguacaaccucaaaacggaagauguacaaccgacggaguacuacuaggaacuacacaacuuuccccuguaaauauauguacuuuucgaggagacguaacacauauagccggaacacaagaauauacgaugaauuuagcaucacaaaacuggaacaauuaugauccaaccgaagaaauaccagccccacuaggaaccccagacuucguaggcaaaauacaagggguacuaacacaaacaacaagaggugacgguucaacaagaggccacaaagcaacagucucaacaggaucuguacauuucacaccaaaauuaggacggauacaauucucuacagauaccucuaacgauuuugaaaccggccaaaauacacgcuucacaccaguaggaguuguccaagacggaagcacuacccaucaaaaugaaccucaacaaugggucuuaccaaacuauucagggagagauagccauaauguucauuuagcaccagccguagcaccaucauucccuggagaacaauuauuauucuuuagaucaacuaugccaggaugcucaggauauccuaauaugaauuuagauugucuacuaccacaagaauggguacaacauuucuaucaagaagccgcaccagcacaaucugacguugcacuuuuaagauuuguaaauccagacacuggaagaguauuauucgaaugcaaacuacauaaaucuggauauguaacaguagcacauacaggacaacaugaucucguaauacccccuaaugguuauuucagauucgauucauggguaaaucaauuuuauacgcuagcucccaugggaaauggaacagggagacgacgcuga

SEQ ID NO: 33887 - RNA, 1617 nt, Artificial Sequence
  derived and/or modified sequence opt6 from VP1__Norovirus_and/or_Norovirus-like__AB385636
augaaaauggcauccaaugaugcaacaccaagugauggaucaacugcaaaccuaguacccgaagucaacaaugaagucauggcauuagaaccaguuguuggugcagcaauagcagcaccuguugcaggccaacaaaacgucauugacccauggauacgaaacaauuucguucaagcaccagguggugaauuuaccguaucuccaagaaacgcucccggagaaauauuauggucagcuccacuaggaccagaucuaaaccccuaucucucacaccuagcuagaauguacaauggcuacgcaggagguuuugaaguacaaguaauacuugccggaaaugcauucacugcagguaaaauaauauucgcagccguaccuccaaacuuuccaacugaaggacuaucuccuucucaaguaacaauguucccacauauaauaguagacguaagacaacuugaaccaguacuaauuccacuucccgacguaaggaauaauuucuaccauuacaaucaaagcaacgauccaacuauuaaacuuauugcaauguuauacacuccccuaagagcaaauaacgccggagaugauguauucacagacucuuguagaguauuaacacgcccauccccagauuuugacuuuauuuucuuaguuccacccacuguagaaucacgcacaaaaccuuucucaguaccaauauuaacaguugaagaaaugacaaacucaagauuuccaauaccacuagaaaaauuauuuacugguccaucaucugcuuuuguuguacaaccacaaaauggaagauguacaacagacggaguacuuuuagguacaacacaacuuucaccuguaaauauaugcacauuuagaggugauguuacacacauagcuggaacacaaaauuauacaaugaaucuagcaucccaaaacuggaacaacuacgauccaacagaagaaauacccgcuccacuuggcacacccgauuuuguaggaaaaauccaaggaguauuaacacaaacuacuagaggagacggaucaacaagaggucacaaagcaaccguaucuacugguucaguucauuuuacaccaaaacuaggaucaguccaauucucaacugauacaucaaaugaucuagaaaccggacaaaauacaagauucacuccuguuggaguuguacaagacggaucaacaacacaucaaaacgaaccccaacaauggguacuaccaaacuacucaggacgagacucccauaacguacacuuagccccagcaguugcccccacuuuuccaggagaacaauuauuauuuuucagaucuacaaugccaggauguucaggauauccaaauaugaaccuagauugcuuacuaccccaagaauggguacaacauuuuuaucaagaaucagccccagcacaaucagauguagccuuacuaagauucgucaauccagauacuggaagagucuuguuugaaugcaaauuacauaaauccgguuauguuacagucgcacauacaggacaacaugaucucguaauaccaccuaauggauauuuccguuuugauucaugggucaaccaauucuacacccuagcaccaaugggcaauggcgcaggaagaagacgauaa

SEQ ID NO: 33888 - RNA, 1617 nt, Artificial Sequence
  derived and/or modified sequence opt6 from VP1__Norovirus_and/or_Norovirus-like__AB385629
augaaaauggcaagcaaugacgcaacaccgucagauggaucuacagcaaauuuaguaccugaaguuaauaaugaaguuauggcauuagaaccaguugcaggagcugccaucgcagcacccguagcuggacaacaaaaugucauagaccccuggauaagaaauaauuuuguucaagcuccaggaggagaauuuaccguuucaccgagaaaugcaccaggcgaaauauuauggagugcaccucuuggaccugaucuaaauccuuauuuaucacaccuagcacguauguauaacggauaugcaggaggauucgaaguacaagucauacuagcaggaaacgcauuuacagcuggaaaaauaauauucgcagcaguaccaccaaacuuuccaacagaaggacuauccccaucccaagucacuauguuuccacacauaauaguugacguacgacaauuagaaccaguauuaauaccauuaccagacguaagaaacaauuucuaucauuauaaucaaucuaaugauccaacuauaaaacuaauagcaauguuauauacaccuuuaagagcaaacaaugcaggagaugacguauuuacagucucauguagaguauuaacaagaccaucacccgauuuugacuuuaucuuucuaguaccaccaacaguagaaucccgaacaaaaccauucucuguacccauccuaacaguagaagaaaugacaaauucaagauuuccaauaccucuugaaaaauuauucacuggaccaucuucugcauuuguaguacaaccacaaaauggccgaugcacuaccgacgguguacuauuaggaacaacucaacuaucaccuguaaauaucugcacauucagaggcgacgucacccauauagcaaauacacaaaauuacacaaugaaucucgcaagccaaaacuggaauaacuacgaucccacagaagaaauaccagcaccauuaggaacaccagauuucguaggccguauacaagguguccuaacacaaacaacaagaggagacgguagcacaagaggacacaaagcaacaguaucuacagguaguguacacuucacaccaaaacuaggaucaguccaauucucaacagacacuucuaaugaucuagaaacaggacaaaacacacguuucaccccaguaggaguaguacaagacggaggaacaacucauagaaacgaaccacaacaauggguccuaccagauuauuccggaagagauucacauaacguucacuuagcgccagcaguagccccaacuuuccccggagaacaauuauuauuuuucagaucuacaaugccaggauguuccggauauccaaauaugaauuuagacugccuuuuaccucaagaaugggugcaacacuucuaucaagaaagcgcuccugcacagucagauguagcauuacuaagauucguaaaucccgacacaggaagagucuuguucgaauguaaauuacacaaauccggcuauguaacaguugcacacacaggccaacaugaucuuguaauaccaccaaauggauacuuccgauuugauucauggguaaaucaauuuuauacuuuagcaccaaugggaaacggagcaggaagacgaagauaa

SEQ ID NO: 33889 - RNA, 1617 nt, Artificial Sequence
  derived and/or modified sequence opt6 from VP1__Norovirus_and/or_Norovirus-like__EU839586
augaaaauggcaagcaaugacgcuucacccuccgacggaucuacagcuaaccucguaccugaaguaaauaaugaaguaauggcacuagaaccaguuguaggagcagcuauagcagcaccagucacaggacaacaaaacgucauagacccauggauaagaaacaauuuuguacaagcaccaggaggagaauuuacaguaucaccucgaaacgcaccuggagaaauacucuggucagcaccacuaggcccagaucuaaacccauauuuaucccacuuggccagaauguauaauggauacgccgguggcuucgaaguacaaguaauacuagcaggaaaugcauuuacagcaggaaaaauaauauucgccgcuguacccccuaauuuuccaacagaaggauuaucaccaucacaaguaacaauguuuccucauauaauuguagacguuagacaacuagaaccagucuuaauuccacuaccagacgucagaaacaacuucuaccauuauaaucaaucaaacgauuccaccauaaaacuaauagcaaugcuuuacacacccuuaagagcuaacaaugcuggugaugauguauuuacagucucauguagaguauuaacaagaccuucccccgacuuugacuuuaucuuccuagucccuccuacaguugaaucacgaacaaaaccauucaccgucccaauccuaacaguugaagaaaugacaaacaguagauuuccaauaccacuagaaaaacucuucacaggaccuucaucagcauuuguaguacaaccccaaaauggaagauguacaacagacgguguacuauuaggaacaacacaacucucaccagucaauauaugcacuuuucgaggcgauguaacacauauaccaggaacucgaacuuauagaaugaauuuagcaucucaaaacuggaacaacuacgacccaacugaagaaauaccagcaccccuaggaacaccggacuucguaggaaaaauacaagguaugcuaacacaaacaacaaaaggagacggaucuacccgaggccacaaagcaacaguaucaacuggaucaguagauuucacuccaaaauuaggcucaguacaauuugcuacagauacagauaaugauuucgaaacaggacaaaacacaagauucacaccuguaggaguaauacaagacggaucaucaacacaucguaaugaaccucaacaauggguacuaccagauuauucaggaagaacagcacauaacguucaucuagcaccagcagucgcuccuacuuuuccaggagaacaacugcuuuucuuucgaagcacaaugccagguugcucagguuacccaaauauggaucuagauugucucuuaccacaagaauggguacaacauuuuuaucaagaagcugcuccaucucaaagugacguugcacuacucagauucguaaacccagacacuggcagaguucuuuuugaaugcaaacuccauaaagcagguuaugucacaguagcacacacaggacaacaugaucuaguuaucccaccaaauggcuauuucagauucgauucaugggucaaucaauuuuacacucuagcaccuauggguaacggugcaggcagaaggagauaa

SEQ ID NO: 33890 - RNA, 1617 nt, Artificial Sequence
  derived and/or modified sequence opt6 from VP1__Norovirus_and/or_Norovirus-like__EU310927
augaaaauggcuucuucugaugcaucaccaucagaugguucaacugcuaacuuaguaccugaagucaacaaugaaguaauggcuuuagaaccagucguaggugccgcaauagcugcccccguugcaggucaacaaaacguuauagauccauggauacguaacaacuucguacaagcuccugguggugaauuuacaguaucaccacgcaaugcaccaggagaaauacuauggucagcuccuuuaggaccugauuuaaauccauaucucucucaccuugcaagaauguauaacgguuacgcuggagguuucgaaguccaaguaauacuagcaggaaaugcauuuacagcaggaaaaauuauuuucgcugccguaccaccaaacuuuccaacugaaggauuaucuccaucacaaguaacaauguuuccacacauaauaguagauguaagacaauuagaaccuguauuaauaccuuuaccagaugucagaaacaacuucuaucauuauaaccaaucaaaugacccuacuauuaaacuaaucgccaugcuauacacaccacuacgagccaacaaugcuggagacgacguauucacaguuuccuguagaguacuuacacgcccaucuccugacuuugacuuuaucuuccuaguuccaccaacaguagaaucacgaacuaaaccauuuaccguucccauucuaacaguugaagaaaugacaaacucacguuuucccauaccacuugaaaaacucuuuacugguccuucuggcgcauuuguuguccaaccacaaaauggccgcuguacaacagacgguguauuauuaggaacaacacaacuaucuccaguaaacauaugcacauuuagaggugauguaacacauauagcuggcacacaugauuacacaaugaaucuagcaucacaaaacuggaacaauuacgauccaaccgaagaaauaccagcaccacucgguacaccagacuuuguaggaaaaauacaaggaguauuaacacaaaccacaagaggagacgguuccacacgaggucacaaagccacuguaucuacaggcucaguucauuucacaccuaaauuaggaucaguacaauuuacaacagauacaaauaacgaccuagaaacaggacaaaacacuaaauucacuccaguuggcguaguucaagauggaaacucagcccaccaaaaugaaccacaacaauggguauuaccuaacuauucagguagaacaggacauaacguacauuuagccccagcaguagcaccuaccuuuccaggcgaacaauuauuauucuuuagauccaccaugccaggaugcucuggauauccaaauaugaaccucgauugcuugcuaccacaagaauggguacuucauuuuuaucaagaagcagcacccgcccaaucugauguagcuuuacuaagauucguaaauccagauacaggaagaguacuauuugaaugcaaauuacauaaaucaggauauguuacuguagcucauacaggaccucacgauuuaguaaucccacccaauggauauuuccgauuugauucauggguuaaucaauuuuauacacuagcaccaaugggaaacggcgcaggaagacgacgauga

SEQ ID NO: 33891 - RNA, 1617 nt, Artificial Sequence
  derived and/or modified sequence opt6 from VP1__Norovirus_and/or_Norovirus-like__AB294787
augaaaauggccuccaaugacgcuucaccaucugaugguucagccgcaaaucuaguaccagaaguaaauaaugaaguaauggcacuagaaccaguaguaggagccgcaauagcagcuccuguagcaggccaacaaaauguuauagaccccuggauacgaaauaacuuuguacaagcaccaggaggcgaauuuacagucucaccacgaaacgcaccaggagaaauccucuggucugcaccacuaggcccagaucuuaaccccuaucuaucucauuuagccagaauguauaauggauacgcuggaggauuugaaguacaaguuauauuagcaggcaaugcauuuaccgcuggaaaaauaauauuugcagcaguaccaccaaauuuucccacugaaggucuaucuccaucacaagucacaauguuuccucauauaauaguagacgucagacaauuagaacccgucuuaauaccauuaccagaugucagaaacaauuuuuaccauuauaaccaaucaaaugacucaacaauuaaacuaauugcaaugcucuauacuccacuuagagcuaauaaugcaggagacgauguauucacaguuucauguagaguacuuacuagaccaucaccagacuuugacuuuauuuuucuaguaccuccaacagucgaaucucgaacaaaaccauuuacuguaccuauacuaacugucgaagaaaugacaaacucaagauucccaauacccuuagaaaaauuauuuacaggaccaucaucagcuuuuguaguacaaccucaaaauggaagauguacuaccgacggagucuuauuaggaacaacacaauuauccccaguaaacauuugcacauuuagaggugacgucacacauauaagugguacaagaacauacagaaugaaucuagccucacaaaauuggaauaauuacgaccccacugaagaaauaccagcaccacuaggaacaccagacuuugucggaaaaauccaaggaauguuaacacaaacuacaaaaggagauggaucaacaagaggacacaaagcaacaguuucaacaggaucaguugauuuuaccccuaaacuuggaucaguacaauucgcuacagauaccgauaaugauuucgaaaccggccaaaacacaagauucacgccuguaggaguaauacaagauggcaguucagcacauagaaacgaaccacaacaauggguacuccccgacuauucaggccguacaguacacaauguacauuuagccccagcugucgccccaacauuuccaggagaacaacuacucuuuuuccgaucuacaaugccaggauguucaggauauccaaacauggaucuagacuguuuauuaccccaagaauggguacaacacuucuaucaagaagcagcaccaucccaaucagacgucgccuuacuacgauuuguaaacccagacacaggaagaguauuauucgaaugcaaacuacauaaagcuggauauguaacaguagcucacacaggccaacacgauuuaguaauaccaccaaacggauauuuuagauuugacuccugggucaaucaauuuuacacucuagcaccaaugggaaauggcgccggacgacgaagauaa

SEQ ID NO: 33892 - RNA, 1617 nt, Artificial Sequence
  derived and/or modified sequence opt6 from VP1__Norovirus_and/or_Norovirus-like__AY587987
augaaaauggcaucaaaugaugccaaucccucagacgguuccacagcaaauuuaguaccagaaguaaauaacgaaguaauggcacucgaacccguaguaggugcagcaauugcagcaccaguagcuggacaacaaaauguaauagacccauggauucgaaauaacuucguacaagccccaggaggagaauuuacaguaucaccacgaaaugcaccaggagaaauacuuugguccgcuccauuagguccagauuuaaauccauaucuaucacauuuagcacgaauguacaacgguuaugcaggagguuuugaaguucaaguaaucuuagcuggaaaugcauuuacagcaggaaaaauaauauuugcugcaguuccucccaacuucccaacagaaggacucucaccuucacaaguuacaauguuuccacacauaauaguagauguuagacaauuagaaccugucuuaauaccuuuaccagauguccgaaacaauuuuuaucacuacaaccaaucaaaugacccaacuauaaaauuaaucgcaaugcuauacacaccccuaagagcaaauaaugcaggagaagauguauuuacagucucauguaggguacuaacacguccuuccccugacuuugacuuuauauuccuaguuccuccaacuguagaaucuagaacaaagccauuuacaguuccuauuuuaacaguagaagaaaugacuaauucucgauuuccaauaccacuugaaaaacuauuuacaggcccaucaggugcuuucguaguacaaccccaaaauggcagauguacaacagacggaguacuucuaggaacaacucaacuauccccaguaaauauaugugcauucagaggagacgucacacauauagccggaacucacaauuauacaaugaaucuagcaucccaaaauuggaacaauuaugauccaacagaagaaauaccagcuccauuaggaacacccgacuuuguaggacguauucaaggaauguuaacacaaacaacaagaggugauggaucaacaagaggacacaaagcaacaguauccacaggugauguccauuucaccccuaaauuaggaucaauccaauucaacacagauacaaauaacgauuuugaaaccggacaaaacacuaaauuuacucccgucggcguaguacaagauggcaacggaacacaccaaaacgaaccccaacaauggguacuaccaucuuauucaggaagaacuggacauaacguccauuuagcaccagcaguagcaccaacauucccaggcgaacaacuucuauucuucagaucuaccaugccaggaugcuccggcuauccaaauaugaaccucgauugcuuauuaccacaagaauggguacaacauuucuaucaagaagcagcuccugcucaaagugacguagcacuuuuacguuucguuaauccagacacaggaagaguacuauuugaaugcaaauuacauaaaagcggauacgucacaguagcccacacuggacaacaugauuuaguaauaccuccaaauggauacuuccgcuuugauucaugggucaaucaauuuuacacuuuagccccaauggguaauggaaccggaagaagaagauaa

SEQ ID NO: 33893 - RNA, 1617 nt, Artificial Sequence
  derived and/or modified sequence opt6 from VP1__Norovirus_and/or_Norovirus-like__AY502019
augaaaauggcaucuaaugacgcaaauccuucagacggcucaacagcaaacuuaguccccgaaguuaauaaugaaguuauggcauuagaaccaguaguaggcgcagcuauugcugcaccaguagcuggacagcaaaaugucauagauccauggauaagaaauaauuucguucaagcaccuggaggugaauuuacaguauccccaagaaacgcaccaggagaaauacuaugguccgcaccacuaggacccgaccuuaacccauaccuaucacaucucgcaagaauguauaacggcuaugcaggaggcuuugaaguacagguaauacuagcuggaaacgcauuuacagccggaaaaauagucuucgcagcagucccaccuaauuuuccuacagaaggccuaaguccaucucaaguaaccauguuuccucacaucaucguugauguaagacaacuagaaccaguacuaaucccccuuccagauguaagaaacaauuucuaucacuauaaucaaucaaaugacccuacaaucaaauuaauagcaauguuauacacuccucuaagagcuaacaaugcaggagaagacgucuuuacaguuucuugucguguccuaacaagaccaucaccagacuuugacuuuauauuuuuaguuccaccuaccguagaaucacgaacuaaaccauuuacaguaccaauuuuaaccguagaagaaaugacaaacagcagauuuccgauaccacuagaaaaacuauuuacaggaccaucaucagcuuucguaguacaaccacaaaacggaagauguacaaccgacggaguauuauuaggcacuacacaacuaucaccaguaaacauauguacauucagaggagauguaacacauauagcagguacacauaauuacaccaugaauuuagcuucacaaaacuggaacaauuacgauccaacagaagaaauaccugccccuuuagguacaccagauuuuguaggaagaauacaaggcaugcuaacacaaacaacaagaggagacgguucaacaagaggacauaaagcaacuguaagcacaggagauguccauuuuaccccuaaacuaggaaguauacaauuuaacaccgauacaaauaaugacuuugaaacaggacaaaauacaaaauucacacccguaggaguuguacaagacgguaacggaacccaucaaaaugaaccacagcaauggguacuaccaucauauucaggacgaacuggacauaauguacaccuagcaccagcaguagcacccacauuuccuggugaacaauuauuauucuuuagaucaacaaugccaggaugcuccggauacccuaauaugaaucuagauugucuauuaccucaagaauggguacaacauuuuuaucaagaagcagcaccagcacaaucagauguugcacuauuaagauuuguaaacccagauacaggacguguauuauucgaaugcaaacuccauaaaucuggauauguaacuguagcacauacaggacaacaugaucuaguuauacccccaaacggauacuucagauuugauucaugggucaaucaauuuuauacacuagcacccaugggaaauggcacaggcagacgacgauaa

SEQ ID NO: 33894 - RNA, 1617 nt, Artificial Sequence
  derived and/or modified sequence opt6 from VP1__Norovirus_and/or_Norovirus-like__LC177653
augaaaauggcuuccaaugaugcaaacccaucugacggaucugcagcaaauuuagucccagaaguaaacaacgaaguuauggcacuagaaccaguaguaggagcagcaauagcagcaccaguugcaggacaacaaaacgucauagauccauggauacgaaauaauuuuguacaagcacccggaggagaauuuacaguaucaccuagaaaugcgcccggcgaaauauuauggucugcgccacuaggaccugauuuaaauccauaucucucccacuuagcccgcauguauaacggauacgcaggaggauuugaaguucaaguuauauuagcaggcaacgcuuucaccgcuggaaaaauaguuuucgcagcuguuccucccaacuuuccaacagaaggacuaucuccaucucaaguaacaauguuuccacacauaauuguagauguaagacaauuagagccuguacuaauaccauuaccugauguaagaaacaauuucuaccacuacaaucaaucaaaugacucaacaauaaaauuaauagcaauguuguauacaccauuaagagccaauaacgccggugaagauguauuuacagucucauguagagucuuaacaagaccuuccccagauuuugauuuuauauuucuaguaccaccaacagucgaaucaagaaccaaaccauuuacaguaccaaucuuaacaguagaagaaaugacaaauucaagauucccaauuccauuagaaaaauuauuuacuggacccucaggagcauucauaguucaaccacaaaauggaagauguacaacagacggaguauuauuagguacaacacaauuaucaccuguaaauauauguacauuuagaggagacguaacacauauagcaggcuccagaaauuacaccaugaaccuagcaucccuaaacuggaauaauuaugaccccaccgaagaaauaccagcuccacuuggaacaccagacuuugucggaaaaauacaaggaguauuaacacaaacaaccaaaggugacggaucaacaagaggucacaaagccaccguauacacaggaucagcuccauucacaccuaaacugggaaguguccaauucucaacugauacagaaaacgauuucgaagcucaucaaaauacaaaauuuacuccaguuggagucauacaagacgguggaacaacacauagaaaugaaccacaacaauggguacuaccaucauauagcgguagagauguacauaacguacaccucgcuccagcaguagcuccuacuuuuccaggagaacaacuacuauucuucagaucaacaaugcccggcugcucaggcuaucccaacauggauuuagauugucuacuaccccaagaauggguacaacauuuuuaucaagaagcagcacccgcacaaucagacguagcacuauuaagauuuguaaacccagacacuggaagaguuuuauuugaaugcaaauuacauaaaucaggcuauguaacugucgcucauacuggacaacaugaccuaguaauacccccuaauggauauuuccgauuugacucauggguaaaucaauuuuauacauuagcuccuaugggaaacggaacuggacgcagacgcuaa

SEQ ID NO: 33895 - RNA, 1617 nt, Artificial Sequence
  derived and/or modified sequence opt6 from VP1__Norovirus_and/or_Norovirus-like__AB972486
augaagauggcaucaaaugaugccaacccaucagauggaucagcugcuaaccuaguaccugaaguaaacaacgaaguaauggcucucgaaccaguugucggagcagccauagcagcuccaguagcaggacaacaaaaugugauugauccauggauaagaaauaacuuuguacaagcaccaggaggagaauuuacagucucuccaagaaaugcaccaggagaaauucucuggucugcaccauuaggccccgauuuaaauccauaccuaucacaucuagcaagaauguacaacgguuacgcuggaggauucgaaguacaagucauacuugcaggaaaugcauucaccgcaggaaaaauaauauucgcagcaguaccaccaaauuuuccuacagaaggacuaucaccaucacaaguuacaauguucccucacauaauaguugacgugagacaacuagaaccaguauuaauaccacuaccagacguacgaaacaauuucuaucacuauaaucaaucaaacgacucaacaauaaaauuaauagcuauguuauauacccccuuacgagcuaauaaugcaggagaagacguauuuacaguaucaugcagaguauuaacuagaccaucaccagacuucgacuuuauuuuucuuguacccccaaccguagaaucaagaacaaaaccauucacuguaccaauacuaacagucgaagaaaugacaaauuccagauuuccaauuccauuagaaaaauuauuuaccggaccuucuucagcuuuuguaguacaaccacaaaacgguagaugcacaacagauggaguccuacuuggaacaacucaacucucacccgugaauaucugcacauuucgaggagaugucacacauauagcagguuccagaaauuacacuaugaaucucgcaucacuaaacuggaacaauuaugauccaacugaagaaauaccugcacccuuagguaccccagacuuugucgguaaaauacaaggaaugcuaacccaaacaaccaaaggagaugguucuacaagaggacacaaagccacaguauauacaggaucagcaccauuuaccccaaaauuaggaucaguacaauucgcaacagauacugaaaaugacuucgaaacacaucaaaacacaaaauuuacacccguaggaguaauacaagacggaggcacaacccauagaaaugaaccacaacaguggguacuaccaaguuacucaggaagaaaugugccuaacguacaccuugcuccagcaguagcaccuacauuccccggagagcaauuacuauucuuuagaaguaccaugccaggaugcucaggauacccaaauauggaucucgauugucuauuaccccaagaauggguucaacauuuuuaccaagaagcagcuccagcucaaucagacgucgcauuacuuagauucguuaauccagauacaggacgaguccuauucgagugcaagcuacacaaaucaggauaugucacugucgcacacacaggucaacacgauuuagucauaccuccaaauggauauuuccgauuugauucauggguaaaucaauuuuacacacuagcuccaaugggaaauggaaccggacgaaggagauaa

SEQ ID NO: 33896 - RNA, 1617 nt, Artificial Sequence
  derived and/or modified sequence opt6 from VP1__Norovirus_and/or_Norovirus-like__KR904235
augaaaauggccucaucagacgcaaacccaucagauggaucaacggcaaaccucguccccgaagucaacaaugaaguuauggcccuagaaccaguuguaggugccgcaauagcugcacccgucgcaggacaacaaaaugucauugacccuuggauuagaaacaacuuuguacaagcacccggaggagaauuuacagucucaccacguaaugcaccaggagaaauauuauggucuacaccacuaggacccgauuuaaaccccuaucuaucacacuuagcaagaauguacaacggauaugcaggaggauuugaaguacaaguaauacuagcuggaaacgcauuuacagcaggaaaaauuauauucgcugcaguaccaccuaauuuuccaacagaaggcuuaaguccaucucaaguaacuauguucccacacauuauugucgauguacgacaacuagaaccaguacuaauaccauugccagaugucagaaacaacuuuuaucacuauaaccaauccaacgacccuacaauaaaauuaauagcaaugcucuauacaccauuaagagcaaauaaugccggcgacgacguauuuacaguaaguuguagaguccuaacaagaccuucaccagacuuugacuucaucuuccuaguaccaccaacuguagaauccagaacuaaacccuucucaguuccaguacuaacaguagaagaaaugacaaacucuagauuucccaucccacucgagaaacuauuuacaggaccuucuagcgcuuuuguuguacaaccacaaaauggaagaugcacaacagauggcguacuacuaggcacaacacaauuauccccuguuaauauauguacuuuccgaggugacguaacacacauuucagguucacgcaauuauaccaugaauuuagcaagccaaaacuggaacucuuacgauccuacagaagaaauuccugcaccccuagguacaccagacuuuguaggaaaaauccaaggaguauuaacacaaaccacaagaacagaugguucaacaagaggacacaaagccacaguauauacagguucagccgacuucucaccaaaauuaggaagaguacaauucgcaaccgauacugauaacgauuuugaaaccaaucaaaauacuaaauucacaccaguuggaguaauacaagacggauccacaacucauagaaaugaaccucaacaauggguucuaccaucauauucuggccgaaauacacauaauguacaucuagcaccagcugucgcuccuacauuucccggugaacaacuauuauucuuucgaucaacaaugccagguugcucugguuacccuaauauggaucucgauuguuuacuaccacaagaauggguacaauauuuuuaucaagaagcagcaccagcacaaucugacgucgcucuuuuaagauuuguaaauccugacaccgguagagucuuauuugaaugcaaacuacauaaaaguggauauguuacuguagcacauacaggacaacaugacuuaguuauuccuccaaauggauacuuuagauuugauucauggguaaaucaauuuuacacauuagcacccaugggcaauggcacaggccgaagaagauaa

SEQ ID NO: 33897 - RNA, 1617 nt, Artificial Sequence
  derived and/or modified sequence opt6 from VP1__Norovirus_and/or_Norovirus-like__AB933753
augaaaauggcaucaucagaugcuaauccaucagauggauccaccgcaaaccuaguucccgaaguaaacaaugaaguaauggcacuagaaccaguaguaggugcagcuauagcagcaccaguagcaggacaacaaaauguaauagaucccuggauacguaacaauuucguacaagccccaggaggagaauuuaccguaucaccaagaaaugccccuggcgaaauucucugguccgcaccauuaggucccgaucuuaauccauaucuaucccacuuagcccgaauguacaacggauacgccggaggauucgaaguccaaguuauuuuagcaggaaacgcuuuuacagccggaaaaauaauauuugcagcuguaccaccaaauuucccaacagaaggacuauccccaucacaagucaccauguucccacacauaauugucgauguaagacaacuagaaccagucuuaauaccauuaccagacguccguaauaauuuuuaucacuauaaccaaucaaaugacccaacaauaaaauuaauagcuaugcuuuauacuccauuaagagcaaauaaugcaggagacgacguuuuuacaguaucauguagaguacucacuagaccaucaccugacuuugacuuuauauuuuuaguaccaccuacaguagaaucuagaacaaaaccauucucuguaccuauacuuacagucgaagaaaugacaaauucaagauuuccuauaccuuuagaaaaauuauuuacagguccuaguucaacauuuguuguccaaccacaaaauggacgaugcacaacagacggaguacuccuaggaacaacacaauuaucaccuguaaauauauguaccuuucgcggagacguaacacauauagcuggaucuagaaacuacacuaugaaccuagcaucacaaaacuggaacucauacgauccaacugaagaaauaccugccccacuuggaacaccagacuuugucggcaaaauucaagguguuuuaacacaaacaacaagaacagaugguaguacaagaggacacaaagcaacaguuuauacaggaucagcagauuucagcccaaaauuaggaagaguacaauuugcuaccgacacugauaaugauuuugacgcaaaucaaaauacaaaauucacaccuguuggaguaauacaagacgguggcacagcucauagaaacgaaccucaacaauggguuuuaccaucuuauucaggucgaaauacucauaacguacaccuagcaccagcaguggcaccuacauuuccaggagaacaacuacuauucuuucgaucaacuaugccaggcuguucaggauauccaaauauggauuuagauugcuuauuaccacaagaauggguccaauauuuuuaucaagaagcagcucccgcacaauccgacguagcauuacuccgauucguaaacccagauacaggaagagucuuauuugaaugcaaauuacauaaaucaggauauguaacaguugcacauacaggacaacacgaccuaguaaucccaccuaauggauauuuuagauuugauucauggguaaaucaauucuauacuuuagcacccauggguaauggaacaggaagaagaagauaa

SEQ ID NO: 33898 - RNA, 1617 nt, Artificial Sequence
  derived and/or modified sequence opt6 from VP1__Norovirus_and/or_Norovirus-like__AB933721
augaaaauggcaucaaaugaugccaacccaucagauggaucugcugcaaacuuaguaccugaaguaaauaaugaaguuauggcccuagaaccagucguaggugcugccauagcagcaccaguagcaggccaacaaaacguaauugaccccuggauaagaaauaauuuuguacaagcuccuggcggagaauuuacuguaucaccucgaaacgcaccaggagaaauacuauggucagcaccccuaggaccagaucuaaaucccuauuuaucacaucuagcacguauguacaauggcuaugcaggaggauucgaaguccaaguaauacuagcagguaacgcauuuaccgcuggaaaaauuauauucgcagcagucccuccaaacuuuccaacagaaggauuaucaccaucucaaguuacuauguucccacauauaauaguagauguaagacaauuagaacccguacuaauaccauuaccagauguaagaaacaauuucuaucacuauaaccaauccaacgacucuaccauaaaacuaaucgcaaugcuuuauacucccuuacgagccaauaaugcuggugaggacguauuuacuguaagcugcagaguacuaacaagaccgucacccgauuuugauuuuauauuucuuguaccaccaacaguagaaaguagaacuaaacccuuuacagucccaguacuaaccguagaagaaaugacaaauuccagauucccaauaccauuagaaaaacuuuuuaccggcccaucaagugcauucguaguccaaccacaaaaugguagauguacaacugauggcguacuauuaggcacaacacaacuuucaccagucaauauauguacauuuagaggugaugucacacacauagcaggauccagaaauuauacaaugaaucucgcaucccuaaacuggaacaauuacgauccaacagaagaaauacccgcuccacuaggcacaccugacuucguaggaaaaauccaagguauguuaacacaaaccacaaaaggagacggauccacaagaggucacaaagcuacaguauauaccggauccgccccauucacaccaaaacuuggaucaguccaauucucuacagauacagaaaaugauuucgaaacacaucaaaauacuaaauuuaccccaguaggaguaauacaagacggaucaaccacacaucgcaacgaaccucaacaauggguucucccuuccuacagcggaagaaacguucccaauguucaccuagcacccgcuguagcccccacauucccaggugaacaacuauuauucuuuagaucuaccaugcccggaugcucaggcuauccaaauauggauuuagauugccuauuaccacaagaauggguucaacauuuuuaucaagaagccgccccagcccaaucugacguagcuuuauuacgauucgucaacccagacacagguagaguucuuuucgaaugcaaauuacacaaaucaggauacgucacaguagcacacacaggccaacacgaucuaguuauaccaccaaauggauacuucagauuugauucauggguaaaucaauuuuauacacuagcacccauggguaaugguacaggccgacgaagauaa

SEQ ID NO: 33899 - RNA, 1617 nt, Artificial Sequence
  derived and/or modified sequence opt6 from VP1__Norovirus_and/or_Norovirus-like__AB933706
augaagauggcaucaaaugaugcuaacccuucugaugguucugcagcaaacuuaguaccagaaguaaacaacgaaguuauggcucuagaaccaguaguaggcgcagcaaucgcagccccagucgcaggacaacaaaaugucaucgauccauggauacgaaauaauuuuguacaggcuccaggcggagaauuuacaguaagcccacgaaaugcacccggcgaaauccuauggagugccccauuaggaccagauuuaaauccauaucucucccaccuagcaagaauguauaacggauacgcaggaggauuugaaguacaagucauacuagccggaaaugcauuuacugcaggcaaaauaauauucgcugcuguaccaccuaacuucccuacagaagguuuaucaccaagccaagucacaauguucccacauauaauaguagacguaagacaacuugaaccaguauuaaucccacuccccgauguuagaaacaauuuuuaucauuauaaucaaucaaacgacuccacaauaaaacucaucgcuauguuauauacaccuuuaagagccaacaaugccggugaagauguauuuacaguaucauguagaguucucacacguccaucaccugauuuugacuuuauauuccuuguaccaccuacaguagaaucaagaacaaaaccauucacuguaccuauacucacaguagaagaaaugacuaauucccguuuucccauaccccuugaaaaauuauuuacaggaccuaguucugcauuuguaguacaaccacaaaacgguagaugcacaacagacggacuauuacuaggaacaacacaauuaucaccuguaaauauauguacauuucgcggagacgucacacauauugcagguuccagaaacuauacaaugaaucuagcaucauuaaacuggaauaauuaugacccaacagaagaaaucccagcaccucuuggcacaccagacuuuguaggcaaaauacaagguaugcucacacaaaccacuaaaggugauggauccacacgaggucauaaagcaacuguauacacaggaucagcaccauucacaccuaaacuaggaucaguacaauucucgacagacacagaaaacgauuucgaaacucaucagaacacaaaauuuaccccaguaggaguaauacaagacgguagcacuacucauagaaacgaaccccaacaauggguucuacccucauacucaggcagaaauguaccaaacguacauuuagcaccagcaguagcuccaaccuuuccaggugaacaacuacucuucuucagaucuacaaugccaggcuguucaggauauccaaauauggauuuagauugucuuuuaccacaagaauggguucaacacuucuaucaagaagcagcuccagcucaaucagacguagcauuauuaagauucguaaacccugacacuggccgaguccuauuugaaugcaaacuacacaaaucaggauauguaacuguagcccauacaggacaacaugauuuaguaauaccaccaaacggauacuuuagauucgacucauggguaaaucaguuuuauacauuagcaccaauggguaacggaacaggacgcagaagauaa

SEQ ID NO: 33900 - RNA, 1617 nt, Artificial Sequence
  derived and/or modified sequence opt6 from VP1__Norovirus_and/or_Norovirus-like__AB933669
augaaaauggcauccaaugaugcaacagcaucugaugguucagcagcaaacuuaguaccugaaguaaauaacgaaguuauggcacuagaaccaguagucggagccgccauugcugccccaguagccggacaacaaaauguaauagacccauggauaagaaacaacuucguacaagccccaggaggggaauuuacaguuucaccacgaaaugcaccaggagaaauccuauggucagccccucuaggcccagaucuaaaucccuaucuaucacaccuagcaagaauguauaacggguacgcuggugguuuugaagugcaagucauuuuagcaggaaacgcuuucacagcaggaaaaauaauuuucgcagcugucccaccaaauuuuccaauagaaggacuauccccaucacaaguaaccauguucccccauauuauaguagacguuagacaacuagaaccagucuuaauacccuuacccgauguacgaaauaauuuuuaccacuauaaccaaucaaaugacucaacaauaaaacuaauagcaauguuauacacuccauuaagagcaaauaaugcuggugaagauguauuuacaguaucauguagaguucuaacaagaccaucaccagacuuugacuucauauuucuaguacccccaaccguugaauccagaacuaaacccuuuacaguaccaaucuuaaccguagaagaaaugacaaacucaagauuuccuauuccacuagaaaaacuauucaccggaccaucuucagcauuugucguacaaccacaaaauggaagaugcaccaccgacggaguacuauuagguaccacacaauuaucaccuguaaacauauguacauucagaggugauguuacucacauagcagguuccagaaauuacacaaugaauuuagcaucauuaaacuggaacaacuaugacccuaccgaagaaauuccagcaccauuaggaaccccagacuuuguaggaaaaauacaaggaguacuuacucaaaccacaaaaggugacgguucaacacgaggacacaaagcaacagucuauacuggauccgcaccauucacuccaaaacuugguucaguacaauuuucaacagauacugaaaacgacuucgaaacacaucaaaauacaaaauucacaccagucgguguaauccaagauggugguacaacacauagaaaugaaccacaacaaugggucuuaccaucauauucagguagaaauguuccaaauguucaucuagcuccugcaguagcuccaacauuuccuggagaacaacuuuuauucuuucgaaguacaaugccaggaugcucaggauauccaaacauggaccuagauugcuuacuuccacaagaauggguacaacauuuuuaucaagaagccgcaccagcacaaucagacguagcacuuuuaagauuuguaaauccagauaccggaagaguacuauucgaaugcaaauuacacaaaucagguuacguaacgguagcucauacaggacaacacgaucucgucauaccacccaauggauauuucagauucgauucuuggguaaaucaauuuuauacacuagcuccaaugggaaauggcacuggaagaagacgauaa

SEQ ID NO: 33901 - RNA, 1617 nt, Artificial Sequence
  derived and/or modified sequence opt6 from VP1__Norovirus_and/or_Norovirus-like__EU921350
augaaaauggccucuucagacgcuaauccuucugaugguucuaccgccaauuuaguacccgaaguuaauaaugaaguuauggcauuagaaccaguaguuggugcagcaauagcagcaccuguagcaggacaacaaaacgucauagauccauggauaagaaauaacuuuguucaggccccaggaggagaauuuacuguuucaccaagaaaugcaccuggagaaaucuuauggucagcaccuuuaggaccagaucuaaacccuuauuuaucacacuuagcaagaauguauaauggauaugccggaggauuugaaguacaaguuauacuagcaggaaacgcauuuacagcaggaaaaaucaucuuugcagcagugccaccuaauuuccccacagaaggacucucaccuucacaaguuacaauguuuccccauauaauaguagacguaagacaacuagaaccaguauuaauaccacuucccgauguaagaaauaauuucuaucacuauaaucaaucaaaugacccaacaauaaaauuaauagcaaugcuauacacaccacuuagagcaaauaaugcaggagacgauguuuuuaccguaagcuguagaguccuaacccgaccuucaccagacuucgacuuuauauuucuaguuccaccaacaguugaaucaagaacuaaaccauucucaguaccaauacucacagucgaagaaaugacaaauuccagauuuccaauaccauuagaaaaauuauuuacagguccaucaucagcauuuguaguucaaccucaaaacggacgauguacuacagacggaguauuacuugguacgacucaacuuagcccaguaaauauauguacauuucgaggagauguaacucauauagcaggaacacaagaauacacaaugaaucuagcaucacaaaacuggaacaacuaugauccuacagaagaaauaccagccccucuagguacaccugauuuuguaggaaaaauacaaggcguauuaacacaaacaacaagacgagauggaucaaccagaggacacaaagccacuguaucuacaggaucaguacacuuuacaccaaaauuaggaagaauccaauucucuaccgacacaucuaaugauuucgaaacaggacaaaauacacgauuuacacccgucggagucguccaagauggcuccacaacccaucaaaacgaaccccaacaaugggcacuaccagauuacucuggaagagacucccauaauguucacuuagcaccagcaguugcuccaucauuucccggagaacaacuacuauucuuucgauccacuaugcccgguugcucaggcuacccaaacaugaaucuugauugcuuacuuccacaagaauggguacaacacuuuuaucaagaagcugcaccagcacaaagugauguagcacuucuacgauuugucaauccugauacuggacgaguucuuuuugaauguaaauuacacaaaucagguuacguaaccgucgcgcauacuggccaacacgauuuaguaauuccacccaacggauauuuuagauucgauuccuggguaaaucaauuuuacacucuugcaccaaugggaaacggaacaggcagacgaagauaa

SEQ ID NO: 33902 - RNA, 1617 nt, Artificial Sequence
  derived and/or modified sequence opt6 from VP1__Norovirus_and/or_Norovirus-like__LC005712
augaaaauggcuucaaaugaugcaaacccuuccgauggcucagccgcaaaccuagucccagaagucaacaaugaaguuauggcucuugaaccaguaguaggugcagcaauagcugcuccaguugcaggacaacaaaacguaauagauccauggaucagaaauaauuucguccaagcucccggaggggaauuuacaguaucaccaagaaaugcuccaggugaaauauuauggucagcaccacuaggacccgaucuaaaucccuacuuaucacauuuagcaagaauguauaacggcuacgcuggaggauucgaaguacaaguaauucucgcagguaacgccuuuacagcaggaaaaauaaucuuugcagcaguacccccuaauuuuccaacagaaggucuaucucccucucaaguaacaauguucccucauauaauagucgacguuagacaacuagaaccagucuuaauaccucuuccagauguaagaaacaauuucuaccacuauaaccaaaguaaugauucaacaauuaaauuaauagcuauguuauacacaccccuacgugcuaacaaugcuggagaagauguauuuacaguaagcugcagaguacuaacucgaccauccccugacuuugacuucauauuucucguaccaccaacaguugaaaguagaacaaaaccauuuacaguaccaauauuaacaguagaagaaaugacaaacucaagauuuccaauaccauuagaaaaauuauuuacagguccaucauccgcauucguaguccaaccucaaaauggcagauguacuacagacgguguauuacuuggaacuacccaauuaucuccaguuaauauaugcaccuuuagaggagauguaacacauauagccggaucaagaaacuauacaaugaaccucgcuucacuuaacuggaacaacuaugaucccacagaagaaauaccugcaccauuaggcaccccagacuuuguuggaaagauacaaggagucuuaacacaaacuacaaaaggcgacggaucuacaagaggccauaaagccacaauauauacaggaucagcacccuucacaccaaaacuuggauccguacaauucucaacagauacagaaaaugauuuugaaacacaucaaaauacaaaauuuacucccguuggagucauacaagacggcggcacaacccauagaaaugaaccacaacaauggguauuaccauccuauucaggcagagacguuccuaauguucauuuagcuccugcaguugcaccuacauuuccaggagaacaauuacucuucuuucgcucaacaaugccaggcuguucaggauaccccaauauggauuuagauugcuuacucccucaagaauggguucaacacuucuaccaagaagcugcacccgcacaaucagauguagcccuacuccgcuucguaaacccugacacaggaagaguacuauucgaauguaaauuacauaaaucaggauauguaacagucgcucauacuggccaacaugacuuaguaauaccaccuaacgguuauuucagauucgauucauggguaaaccaauuuuacacacucgcuccaaugggaaauggcacaggaagaagacgcuaa

SEQ ID NO: 33903 - RNA, 1617 nt, Artificial Sequence
  derived and/or modified sequence opt6 from VP1__Norovirus_and/or_Norovirus-like__LC018707
augaaaauggccuccagugacgcuaacccaucagauggcucugcagcaaaccucguucccgaaguuaauaacgaaguuauggcacuagaaccaguaguaggagcagcaauagccgccccaguagcuggccaacaaaacgucauagacccauggauaagaaauaauuuuguacaagcaccugguggagaauuuacaguaucaccacgaaaugcacccggagaaauauuauggucugccccacuaggaccagauuuaaaucccuaucuaucacaucuagccagaauguacaacggauacgcaggaggauucgaaguccaagucaucuuagcaggaaaugcuuuuacagcaggaaaaguaauauuugcugcaguacccccuaacuucccuacugaaggauuaucaccaagccaaguaacaauguucccacacauaguaguagacguuagacaauuagaaccuguucuuaucccuuuacccgauguaagaaacaacuuuuaucauuauaaucaaucaaacgauccuacaauuaaacuaauagcaauguuauauacaccacuaagagcaaauaaugcuggcgacgaugucuuuacagucaguugucgagucuuaacaagaccuucgcccgacuucgacuuuauauuucucguaccaccaacaguugaaucaagaacuaaaccauucucaguaccaguauuaacaguugaagaaaugaccaauuccagauucccaaucccccuagaaaaacuauucacaggaccaaguucagcuuucguaguacaaccccaaaauggaagauguacaacugacggaguauuacuaggaacaacucaauuaucaccaguaaauauauguacauuuagaggagauguaacacauauaacaggauccagaaauuacacaaugaaucucgcuucucaaaacuggaacaacuacgauccaacagaagaaauaccagcaccacuaggaaccccugacuuuguaggaaaaauacaaggcguacuaacacaaacaaccagaacagaugguuccacacgaggacacaaagcuacaguauauacaggauccgcaaacuucuccccuaaauuaggcagaguacaauucgaaacagauacagaucacgauuucgaaguaaaucaaaauacaaaauuuacaccaguuggagucauacaagacggaucuaccacacauagaaaugaaccacaacaauggguccuaccuuccuacuccggccguaacacaccaaacguacauuuagcaccagccguagcaccaacauuuccaggcgaacaauuacuauucuuccgcucaacaaugcccggauguucaggauacccaaauauggaucuagauugccuuuuaccacaagaauggguacaauauuucuaucaagaagcagcacccgcacaaucagacguagcauuacuaagauuuguaaacccagauacuggaagaguuuuauucgaaugcaaacuacacaaaucaggauaugucacaguugcacacacaggacaacaugaccuaguaauaccaccgaauggauauuucagauucgacucuuggguaaaccaauuuuauacacuugcaccaaugggaaacggaacaggaagacgacgcuaa

SEQ ID NO: 33904 - RNA, 1617 nt, Artificial Sequence
  derived and/or modified sequence opt6 from VP1__Norovirus_and/or_Norovirus-like__KM982955
augaaaauggcaucuucagaugcaacacccuccgaugguucagcagccaacuuaguacccgaaguuaauaaugaaguaauggcauuagaaccaguuguuggugcagcuauagcagcaccaguagccggucaacaaaaugucauagauccauggauacgaaauaauuuuguccaggcaccaggaggagaauuuaccguauccccaagaaaugcuccaggcgaaauuuuauggucagcaccucuaggaccagacuuaaacccauaucuaucccaucuagcgagaauguauaacggauacgccggaggauuugaaguacaaguaauuuuagccggaaaugccuuuacagcaggaaaaguaaucuuugcagcagucccaccuaauuuucccacugaaggacuuucaccaucucaagucacaauguuuccccauauaguaguugauguaagacaauuagaaccuguacuaauucccuuaccugauguaagaaauaauuucuaucacuauaaucaaagcaaugauccaacaauaaaauuaauagcaaugcuauauacaccacuaagagcaaauaacgcaggagacgacguauucacaguuucaugcaggguacuaacuagaccaucuccagauuucgacuuuauauuccuaguaccucccacaguugaaucccgaaccaaaccauuuucaguacccguuuuaacaguagaagaaaugacuaauuccagauuuccaauaccauuagaaaaauuauuuacaggaccaucaucagcauuuguaguacaaccacaaaaugguagauguacaacugacggaguacuauuaggaacaacacaacuaucaccaguuaauauauguacauuucgaggugauguaacccauaucacuggcucccacaacuacacaaugaaccucgcaucacaaaacuggaauaauuaugacccaacagaagaaauaccagcaccacuaggaacaccagauuuuguaggaaaaauacaaggaguacuuacacaaacaacuagaacugauggaucaacacgcggacacaaagcaacaguauacacaggaucagcugauuucgcuccuaaacucggaagaguacaauucgaaacugacacuaaucacgauuuugaagcaaaucaaaauacaaaauucacaccaguaggaguaauacaagauggaaguacaacacauagaaacgaaccacaacaauggguauuaccaucauauuccggacguaauacacauaauguacacuuagcacccgccguagcuccuacauuuccuggugaacaauuauuauucuucagaucuacgaugcccggauguucaggauauccaaauauggaucuagauugucuccuaccacaagaauggguacaauauuucuaucaagaagcagcaccagcacaaucugauguugcucuauuaagauuuguaaauccagacacuggcagaguucuuuucgaaugcaaacuacauaaaucagguuauguuacaguagcacacacuggacaacacgaccuaguaauuccaccaaacggauacuuuagauuugauucuuggguuaaucaauuuuacacauuagcaccuaugggcaauggcacaggaagaagaagauaa

SEQ ID NO: 33905 - RNA, 1617 nt, Artificial Sequence
  derived and/or modified sequence opt6 from VP1__Norovirus_and/or_Norovirus-like__KM982949
augaaaauggcaucaucagacgcaaauccaucagacggauccgcagccaaucuuguaccagaaguaaacaacgaaguuauggcauuagaacccguagucggagcagcaauugcagcaccaguagccggacaacaaaacgucauagacccauggauucgcaauaauuucguacaagcacccgguggagaauuuacugucucaccaagaaaugcacccggagaaauucuauggucugcuccauuagguccagaucuaaauccauaucucucacaucuagcacgaauguauaauggcuacgccggugguuuugaaguacaaguaauuuuagcaggaaaugccuucacagcaggcaaaguaauauucgcagccguaccaccaaacuucccaacagaaggauuaucaccaucucagguaacaauguucccacauauaguaguugacguaagacaacucgaaccuguauuaauacccuuaccagacguaagaaauaacuuuuaucauuauaaucaaucaaaugacccuacuauaaaauuaaucgcuauguuauauacaccauuacgagcaaacaaugcaggcgaugacguuuuuacuguauccugcagaguauuaacaaggccaucaccagauuucgauuucauuuuccuuguaccaccaacaguagaaucccgaacaaaaccauuuucuguuccaguucuaacaguagaagaaaugacaaauucccgauucccaauaccacuugaaaaacuauuuacaggaccuucaucagcauuuguaguucaaccccaaaauggaagauguacaacagaugggguucuacuagggacuacacaacuaucacccguaaauauuugcacauuuagaggagacauaacucauaucacaggcucacgaaauuacacaaugaaucuugcuucacaaaauuggucaaauuacgauccaacugaagaaauuccagcaccucucggaacuccagauuuuguaggaaaaauucaaggagucuuaacacaaacaacaagaacagauggaucaacacgaggacauaaagcaacaguuuauacaggaagcgccgauuucgcgccuaaacuaggaagaguucaauuuggaacagauacugaucacgauuuugaagcaaaucaaaauacaaaauuuacaccaguaggcguuauucaagauggaucaacaacacauagaaaugaaccacaacaauggguauuaccaucauauucaggaagaaauacuccaaauguccaucucgcaccagcaguagcaccaacauuuccaggcgaacaauuauuauucuuuagaucaacaaugccaggauguuccggauacccuaauauggaucuagauuguuuacuaccacaagaguggguacaauauuuuuaucaagaagcagcuccugcacaaucagacguagcacuacucagauuuguaaaucccgacacaggaagaguauuauuugaauguaaauuacauaaaucuggcuauguaacagucgcacauacaggacaacaugacuuaguaauaccucccaauggauauuuuagauucgacucguggguaaaccaauuuuauacauuagcaccaaugggaaaugguacuggacguagaagauaa

SEQ ID NO: 33906 - RNA, 1617 nt, Artificial Sequence
  derived and/or modified sequence opt6 from VP1__Norovirus_and/or_Norovirus-like__KM406485
augaaaauggccucaaaugacgcaaauccaucugauggaucagcagcaaaccuagucccagaaguaaacaaugaaguaauggcacuagaacccguagucggugccgccaucgcugcaccaguagccggacaacaaaauguaauagacccuuggauacguaauaauuucguacaagcccccggcggagaauuuacaguaucaccaagaaaugcaccuggcgaaauucuauggagugcuccccuaggaccagauuuaaauccauauuuaucacacuuagccagaauguacaauggcuacgcaggaggauucgaaguucaaguaauacucgcaggaaaugcauucacagccggcaaaguaauauucgcagcaguaccaccaaacuuuccaacagaaggacuauccccaucacaaguuacaauguucccacacauaguaguagauguaagacaauuagaaccuguuuuaauaccuuuaccagacguacguaauaauuucuaucauuacaaccaaucaaaugauccuacaauaaaauuaauagccaugcuauacacuccacuacgugccaauaaugccggcgacgacgucuuuacaguaagcugcagaguuuuaacaagacccucaccagauuucgacuucauauuucuagucccaccaacggucgaaucuagaacuaaacccuuuucagucccugucuuaacaguagaagaaaugaccaacucccgauucccuauuccacuagaaaaauuauucacaggaccaucuucugcauuuguuguacaaccucagaacggaagguguacaacugauggaguauuacuaggaacuacacaacuaucaccaguaaauauuugcacauucagaggagauguaacacacauaacaggaucucgaaauuacacaaugaaccuagcaucacaaaauuggaacaauuacgacccaacagaagaaauacccgcaccuuuaggaacaccagacuuuguaggaaaaauucaagguguauuaacccaaacaaccaggacugacggcucaaccagaggacauaaagcaacaguauauacagguucagcagacuuugcaccaaaauuaggaagaguucaauucgaaacagauaccgaccaugauuucgaagcuaaucaaaauacuaaauuuacaccaguaggagucauacaagacggcucaacaacacauagaaaugaaccacaacaauggguuuuaccaucuuacucagguagaaacacaccaaauguccacuuagcaccagcaguagcuccaaccuuuccaggagaacaacuauuauucuuuagaaguacuaugccaggaugcuccggauacccaaacauggaucucgauugucuacuaccgcaagaauggguacaauacuuuuaucaagaagcagcuccugcacaaucagacguagccuuacuaagauuuguaaauccugacacaggaagaguauuauuugaaugcaaacuacauaaaucuggauaugucacaguagcacauacaggacaacacgacuuaguaauacccccuaauggauauuuuagauuugauucauggguaaaucaauuuuauacauuagcuccaauggguaaugguacaggacgaagaagauaa

SEQ ID NO: 33907 - RNA, 1617 nt, Artificial Sequence
  derived and/or modified sequence opt6 from VP1__Norovirus_and/or_Norovirus-like__KM198574
augaaaauggccucaaaugacgcaaacccaucagauggauccgccgcaaacuuaguaccugaaguaucuaaugaaguuauggcacucgaacccguuguaggagccgcaauagcugccccuguagccggacaacaaaacgucauagauccuuggauaagaaauaauuuuguucaagcaccuggaggagaauuuacaguaaguccuagaaacgccccgggagaaauucuauggucagcaccccuaggaccagaucuaaauccuuaucugucacacuuagcaagaauguauaacggcuacgccgguggauucgaaguacaaguuauauuagcaggaaaugcuuuuacugcugguaaaauaauauucgccgccgucccaccaaauuuuccaacagaaggccuaagccccucucaaguuaccauguuuccacacauaauaguagauguaagacaacucgaaccagucuuaauaccacuaccagaugucagaaacaauuucuaucacuauaaccaaacaaaugacucaacaauaaaacugauugccaugcuauacacaccauuacgcgcaaacaacgccggagaagauguuuuuacaguaucauguagaguacuaaccagaccaucaccagauuuugacuucauauuccuaguaccaccaacaguugaaucuagaacaaaaccauucacuguaccaauacuaacugucgaagaaaugacuaauaguagguuuccaauaccuuuagaaaaauuauuuaccggaccuucaggagcauucguaguacaaccacaaaauggacgauguacaacagacggagucuuacucggaacaacccaauuauccccaguaaauauauguacauuccgaggagacguaacacacauagcagguucaagagauuacacaaugaaucuagcaucauuaaauuggaacaacuacgaucccaccgaagaaauaccagcaccacuaggaacaccagacuucguuggaaaaauacaaggcgucuuaacacaaacaacaaaaggagauggaucaacuagaggacacaaagcaacugucuauacaggaucagcaccauuuacacccaaacuaggcucuguacaauucucaacagacaccgaaaacgacuucgaaacacaucaaaauacaaaguucaccccaguuggaguaauucaagacggaggaacuacacacaggaaugaaccacaacaauggguauuaccaagcuacagcggaagagacguucauaacguacauuuagccccagcagucgcuccaacauuuccaggugaacaauuacuauuuuucagaucuacaaugcccgguuguucuggauauccaaacauggaccuagauugucucuuaccccaagaauggguacagcacuuuuaucaggaagcagcacccgcucaauccgacguagcccuacuaagauuuguaaacccagacacaggaagaguuuuauuugaaugcaaauuacauaaaucugguuacguaacaguagcucacacaggacaacaugaccuaguaauaccuccaaauggcuauuuuagauucgauucauggguuaaucaauucuacacguuagcaccuaugggaaauggaacaggacgaagaagauaa

SEQ ID NO: 33908 - RNA, 1617 nt, Artificial Sequence
  derived and/or modified sequence opt6 from VP1__Norovirus_and/or_Norovirus-like__KM198517
augaaaauggcuuccaaugaugcuaacccuucagauggauccgcagcaaaccuaguaccugaaguaaguaaugaagucauggcacuagaaccaguaguuggcgccgcaauagcagcaccaguagcaggacaacaaaacguuauagauccauggauuagaaauaacuucguucaagcaccagguggagaauuuacugucucaccaagaaacgccccaggagagauucuauggucagcaccauuaggaccugauuuaaauccauacuuaucucauuuagcacgaauguauaauggauacgcaggaggauucgaaguacaaguaauccuagcgggaaaugcauucacagcgggaaaaaucauuuucgcagcaguuccgccaaacuuucccacagaaggauuaucaccaucucaaguaacaauguuuccucauauuauaguagaugucagacaauuagaacccguccuuauaccacuaccagauguaaggaauaauuucuaccacuacaaucaaaucaaugacccaacaauaaaauuaauagcaauguuauacacacccuuaagagcaaacaaugcuggugaagauguauucacagucaguuguagaguacucacucguccaucaccagauuuugacuuuaucuucuuaguaccacccacagucgaaaguagaacaaaaccauucacagucccaauacuaacaguagaagaaaugacuaacucaagauuccccauaccgcuagaaaaacuauucacaggacccuccggcgcuuuuguaguacaaccacaaaacgguagauguacuacagacggcguauuacuaggaacaacacaauuaucaccaguaaauauauguacauuuagaggcgacguaacucauaucgccggcucuagaaauuacacuaugaaccuagcaucacuaaacuggaacaauuacgauccuacagaagaaauaccagcaccucuaggcacuccagauuucgucgguaaaauacaaggagucuugacccaaacaacuaaaggagaugguucaacaagaggucacaaagcaacaguauauaccggcucagcaccuuucacuccaaaacuaggaucuguacaauucucuacagacacugaaaacgauuuugaaacacaucaaaauacaaaauucacaccaguuggaguaauacaagauggaucuacaacacacagaaacgaaccacaacaauggguuuuaccaucguauucaggaagagacauucauaacguucauuuagccccagcaguagccccaacauuuccaggagaacaacuauuauucuuuagaucaacaaugccaggcuguuccggcuauccaaacauggauuuagauugucuauuaccucaagaauggguucaacauuuuuaucaagaagcagcaccagcacaaucagacguagccuuacuacgauuuguuaacccagacacaggaagaguauuauuugaauguaaacuucauaaaucagguuauguuacaguagcacauacaggucaacacgaucuagucauaccacccaauggauauuucagauuugauucauggguaaaucaauuuuacacuuuagcaccaaugggaaauggaacaggaagaagacgauaa

SEQ ID NO: 33909 - RNA, 1617 nt, Artificial Sequence
  derived and/or modified sequence opt6 from VP1__Norovirus_and/or_Norovirus-like__JX439839
augaaaauggcaaguucagacgcaaacccuucagaugguagcgcagcaaacuuaguacccgaagucaacaaugaaguaauggcccuagaaccagucgucggugcagccauagcagcaccaguagcaggacaacaaaauguaauagauccauggauaagaaacaacuuuguacaagcaccaggcggagaauuuacaguaagcccaaggaaugcaccaggagaaauauuauggucagcaccauuaggaccugaucuaaacccauacuuaucccauuuagcuagaauguauaacggauacgcaggagguuuugaaguacaaguaauacuagcagguaacgccuuuacagcaggaaaaauaauauucgcagccguaccacccaacuuuccaacagaaggauuaucacccucucaagucaccauguuuccacauauaauaguagacgucagacaacuagaaccaguacuaauucccuuaccugauguuagaaauaauuuuuaucacuacaaccaauccaaugacuccaccauaaaauuaaucgccauguuauacacuccauuaagagcaaauaaugccggugaagauguauuuacaguauccugccgaguccuaaccaggccaucacccgacuucgacuucaucuuccuaguaccaccaacaguugaaucaagaacaaaaccuuuuacaguaccaauacuaaccguagaagaaaugaccaacucaagauuuccaauaccacucgaaaaauuauuuacuggaccaucaucugcauucguuguacaaccacaaaacggcagauguacaacagauggaguacuuuuaggaacaacccaauuaaguccaguaaauauaugcacauuuagaggagacguaacacauauagcaggaucacacaauuacacaaugaaucuagcaagccuaaacuggaacaauuacgaucccacagaagaaauacccgccccacuaggaaccccagacuuugucggaaaaauacaaggaguauuaacacaaacaacaaaaggagaugguucaaccagaggccacaaagcaacuguuuauacuggaagugccccauucaccccuaaacuaggaucuguacaauucucuacagauacugaaaaugauuucgaaacccaucaaaauaccaaauucacaccuguaggaguuauacaagauggaggaacaacucaccgaaaugaaccacaacaauggguccucccauccuauucagguagaaaugucccaaauguacacuuagcaccagcaguagcucccacauuuccuggagaacaauuauuguucuuuaggucaacuaugccaggaugcucaggauauccaaauauggaucuagacuguuuacuuccucaagaauggguacaacacuuuuaucaagaagcagcaccggcacaaucagacguagcacuacuaagauuugucaacccagauacagguagaguacuuuucgaaugcaaacuacauaaaucuggauaugucaccguagcccacacaggucaacacgaucuaguaauaccaccaaacggauacuuuagauucgauucauggguaaaucaauucuauacauuagcuccaaugggaaauggcacaggaagaagaagauaa

SEQ ID NO: 33910 - RNA, 1617 nt, Artificial Sequence
  derived and/or modified sequence opt6 from VP1__Norovirus_and/or_Norovirus-like__JX439837
augaaaauggcuucaaacgaugccaacccaucagacggaucaacagcaaacuuagucccagaaguaaauaaugaaguaauggccuuagaaccaguaguuggagcugccauagcugcaccagucgcaggacaacaaaaugucauagacccuuggauacgaaauaauuuuguacaagccccaggaggagaauuuaccguaucuccaagaaaugcaccaggugaaauauuauggucugcuccucucggaccugauuuaaauccuuaucucucacacuuagcaagaauguauaacggauacgcaggaggauucgaaguucagguaauacuagcugguaaugccuuuacagcaggaaaaauaauauuugcagcaguaccucccaauuucccuaccgaaggucuaucaccaucacaaguaacaauguucccacauauaauaguagacguuaggcaauuagaacccguccuaauaccauuaccugacguaagaaauaauuuuuaucauuauaaccaaucuaaugacucuaccauaaaacucauagcuaugcuauacaccccauuacgagcaaacaaugcaggagaagauguauucaccguauccugccgaguauuaacaaggccaagcccagauuucgacuuuauauuuuuaguuccaccaacaguagaaucaagaacuaaaccauucacaguaccuauauuaacaguagaagaaaugacaaauucaagauuccccauaccacuagaaaaacucuuuacuggaccaaguuccgcauuugucguacaaccacaaaacggacgauguaccacagacggaguauuacuuggaacaacccaacuaucuccaguuaauauauguacauuccgaggagauguaacacauauugcaggaucucgaaauuauacaaugaaucuagcaucacuuaauuggaacaauuacgauccaacagaagaaaucccagcaccucuagguacaccagauuuugucggaaaaauacaaggaguacuaacacaaacaacuaaaggagacggaucaacaagaggacacaaagccacaguauauacugguucagcaccuuucacaccaaaauuaggcucaguacaauucuccacagauaccgaaaaugauuucgaaacacaccaaaauaccaaauuuacucccguaggaguuauccaagacggaggaaccacccacagaaaugaaccacaacaauggguauuaccaucuuauucagguagaaauguacaaaacguacaccuagcaccggcaguagcaccuacauuuccaggagaacaacuacuauuuuuccgauccacuaugccuggaugcucaggcuauccaaauauggaccuagauugucuacuaccacaagaauggguccaacauuucuaucaagaagcagcaccagcacaaucagacguagcauuauuacgauucguaaauccagacacgggaagaguauuauucgaaugcaaauuacacaaaucaggauauguaacagucgcacauacuggccaacacgaucuuguaauaccacccaauggauauuuuagauuugauucaugggugaaucaauuuuacacucuagcaccaaugggaaaugguacugguagaagaagauaa

SEQ ID NO: 33911 - RNA, 1617 nt, Artificial Sequence
  derived and/or modified sequence opt6 from VP1__Norovirus_and/or_Norovirus-like__KC631815
augaaaauggcaucaucagacgccaauccaucugauggcucuacagcaaauuuagucccugaaguuaacaaugaaguaauggcccucgaaccaguuguaggagcugcaauugcagccccaguagcaggacaacaaaacgucaucgauccauggauaagaaauaauuuuguacaagccccaggaggagaauuuacaguaucaccuagaaaugcuccaggagaaauacuauggucagccccauuaggaccugaucuaaaucccuacuuaagucacuuagcaagaauguauaauucauaugccggaggauuugaaguacaaguaauauuagcagguaaugccuucacagcuggaaaaauaauauucgccgcaguaccaccaaacuuuccaaccgaaggauuaucaccaucucaaguuacaauguucccacacaucauaguagacguaagacaauuagaaccaguacuaauacccuuaccagaugucagaaacaauuuuuaucauuauaaccaauccaaugauccaacaaucaaauuaauagcaaugcuauacacaccuuuaagagcuaacaaugcaggagaugauguauuuaccguaucaugccgaguauuaacgaggccaucacccgauuuugauuuuauauuuuuaguaccaccaaccguagaaucaagaacaaaacccuucucaguaccuauacuaacaguagaagaaaugacuaauuccagauucccuauuccacuagaaaaauuauuuacaggaccaaguagugcuuuuguuguacaaccucaaaacggacgaugcacaacagauggcguauuacuaggcacaacucaauuauccccaguaaauauauguacauuuaggggcgauguaacacauaucgcaggaacacaagaauacacaaugaacuuggcuucacaaaacuggaacaauuaugacccaacagaagaaauccccgcaccucuaggaacaccugacuuuguaggcaaaauacaaggaguacuaacucaaacaacucgaagagauggaaguacuagaggacacaaagcaacuguaucaacugguucaguucacuuuacucccaaacucggacgaauacaauuuaguaccgauacuucaaacgacuuugaaacaggacaaaauacaagauucacacccguaggagucguucaagaugguucuacuacacaucaaaacgaaccacaacaauggguacuaccuaacuauucaggaagagauucacauaauguccaccuggcuccagcugucgcaccaucauuuccaggagaacaacuguuauucuuuagauccacaaugccuggauguucuggauacccaaauaugaaucuagacugccuauuaccucaagaauggguacaacacuucuaucaagaagcugcuccagcacaaucugacguagcauuacucagauucguaaacccugacacaggacgaguauuauucgaauguaaauuacauaaaucaggauacguaacuguugcucacacaggccaacaugaucuaguuauaccuccaaacgguuauuuucgauuugacucaugggucaaucaauucuacacauuagcaccaaugggaaaugguacaggcagacgacgauaa

SEQ ID NO: 33912 - RNA, 1617 nt, Artificial Sequence
  derived and/or modified sequence opt6 from VP1__Norovirus_and/or_Norovirus-like__KC409315
augaaaauggcuucaaacgaugcaaacccaagcgacggaucugcagcgaaccuuguccccgaaguauccaaugaaguaauggcacuugaaccagucguaggugcugcaauugccgccccaguugcaggacaacaaaauguaauagauccuuggauuagaaauaacuuugugcaagcacccggcggagaauuuacuguaucaccaagaaaugcaccuggcgaaauacuauggagcgcaccucuaggacccgaucuaaauccauauuuaucccauuuagcacgcauguauaacgguuacgcaggagguuucgaaguccaaguuauacuagcuggaaaugcauuuacagcaggaaaaauuauauuugcagcaguaccacccaacuuccccaccgaaggauuaucaccaucacaagucacaauguuuccacacauaauaguagauguacgccaauuagaacccguauuaauuccccuucccgauguacguaacaacuuuuaucacuauaaccaaaccaaugauucaacaauaaaacuaauugcaaugcuauacacaccauuaagagcuaacaaugccggagaagauguauucacuguuuccuguagaguacucacaagacccaguccagauuucgacuuuaucuuccucguacccccuacaguugaaucaagaacuaaaccauucacuguaccaauauuaacaguagaagaaaugacaaacucacgcuuuccaaucccauuagaaaaacuauuuacagguccuuccggugcauuuguaguacaaccacaaaacggaagauguacaacagauggaguacuucuagguaccacucaacuaucaccaguuaauauauguacauuuagaggcgacgucacacauauagcagguucaagaaauuacacaaugaaucuagcuucccuaaacuggaauaauuaugauccaacagaagaaaucccagcaccacucggaacaccugauuucguaggcaaaauacaagguguauugacacaaacuacuaaaggagacggaucaacaagaggccacaaagcaacaguauauacuggcucugccccauuuacaccaaaauuaggaucuguacaauucucaacagauacagaagacgauuuugaaacccaccaaaauacuaaauuuacaccaguaggagucauucaagacggaggaacaacucauagaaacgaaccacaacaauggguauuaccaucuuacuccggccgagacguacauaacguucaucuagccccugcagucgcacccacauuuccaggagaacaauuauuauucuuuagaaguaccaugcccggcugcucuggcuauccaaauauggacuuagauuguuuacuaccucaagaauggguacaacauuucuaccaagaagcagcaccagcccaaagugacguugcacuacuaagauucgucaacccagacacagguagaguccuauuugaauguaaauuacauaaaucaggauacguuacaguagcccacacaggucaacacgauuuaguaauaccaccaaauggauauuuuagauuugauucaugggucaaucaauuuuacacacuagcaccuaugggaaacggaacaggaagacgaagauaa

SEQ ID NO: 33913 - RNA, 1617 nt, Artificial Sequence
  derived and/or modified sequence opt6 from VP1__Norovirus_and/or_Norovirus-like__KC409289
augaaaauggcaaguaaugacgcuaauccaucagauggcucagcagcaaacuuaguucccgaaguaucuaaugaaguaauggcauuagaaccaguuguaggagcagcaauugcagccccaguugcuggccaacaaaauguuaucgauccuuggauaagaaacaauuucguucaagcaccaggaggagaauuuacaguaaguccuagaaaugcuccaggcgaaauacuauggucagcaccauuaggacccgaucuaaauccauaccuaucccacuuagcaagaauguacaacgguuacgcaggcggauucgaaguccaaguaauuuuagccggaaaugcauucaccgcuggaaaaauaauauuugcagcaguuccaccuaacuuuccaacagaaggauuaucuccaucacaaguaacaauguucccacacaucauaguugauguacgccaacuagaaccaguacuaaucccuuuaccugauguacgaaauaauuuuuaucacuauaaccaaacaaaugacccuacaauuaaacuaauagcaaugcucuacacaccacuuagagcuaacaacgcuggugaagaugucuuuacuguaucauguagaguccuaacaagaccuucaccagauuucgacuuuauauuuuuaguuccaccuacaguagaaucuagaacuaaaccauucacgguaccaaucuuaacagucgaagaaaugacaaacucaagauuuccaauuccauuagaaaaacucuuuacagguccaucaggagcauucguaguccaaccacaaaaugguagauguacaaccgacggaguacuuuuagguaccacacaauuaagucccguaaauauauguaccuuucgaggagauguaacucauauagcaggaucuagaaauuacacuaugaacuuagcaucauuaaauuggaauaauuacgaucccacagaagaaguuccagcaccacucggaacaccagacuuugucggaaaaauucaaggugucuuaacacaaacaacaaaaggcgauggaucuacccgaggacacaaagcaacaguuuauacuggaucagcaccauuuacaccaaaauuaggcucaguacaauucucuacugauacagaaaaugauuuugaaacacaucaaaauacaaaauucacaccuguaggcguaauccaagacggaggcacaacacauagaaaugaaccacaacaauggguccuuccaucauauucaggaagagauguacauaacguacaccuagcaccagcagucgcaccuacauuuccaggcgaacaauuauuauuuuucagauccacaaugccaggaugcuccggauauccaaacauggaucucgacugcuuacuaccacaagaauggguucaacauuucuaucaagaagcagcaccagcacaaucagauguagccuuauuaagauuuguuaauccagacacuggaagaguacuauucgaauguaaacuacauaaaaguggauauguaacaguagcacacaccggacaacacgauuuaguaauaccaccaaauggauauuuucgguucgauuccuggguuaaccaauucuauacucuagcuccaauggguaacggaacaggaagaagaagauaa

SEQ ID NO: 33914 - RNA, 1617 nt, Artificial Sequence
  derived and/or modified sequence opt6 from VP1__Norovirus_and/or_Norovirus-like__KC409278
augaaaauggcaagcaaugacgcaaauccguccgacggcucugcugcaaacuuaguaccagaaguaaacaaugaaguuauggcucuagaaccaguaguuggugcagcaauagcagccccagucgcaggacaacaaaacgucauagauccuuggauuagaaauaacuuuguacaagcaccaggaggagaauuuacuguaucaccaagaaaugccccaggagaaauauuauggagcgcuccauuaggaccagauuuaaauccauauuuaucacaccuagcucgaauguauaacggauaugcaggcggauucgaaguacaggucauauuagcaggaaaugcuuuuacagcaggaaaaauaauauucgcagcuguaccacccaacuuuccuacagaaggacuaucacccucucaaguuaccauguucccucacauaauaguugacguucgucaacuagaaccgguauuaauuccucuaccagauguucgaaacaacuucuaucauuauaaccaaucaaacgacucaacaauaaaguuaauagcaauguuauauacaccacuaagagcaaacaaugcaggagaagauguuuucacuguuucaugucgugucuuaacaagaccauccccagacuucgauuuuauuuuucucguaccaccaaccguugaaucaagaacaaaaccauuuaccguaccaauccuaaccguagaagaaaugacuaauucacgauuuccaauuccauuagaaaaacucuuuacaggaccaucaggcgcauuugucguccaaccacaaaacggucgaugcacaacagacggcguuuuacuagguaccacacaacuaucacccgucaauauauguacauuuagaggagauguaacucacauagcugguucaagaaacuauacaaugaaucuagcaucacugaacuggaauaauuacgauccuacagaagaaauaccugcaccuuuaggaacaccugacuuuguaggaaaaauacaagguguauuaacucaaacaacaaaaggcgacggaucaacaagaggacacaaagcaacuguuuacacaggaagcgcaccauucaccccaaaacuaggaucaguccaauucucaacagauacagaaaaugauuucgaagcacaucaaaacacaaaauuuacuccaguuggaguuauucaagauggaggaaccacacauagaaaugaaccacaacaauggguauuaccaucauauucaggaagagacguacacaauguacaccuugcccccgcaguagcaccaaccuuuccaggagaacaauuauuauucuuuagaucaacaaugccaggauguuccggauaucccaauauggaucucgacuguuuacuaccccaagaauggguacaacauuuuuaucaagaagcugcacccgcacaaucugacguugcacuauuacgauucguaaacccagacacuggaagagucuuauuugaaugcaaacuacauaaaucuggcuauguuacuguagcccacacaggacaacaugaucuaguaauaccaccuaacggauacuuuagauuugacuccuggguuaaucaauuuuacacucuagcaccuaugggcaacggcacuggacguagaagauaa

SEQ ID NO: 33915 - RNA, 1617 nt, Artificial Sequence
  derived and/or modified sequence opt6 from VP1__Norovirus_and/or_Norovirus-like__KC175402
augaaaauggcaucaucagacgcaaauccaucagauggaucagcagcgaacuugguaccugaaguuaacaaugaaguaauggcccuagaacccguaguaggugcagcaauagccgcuccaguugcaggccaacaaaauguaauagacccauggauaagaaacaauuuuguucaggcaccaggaggugaauuuacaguaucaccaagaaaugcaccaggugaaauacuuuggucagcaccacuaggaccagauuuaaauccauaucuaucucacuuagccagaauguacaacggauaugcuggaggauuugaaguacaaguaauauuagccggaaaugcauuuacagcaggaaaaauaauauucgcugccguaccaccaaacuuuccaacugaaggauuaucaccaucacaaguaacaauguucccacacauaaucguagacguacgacaauuagaaccaguacuaauaccucuacccgacguuagaaauaauuucuaucacuacaaccaaucuaacgauucaacaauaaaauuaauugcaaugcuauauacaccauuacgagcaaacaaugccggugaagauguauuuacaguauccugcagaguacuaacaagaccaucuccugauuuugauuucaucuuucucguuccucccacaguugaaucaagaacaaaaccauuuacugucccaauauuaacaguagaagaaaugacaaauucaagauuccccauuccauuagaaaaauuauucaccgguccaucuuccgcauucguaguccaaccacaaaacggacgcugcacaacugacggcguauuacucggaaccacacaacugucaccuguaaauaucugcacauuuagaggagacguuacacacauagcaggcucacgaaacuacacaaugaaucuugccucacuuaacuggaacaauuacgacccaacagaagaaaucccagcuccauuaggaaccccagacuucguuggaaaaauucaagguguauuaacacaaacaaccaaaggugauggcucaaccagaggacauaaagcaacuguuuacacaggaucagcaccauuuacaccuaaacuaggaucaguacaauuuucaacagauacagaaaacgauuucgaaacucaucaaaacacaaaauucacucccguuggcguaauacaagauggaucaacuacacaccgaaacgaaccacaacaauggguacuaccuagcuauucaggacgaaauguaccuaacguacauuuagcaccagcaguugcaccaacauucccaggagaacaacuccuauucuuucgaucuacaaugccaggauguuccggauauccaaacauggaucuagacugcuuauuaccacaagaauggguacaacauuuuuaucaagaagcagcucccgcccaaucugacguagcacucuuacguuuuguaaauccugacaccggucgaguccuauuugaaugcaaacuccauaaaucaggauauguaacagucgcccauacaggacaacacgaucuaguaaucccaccaaauggcuacuuccgauucgacucauggguaaaucaauuuuacacacuagcaccaaugggaaauggaacaggcagacggagauaa

SEQ ID NO: 33916 - RNA, 1617 nt, Artificial Sequence
  derived and/or modified sequence opt6 from VP1__Norovirus_and/or_Norovirus-like__JX459616
augaaaauggcaucaaacgaugcaaacccuuccgacggaucggcagcaaacuuaguaccagaaguuaacaaugaaguuauggcauuagaaccaguaguaggagcagcaaucgccgcaccuguagcuggacaacaaaauguaauagauccauggaucagaaauaacuuuguacaagccccaggaggugaauuuaccguaucaccccgaaacgcuccuggagaaaucuuauggucugcaccauuaggcccugaucuaaacccauaccuaucccauuuagcaagaauguacaacgguuaugcaggcgguuucgaaguacaaguaauauuagcuggaaacgcauuuaccgcaggaaaaauaauauucgcagcaguacccccuaauuuuccaacagaaggacuauccccaucucaaguaacgauguucccacacauaauaguagacgucagacaauuagaacccguccuaauaccccucccugauguaagaaacaauuucuaucauuauaaucaaucuaaugacucaacuauaaaauuaaucgcaauguuauauacaccauuaagagcaaauaaugcaggagaagaugucuuuacugucucaugucgaguacucaccagaccaagucccgacuuugacuuuauauuucuagucccucccacaguagaaucuagaacaaaaccauucacaguaccaauuuuaacaguagaagaaaugacaaacucaagauucccaaucccacuugaaaaauuauuuaccggaccaaguggagccuuuguaguacaaccccaaaauggucgauguacaacagacggcguucuacuaggcacaacacaauuaucaccagucaauauaugcacauuuagaggagauguuacccauauagcaggcucuagaaacuacacaaugaauuuagcuucacuuaacuggaacaauuacgauccaaccgaagaaauaccagcuccucuuggaacaccugauuuuguaggaaaaauacaagguguauuaacacaaacaaccaaaggagaugguuccacaagaggacacaaagcaacaguauauacagguagcgcaccauucacccccaaauuaggcucaguacaauuuucuacagacacagaaaacgauuucgaaacccaucaaaauaccaaauuuacaccaguaggcguuauacaagacggaggcacaacucauagaaaugaaccccaacaauggguucuccccucauauuccgguagaaacguacauaauguacacuuagccccugcaguugcacccacauuuccuggagaacaauuacuauucuuucgaagcaccaugccaggauguucaggauauccaaacauggaucucgauugucuauuaccacaagaauggguacaacauuucuaucaagaagcagcaccagcacaaagcgacguagcacuacuacguuucguuaauccagauacaggcagaguauuauucgaauguaaacuacauaaaucuggauauguaaccguugcucacacuggacaacacgauuuaguaauaccaccaaaugguuauuuccgauuugauagcuggguaaaucaauuuuauacuuuagccccaaugggcaauggcacaggacgaagaagauaa

SEQ ID NO: 33917 - RNA, 1617 nt, Artificial Sequence
  derived and/or modified sequence opt6 from VP1__Norovirus_and/or_Norovirus-like__JX459599
augaaaauggcaucaaaugaugcgacaccuucagacggauccacagcaaaucuagucccagaaguaaauaaugaaguaauggcacuagaaccaguaguaggagcagcaauugcagcaccaguagcuggccagcaaaacguaauugaucccuggauacguaauaacuuuguacaagcaccaggaggagaauuuaccguaagcccaagaaacgccccuggagagauauuaugguccgcaccacuaggaccugauuuaaauccauaucuaucucaccuaagcagaauguauaauggcuaugcaggcggauucgaaguacaaguaauacuagcaggcaaugccuuuacagcuggaaaaauaauauuugcagccguacccccaaacuuuccaacugaaggccuaucaccaucacaaguaaccauguucccacacauaauuguagacguuagacaauuagaaccaguauuaauaccauuaccagauguaagaaacaauuucuaucacuauaaucaauccaaugacccuacaauaaaauuaauugcaaugcuauauacuccacuacgugcaaauaaugcuggugaugauguauucacagucuccugucgaguucuaacacguccaagcccugauuucgacuuuaucuuuuuaguuccaccaacuguugaaagccgaacuaaacccuuuucaguaccuauauuaacaguagaagaaaugacuaacucuagguuucccauaccccuagaaaaauuauuuacuggacccucaagcgcauucguaguacagccacaaaauggaagauguaccacugacggaguauuacuuggaacaacacaauuaucaccuguaaauauauguacauuccguggaaauguuacaaauauagcagguucccaaacauacacuaugaaucuagcaucacaaaauuggaacaauuaugauccaacagaagaaauuccagcaccccuaggaaccccagacuuuguaggaagaauacaaggaguauuaacucaaacuacucgaggagacggauccacaagaggucauaaagcaacaguuucaacaggaucagcauacuuuaccccaaaacuuggcucaguacaauucucaaccgacaccaguacagauuucgaaacaggucaaaauacucgcuuuaccccagucggaguaguacaagauggaucaaccacacauaaaaacgaaccacaacaauggguauuacccucauauucaggaagagauucccauaacguacacuuagccccagcaguagcaccaacauuuccaggugaacaaauacuauuuuucagaucaacaaugccagguuguucaggauauccuaauauggacuuagauugccuccuaccccaagaauggguacaacauuuuuaucaagaaucagcaccagcacaaucugacguugcucuauuaagauucguuaacccugacacaggccguguucuauucgaauguaaauuacauaagagugguuaugucacagucgcucacacaggucaacaugaccuaguuauaccaccaaauggauauuuuagauuugauuccuggguaaaucaguuuuacacauuagcaccaaugggaaauggagcaggcagacgaagauaa

SEQ ID NO: 33918 - RNA, 1617 nt, Artificial Sequence
  derived and/or modified sequence opt6 from VP1__Norovirus_and/or_Norovirus-like__JN400603
augaaaauggcgucuaaugacgcaaacccaucagacggcucagcagcaaaccuugucccugaaguaaacaacgaagucauggcccuagaaccagucguuggagcugcaaucgcugcaccagucgcaggccaacaaaacgucauugacccuuggauaagaaauaauuuuguucaagcaccaggaggugaauuuaccguaucaccaagaaacgcuccaggagaaauauuauggucagcaccuuuaggaccugaucuaaauccauaucuaucacauuuagcaagaauguacaacgguuacgcugguggauucgaaguccaaguaauacuagcaggaaaugcauuuacugcaggaaaaauuauauuugcagcaguuccaccaaacuucccaaccgaaggccuuucuccuucucaaguaaccauguucccacauauaauaguagacguuagacaacuagaaccaguuuuaauaccacucccagacguaagaaauaacuucuaucacuacaaucaaucaaaugauucaaccauaaaacuaauagcuauguuauacacaccauuaagagcaaacaaugcaggagaagacgucuucacaguuuccugucgaguauuaacuagaccaucuccagacuucgacuuuauauuucuaguaccacccacaguugaaucaagaacaaaaccauuuaccgucccaauacuaacagucgaagaaaugacaaacucacgauuuccaauaccauuagaaaaacuauuuacaggaccaucaucagcauuuguaguacaaccacaaaacggacgauguaccacugauggaguacuauuaggaacaacucaauuaucaccagucaacauuugcacauuuagaggagacguuacucacauugcuggaucaagaaauuacacaaugaaccuagcuucauuaaacuggaauaacuacgaucccaccgaagaaauacccgcaccauuaggaacuccagauuuuguagguaaaauccaaggcgucuuaacccaaauaacaaaaggagacggaucaacuagaggucacaaagcaacaguuuauacaggaggagcacccuucacaccuaaacuaggaucuguucaauucucaaccgacacagaaaacgacuucgaaacacaucaaaauaccaaauucacaccuguuggcgucauacaagacgguucaacuacacaccgaaaugaaccucaacaauggguucuaccauccuacucaggcagaaauguacauaacguucaccuagcaccagcuguagcaccaacauuuccaggagaacaguuauuauucuuuagaaguacaaugccaggaugcucgggauaucccaacauggacuuagauugccuucuaccucaagaauggguacaacauuuuuaucaagaagcugcaccagcccaaucagacguagcacuuuuaagauuuguaaacccagacacaggaagaguacuuuuugaaugcaaauuacauaaaucagguuacguaaccguagcacacacuggacaacaugauuuaguaauacccccaaauggcuacuucagauucgauucauggguaaaucaauuuuacacccuagcacccauggguaaugguacuggcagaagaagauaa

SEQ ID NO: 33919 - RNA, 1617 nt, Artificial Sequence
  derived and/or modified sequence opt6 from VP1__Norovirus_and/or_Norovirus-like__JQ613572
augaaaauggcaucaaaugacgcaaacccaucagaugggucagccgcuaacuuagucccagaaguaaauaacgaaguaauggcccuugaaccuguaguaggcgcugcaaucgcagcuccaguagcaggccaacaaaacguaauugacccauggauaagaaauaauuuuguucaagcuccuggaggagaauuuacaguuucucccagaaaugccccaggagaaacccuauggucagcaccacucggaccagaucugaauccauaccuaucccaucuagcacgaauguauaauggauaugcaggaggauucgaaguacaaguaauauuagcaggaaaugcauuuaccgcaggaaagauaauauucgccgcaguuccacccaacuuuccaacagaaggacuaucaccaucacaagugacaauguucccacacauaaucgucgauguaagacaacuagaaccuguacuaauaccacuaccagauguaagaaauaauuuuuaccauuauaaccaaucaaacgauucaaccauaaaauuaauagcaaugcucuacacaccauuaagagccaacaaugccggagacgauguauuuacaguaagcuguagaguucuaacuagaccaucacccgauuucgauuuuauauuucuagucccaccaacagucgaaucaagaacuaaacccuuuacaguaccgauuuuaacaguagaagaaaugacuaacucucgauuuccuauaccuuuagaaaaacuuuuuacuggaccaucaucugcauuuguuguucaaccacaaaacgguagauguacaacagacgguguacuauuagguaccacccagcuaucaccuguaaauauauguacauuuagaggagauguaacccauauagcuggaucaagaaauuauacuaugaacuuagcaucauuaaauuggaacaauuaugaucccacagaagaaauuccagcaccacuaggaacaccugacuuuguaggaaaaauacaaggcauguuaacccaaacaacucaaggagaugguuccacaagaggccauaaagcaacuguauauacaggcucagcagacuuuacaccaaaauuaggaucuguacaauucgcaacagauacagaaaaugauuucgaaacacaucaaaauacaaaauucacaccaguuggagucauacaagacgguagcaccacacauagaaaugaaccacaacaaugggccuuaccaucuuauucaggacguucagcacauaauguacauuuagcaccagccguagcaccuaacuuuccaggugaacaacuauuguucuuuagaucaacaaugccaggaugcaguggauacccaaauauggaccuagauugccuauuaccucaagaauggguacaacacuucuaucaagaagcugcaccagcacaaucugauguugcucucuuaagauucguaaaucccgacacaggucgaguuuuauucgaauguaaacuacacaaaucaggauacguaacaguagcucacacaggccaacacgaucuaguaauaccuccaaauggauauuuuagauucgacucuuggguaaaccaauuuuacacacuagcaccaaugggcaauggaacaggaagaagacgcuaa

SEQ ID NO: 33920 - RNA, 1617 nt, Artificial Sequence
  derived and/or modified sequence opt6 from VP1__Norovirus_and/or_Norovirus-like__JQ613525
augaaaauggcaagcaaugacgccaauccgucagacgguucagcagcaaacuuaguuccugaaguaaauaaugaaguaauggcucuagaaccaguaguaggagcagcuauagcagcaccaguagcaggacaacaaaacguaauagacccauggauuaggaauaacuuuguacaagcaccuggaggagaauuuacaguaucaccaagaaaugcaccaggagaaauacuaugguccgcaccauuaggaccagauuuaaauccauauuuaucacacuuagcaagaauguauaacggauacgcaggcggauucgaaguacaaguaauacuagcagguaaugcauuuacagcaggcaaaauaauuuucgcagcaguaccaccaaauuuucccacagaaggacuuucaccaucucaagucacaauguucccccacauaauaguugacguaagacaacuugaaccaguauuaauuccacuuccagacguacgaaauaauuuuuaccauuauaaucaaaguaacgauucaacaaucaaauuaauagcuauguuauacacaccacuaagagccaauaacgcuggugacgaugucuuuaccguaucaugucgaguucuaacucgaccaucaccagacuuugauuucauauucuuaguaccaccaaccguagaaucaagaacaaaaccauucacagucccaauucuaacaguugaagaaaugacaaacaguagauucccaaucccccuagaaaaacuauuuacagguccaucuucugccuucguuguacaaccacaaaacgguagaugcaccacugacggaguauuacuuggaacaacucaauuaucuccgguaaauauaugcacauuucgaggagacguaacacacauagcaggaucaagaaauuacacuaugaaucuugcuucacucaacuggaauaauuacgacccaacagaagagauaccagcuccacuuggcaccccagacuuuguaggcaaaauacaagguguuuuaacacaaacaacaaaaggagacggauccacccgaggccauaaagccacaguuuauacagguuccgcagacuuuaccccaaaauuaggaucaguacaauucucaaccgacacagaaaacgauuuugaaacucaccaaaauacaaaauucacaccaguaggagucauacaagauggaaguacaacacauagaaacgaaccacaacaauggguucuuccaagcuauuccggaagaaauguccacaauguacacuuagcaccagcaguugcacccaauuucccaggagaacaacuacuauucuuuagaucaacaaugccagguuguucaggauaucccaauauggaucuagacugccuacucccccaagaauggguccaacacuuuuaucaagaagcagcuccugcacaaucagauguugcauuauuaagauucguaaauccagacacaggaagaguauuauucgaauguaaacuacauaaaccagguuaugucacuguagcacacacaggccaacaugaccucguaauaccuccaaauggcuacuucagauucgauucauggguaaaucaauucuauacccuagcaccuaugggaaauggagcaggacgaagaagauaa

SEQ ID NO: 33921 - RNA, 1617 nt, Artificial Sequence
  derived and/or modified sequence opt6 from VP1__Norovirus_and/or_Norovirus-like__JQ613510
augaaaauggcaucuaaugacgcuaaucccagcgacggaucagcagcaaacuuagucccagaaguaaacaaugaaguaauggcucuagaaccaguaguaggagcagcuauagcagcaccaguagcaggccaacaaaacguaaucgacccauggauaagaaauaacuucguacaagcuccuggaggagaauuuacagucucaccaagaaaugccccaggagagauacuauggucugcaccauuaggaccagauuuaaauccauaucuaucacaccuagcacgcauguauaacgguuacgcaggaggauucgaaguccaaguaauuuuggcaggaaaugcauucacggcaggcaaaauaauauuugcagcagucccuccaaacuuuccaacagaaggauuaucaccaucacagguaacuauguucccucacauuauaguugacguaagacaauuagaacccguacuuauaccauuaccugauguacgcaauaauuucuaucacuacaaccaauccaaugacucaacaauaaaauuaauagcaaugcuauauacuccacugagagcaaacaaugcaggagaagauguauuuacaguaucaugcagaguuuuaacacgacccucaccagauuuugacuucauauuccuagucccacccacaguagaaucaagaacaaaacccuucacaguaccaauauuaaccguagaagaaaugaccaacucucgauuuccaauaccauuagaaaaacucuuuaccggaccaucaucagccuuuguaguucaaccacaaaacggacgauguacaacagauggcguacuauuagguacaacucaauuaucaccaguaaauauauguacauuuagaggcgauguaacucacauagcaggaucaagaaauuacgcaaugaaucuagcaucauuaaacuggaacaauuaugauccaacagaagaaauaccagcgccacuuggaacaccagacuucguaggaaaaauucaaggucuauuaacacaaaccaccaaaggagacggaucaacacgcggacauaaagcaacaguauacacaggaucagcaccauucacccccaaauuaggcucaguucaauucucuaccgacaccgaaaacgacuuugaaacccaucaaaauaccaaauucacucccguuggaguaauccaagaugguagcacuacacaucgaaaugaaccucaacaauggguacuaccaagcuauucagguagaaacguacauaacguacaccuagcaccagcagucgcaccaacauuucccggagaacaauuacuauucuuuagaucuacaaugccuggaugcuccggauacccaaauauggaccuugauugucuauuaccacaagaauggguacaacauuuuuaucaagaagcagccccugcacaaucagacguugcauuauuacgauuugucaacccagacacagguagaguccucuuugaaugcaaacuacauaaaucaggauacguaacaguugcacacaccggacaacacgauuuaguuauaccaccaaauggcuauuuccgauucgauucuuggguuaaucaauuuuacacacuagccccaaugggaaaugguacagguagaagaagauaa

SEQ ID NO: 33922 - RNA, 1617 nt, Artificial Sequence
  derived and/or modified sequence opt6 from VP1__Norovirus_and/or_Norovirus-like__GQ856450
augaaaauggcauccaacgacgcuaacccaucagaugguucagccgccaaucuuguaccagaaguaaacaaugaaguuauggcauuagagccaguuguuggagcagcuauagcagccccaguagcaggacaacaaaauguaauagacccauggauaagaaauaacuuuguacaagcuccaggaggagaauuuacaguuuccccgagaaaugcaccuggugaaauauuauggucagcaccacuagguccagauuuaaauccauacuuaucacacuuagcaagaauguauaacggauaugcuggaggauucgaaguacaaguaauccuagcagguaaugcaagcacagcaggaaaaauaauauuugcagccguuccuccaaacuuuccaacagaaggucuauccccuucacaagucacaauguuuccacacauuauaguugauguaagacaacuagaaccaguucuaauaccccuaccagauguaagaaacaauuuuuaucacuauaaucaaucaaaugauucaaccaucaaacuaauagccaugcuuuacacaccacuccgagcaaauaaugcaggagaagacguauuuaccguaucuugcagaguacuaacuagaccaucaccugauuucgacuuuauauuccucguaccaccaacaguagaauccaggacaaaaccauucacaguuccuauucuaacaguugaagaaaugacaaacuccagauuccccauaccacuugaaaaauuauuuaccggaccauccucagcauucguuguacaaccccaaaacggaagaugcacuacagauggcguucuauuaggaacaacacaauuaucaccaguaaauaucuguaccuucagaggagacguaacucauauagcaggaacucacaauuacacaaugaaucuagccaguuuaaacuggaauaauuacgauccaaccgaagaaauaccagcaccacuuggaacaccagauuuuguuggaaaaauacaaggaguauuaacacaaacaacaaaaggcgauggcucaacaagaggacacaaagccacugucuauacaggauccgcaccauucacaccaaaacucggaucuguacaauuuucuacagauacagaaaaugacuuugaaacucaucaaaacacaaaauucacuccuguuggcguaauacaagacgguucaacaacucauaggaacgaaccacaacaauggguacucccuaguuauagcggaggaaauguccaaaacguacacuuagcacccgcaguagcaccaacauuuccaggagaacaacuucuauucuuucgaaguacaaugccuggcuguaguggauaccccaauauggacuuagauugucuuuuaccucaagaaugggugcaacauuucuaucaagaagcagcuccugcucaaucugauguagcacuuuuacgcuuuguaaaccccgauacuggaagaguacuauucgaaugcaaacuucauaaaucaggauauguaacaguagcacacaccggucaacacgauuuagucauaccaccaaauggcuauuuccguuuugauucauggguaaaucaauuuuauacacuugcaccuaugggaaacggaacaggucgacgaagauaa

SEQ ID NO: 33923 - RNA, 1617 nt, Artificial Sequence
  derived and/or modified sequence opt6 from VP1__Norovirus_and/or_Norovirus-like__AB541296
augaaaauggccuccaaugacgcaaacccaagugauggaucagcagcuaaucuaguaccugaaguaaauaaugaaguaauggcuuuagaaccaguaguuggagcagcaauagcagccccuguagcaggacaacaaaacguaauugauccuuggauaagaaauaauuucguccaagcacccggaggugaauuuacaguuaguccacguaaugcacccggugaaauacuauggagugcaccucuaggaccagauuuaaauccuuaucuuagucacuuagcaagaauguauaauggauacgcaggagguuucgaaguacaaguaauacuagcagguaaugcauuuacagcuggaaaaauaaucuuugcagcuguacccccuaauuuuccaacagaaggccuaaguccaucacaaguaacaauguuuccccauaucauaguugaugucagacaacuagaaccaguucucauaccauuaccagacgucagaaauaauuucuaucauuauaaccaaaguaaugacucaacaauaaaauuaauagcaauguuguauaccccuuuaagagcaaacaaugccggagaagacguauuuaccguaaguugcagaguauuaacacgaccuuccccagauuuugacuuuaucuuuuuaguaccaccaacaguugaaucacguacaaaaccauucacagucccaauuuuaacaguugaagaaaugacaaacucaagauuuccaauaccacuagaaaaacuuuuuaccggcccaucaggagcauucgucguccaaccacaaaauggcagauguacuacagacggaguccuauuaggcacgacacaauuauccccaguaaauaucuguacauuuagaggagacguaauacauauagccggaucaagaaauuauacaaugaaccuagcagcccuaaacuggaacaacuacgauccaacagaagaaauaccagcacccuuaggcacccccgauuuuguagguaaaauacaaggaguccuaacacaaacaacaaaaggagauggaaguaccagaggccauaaagcaacuguauauacaggaucagcagauuucacaccaaaacuaggaucuguacaauucucaacagauacagaaaacgacuuugaaacacaucaaaauacaaaauuuacaccagucggaguuauucaggacgguucaacuacccacaggaaugaaccacagcaauggguuuuaccaagcuacucaggacgaaacguucauaacguccaccuagcacccgcaguugcuccaacuuuuccaggagaacaauuacuauucuuuagauccacuaugccaggaugcucuggauacccaaauauggaucucgauugcuuacuaccucaagaauggguucaacacuuuuaccaagaagccgcaccagcccaaucagacguagcacuauuaagauucguaaauccagauacaggaagagucuuauuugaauguaaacuacauaaaucuggauauguaacaguagcucacacaggacaacacgaucuaguaaucccgcccaauggcuauuuuagauuugauucauggguuaaucaauuuuacacucucgcacccauggguaaugguacaggaagacgaagauaa

SEQ ID NO: 33924 - RNA, 1617 nt, Artificial Sequence
  derived and/or modified sequence opt6 from VP1__Norovirus_and/or_Norovirus-like__AB541212
augaaaauggcaucaaaugacgccaacccaucagacggaagcgcugcaaacuuagucccagaaguuaacaaugaaguaauggcucuugaaccaguaguaggagcagcaauagccgcuccagucgcuggacaacaaaaugucauagauccauggauaagaaauaauuuuguacaagcacccggaggagaauuuacaguuucaccacguaaugccccaggugaaaucuuaugguccgcaccauuaggaccagauuuaaauccauaucuuucccacuuagcaagaauguauaauggcuaugcuggaggcuuugaaguucaaguaauauuagcagguaaugcauuuaccgcgggaaaaaucauauucgcggcaguaccaccaaacuuuccaacagaaggacuaucaccaucacaaguaacaauguucccacauauaauaguagacguuagacaacuugaaccaguauuaauaccacuaccagacguuaggaacaauuucuaucauuauaaccaaucuaaugacuccacuauaaaacuuaucgcaaugcucuauacaccacuacgagccaauaaugcuggugaagauguauuuacaguuucaugccgaguauuaacuagaccaucaccugauuuugauuuuaucuuccucgucccaccuacuguugaaucacgcaccaaaccauuuacaguaccaauucuaacaguagaagagaugacuaacucuagauuuccaaucccacucgaaaaauuauuuacaggacccucaucagcauucguaguacaaccacaaaacggaagguguacaaccgaugguguauuacuaggaacaacacaacuaucaccaguaaauaucuguacauuucgaggagacguaacacacaucgcaggaucaagagauuacaccaugaauuuagcaucauuaaauuggaauaauuaugaucccacagaagaaaucccagcaccucucggaacaccagauuuuguaggcaaaauacaaggaguacuuacacaaacaacuaaaggagacggaucaaccagaggucauaaagcaacaguuuauacuggcuccgcaccauuuacaccaaaauuaggauccguaagauuuucuacagauacagaaaacgauuuugaaacucaucaaaauacaaaauuuaccccuguaggaguuauacaagacggcucaacaacacauagaaacgaaccccaacaauggguacuaccgucauacucaggccgugacguccauaacguucacuuagcaccagcagucgccccaacuuuuccuggugaacaauuauuauucuucagaaguacaaugccagguugcucagguuauccaaauauggaccuggauugccuauuaccccaagaauggguacaacauuucuaucaagaagcagcuccagcacaaucagacguagcucuuuuaagauucguaaauccugacacagggagaguccuauuugaaugcaaacuacauaaaccuggauacguaacugucgcccacacaggacaacacgaucuaguaauaccucccaauggauauuuuagauuugauucaugggucaaccaauuuuauaccuuagcucccaugggaaaugguacaggaagaagaagauga

SEQ ID NO: 33925 - RNA, 1617 nt, Artificial Sequence
  derived and/or modified sequence opt6 from VP1__Norovirus_and/or_Norovirus-like__AB504321
augaaaauggcuucaaacgaugcaaacccaucagacgguucagcugcaaaccucguacccgaaguaaacaaugaaguuauggcccuagagccaguaguaggugcagcuauagcagcaccaguugcaggacaacaaaauauaauagacccuuggauacgaaauaauuucguacaagcaccaggaggagaauuuacaguaucaccacgaaaugccccaggagaaauauuauggucagcaccuuugggaccagaccuuaauccauaucuuucacaucucgcccgaauguauaauggcuaugcaggagguuucgaaguucaaguaauauuagccgguaaugccuucacugcagguaaaauaauauuugcugcaguaccaccuaauuuuccaacugaagguuuaucaccaucucaaguaacaauguucccacacauaauaguagacguaagacaauuagaacccguccuaauaccuuuaccugauguaagaaacaauuucuaucauuauaaucaaucuaacgauuccaccaucaaauuaaucgcaaugcuauauacaccauuaagagcuaauaaugcaggagaagacguauucacaguuaguuguagaguacuaacaagacccucaccagauuucgauuuuaucuuucuaguaccaccuacaguugaaucaagaacaaaaccauuuacagucccaauauuaacaguagaagaaaugacaaacucuagauuucccauaccacuagaaaaacucuuuacaggaccaucaggagcauucguaguacaaccacaaaacggcagaugcacaacagacggaguuuuacucgguacaacccaacuaucaccaguaaacauauguacauuuagaggagauguaacacauauagcugguaccagaaauuacacaaugaauuuagcuucacuaaacuggaacaauuacgacccaaccgaagaaaucccagccccauuaggaacaccagacuuuguuggaaaaauucaaggaguauuaacucaaaccaccaaaggcgaugguucaacucgaggccauaaagcaacaguauauaccggcucagcaccuuuuacaccaaaauuaggaucaguacaauucaguacagacacagaaaaugauuucgaaacccaucaaaauacaaaauucacaccaguaggaguuauacaagauggaggaacaacccauagaaaugaaccucaacaauggguucuaccaucuuacagcggacgaaauguacauaauguacaccucgccccugcaguagcaccaacauuuccaggagaacaacuacuauucuuccgcuccacuaugcccggauguuccggauacccuaacauggaucuagacugucuacuaccucaagaauggguucaacacuucuaucaagaagccgcaccagcacaaucagacguagcacuaaugcgguucguaaauccagacacaggaagaguauuauucgaauguaaacuucauaaaucaggauacguaacaguagcacacacaggccaacaugaccucguuauaccuccaaauggauauuucagauucgacucauggguaaaccaauuuuacacauuagcuccaauggguaauggcacaggacgacgaagauaa

SEQ ID NO: 33926 - RNA, 1617 nt, Artificial Sequence
  derived and/or modified sequence opt6 from VP1__Norovirus_and/or_Norovirus-like__AB294785
augaaaauggcaagcaaugaugccacaccaucagauggaaguacagcaaaccuaguaccagaaguuaacaaugaaguaauggcacuugaaccaguagucggugccgccauagcagccccaguagcuggacaacaaaauguaauugacccauggauaagaaauaacuuuguccaagcaccaggcggagaauuuacaguaucgccaagaaacgcaccaggagaaauacuauggucagcacccuuagguccagaucuaaauccauaucuuucacauuuagcaaggauguauaaugguuacgcuggaggauucgaaguucaaguaauucuagcaggaaaugcauucacagcaggcaaaaucauauuugcagcaguaccacccaacuuuccaacagaaggauuauccccaucacaagucacaauguucccacauauaauaguagacguacgccaacuagaaccaguccuaauuccacuaccagaugucagaaacaauuuuuaccacuauaaccaaucaaaugacucaacuauaaaauuaauugccaugcuuuauacaccauuacgagcaaauaaugcaggagacgauguauuuaccguaucaugccgaguccuaacaagaccaucaccagacuuugauuuuauauuuuuaguaccaccaaccguagaaucacgaacaaaaccauuuuccguuccaauuuuaaccgucgaagaaaugacaaauucucgauuuccaauacccuuagaaaaauuauuuacuggaccaucauccgccuuuguaguacaaccacaaaacggaagauguaccacugauggaguauuauuaggaaccacacaauuaucuccuguaaacauauguacauuuagaggagacguuacacauauagcuggaacacaaaauuacacuaugaaucucgcaucacaaaauuggaauaauuaugauccaacagaagaaauuccagcaccacuaggaacaccagacuuuguaggaaaaauacaagguguacuaacucaaacaacaagaagagacggauccacaagaggucauaaagcuacaguaucuacaggaagcguucauuuuaccccaaaacuaggaaguguacaauucucuacagacaccucaaaugauuuugaaacaggacaaaauacaagauucaccccagucggcguaguccaagaugguuccacaacccaccaaaaugaaccucaacaauggguacuuccaaacuauucaggccgagacucacauaacguucauuuagccccagcaguagccccuacauuuccaggcgaacaacuacuauucuuuagauccacaaugccugguuguucaggauacccuaacaugaaccuugauugcuuacuaccacaagaauggguacaacauuucuaucaagaaucugcaccagcacaaucugacgucgcauuacuaagauuuguaaacccagauacuggaagaguauuauucgaauguaaacuacacaaaucaggauauguuacuguagcacauacuggacaacaugauuuaguaauaccuccaaaugguuauuucagauucgauaguuggguaaaccaauucuauacauuagcaccaaugggaaacggagcuggaagacgaagguaa

SEQ ID NO: 33927 - RNA, 1617 nt, Artificial Sequence
  derived and/or modified sequence opt6 from VP1__Norovirus_and/or_Norovirus-like__AB294780
augaaaauggcuucaaacgaugcaaauccauccgauggaucaacagcaaaucuuguaccagaagucaauaaugaaguaauggcauuagaaccaguaguaggagcagcaauagcagcacccgucgccggacaacaaaacguaauugauccauggauaagaaauaacuucguacaagcuccagguggagaauuuacagucaguccaagaaacgcaccuggugaaauucuuuggucagcaccucuaggaccugauuuaaacccauaucuaucacaccuugcacgaauguauaacgguuaugcugguggauuugaaguacaagucauacuagcaggcaacgcauucacagcaggcaaaauaauauuugcagcaguaccaccaaauuuuccaacugaaggcuuaucaccaucacaaguaacaauguucccacacauaaucguagauguacgacaacuagagccaguauuaauccccuuacccgacguaagaaacaacuucuaccacuauaaucaaucaaacgauccaacaauaaaauuaauagcuauguuauacacaccauuaagagccaacaaugcuggagaagauguauuuacugucucuuguagaguacuuacaagaccaagcccugacuuugauuuuauauuucuaguacccccaacuguagaaucaagaacaaaaccuuuuacuguaccuauauuaacagucgaagaaaugacuaauucacgauuuccaauuccacuugaaaaacuauuuacaggaccuucuggcgcauucguaguacaaccacaaaaugggagauguacuacagacgguguucuacuuggcacuacucaauuauccccuguuaacauauguacauucagaggagacgugacacacauagcaggaacacauaacuacacuaugaaucuagcaucacaaaauuggaauaacuacgauccaacagaagaaauaccugccccacuaggaacaccagacuuuguagguagaauacaaggaauguuaacacaaacaacuaaaggagacggaucaacacgaggucauaaagccacaguuagcaccggcgacguacauuuuacaccaaaauuaggaagcauacaauucaauacagacacaaacaaugauuucgaaacaggacaaaacaccaaauucacacccguaggugucguacaagacgguaacgguacccaucaaaacgaaccacaacaauggguacuaccgucauauuccggaagaacaggacacaacguccacuuagcacccgcaguugcacccacauuucccggagaacaauuauuauucuuccgaagcaccaugccaggaugcucaggcuauccaaauaugaacuuagauugccuucuaccacaagaauggguacaacacuuuuaccaagaagcugcaccagcacaaagugauguagcauuacucagauucguuaacccagauacagguagaguacuauucgaaugcaaacuacauaaaucagguuacgucacuguagcucauacaggacaacaugaucucguaauaccaccaaauggcuauuuuagauucgauucauggguuaaccaguuuuacaccuuagcaccaauggguaauggcacaggaagacgcagauaa

SEQ ID NO: 33928 - RNA, 1617 nt, Artificial Sequence
  derived and/or modified sequence opt6 from VP1__Norovirus_and/or_Norovirus-like__AB303933
augaaaauggcgucaaaugaugcaacacccucagacgguaguacagcuaaucuaguaccugaaguaaauaacgaaguaauggcauuagaacccguaguaggagccgcaauagcagcaccaguagcaggacaacaaaacgucaucgacccauggauuaggaauaacuuuguucaagcaccagguggagaauuuacaguaucaccaagaaaugcaccaggagaaauacuauggucagccccauuaggaccagauuuaaacccauaucuaucacaccuagcaagaauguauaacgguuacgcgggaggcuuugagguacaaguuauucuagcaggaaacgccuuuacagcugguaaaauaauauucgcugcaguaccaccuaauuuccccacagaaggacuaucaccaagucaaguaacaauguucccccacauuauagucgacguacgucaauuagaaccaguauuaaucccacuaccugauguaagaaauaauuucuaucacuauaaucaaucaaaugacccuacaauaaaacuaauagcaauguuauacacaccauuaagagcaaacaaugcaggagaagaugucuuuaccguuucuugucgaguacuaaccagaccaucaccagauuuugauuuuauauuucuuguaccacccaccguugaaagcagaacuaaaccauucacugucccaauucuaacaguagaagaaaugacaaacucaagauucccaaucccauuagaaaaacuauuuacaggaccaucaggcgcauucguaguacaaccacaaaacggacguugcacaacagacggaguauuacuaggaaccacucaauuaucaccagugaacauauguacauuccgcggugacguaacacauauagcuggaacacacaauuacacaaugaauuuagcaucccaaaacuggaauaacuaugaucccacagaagaaauaccagcuccacuaggaacaccagacuuuguaggaagaauacaagguaugcuaacccaaacaacuagaggagacggcucaacaagaggacauaaagcaacuguaucaacuggagacguacauuucacaccaaaauuaggaagcauacaauuuaauaccgauacuaauaaugauuuugaaacaggucaaaacacaaaauucacaccaguaggaguaguacaagacggaaauggaacacaucaaaaugaaccacaacaauggguuuuaccuucauauucaggaagaacuggacacaacguccaucuugccccugcaguagcaccaacauuuccaggagaacaauuauuauucuuucgauccacuaugcccggaugcuccggauauccaaacaugaauuuagauugucuauuaccccaagaauggguacaacauuuuuaucaagaagcagcaccagcacaaucugacguagcucuacuaagauuuguuaacccagacacaggacgaguacuauuugaaugcaaacuucacaaaucaggauaucuuaccguagcacacacaggacaacacgauuuagucauaccuccaaacggcuacuucagauucgauucaugggucaaccaguucuacacauuagcaccaauggguaauggaaccggaagaagacgauag

SEQ ID NO: 33929 - RNA, 1617 nt, Artificial Sequence
  derived and/or modified sequence opt6 from VP1__Norovirus_and/or_Norovirus-like__AY587988
augaaaauggcuucaaaugaugcaaacccaucagacgguucaaccgcaaauuuaguuccagaaguaaauaaugaaguuauggcuuuagaaccagucguuggagcagcaaucgcugcacccguagcaggacaacaaaauguaauagacccauggauaagaaauaauuucguacaagcaccaggaggagaauuuacuguauccccacgaaacgcaccaggagaaauuuuauggucagcaccauuaggaccugaccuaaauccauaucuuucacacuuagcccgaauguacaacggauacgcaggaggauucgaaguacaaguuauacucgcaggcaaugcauuuacugcuggcaaaauaauauuugcagcaguaccaccaaacuuucccacagaaggacuaucaccaucacaaguaacaauguucccucacauaauaguagacguaagacaauuagaaccaguacuuauaccauuaccugauguaagaaacaacuucuaccauuauaaccaaucuaacgaucccacaauaaaauuaauagcaaugcuuuacacaccacuacgagcaaacaaugcaggagaagaugucuuuacagugucaugcagaguauuaacucgaccaucccccgauuuugauuuuauuuucuuaguaccaccaacaguagaaucaagaacgaaacccuucacagucccaauauuaacuguugaagaaaugacaaacucccgauuuccaauaccacuagaaaaacuauuuaccggaccuaguggagcauucguuguucaaccacaaaauggccgauguacaaccgacggcguauuauuaggaaccacucaacuuucaccuguaaauauaugugcauuucgaggagauguuacacacaucgccggaacacauaauuacaccaugaaccuagcaucacaaaacuggaacaauuacgauccaacagaagaaauuccagccccauuagguacaccagacuucguaggacgaauacaagguauguuaacucaaacaacuagaggagacggaucuacaagaggacauaaagcaacuguuucgacaggagacguccauuucacaccaaaauuaggcuccauacaauucaauacagauacuaacaacgauuucgaaacaggacaaaauaccaaauucaccccaguagguguaguccaagacgguaauggaacgcaccaaaaugaaccccaacaauggguacucccuucauauucaggacgaacaggacauaacguacaucucgcuccugcaguagcaccaaccuucccaggagaacaacucuuauuuuucagaucuacaaugccaggauguuccggcuauccaaauaugaaccuugacugcuuauuaccacaagaauggguacaacauuucuaucaagaagcagcaccagcacaauccgacgucgcacuuuuaagauuugugaauccagauacuggacguguacucuuugaauguaaauuacauaaaacaggauauguuacuguugcacacaccggccaacacgauuuaguaauaccaccaaauggauauuuuagauucgacucuuggguaaaucaauucuacaccuuagcaccaaugggaaacggaacaggaagaagaagauaa

SEQ ID NO: 33930 - RNA, 1617 nt, Artificial Sequence
  derived and/or modified sequence opt6 from VP1__Norovirus_and/or_Norovirus-like__KX354103
augaaaauggcaucaucagacgcaaacccuagugauggaucugcagcaaacuuagucccagaagucaacaaugaaguaauggcauuagaacccgucgucggagcagcaauagcagcucccguagcaggacaacaaaauguaauugaccccuggauaagaaauaacuuuguacaagcaccaggaggagaauuuacuguaucaccccgaaaugccccaggagaaauauuauggucagcaccucuaggaccagaucuaaauccauaccuaagucauuuagcuaggauguauaacggauaugcaggaggauucgaaguacaaguuaucuuagccggcaaugcuuucacugcaggaaaagucauauucgcagcuguaccaccaaauuuuccuacugaaggauuaucgccuucccaaguaacuauguucccucauauuguaguugauguaagacaauuagaaccagucuuaauaccauuaccagauguaagaaacaauuucuaucauuauaaccaaucuaaugacccaacuaucaaauuaauugcaaugcuuuauacuccacuucgugccaacaaugccggagaugacguauucacaguuucuuguagaguauuaacaagaccuucaccugacuuugauuucauauuuuuaguacccccaacaguagaaucccgaacaaaaccauucucaguuccaguuuuaacaguagaagaaaugacuaacucaagauuuccaauaccauuagaaagacuuuuuacaggaccuucauccgcauucguuguacaaccacaaaaugguagauguacaacugacgggguauuacucggaacuacacaacugucaccuguaaauauauguacauuccgaggagacguuacucauauuacaggaucucacaacuacacaaugaacuuagcaagccaaaacuggaacaauuacgauccaacagaagaaauaccagccccauuaggaaccccagauuuugucggaaaaauacaagguguacuaacccaaacaacaagaacagacggaagcacaagaggucauaaagccacaguauauaccggaucagcagaauuugcuccuaaacuaggaagaguacaauucgaaacagacacaaaucaugacuucgaagcaaaucaaaacacaaaauucacaccaguaggcgucauucaagacggcucaaccacacaucgaaaugaaccacaacaauggguacuaccaucuuacucuggacgaaauacacauaacguacaucuugcaccagcagucgccccuacuuucccaggagaacaacuucuauucuuucgaucuacaaugccagguugcucuggcuacccaaauauggaucuagacugucuacucccacaagaauggguccaauacuucuaucaagaagcagccccagcacaaucagacguagcauuacuaagauuuguaaaccccgauacaggucguguacuauucgaauguaaacuacacaaaucaggauauauaacaguagcacacacaggccaacaugaccucgucauucccccuaauggauauuuccguuucgauucauggguaaaucaauuuuacacacuagcaccaaugggaaauggaacugguagaagaagauaa

SEQ ID NO: 33931 - RNA, 1617 nt, Artificial Sequence
  derived and/or modified sequence opt6 from VP1__Norovirus_and/or_Norovirus-like__KX354048
augaaaauggcauccucagaugcaaacccaucugauggaucugcagcuaacuuaguaccagaaguaaauaacgaaguaauggcauuagaaccaguaguaggagcagcaauagcagccccugucgcuggacaacaaaauguaauagacccuuggauacgaaauaacuuuguacaagcaccgggaggagaauuuacagucucaccacgaaaugcccccggugaaauacuaugguccgccccacucggcccugauuuaaaucccuacuuaucacauuuagcaagaauguacaacggauaugcuggcgguuuugaaguccaagugauauuagcuggcaacgcauucacagccggaaaaguaauauuugcagcaguaccaccaaauuuuccaacagaaggccucucaccaucacaaguaacaauguuuccacauauaguaguagacguaagacaacuagaaccaguacuaaucccuuuaccugaugucagaaauaauuuuuaucacuauaaucaaucaaacgacccaacaauaaaacuuauagcuaugcucuacacaccauuacgcgcaaacaaugcaggagaugauguuuuuacaguuucauguagaguuuuaacuagacccucaccagacuuugacuuuauauuccuaguaccuccaacaguagaaucgcgaacuaaaccauuuucaguaccaguacuuacaguagaagaaaugaccaacucaagauuccccauaccacuugaaaaacuauucacaggaccaucgucugcuuuuguuguacaaccucaaaacggaagauguacaacagacggaguacuucuaggaacuacacaauuaucuccaguuaauauuugcacauuccgaggcgacguaacacacauaacaggaucaagaaauuauacaaugaaucuagcaucacaaaacuggaacaauuaugauccaacagaagaaauaccagcaccucuaggaacaccagacuucgucggaaaaauacaaggaguauugacacaaacuacaagaacagacggcucaacacgaggacacaaggcaacaguauauacaggaucagcagacuuugcaccaaaacuuggacgaguucaauuugaaacagauacagaucacgauuucgaagcaaaccaaaauacaaaauuuacaccuguaggcguaauccaagacggcucaacuacacauagaaaugaaccucaacaauggguauuaccuucauauucaggaagaaauacucacaacguacaucuagcaccagcaguagcacccacauucccuggagaacaauuauuauucuuccgaucaaccaugccagguuguucaggauacccaaauaccgaccuagacugcuuacuuccacaagaauggguacaauauuuuuaucaagaagcagcuccagcacagucagauguggcacuauuacgauucgucaacccugacacaggacguguacuauuugaauguaaacuacacaaaucaggcuacguuacuguagcacacacaggccaacacgaucuaguaauaccaccaaauggauacuuccgauucgacucaugggucaaucaauuuuauacucuagcaccaaugggaaauggaacgggacgucgaagauaa

SEQ ID NO: 33932 - RNA, 1617 nt, Artificial Sequence
  derived and/or modified sequence opt6 from VP1__Norovirus_and/or_Norovirus-like__KX354047
augaaaauggccuccucugaugcuucaccauccgacggcucugcagcaaacuuaguacccgaaguaaacaaugaaguaauggcauuagaaccaguuguuggagcagcuauugcagcaccuguagcuggacaacaaaacgucauagauccauggaucagaaacaauuucguacaagcacccggaggagaauuuacaguuuccccucgaaaugccccaggagaaauauuauggucagcaccacuaggaccagaucuaaacccauauuuaucucacuuagcacgcauguauaauggauacgcuggaggauucgaaguccaaguuauauuagcaggaaaugccuucaccgcuggaaagguaauuuucgcagcaguuccaccaaacuuuccaacugaaggauuaucaccuucucaaguaaccauguucccucauaucguaguugacguaaggcaauuagaacccguccucauaccccuuccagauguaagaaacaauuuuuaucacuauaaccaaucaaaugacccaaccauaaaauuaauugcaauguuauacacaccacuaagagcaaauaacgcuggagacgacguauuuacaguaucaugcagaguacuuacaaggccaucaccagauuuugauuuuauuuuucuaguaccacccacuguagaaucacguacaaaaccauuuuccguaccaguuuuaacaguugaagaaaugacaaacucaagauuuccaaucccauuagaaaaacuuuuuacaggaccaaguucagcauuuguaguucaaccccaaaacggaagaugcacaacugauggaguauuacuagguacaacccaacucuccccaguuaauauauguacuuucagaggagauguaacccauauaacaggaucaagaaauuacacaaugaaucuugcuucacaaaacuggaauaauuaugauccaacagaagaaauaccugcaccacuaggcacacccgauuuuguuggaaaaauccaagguguucuaacccaaaccacaagaacagacggcuccacccgaggacauaaagcuacuguuuacaccggaucagcagauuuugcaccaaaacuaggaagaguucaauucgaaacagauacugaucacgacuucgaagccaaucaaaacacuaaauucacacccguaggaguaauucaagacggaucaacuacacauagaaaugaaccacaacaauggguucuaccaucuuauucagguagaaacacacauaauguccaucuugcaccagcaguagccccaaccuuuccaggagaacaacuacucuucuuuagaucaacuaugcccggaugcucaggauacccaaauauggauuuagacuguuuacuaccacaagaauggguacaauauuuuuaccaagaagcagcaccagcucaaucagauguugcauugcuacguuucguaaauccagacacaggacgaguacuauuugaauguaaguuacauaaaucaggcuaugucacaguagcacacacuggacaacaugauuuaguuauaccuccuaauggauacuucagauuugacucauggguaaaucaauuuuauacacuagcacccaugggaaauggagccggacgaagaagauaa

SEQ ID NO: 33933 - RNA, 1617 nt, Artificial Sequence
  derived and/or modified sequence opt6 from VP1__Norovirus_and/or_Norovirus-like__KU985161
augaaaauggcuucuucagaugcaaauccuucugauggauccgcagcuaaccuaguuccagaagucaacaaugaaguuauggcauuagaaccuguuguaggugcugccauagcagcaccaguagcaggacaacaaaauguaauugauccuuggauccgaaauaacuuuguucaagcaccaggaggugaauuuacaguaucuccuagaaaugcaccuggagaaauauuauggucagccccucucggaccagacuuaaauccauaccuaucacaucuagcaagaauguauaauggauacgcugguggcuucgaaguacaaguaauccucgcaggaaaugcauuuacagcuggaaaaguaauuuuugcagcaguucccccaaacuucccaacagaaggauuauccccaagccaaguuacaauguucccacacauaguagucgauguacgccaauuagaaccaguacuaaucccacuacccgauguaagaaauaauuucuaccauuacaaccaaucaaaugacccaacaauaaaacuaauagcuauguuauauacuccacucagagcuaauaaugcuggugacgacguauuuacgguaucauguagaguucuaacaagacccucuccagacuuugacuuuauauuuuuaguuccgccaacaguagaaucuagaacaaaaccauuuuccguaccaguacuuacuguugaagaaaugacuaauucaagauuucccaucccauuagagaaacuauuuacaggaccaucaucagcauucguaguccaaccacaaaacggacgauguacaacagauggcguacuauuaggcacaacacaacuaucaccuguaaauauauguacauuuagaggcgacguaacacauauaaccggaucccauaacuauacaaugaaucuagcaucacaaaauuggaauaauuacgauccaacagaagaaauaccagcaccauuaggaacaccagacuuuguaggaaaaauucaaggcguauuaacacaaaccacaagaaccgacggguccacccgaggacauaaagcaacagucuauacuggaucugcagacuuugcaccaaaauuaggaagaguacaauuugcaacugacacagaucacgauuucgaggcaaaucaaaauacgaaauucacuccaguuggaguaauucaagauggaaguacaacacauagaaaugaaccacaacaauggguccuaccgucuuauucuggacgaaauacacauaacguacaucuugcaccagcaguagcaccaacauuuccaggagaacaacucuuauucuuuagaucaacaaugccaggcugcaguggauacccaaauauggauuuagauugcuuauugccacaagaauggguucaauauuuuuaucaagaagcagcuccagcacaaucagauguugcauuauuaagauuuguaaacccugacacugguagaguauuauuugaauguaaacuucauaaaucaggauacgucacaguagcacacacaggacagcaugaccuaguaauuccuccaaauggauauuuuagauucgauuccugggucaaucaauuuuauacacuagcaccaaugggaaacggcacaggucgaagaagauaa

SEQ ID NO: 33934 - RNA, 1617 nt, Artificial Sequence
  derived and/or modified sequence opt6 from VP1__Norovirus_and/or_Norovirus-like__AB972517
augaaaauggccagcucagaugcaaauccaucugacggaucagcagcuaauuuaguaccugaaguaaacaaugaaguaauggcacuagaaccaguuguaggagcagcaaucgcagcaccaguagcaggccaacaaaauguaauagauccauggauucgaaauaauuucguacaagcuccuggaggagaauuuacaguuucaccacgcaaugcaccaggugaaauauuauggagugcaccacuaggaccagaccucaauccauauuugucacaccuagcaaggauguauaacggauacgccggugguuuugaaguacaagucauacuagcaggaaaugcuuucacagcaggaaaagucauauucgcagccguuccaccaaauuuuccaacagaaggauuaucaccaucucaggucacaauguucccccauauaguaguagacguaagacaauuagaaccaguauuaauaccacucccugacguaagaaauaacuucuaucauuacaaucaaagcaaugacccaacaauaaaauuaauagcaaugcuauauacaccauuacgagcaaauaaugccggagacgauguauucacaguuuccuguagaguacuaacaagaccaucuccagauuucgacuuuauuuuccucguaccaccaaccguagaauccagaacaaaaccauuuucaguaccaguauuaacaguagaagaaaugacaaauaguagauuccccauaccacuagaaaaauuauucaccggcccauccucagcauucguaguacaaccacaaaauggacguuguacuacagacgguguacuuuuagguaccacucaauuaucaccaguaaauaucuguacauuucgaggagacauaacacauauaacaggaucaagaaacuacacaaugaauuuagcaucacaaaacuggucaaauuacgauccaacagaagaaauuccugcaccuuuaggaaccccagacuuuguaggcaaaauucaagguguacucacacaaacaacaagaacugauggauccacuagaggacacaaagcuacgguauacacaggaucugcugauuuugccccaaaacuaggaagaguacaauuugaaacagauacagaucaugauuucgaagcaaaucaaaauaccaaauuuacaccaguagguguaauucaagacggaucuaccacacauagaaaugaaccacaacaauggguauuacccucauacucuggacgaaauacaccaaauguacacuuggcacccgcuguagcacccacauuuccaggagaacaauuacucuucuuuagaucuaccaugccaggauguucaggauaccccaacauggauuuagacugcuuacuaccacaagaauggguacaacacuucuaucaagaagccgcaccagcacaaucagacguagcauuacuaagauucguaaaucccgacacuggacgagucuuauuugaaugcaaacuacacaaaucaggauacguaacuguagcucacacuggacaacacgaucuagucauaccucccaauggauauuuuagauucgauucaugggucaaucaauuuuauacucuugcacccaugggaaacggaacuggaagaagacgauaa

SEQ ID NO: 33935 - RNA, 1617 nt, Artificial Sequence
  derived and/or modified sequence opt6 from VP1__Norovirus_and/or_Norovirus-like__AB972494
augaaaauggcaucaagcgaugcaaauccaucugacggcucagcggcaaaccuaguaccugaaguaaauaaugaaguaauggccuuagaaccagucgucggagcagccauagcagcuccaguagcuggucaacaaaauguaauagacccauggauaagaaguaacuuuguacaagcaccaggcggagaauuuacaguaucaccuagaaaugcuccaggugaaauauuauggucagcaccuuuagguccugauuuaaauccuuaccuaucacaccuugcaagaauguauaacggauacgcaggaggauuugaaguacaaguaauacuugcagguaaugcauuuacagcaggaaaaguaauauucgcagcaguaccuccaaacuuuccuacugaaggauuaucaccuucucaaguaacaauguucccacacaucguaguagauguacgucaauuagaacccguucuaauucccuuaccagacguaagaaacaacuucuaucacuauaaccaaucaaacgauccuacaauuaaacuuauagcaaugcuuuacaccccacuucgagcaaauaaugcaggcgaugacguauuuacaguauccuguagaguacuuacaagaccauccccagauuucgacuuuauauucuuaguucccccuacaguagaaucuagaacaaaacccuuuucagucccaguauuaacagucgaagaaaugacaaauuccagauuuccaaucccacuugaaaaauuauuuacaggcccuaguucagcauuuguuguacaaccacaaaacggaagauguacaacagauggcguacuacuaggaacaacacaauuaucucccgucaacauauguacuuuuagaggagacguaacucauauaacaggaucuagaaauuacacaaugaaccuagcaucccaaaacuggucaaauuacgauccuacagaagaaauuccagcacccuuaggaacaccagauuucguagguaaaauacaagguguacuaacccaaaccacaagaacagauggaaguacuagaggacacaaagcaacagucuauaccggcuccgcaaauuuugcacccaaauuaggaagaguucaauuugaaaccgauacugaccaugauuucgaagcaaaccaaaauacaaaauuuaccccaguuggaguaauacaagacggaucaacaacacauagaaaugaaccacaacaauggguacuaccaucauauucaggacgaaauacaccaaacguacauuuagcuccagcaguagcaccaacauuuccaggagaacaacuauuauucuucagaucaacaaugccagguuguucuggauacccuaauauggauuuagauugcuuacuaccacaagaauggguacaauacuuuuaucaagaagcugcuccagcucaaucagacguugcauuauuaagauuugucaacccugauacaggaagagucuuauuugaaugcaaacuacauaaaucaggauaugucacaguagcacacacuggacaacacgaccuagucauaccaccaaauggcuauuuucgcuuugacucauggguaaaccaauuuuauacacuagcaccaaugggaaacgguacaggaagaagaagauaa

SEQ ID NO: 33936 - RNA, 1617 nt, Artificial Sequence
  derived and/or modified sequence opt6 from VP1__Norovirus_and/or_Norovirus-like__KU311163
augaaaauggcaucaaaugaugcaaaucccuccgauggcucagcagcaaacuuagucccugaaguaaauaaugaagucauggcacuagaaccagucguaggcgcagccaucgccgcuccaguagcaggucaacaaaauguaaucgacccauggauccgaucuaacuucguacaagcuccgggaggagaauuuacaguaucaccaagaaaugcaccaggagaaauauuauggucugcuccauuaggacccgaucuaaauccauaucucucucacuuagcuagaauguauaacggauaugcaggaggauuugaaguacaaguaaucuuagccggaaacgcuuucaccgcaggaaaaauaauuuucgcagcaguaccaccaaacuucccaacugaaggacuaucaccuucacaaguaacaauguuuccacauauaauaguugacguacgacaacuagaaccaguucuaauaccacucccagacguaagaaauaacuuuuaucauuauaaucaaucaaaagauucaaccauaaaacuuauagccaugcuuuacacaccucuaagagcaaauaaugcaggagaugacgucuuuacaguaucaugucgaguuuuaacaaggcccucccccgauuuugauuucauauucuuaguaccuccuacaguugaaucaagaacaaaacccuuuacaguaccaauuuuaacaguagaagaaaugacaaauucccgauuucccauaccacuagaaaaacuauucacaggaccaucuaacgcauuuguaguacaaccacaaaauggaagauguacuacagauggaguacuauuaggaacuacacaacuuucucccguaaacauuugcacuuuccgcggugauguuacacaaauagccucaacacaaacuuauaccaugaaccucgccucacuaaauuggaauaacuaugacccaacagaagaaauaccagcuccauuaggagcaccagacuucaugggaaaaauccaagguguccuuacacaaacuacaagacaagacggauccacaagaggacauaaagccacaguaucaacagguuccguucacuucacuccaaaacuaggaucugucagauuugacacagacacaaacaauaaccuacaaccacaucaauccacaagauuuaccccuguaggaguaauccaagacggagacacacaucaaaacgaaccacaacaauggguacuaccuuguuacucaggaagagacgucaacaacguucaccucgcaccagccguagccccaucauuucccggagaacaacucuuauucuuucgaucaacuaugccaggauguucaggauacccaaauauggauuuagauugcuuauuaccacaagaauggguacaacacuuuuaucaagaagcagcuccagcucaaucagacgucgcacuauuaagauucgucaauccagacacaggcagaguauuauucgaauguaaacuacauaaaucaggauauguuacagucgcccacacuggacaacacaaucuaguuauaccuccuaauggauauuucagauucgauuccuggguaaaucaauucuacacuuuagcaccaauggguaacgguacaggaagaagaagagucuaa

SEQ ID NO: 33937 - RNA, 1617 nt, Artificial Sequence
  derived and/or modified sequence opt6 from VP1__Norovirus_and/or_Norovirus-like__KR904236
augaaaauggcaucuucugacgcuaacaguagugauggaucagcagcaaacuuaguaccagaaguaaauaaugaaguaauggcauuagaaccaguagugggagcagcuauagcugcaccaguagcuggacaacaaaacguaauagacccauggauacgaaacaauuucguacaagcuccagguggagaauuuacaguuucacccagaaacgcuccaggcgaaaucuuauggucagcaccacuaggaccagaucuuaauccauauuuaucacacuuagcuagaauguacaauggauaugcaggaggauucgaaguucaaguaauauuagcuggaaaugcauuuacagcagguaaaauaauauucgcagcaguacccccaaacuuuccaacagaaggacuaucaccaucacaaguaacaauguuuccucauauaaucgucgacguaagacaauuagaacccguauuaauuccauugcccgauguuagaaacaauuucuaucacuauaaucaaucaaacgaucccacaauaaaauuaauagcuaugcuuuauacuccacuaagagcaaacaacgcuggagacgacguauuuaccguauccugucgaguuuuaacaagaccuucuccugacuuugacuuuauauuuuuaguacccccuacuguugaaucccgaacaaaaccauucucaguaccaauauuaacaguugaagaaaugacuaauucaagauuuccaauuccauuagaaaaauuauucaccggaccuucuucugcauuugucguucaaccccaaaacggaagaugcacaacagauggaguccuacuaggaacaacacaauuaucgccaguaaauauauguacauuuagaggugacguaacccauauaacaggauccagaaacuauacaaugaauuuagccacacaaaacuggaacaguuacgauccaacagaagaaauaccagcaccacuagguacaccagauuuuguaggaaaaauacaaggagucuuaacacaaacaaccaaaacagacggaucaacccguggacacaaagccacaguauauacaggcuccgcagacuucgcaccaaaauuaggaagaguacaauuugcaacagauaccgacaaugacuucgaagcaaaccaaaacacaaaauucacuccagucgguguuauacaagauggaggaacaacccaucgaaacgaaccacaacaauggguacuaccaucuuacucaggaagaaauacacauaacguacacuuagcucccgccguagcaccaacauuucccggagaacaauuacuauucuuucgaucaaccaugccagguuguucaggauacccaaacauggaucuagacugccuacuaccucaagaauggguacaauauuuuuaucaagaagcugccccagcacaaucagauguagcacuccuaagauuuguuaacccagauacaggucgcguacuauuugaauguaaacuacauaaaucaggauacguaacaguagcacacacuggaccacaugauuuagucauaccaccaaauggcuacuuuagauuugauucauggguaaaccaauuuuacacauuagcaccaaugggaaauggaacaggaagaagaagguaa

SEQ ID NO: 33938 - RNA, 1617 nt, Artificial Sequence
  derived and/or modified sequence opt6 from VP1__Norovirus_and/or_Norovirus-like__KR904225
augaaaauggcaucaucugaugcaaacccaucagaaggaucaacugcaaguuuaguaccagaaguaaacaaugaaguaauggcauuagaaccagucgcuggugcagcaauagcagcuccaguugcgggucaaguaaacguaauagacccuuggauaagaaacaauuucguacaagccccaggaggagaauuuacugucucacccagaaaugcaccaggagaaauauuaugguccgcaccucuaggaccagaucuaaauccauaccuaucacauuuagccagaauguauaauggcuaugcaggaggauucgaaguacaaguaauauuagcaggcaaugcuuucacagccggaaaaauaauauucgccgccgucccaccaaauuucccaacagaaggucuaucucccucccaagucacaauguuuccacacauaauaguagacguacgacaacuagaaccaguacuaauuccauuaccagaugucagaaacaauuucuaucacuauaaccaauccaaugaaccaacaauaaaauuaguagcaaugcuauacacaccauuaagagcaaauaaugcuggagacgauguauucaccguaucauguagaguauuaacaagaccaucaccagacuuugacuuuauauuuuuaguaccaccaacaguugaaucaagaacaaaaccauucucaguuccaauacuuaccguugaagaaaugacuaacucucgauuuccaauuccacuagaaaaacuauuuaccggaccaucaagcucauuuguaguccaaccccaaaacggccgcuguacuacagacggaguuuuauuagguaccacacaauuaucaccaguaaacaucuguacauuuagaggugacguaacacacauaucaggaucaagaaaucacacaaugaaucuagcuagccaaaauuggaacucauaugaccccacagaagaaauaccagcacccuuaggaacaccagacuuuguugguaaaauacaaggaguacuaacucaaacuacccgaucugacggaucaacccgcggccacaaagcaacaguauacaccggaucagcagacuucucaccaaaauuaggacgaauacaauuugcuacagauacagauaaugacuucgaaacuaaucaaaauacaaaauuuacaccaguaggcguaauacaagauggaggcacuacccauagaaacgagccucaacaaugggucuuaccaaccuauuccgguagaaauacacauaauguacaucuagccccagcaguagcaccaacauuuccuggugaacaauuauuguucuuuagaucuacaaugccaggauguucugguuauccagauauggauuuagauugucuacuaccacaagaauggguucaacauuuuuaccaagaagcagcuccugcacaaucagauguagcccuuuuaagauucguuaacccagauacaggaagaguccuauuugaauguaaacuucauaaagcaggauauguaacaguugcacauacaggacaacaugaccuuguaaucccucccaacggauauuucagauucgauaguuggguaaaucaauuuuucacacuagcaccaaugggaaaugguacaggcagaagacgcuaa

SEQ ID NO: 33939 - RNA, 1617 nt, Artificial Sequence
  derived and/or modified sequence opt6 from VP1__Norovirus_and/or_Norovirus-like__LC005710
augaaaauggcaucuaacgaugcaaauccauccgauggcucugcagcaaaccuaguaccugaaguaaauaaugaaguaauggcacuagaaccaguagucggagcagcaauagcagccccgguugcaggacaacaaaauguaauugauccauggauaagaaacaauuucguucaggccccaggaggagaauuuacaguuucaccaagaaaugccccaggagaaauauuauggucagcaccccuaggaccagauuuaaacccauaucuaucacauuuagcaagaauguacaacgguuacgcaggaggauucgaaguccaaguaauacucgcagguaaugcauucacagcaggaaaaauaaucuucgcagccguacccccuaauuucccuacugaaggacuuuccccuucucaagucacuauguucccacacauuaucguagacguacgccaacuagaaccaguacuaauuccucucccagacguaagaaacaauuuuuaucauuauaaccaaucaaacgauagcacaauuaaauuaauagcaauguuauacacuccauuaagagcaaauaaugccggugaagauguauucacaguauccuguagaguacuuacuagaccuucaccagauuuugauuucauuuuucucguuccaccuacuguugaaucaagaaccaaacccuucacagucccaacauuaacuguagaagaaaugacuaauucuagauuuccaaucccccuagaaaaauuauuuacagguccuuccuccgcauucguaguucaaccacaaaacggaagauguacaacagacgguguauugcuaggaaccacacaacucucaccaguaaauaucuguacauuucgaggagacguuacacacauagcaggaucuagagauuacacaaugaaccucgcauccuuaaauuggaauaacuaugauccaacagaagaaauacccgcaccauuagguacaccugauuucguagguaaaauacaagguguuuuaacccaaacaacaaaaggagacggaucaacaagaggacauaaagcaacagucuauaccggcuccgcuccauucacacccaaacuaggaucuguaagauucucaacagacacugaaaacgacuucgaaacacaccaaaacacaaaauucacaccaguaggcguaauucaagacggaucaacuacucaucgcaaugaaccccaacaauggguucuaccaucauauucagguagagauguacauaauguucaccucgcaccagcaguugcaccuacauucccuggagaacaacucuuauuuuucagaucaacaaugccuggcuguucaggauauccuaauauggaucuagauugccuccuaccacaagaauggguacaacauuucuaucaagaagcagcuccugcacaaucagacguagcacuauuacguuuuguuaauccugacacuggaagaguacuauuugaaugcaaacuacauaaauccggcuacguuacuguagcacacacuggccaacacgacuuaguuauaccaccaaauggauacuucagauucgauucuuggguaaaucaauuuuauacucuagcaccaauggguaacggaacaggucguagacgauaa

SEQ ID NO: 33940 - RNA, 1617 nt, Artificial Sequence
  derived and/or modified sequence opt6 from VP1__Norovirus_and/or_Norovirus-like__LC018709
augaaaauggcauccagcgacgcuaaucccucugacggaucagcagcaaacuuaguccccgaaguuaacaaugaaguaauggcacuagaaccaguaguaggcgcagcaauagcugcaccugucgcaggucaacaaaacguaaucgauccauggauacgaaacaauuuuguacaagcaccaggaggcgaauuuacaguauccccaagaaacgcaccuggagaaauauuauggucagcuccacuaggacccgaccuaaauccauacuuaucccaucuagcaagaauguauaauggauacgcuggcggauucgaaguacaaguuauacuagcaggaaaugcuuuuacagcaggaaaaguuauauuugcagcaguaccuccaaacuucccaacagaaggauuaucaccaucucaaguaacuauguucccacacauuguaguagauguucgacaacuagaaccaguacuaauaccacuaccagauguaagaaauaauuuuuaccauuauaaucaauccaacgacccaacuauuaaacuaauagcaauguuauauacuccacuuagagcuaauaaugcaggagaugaugucuuuacuguuucuugcagaguauuaacaagacccaguccagauuucgacuucauauuucuaguuccuccaacaggugaaucucgaacaaaaccauucucaguaccaguauuaaccguagaagaaaugacaaauucaagauuuccuauaccauuagaaaaauuauuuacaggcccaaguucagcauuuguuguucaaccucaaaauggccgcuguacuacugacggaguacuauuggguacaacacaauuaaguccaguaaauauauguacauucagaggagauguaacucacacuacagguagucauaauuacacaaugaauuuagccucacaaaacuggaacaauuaugaucccacugaagaaauaccagcaccacuaggaaccccagacuucguagguaaaauccaaggaauguuaacacaaacaacaagaacagacggaucuacccgaggucauaaagcaacaguuuauacuggauccgcugacuuugccccuaaauuaggaagaguacaauucggaacagauacagaucacgaucuagaagcaaaccaaaacacaaaauuuacaccuguaggaguaauacaagaugguucuacuacacauagaaaugaaccacaacaauggguacuaccaucauauucaggcagaaauacuccuaauguucaucucgccccugcaguugcaccaacauuuccaggagaacaauuacuauucuuccgaucaacaaugccaggcugcagcggauacccaaacauggaucuugauugcuuauuaccucaagaauggguccaauauuuuuaucaagaagcagcuccagcacaaucugacguagcacuauuaagauuuguaaauccugacacaggaagaguacuauucgaauguaaacuccauaaaucagguuauguaacaguagcccacacaggucaacacgaucuaguaauuccucccaacggauauuuucguuuugauucaugggucaaucaauucuauacuuuagcaccaaugggaaaugguaccggaagaagaagauaa

SEQ ID NO: 33941 - RNA, 1617 nt, Artificial Sequence
  derived and/or modified sequence opt6 from VP1__Norovirus_and/or_Norovirus-like__KM198587
augaaaauggccuccaaugacgccaauccuucagauggaucugcagcaaacuuaguaccugaaguuucaaacgaaguaauggcacuagaaccaguuguaggcgcagcaauagcugcaccaguagcaggucaacaaaauguuauugacccuuggauaagaaauaauuuuguccaagcaccaggaggagaauuuacuguuuccccuagaaaugcaccuggagaaauauuauggucagccccacuuggaccagaucucaacccauauuuaucccacuuagcaagaauguauaacggauacgcaggaggauucgaaguacaaguaauacuagcuggaaacgcauuuacagcaggaaaaaucauauucgcagcaguuccaccaaauuucccaacagaaggauuaucuccaucccaaguaacaauguucccacauauuauaguugauguacgccaacucgaaccaguucuaaucccucuucccgauguaagaaauaauuucuaccacuacaaucaaacaaaugacuccacaauaaaacucauagcuaugcuuuacacaccacuaagagcuaacaacgccggagaagauguauuuacagucucaugucgcguucuaacacgaccuuccccagacuuugacuuuauauuccuagugccaccaacaguagaaaguagaacuaaaccauucaccguaccaauuuuaacaguugaagaaaugacuaacucacgauuuccaauuccuuuagaaaaacuauuuacuggacccucaggagcuuuuguaguacaaccacaaaauggcagauguacaacagacggaguacuuuuaggaacaacacaacuaucaccaguuaauauauguaccuuuagaggagauguaacacauauagcaggaucuagaaauuacacaaugaauuuagcgagucuaaacuggaacaacuacgauccaacagaagaaaucccagccccacuaggcacuccagacuuuguagguaaaauacaaggaguguuaacacaaacaacaaaagaagacgguucaacaagaggacacaaagcuacuguauauacaggaucagcaccauuuacaccaaaacuuggcagcguccaauucucaacagacacagaaaacgauuucgaaacacaccaaaacaccaaauucacaccuguuggaguuauccaagacggaggaacaacacauagaaacgaaccacaacaauggguauuaccaucuuauucaggcagagauguacauaacguacauuuagcuccugcaguagcaccaacauuuccaggugaacaacucuuauuuuucagaucuacaaugccaggauguuccggauacccaaacauggaccuagauugcuuacuaccacaagaauggguacaacauuuuuaucaagaagcugcaccagcacaaucagacguugcauuauuaagauuuguaaacccagauacuggacgaguauuauucgaauguaaauuacauaaaaguggauauguaacuguugcucacacaggucaacaugaucuaguuauaccaccaaacggauauuucagauucgacuccuggguaaaucaauuuuacacauuagcaccaaugggaaacggaacaggaagaagacgauaa

SEQ ID NO: 33942 - RNA, 1617 nt, Artificial Sequence
  derived and/or modified sequence opt6 from VP1__Norovirus_and/or_Norovirus-like__KM198560
augaaaauggcuagcaaugacgcaaauccaucugauggaucagcagcuaauuuaguaccagaaguaaacaaugaaguuauggcacucgaaccaguaguaggagcagcaauagcagcaccaguugcuggacaacaaaaugucauagacccauggauaagaaauaauuuuguacaagccccagguggagaauuuacaguaaguccaagaaacgcaccaggagaaauauuauggagcgccccuuuaggacccgauuuaaaccccuaucuaucacaccuagcaagaauguauaauggauacgcaggagguuucgaaguacaagucauacuagcaggcaaugccuucaccgcuggaaaaauaauauuugcagcaguaccaccaaacuuuccaacagaaggacuaucaccaucacaaguaaccauguucccucauaucauaguagacguuagacaacuagaaccaguuuuaauaccacuaccagauguaagaaauaauuuuuaucauuauaaucaaucaaaugacucaacaauaaaacuaauugcaaugcuauacacaccacuaagagcaaauaacgcaggagaagacguauuuacaguauccuguagaguauuaacacgccccucaccagacuuugacuuuaucuuucuaguaccaccaacaguagaaucaagaacuaaaccuuuuacugucccaauauuaacaguugaagaaaugacaaacuccagauuucccauaccuuuagaaaaacuauucacaggaccaucuggagcuuucauuguacaaccacaaaacggaagauguacaacagacggcgucuugcuaggaacgacacaacuauccccaguuaauauauguacauuucgaggugacguaacacacauagcgggaucaagaaacuauacaaugaauuuagcuuccuuaaauuggaacaacuaugaccccacagaagaaauaccugcaccauuaggaacaccagacuuugucggaaaaauacaagguguauuaacucaaacgacaaaaggagacggaucaacuaggggacacaaagcaacaguauacacuggaucagcaccauuuacaccaaaacucgguucaguccaauuuucaacagauacagaaaaugacuucgaagcacaccaaaauaccaaauuuacacccguaggaguaauacaagacggaggcacaacccaucgaaaugaaccacaacaauggguacuaccuucauauucagguagagacguccauaacguacacuuagcaccagcuguagcaccuacuuuuccaggagaacaacuucuauuuuucagaucaaccaugccaggaugcucagguuauccaaauauggaucuagacugucuucuaccccaagaauggguacaacauuuuuaucaagaagcagccccagcucaaucugauguagcauuauuaagauuuguaaauccagauacaggcagagucuuauuugaaugcaaacuacauaaauccggauaugucacaguagcacauacaggacaacacgaucuaguaauuccuccaaauggauacuucagauuugauucaugggucaaucaauucuacacacuugcaccaaugggcaauggaacaggacguagaagauaa

SEQ ID NO: 33943 - RNA, 1617 nt, Artificial Sequence
  derived and/or modified sequence opt6 from VP1__Norovirus_and/or_Norovirus-like__KM198521
augaaaauggcaucaaaugacgcaaauccaagcgacggaucggcagccaauuuagucccagaaguaucaaaugaaguaauggcacuagaaccaguaguaggggccgcaauagcagccccaguagcuggacaacaaaauguuauagacccauggauaagaaauaacuucguacaagccccuggaggggaauuuaccguuucaccuagaaaugcaccaggcgaaaucuuauggucagccccuuuaggaccugaccuuaauccauaucuaucacaccuagcucgaauguauaacggauacgcuggugguuuugaaguccaaguaauccuugcaggcaaugcauucacagcaggaaaaauaauauuugcagcaguaccaccaaacuuucccacugaaggacugucaccaucccaaguaacaauguuuccucacaucaucguagauguaagacaauuagaaccaguacuaauaccuuuaccagauguaagaaauaauuuuuaucauuauaaucaaacaaaugauucuacuauaaaauuaauagcaauguuauacacuccauuaagagcuaauaaugcaggagaagauguguuuacaguaucaugccgcguuuuaaccagaccaucaccagacuuugacuuuauauuucuaguuccaccaacaguugaaucaagaaccaaaccauucacaguaccuauauuaaccguagaagaaaugaccaauagcagauucccaauaccauuagaaaaacuauuuacagguccuucuggugcuuucgucguacaaccccaaaacggccgauguacaaccgacggaguauuacuaggaaccacacaacuuucaccagucaauaucugugcauucagaggugacguaacccauauagccgguucucgaaauuacacaaugaauuuagcaucucuaaacuggaacaauuacgacccaacugaagaaauaccagcaccauuagguacacccgacuucgucggaaaaauucaagguguauuaacacaaacaacaaaaggagacggaagcacuagaggacauaaagcaacuguauauaccggaagugcacccuuuacaccaaaacucggaucaguucaauucucuacagauacugaaaacgauuucgaaacccaucaaaacacaaaauucaccccuguuggaguaauccaagauggaggaacaacacaucgaaaugaaccacaacaauggguauuaccauccuauagcgguagagauguacacaacguacaccuugcaccagcagucgcuccaaccuuuccuggugaacaacuacuuuucuuuagauccacaaugccaggaugcucaggauaucccaauauggaucuagauugcuuacuaccacaagaauggguccaacauuucuaccaagaagcagcaccagcacaaucugacguagcacuacuucguuucgucaauccugauaccggaagaguacuuuucgaauguaaacuacauaaaucagguuauguaacuguugcacacacaggacaacaugaccuaguaauuccaccaaauggauauuucagauucgauuccuggguaaaucaauuuuacacacucgcaccaaugggaaauggaacaggaagaagaagauaa

SEQ ID NO: 33944 - RNA, 1617 nt, Artificial Sequence
  derived and/or modified sequence opt6 from VP1__Norovirus_and/or_Norovirus-like__KM198490
augaaaauggcaucuaaugacgcuaaucccucagacggcucugcagcaaaccuaguaccagaagucucaaaugaagucauggcuuuagaaccaguugucggagcagcaauugcagcaccaguagcuggacaacaaaauguaaucgacccauggauacgaaauaauuuuguacaagcaccuggaggagaauuuacagucucaccaagaaaugcaccaggagaaauacuauggucugcaccacuuggucccgauuuaaauccauaucucagccacuuagcaagaauguauaacggauaugcaggaggauucgaaguacaagucauacuagcaggaaaugcauuuacugcaggaaaaauaauauucgccgcagucccaccaaacuucccuacagaaggacuuuccccaucucaaguaaccauguucccacauauaauaguagacguccgacaacuagaaccaguauuaauaccccuaccagauguacgaaacaauuuuuaucacuacaaccaaacaaacgacaguacaauaaaauuaauagcaauguuauacacaccuuuaagagcaaauaaugccggugaagacguuuuuaccguuucaugucgaguacuaacaagaccaucaccagacuuugacuuuauauuucuaguacccccaacuguagaaucaagaacaaaaccuuuuacagucccaauuuuaacaguagaagaaaugaccaacuccagauuuccaauaccacuagaaaaacucuuuacagguccuucaggugcauuuguaguacaaccacaaaacggucgauguacaacagacggaguacuauuaggaaccacucaacuaucaccaguaaauauauguaccuuucgaggagacauuacacacauagcaggcucaagagauuacacaaugaacuuagcguccuuaaauuggaacaauuacgauccuacagaagaaaucccagcccccuuagguacaccugauuuuguaggcaaaauacaaggaguauuaacacaaacaacuaaaagagauggaucaaccagaggacacaaagcaacuguauauaccggcagcgcacccuuuaccccaaaacuaggaucuguaagauucucaacugauacagaaaacgauuucgaaacacaccaaaauacaaaauucacaccaguaggaguaauucaagacggaucaacaacacauagaaaugaaccacaacaauggguacuaccaucauacucuggucgagauguacauaauguucauuuagcaccagcaguagcaccaacauuccccggagaacaacuacuauucuuccgaucaacaaugcccgguugcucaggauacccaaauauggaccuugauugccuucucccucaagaauggguacaacauuucuaccaagaagccgcaccagcacaaucagauguugcucuacuaagauucguaaauccagauacuggacguguacuuuuugaauguaagcuacacaaaucuggauauguaacaguagcacauacaggacaacacgauuuaguaaucccuccaaauggauacuuuagauuugauaguuggguaaaucaauucuacacucuagcaccaaugggaaacggaacuggcagaagaagauag

SEQ ID NO: 33945 - RNA, 1617 nt, Artificial Sequence
  derived and/or modified sequence opt6 from VP1__Norovirus_and/or_Norovirus-like__KC409241
augaaaauggcuucauccgacgcgaaucccucagacggcucaacagcaaacuuagucccugaaguuaacaacgaaguuauggcgcuagaacccguuguaggggcagcaauugcagcaccugucgcaggacaacaaaacguaauagauccauggauaagaucaaacuucguacaagccccaggaggugaauuuacaguaucaccaagaaaugcaccaggugaaauauuauggagcgcaccauuagguccagaucuaaauccuuaucuaucccacuuagcucguauguauaauggcuaugccgguggauucgaaguccaaguuauacuagcagggaacgcauucaccgcaggaaaaauaauauucgcagcaguaccaccaaauuuuccaacagaaggccuaucaccaucccaaguaacaauguuuccacauauaauaguagacguaagacaauuagaaccaguacuaauuccuuuaccagacgucagaaacaauuuuuaucacuauaaccaauccaaugacccaacuauaaaauuaaucgcuaugcuuuacacaccuuuacgugcaaacaacgcaggagacgauguuuucaccguaucaugucgaguacucacuagaccaagcccagauuuugacuuuauuuuccuuguaccaccaacaguagaaucaagaacaaaaccauucucaguaccaguacuaacaguagaagaaaugacuaacucccgauuuccuauaccacuagaaaaacuauuuacagguccaagcagugcauucguaguacaaccacaaaacggacguuguacaacagacgguguacuacuaggaaccacucaauuaucaccaguaaauaucuguacauuuagaggagacguaacccauaucccagguucgagaaauuacacaaugaaucuagcaagucaaaauuggaacucauaugauccaacagaagaaauuccagcaccacuagguacaccagauuucgucggaaaaauucaaggcguacuaacucaaacuacaagaacugacgguucuacuagaggacauaaagcaacaguauauacaggcucagcagacuucuccccaaaacuaggaagaguccaauucgcaacugacacagauaacgacuuugaaacaaaccaaaauaccaaauuuacaccuguaggaguaauacaagauggaucaacaacucaucguaaugaaccucaacaauggguacuaccaucauauucaggacgcgacguccauaauguccaucuagcuccugcaguugcaccaacuuuuccaggagaacaauuauuauucuucagaucuacaaugcccggauguuccggauaccccaacauggaucuagauugucuauuaccucaagaauggguccaauauuucuaucaagaagcagcaccagcacaaucagacgucgcacuauuaagauucgucaacccugauacaggucgaguuuuauucgaaugcaaacuacauaaaucaggauaugucacaguagcucacacaggacaacaugaucucguaauaccaccaaauggauauuuucgauuugacucauggguaaaucaauuuuacacauuagcacccauggguaauggaaccggaagacgaagauaa

SEQ ID NO: 33946 - RNA, 1617 nt, Artificial Sequence
  derived and/or modified sequence opt6 from VP1__Norovirus_and/or_Norovirus-like__JX459625
augaaaauggccucaaaugacgcaaacccaucugauggaucagcagcaaaccuaguaccagaagucaacaaugaaguaauggcuuuagaacccguaguaggagcagcaauagccgcacccguagcaggacaacaaaauguuauagaccccuggauacguaauaacuuuguacaagcaccuggaggagaauuuacaguauccccacgaaaugcaccaggagaaauucuaugguccgcaccuuuaggaccugaccuaaauccauauuuaagucauuuagcccgaauguauaacgguuaugcaggagguuucgaaguccaaguaauucuggcaggcaacgcauuuacagcuggaaaaauaauuuucgcugcaguaccuccaaacuucccaacugaaggauuauccccaucucaaguuacuauguucccccauauaauaguugacguuagacaacuagaaccaguacucauuccacuaccagauguaagaaacaacuucuaccauuauaaccaauccaaugacucaacaauaaaacuaauagcuauguuauauaccccauuaagagccaauaacgccggagaagacguauucacaguaucaugcagaguacucacaagaccaucacccgauuucgacuuuauauuucuuguaccaccaacaguagaaucaagaaccaaaccuuucacuguaccuauauuaacaguagaagaaaugacuaacucacgauuuccaaucccacuagaaaaacuauuuacagguccuucuggagcauuugucguacaaccacaaaacggacgcugcaccacugacgguguauuauuaggaacaacacaauuaucccccguaaauauauguacauuuagaggcgacguaacccauauagcagggacuagaaacuacaccaugaaccuagcaucauuaaacuggaacaauuaugauccaacugaagaaauaccagcaccacuugguacaccagauuucguaggaaagauucaaggaguacuaacacaaacaacaaaaggcgacgguucuacaagaggacacaaagcaacuguauacacugguucagcaccauucaccccaaaacuagggucaguacaauucucaaccgauacagaaaacgacuucgaaacacaucaaaacacaaaauuuacaccagucggcguaauacaagauggaggaacaacccaucgcaaugaaccacaacaauggguacuaccauccuauucaggacgaaauguccauaacguucauuuagcaccagcaguugcaccaaccuuuccaggagaacaacuauuauucuuuagaucgacaaugcccgguugcucagguuauccuaauauggauuuagacugccuauuaccacaagaauggguacaacauuuuuaucaagaagcagcuccugcacaaucagacgucgcacuaaugcgcuuuguaaacccagacacaggaagaguacuuuucgaaugcaaacuucacaaaucaggauacguaaccguagcacacacuggacaacaugaucuuguaauaccaccaaauggcuacuuuagauucgauuccuggguaaaccaauuuuacacccuagcacccaugggaaauggaacaggacgaagacgauaa

SEQ ID NO: 33947 - RNA, 1617 nt, Artificial Sequence
  derived and/or modified sequence opt6 from VP1__Norovirus_and/or_Norovirus-like__JX459613
augaaaauggcaucaaaugacgcacauccuucagauggaagcgcagcaaaucuaguaccagaaguaaacaaugaaguaauggcacuugaaccaguaguuggggccgcaauugcagcaccaguagcaggacaacaaaauguaauagaucccuggauaagaaauaacuucguucaagcuccagguggagaauuuacaguauccccuagaaacgcaccaggugaaauacuauggucagccccucuaggaccagaucuaaauccauacuuaucacacuuagcaagaauguauaacggauacgcaggaggcuucgaaguacaaguaauacuagcaggaaacgcauucacagcaggaaaaauaauuuuugcugcaguacccccaaacuuuccaacagaaggucucucaccaucacaagucacaauguucccucacauaauaguagauguaagacaauuagaaccaguacuaauaccauuaccagacguaagaaauaauuuuuaucacuauaaucaaucaaaugacaguacaauaaaauuaauugcaaugcuuuauacaccccuaagagcaaacaaugcaggcgaagacgucuuuacaguaucaugucgcguucuaacacgaccaucaccagacuuugacuucauauuucuuguaccaccaaccgucgaauccagaacaaaaccauuuacagucccaauauuaacaguagaagaaaugacaaacucacgcuuucccauuccacuagaaaaacucuucacagguccaucaggagcauucguaguacaaccacaaaaugguagauguacuacagauggaguccuacuagguacaacucaacuauccccaguaaacauaugcacauuuagaggagauguuacacauaucgcaggcucuagaaauuacacaaugaaucuagccucauuaaacuggaauaauuaugaccccacagaagaaauaccugcaccucuaggaacaccagacuucguugguaaaauacaaggcgucuuaacacaaacaacaaaaggagauggauccacuagaggacacaaagcaacggucuauacuggaucugcaccauucacaccaaaacuaggaucaguccaauuuucuacagauacagaaaacgauuucgaaacacaucaaaauacaaaauucaccccaguuggcguuauacaagaugguggaacaacacauagaaaugaaccacaacaauggguacucccaucauauagcggaagaaauguacacaacguacaccuagccccugcagucgcaccaacauuuccaggcgaacaauuauuauucuuuagaucaaccaugccuggauguucaggcuacccaaacauggaccuagacuguuuacuaccacaagaauggguacaacauuucuaccaagaagcagccccagcucaaucagacguagcacuccuaagauucguaaauccagacacaggacgaguauuauuugaauguaaacuacauaaaucuggauacgucacuguagcacauacuggacaacacgacuuaguaauaccgccaaauggauauuucagauucgauuccugggucaaccaauuuuacacccuagcaccaaugggaaauggaacaggaagacgaagauaa

SEQ ID NO: 33948 - RNA, 1617 nt, Artificial Sequence
  derived and/or modified sequence opt6 from VP1__Norovirus_and/or_Norovirus-like__JX459600
augaaaauggcaucaaaugacgccaacccaucagacggcucugcagcacacuuaguuccagaaguuaauaaugaaguuauggcacuagaaccagucguaggagcagcaauagcagcucccgucgcuggucaacaaaacguaaucgacccauggaucagaaacaacuuuguucaagcaccagguggcgaauuuaccgucucaccuagaaaugcaccaggagaaauacuauggucagcaccuuuaggaccagaucuaaauccuuacuuaucacaccuagcccgaauguauaauggauacgcaggcggcuuugaaguccaagucauacucgcaggcaacgcauuuacugcuggaaaaauuauuuucgcagcaguaccacccaacuuucccacagaaggccuaucacccucucaaguaacaauguucccccauauaauaguagauguaagacaacucgaaccaguacuuaucccacucccagauguaagaaacaauuuuuaucacuacaaccaauccaaugacucaacuaucaaacuaauagcuaugcuauauacaccccuaagagcaaacaaugcaggggaagacgucuuuacaguaucaugccgaguauuaaccagacccagcccagauuuugacuuuauauuucucguaccaccaacaguagaaucuagaacuaaaccauuuacaguaccaauacuuaccguagaagaaaugacaaacucaagauuuccaauaccguuagaaaaacucuucaccgguccuuccggagcauucguaguacaaccacaaaauggaagaugcacaacagauggaguacucuuaggaacaacacaacuuucaccaguaaauauuugcacuuuuagaggugacguaacacacauagcaggaucaagaaauuacacaaugaaucuugcauccuuaaacuggaacaauuaugauccaacagaagaaauaccugccccauuaggcacacccgacuuuguaggaaaaauacaaggcguauuaacucaaacaacaaaaggagacggaucaaccagaggacacaaagcuacaguauauacaggcucugccccauuuacaccaaaacucggaucaguacaauucucaaccgauacagaaaacgauuucgaaacucaccaaaauacuaaauuuacuccuguaggaguaauacaagacggaagcacaacacacagaaacgaaccacaacaauggguauuaccaucuuauucagguagaaauguacacaacguacaccuugcaccagcagucgcaccaacuuuuccaggagaacaacuccucuucuuucgaaguaccaugcccggaugcuccggauauccaaacauggaucucgacugccuacuaccucaagaauggguacaacacuucuaccaagaagcagcaccagcacaaucagauguugcuuuacuaagauucguaaacccagacacagguagaguauuauucgaaugcaaacuacauaaauccggauacguuaccguugcacacacaggccaacacgaucuaguaauaccuccaaauggauauuuccgauuugacucuuggguaaaucaauucuacacucucgcuccaauggggaacgguacaggcagaagacgauaa

SEQ ID NO: 33949 - RNA, 1617 nt, Artificial Sequence
  derived and/or modified sequence opt6 from VP1__Norovirus_and/or_Norovirus-like__JX459596
augaaaauggcaucuaaugacgcccauccaucagauggaucaacugcaaacuuaguacccgaaguaaauaacgaaguaauggcacuagaaccaguagucggagcagcaauugcagcaccaguagcuggacaacaaaauguaauugacccauggauaagaaacaauuucguacaagcuccaggcggagaauuuacaguaucaccaagaaaugcuccaggugaaauauuauggucagcaccauuaggaccagaccuaaacccauacuuaucucaucuagcaagaauguauaauggauacgcaggcgguuucgaaguccaaacaauacuagcaggaaacgccuuuacagcaggaaaaauaaucuucgccgcaguaccaccuaacuuuccaacagaaggacuaucaccuucucaaguuaccauguuuccucacauuauuguagacguacgccaacuagaaccaguuuuaauaccgcuaccagaugugagaaacaacuucuaccacuauaaucaaucaaaugauccaacaauuaaauuaauagcuaugcuauauacaccccuacgagcuaauaaugccggugacgauguguuuaccguuaguugucgcguauuaacacguccuucaccagauuuugacuucauuuuccuaguacccccaacaguugaaucaagaaccaaaccauuuaccguaccaauauuaacaguugaagaaaugacaaauucaagauucccaauaccauuagaaaaauuauucacaggaccaucaucagcauuuguuguacaaccacaaaacggaagauguacaacagauggaguacuacuagguacaacacaacuuaguccuguaaacauauguacuuucagaggagacgucacucacaucgcaggaacccauaauuacacuaugaacuuagcuucacaaaauuggaacaauuaugauccaaccgaagaaauaccagcaccacuaggaacaccagauuucguaggaagaauacaaggaauguuaacacaaacaacaagaggagacggauccacuagaggacauaaagcaaccgucucaacaggagacguucacuucaccccaaaacuaggaucaauacaauuuaacacagauaccaauaaugauuuugaaaccggacaaaacacaaaauucacaccaguaggaguaguccaagacgguaaugguacacaccaaaacgaaccccaacaauggguauuacccuccuauucugguagaacaggacauaacguacaucuagccccagcuguagcaccaacauuuccuggagaacaacuauuauucuuccgauccacaaugcccggaugcucaggcuauccaaauaugaauuuagauugcuuauuaccucaagaauggguccaacacuucuaucaagaagcagcaccagcacaaucagacguagcccuacuaagauucguuaaucccgacacuggaagaguacuauuugaaugcaaauuacauaaaucgggauauguuacaguagcacacacaggacaacacgauuuaguaauaccaccuaacggauacuucagauuugacucuugggucaaucaauuuuacacucuagcaccaaugggaaauggcacaggaagacgaagauaa

SEQ ID NO: 33950 - RNA, 1617 nt, Artificial Sequence
  derived and/or modified sequence opt6 from VP1__Norovirus_and/or_Norovirus-like__JX155749
augaaaauggcauccaacgacgcaaacccaucagaugguucagcugcaaauuuaguaccugaaguuaacaacgaaguaauggcauuagaaccagucguuggcgccgcaauagcugcccccguagcuggccaacaaaauguaauugacccuuggauaagaaauaacuucguccaagcuccaggaggagaauuuacaguaucaccuagaaacgcaccaggugaaauauuauggucagcaccacuuggacccgauuuaaauccuuauuuaucacaccuagcaagaauguauaacggauacgcaggcgguuucgaaguacaaguaauauuagcagguaaugcauuuaccgcaggaaaaaucaucuucgcagcaguacccccaaauuuucccacagaagguuuaucaccaucacaaguaacaauguucccucauauaauugucgacguaagacaacuagaacccguacuaauaccacuaccagaugucagaaauaacuucuaucauuauaaccaaucaaaugauucaacaauuaaacuaauagcaauguuauacacaccccuaagagcaaauaaugccggugaagauguauuuacaguaagcugcagaguauuaacaagaccaucaccagacuuugacuucauauucuuaguacccccaacaguugaaucaagaacaaaaccauucacaguaccaauauuaaccguugaagaaaugacaaacuccagauuuccaauuccacuagaaaaacuauuuaccgguccgucauccgcuuuuguuguccaaccacaaaacggacguuguaccacagacggaguauuacuagguaccacacaauuaucaccaguaaauauauguacauuuagaggagauguuacacauauagccggaucuagaaacuacacaaugaacuuagcauccuuaaauuggaacaauuaugaucccacagaagaaauccccgcaccccuugguacaccagacuuuguaggaaaaauacaaggaguuuuaacacaaacuacaaaaggagaugguucaacuagaggucauaaagcuacagucuacaccggcucagcaccauuuacaccuaaacuagguucaguucaauucucaacugauacugaaaacgacuucgaaacccaccaaaauacaaaauuuaccccaguuggaguaauacaagauggaggcacaacccauagaaaugaaccccaacaauggguauuaccaucuuauucagguagaaauguaccuaacguacacuuagcuccagccguagcaccaaccuuuccaggagaacaacuacuauucuuuagauccacuaugccagguugcuccgguuauccaaacauggauuuagacugccuucuuccacaagaauggguacaacacuucuaucaagaagccgcaccagcacaaucagaugucgcacuacuaagauuuguuaauccagauacaggaagaguauuauuugaaugcaaacuacacaaaccaggauauguaacaguagcacauacaggacaacacgauuuaguaaucccacccaacggauacuucagauucgauucauggguaaaucaauucuacacucucgcaccuauggguaauggcacaggaagaagacgauaa

SEQ ID NO: 33951 - RNA, 1617 nt, Artificial Sequence
  derived and/or modified sequence opt6 from VP1__Norovirus_and/or_Norovirus-like__JQ613511
augaaaauggccuccucagacgccaauccaucagacggcucaacagcaaacuuaguaccugaaguaaauaaugaagucauggcuuuagaaccaguaguaggagccgcaauagccgccccaguagcuggacagcaaaaugucauugauccauggauaagaaacaacuuuguacaagcuccaggcggagaauuuacaguaucacccagaaaugccccaggagaaaucuuaugguccgcaccucucgguccagacuuaaauccauaccuaucacacuuagcaagaauguauaacucauacgcaggcggauuugaaguacaaguaauacuagcugguaaugcauuuacagcaggaaaaaucauuuucgcagcaguuccaccaaauuuucccacagaaggacuaucaccaagucaaguuacaauguuuccacacauuauaguagauguacgacaauuagaaccuguacuuauccccuuacccgauguacgaaauaauuucuaccauuauaaucaaucaucugacccaaccauaaaacuuauagccauguuauacacaccccuacgagcaaacaacgcuggugacgauguauucacagucucaugcagaguauuaacaagaccaucaccagacuuugacuuuauauuuuuaguaccuccuacaguagaaucaagaaccaaaccuuucucuguaccaauuuuaacaguugaagaaaugacaaauucaagauuuccaauuccacuugaaaaacuauuuacaggaccauccucugcauuuguaguacaaccucaaaacggacgauguaccacagacggaguucuccuuggaacaacgcaacuaagcccuguaaauauauguacauuuagaggcgaugucacccacaucgcugggacucaagaauauacuaugaaucuagccagccaaaauuggaacaacuacgauccaacagaagaaauaccagcaccacuaggaaccccugacuuuguaggaaaaauacaaggagucuuaacccaaacaacaagaagagacgggucuacaagaggccauaaagcaacuguauccacaggaucaguucacuuuaccccaaaauuaggacgaauacaauucucuacagauacaucuaacgauuuugaaacaggacaaaauacaagauucacaccaguuggaguaguccaagacggaaguaccacucaucaaaaugaaccacaacaauggguauuaccaaacuauucaggucgagauagccacaacguacauuuagccccagcaguagcaccauccuucccuggagaacaacucuuauucuuucgaucaacaaugcccggaugcucuggauauccaaauauggauuuagauugcuuacuaccacaagaauggguccaacacuuuuaucaagaagcagcaccagcacaaucagacguagcacuuuuaagauuuguaaauccagacacaggaagaguauuauuugagugcaaauuacauaaaucaggcuacgucacaguagcccauacaggacaacaugauuuaguaauaccaccaaauggauauuucagauuugauucauggguaaaccaauuuuacacucuagcaccaaugggaaacgguacuggaagaagaagauaa

SEQ ID NO: 33952 - RNA, 1617 nt, Artificial Sequence
  derived and/or modified sequence opt6 from VP1__Norovirus_and/or_Norovirus-like__HM802547
augaaaauggcaaguucagacgcuucaccuagcgauggaucugcagcaaaucuaguaccugaaguaaacaacgaaguaauggccuuagaaccaguagucggagcagcuauagcagcccccguagcaggacaacaaaauguuauagauccuuggauuagaaauaauuucguucaagcaccuggaggagaauuuacaguaucaccaaggaacgccccuggagaaauauuauggucagcaccacucggcccagaccuaaauccauaucucucacaccuagcuagaauguauaauggauacgcaggaggauucgaaguacaaguaauauuagcaggaaacgcauucacagcagguaaaauaauuuucgccgcaguaccaccaaauuuuccaaccgaaggccuauccccgucacaaguaacaauguuuccucacaucauaguagacguucgacaauuagaaccgguacuaauuccuuuaccagauguaagaaauaauuucuaucacuauaaccaauccaaugacagcaccauaaaacuuauagccauguuauauacacccuuaagagcuaacaaugcaggagaugauguauuuaccguuucaugucgcguauuaacaagaccaucuccagacuucgauuucaucuuccuaguaccaccaacuguugaaucacguacaaaaccguucacuguaccaauacuaacagucgaagaaaugacuaauaguagauucccaauaccauuagaaaaacuauuuacaggaccaaguuccgcuuuuguuguccaaccacaaaauggaagauguacaacagacggaguauuacuuggaaccacucaauuaucaccaguaaauauaugcacauuuagaggcgacguaacacauauauccggcucccgaaauuacagaaugaauuuagcuucacaaaauuggaacaacuaugaccccacugaagaaauaccagcaccucuagguacacccgacuuuguuggaaaaauacaaggaauguuaacacaaacaaccaaaggagaugguucaacaagaggacauaaagcuaccguaucaacuggcucagucgacuuuacaccuaaauuagguucaguacaauuugcaacagacacugauaacgauuucgaaacuggacaaaacacaagauuuacacccguaggaguaauacaagacggaucuuccgcacauagaaacgaaccacaacaauggguacuaccagacuacucaggaagaacaguucacaauguucaccuagcaccagcaguagcaccuaccuucccaggagaacaauuacuauucuuucgauccacaaugccaggauguaguggcuauccuaauauggaucuagacugcuuauuaccacaagaauggguacaacauuuuuaccaagaagcagcaccaucacaauccgacguagcccuuuuaagauuugucaauccugauacaggcagagucuuauucgaaugcaaacuucauaaagcaggauauguaaccguagcccauacaggacaacaugauuuaguaauaccacccaauggauacuuuagauucgauaguuggguaaaucaauuuuacacauuagcaccaaugggcaauggagcaggaagaagacgcuaa

SEQ ID NO: 33953 - RNA, 1617 nt, Artificial Sequence
  derived and/or modified sequence opt6 from VP1__Norovirus_and/or_Norovirus-like__HM802544
augaaaauggcaucuaaugacgcaacaccaucugacggaaguacugcaaaccuaguuccugaaguaaacaacgaagucauggcacuugaaccaguagucggagcagcaauagcugccccaguagccggacaacaaaacguaauagacccauggauacgaaauaacuucguacaagcaccaggaggagaauuuacaguaucaccacgaaacgcaccaggagaaauuuuauggucagcaccuuuaggaccagacuuaaacccauauuuaucccacuuagcacgaauguauaacggauacgcaggagguuuugaaguucaaguuauacuagcaggaaacgccuucacagcaggaaaaauuauauuugccgcaguaccucccaacuuuccaacagaaggucuaucaccuucccaaguuacaauguuuccacacaucauuguagauguaagacaacucgaaccaguuuuaauaccacuaccagacguacguaacaauuucuaucacuauaaccaaucaaaugauucaacaauaaaguuaauugcaaugcuuuacacaccuuuacgcgcaaacaaugccggugaugauguuuuuacuguuucaugucgcguacuuacuagaccaagcccugauuuugauuucauauuucuuguaccacccacaguagaauccagaacuaaacccuucucaguaccaauacuaacaguagaagaaaugacuaacucaagauuuccaauaccacuugagaaauuauuuacuggacccucaucagcauuugucguccaaccacaaaauggaagauguacaaccgacggaguauuacucggcaccacacaacuaucaccuguaaauauuuguaccuucagaggagauguuacucacaucgcaggaacacaaaacuacacaaugaaccuagcaucacaaaacuggaacaauuacgacccaacagaagaaauaccagcaccuuuagguacaccagacuucguuggaaaaauucaaggaguauuaacccaaacuacuagaagagacggaucaacaagaggacacaaagcuacaguaucaaccggaucaguacacuuuaccccuaaacuuggaaguguacaauuuucaaccgauacaucaaacgacuuugaaaccggacaaaauaccagauucacaccaguuggcguuguacaagacggaucaacaacucaucaaaaugaaccacaacaauggguauuaccugauuauucaggacgagauucccauaacguacauuuagccccugcaguagcaccaaccuuuccuggagaacaauuacuuuucuuccgaucuaccaugccaggaugcucaggcuacccaaauaugaaucuugauuguuuacuaccacaagaauggguacaacauuuuuaccaagaaucagcaccagcacaaucagauguagcacuucuacgauuuguaaauccagauacaggaagaguacucuuugaaugcaaacuacacaaaucaggauaugucacaguagcucauacaggacaacaugauuuaguaauaccaccaaauggauauuuccgcuucgacagcuggguaaaucaauuuuauacucuagcuccuaugggcaauggagcaggaagaagaagauaa

SEQ ID NO: 33954 - RNA, 1617 nt, Artificial Sequence
  derived and/or modified sequence opt6 from VP1__Norovirus_and/or_Norovirus-like__GQ856456
augaaaauggcuaguaacgacgcuaacccuuccgauggaucagccgcaaaccuaguuccagaaguaaacaaugaaguuauggcucuagaaccaguaguaggcgcugcuauagcagcaccaguagccggucaacaaaauguaauagauccuuggauacgaaacaauuuuguacaagcacccggaggagaauuuaccguuuccccaagaaaugcaccaggagaaauccuuuggucugcaccuuuaggaccagauuuaaauccuuaucuaucacauuuagcccguauguauaacggcuaugcaggaggcuucgaaguacaaguaauauuagcuggaaacgccuucacagcaggaaaaauuauauucgcagcaguacccccaaacuuuccaacagaaggacuuuccccaucucaagugacuauguuuccccauauaauaguaggcguucgacaauuagaaccaguauuaauaccacuacccgauguccgaaacaauuucuaucauuacaaccaaucaaaugacuccacaauuaaacuaauagcaauguuauauacuccauuaagagcuaacaacgcaggagaagauguauucacaguaaguugccgcguacuaacaagaccaucacccgacuuugacuuuauauuccuaguaccuccaacaguagaaucacgaaccaaaccuuuuacaguaccaauauuaacaguagaagaaaugacaaauucacgauucccaauuccucucgaaaaacuuuuuaccggaccuucaucagcuuuuguaguacagccacaaaacggucgauguaccacugauggcguuuuacuaggcaccacacaacuuucaccaguaaauauauguacauucaaaggugauguaacucacauagcaggcucucgaaacuacacuaugaaccuagccuccuuaaauuggaauaauuacgauccaacagaagaaauaccagcaccacucggaaccccagacuucguaggaaagauccaaggaguacuuacccaaacaacaaaaggagauggaucaacucgaggucacaaagcuacuguauacacaggauccgcaccguuuacaccaaaacuaggaagcguccaauuuagcacggacacagaaaacgacuucgaaacacaucaaaauacaaaauuuacaccagucggcguaauacaagacgguggaacaacacaucgaaaugaaccucaacaauggguacuaccaucauacagcggaagaaauguucaaaauguucacuuagcaccagcaguugcaccuacauuuccaggagaacaauuauuauuuuucagaucaaccaugccagguuguuccggcuauccaaacauggauuuagauugcuuacuaccucaagaauggguccaacauuuuuaccaagaagcagcaccagcucaaucagauguagcucuuuuaagauucgugaaccccgacacaggaagaguacuauucgaaugcaaacuacacaaaucaggauacguaacuguagcucacacaggacaacaugaucuaguaauaccuccaaacggauacuuucguuucgacuccuggguaaaccaauuuuauacucucgcaccaaugggaaauggaacuggacgacgacgauaa

SEQ ID NO: 33955 - RNA, 1617 nt, Artificial Sequence
  derived and/or modified sequence opt6 from VP1__Norovirus_and/or_Norovirus-like__AB541332
augaaaauggcaucgaacgaugcuaacccaagcgaugguucagcagcaaauuuaguaccugaaguaaacaacgaaguaauggcauuagaaccaguaguuggagccgcaauagccgccccugucgcaggacaaacaaacguaauagacccuuggauaagaaauaacuuuguacaagcaccaggaggagaauuuacaguaucaccuagaaacgcaccaggagaaauauuauggucagcuccuuuaggucccgacuuaaacccuuaucuaucacaucuagcccgaauguauaacggauaugcaggaggcuuugaaguacaaguaauacuagcugguaaugcuuuuacugcaggaaaaaucauauucgccgcagugccaccaaauuuuccaacagaaggucuuucaccaucacaaguaacuauguuuccacacauaaucguugacguuagacaacuagaaccaguauuaauaccacuaccagauguaagaaauaauuucuaucauuauaaccaaucaaaugauucaacaauuaaauuaauagcaaugcuuuacacaccacuacgcgccaacaaugcaggagaagauguuuuuaccguuucaugcagaguacuaacaagaccaagcccagauuuugacuucauauuucuaguaccaccaacaguagaauccagaacuaaaccauucaccguaccaauauuaacaguugaagaaaugacaaacuccagauuuccaauaccacuagaaaaacuauuuaccggaccaucuggugcauucguaguucaaccccaaaacggacgcuguacaacagacgggguauuacuaggaacaacacaauuaagcccagucaauauauguaccuuuagaggagacguaacacauauagcuggaucacguaauuacacaaugaaucuugcuucauuaaacuggaauaacuacgauccuacagaagaaauuccagcaccauuaggaacuccugauuucguaggaaaaauccaaggcguacuaacacaaacgacaaaaggagacggaucaaccagaggacacaaagcaacuguauauacaggaggagcaccauuuaccccuaaauuaggcagcgcccaauuuucaacagacacagaaaaugauuucgaaacccaccaaaauaccaaauucaccccagucggcgucauacaagacggaggcacaacacaccgaaaugaaccucaacaaugggugcucccauccuacucuggacgcaauguccacaacguacauuuagcaccagcaguugcaccuacuuucccaggagaacaacuauuauucuucagaucaacaaugccuggaugcaguggauauccaaauauggaucuagacuguuuauuaccacaagaauggguacaacauuucuaccaagaagcagcacccgcacaaucugauguagcauuauuaagguucguaaacccagacacaggaagaguauuauucgaauguaaauuacauaaaucagguuauguaacuguagcacacacaggacaacacgaucuaguaaucccaccuaacggauacuuccgauucgauaguuggguuaaccaauucuacacacuagccccaaugggaaauggaacaggaagaagaagauaa

SEQ ID NO: 33956 - RNA, 1617 nt, Artificial Sequence
  derived and/or modified sequence opt6 from VP1__Norovirus_and/or_Norovirus-like__AB541316
augaaaauggcaucaaaugaugcaaacccaucagauggauccgcagcaaaucuaguacccgaagucaacaaugaaguaauggcacuagaaccaguaguaggagccgcuaucgcagcaccaguagcaggucaacaaaacguaauugauccauggauaagaaacaacuuuguacaagcaccaggaggugaauuuacaguaucaccaagaaaugcucccggcgaaauacuauggucagcuccauuaggcccagaucuuaacccuuaucucucacauuuagccagaauguacaacggauacgcaggagguuuugaaguacaaguuauacuagcuggaaacgcauucacagccggaaaaaucauauucgcagcaguaccaccaaauuuuccuacagaaggacuuucuccaucacaaguuacuauguuuccacauauaauaguagacguccgucaacuagaaccaguacuaauaccacuucccgauguaaggaauaauuucuaucacuacaaucaauccaaugacuccacuauaaaauuaaucgcaauguuauacacaccacuaagagcaaacaaugccggugaagaugucuuuacaguuucauguagaguucuaacaagaccuucaccagacuuugacuuuauauuucucguaccacccacaguagaauccagaaccaaaccauucaccguaccuauacuaacaguagaagaaaugacaaauaguagauuuccaauaccacucgaaaaauuauucacagguccaucauccgcauuuguuguacaaccucaaaauggacgauguacgacagauggaguacuccuaggaaccacccaauuaucacccguaaauauauguacauuuagaggugauguaacccacauagcuggaucaagaaauuacacaauggaucuugccucuuuaaacuggaauaauuacgaucccacagaagaaauaccugcaccuuuagguacaccagacuuuguuggaaaaauacaaggaguuuugacccaaacuacaaaaggugacggaucaacacgaggacauaaagcaaccguauacacuggaucugcuccuuuuacaccuaaauuagguuccguacaauuuucaacugacaccgaaaaugacuuugaaacucaucaaaauacuaaauuuacaccaguaggaguaauccaagauggagggacuacucacagaaaugaaccacaacaauggguacuuccuuccuauucaggaagaaauguuccuaauguucacuuagcaccagcaguugccccaacauuuccaggagaacaauuacuuuucuuuagaucuacaaugcccggaugcucaggauauccaaauauggauuuagauugccuauuaccacaagaauggguucaacauuuuuaucaagaagcagcuccagcacaaucagacgucgcacuucuucgauucguaaauccagacaccggacgcgucuuauuugagugcaaauuacauaagucaggauauguaacaguagcucacacaggacaacacgaccuaguuaucccuccuaaugguuauuucagauucgauucauggguuaaucaauuuuacacuuuagcaccaaugggaaauggaacaggacgucgaagauaa

SEQ ID NO: 33957 - RNA, 1617 nt, Artificial Sequence
  derived and/or modified sequence opt6 from VP1__Norovirus_and/or_Norovirus-like__AB541238
augaaaauggcaucuaaugacgcaaauccaucagacgguucugcagcaaaucuaguaccagaaguaaacaacgaaguaauggcacuagaaccuguuguaggagcugcuaucgcagcaccaguugcugggcaacaaaacguuauagacccauggauuagaaauaauuuuguccaagcaccuggaggugaauuuacagucucuccgcgaaacgcaccaggugaaauacuauggucagcaccacuagguccugaucuaaauccauaccucucacacuuagcaagaauguauaaugguuaugcaggcggauucgaaguacagguaauauuagccggaaacgcauucacagcaggaaaaaucaucuucgcugcaguaccuccaaacuuucccacagaaggcuuaucacccucacaaguaacaauguuuccacauauaauaguagauguuagacaauuagaaccaguacuaauaccccuucccgaugucagaaauaauuucuaucacuauaaccaaucaaaugacucaacaauaaaauuaauugcaauguuauauacaccacuaagagcuaacaacgcuggagaagauguauuuaccgucucaugucgagucuuaacacgaccaucuccugacuuugauuuuauuuucuuaguacccccaacaguugaaagucgaacaaaaccauuuacuguacccauacuuacaguugaagaaaugacaaauucaagauuucccauaccacuugaaaaauuauuuacaggaccauccggagcauuuguaguacaaccucaaaauggcagauguacaacagauggaguuuuauuaggaacaacucaauuaucaccaguaaacauauguaccuuuagaggagacguaacacacaucgcugguucaagaaauuacacaaugaaccuagcaucacucaacuggaacaacuacgauccaacagaagaaauaccugcaccauuaggcacaccagauuucguaggaaaaauacaaggaguauuaacacaaacgacaaaaggagacggaucaaccagaggucauaaagcuacaguauacacagguuccgcccccuuuacaccaaaauuagguuccguacaauuuucaacagauacugaaaacgauuuugaaacacaccaaaauaccaaauucacaccagucggcguaauacaagauggaggaaccacacauagaaaugaaccacaacaauggguauuaccaucuuauucaggaagagauguacauaauguacaucuagcaccagcgguagccccaacauucccaggugaacaauuacuauucuuuagaucaaccaugccuggaugcucugguuauccaaacauggauuuagauugucuucuaccccaagaauggguacaacauuucuaccaagaagcagcacccgcucaaucagacguugccuuacuaagauucguaaauccugauaccggaagaguucuauucgaaugcaaacuucauaaaucaggauauguaacugucgcucacacaggacaacaugauuuaguaaucccaccuaaugguuacuucagauucgacucauggguaaaccaauuuuacaccuuagcaccaaugggcaauggaacaggaagacguagauaa

SEQ ID NO: 33958 - RNA, 1617 nt, Artificial Sequence
  derived and/or modified sequence opt6 from VP1__Norovirus_and/or_Norovirus-like__AB535750
augaaaauggcaucaaacgacgcaaacccaagcgacggaucagccgcaaaucuaguaccagaaguaaacaacgaaguaauggcuuuagaaccuguaguaggagcagccaucgcagccccuguagcaggacaacaaaauguuaucgacccauggauaagaaauaacuucguacaagcaccaggaggugaauuuacuguaucaccccguaaugcaccaggggaaauacuaugguccgcaccucucggcccagauuuaaauccuuauuuaucucaccuagcaaggauguauaacggauaugcaggaggauucgaaguacaaguaauauuagcuggaaaugcauuuacagcuggaaaaauaauuuucgcagccguuccuccaaacuuuccuacagaaggcuuagguccuagccaaguaacuauguucccacacauaaucguagacguuagacagcuagaaccuguauuaauaccacucccagacguacguaacaauuucuaccauuauaaucaaucaaaugauagcacaauaaaauuaauagcaaugcuauacacaccauuaagagccaacaacgcaggagaagauguauuuacuguuucauguagaguuuuaacaagacccucaccagacuuugauuucauauuuuuaguaccgccaacaguagaauccagaacaaaacccuuuacugucccaauacuaacagucgaagaaaugacaaauucaagauucccaaucccauuagaaaaacuauuuacaggaccaucaagugcuuucguaguucaaccccaaaauggaagauguacaacugauggaguccuucuaggaacaacacaacuuuccccaguaaacauauguaccuucagaggagacgucacaagaauagcaggaaguagaaauuacacaaugaauuuagcaucacuaaauuggaacaacuacgauccaacagaagaaauuccagcaccucuaggaacuccagacuucguaggaaaaauucaaggaguacuaacccaaacaacaaaaggagauggcucaacaagaggacacaaagcaaccguuuacacugguucagcaccuuuuacuccaaaauuaggcucaguacaauucucuacagauacagaaaaugacuucgaaacacaucaaaacacuaaauuuacuccaguaggaguuauacaagauggaggaacuacucacagaaacgaaccacaacaauggguucucccuucauacucagguagaaauguuccuaauguacacuuagcacccgcagucgcacccacauuuccaggagaacaauuacuuuucuuuagaucaacuaugccagguugcagcggauauccaaauauggaucucgauugccuauuaccucaagaauggguacaacauuuuuaccaagaagcagcucccgcacaaagcgauguagcacuacuucgauuuguaaacccugauacaggaagaguucuauucgaaugcaaacuacauaaaucaggauauguaacaguagcucauacuggucaacacgaucuaguaauuccgccaaacggauauuuuagauucgacucaugggucaaucaauuuuacacacuagcaccaaugggaaauggaacaggaagaagaagauaa

SEQ ID NO: 33959 - RNA, 1617 nt, Artificial Sequence
  derived and/or modified sequence opt6 from VP1__Norovirus_and/or_Norovirus-like__FJ538900
augaaaauggcuucaaacgaugcuaauccuucagacggaucaacagcaaaccuagucccagaaguaaacaacgaagucauggcucuugaacccguagucggagcagcaauagcugcccccguagcaggacaacaaaaugucauagaucccuggauuagaaauaacuuuguucaagcaccaggaggugaauuuacaguaaguccaagaaaugcaccaggugaaauccuuuggagcgccccauuaggaccagauuuaaaucccuauuuaucacaucuugcucgaauguauaacggauaugcaggaggauucgaaguacagguuauacuugccggaaaugcauuuacagcuggaaaaauaauuuucgcagcaguaccacccaacuuuccaacagaaggccuaucccccucccaaguaacuauguuuccacacauaaucguagacguuagacaacuagaaccagucuuaauaccucuuccagauguaagaaacaauuuuuaucacuauaaucaaaguaaugacccuacaauaaaacuaauagcgauguuauauacaccacuaagagccaacaaugcaggagaagaugucuucacaguaucauguagaguauuaacucgaccaucuccagauuuugauuuuauauuucuaguaccuccaaccguagaaucuagaacaaaaccauucacaguuccaauauuaacaguugaagaaaugacaaacucaagauuuccaauaccauuagaaaaacuauuuacuggaccaucaggcgcuuucguaguacaaccucaaaacggacgauguacuacugacggaguacuauuaggaacaacacaacuuuccccaguuaacauuugcacauuuagaggugauguaacacacauagcagguacacacaacuacacuaugaaucuagcaucacaaaacuggaacaauuacgaucccgcugaagaaaucccagcaccauuaggaacuccagacuucgucgguagaauacaagguguauuaacucaaaccacaagaggugacggaagcacaagaggacauaaagcaaccguaucaaccggagauguacacuucacaccaaaauuaggaucaauccaauuuaauacagacacuaauaaugauuucgaaacuggacaaaacacaaaauuuaccccaguaggaguaguccaagacgguaacgguacacaucaaaaugaaccacaacaauggguucuacccucauauucaggaagaaccggacauaauguacaucuugccccagccguugcaccaacauuuccaggagaacaauuacuauucuuuagaucaacaaugccaggauguucuggauauccuaacaugaauuuagauugccuacuuccucaagaauggguacagcauuucuaccaagaagcagcaccagcacaaucagacguagcauuacuacgauucguaaauccagauacaggaagggucuuauucgaauguaaacuucacaaaucuggguacguaacaguagcucauaccggucaacaugaucuaguaaucccaccaaauggauauuucagauuugauucauggguaaaccaauuuuauaccuuagcaccaaugggaaacggcacaggacgaagaagauaa

SEQ ID NO: 33960 - RNA, 1617 nt, Artificial Sequence
  derived and/or modified sequence opt6 from VP1__Norovirus_and/or_Norovirus-like__EU876889
augaaaauggcuucauccgacgcaaacccaucugaugguucaaccgcaaacuuaguuccugaaguaaauaacgaaguaauggcacuagagccuguaguaggugccgcaauagcagcaccaguugcaggucaacaaaauguaauagaccccuggauacgcaauaacuuuguccaagccccaggaggcgaauuuacaguuucaccaaggaaugcccccggugaaauauuauggucagcaccacucggacccgaccuaaauccauauuuaucacaccuugcuagaauguauaacucauacgcugguggauucgaaguccaagucauacuagcaggaaacgccuuuaccgcuggaaaaaucauauuugcagcuguaccaccaaacuuuccuacugaaggucuaucuccaucacaaguaaccauguucccacauauaauaguagauguacgacaacucgaaccuguauuaauucccuuaccugauguaagaaacaauuucuaucacuauaaucaauccaacgacccaacaauaaaauuaauugcuauguuauacacacccuuaagagccaacaaugcuggugacgauguuuuuacuguaucaugcaggguucuuacaagaccaucaccagacuuugacuucauauuucuaguaccaccaacuguagaaucaagaacaaaaccuuuuuccguaccuauacuuacaguagaagaaaugacaaacucuagauuuccaaucccuuuagaaaaacuauucaccgguccaucuagcgcauucguuguucaaccccaaaauggaagauguacuacagauggaguauuacuaggcacaacucaauuaucaccuguaaauauaugcacuuuucgaggcgacguaacucauauagcaggaacucaagaguacacaaugaacuuagcaucccaaaauuggaacaauuacgacccaaccgaagaaauuccugccccuuuagguacaccagacuuugucggaaaaauacaaggaguuuuaacccaaacaacaagacgagacggauccacuagaggacacaaagcaacuguaucaaccggaaguguacacuucacaccaaaauuaggacgaauacaauucucgacagauacauccaacgauuucgaaacaggacaaaauaccagauucacuccagucggaguaguccaagauggagggacaacccaucaaaaugaaccucaacaauggguacuaccuaacuauaguggcagagauucucacaacguacacuuagcaccagccguagcaccaucauuucccggagaacaauuauuguucuuuagauccacuaugccagguugcucaggcuauccaaauaugaaccuagacugccuccuaccacaagaauggguacaacacuuuuaucaagaagccgccccagcacaaucagacguugcacuacuaagauuuguuaaucccgacacaggaagaguauuauuugaaugcaaauuacauaaaucagguuacguaacuguagcacacacaggacaacacgaccuaguaauaccaccaaauggauauuuucgauuugauucaugggucaaccaauuuuacacacuagcaccaaugggaaauggaacaggaagaagaagauaa

SEQ ID NO: 33961 - RNA, 1617 nt, Artificial Sequence
  derived and/or modified sequence opt6 from VP1__Norovirus_and/or_Norovirus-like__EU876887
augaaaauggcaucaucugacgccaacccaucagauggaucaacagcuaacuuaguaccugaagucaauaacgaaguaauggcacuagaaccaguagucggcgccgcaauugcagcaccaguagccggacaacaaaacguuauugaccccuggauacgaaauaacuuuguacaagcaccaggcggcgaguucacaguaucaccuagaaaugcacccggagaaauacuauggucugcaccauuaggaccagaucuaaacccauauuuaucacaccuagcccgaauguacaauuccuacgcaggcgguuuugaaguccaaguaauuuuagcagguaaugcauucacagcuggaaaaauuauauuugcagcaguuccaccaaauuuuccuaccgaagguuuaucaccuucccaaguaacaauguucccccacauaaucguugaugucagacaacuagaaccaguauuaauaccauuaccagauguacgaaauaauuucuaucacuauaaccaauccaaugacccuacaauuaaacucauagccauguuauacacaccauuaagagcaaacaaugcaggagacgacguauuuaccgucucauguagaguucucacucguccaucaccugacuuugacuuuaucuuucuaguucccccaacaguagaaucacgcacuaaaccauuuucaguucccauacucacaguagaagaaaugacaaacuccagauuuccaauaccauuggaaaaacuauuuaccggaccaucuucugcauucguuguacaaccccaaaacggacgauguacuacagauggaguucuacuuggaacaacacaauuaucaccuguaaauauauguacuuuuagaggugacgucacucauauagcaggaacacaagaauauacuaugaaccuagcaucucaaaacuggaauaauuaugacccuacagaagaaauaccugcuccacucggaacuccugauuuugucggcaaaauccaaggagucuuaacucaaacaacaagaagagacggaucuacaaggggacauaaagcuacuguuucaacaggaucaguacauuuuacuccaaaauuaggaagaauacaauuuucaacagauacauccaacgauuuugaaaccggccaaaauacaagauuuacaccuguagguguuguccaagauggauccacuacccaucaaaaugaaccccaacaauggguacuaccuucauacucaggacgagacucucacaacguucaccuagcaccagcaguagcaccaucauuuccuggcgaacaacuauuauucuuucguucaacuaugccuggauguucaggauauccaaauaugaaucuugauuguuuauuaccucaagaauggguccaacauuuuuaccaagaagcugccccagcacaauccgauguagcauuauuaagauuuguuaacccagacaccggacguguucuuuuugaauguaaauuacauaaaucaggauauguaacaguugcacacacaggccaacacgauuuaguaauuccaccuaacgguuauuuuagauucgauucauggguaaaucaauuuuauacacucgcaccaaugggcaacggcgcaggaagacgacgcuaa

SEQ ID NO: 33962 - RNA, 1617 nt, Artificial Sequence
  derived and/or modified sequence opt6 from VP1__Norovirus_and/or_Norovirus-like__FJ411171
augaaaauggcaucuaacgacgcaaauccaucagauggaucuaccgcaaauuugguacccgaaguuaacaaugaaguaauggcacuugaaccaguuguaggcgcagcaauagccgccccaguagcuggacaacaaaauguaaucgacccauggauccgaaacaauuuuguccaagcccccgguggagaguuuacaguuucaccucgcaacgccccaggagaaauauuauggucagccccuuuaggaccagaucuuaauccauaucuuagucacuuagcacgaauguacaacggauacgccggcggcuucgaaguacaaguaauccuagcaggaaaugcauuuacagcaggcaaaauaauuuucgcagcuguaccaccaaacuuuccuacugaaggcuuaucuccuucacaaguaacaauguuuccacacaugaucgucgacguaagacaacuagaaccuguacuaauaccauuaccugauguaagaaacaauuuuuaccauuacaaucaauccaaugacccuacaauaaaacuaaucgcuaugcuauacacaccuuuacgagcuaauaacgcaggagacgauguauuuacuguaucaugccgaguuuuaacacgcccauccccagauuuugauuuuaucuuuuuaguaccaccuacaguugaaucaagaaccaaaccauuuacaguaccaauauuaacaguagaagaaaugacaaauucaagauuccccauaccuuuagaaagacuauacacaggaccauccucagcauuugucguacagccacaaaacgguagauguacaacagauggaguuuuacuaggaacaacacaacuauccgccguaaauauaugcacauuuagaggugacgucacacacauagcuggcucacguaauuacacuaugaauuuagcaagccaaaacuggucaaacuacgacccaaccgaagaaauuccugcaccacuaggaacaccagauuucguaggaaaaauccaaggaaugcuuacacaaacaaccagacgagacggaucaacaagaggacauaaagcaacaguauuaacugguagcgcugauuuugcaccaaaauuaggaagaguucaauuugcaacugauacagacaaugauuuugaaucuggagaaaauacuaaauucacuccaguaggagugauacaagaugguucuacuacccacagaaacgaaccacaacaauggguauuaccaaacuauagugguagaacaggacauaacguacauuuagcaccagcaguugccccaaccuauccaggagaacaacuuuuauucuuuagaucaacaaugccaggauguucaggauauccaaacauggaucuagacugccuacuuccacaagaauggguaagacauuuuuaucaagaagcugccccagcucaaucagauguagcuuuacuaagauucguuaauccagacaccggacgcguccuauucgaauguaaacuacauaaaucaggauauguaacaguagcacacacaggacagcacgaucuaguaauucccccuaacggauauuuccgauucgauuccugggucaaccaauuuuacacucucgcacccaugggaaacggcgcaggacgacgaagauaa

SEQ ID NO: 33963 - RNA, 1617 nt, Artificial Sequence
  derived and/or modified sequence opt6 from VP1__Norovirus_and/or_Norovirus-like__AB447460
augaaaauggcaucaaaugacgccaacccaucggauggcucagcagcaaacuuaguaccagaaguaaacaacgaaguaauggcacuugaaccaguuguaggugcagccauagcagcuccugucgcaggacaacaaaacguaauugauccauggauaagaaacaauuuuguacaagcaccaggaggcgaauuuacaguaucaccaagaaacgccccaggagaaauacucuggucagcaccccuaggaccagauuuaaacccuuacuuaucacacuuagcaagaauguacaauggauacgccgggggauuugaaguacaaguaauauuagcgggaaaugcauuuacagcaggaaaaauaauauuugcugcaguacccccuaacuuucccacugaaggauuaucaccgucacaaguaacaauguuuccacacauaauaguagacguacgacaauuagaaccaguauuaauaccauuaccugacguacgaaacaauuucuaccauuauaaucaaucaaaugacaguaccauaaaauuaauagcuaugcuauauacaccauuacgagcaaacaaugcaggagaagauguuuuuacaguuucauguagaguauuaacacgaccauccccagauuuugacuuuauauuuuuaguacccccaacaguagaaucacgaacuaaaccauuuaccguaccaauauuaacaguagaagaaaugacaaauuccagauucccaauaccacuugaaaaacucuuuacaggaccaucaggugcuuucgucguacaaccccaaaacggaagaugcacaacagacgguguauuauuagguacuacccaauuaagcccaguaaacaucuguacauuuagaggagacgucacacauauagcuggaucaagaaauuacacuaugaaucuugccucacuaaacuggaacagcuacgauccaacugaagaaauuccagcaccauuagguacacccgacuucguagguaaaauacagggauuacuaacacaaacaacaaaaggugacggcucaacacgaggucauaaagcaacagucuacacgggaucagcaccauucacuccaaaacuaggaucaguacaauucuccacagauaccgaaaaugauuucgaaacacaucaaaauacuaaauuuacuccaguuggaguaauacaagacgguucuacaacacaucgaaaugaaccacaacagugggucuuacccucauauucuggaagaaauguacacaacguacauuuagcaccagcaguugcaccaacauuuccuggcgaacaacuauuauucuuuagaaguaccaugccaggauguucaggauaucccaauauggaucuagauugucuacucccacaagaauggguacaacauuuuuaucaagaagcagcaccagcacaaucagauguugcacuauuacgcuucguaaauccugauacuggacgcguauuauucgaauguaaauuacauaaaucagguuacguaacaguagcacacacaggacaacaugaccuaguaaucccuccaaauggauacuucagauucgauucauggguaaaccaauucuauacuuuagcucccauggguaacggaacaggaagaagacgauaa

SEQ ID NO: 33964 - RNA, 1617 nt, Artificial Sequence
  derived and/or modified sequence opt6 from VP1__Norovirus_and/or_Norovirus-like__AB447454
augaaaauggcuucaaaugaugcaaacccaagugauggaucagcagccaauuuaguaccagaaguaaacaaugaaguaauggcacuugaaccaguaguaggcgccgccauagccgcaccuguagcaggacaacaaaauguaauagacccauggauacgaaacaauuucguacaagcaccuggaggagaauuuacuguaucaccacgaaacgcccccggagaaauccuauggucagccccacuaggaccagaucucaaucccuaccuaagccaccuagcaaggauguacaacggauaugcuggaggauucgaaguacaaguaauauuagcaggcaacgccuucaccgcaggaaaaaucauuuucgccgccguaccaccaaauuucccaacagaaggacuaucaccaucccaaguaacuauguucccacacaucaucguagacguuagacaacuagaaccuguacuaauucccuuaccugacguaagaaacaauuucuaucacuauaaccaaucaaacgacucaacaauuaagcucauagcaaugcuauacaccccacuaagagcuaacaacgcuggagaggauguauuuacagucucaugucgaguacuaaccagaccaucaccagauuuugauuuuauauuucuagucccaccaacagucgaaucaagaacuaaaccauucacaguaccaauucuaaccguagaagaaaugacaaauucacgauuuccaauaccucuagaaaaacuauuuacuggaccauccggagcauucguaguacaaccucaaaacggcagaugcacuacagauggaguacuauuaggaaccacccaacucaguccaguaaacauauguacauucagaggagauguaacacacaucgcagguacuagaaacuauacuaugaaccuagcaucccuaaacuggaauaauuacgauccaacagaagaaauaccagcaccauuaggaacaccagacuuuguaggaaaaauacaaggcguucuaacacaaaccacaaaaggcgauggaagcacacguggacacaaagcaacuguuuauacaggcuccgcacccuuuacaccaaaacuaggaagcguucaauucucuacggauacagaaaaugauuucgaaacacaucaaaauacaaaauuuacaccuguuggcguaauacaagacgguggaacaacucacagaaaugaaccacaacaauggguucuucccucauauucaggaagaaacguacauaacguucaucuagcaccagcaguagcaccaacauuuccuggagaacaacucuuauucuuuagaagcaccaugccaggaugcuccggauaucccaauaugaaucuagauugccuauuaccacaagaauggguacaacacuuuuaucaggaagcagcuccugcacaaucagauguugcauuauuacguuucguaaacccagauacaggaagaguauuauucgaaugcaaacuacauaaaucagguuacguaacagucgcacauacaggacaacacgauuuaguaauaccuccaaauggauauuuucguuucgauucauggguaaaucaauuuuacacauuagcaccaaugggaaauggaacaggaagaagacguuaa

SEQ ID NO: 33965 - RNA, 1617 nt, Artificial Sequence
  derived and/or modified sequence opt6 from VP1__Norovirus_and/or_Norovirus-like__AB447443
augaaaauggcaucaaaugacgcaaaccccucagacggauccgcagcaaaccuuguaccugaaguaaauaaugaagucauggcauuagaaccaguaguaggcgcagcaauagcagcaccagucgcuggacaacaaaauguuauagaccccuggauaagaaauaauuuuguccaagcaccuggaggugaauuuacaguauccccuagaaacgcaccgggagaaauucuuuggucagcaccccuaggucccgauuuaaacccauaccuaucucaucuagccagaauguauaacgguuacgcuggcggauuugaaguacaaguaauacuugcuggaaaugcauucacugccggaaaaauaauauucgcugcuguaccaccaaacuuuccaacugaaggucucucacccucacaaguaacuauguucccccacauaauaguagacguacgacaacuagaaccaguacuaauaccacucccagauguaagaaacaauuucuaucacuauaaucaaucaaaugauucaacaauaaaauuaauagccauguuauacacaccccucagagcaaacaacgcuggagaagacguauuuaccguuucauguagaguacucacaagaccaucgccagacuucgacuucauauuucuaguaccaccaacaguugaaucacgaacaaaaccauucacaguacccauauuaacagucgaagaaaugacaaacucaagauuuccaauaccuuuggagaaacuauuuaccggaccaucaggagccuuuguaguccaaccccaaaaugguagauguacuaccgacggaguauuauuagguacaacacaacucucaccaguuaauauaugcacuuuucgaggugacguuacacauauagccggaucacgcaacuacacaaugaaccuugcauccuuaaauuggaacaauuacgaucccacagaagaacuaccagcaccacuaggaacaccagacuuugucggaaaaauccaagguguucuuacccaaaccacaaaaggagacggaucaacuagaggccauaaagcaacaguauauacaggaucagcaccauuuacacccaaauuaggaucuguccaauucucaacagacacagaaaacgauuucgaaacacaccaaaacacaaaauucacaccaguaggaguaauacaagaugguucaacaacacauagaaaugaaccacaacaauggguacucccaucauacuccggcagaaauguucauaacguacaucuugccccugcaguagcacccacauuuccuggugaacaacuacuauucuuuagaucaacaaugccuggauguucaggauauccaaauauggaccuagacugcuuacuuccucaagaauggguacaacauuucuaucaagaagcagcuccagcacaaagugauguagcacuccuccgauucguuaacccagauacaggaagaguauuauucgaaugcaaacuacauaaaucaggcuauguaacaguugcucacacuggacaacacgauuuaguuaucccacccaacggauauuucagauuugauucauggguaaaucaauuuuacacacuugcaccaaugggaaauggcacaggaagaagaagauaa

SEQ ID NO: 33966 - RNA, 1617 nt, Artificial Sequence
  derived and/or modified sequence opt6 from VP1__Norovirus_and/or_Norovirus-like__AB447430
augaaaauggcaucaaacgacgcuaacccaucugauggaucuacugcaaaucuagucccugaaguaaacaaugaaguaauggcccucgaaccaguaguaggcgccgcaauagcagcaccaguagcuggacaaacaaaugucauugauccauggauucguaauaacuuuguacaagcaccuggaggugaauuuaccguuucuccaagaaacgcuccaggagaaauauuauggagcgcaccccuaggaccagaucuaaauccauaucuaucacacuuagcacgaauguauaauggauaugcugguggcuuugaaguacaaguaauucuugcaggaaaugcauuuaccgcaggaaaaauaauauuugcaaaaguuccaccuaacuuccccacagaaggauuaucuccaucacaagucacaauguucccacauaucauuguugacguacgacaauuagaaccuguacuaauaccuuuaccagaugucagaaacaacuuuuaucacuauaaucaauccaaugacuccaccauaaaacuaauagcaaugcuuuacacaccucuaagagcaaacaaugcaggagaagacguauuuacaguaucaugucgcguacugacaagaccaucuccagauuuugacuuuauauuucuaguaccaccaacagucgaaucacgaacaaaaccauuuacaguaccuauacuuacaguagaagaaaugacaaacucacgcuucccaauaccacuagaaaaacuauucacaggaccaucaggugcauucguuguacaaccacaaaaugguagaugcaccacagacgguguauuauuaggaacaacacaacuaucaccagucaauauauguaccuuucgaggagacguaacacauauagcuggaucacgaaauuauacaaugaaccuagcuucauuaaacuggaacaauuaugauccaacagaggaaauaccagcuccucuaggaacaccagauuucguaggcaaaauacaggguguauuaacacaaacaacaaaaggugacggauccacaagaggacauaaagcgacaguauacaccggaagugcaccauuuacgccuaaguuaggauccguacaauucagcacagauacagaaaaugauuuugaaacacaccaaaauacaaaauucacacccgucggaguaauccaagauggaucuacaacacauagaaaugaaccacaacaauggguucuacccucauacucaggacgaaauguacacaauguacaccuagcgcccgcaguagccccuacauuuccaggcgaacaauuguuauucuuccgcagcacaaugccaggaugcucuggauauccaaauauggaccuagauugcuuauuaccacaagaguggguacaacacuuuuaccaggaagcagcaccagcucaaucagauguagcauuauuaagauuuguaaauccagauacaggaagaguauuauucgaaugcaaauuacacaaaucaggauacguuaccguagcccacacaggacaacaugauuuaguuauaccaccuaacggauacuucagauucgauucauggguaaaccaauuuuacacacuagcuccaaugggaaauggaacaggaagaaggagauag

SEQ ID NO: 33967 - RNA, 1617 nt, Artificial Sequence
  derived and/or modified sequence opt6 from VP1__Norovirus_and/or_Norovirus-like__EU078420
augaaaauggccucuaaugacgccaaccccucugauggaucagcagcuaaccuaguaccugaagucaacaaugaagucauggcacuagagccuguaguuggagcagcaauagcagcaccagucgcaggacaacaaaacguuauugacccauggauaagaaacaacuucguacaagcaccuggaggcgaguucaccgugucaccaagaaaugccccaggagaaauacuauggucagccccacuaggaccagaucuaaacccuuauuuaucccacuuagcaagaauguauaacggauacgccggcgguuucgaaguacaaguuauuuuagcuggaaaugcauuuacagcaggaaaaauaauauuugcugcuguaccaccaaauuuuccaacagaaggacuaucucccucacaaguuacaauguuuccacacauaauaguagacguaagacaauuagaacccguacucauaccgcuuccagaugucagaaauaacuucuaccacuacaaccaaucaaaugauucaacaauaaaacuaauagcuaugcuauacacaccauuaagagccaacaacgcuggugaagauguauucacaguaucuuguagaguccuaacaagaccuucaccagacuucgacuuuauauuucuaguaccaccaacuguagaaucaagaacuaaaccauucacugucccuauauuaacaguagaagaaaugacaaauuccagauuuccaauaccacuagaaaaacuauuuacaggaccaagcucagcauuuguuguccaaccucaaaacggaagauguacaacagacggagucuuacuagguaccacacaacuaucaccaguaaacauauguacauuccguggagacguaacacacaucgcaggcucuagaaauuacacuaugaaccuagcaucacuaaacuggaacaauuaugaucccacugaagaaauaccagcaccucuaggaacaccugauuuuguuggaaaaauccaaggaguauugacucaaaccacaaaaggagacgguagcaccagaggucauaaagcaaccgucuacacaggauccgcuccauuuacuccuaaauuaggaucaguucaauuuucaacagacacagaaaaugauuucgaaacccaucaaaauacaaaauucacaccagucggcgucauucaagauggauccacaacucacagaaaugaaccacaacaauggguacuaccaucauauaguggcagaaacguccauaauguacauuuagccccugcaguagcccccacuuuuccaggagaacaacuauuauuuuuccgaucuacaaugccaggcugcuccggcuacccaaacauggauuuagauugccuucuaccacaagaauggguucaacauuuucaucaagaagcagcuccagcacaaucagaugucgcacuucuacgauucguuaaccccgacacuggaagaguauuauucgaaugcaaauuacauaaaucaggauauguaacuguagcacacacaggacaacaugaccuuguuauaccaccaaauggauacuuucgauucgauuccuggguaaaucaauuuuacacacuagcaccaaugggaaauggaaccggacgaagacguuaa

SEQ ID NO: 33968 - RNA, 1617 nt, Artificial Sequence
  derived and/or modified sequence opt6 from VP1__Norovirus_and/or_Norovirus-like__AB385637
augaaaauggcuucaucugacgcuaauccaucugauggaucuacagcuaaccuaguaccagaagucaacaacgaaguaauggcucuagaacccguaguaggagcagcuauugccgcaccaguagcaggacaacaaaauguaauagauccauggauaagaaacaacuucguccaagcccccgguggagaauuuacaguaucccccagaaaugcaccaggagaaauuuuauggucugcaccccucggaccagacuuaaauccauauuuaucccacuuagcuagaauguauaacucauaugccggaggauuugaaguacaaguaauacuugcagguaaugcauuuacagcuggaaaaauaauauucgcugcaguuccuccaaacuuuccaacagaaggucuaucuccaucacaagucacaauguuuccucauauaauaguagauguucgacaacuagaaccuguauuaauaccauuacccgauguaagaaacaauuucuaucauuauaaucaaucaaaugaccccacaauaaaacuuauagcaauguuauauacuccucuucgagcaaacaaugccggugacgauguauucacaguaucaugucguguccuaacaagaccaucuccugauuuugacuuuauauuuuuaguaccaccuacaguagaaucacgaacaaaaccauucucaguaccaauauuaacaguugaagaaaugacaaacucacgauuuccaauaccauuagagaaauuauuuacaggaccuucaucagcauucgucguucaaccacaaaacggcagauguacaacagauggcguauuauuaggaaccacacaacuauccccaguaaauauauguacauuuagaggugauguuacacacauagcaggcacacaagaauauacaaugaaccuagcaucccaaaauuggaauaacuaugauccaacagaagaaauaccagcaccguuagguacaccagacuucguuggaaaaauacaaggcgucuuaacacaaaccacacgcagagacggauccacuagaggacacaaagccacagucuccaccggcagcguccauuuuacaccaaaauuaggaagaauccaauuuucaacagacacaucaaaugauuucgaaaccggacaaaauaccagauuuacaccaguaggcguuguacaagacggauccacuacccaucaaaacgaaccucaacaauggguuuuaccaaacuacaguggaagagauggccauaauguacauuuagcuccugcugucgcaccauccuuuccaggugaacaacuacucuucuuucguucaacuaugccaggaugcucaggauaccccaauaugaaucuagacuguuuacuaccacaagaaugggugcaacauuuuuaccaagaagccgcaccagcucaaucugauguagcauuacuaagauuuguaaacccagacacgggacgaguauuauucgaaugcaaacuacacaaaucugguuacguaacagucgcucauacuggacaacaugauuuaguuauaccaccaaacggauauuuuagauucgacucuuggguaaaucaauuuuauacacuagccccaaugggaaacggaacaggcagacgcagauaa

SEQ ID NO: 33969 - RNA, 1617 nt, Artificial Sequence
  derived and/or modified sequence opt6 from VP1__Norovirus_and/or_Norovirus-like__EF202568
augaaaauggccucaaaugacgcaacucccucagacggaucagcagcuaacuuaguaccagaaguuaacaaugaaguaauggcacuagaaccaguuguaggagccgcuauagcagcaccaguagcaggacaacaaaauguaauugaccccuggaucagaaauaacuuuguacaagcuccaggcggagaauuuacaguaucaccaagaaacgcaccaggagaaauacuuuggagugcucccuuaggucccgaucuuaauccauauuuaucucauuuagcaagaauguauaacggauacgcgggagguuucgaaguccaaguaauauuagcagguaacgcauuuacagcagguaaaaucauuuucgcugcuguuccaccaaauuuuccgacugaaggacuaucuccaucccaaguuacuauguuuccccacauaauaguagacguuagacaauuagaaccuguacuaauccccuuaccagauguaagaaacaacuucuaucacuacaaccaguccaaugacccaacaaucaaauuaauagcaaugcuuuauacaccccuacgugcaaauaaugccggugacgauguauucacaguaucuuguagagucuuaacacgaccauccccagacuuugacuucauauuuuuaguaccaccaacaguggaauccagaacaaaaccauuuucaguaccuauuuuaaccguagaagaaaugacaaauuccagauucccuauaccacuagaaaaauuauuuacagguccauccucuuccuucguaguacaaccacaaaauggacgcuguaccacagacggaguacuacuaggaacaacacaacuuucuccaguaaauauauguacuuucagaggagauguuacucacauagcaggaacacagaacuauacaaugaaucuagcaucacaaaacuggaauaacuacgauccaacagaagaaauaccugcaccucuaggaacaccagacuuuguaggaaaaauucaaggcguucuaacacaaacaacaaggcgagacggaucaacacgaggccauaaagcaacaguaucaacaggcucaguacacuuuacaccaaaauuaggaucaguacaauucucaacugacacaucaaacgacuucgaaacaggucaaaacacccgcuucacucccguuggaguaguacaagacgguucaacaacaccacaaaaugaaccacaacaauggguucuaccagacuauucaggacgcgauucacauaauguacaccuugcaccagcaguugcaccaacauuuccaggcgaacaauuauuauucuuuagaucaaccaugccaggauguucuggauaucccaauaugaaccuugauugccuauuaccccaagaauggguacaacacuucuaucaagaauccgcuccagcucaaagcgacguugcacuccuuagauuuguaaauccagauacaggaagaguucuauucgaaugcaaauuacauaaaucagguuacguaacaguagcucacacaggccaacacgaccuagucauaccaccaaauggauacuuuagauuugauucauggguaaaccaauucuacaccuuagcuccaaugggaaauggcgcaggacgccgaagauaa

SEQ ID NO: 33970 - RNA, 1617 nt, Artificial Sequence
  derived and/or modified sequence opt6 from VP1__Norovirus_and/or_Norovirus-like__AB294781
augaaaauggcaucaaaugacgcaaauccaucagauggaagcacagcaaaccucgucccagaaguaaacaaugaagucauggcacuggaaccaguagucggugccgccaucgcugcaccugucgcaggucaacaaaauguaauagacccauggauuagaaauaacuuuguacaagcucccggaggagaauuuacaguaucaccccguaaugcacccggagaaaucuuaugguccgcuccacuaggaccagaccuaaauccauauuuaucacaccuagcaagaauguacaauggguacgcaggaggauuugaaguacaaguaauacuugcaggaaaugccuuuacagcaggaaaaauaauauuugcagcaguaccaccaaauuuuccaacagaaggacuaucuccaagucaaguaacaauguuuccacauauaauaguagauguacgccaacuagaaccaguacuaauaccacuaccagauguaagaaauaacuucuaucauuauaaccaaucaaaugacccuacuaucaaacucaucgcuauguuauauacaccauuacgagcuaauaaugccggagaagaugucuucacaguaucaugucgaguguuaacaagaccaucaccagacuuugacuuuauauuccuagucccuccaacaguugaaaguagaacaaaaccauuuacaguaccuguacuuacaguugaagaaaugaccaauucccgauucccaauaccauuagaaaaacuauuuacaggaccaaguggagcauuugucguccaaccacaaaacggccgauguacaacagauggaguacuacuaggcaccacacaauuaucaccuguaaacauauguacuuucagaggagacguaacacacauagcaggaacacacaacuacacaaugaaucuagcaucccaaaacuggaauaacuacgauccaacagaagaaauacccgcaccacuagguacaccugacuucguaggaagaauacaagguauguuaacacaaaccacuaaaggagauggauccacuagaggucacaaagcuacaguuucuacaggcgacguacauuucacaccaaaauuaggaucuauacaauucaacacugauacaaauaacgacuuugaaacaggacaaaacacaaaauuuacuccaguaggaguaguucaagauggaaacggaacacaucaaaaugaaccacaacaauggguuuuaccaucauauucagguagaacaggacacaacguacacuuagcacccgcuguagcacccacauuuccuggagaacaacuacuuuucuuucgaucaacaaugccaggcugcucuggauauccaaacaugaaucuagauugcuuauuaccucaagaauggguacaacacuuuuaccaagaagccgcaccagcacaaucugacguagcucuauuaagauucguaaacccagauacaggaagaguacuauucgaaugcaaauuacauaaaucuggcuauguaacaguagcccauacuggacaacacgaucuaguaauaccgccaaauggauauuuccgcuucgauucauggguaaaucaauuuuacacacuugcaccaaugggaaacggaacaggaagacgaagauaa

SEQ ID NO: 33971 - RNA, 1617 nt, Artificial Sequence
  derived and/or modified sequence opt6 from VP1__Norovirus_and/or_Norovirus-like__AB303940
augaaaauggcguccaaugacgcaacuccaucagacggcucuacagcaaaccuagucccagaaguaaacacagaaguaauggcacucgaaccaguaguaggagccgccaucgcagcaccaguagcaggacaacaaaauguaauagacccauggaucagaaauaauuucguucaagcuccaggaggugaauuuacaguuaguccaagaaacgcaccaggcgaaauauuauggucagcaccccuaggacccgaucuaaaccccuaucuuucucaucuagcaagaauguacaacggauacgcaggaggcuucgaaguacaaguaauacuagccggaaacgccuucaccgcuggaaaaaucauauuugcagcuguaccuccaaauuucccaacagaaggauuaucaccuucccaaguaacaauguuuccacacauaauuguagacguacgucaacuagaaccaguauuaauaccacuaccagauguaagaaauaacuuuuaucacuauaaccaaucuaaugacccgacaauaaaacuaauagcaauguuauauacaccccuaagaacaaauaaugcuggagacgacguauuuacuguaucaugcaggguacuaacaagacccaguccagacuucgacuucauauuccuaguuccuccaacaguagaaucacgaacaaaaccauucucaguaccaauucuaacagucgaagaaaugaccaauucaagauuuccuauaccuuuagaaaaauuauucacaggaccuucuagcgcauucguaguacaaccacaaaauggaaggugcacaacugauggaguacuauuaggaacuacacaacuaucaccuguuaauauuugcacauuccgaggagacguaacacauauagcgggaacacaaaacuacacaaugaacuuagccucacaaaacuggaauaacuacgacccuacugaagaaauuccagcuccauuaggcacuccagauuuuguagguaaaauccaaggaguacuaacucaaacaacacguagagacgguucaacaagaggccacaaagccacaguaucaacaggaucaauucacuuuacaccaaaguuaggaucuguacaauuuuccacugacacauccaacgacuuugaaacaggacaaaacacacgauucacuccaguaggaguaguacaagacggcucaacaacccaccaaaacgaaccacaacaauggguacuaccagacuauucaggaagagauucacacaacguacauuuagcaccagcaguagcaccaacuuuuccuggagaacaauuacuauuuuuccgcucaaccaugccagguugcagugguuacccaaacaugaacuuagauugccuauuaccacaagaauggguucaacacuuuuaucaagaaucagcaccagcacaaucagacgucgcccucuuaagauuuguaaacccagauaccggaagaguacucuucgaauguaaacuccauaaauccggauauguaacaguagcacauacaggacaacaugaucuagucauaccucccaacggauauuuuagauuugacucauggguaaaccaauuuuacacacuagcccccauggguaacggagcaggaagaagaagauaa

SEQ ID NO: 33972 - RNA, 1617 nt, Artificial Sequence
  derived and/or modified sequence opt6 from VP1__Norovirus_and/or_Norovirus-like__DQ415279
augaaaauggcaucuaaugaugcaaacccuucagacggcucaacagcuaauuuaguaccugagguaaauaaugaaguaauggccuuagaaccaguaguaggugcagcaauagcagcucccguagcaggacaacaaaauguaauagacccauggauaagaaauaacuuuguccaagcaccaggaggagaauuuaccguauccccacgaaaugcuccaggagaaauacuauggucagcaccauuaggaccagauuuaaauccuuauuuaucacaucuagcaagaauguauaacgguuacgcuggaggauucgaaguacaaguaauuuuagcaggaaacgcauuuaccgcaggaaaaauuauauuugccgcaguacccccuaacuuucccacugaaggacuaucucccucacaaguuacaauguucccacacguaauaguagacguaagacaacuugaaccaguacuaauccccuuaccagacgucagaaacaacuuuuaccauuauaaucaaucuaaugauccaacaauaaaacuaaucgcaauguuauacacaccauuaagagcaaacaaugcuggagaagacguauuuaccguaucaugucgaguucuaacaagaccaagcccagacuuugacuuuauauuuuuaguuccacccacaguagaaucaagaacaaaaccauucaccguaccaauacuaaccguugaagaaaugaccaauucacgcuuuccuauaccccuagaaaaacucuuuacaggcccaucaggagcuuuuguaguacaaccucaaaauggacgauguacaacagauggaguacuucucggaacuacucaauuaucaccugucaauauauguacauuucgaggagacguaacacacauagcaggaacucacaauuacacaaugaaucuugcaucccaaaacuggaauaauuacgacccaacugaagaaauaccagcaccacuuggcacaccagauuuuguaggacgaauccaaggcaugcucacacaaacaacccgcggagauggaucaaccagaggucacaaagcaaccgucucaacuggagauguacauuucacaccaaaauuaggaucaauacaauucaacacagauacuaacaacgauuucgaaacaggacaaaauaccaaauuuacucccguuggaguaguucaagacggaaacggaacccaucaaaaugaaccacaacaauggguauuaccaaguuacuccgguagaacuggacacaacguacacuuagcacccgcaguagcacccacauucccaggcgaacaauuacuauucuuuagaucuacaaugccaggauguucaggcuauccuaauaugaaucuagauugucuauuaccgcaagaauggguucaacauuucuaucaagaagcagcgccagcacaaucagauguagcuuuacuaagauuuguaaaucccgacacaggacgaguauuauuugaaugcaaacuacauaaaucaggauacguaacugucgcacacacaggccaacaugaccuaguaauaccaccaaacgguuauuuuagauucgauucauggguuaaccaauucuacacccuagcuccaaugggcaacggaacaggaagaagaagauaa

SEQ ID NO: 33973 - RNA, 1617 nt, Artificial Sequence
  derived and/or modified sequence opt6 from VP1__Norovirus_and/or_Norovirus-like__DQ078794
augaaaauggccaguaaugacgcaacaccauccgauggaucaacagccaacuuaguaccagaaguaaacaaugaaguaauggcacucgaaccaguagugggagcugcaauagcugcuccuguagcaggccaacaaaacguaauagacccauggauaagaaauaacuuuguucaagcaccaggaggagaauuuacaguaucaccaagaaaugcaccaggagaaauacucuggucagcaccccuaggaccagaucuaaacccauaucucucacaccuagcaagaauguauaacggauaugcaggcgguuucgaaguccaagucauacucgcaggaaacgccuucacagcaggaaaaauaauuuucgcugcuguaccaccuaauuuuccuacagaaguauuaucaccaucucaaguaaccauguuuccacacauaauaguugacgucagacaauuagaaccaguacuaauaccauuaccugaugucagaaauaaucuuuaucacuacaaucaaucuaacgaucccacaauacgauuaauagcaaugcuauauacaccacuacgagcaaacaaugcaggcgacgauguauuuacaguaucuugucguguauuaacaagaccaucuccagacuuugauuuuauguuuuuaguacccccaacugucgaaucaagaacuaaaccuuucucaguaccuauauuaacaguugaagaaaugaccaacucaagauuuccaauaccauuagaaaaauuauuuacaggaccuucauccgcauuuguaguacaaccacaaaauggaagaugcacaacagauggcguccuacugggaacaacacaacucucaccaguuaacauaugcaccuuuagaggugacguuacucacauagcuggagcacaaaauuacacuaugaaucuagcaucacaaaacuggaacaauuacgauccaaccgaagaaauacccgccccacuuggaacaccagauuuuguaggaaaaauacaaggcguauuaacacaaacaacucgucgugauggaucaacacgaggacacaaagcaacuguaucuacaggauccguacauuucacuccuaaauuaggaucuguccaauuuucaacagacacaucaaacgauuuugaaaccggacaaaacacaagauuuacaccaguaggcguaguccaagauggcuccaccacucaucaaaacgaaccgcaacaauggguucucccugacuauucaggaagagacagucauaacguacaccuugcaccagcaguagcaccaacauuucccggagaacaauuacuauucuuuagaucaacaaugccaggauguucaggauauccuaacaugaauuuagacugcuuauuaccacaagaauggguacaacauuucuaucaagaaucagcacccgcacaaucagacguagcauuacuacgauucguaaacccagacaccgguagaguauuauuugaaugcaaauuacauaaaucaggauauguaacagucgcacacacuggccaacacgaccucguaauaccacccaacggauauuucagauucgacucauggauaaaucaauuuuacacauuagcaccaaugggaaauggagccgguaggagaagauaa

SEQ ID NO: 33974 - RNA, 1617 nt, Artificial Sequence
  derived and/or modified sequence opt6 from VP1__Norovirus_and/or_Norovirus-like__KP784691
augaaaauggcuucuaaugaugccacaccaucugauggauccacagcuaacuuaguacccgaagucaacaaugaagucauggcacuagaaccaguaguaggagccgcaauagcagcaccaguagcaggacaacaaaacguaauugacccauggauaagaaauaauuuuguccaagcaccaggaggagaauuuaccguauccccuagaaaugcuccuggugaaauauuauggucagcaccccuaggacccgauuuaaacccauaccucucucaccuugcaagaauguacaaugguuacgcaggcggauucgaaguacaagucauauuagcaggaaaugcauuuaccgcaggaaaaauaauauucgcugccguuccuccaaacuucccaacugaaggauuaucucccucacaaguaaccauguuuccacacauaauaguugauguaagacaacuugaaccaguucucauaccucuucccgauguaagaaacaauuuuuaccacuauaaccaaucaaaugacccuaccauuaaauuaauagcaauguuauacacuccucuaagagcuaacaacgcaggagacgaugucuuuacaguaucuugucgaguauuaacacgaccaucaccggauuuugacuuuauauuuuuaguaccucccacaguugaaucaagaacaaaaccuuucucaguaccaauucuaacaguugaagaaaugacaaauucaagauuuccaauaccacuagaaaaacuauuuacaggacccuccucagcuuucgucguccaaccacaaaacggaagauguaccacagaugguguauuacucggcacaacacaacuaucuccgguaaauauaugcacauuucgaggagauguaacucauauugccgguacacauaauuauaccaugaauuuagcaucacaaaacuggaacaacuacgauccaacagaagaaauaccagcaccacuaggaacaccagacuuuguaggaaaaauacaaggaguauuaacgcaaacaacaagaggagaugguucaaccagaggacacaaagcaacuguaucaacaggagaugcacauuucacaccuaaauuaggaucuguaauguuuucaacugauacuaauaacgauuucgaaacaggacaaaauacaagauucaccccaguuggcguaguacaagacggaucaacgacccaucaaaacgaaccacaacaauggguacuucccucauauuuaggaagagauagucauaauguccauuuagccccugccguagcaccuagcuucccaggagaacaacuauuauucuuuagauccacaaugccaggauguucaggcuauccaaacaugaacauggauugcuuacuuccucaagaauggguccaacacuuuuaucaagaagcagcaccagcacaaucagacgucgcacuacuuagauuuguuaauccugacacaggaagaguauuauuugaaugcaaacuacauaaaucuggauauguuacaguagcucauacuggacaacaugauuuaguaauaccaccaaauggcuauuuccgauuugacucauggguaaaucaauuuuauaccuuagcuccuauggguaacggaacagguagaagaagauga

SEQ ID NO: 33975 - RNA, 1617 nt, Artificial Sequence
  derived and/or modified sequence opt6 from VP1__Norovirus_and/or_Norovirus-like__KX907727
augaaaauggcaucauccgaugcaaacccauccgauggaagcgcagcaaaccucguaccagaaguaaacaacgaaguaauggcuuuagaaccaguagucggugcagcaaucgcagcaccaguagcaggacaacaaaauguuauagacccuuggauuagaaacaauuuuguacaagccccagguggugaauuuacagucucaccuagaaacgcaccaggagaaauacuuuggucugcaccacuaggaccugaccuaaaucccuauuuaucacacuuagcaagaauguauaacggauacgcaggaggauucgaaguacaagucauauuagcaggcaaugcauuuacagcaggaaaaauaauauucgcagcaguaccaccuaacuuuccaacagaaggcuuaucaccaucucaagucacaauguucccucacauaauagucgacguaagacaacuagaaccaguccuaaucccucucccggacguaagaaauaauuucuaccauuauaaucaauccaaugaccccaccauaaaauuaaucgccauguuauauacuccauuaagagcaaacaacgccggugacgacguauuuaccguaucauguagaguacuaacgcgaccaucaccugacuucgacuuuauuuucuuaguacccccaacaguagaaaguagaaccaaaccauucuccguaccaguauuaacaguagaagaaaugacaaauagcagauuuccaauaccacuugaaaaacuauuuacagguccaucauccgcauuuguaguccaaccccaaaacggaagaugcacaacagaugguguucuauuaggaacaacucaauuaucaccugucaauauaugcaccuuucgaggagacgucacacauaucacaggaucaagaaacuacacaaugaaucucgcaucacaaaacuggaacaauuaugaccccaccgaagaaauaccagcaccacuaggaacuccagacuuuguaggaaaaauacaaggaaugcuaacacaaacaacuagaacugacgguucaacuagaggacacaaagcaauuguauacacuggaucagcagauuucgcaccaaaauuaggacgcguacaauucgaaaccgauacagaucaugauuuugaagccaaccaaaauaccaaauuuacaccaguaggaguaauacaagacgguucaaccacacauagaaacgaaccccaacaauggguccuaccauccuacucaggaagaaacacacacaauguucaccuugcaccagcuguagcaccaacauucccaggagaacaacuacuuuucuucagaucaacaaugccagguugcucaggauauccaaauauggacuuagauugucuacuaccacaagaauggguccaauauuuuuaucaagaagccgcuccagcacagucagauguagcacuacuaagauuugucaacccugauaccggaagaguacuuuucgaaugcaaauuacauaaaucaggauauguaacagucgcacacacaggacaacacgaucuuguaauuccacccaauggcuauuuuagauuugauaguugggucaaucaauuuuauacauuagcaccaauggguaauggaaccgguagaagacgauaa

SEQ ID NO: 33976 - RNA, 1617 nt, Artificial Sequence
  derived and/or modified sequence opt6 from VP1__Norovirus_and/or_Norovirus-like__KX354049
augaaaauggcaucaucagacgcaaacccauccgauggaucugccgcaaacuuagucccagaagucaauaacgaaguaauggcucuagaaccaguaguaggagcagccaucgcagcaccaguagcaggacaacaaaauguaauagacccauggauaagaaauaacuuuguacaagcaccagguggagaauuuacagucucaccaagaaaugccccaggagaaauacuauggucugcuccuuuaggacccgaucuaaaucccuaucuaucucacuuagccagaauguacaauggauaugcaggaggauuugaaguccaaguaauacuagcaggcaaugcauucacugcuggcaaaauaauauuugcagcugucccaccaaacuuuccaacugaaggauuaucaccaucccaagucaccauguuuccacauauaauaguagaugucagacaauuagaaccaguauuaaucccauuaccagauguaagaaauaacuuuuaccacuacaaucaaucaaaugacccaacaauaaaauuaauugcaauguuauacaccccauuaagagcaaacaacgcuggugaugacgucuuuaccguaucauguagaguauuaacacguccaucaccagauuucgacuuuaucuuucuagucccaccaacaguugaaucaagaaccaaacccuuuucaguaccaaucuuaacugucgaagaaaugacaaacucaagauuuccaauaccacuagaaaaacuuuucacaggaccaagcuccgcauucguaguacaaccacaaaacggaagauguacaacugacggcguacuuuuaggaacaacacaacuaucucccgucaauauuuguacuuuucgaggagacguaacccauauaacaggaucucgaaacuauacaaugaaucucgcaagucaaaacuggaacaauuacgacccaacagaagaaauaccagcaccacuaggaacacccgacuuuguaggaaaaauacaaggaguacucacacaaaccacaagagcagauggcagcacacguggacauaaagcaaccgucuacacagggucagcagacuuugcaccuaaacucggaagaguacaauuugaaacagauaccgaccacgauuuugaagccaaccaaaauacuaaauucacacccgucggagucauccaagacgguggaacaacacacagaaaugaaccucaacaauggguccuacccucauacucaggaagaaauacacauaauguacacuuagccccugcaguagcaccaaccuuuccaggagaacaacuauuauucuuuagauccacaaugccaggaugcucaggauauccaaauauggauuuagacugccuauuaccacaagaauggguacaauacuucuaccaagaagcagcaccagcacaauccgauguagcacuacuaagauucguaaauccagauaccggaagagucuuauucgaaugcaaacuacauaaauccggauauguaacaguugcacacacuggacaacacgaucuugucaucccaccuaauggauauuucagauucgacuccuggguaaaucaauuuuacacacuagcaccaaugggaaaugguacaggacgaagacgauaa

SEQ ID NO: 33977 - RNA, 1617 nt, Artificial Sequence
  derived and/or modified sequence opt6 from VP1__Norovirus_and/or_Norovirus-like__KX354024
augaaaauggcaaguucagaugcuaacccuucagaugguucagccgcaaauuuaguaccagaaguuaacaacgaaguaauggcauuagaaccagugguaggcgcagcuauagcagcaccaguagcaggacaacaaaauguuaucgauccauggauaagaaauaauuuuguacaagcuccaggaggugaauuuacaguaucaccaagaaacgcuccaggagaaauacuauggucagccccauuaggaccagaucuaaacccauauuuaucacauuuagcaagaauguacaacggcuaugccggaggauuugaaguacaaguaauacuagcaggaaaugcuuuuacagcaggcaaaguaauauuugcagcaguacccccaaacuuuccaacagaaggacuaucaccaucucaaguaacaauguucccucauauagucguagacguacgccaacuagaaccaguauuaauuccacuuccagacgucagaaauaauuuuuaucauuauaaccaaucaaaugacccaacaauaaaauuaaucgcaauguuauacacaccauuaagagcaaacaaugcaggagacgacguauucaccguaagcugcagaguuuuaaccagacccaguccagacuuugacuuuauauuucuaguacccccaacuguagaaucuagaacaaaaccauuuucgguaccaguuuuaacuguagaggaaaugacaaauucaagauuuccaauuccacuugaaaaacuauuuacagguccaagcucugcauucguuguacaaccacaaaacggcagaugcaccacagacggcgucuuacucggaacaacacaacuuucuccuguaaacaucuguacauuuagaggugacguaacacauaccacaggaucaagaaauuauacuaugaacuuagccucacaaaauuggaauaauuacgacccuacugaagaaauaccagcaccuuuaggaacaccagauuuuguaggaaaaauacaagguguacuaacacaaacaacuagaacagacggaucaacaagaggucacaaagcaacaguguacacaggaucagcagacuuugccccaaaauuaggaagaguacaauucgaaacagauacagaccacgauuuugaagccaaccaaaauacaaaauucacuccaguaggaguaauacaagacggauccacaacacauagaaaugaaccacaacaauggguucucccaagcuacucuggacggaauacacauaacguccaucuagcaccagcuguagcucccaccuuuccuggagaacaacuacuauucuuucgaucuacaaugccaggauguucaggauaccccaauauggauuuagacugcuuauuaccccaagaauggguacaauauuucuaucaagaagcagcuccagcacaauccgauguugcacuacuacgauucguaaauccagacacaggaagaguccuauuugaaugcaaauuacacaaaucaggauaugucacagucgcacacacuggucaacaugacuuaguaauaccacccaauggcuauuucagauucgacucuugggucaaucaauuuuacacucuagcucccaugggaaauggaacaggaagaagaagauaa

SEQ ID NO: 33978 - RNA, 1617 nt, Artificial Sequence
  derived and/or modified sequence opt6 from VP1__Norovirus_and/or_Norovirus-like__KX353955
augaaaauggcaaguaaugacgcaaauccuucagauggauccgcagcuaacuuagucccagaaguaagcaaugaaguaauggcccuagaaccaguaguaggagccgcuauagcagcuccagucgccggccaacaaaacguaaucgauccauggauaagaaauaacuuuguccaagccccaggaggagaauuuacaguaucaccuagaaacgccccuggagaaauacuuuggucagcaccauuagguccagauuuaaauccauaucuaucucacuuagcaagaauguauaacggauacgcaggaggauucgaaguacaaguaauacucgcaggaaacgcauuuacagcaggaaaaauaauuuucgcugcaguaccuccaaacuucccaacagaaggacugucgcccucacaaguaacaauguucccacauauaauaguugacguaagacaacucgaacccguacucaucccauuaccagacguaagaaacaauuuuuaccauuauaaucaaucaaacgacucuacaauaaaauuaauagcaaugcuuuauacacccuuacgugcuaacaacgcaggagaagauguauuuacaguaaguuguagaguucuaacuagaccaucaccagauuuugacuuuauuuuucuaguuccaccaaccguagaaaguagaacuaaaccauuuacuguaccaauacuaaccguagaagaaaugacuaauucacgauuuccaauaccuuuagaaaaauuauuuacaggaccuucaggagcauucguuguccaaccacaaaacggaagaugcacaacagacggaguauuacuaggcaccacacaauuaucuccaguaaauauuugcacauuucgcggcgacguaacacauauagccggaucaagaaacuacacaaugaaucuugccucauuaaauuggaacaauuaugauccaacagaagaaauaccagcuccauuaggaacaccagacuucguaggcaaaauacaaggaguacucacacaaacgacaaaaggggaugguucaacacgaggacacaaagcaacugucuauacagguucagcaccauuuacuccaaaauuaggcucaguacaauucuccacagacacagaaaaugauuuugaagcacaccaaaauacaaaauucacaccugucggcguaauacaggauggaucaacuacacacagaaaugaaccucaacaauggguucuaccaagcuauuccggaagaaacguacauaacguacacuuagcaccagccgucgcacccacauuucccggugaacaacuauuauucuuuagaucaacaaugccaggauguucaggauauccaaauauggacuuggauugcuuauuaccucaagaauggguucaacauuuuuaccaagaagcagcuccugcacaaagugacguagcccuucuaagauuuguaaacccugacacaggaagaguauuauuugaaugcaaauuacacaaaucuggauacguaaccgucgcacauacuggccaacacgaucuaguaauuccaccaaacggcuauuuuagauuugauuccugggucaaucaauuuuacacauuagccccaaugggaaauggaacaggacgaagaagauaa

SEQ ID NO: 33979 - RNA, 1617 nt, Artificial Sequence
  derived and/or modified sequence opt6 from VP1__Norovirus_and/or_Norovirus-like__AB972518
augaaaauggcuuccucagacgcaaauccuucugacggaagugcagcuaaucuaguaccagaaguaaauaaugaaguaauggcacucgaaccaguaguaggugcugccauagcagccccaguagcgggacaacaaaauguaaucgacccauggauacgaaauaauuucguacaagcaccaggcggcgaauuuacaguuucaccacggaaugccccaggagaaauacuuuggucugccccacuaggacccgaccuaaauccuuaccuaucacauuuagcacgaauguauaauggauacgcuggcgguuucgaaguccaaguaauauuagcuggaaacgcauucaccgcaggaaaaguaauauuugcagcaguaccuccuaauuuuccgacagaaggcuuaucuccaucacaaguaacaauguuuccacauauaguaguagauguaagacaacuagaaccaguacuaauuccacuaccagacguacgaaacaauuucuaucacuauaaucaaucaaaugacccuacaauaaaacucauagcuaugcuauauacaccucuaagagcaaacaacgcuggugacgacguauuuaccguaucaugcagaguacucacacgaccaucaccagacuuugauuuuauauuccuaguuccaccaacuguugaaaguagaacaaaacccuucucagucccaguacuaacaguugaagaaaugacaaauucuagauucccuauaccucuagaaaaacuauuuacagguccaaguucagcauuuguaguucaaccacaaaauggaagauguacuaccgaugguguacuucuaggaacuacacaacuaucuccuguaaauauauguacauucagaggagacguuacccauauaacaggcaguagaaauuacacaaugaaucucgcaucucaaaacuggucaaauuacgauccaacugaagaaauaccugcaccacuagguacacccgacuuuguaggaaaaauacaaggaguauuaacacaaacaacaagaacagacggauccaccagaggacauaaagcaaccguauacaccggaucagcagacuuugcaccaaaacuaggaagaguacaauuugaaacagacacagaccgcgacuuugaagcaaaucaaaauacaaaauuuacuccaguuggaguaauacaagauggaucaacaacacauagaaaugaaccacaacaauggguacuaccaucauauucaggucgaacaacaccaaauguacauuuagcaccagcaguagcaccuacauuuccaggagaacaauuacuuuucuuuagaucuacaaugccaggaugcucuggauaccccaauauggauuuagauugccuuuuaccacaagaauggguccaauauuucuaucaagaggccgcucccgcacaaucugacguagcacuauuaagauucguaaacccagauacaggacgaguauuauucgaauguaaacuacauaaauccggauauguaacagucgcacacacuggacaacacgauuuaguuauuccacccaauggauauuuuagauuugauucuuggguaaaucaauucuauacacuagcaccaaugggaaauggcacaggacgaagaagauaa

SEQ ID NO: 33980 - RNA, 1617 nt, Artificial Sequence
  derived and/or modified sequence opt6 from VP1__Norovirus_and/or_Norovirus-like__AB933744
augaaaauggcuucaucugaugcaaaucccuccgacggcucaacagcaaaucuaguuccagaaguuaacaaugaaguuauggcacuagaaccaguaguaggugcagcaauagcagccccagucgcaggacaacaaaauguaauagauccauggauaagaaauaacuuuguacaagcaccagguggagaauuuacaguaucaccaagaaaugcaccaggagaaauauuauggucugccccacuaggaccagaucuaaauccauauuuaucacauuuagcaagaauguauaaugguuaugcaggaggauuugaaguccaaguaauacuggcuggaaacgcauucaccgcuggaaaaauaauauucgcagccgugccaccaaacuuuccaacugaaggacucucaccuucucaagucacaauguucccucauauaaucguagacguaagacaacuagaaccuguacuaauacccuuaccagacgucagaaacaacuucuaccauuacaaucaauccaaugaucccacaauaaaacucauagcuaugcuauacacaccacucagagcaaacaaugcgggagacgauguauuuacaguauccuguagagucuuaacaagaccaucaccagacuuugacuuuauauuucuuguaccaccaaccguagaauccagaacaaaaccuuucucaguucccauacucaccguagaagaaaugacaaauucaagauuuccaauuccauuagaaaaauuauucaccggcccauccucuacauucguuguucaaccucaaaauggaagaugcacaacagacggaguacuacuaggcacaacucaacuaucucccguuaacauauguacauuucguggugacguuacacacauagcaggaucccgcaauuauaccaugaauuuagcaagucaaaauuggaacucauacgacccaacagaagaaauucccgcaccacuaggaacaccagacuuugucgguaaaauucaaggaguucuuacacaaaccacacgcacagacggaucaacaagaggacauaaagccacagucuauacaggcucagcagauuuuucuccuaaauuaggacgaguacaauuugccacugacacugacaacgauuucgacgcaaaucaaaacaccaaauucacaccaguagguguaauacaagauggcggcacugcacaucgaaacgaaccacaacaauggguucuaccaucuuauucagguagaaauacacacaacguucacuuagcaccagcaguugccccaacauucccaggagaacaacuccucuucuuucguagcacaaugccagguuguucagguuacccaaauauggaccuagauuguuuacuaccucaagaauggguccaauacuucuaucaagaagcagcaccagcccaaucagacguagcauuauuacgauucguaaacccagacaccggcagaguacuuuucgaauguaaauuacauaaaucaggcuaugcuacaguagcucauacuggacaacacgacuuaguaauaccacccaauggauacuuuagauucgauuccuggguaaaccaauuuuacacauuagcuccaaugggaaauggaacagguagaagacguuaa

SEQ ID NO: 33981 - RNA, 1617 nt, Artificial Sequence
  derived and/or modified sequence opt6 from VP1__Norovirus_and/or_Norovirus-like__AB933673
augaaaauggcaucaaacgacgcaaauccaucugauggaucagcagcaaauuuaguaccugaagucaauaacgaaguaauggcacucgaaccaguaguaggagccgccaucgcugcuccaguagcuggacaacaaaaugucauagacccuuggauaagaaauaauuucguacaagcaccuggaggagaauuuacuguaucaccacgaaacgcaccaggagaaauacuuuggucugcaccauuaggucccgacuuaaauccauauuuaucucacuuagcaagaauguauaauggauacgcuggagguuucgaaguucaaguaauacucgccggaaaugccuucacagcuggacaaauuauauucgcagcaguaccacccaacuuuccaacugaaggucuaucuccuucucaagucacuauguucccacauauaauaguugauguaagacaauuagaaccaguacuaauaccauuacccgacguacgcaacaacuuuuaucauuauaaucagaguaacgauagcaccauaaaacuaauagcaauguuauacaccccacuaagagcuaauaacgcaggagaagauguauuuacaguaucauguagagucuuaacucgcccaucuccagauuucgacuuuauauucuuaguaccaccaacagucgaaucaagaacaaaaccauucacaguaccaauacuaacaguagaagaaaugacuaacagcagauuuccaauacccuuagaaaaacuuuuuaccggaccuucaucagcauucguuguucaaccccaaaacgguagauguacaacagacggaguccuauuaggaacaacucagcucuccccaguuaauauauguacauuuagaggagacguaacacauauagcaggaagucgaaacuacacaaugaacuuagcaucacuaaacuggaauaauuacgacccuacugaagaaauaccagcaccauuaggaacaccagauuucguaggaaaaauacaaggaguacuaacccaaacaacaaaaggagacggaucaacucguggccacaaagcaacaguauacacaggaucugcacccuucacacccaaauuaggaucaguacaauucucuacagauacagaaaacgacuuugaaacacaucaaaauacaaaauuuacacccgucggcguuauccaagaugguggaacaacacaucgcaacgaaccacaacaauggguucuuccuucuuacuccggaagaaacguaccuaauguacaucuagcaccagcaguugcaccuacauuuccaggagaacaauuauuauucuuucgaucaacaaugccagguugcucaggauauccaaauauggauuuagauuguuuacuaccccaagaauggguacaacauuucuaucaagaagcagcaccagcacaaucagacguagcacuauuaagauucguaaauccugacaccggccgaguauuauucgaaugcaaauuacacaaaucaggcuacgucacagucgcacacacaggacaacaugaucuaguaauacccccaaauggauauuucagauucgacucauggguaaaucaauuuuacacucucgcaccaaugggaaauggaacuggaagacgaagauaa

SEQ ID NO: 33982 - RNA, 1617 nt, Artificial Sequence
  derived and/or modified sequence opt6 from VP1__Norovirus_and/or_Norovirus-like__KM245070
augaaaauggcaucaaaugaugcuaauccauccgauggaucugccgcgaaucuuguaccagaagucaauaaugaaguaauggcauuagaaccaguagucggagcagccauugcugcccccguugcaggucaacaaaauguuauagauccuuggauaagaaacaacuucguacaagcaccaggcggagaauuuacagucucaccuagaaaugccccaggugaaauauuauggucugcaccauuaggaccagaccuaaacccauacuuaucacacuuagcacguauguauaacggauaugcuggcggauuugaaguacaaguaauccuagcaggaaaugcauuuacagccggaaaaaucauuuucgcagcaguaccaccaaauuucccuacagaaggacuaucaccaucccaagucaccauguucccucacaucauuguagauguaagacaacuagaaccaguacuaauaccauugccagaugucagaaauaauuuuuaucacuauaaccaaucaaaugacucuaccauaaaacuaaucgccauguuauacacaccacuaagagcaaacaaugccggagaagauguauucacaguaucuuguagaguuuuaacucgaccaagcccugauuucgauuuuauuuuucuuguuccaccaacaguugaaucacgaacaaaaccauuuacaguuccaauacuuacuguagaagaaaugaccaacucaagauucccaauaccacuugaaaaacucuuuacaggaccuucaggagcauucguaguccaaccacaaaauggaagaugcacuacagaugguguauuacuaggaacuacucaacuaucuccaguaaacauaugcaccuuucgaggagacguaacacauauagcaggaucaagaaauuauacaaugaaucucgcaucccuaaacuggaacaacuaugauccuacagaagaaauaccagcaccauuaggcacaccagacuuuguaggcaaaauacaaggaguauuaacucaaacaacaaaaggagauggauccacaagaggacauaaagccaccguauauacaggaggcgcaccauucacaccuaaauuaggaucuguacaauucucaacagauacagaaaacgauuuugaaacacaucaaaacacaaaauucacaccagucggcguuauacaagacggauccaccacacaucgaaaugaaccacaacaauggguacuaccaucauauuccggucgcaauguacauaaugugcaccuagcaccagcaguagcaccaacauucccaggugaacaauuauuauucuuuagaucuacaaugccaggcugcucaggcuaucccaacauggaccuugacugcuuauuaccacaagaauggguacaacauuuuuaccaagaagcugcaccagcucaaucagacguugcucuccuacgauucgucaacccagacaccggccgagucuuauucgaauguaaacuucacaaaucaggcuacgucacaguagcucauacaggucaacacgauuuaguaaucccaccuaauggauacuuucgauuugauucauggguaaaucaauuuuacacacuagcaccaaugggcaauggaacaggucgucgccgauaa

SEQ ID NO: 33983 - RNA, 1617 nt, Artificial Sequence
  derived and/or modified sequence opt6 from VP1__Norovirus_and/or_Norovirus-like__EU921382
augaaaauggcauccaaugacgccaacccaucagauggaucugcagcuaauuuaguaccagaaguuucuaaugaaguaauggcacuagaaccgguuguaggagcagcuauagcagcaccuguugcaggacaacaaaacgucaucgacccuuggauaagaaauaacuuuguccaagcaccuggaggcgaauuuacaguaucaccacgaaaugccccaggagaaauacuauggucagcaccauuaggaccagacuuaaacccauaccuaagucaucuagcaagaauguauaacgguuacgcuggagguuucgaaguccaaguaauucuagcaggaaacgcuuuuacagcuggaaaaauaauauucgcugcaguuccaccaaacuuucccacagaaggacuaucaccaucacaaguaacaauguucccacacauaauaguagacguaagacaauuagaaccaguauuaauaccacuuccagauguacguaacaacuuuuaucauuacaaucaauuaaacgacucuacaauaaaauuaauagcgaugcuauauacaccuuuacgagccaauaacgcaggagaagauguauuuacaguaucauguagaguucuaacuagaccuucuccagauuucgacuuuaucuuccuaguacccccuaccguagaaucucgcacuaaaccauucacaguaccaaucuuaacagucgaagaaaugacaaauaguagauuuccaauuccauuagaaaaacuauuuacaggacccuccggagcuuuuguaguacaaccacaaaauggaagauguacuacugacggcguauuacuaggaacaacacaacuaucaccaguaaacauauguacauuuagaggagacguuacacauauagcaggaucaagagacuauacuaugaaucuagccucauuaaacuggaacaacuaugaucccacagaagaaauaccugcaccacuaggcacaccagacuuuguagguaaaauucaaggaguauuaacacaaacuacaaaaggagaugguagcacaagaggacauaaagcaacaguauauacaggcagcgccccauucacuccaaaacuaggcucaguacaauucucaacagauacagaaaacgauuucgaaacacaccaaaacacaaaauuuaccccaguaggaguuauccaagaugguuccacaacucauagaaaugaaccacaacaauggguauuaccuucauauucaggacguaauguucauaauguacaccuugcccccgcugucgccccaacauucccaggagaacaacuauuauucuuuagaucaacaaugccaggcugcucuggauauccaaauauggaccuagacugucuauuaccacaagaauggguacaacauuucuaucaagaagcugcuccagcucaaucugacgucgcauuauuaagauuuguaaacccagauacaggaagaguacuauuugaauguaaacuacacaaaucaggcuaugucacaguagcacauacuggccaacacgacuuaguaauaccuccaaauggauauuucagauucgacucauggguaaaucaauucuacacacuugcacccaugggaaauggaacaggcagacgaagauaa

SEQ ID NO: 33984 - RNA, 1617 nt, Artificial Sequence
  derived and/or modified sequence opt6 from VP1__Norovirus_and/or_Norovirus-like__KP293589
augaaaauggcuagcucagacgcaaauccaucagauggaucagcagcaaaucuagucccugaaguaaacaaugaaguaauggcacuagaaccaguugugggagcagcaaucgcagcacccguagccggacaacaaaauguaauagauccauggauaagaaauaauuuuguccaagcaccugguggagaauuuacaguuucaccacgaaaugcucccggagaaauauuauggucagccccacuagguccugacuuaaauccauauuuaagucauuuagcuaggauguauaauggauacgcaggaggcuuugaaguacaaguaauauuagcuggaaacgcauucacugcaggaaaaguaauauuugcagcaguucccccaaauuuuccaacagaaggauuaucucccucacaagucaccauguuuccacauauaguaguagauguaagacagcucgaaccugucuuaauuccuuuaccagacguaagaaacaauuucuaucauuacaaucagucaaaugacccaacaauaaaauuaauugcuaugcuauauacaccauuaagagcaaauaacgcuggagaugacguauucacaguaucauguagaguacucacaagaccuucaccagauuuugauuucauauuuuuaguaccaccaacuguagaaucaaggacaaaaccauuuucaguucccguacuaaccguagaagaaaugacaaauucacgauuuccaauuccucuagaaaaauuauuuacaggaccaucaucagcauuuguaguacaaccucaaaauggaagauguacuacagauggagucuuacuuggcacuacacaauuaagcccaguaaauauuuguacauuucgaggcgacguaacucauauuacaggaucaagaaauuauacuaugaaucuagcaucucaaaacuggucaaauuacgauccaacagaagacauuccagcuccacucggaaccccagauuuuguaggaaaaauacaagguguuuuaacucaaacaaccagaacugacggcucuacacgaggucauaaagcaacuguauauaccggaucugcagauuucgcuccaaaauuaggaagaguacaauuugaaacagacacagaucacgauuuugaagcaaaucaaaauaccaaguucaccccagucggaguaauucaagacggaucuacaacacacagaaaugaaccacaacaauggguauuaccaucauauucaggaagaaauacuccuaauguacaccuagcaccagcaguagcaccaacauucccaggagaacaauuauuguucuuucgauccacuaugccaggauguucaggauaucccaauauggauuuagacugccuauuaccucaagaauggguacaauauuuuuaucaagaagcagcacccgcccaaucagauguugcuuuacucagauuuguaaacccagacacuggcagaguccuauuugaauguaaacuucauaaauccggcuacguuacuguagcacauaccggacaacaugauuuaguaauaccacccaaugguuauuuuagauuugauaguuggguaaaccaauuuuauacacuagcuccaaugggaaaugguacaggaagacgccgauaa

SEQ ID NO: 33985 - RNA, 1617 nt, Artificial Sequence
  derived and/or modified sequence opt6 from VP1__Norovirus_and/or_Norovirus-like__KP241908
augaaaauggcaucaagugaugcaaacccaucagaugguucagcugcaaaucuaguaccagaaguaaacaacgaaguuauggcauuagaaccagucgugggagcagccauagcagcacccguugcaggucagcaaaaugucaucgacccauggauacgaaauaacuuuguacaagcaccuggaggcgaguuuacuguaucaccacguaaugcaccuggugaaauauuauggucagccccucucggaccagaucuaaacccauacuuaucacaucuagcaagaauguauaauggauacgcaggcggauucgaaguacaaguaauccuagcaggaaaugcauuuacagccggaaaaguuaucuuugcagcaguaccaccuaacuucccaacagaaggucuauccccaucucaaguaacaauguuuccacauauugucguagauguaagacaauuagaaccaguacuaauaccuuuacccgaugucagaaacaauuuuuaucauuauaaccaaucuaaugauccaacgauaaaacuaauugcaaugcuuuauacaccacuaagagcaaauaaugcaggcgaugacguauuuacaguaucaugcaggguacuaacacgaccuucaccagauuucgauuucauauuuuuaguaccuccaacagucgaauccagaacuaaaccauuuucuguaccaguccuaacaguugaagaaaugacaaauaguagauuucccauaccauuagaaaaauuauuuacaggaccaucaucagccuuuguaguacaaccccaaaauggacgauguacaacagauggaguacuacuaggaaccacacaacuuucgcccguuaacaucuguacauuuagaggugauguaacucauauaacuggaagccacaacuauacuaugaaucuagcuucacaaaauuggucaaauuacgacccuacagaagaaauaccugcuccacuuggaacgccagacuuuguagguaaaauucaaggaguauuaacacaaacuacuagaacagacggaucaacaagaggacauaaagcaacaguauacacaggaucagccgauuucgcaccaaaauuaggaagaguacaauuugaaacagauacuaaucaugacuuugaagcaaaccaaaacacuaaauucacaccaguaggcguaauacaagauggauccacaacacauagaaacgaaccacaacaauggguucuaccaucauacucaggcagaaacacccccaacguacaucuagcaccagcaguagcaccaacuuuucccggagaacaauuauuauuuuucagaucuacaaugccaggauguucaggauacccaaauauggauuuagacugccuauuaccacaagaauggguacaauacuuuuaucaagaagcagccccagcacaaucagacguagcucucuuacguuucguaaauccagauaccggaagaguauuauuugaauguaaauuacauaaaucaggauacguaaccguagcacauacaggccaacacgaccuaguaauaccuccaaauggcuacuuucgauuugacucauggguuaaucaauuuuacacauuagccccuauggguaauggaacaggaagaagaagauaa

SEQ ID NO: 33986 - RNA, 1617 nt, Artificial Sequence
  derived and/or modified sequence opt6 from VP1__Norovirus_and/or_Norovirus-like__KJ451059
augaaaauggcaucaucagaugcaagcccuucugaugguagcgcagcuaauuuaguuccagaaguuaauaaugaaguuauggcccuagaacccgucgucggagcugcaauugcagcaccaguggcaggccaacaaaacguaauagauccauggauuagaaauaauuuuguacaagcaccaggaggugaauuuacugucucuccacgaaaugcaccaggugaaauauuaugguccgccccacugggacccgacuuaaauccauacuuaucacaucuugcaagaauguacaauggauacgcaggagguuuugaaguucaaguaauauuagcuggcaaugcauuuaccgcuggaaaagucauauucgcagcaguaccaccaaacuuucccaccgaaggucuuucaccaucacaaguaacuauguuuccacacauaguaguagauguaagacaacuagaacccguacuaauaccauuaccagauguacguaacaauuuuuaccauuacaaucaaucaaaugacccaacaauaaaauuaauagccauguuauacacuccauuaagagcaaauaaugcuggugacgauguauuuaccgucucuugucgcguccuaacaagaccuucaccagauuucgauuuuauauuuuuaguaccaccaacaguagaaucucgaacaaaaccauuuucugucccaguacuaacaguugaggaaaugacaaacucaagauuuccaauaccauuagaaaaacucuucacaggaccaucauccgccuuuguuguacaaccacaaaacggaagauguacaaccgauggaguccuucuaggaacaacccaacuaucaccaguaaauauauguacauuuagaggagacguaacacauauaacaggaucaagaaacuacacaaugaaucucgcuucucaaaauuggucaaauuaugacccuacagaagaaaucccagcaccacuuggaaccccagacuuuguaggaaaaauccaaggaguauuaacacaaacaaccagaacagauggaucaacaagaggacauaaagcaacaguauauacuggcuccgccgauuuugcaccuaaacuagguagaguacaauuugaaacagacaccgauagagauuuugaagcaaaccaaaacacaaaauucacuccaguaggaguaauccaagauggaucuacuacacacagaaaugaaccacaacaauggguccuaccaucauauuccggaagaaauacaccaaauguacaccuugcaccagcaguagcuccaacuuucccuggagaacaacuauuauucuuuagaucaacaaugccaggaugcuccggauauccaaacauggauuuagauugucuuuuaccacaagaauggguacaauauuuuuaccaagaagcagcuccugcacaaucagacguagcauuauuaagauuuguaaauccagacacuggccgaguacuauucgaaugcaaacuacauaaauccgguuauguaacuguagcacauacaggccaacaugauuuaguaaucccgccaaauggauauuuuagauucgauucauggguaaaucaauuuuacacucuagcucccaugggaaauggaacuggaagacgaagauaa

SEQ ID NO: 33987 - RNA, 1617 nt, Artificial Sequence
  derived and/or modified sequence opt6 from VP1__Norovirus_and/or_Norovirus-like__KM198570
augaaaauggccucaaaugacgcaaacccaucugaugguucugcagcaaacuuaguuccagaaguauccaaugaaguuauggcacuagaacccguaguaggugcagcuauagcagcacccguagcaggccaacaaaaugucauugacccauggauaagaaauaauuucguccaagcaccaggaggagaauuuacagucucaccaagaaaugcaccaggagaaauacuauggggagcaccauuaggaccugauuuaaaccccuauuuaucucacuuagccagaauguauaacgguuaugcaggaggauucgaaguacaagucauauuagcaggaaaugcauuuacagcagguaaaauaauauucgccgcaguuccaccaaacuucccaacugaaggccuaucaccaagucaaguaacaauguucccacacauaauaguagauguaagacaacucgaaccaguacuaauaccauuaccagauguacgaaacaauuuuuaucauuacaaucaaaccaacgauuccacuauaaaacuaauagcuauguuauacacaccucuaagagccaacaaugccggagaagauguuuucaccguuaguugcagaguacuaacacgaccaucccccgacuuugauuuuaucuuucuaguaccaccaacaguagaaucacgaacuaaaccauucacaguaccaauauuaacaguagaagaaaugaccaacuccagauuccccauuccacuagaaaaacuuuucaccggaccaucaggagcuuucguaguccaaccccaaaauggaagaugcacuaccgacggcguauuauuaggaacaacacaauuauccccuguaaauauauguacauuccgaggagacguuacacauauagcuggaucaagaaacuacacaaugaacuuagcuucauuaaauuggaacaauuacgacccaacugaagaaauaccugcaccucuaggaacaccagacuucgucggaaaaauacaaggaguguuaacacaaaccacaaaaggugacggaucaacacgaggacauaaagcaacaguauauacaggaucagcucccuuuacaccaaaacuuggaucuguucaauuuucaacagacacagaaaacgauuuugaaacgcaucaaaacacaaaauuuaccccaguaggaguaauacaagacggaggcacaacccaucgaaacgaaccacaacaauggguauuaccaucauauucagguagagauguacauaacguacacuuagccccagccguagcaccaaccuuucccggcgaacaauuacuauuuuucagaagcacuaugccaggcugcucuggauacccaaacauggaucuugauuguuuacuaccacaagaauggguacaacacuucuaucaagaagcagcaccagcccaauccgacguagcauuacuacgauuuguuaauccagacacaggaagaguauuauucgaauguaaacuccauaaaucugguuauguaacaguagcacacaauggucaacacgaccuuguaauaccaccaaacggauauuuccgauucgauucaugggucaaccaauuuuauacauuagccccaaugggaaauggaacaggaagaagaagauaa

SEQ ID NO: 33988 - RNA, 1617 nt, Artificial Sequence
  derived and/or modified sequence opt6 from VP1__Norovirus_and/or_Norovirus-like__KM198558
augaaaauggcaucaaaugacgcaaauccauccgacggaagcgcagcuaaccuaguaccagaaguuucaaacgaagucauggcauuagaaccaguuguaggugcagcaauugcagcaccaguagcaggacaacaaaaugucauagauccuuggauacgaaauaauuuuguucaagcaccaggaggugaauuuacaguuagcccaagaaaugcaccaggagaaaucuuauggucagcaccacuaggaccagaccuaaauccauauuuaucacaucuugccagaauguacaauggauacgccgguggauuugaaguucaaguaauauuagcuggaaaugcauuuacagcaggaaaaauaauauucgcagccguuccaccaaacuuuccgacagaaggucuaucaccaucacaaguaacaauguucccacacauaauagucgauguaagacaacuugaaccaguacuaauuccauuaccagauguacgaaauaacuucuaucauuauaaccaaacuaaugacccaaccauaaaauuaauagcaaugcuauauacaccauuaagagcuaauaacgcuggugaagauguauuuacaguuucaugcagaguacuaacaagaccuucuccagauuucgacuuuauauuucuuguaccaccuacuguagaaucccgaacuaaacccuuuacaguaccuauauuaacaguagaagagaugacaaauucaagauuuccaauaccauuagaaaaauuauuuacaggaccuucaggagcauuuguaguacaaccccaaaacggaagauguacaacagauggaguacuauuagguacaacccaauugucaccaguuaacauauguaccuuucgaggugacguaacacacauagccggaucaagagauuacaccaugaauuuagcaucacuuaacuggaacaacuaugaucccaccgaagagauaccagcaccucuaggaacaccagauuuuguagguaaaauacaaggaguacucacucaaacaacacguggugauggcucaacaagaggacacaaagcaaccguauauacaggaucagcuccauuugcgccaaaauuaggaucaguccaauucucaacugauacugaaaacgacuucgaaacacaccaaaauacuaaauucacuccaguaggaguaauacaagacggaggcacaacacaccgcaaugaaccacaacaauggguauuaccuucauacucagguagagauguacacaacguucaccuagccccugcaguagcaccaaccuucccaggugaacaauuauuauucuuucgaagcacaaugccagguugcucuggauauccuaauauggaucuagauugccugcuaccucaagaauggguucaacauuuuuaccaagaagcagccccagcacaaucagauguugcacuauuaagauucguaaacccagacacaggaagaguauuauucgaaugcaaacuccauaaaucaggauacguaacaguagcacauacuggccaacacgaucuagucauaccaccaaauggauauuuucgauuugacucauggguaaaucaauuuuacacuuuagcaccuaugggaaauggaacaggaagaagaagauaa

SEQ ID NO: 33989 - RNA, 1617 nt, Artificial Sequence
  derived and/or modified sequence opt6 from VP1__Norovirus_and/or_Norovirus-like__AB447456
augaaaauggcaucaaaugaugcuaacccaucugauggaucggcagcaaacuuaguaccagaaguaaacaacgaaguaauggcacuugaacccguaguaggagcagcaauagcagcaccuguagcaggacaacaaaacguuauugacccauggauaagaaauaauuuuguacaagccccaggcggagaauuuacaguaucaccucgaaacgcaccaggagaaauacuauggucagccccauuagguccagaucuaaacccauacuuaucacacuuagcgcgaauguacaacgguuaugccggcggauucgaaguacaaguaauacuagcagguaacgcauuuaccgcaggaaaaauaauauuugcagcaguuccaccuaacuuuccaacagaaggacuaucuccaucacaaguaacaauguuuccccacauaaucgucgauguaagacaacuagaaccaguuuuaauaccauuaccagauguaagaaacaauuuuuaucacuauaaccaaucaaaugacuccaccauaaaauuaauagcaaugcuuuacacaccacuaagagcaaacaaugcaggagaagauguauucacuguaucauguagaguuuuaacacgaccauccccagauuucgacuucauauuuuuaguaccaccaacaguugaaagccgcacaaaacccuuuacaguaccuauacuaaccgucgaagaaaugacaaacuccagauuuccaauuccacuagaaaaauuauucaccggaccaagcggcgcauucguaguacaaccacaaaacggacgaugcacaacugacggaguauuauuaggaaccacacaacuaucccccguuaauauauguacauuuagaggugacguaacacauauagccggcucaagaaacuauacaaugaaucuagccucauuaaacuggaacaauuacgauccaacagaagaaauaccugcaccacuagguacaccagauuucguaggcaaaauacaaggauuauuaacacaaaccacaaaaggcgacgguagcacaagaggacauaaagcaacaguauauacaggaucagcuccauucacaccaaaacuagguucaguccaauuuucaacugauacugaaaaugacuucgaaacccaccaaaauacuaaauucacuccagucggaguaauacaagacgguuccacaacccacagaaaugaaccacaacaauggguccuaccaucauauucaggacgaaauguacacaacguacauuuagcaccagcuguagcaccaacauuucccggugaacaacucuuauucuuuagauccacaaugccagguugcucaggauauccaaauauggacuuagauugcuuauuaccccaagaauggguccaacauuuuuaccaagaagccgcaccagcccaaucggauguagcgcuacuacguuuuguuaauccagauacaggacgaguacuuuuugaauguaaacuacauaaaucuggauauguaacaguagcacacacuggccaacaugaccuaguaauaccaccaaacggauauuuccgcuuugacuccuggguaaaucaauuuuacacauuagcaccuaugggaaauggaacuggaaggagaagauaa

SEQ ID NO: 33990 - RNA, 1617 nt, Artificial Sequence
  derived and/or modified sequence opt6 from VP1__Norovirus_and/or_Norovirus-like__KF177444
augaaaauggcaucaagugacgcaaauccaucagaugguucagcugcaucacuugucccagaaguaaacaaugaaguaauggcccucgaaccaguagucggagcagcaauagcugcaccaguagcuggacaacaaaacguaauagauccauggauaagaaauaacuuuguacaagcaccaggcggcgaauuuacaguuuccccacgaaacgcacccggagaaauuuuauggucagcaccauuaggacccgaucuaaaccccuaccucagucacuuagcaagaauguauaaugguuacgcaggaggcuucgaaguacaagucauacuagcaggaaaugcauuuacagccggaaaaguaauauuugcagccguuccaccaaacuuuccaacagaaggucuuucaccaucucaaguuacaauguucccacacauaguaauugauguacgccaacuagaaccaguccuuauuccauuaccagauguaagaaauaacuuuuaucauuacaaccaaucaaacgauccaacuauaaaacuaauagcuauguuauauacuccacucagagcaaauaaugcaggagaugaugucuuuacaguaucaugccgaguauuaacuagacccucaccagacuuugacuuuauuuuucuuguaccaccaacaguagaaucaagaacuaaaccauuuucaguaccaguauuaacaguagaagaaaugacaaacucuagauuuccaauuccauuagaaaaacuauuuaccggacccucuucagccuucguaguacagccacaaaauggucgauguacuaccgauggagucuuacuaggaacaacacaacuauccccuguaaauauauguacuuucagaggcgauguaacacauauaaccggaucaagaaacuacaccaugaauuuagcaucucaaaauuggaacaauuacgauccaacagaagaaauacccgcaccacuugguacaccagauuuugucggaaaaauucaagguguuuuaacgcaaacaacaagaaccgauggaucaacaagaggacauaaagcaacuguauauacaggaagugcagauuuugccccuaaacuaggaagaguucaauucgaaacagauaccgaccacgauuuugaagcaaaucaaaauacuaaauuuacuccuguaggcguaauacaagauggaucaaccacacauagaaacgaaccacaacaauggguacucccauccuauucagguagaaauacaccuaacguacauuuagcaccagcaguagcacccacauuucccggagaacaauuauuauucuuuagaucuaccaugccaggaugcaguggauauccaaacauggaucuagauuguuuacuaccccaagaauggguucaauauuucuaccaagaagcagcuccagcacaaucugauguagccuuauuaagauuuguuaacccagacacuggacgaguuuuauucgaauguaaauuacacaaaucaggauacguuacuguagcacacacaggucaacaugaucuaguuaucccacccaacggauauuuucgauucgauucauggguaaaucaauucuacacacuugcacccaugggaaacggcacuggacgcagacgcuaa

SEQ ID NO: 33991 - RNA, 1617 nt, Artificial Sequence
  derived and/or modified sequence opt6 from VP1__Norovirus_and/or_Norovirus-like__KF429776
augaaaauggcuucuaaugacgcaaacccaucugacggaucagcugccaacuuaguaccagaaguaaauaaugaaguuauggcacucgaaccagucguaggugcagcaaucgccgccccaguugcuggucaacaaaaugucauagauccauggauaagaaauaauuuuguccaagcaccagguggagaauuuacuguaucaccacgaaaugcaccaggugaaauacuauggucagccccucuagguccugauuuaaacccauauuuaucacauuuagcccgaauguacaacggauacgcaggaggauuugaaguccaagucauacucgccggaaaugcuuuuaccgcaggaaaaauaauauucgcugcaguucccccaaauuuuccuacagaaggacuaucacccucucaaguaacaauguuuccacauauaauaguugacguacgucaacuagaaccaguauuaauaccacuaccugacgucagaaauaacuucuaccauuacaaccaaucuaaugauuccacaauaaaauuaauagcaauguuauacacacccuuacgugcuaauaaugcaggagacgacguauucacuguaucauguagaguauuaaccagaccaucaccagacuuugacuuuaucuuuuuaguaccacccacaguagaaucacgaaccaaaccuuuuuccgucccaauauuaacaguugaagaaaugacuaacucccguuucccaauucccuuagaaaaacuauucacuggcccuucauccacauucguaguacaaccacaaaauggaagauguacuacagauggagucuuacuagguacaacacaauuaucccccguaaauauuuguaccuuuagaggagacguaacacauauugccggaucaagaaauuacacaaugaaucuagccucacaaaacuggaacucuuacgauccaacagaagaaauaccagcuccacuuggcacaccagacuucguagguaaaauucaaggcguauuaacacaaacaacaagaacugacggaucaacuagaggacauaaagcuacagucuacacaggcucagcagauuuuucuccaaaauuaggaagaguucaauuugcaacagauaccgauaacgacuuugaugcaaaucaaaauacaaaauucacaccaguaggaguaauacaagacggaggcacagcccacagaaacgaaccccaacaauggguacucccauccuauucuggccgaaauacacauaacguucauuuagcuccagcugucgcuccaaccuuuccaggugaacaacuacuauucuuuagauccacaaugccaggauguucaggauauccuaacauggaucucgauuguuuacuaccccaagaauggguacaauauuuuuaucaagaagccgccccagcacaaucugauguagcauuacucagauucguaaauccagauacaggcagaguacuuuuugaauguaaauuacauaaaccaggcuacguaacaguugcucauacuggucaacaugauuuaguuauaccuccaaacggcuacuucagauucgauucuuggguuaaucaauuuuauacauuagcaccaaugggaaauggaaccggaagaagacgauaa

SEQ ID NO: 33992 - RNA, 1617 nt, Artificial Sequence
  derived and/or modified sequence opt6 from VP1__Norovirus_and/or_Norovirus-like__KC243078
augaaaauggcaucuucagaugcaaacccuucugauggaucugcugcuaaucuaguaccagaagucaacaaugaaguaauggcacuagaaccuguaguaggagcagcaauagcagcaccaguugcagggcaacagaauguaaucgauccauggauacgaaauaauuucguacaagcaccuggaggagaauuuacuguaucaccaagaaaugccccaggagaaauauuauggucagcaccauuaggaccagauuuaaauccauauuuaucucaucuagcucgaauguauaacggauaugcaggaggauucgaaguucaaguaauccuagcagguaacgcuuucacagcaggaaaaguaauauuugcagcaguacccccaaacuuuccuacagaaggacuaagucccucacaagucacaauguucccacacauuguaguggacguaagacaauuagaaccuguacuaauaccauuaccugauguaagaaauaauuuuuaucauuacaaccaaucaaacgauccaacaaucaaauuaauagcaauguuauacacaccuuuaagagccaacaacgccggugacgacguauuuacaguaagcugucgaguacucacgagaccaucaccagacuuugauuuuauauuuuuaguuccuccaacaguagaaucccgaacaaaaccuuucucaguaccaguauuaacuguugaagaaaugacaaauucacgauucccaauaccacuagaaaaauuauuuacaggaccaucauccgcauuuguaguccaaccacaaaauggaagauguacaaccgauggcguauuauuaggaacaacacaauuaucaccagucaauauauguacauuuagaggagacguaacacacauaacaggaagcagaaacuauacaaugaauuuagcaucacaaaauuggaacaacuacgacccuacugaagaaauaccagcaccacuuggaaccccagacuucguuggaaaaauucaagguguacuaacacaaacuaccagaacagacgguuccaccagaggacacaaagcaaccguauauacaggaucagcugauuucgccccuaaauuagguagaguucaauuugaaacagauacugaucaugacuucgaagcaaaccaaaauacaaaauucacuccuguaggaguaauacaagaugggggaacuacacauagaaaugaaccacaacaauggguacuaccaucauauuccgguagaaacacacauaauguacacuuagcaccagcaguagcaccgacauucccaggagaacaacucuuauucuuuagaucaacaaugccaggauguucaggcuauccuaauauggaccucgauuguuuacuuccacaagaauggguacaauacuuuuaucaagaagcagcaccagcacaaucagaaguagcauuacuacguuucgucaacccagacacuggacguguauuauucgaaugcaaacuucauaaaucuggauauguaacaguagcacauacuggacaauacgaucuaguuauaccaccaaacggauauuuucgauucgauucaugggucaaucaauuuuacacacuagcaccaaugggaaauggaacaggacgaagacgauaa

SEQ ID NO: 33993 - RNA, 1617 nt, Artificial Sequence
  derived and/or modified sequence opt6 from VP1__Norovirus_and/or_Norovirus-like__KC409280
augaaaauggcaucaaacgacgcaaaucccagcgacggaucagcagcaaaccuaguaccagaaguuucaaaugaagucauggcguuagaaccaguaguaggagcagcaauagcagcaccuguagcaggacaacaaaauguaauagauccauggaucagaaacaauuuuguacaagcaccuggaggcgaauuuacaguuucaccuagaaaugcuccuggugaaauauuauggucagcaccucuuggcccagauuuaaacccauauuuaucacacuuggcaagaauguauaaugguuacgcaggaggauucgaaguacaaguaauccuagcaggaaacgcauuuacagcaggaaaaauaauauucgcagcaguaccaccuaacuucccaacagaaggacuuagccccucacaaguaacaauguucccucauauaauuguagauguaagacaacucgaaccaguacuaauaccccuuccagauguacgaaacaauuucuaucacuacaaccagaccaaugacucaacaauuaaauuaauagcuaugcuauacacaccauuacgugccaauaaugccggagaagauguauuuacaguaucuuguagaguuuuaacaagaccaucaccagauuucgauuuuaucuuucuaguacccccaacaguagaaucucguaccaaaccauuuaccguaccaauauugacaguagaagaaaugacaaacucaagauuuccuauaccacuagaaaaauuauuuacaggcccuucaggagcauucguuguacaaccacaaaacggacgaugcaccacagacggaguacuauuaggaacaacccaauuaucuccaguaaauauaugcacuuuuaggggagacguaacacauauugcuggaucacguaauuauacaaugaauuuagcuucacuaaacuggaacaauuacgauccaacagaagaaaucccagcaccuuuaggaacacccgauuuuguuggaaaaauccaaggaguuuuaacacaaacaacaaaagaggacggaucaacaagaggacauaaagccacaguauauacagguucagcaccauuuacaccuaaauuagguucuguucaauucucuacagauacagaaaacgauuuugaaacccaucaaaauacaaaauucacacccgucggaguuauacaggacgggggaacaacacacagaaaugaaccacaacaauggguucuaccaucauauucaggaagagauguacauaacguucacuuagccccagcaguagcaccaacauucccaggagaacaaaucuuauucuuucgaucaacaaugccagguuguucaggauauccaaauauggaucuagauugcuuacuaccacaagaauggguacaacacuucuaccaagaagcagcaccagcucaaucugacguagcacuacuaagauuuguaaacccagacacaggcagaguccuauuugaauguaaauuacauaaaucuggauaugucacaguugcccacacaggccaacacgauuuaguuauaccacccaauggauauuuccgauucgauucaugggucaaucaauuuuacacgcucgcaccaaugggaaauggcacaggaagaagaagauaa

SEQ ID NO: 33994 - RNA, 1617 nt, Artificial Sequence
  derived and/or modified sequence opt6 from VP1__Norovirus_and/or_Norovirus-like__KC175357
augaaaauggcuucaucagacgcuaacccuucagacggaucugccgcaaacuuaguaccagaaguuaauaaugaaguaauggcauuagaaccaguaguaggagccgcaauagcagcaccaguagcuggacaacaaaacguaauagacccauggauaagaaauaauuuuguccaagcaccaggaggagaauuuaccguaucaccacgaaaugcuccaggugaaauacuuuggucagcaccauuaggaccugauuuaaauccuuaucucucacauuuagcaagaauguauaacggauaugcaggaggauucgaaguccaagucaucuuagcuggaaaugcuuucacagcaggcaaaauaauuuucgcagcaguaccaccaaacuucccaacagaaggacuaucaccuucccaaguaacaauguuuccacauauuauaguugacgucagacaacuagaaccagucuuaauaccuuuaccagauguaagaaacaauuucuaucacuacaaccaaucaaaugacuccacuauuaaauuaauagcuauguuauauacaccuuuacgcgccaauaaugcaggcgaagacguauuuaccguuucauguagaguauuaacucgcccaucaccagacuuugauuucauauuucuaguuccaccaaccguagaaucacgaacaaaaccauuuacaguaccuauacuaaccguggaagaaaugacaaacucaagauuuccaauaccucuagaaaaacuauuuaccggaccaucaucagccuucguaguucaaccacaaaauggacgaugcacaaccgacggaguauuacucgguacaacacaauuaucaccuguaaauauauguaccuuucgaggagacgucacacacauagcaggaucuagaaauuauacaaugaaucuagcaucacuaaacuggaacaauuacgauccaacagaagaaauucccgcaccauuaggcacaccugauuucguagguaaaauacaaggaguauuaacacaaaccacuaaaggagacggaucaacacgaggacacaaagcuacagucuacacaggauccgcaccauuuacaccaaaacuugguucuguccaauuuucaaccgauacagaaaacgacuucgaaacacaucaaaauacaaaauuuacuccaguaggaguuauacaagacggcggaacaacccaucgaaaugaaccccaacaauggguucucccaagcuauucaggacgaaauguuccaaacguccaccuugcacccgccgucgcaccaacauuuccaggcgaacaacuacuuuucuuuagaucaacaaugccaggauguucuggauauccaaauauggacuuagacuguuuauuaccacaagaauggguacaacauuuuuaucaagaagccgcgccugcacaaucagacguagcuuuauuaagauucgucaacccagauacaggaagaguacuuuuugaauguaaacuacauaaaucaggcuacguaacuguagcacacacaggacaacacgaucucguuauaccuccaaauggcuauuuucgauuugauucauggguaaaucaauuuuauacccucgcaccaaugggaaacgguacgggacgacgcagauaa

SEQ ID NO: 33995 - RNA, 1617 nt, Artificial Sequence
  derived and/or modified sequence opt6 from VP1__Norovirus_and/or_Norovirus-like__JX459621
augaaaauggccuccucagacgcaaacccuagugauggaucaaccgcaaacuuagucccugaaguaaacaacgaagucauggcacuagaacccguaguaggagcagcuauagcagcacccguagcaggacaacaaaauguaauagacccauggauuagaaauaauuuuguccaagcaccaggaggagaauuuacaguuucaccacgcaacgccccaggagaaauauuaugguccgccccacuuggaccagacuuaaauccauacuuaucacacuuagcacgaauguauaauggauacgccgguggauuugaaguacaaguaauacuagcaggaaacgcauucacugcaggaaaaauaauauucgcagcagucccacccaacuuuccaacagaaggauuauccccaucacaaguaacaauguuuccccacauaauaguagauguacgacaacuagaaccaguauuaauaccacuacccgauguacgaaauaauuucuaccacuacaaccaaucaaaugacccuacaaucaaauuaauugcaaugcuuuauacaccauuaagagcaaacaacgcaggagaugacgucuucacagucuccuguagagucuuaacucgcccaucaccagauuuugacuuuauauuucuaguacccccuacugucgaaucaagaacaaaaccauucucaguaccaauuuuaacaguagaagaaaugacuaacucaagauucccaauuccauuagaacgauuauuuacaggaccaucuucugcuuucguaguccaaccgcaaaacggucgauguacaacagauggcguacuacuaggaacuacacaauuaucucccguaaauauaugcacauuuagaggagauguagcacauauagcagguacacaagaauauacaaugaauuuagcaagucaaaacuggaauaauuaugaccccacagaagaaauaccugcaccucuaggaacuccagacuucguagguaaaauacaaggaguauuaacacaaaccacaagaagagacggaucuaccagaggucacaaagcaacaguaucaacgggauccguacauuucacaccaaaauuaggucgaauccaauucagcacagacacaucuaaugacuuugaaacaggacaaaauacccguuuuacaccaguaggcguaguacaagauggaggaaccacacaucaaaaugaaccacaacaauggguauuaccagacuacucuggaagagacucacauaauguacaccuagcacccgcaguagcgccaucauuuccaggcgaacaauuacuuuucuuuagaucaacaaugccaggcugcucaggauacccuaauaugaauuuggauuguuuacuaccacaagaauggguacaacacuucuaucaagaagcagcuccagcacaaucagacguagcacuacuacgauucguaaacccagacacaggaagaguacuauuugaaugcaaacuacauaaaucaggauaugugacagucgcacauaccggacaacacgacuuaguaauaccucccaauggcuacuucagauucgauucuugggucaaucaauuuuacaccuuagcuccaaugggaaacggaaccggacgaagaagauaa

SEQ ID NO: 33996 - RNA, 1617 nt, Artificial Sequence
  derived and/or modified sequence opt6 from VP1__Norovirus_and/or_Norovirus-like__JQ613541
augaaaauggcaucuucagacgccaauccuucugauggaucaaccgcaaacuuaguaccugaaguaaauaaugaaguaauggcacucgaaccaguagucggagcugcaauagccgccccaguugcuggucaacaaaauguaauagauccauggauuagaaauaacuucguacaagcaccaggaggagaauuuacaguaucaccacgaaaugcaccuggagaaauuuuauggucagcaccucuuggaccagaucuaaacccuuaccucucccauuuagcacgaauguacaauggauaugcaggcggauucgaaguacaaguaauuuuagcaggaaaugcauuuacagcaggaaaaauaguauucgcuguaguaccaccaaauuuuccaacagaaggauuaucaccaagucaaguaacuauguucccacauauaauaguagacguacgccaauuagaaccaguauuaauacccuuaccagauguaagaaacaauuuuuaucauuauaaucaaucaaacgauccaacaauaaaacuaauagcaauguuauauacaccuuuacgagcuaauaaugcaggcgacgauguauuuaccguaucuugucgaguacuaacccgucccucaccugauuuugacuuuaucuucuuaguaccuccuacuguagaaucaagaacaaaaccauucuccguaccaauauuaaccguagaagaaaugacuaacagcagauuuccaauaccuuuagaaaaauuauuuacaggaccaucgucugcuuucguaguccaaccacaaaacgguagaugcacaacagauggaguacuauuaggaacaacacaacucucuccaguaaauauuuguaccuuuagaggagacguaacacauauagcuggaagucacaacuacacuaugaauuuagccucacaaaauuggaacucauaugauccaacagaagaaauaccagcuccauuaggaaccccagauuuuguuggcaaaauacaaggaguauuaacacaaacaacaagaacugauggauccaccagaggacauaaagcaacuguauauacaggcuccgcagaauuuuccccaaaauuaggacguguucaauuugcaacagauacaaauaacgauuucgaugcaaaucaaaacacaaaauucaccccaguaggaguaauacaagacggagguacaacacaucgcaaugaaccucaacaauggguucucccaucauauaguggaaggaauacucacaauguacacuuagcuccagcaguugcaccuacuuucccuggugaacaacuacuuuucuuuagaucuacuaugccaggauguucaggauacccaaacauggauuuagacugucuacuaccccaagaauggguccaauacuucuaccaagaagcagccccugcacaaucugaugucgcacuacugagauucguaaauccagacacaggaagaguuuuauuugaaugcaaacuccacaaaucaggcuacguaaccguagcacacauaggucaacaugauuuaguuauacccccuaauggauacuucagauuugauuccuggguuaaucaauuuuacacccuagcuccuauggggaauggcacuggaagaagacgauaa

SEQ ID NO: 33997 - RNA, 1617 nt, Artificial Sequence
  derived and/or modified sequence opt6 from VP1__Norovirus_and/or_Norovirus-like__JQ613527
augaagauggcuucaucugacgcuaacccaucagauggaucaacagcaaauuuaguaccagaaguaaacaaugaaguuauggcccuagaacccguaguaggugcugcaauagccgcaccaguagcaggacaacaaaacguaauagacccauggguaagaaauaacuuuguccaagcaccugguggagaauuuacaguaucacccagaaaugcaccaggagaaauucuauggucagcaccacucggacccgacuuaaacccauaccucucucauuuagcacgaauguauaacggauacgcaggaggauucgaaguacaagucauacuagcaggaaaugcauuuacugcuggaaaaauaauauucgcagcaguaccaccaaauuucccaacagaaggacucucuccaucacaaguaacaauguucccacacauaauuguagacguaagacaacuagaacccguauuaauaccccuaccugacguaagaaauaauuucuaucacuauaaccaauccaaugauccaacuauaaaauuaauagccaugcuauauacaccauuaagagcuaauaaugcaggagacgaugucuuuacagucucuuguagaguucuaacuagaccaucaccagacuuugauuuuauauuccuugucccaccuacuguagaaagucgaacaaaacccuuuucgguaccaauacuuacuguugaagaaaugaccaacuccagauucccaauuccucuagaaaaacuauuuacaggaccaaguucagcauuuguaguacaaccacaaaauggaagaugcacaacugacggaguccuacuaggaaccacucaauuaucacccguaaauauauguacauuucgaggugacguaacacauauagccggcucacauaacuauacaaugaaucuagcuucccaaaacuggaacaguuaugaucccacugaagaaauacccgcuccauuaggaacucccgauuucguagguaaaauucaaggaguauuaacacaaacaacaagaacagauggaucaacucgaggacauaaagcaacaguauauacuggaucaacagaauuuucaccuaaauuaggacgaguacaauucgcaacagacacaaauaacgauuucgaugcuaaucaaaacacaaaauucacaccuguaggcguaauacaagacggaggcacaacacaucgaaaugaaccacaacaauggguacuuccaucauauucaggcagaaauacccauaacguucaccuagcaccagccguggcacccacauuuccaggagaacaauuauuauucuuucgaucaacaaugccuggauguucgggcuacccuaauauggaucuagauugccuacuaccacaagaauggguucaauacuucuaucaagaagcagcaccagcacaauccgauguagcauuacuaagauuuguaaacccagauacaggaagaguccuauucgaaugcaaauuacauaaaucagguuauguuacuguagcacauacaggacaacaugacuuaguaauuccaccaaauggauacuuccgcuucgauucuuggguuaaucaauucuauacccuugcaccaaugggaaauggaacagguagaagaagauaa

SEQ ID NO: 33998 - RNA, 1617 nt, Artificial Sequence
  derived and/or modified sequence opt6 from VP1__Norovirus_and/or_Norovirus-like__JF827296
augaaaauggcaucaaaugacgcaacaccaucagauggaucaacagcaaaucuaguacccgaaguaaacaacgaagucauggcauuagaaccaguuguaggagcagcaaucgcagccccuguugcaggacaacaaaacguaauagauccuuggaucagaaauaacuuuguacaagccccaggaggugaauuuacagucucaccuagaaacgcuccuggagaaauacucuggucagcaccacuaggaccagaccuaaauccauaccuaucucaucuagcaagaauguauaacgguuacgcaggaggauucgaaguacaagucauauuagcuggaaauguauuuacagcaggaaaaauaauauucgcagccguaccaccaaacuucccaacagaaggacuaucucccucacaagucacaauguuuccucauauaauaguugacguuagacaauuagaaccaguauuaauaccauuacccgauguaagaaacaauuucuaucauuauaaucaaucuaaugaccccacuauuaaacuaauagcaaugcuauacacaccacuacgcgccaacaaugcuggcgacgaugucuucaccguaucauguagaguauuaacaagaccaucaccagauuuugauuuuauauuccuagcuccaccuacaguagaaucacguacuaaaccauucucugucccaauauuaacaguagaagaaaugacaaacucaagauuuccaauaccccuagaaaaauuauuuacaggaccaucaucagcauucguaguccaaccacaaaauggacgaugcacaacagacgguguauuacuaggaacaacacaauuaucaccuguaaauauauguacauuccgaggagauguaacacacauagcaggaacucaaaacuacacaaugaaccuagcuucacaaaauuggaauaacuaugauccaacagaagaaauaccagcaccccuaggaacaccugacuuuguuggaaaaauacaagguguacuaacacaaacaaccagacgcgacggaucaaccagaggacauaaagccacagucucaaccggaucaguccacuuuacacccaaacuaggaucaauacaauucucuacagacacaucaaaugauuucgaaacaggacaaaacacaagauuuaccccaguaggaguaguacaagacggaucuacaacacaccaaaacgaaccucaacaauggguccuaccugacuacucaggcagagauucccauaauguacacuuagcaccagcaguagcaccaacauucccaggagaacaauugcuauucuuuagaaguacuaugccaggauguucuggauacccaaauaugaaucucgacugcuuacuaccacaagaauggguacaacauuucuaucaagaauccgcacccgcucaaucugacguagcucuauuacgauucguaaacccagacaccggccguguacuuuuugaauguaaauuacauaaaucaggauauguuacaguugcacacacaggucaacacgaucuagucauaccaccaaacggcuacuucagauucgacuccuggguaaaucaauuuuacaccuuagcaccaaugggcaauggagcaggacgacgacgauaa

SEQ ID NO: 33999 - RNA, 1617 nt, Artificial Sequence
  derived and/or modified sequence opt6 from VP1__Norovirus_and/or_Norovirus-like__JF713050
augaaaauggcaucaaaugacgcuaacccuucugauggaucagcagcaaacuuaguaccagaagucaauaacgaagucauggcacucgaacccguagcuggagccgcauuagcagcaccaguagcuggacaacaaaauguaauagauccauggauaagaaacaauuuuguacaagcacccggaggagaauuuacaguaucaccaagaaaugcaccaggagaaaucuuauggucugcaccccucaguccugauuuaaauccauaccuaucacacuuagcaagaauguauaauucauacgcaggcggcuuugaaguacaaguaauauuagcaggaaaugcauucacagcaggcaaaauuauuuucgccgcaguaccuccaaacuuucccauugaaggauuaucacccucacaaguaacaauguuuccacauauaauagucgacguaagacaacuagaaccaguauuaauaccacuaccagauguacgaaacaauuucuaccauuauaaucaauccaacgaaccuacaauaaaauuaauagcaauguuauacacacccuuacgagccaacaaugcaggagaagauguauuuacuguaucaugccgaguguuaacucgaccaucaccagacuucgauuuuauauucuuaguucccccaaccguggaaucacgaacaaaaccauuuacagucccaaucuuaacaguugaagaaaugacuaauucacgcuucccaauaccauuagaaaaauuauuuacaggacccucaucauccuucguaguccaaccacaaaacggaagauguacaacugacgguguacuucuagguaccacacaauuaucuccuguuaauauaugcacauucagaggugauguaacccauauagcuggaucaagaaauuacacuaugaaucuagcuucaauaaacuggaauaauuaugauccuaccgaagaaauaccugcuccauuaggaacaccugauuucguaggcaaaauucaaggaauguuaacccaaaccacaagaggagacgguuccacaagaggacauagagccaccguauauaccggcagugcaccauuuacaccuaaauuaggaucaguacaauucacaacagauaccgauaacgauuucgaaacaaaucaaaauacaaaauucacaccaguaggaguaguucaagacggagacacagcccacagaaacgaaccacagcaauggguuuuacccucuuauucuggaagaaauguacaaaauguacaccuugccccugcaguagcaccaacauuuccuggugaacaacuauuauucuuucgaucaacaaugcccggauguucaggauauccaaauauggaccucgacugcuuacuaccacaagaauggguacaacauuuuuaucaagaagcagcccccgcacaaucagauguugcuuuacuacguuuugucaaccccgauacaggaagaguauuauuugaauguaaacuucauaaaucaggauacguuacagucgcccacaccggacaacacgaucuaguuauaccacccaauggauacuuuagauuugauucaugggucaaucaauucuacacucuagcaccuaugggaaauggaacaggaagaagaagauaa

SEQ ID NO: 34000 - RNA, 1617 nt, Artificial Sequence
  derived and/or modified sequence opt6 from VP1__Norovirus_and/or_Norovirus-like__HM802548
augaaaauggcaucuaaugacgcuucucccucagaugguucuacagcaaaucuagucccagaaguuaacaaugaaguaauggcauuagaacccguaguuggagcagcaauagcagcaccaguagcaggacaacaaaacguaauugaccccuggaucagaaauaauuucguucaggcccccggcggcgaauuuacuguaucaccaagaaaugcaccaggagaaauacuauggucagcaccucuagguccagaucuuaauccuuaucuaucacaccucgcaagaauguacaauggauaugcaggcggauucgaaguacaaguaauacuagcuggaaaugcauucacagccggaaaaauuaucuucgcugcaguaccaccaaacuuuccaacagaaggucuaucacccucacaaguaacaauguucccacacauaauugucgacguaagacaauuagaaccuguacucaucccacucccagauguuagaaacaauuucuaucauuauaaccaaucuaaugauagcacaauaaaauuaauagcaaugcuuuacacuccuuuacgagcaaauaacgcuggugacgacgucuucacaguaucuugccgaguucucaccagaccaucaccugacuuugauuuuauauuuuuaguaccaccuacaguagaaucacgaacaaaaccauuuacaguaccaauauugacaguagaagaaaugacaaacucacgcuuuccaauuccuuuagaaaaacuauucaccgguccaucuucagcauuugucguacaaccccaaaaugguagauguaccacagauggaguauuacuaggaacaacucaacuaucaccagucaauauuugcacauucagaggagauguaacacauauaccaggaacacgaucuuacagaaugaaucuagcaucacaaaacuggaauaauuacgauccaacagaagaaauuccagcuccauuaggaacaccugacuuuguagguaaaauacaaggaaugcuaacacaaacaacaaaacgagacgguucuacucgaggacauaaagcaacaguaucuacuggaucaguagauuuuacaccaaaauuaggaucuguacaauucgcaacagacacagauaacgauuucgaaacuggacaaaacacuagauuuacuccaguuggaguaauucaagacggaaguuccacacauagaaacgaaccccaacaauggguacuucccgacuauuccggacgaacaguucauaauguccauuuagcaccagcaguagcaccaaccuuuccuggcgaacaacuauuauucuuucgaucuacaaugccagguugcagcggcuauccaaacauggacuuagauuguuuacuuccacaagaauggguccaacacuucuaucaagaagcagcaccaucacaaucugacguagcccuuuuacgauuuguaaacccagacacaggaagaguacuauucgaauguaaacuucacaaagcaggauacgucacaguagcacauacaggacaacacgauuuaguaauaccaccaaacggauacuucagauucgacucaugggucaaucaauuuuacacucuugcaccaaugggaaacggagcaggacgaagaagauaa

SEQ ID NO: 34001 - RNA, 1617 nt, Artificial Sequence
  derived and/or modified sequence opt6 from VP1__Norovirus_and/or_Norovirus-like__GQ856459
augaaaauggcaucaaaugacgcuaauccuagugauggaucagcagcaaacuuaguaccagaaguaaacaacgaaguaauggcacuagaaccaguagucggagcagccauagcugcuccaguagcaggacaacaaaauguaaucgacccuuggauaagaaauaacuuuguccaagcacccggaggugaauuuacagucucaccucgaaaugcaccaggagaaauauuauggucugcaccacuaggaccagaucuaaauccauaucuaucacauuuagcacgaauguacaaugguuaugcaggagguuuugaaguucaaaugauacuagcaggaaacgccuucacagcaggaaaaaucauauucgcagcaguuccaccaaauuuuccaacagaaggccuaucaccaucucaaguaacgauguuuccacacauaauaguugacguaagacaacuagaaccaguccuaaucccauuacccgauguacgaaauaauuucuaucacuacaaucaaucuaacgacucaacaauaaaauuaauugcaaugcuauauaccccuuuaagagcaaacaaugcuggagaagauguauuuacuguuucauguagaguucuaacacgcccuucaccagauuuugauuuuaucuuuuuaguaccgccuacagucgaaucaagaacaaaaccauuuacaguucccauacuaacaguagaagaaaugacaaauagcagguuucccauaccacucgaaaaacuauuuacaggaccauccucagcuuuuguaguacaaccacaaaaugguagauguacaacagauggaguguuauuagguacaacacaauuauccccaguaaauauauguacauucagaggugauguaacacauauagcaggaucucguaauuauacaaugaaccuagcuucacuaaauuggaauaauuacgauccaacagaagaaauccccgcuccauuaggaacaccagacuuuguaggaaaaauacaaggaguacuuacccaaacaacuaaaggugauggaucaacaagaggacacaaagcuacagucuauacuggaucagcaccauucacccccaaauuaggaucaguacaauuuucaacagauacagaaaaugauuucgaaacucaucaaaauacaaaauuuacuccaguaggaguuauacaagauggaggcacuacccaccgcaaugaaccacaacaauggguucuaccaucauauucagguagaaauguuccaaacguacauuuagcaccagcaguugcaccuacauuuccaggagaacaauuacuauucuuuagaagcacaaugccaggauguucuggauacccaaauauggauuuagauugcuuacuaccacaagaauggguacaacacuucuaucaagaagcagcuccagcacagucagacguugcauuauuaagauucguuaaucccgauacaggaagaguauuauucgaaugcaaacuacauaaaucaggauacguaacugucgcucauaccggccaacacggccuaguaauaccuccaaauggauauuuuagauucgauucgugggucaaucaauuuuauacucuagcaccuaugggaaacggaacaggacgacgaagauaa

SEQ ID NO: 34002 - RNA, 1617 nt, Artificial Sequence
  derived and/or modified sequence opt6 from VP1__Norovirus_and/or_Norovirus-like__AB541308
augaaaauggcuucuaaugacgcaaauccaucagauggaucagcagcuaauuuaguaccagaaguaaauaaugaaguaauggcacuugauccaguaguaggagcagcaauagcagcaccuguagcuggacaacaaaacguaauagaccccuggauaagaaacaacuuuguacaagcaccaggaggagaauuuacaguuucaccacgaaaugcaccuggagaaauacucuggucagcaccauuaggaccagaccuaaauccauacuuaucacauuuagcacgaauguauaacggcuacgcaggaggauucgaaguacaaguaauacucgcaggaaaugcauuuacagcuggaaaaauaauauuugcagcaguaccaccaaacuuuccuacagaaggucuaucaccuucucaaguuacaauguucccccacauaauaguugacguaagacaacuagaacccguauuaauuccauuaccagauguuagaaauaacuucuaccacuacaaccaauccaacgacucaacaaucaaacugaucgcaauguuauacacuccacuaagagcaaauaaugcaggagaagacguuuuuacagucucaugcagaguauuaacaagaccaaguccagacuucgauuuuauaugccuaguuccaccuaccguagaaucuagaacuaaaccuuuuaccguacccauauuaacuguagaagaaaugacaaauucuagauuuccaauuccccuugaaaaacuauuuacaggaccaucuucugcauucguuguacaaccacaaaauggaagauguaccacagacgguguccucuuagguaccacccaauuaucacccguuaauauauguacuuuuagaggugauguaacacacauagcaggcuccagaaauuacaccaugaauuuagccucauuaaauuggaauaauuaugaucccacagaagaaauacccgcuccacuaggaaccccagacuuuguaggaaaaauccaagguguauuaacucaaacaacuaaaggugauggaucaacuagaggucauaaagcaacaguuuauacagguucagcuccuuuuacaccaaaacuaggaucaguacaauuuucaaccgauacagaaaacgauuucgaaacacaucaaaauacaaaauuuacucccguaggaguaauucaagacggagggacaacacacagaaaugaaccucaacaauggguacuaccaagcuacucaggcagaaacguaccuaacguacacuuagccccugcaguagcaccaacuuucccaggugaacaauuauuauucuucagaucaacaaugccaggcugcuccggauauccuaauauggaucuagacugcuuacuaccacaagaauggguacaacauuucuaucaagaagcggcaccagcacaaucagacguugcacuucuaagauucguaaauccugacacuggaagagucuuauucgaaugcaaauuacauaaaucagguuauguaacaguugcccauaccggucaacacgauuuaguaauaccaccaaauggauauuucagauucgauaguuggguuaaucaauuuuauacuuuagcuccuaugggaaauggcacagguagacgaagauaa

SEQ ID NO: 34003 - RNA, 1617 nt, Artificial Sequence
  derived and/or modified sequence opt6 from VP1__Norovirus_and/or_Norovirus-like__AB541276
augaaaauggcaucaaaugacgcaaaccccucagauggaucagcagccucauuaguaccugaaguauccaaugaaguuauggcuuuagaacccguuguaggagccgccauagcagcaccugucgcuggacaacaaaacguaauugacccauggauacgaaauaauuuuguacaagcucccggaggcgaauuuacaguaucaccuagaaaugccccaggugaaauacuuuggagcgccccauuaggaccagaucuaaauccauacuuaucccaucuagcacguauguacaacggauaugcaggaggauucgaaguacaaguaauauuggcaggaaaugcauucacugcuggaaaaauaauuuuugcagcaguuccacccaacuuucccacagaaggucuaucucccucucaaguaacaauguuuccucacauaauagucgacguacgccaacuagaacccguucuaauuccauuaccagauguacgaaauaauuuuuaccacuacaaccaaagcaaugacucaacaauaaaauuaauagcaauguuauauacaccccuaagagcuaauaaugcaggggaagauguauuuacuguuagcuguagaguacuaacucguccaucaccagacuuugacuuuaucuucuuaguacccccaacuguugaaucaagaacaaaaccauucacaguaccaauacuaacaguagaagaaaugaccaacaguagauuuccaauacccuuagaaaaauuauucaccgguccauccggagcauuugucguccaaccucaaaacggaagauguacaacagauggagucuuauuaggaacaacacaacuaucaccaguaaauauauguacuuuuagaggagauguuacacacauagcaggaucaagaaacuacaccaugaaccuagcaucauuaaauuggaacaacuacgacccaacagaagaaauaccagcuccacuuggaacaccagacuucguaggcaaaauacaaggaguucuuacccaaacaaccaaaggagauggaucaacacgaggacauaaagcaacagucuacaccggcucagcuccauuuacaccuaaacuugguaguguacaauuuucaacagauacagaaaacgauuuugaaacacaucaaaacaccaaauuuacaccaguuggaguuauacaagacgguucaacaacacaucgcaacgaaccacaacaauggguacucccaucuuauucaggacgagauguacauaauguacaccuugcaccggcaguugcaccaacauuuccaggagaacaauuacuauuuuucagaucaacaaugccaggcugcucaggauacccaaauauggaucuagauugcuuauuaccucaagaauggguacaacacuuuuaucaagaagcggccccugcacaauccgauguagcacuauuaagauuugucaauccugauacaggucgaguacuauuugaaugcaaauuacacaaaucaggauauguaacaguagcacacacuggacaacacgaucuaguaauaccacccaauggcuauuuuagauucgauaguuggguaaaucaauuuuacacucucgcaccuaugggaaacggaacuggucgcagaagauaa

SEQ ID NO: 34004 - RNA, 1617 nt, Artificial Sequence
  derived and/or modified sequence opt6 from VP1__Norovirus_and/or_Norovirus-like__AB541224
augaaaauggcaucaaacgaugcuaauccaucagauggaucggcagcuaauuuaguaccugaagucucaaaugaaguuauggcacuagaaccuguuguaggugcagccauagcagcaccaguagcuggccaacaaaauguaauugacccauggauaagaaauaacuucguacaagcacccggaggagaauuuacaguaucaccuagaaaugccccuggagaaauauuaugguccgcacccuuaggaccagauuuaaauccauaccuaucucaccuagcacgaauguacaacggcuaugcaggcgguuucgaaguacaagucauacuagcuggaaaugcuuuuacagcaggaaaaauaauauuugcugcaguaccaccaaauuuuccaaccgaaggacucuccccaucucaaguuacaauguuuccacauauuauaguugauguaagacaauuagaacccguucucauacccuuaccagauguacguaacaacuucuaucacuauaaccaaucaaaugacucaacaauaaaacuaauagcaauguuauacacaccauuaagagcaaacaaugcaggcgaagacguauucacaguaucaugucgcguacuuacucgaccaucuccugacuuugacuuuauuuuccuaguacccccaacaguagaaucaagaacuaaaccuuuuacuguaccaauucuuacaguagaagaaaugacaaauucaagauuuccaauuccccuugaaaaauuauuuacaggcccaucaucagcuuucguuguacaaccucaaaacgguagauguacaacagauggaguacuauuagguacuacacaacuauccccagucaauaucuguacauuucgaggagauguaacccauauagccggaaguagaaacuacacuaugaaucuagcaucacuaaacuggaacaauuaugaucccacagaagaaauaccagcaccucucgguacacccgacuuuguuggaaaaauacaaggaguauuaacacaaacaaccaaaggagacgguucaacacgaggacacaaagcaacaguuuauacaggcucagcaccauuuaccccaaaacuuggcucaguacaauucucaaccgauacagaaaacgauuucgaaacacaucaaaauacaaaauucacaccaguaggagucauccaagacgguggcaccacacauagaaaugaaccacaacaauggguauuaccauccuauucaggcagaaacguaccaaacguccauuuagcacccgcuguugcaccuacuuuucccggagaacaacuuuuauuuuuccgaucuacaaugccaggauguuccgguuauccaaauauggauuuagauuguuuacuaccacaagaauggguacaacauuucuaucaagaagcugccccagcucaaagugauguugcacuauuaagauucgucaauccugacacaggucgaguauuauucgaauguaaacuacauaaaucaggauacgucaccguagcacauacaggacaacaugaucuaguaauaccaccaaauggcuacuucagauucgauucaugggucaaucaauuuuacacacuugcaccaaugggaaauggcacaggaagacgacgauaa

SEQ ID NO: 34005 - RNA, 1617 nt, Artificial Sequence
  derived and/or modified sequence opt6 from VP1__Norovirus_and/or_Norovirus-like__AB504330
augaaaauggcuuccaaugaugcaaauccaucagacgguucagccgcaaaccuuguuccagaaguuaauaaugaaguaauggcacuugaaccaguaguaggcgcugcaauagcugcaccagucgccggacaaacaaauguaauagauccuuggauaagaaacaacuuuguacaagcaccaggaggcgaauuuacaguauccccaagaaaugcaccuggagaaauuuuauggucagcaccacuagguccagauuuaaauccauauuuaucacauuuagcuagaauguauaauggcuaugcuggaggauucgaaguacaaguaauuuuagcuggcaaugccuucaccgcaggaaaaaucauauuugcugcaguaccaccuaacuuccccaccgaagguuuauccccaucacaaguuacaauguucccccacauuauaguugacguuagacaauuagaaccaguuuuaauaccacuaccagauguacguaauaauuucuaucacuauaaucaauccaaugauucaacaauaaaauuaauagcaauguuauacacaccauuacgcgcaaacaaugcaggagaagaugucuuuacaguaucuuguagaguauuaacaagaccuucaccagacuuugauuuuauuuuccuaguaccaccuacaguugaaucccggacaaaaccuuucacuguacccauauuaacaguagaagaaaugacaaacagcagauuucuaauaccauuagaaaaauuauuuacagggccaucaggagcauucguuguucagccacaaaauggcagauguacaacagacggcguauuacucggaacaacacaauuaucaccuguaaacauauguacuuuucgaggagacguaacacauauagccggaucaagaaacuauaccaugaaccuagcaucuuuaaauuggaacaauuaugacccaacagaagaaauaccagcaccccucggaacaccugauuuuguagguaaaauacaaggaguauuaacccaaacaacaaaaggagauggaucaacucgaggccacaaagcaacaguauacaccggaucagcacccuuuacuccaaaacuuggaucaguacaauucucaacagauacugaaaacgacuucgaaacucaucaaaauacgaaauucacaccaguaggaguaauccaagacgguucaacaacucacagaaaugaaccacaacaauggguacucccaucauacucaggccgaaacguccauaacguucacuuagcuccagcugucgcucccacauuuccaggugaacaacuauuauucuuuagaucaacaaugcccggauguucuggauauccaaauauggauuuagacuguuuauuaccacaagaauggguucaacauuuuuaccaagaagcagcccccgcacaauccgacguagcacuacuccgcuuuguuaauccagacacaggacgaguacuauucgaauguaaacuacacaaaucuggauauguaacuguugcacacacaggacaacacgauuuaguuauaccaccaaauggauauuuuagauuugauucaugggucaaucaauuuuacacucuagcaccaaugggaaauggcacaggaagaagacguuaa

SEQ ID NO: 34006 - RNA, 1617 nt, Artificial Sequence
  derived and/or modified sequence opt6 from VP1__Norovirus_and/or_Norovirus-like__AB447445
augaaaauggcaucaaaugacgcaaauccuucagauggaucagccgccaacuuaguaccagaaguaaauaacgaaguaauggcacuagaacccguaguuggagcagcaauagccgcacccgucgcaggacaacaaaauguaauagauccauggauaagaaacaauuuugugcaagcuccagguggugaauuuacaguaucaccaagaaaugcaccuggagaaauauuauggucagcaccccuaggaccagauuuaaauccauaucuaucucaccucgccagaauguauaacggauacgcaggaggauuugaaguacaagucaucuuagcagguaaugcauuuacugcaggaaaaauaauuuucgcagcaguucccccaaacuuuccaacagacggccuaucaccaucacaaguaaccauguuuccucauauuaucguagauguaagacaauuagagccagucuuaauaccuuuaccagacguaagaaauaauuucuaucacuauaaccaaucaaaugauucaacaauaaaacucauagcuauguuauauacaccauuaagagcuaauaacgcaggagaagacgucuuuacuguaucuuguagaguacuaacuagaccauccccagacuuugacuuuauauuucucguaccaccaacaguugaaagucgaacaaaacccuucacaguaccaauccuaaccguagaagaaaugacaaauucuagauuuccuauuccacuagaaaaacuauuuaccggaccaucauccgccuucguaguacaaccccaaaacggaagauguacaacagacggaguacuacuaggaaccacccaacuaucaccuguaaauauauguacauuuagaggagacguuacucauauugcaggaucuagaaauuacacaaugaaccuagcuucacuuaauuggaauaacuacgauccuacagaagaaauaccagcaccauuaggaaccccugauuuuguaggaaaaauacaagguguuuuaacgcaaacaacaaaaggagacgguagcacaagaggacacaaagcaacuguauacacaggcucagcccccuucacuccaaaacuaggcucaguacaauuuucaacagauacagaaaaugacuuugaaacacaucaaaacacaaaauuuacaccuguuggaguuauacaagacggaggaacaacucauagaaaugaaccccaacaauggguauuaccauccuacucugggagaaacguucauaacguucaccuugccccugcaguagcaccaacauuuccuggugaacaauuacucuucuuuagaagcacaaugccaggaugcucuggauacccuaauauggaucuagauuguuuauuaccacaagaauggguacaacauuucuaucaagaagcagcuccagcacaaucagacguagcauuacuacgauucguaaaccccgacacuggacgaguacuuuucgaauguaaacuccauaaaucaggauauguaaccguagcccauacaggacaacacgauuuaguaauacccccaaauggauauuuuagauuugauagcuggguaaaccaauucuacacucuugcaccaaugggaaacggaacuggaagaagaagauaa

SEQ ID NO: 34007 - RNA, 1617 nt, Artificial Sequence
  derived and/or modified sequence opt6 from VP1__Norovirus_and/or_Norovirus-like__AB294793
augaaaauggcauccaacgacgcuaacccauccgauggaucagcagcuaaccuuguaccagaaguaaauaaugaaguaauggcacuugaaccagugguaggagcagccauagcugcuccuguagcuggacaacaaaacguuauagaucccuggauuagaaauaacuuuguacaagcaccuggaggagaguucacuguaucacccagaaaugcaccaggagaaauuuuauggucagcaccacucgguccagauuuaaacccuuaucucucacacuuagcucgaauguauaauggauacgcuggcgguuucgaaguccaaguaauacucgcaggaaaugcauuuacugcaggaaaaauaauuuuugcagcaguaccacccaauuuucccacagaaggacuaucaccaucacaaguaacaauguucccccacauaauaguugacgucagacaacuagaaccaguauuaauuccauuaccagacguucguaacaauuuuuaucacuauaaccaaucaaacgacucaacaauaaaacuaauagccaugcucuauacuccuuuacgagcaaauaaugcaggagaagauguauuuacuguaucaugucgaguuuuaacaagaccuucaccugauuucgacuuuauauucuuaguaccaccuacaguugaaucaagaaccaaaccauucacaguaccaauacuaacaguugaagaaaugacaaacuccagauuccccauuccuuuagaaaaacuuuucacagguccaucaggagccuucguaguacaaccccaaaauggccgaugcaccacagauggaguacucuuaggaaccacacaauuaucaccuguaaauaucuguacuuucagaggugacguuacucauaucgcuggcucaagaaauuauacaaugaauuuagccucacuaaacuggaacaauuaugaucccacugaagaaauaccagcaccacuaggaaccccagacuuuguaggaaaaauacaaggcaugcuuacucaaacaaccaaaggugacggaucaacacgagggcauaaagcaaccguauauacaggaucagcuccuuuuacacccaaauuaggaucgguucaauuuucuacagauacugaaaacgacuucgaaacccaucaaaauacaaaauucacaccuguuggaguaauccaagacggaucaaccacacacagaaacgaaccucaacaauggguccuuccaucauauucaggucgaaauguacacaacguacacuuagcaccagcaguagcaccaacauuuccaggcgaacaauuacuauucuuuagaucaacaaugccaggcugcucaggauauccaaacauggaucuagacugcuuauuaccucaagaauggguacaacauuuuuaccaagaagcagcaccagcacaaucagauguagccuugcuaagauucguaaacccagacacaggucgcguacuauucgaaugcaaauuacacaaaucuggauauguaacaguagcacauacaggacaacacgaucuaguaauaccacccaauggauacuuuagauuugacucuuggguaaaccaauucuauacacuagcucccaugggaaacggaacuggccgaagacgauaa

SEQ ID NO: 34008 - RNA, 1617 nt, Artificial Sequence
  derived and/or modified sequence opt6 from VP1__Norovirus_and/or_Norovirus-like__AB303934
augaaaauggcauccaaugaugcaaauccauccgacgguuccacugcaaaccuaguaccagagguaaacaacgaaguuauggcauuagaaccaguaguuggagcagcaaucgcagcacccguagcuggucaacaaaauguaauugacccauggauaagaaauaauuuuguccaagcaccaggaggcgaauuuacuguuucaccaagaaacgcaccaggagaaaucuuauggucugccccacucggaccagauuuaaacccauaucuaucacacuuagcacgaauguauaacggauacgcaggcggauucgaaguccaaguaauucuagcaggaaacgcauuuacugcaggaaaaauaauauucgcagcagucccaccaaacuuuccaacagaagguuuaucccccucacaaguaacaauguucccacauauaaucguugacguacgacaauuagaaccuguacuaauaccauuacccgauguacgaaacaauuucuaucacuauaaccaaucaaaugacccuacaauuaaauuaauagcaauguuauauacaccauuacgagcaaauaaugccggugaagauguauuuacaguaaguuguagaguacuaacaagaccuucuccugacuucgauuucauauuucuaguaccuccuacaguagaaucaagaacaaaaccauucacagucccaauucuuaccgucgaagaaaugacaaacucuagauuuccaauaccauuagaaaaacuuuuuacagguccaucaggcgcauucguaguucagccacaaaacgggagaugcacaacagauggaguacuccuaggaacaacacaacuaagccccgucaauauauguacauuuagaggagacguuacacacauagcaggaacacacaauuacacuaugaacuuagcaucacaaaauuggaacaauuaugauccaaccgaagaaaucccugcaccacuaggaacaccagacuuuguaggaagaauccaaggaaugcuuacacaaacaaccagaggugaugguagcacacgaggacacaaagcaacagucucaacaggugacguacauuuuaccccuaaauuaggaucaauacaauucaauacggauacaaacaacgauuucgaaacaggccaaaacacuaaauuuacaccaguuggaguaauacaagacggcaacggagcacaucaaaaugaaccacaacaaugggucuuaccaucuuacucaggaagaacaggccauaauguucacuuagcuccugcaguugcaccaacauucccaggagaacaacuuuuauucuuuagaucaacaaugccaggaugcucaggcuauccaaacaugaaucuagacugcuuauuaccacaagaauggguccaacauuucuaccaagaagcagccccugcacaaucagauguagcauuacucagauucguuaauccagacacagguagaguauuauucgaauguaaacuucauaaauccggauacauaaccguagcacacacuggacaacaugauuuaguuaucccucccaauggauauuuuagauucgauuccuggguaaaccaauuuuauacccuugcaccaaugggaaauggaaccggaagacgaagauaa

SEQ ID NO: 34009 - RNA, 1617 nt, Artificial Sequence
  derived and/or modified sequence opt6 from VP1__Norovirus_and/or_Norovirus-like__KU678205
augaaaauggcaucuagugacgcgaauccuucagauggaucugcagcaaauuuaguaccagaaguaaacaaugaagucauggcacuagaaccaguaguaggagcagcaauagcagcuccaguagcaggacaacaaaauguaaucgauccauggaucagaaauaacuuuguucaagcacccgguggagaauuuacaguuuccccacguaaugcaccuggagaaauccuauggucagcacccuuaggaccagauuuaaauccauacuuaagccauuuagcuagaauguacaacgguuacgccggagguuucgaaguacaaguaauacucgcaggaaaugcauucacagcaggaaaaguaauuuucgcagcuguaccaccaaacuucccaacugaaggcuuauccccaucacaaguaacaauguucccucacauaguaguugacguucgacaauuagaacccguacuaaucccauuacccgacguaagaaacaauuuuuaccacuauaaccaauccaacgauccuacaauaaaacuaauagcaaugcucuacacuccacuacgagcaaauaacgcaggagaugauguauuuaccguaagcugcagaguucuaacaagaccauccccagacuuugacuucauauuccuaguaccaccuacagucgaaucaagaacaaaaccauucucaguaccaguccuaaccgucgaagaaaugacuaauucaagauuuccaauaccucuugaaaaauuauucacuggaccuucuucagcauucgucguucaaccacaaaacgguagauguacuacagacggaguacuacucggaacaacucaacuuaguccaguuaacauauguacauuuagaggugacguaacacauauuaccggaucacacaauuacacaaugaaccucgcaucccaaaacuggucuaauuaugauccaacugaagaaauaccagcaccccuaggaacaccagacuucguagguaaaguacaaggaguacuaacccaaacaacaagaacagacggcucaacacgaggccacaaagcaacaguauauacaggaucagcagacuuugccccaaaauuaggcagaguccaauucgaaacagauacaaaucacgauuuugaagcaaaucaaaauacuaaauucacaccaguaggaguaauacaggacggagguacaacacacagaaaugaaccacaacaauggguacuaccaucauauucaggaagaaauacaccuaauguacaucuugccccugcaguagcaccaacauuucccggagaacaacuccucuucuuuagauccacaaugccuggauguucuggauaccccaauauggaucuagauugccuauuaccucaagaauggguacaauauuuuuaucaagaagcagcaccagcccaaucagacguagcacuacucagauuuguaaaucccgacaccggaagaguauuauucgaauguaaauuacauaaaucaggauauguaacagucgcacauacuggacaacaugauuuaguaauuccacccaauggcuauuuccgauuugauucuuggguaaaucaauuuuauacucuagcacccaugggaaaugguacaggaagacgaagauaa

SEQ ID NO: 34010 - RNA, 1617 nt, Artificial Sequence
  derived and/or modified sequence opt6 from VP1__Norovirus_and/or_Norovirus-like__LC177657
augaaaauggcaucuagugacgcaaauccuuccgauggaucagcagcuaauuuagucccagaaguuaacaacgaagugauggcauuagaaccugucguaggcgcagcaauagccgcaccaguagcgggacaacaaaacgucaucgacccuuggauaagaaauaauuucguacaagccccaggaggagaauuuacaguaucaccacgcaacgcaccuggagaaaucuuaugguccgcaccauuaggcccagaucucaauccauauuuaagccauuuagcaagaauguauaauggauacgcaggaggauucgaaguacaaguaauauuagcugguaaugcauucacagcaggcaaaguaauauucgcagcaguaccacccaacuuuccaacagaaggcuuauccccaucgcaaguaacaauguucccacauauaguaguagauguucgacaauuagaaccuguacuaauaccccuaccagauguuagaaacaacuuuuaucacuauaaccaaucaaacgauccaacaauaaaauuaauagcaauguuauauacaccacuacgcgcaaauaacgcaggagaugacguauuuacaguaucauguagaguauuaaccagacccucaccagacuucgauuucauauuccucguuccaccaacaguagaaucuagaacuaaaccauucaguguaccagucuuaacaguagaagaaaugacgaacucaagauuuccaaucccacuugaaaaacuuuuuacaggaccaucaucagcuuucguaguacaaccacaaaauggacguuguacuaccgacgguguccuucuagguacuacccaauuaucaccaguaaauauauguacauuuagaggagauguaacacauauaacaggaucaagaaauuauacuaugaauuuagcaucccaaaauuggaacaauuacgaccccacugaagaaauuccagcaccauuaggaacaccugauuuuguaggaaaaauacaaggaauguuaacccaaacuacaagaacugauggaucaacacgaggacacaaagcaacugucuacacaggaucagcagacuuugcaccaaaauuagguagaguacaauuugaaacagauacagauagagacuucgaagcuaaucaaaacacaaaauuuacuccaguaggaguaauccaagauggaucaacaacccaccguaacgaaccacaacaauggguauuaccaucauauucaggcagaaacacuccuaauguacacuuagcuccagccguagcaccuacauuuccaggagaacaauuauuauuuuucagaagcacaaugccagguuguucaggcuauccaaauauggaucuagauugccuguuaccacaagaauggguccaauauuuuuaccaagaagcagcuccagcacaaucagacguagcauuagucagauucgucaacccagauacaggacgagucuuauucgaaugcaaacuccauaaaucaggauaugucacaguagcacacacaggacaacacgaccuaguaauaccaccaaauggauauuuuagguucgauucauggguuaaucaauuuuauacuuuagcacccaugggcaacggaaccgguagacgaagauaa

SEQ ID NO: 34011 - RNA, 1617 nt, Artificial Sequence
  derived and/or modified sequence opt6 from VP1__Norovirus_and/or_Norovirus-like__LC177656
augaaaauggcaucauccgacgcaaauccaucggauggaucagcagcuaauuuaguaccagaaguaaacaaugaaguaauggccuuagaaccuguaguaggagcagccauagcugcaccaguagccggacaacaaaauguaauagacccauggauaagaaacaacuuuguacaagcuccaggaggagaauuuacuguuucuccaagaaaugcaccaggagaaauauuauggucugcuccauuaggaccugaucuaaauccauaucuaucucaccuagcccgaauguauaacggauaugcaggaggauucgaaguacaaguaauauuagcaggaaaugcauuuacagcaggaaaaguaaucuuugcagcuguaccaccaaauuuuccuacugaaggauuaucaccuucacaaguaacaauguuuccccauauaguaguugacguucgacaacuagaacccguacuaauaccccuaccugauguacgaaauaauuucuaccacuauaaucaaucuaaugaucccacaauuaaacuuauugcaaugcuauacacacccuuacgagcaaacaaugcaggagacgauguauuuacaguaucaugccgcguucuaaccagaccaucuccugacuuugauuuuauauuuuuaguaccaccaacaguagaaucaagaacuaaaccauuuuccguaccaguauuaacuguagaagaaaugacuaacucaagauucccaauacccuuagaaaaauuauuuacagguccauccuccgcauucguaguucaaccccaaaacggaagauguacaacagacggaguauuacuaggaacuacucaacuaucaccuguaaauauauguaccuuuagaggagacguaacacauacaaccggaucccacaauuacaccaugaaucucgcuucccaaaauuggucuaauuaugauccuacugaagaaauaccugcaccauuaggaacaccagauuucguagguaaaauacaaggaguauuaacucagacaaccagaauugacgguucaacaagaggacacaaagccacaguauacacagguucagcugauuucgcaccaaagcuaggucgaguacaguuugaaacagacaccgaccacgacuuugaagcaaaccaaucaacaaaauuuacaccuguaggaguaauacaagacggaagcacaacucacagaaacgaaccacaacaauggguacuaccuucuuauucaggacgcaauacuccaaacguacaucuugcuccugcagucgccccuacauuuccaggugaacaacuauuauucuuucgcucaacaaugccagguuguuccggauauccaaauauggauuuagacuguuuauuaccucaagaauggguucaauauuuuuaucaagaagcagcaccagcccaaucagacguagcucuauuaagauuuguaaauccagacacaggacggguuuuauucgaauguaaauuacauaaaucaggauacguuacaguagcacacacaggucaacaugaccuaguuauaccaccaaauggauauuuccgauuugauucauggguuaaucaauuuuacacauuagcaccaaugggaaauggaacagguagacgacgauaa

SEQ ID NO: 34012 - RNA, 1617 nt, Artificial Sequence
  derived and/or modified sequence opt6 from VP1__Norovirus_and/or_Norovirus-like__KX354136
augaaaauggcaaguucagaugcaaaccccucugauggaucagcagcaaaccuuguuccagaaguaucaaaugaaguaauggcauuagaaccuguagucggcgcagcaauagcagcaccaguagcaggucaacaaaauauuauagaucccuggauaagaaauaacuuuguacaagcaccaggaggcgaauuuacaguauccccuagaaaugcaccuggagaaauacuauggucugcaccauuaggacccgaucuuaauccauaucuaucacaccuugcaaggauguauaacggcuaugcugguggauucgaaguucaaguaauuuuagcagguaaugcauucacagccggcaaaaucauauucgcugcuguaccaccaaacuucccaacagaaggacuaucucccucucaaguaacaauguuuccacacauuauaguagauguacgacaacuugaacccguacuaauaccacuaccagacguuagaaacaacuucuaucauuauaaccaaucaaaugauccaacaauaaaauuaauugcaauguuauauacaccauuaagagcuaacaaugcaggagaugacgucuuuaccguuucaugcagaguauuaacucgaccuaguccugacuuugacuuuauauuucuuguaccaccaacagucgaaaguagaaccaaaccauuuucagucccaauucuaacagucgaagaaaugacaaauaguagguuuccuaucccucuugaaaaauuauuuacuggaccaaguucagccuucgucguacaaccacaaaacggacguuguacaacagacggaguacuucucggaacaacucaauuaucaccuguaaacauauguacauuuagaggagacguaacacauauaacaggaucucauaauuacacuaugaacuuagcaucacaaaacuggaacaauuaugauccaacagaagaaauaccagcuccacucggaacaccagacuuugucggaaaaauacaaggagugcuaacccaaacaacucgaucagacgguuccacucguggacacaaagcaacaguauauacaggauccgcugauuucgcaccaaaacuaggaagaguacaauucgaaacagacaccgauagagauuuugaaacaaaccaaaacacaaaauucacuccuguaggaguaauacaagacggaacaacagcacauagaaaugaaccucaacaauggguccuaccaucauauucuggaagaaauauacacaauguacacuuagccccagcaguagccccuacauucccaggugaacaacuauuauucuucagaucaacgaugccaggcugcucaggauauccaaauauggaucuagacugcuuacuaccacaagaauggguucaauacuuuuaccaagaagcagcaccagcacaauccgacguagcccucuuaagauuuguaaaucccgacacaggaagaguacuauucgaaugcaaauuacauaaaucaggauaugucacaguugcacauacaggacaacaugauuuagucauaccuccaaaugguuauuuuagauuugauuccuggguaaaccaauucuauacacuagcaccaaugggaaauggaacaggaagacgaagauaa

SEQ ID NO: 34013 - RNA, 1617 nt, Artificial Sequence
  derived and/or modified sequence opt6 from VP1__Norovirus_and/or_Norovirus-like__KX354121
augaaaauggcaucaucugacgcaaaccccucagacggcucggcagcuaacuuaguaccugaaguaaauaacgaaguaauggcacuugaaccaguaguaggagcagcaauagcugcuccaguagcaggacaacaaaauguaauugauccauggauucgaaacaauuuuguucaagcaccuggaggugaauuuacuguaucaccaagaaaugcuccaggcgaaauuuuauggucugccccacuaggaccagaucuaaauccauaucuaucacacuuagcccgaauguauaacggcuaugccgguggauucgaaguacaaguaauacucgcaggaaacgcauucacugcaggaaaaguaauauuugcagcaguaccuccuaauuucccaacugaaggccuaaguccaucacaagucacuauguucccacacauuguaguagacguaagacagcucgaacccguacuaauaccauuaccagacguacgaaacaauuucuaccacuacaaccaaucaaacgauccuacaauaaaauuaaucgcaauguuauauacuccccuaagagccaauaaugcuggugacgacguauucaccguaucauguagagugcucaccagaccuagcccugacuuugacuuuauauuccuaguuccaccaacaguugaaucucgcacuaaacccuucucaguaccuguccucacaguagaagaaaugacaaacuccagauuuccaauaccacuagaacgacucuuuacuggaccaucuucugcauuuguaguacaaccacaaaacggaagauguacaacugaugggguauuacuaggaacaacacaacuaagccccguuaauauauguacauuuagaggagacauaacacauaucaccggaucucacaacuacacaaugaaccucgcaagucaaaauuggaauaauuaugauccaacugaagaaaucccagccccacuagguacaccugauuuuguaggaaaaauucaaggaguucuaacucaaacaacaagaacagacgguucaacuagaggacacaaagcaacaguauacacaggaucagcagaauuugcaccgaaauuaggcagaguucaauuugaaacagacaccaaucacgacuucgaagccaaccaaaauacaaaauucacaccaguaggaguuauacaagauggcucgacuacacauagaaaugaaccccaacaauggguucuaccauccuacucaggaagaaacacacauaauguucaccuagcuccagcaguagcaccuacauuuccuggcgaacaacuacuauuuuuccgaucaacaaugccaggaugcucuggauauccaaauauggaucuagacugcuuauuaccacaagaauggguucaauauuucuaucaagaagcagcaccagcccaaucagauguagcacuccuaagauucguaaauccagauacaggaagaguauuauuugaaugcaaacuacacaaaucaggguauguaacaguagcacauacuggucaacacgaucuaguaauacccccaaauggcuacuuuagauucgacucauggguaaaucaauucuacacacucgcaccaaugggaaacggaacaggcagacgaagauaa

SEQ ID NO: 34014 - RNA, 1617 nt, Artificial Sequence
  derived and/or modified sequence opt6 from VP1__Norovirus_and/or_Norovirus-like__KX354110
augaaaauggcaucauccgaugcaaauccaucagacgggucagcagccaaucucguaccagaaguaaacaacgaaguuauggcacuagaaccaguagucggagcagccauagcugcaccaguagcaggacaacaaaauguaauagauccauggauaagaaauaacuuuguacaagcaccaggaggcgaauuuacagucucaccuagaaaugccccaggagaaauauuaugguccgcacccuuaggaccagaccuuaacccauaucucucccacuuagcaagaauguauaacggauacgcaggaggauucgaaguacaaguaauacuagcaggaaacgcauucacagcaggaaaaguaauauucgcagcaguaccaccuaauuucccaacagaagguuuaucaccaucacaaguuacaauguucccucauauaguaguagacguaagacaacuagaaccuguauuaauaccacuaccagauguaagaaacaacuuuuaucacuauaaccaaucaaaugacccgaccauaaaauuaauagcaaugcuuuacacaccauuaagagcaaacaaugcuggugacgacguauuuaccguaucaugucgaguacuaacuagaccaucuccugauuucgauuucauauucuuagugccaccaacaguugaauccagaacaaaaccauucucaguacccguucuaacaguagaagaaaugacaaacucaagauuuccaauuccacucgaaagacuuuuuacaggaccaucaucagcuuucguaguacaaccacaaaacgguagauguacuaccgacggcgugcuucucgggacuacacaauuaagcccaguaaacauauguacauucagaggagauguaacacauauaacaggaucacauaauuacacaaugaacuuagcaucacaaaauuggaacaacuacgauccaacugaagaaaucccagcaccauuaggaacuccagauuuuguaggcaaaauucaagguguacugacacaaacaaccagcacagacggaucaacccgaggacauaaagcaacaguauauacaggaucagccgaguucgcaccuaaauuaggaagaguacaauuugaaaccgauacagaccacgauuucgaaacaaaccaaaauacuaaauuuacaccuguaggaguaauacaagaugguucuacaacccacagaaacgaaccacaacaauggguacuaccaucauauucaggaagaaauacacacaacguacaccuugcaccagcuguagcaccaacauucccaggagaacaauuauuauucuuuagaucaacaaugccuggcuguucaggauacccaaauauggaucuagacugccucuuaccacaagaauggguucaauauuucuaccaagaagcagccccagcacaaagugauguugcacuuuuaagauuuguuaauccagauacaggacguguauuauuugaaugcaaauuacacaaauccggauacauaacuguugcacacacaggccaacacgaucuaguuauacccccaaacggauacuuuagauucgauuccuggguaaaccaauuuuauacauuagcuccaaugggaaauggaacuggcagaagaagauaa

SEQ ID NO: 34015 - RNA, 1617 nt, Artificial Sequence
  derived and/or modified sequence opt6 from VP1__Norovirus_and/or_Norovirus-like__KX354107
augaaaauggcaaguucugacgcaaacccaucagacggauccgcugcaaacuuagucccagaaguaaacaaugaaguaauggcuuuagaaccaguuguaggagcagcaauagcagcaccagucgcuggucaacaaaauauaauagacccauggauucgaaacaacuuuguccaagcuccaggcggagaauuuacagucucaccacgaaacgcuccaggagaaaucuuauggucagcaccucucggcccagaucucaauccauaccuaucccaccuagcaagaauguacaacggauaugccggugguuucgaaguacaagucauucuagcuggaaaugcauuuacagcaggcaaaguaaucuucgcugcaguaccacccaauuuccccacugaaggauuaucaccaucacaaguaacaauguucccacauaucguuguagauguaagacaauuagaaccaguuuuaauaccacucccagauguacgaaacaacuucuaucauuauaaucaaucaaacgaucccacaauaaaauuaauagcaaugcuuuacacaccuuuacgugcaaauaacgcaggagaugaugucuuuaccguauccugucguguucuuacaagaccaucaccagacuucgacuuuauauuucuaguuccaccaacuguagaaagucgcacaaaaccauucucuguaccaguauuaacaguagaagaaaugaccaauucacgauuuccaauuccauuagaaaaauuauucacaggaccuagcucagcauucguaguccaaccucaaaacggaagauguacaacagacggaguauuacuagguacaacucaacuaucaccagugaauauuuguacauuccgaggagacguaacacacauaacaggaucaagaaauuauacaaugaacuuagcaucccaaaacuggaacaacuaugauccaacagaagaaaucccagcaccgcuaggaacaccugacuuuguaggaaaaauacagggaguacuuacccaaacaacacgaacagacggaucaacaagaggacacaaagcaacagucuauacaggaucagcugauuucgcacccaaacuaggacgaguccaauucgaaacagauaccgaucacgauuuugaagcaaaucaaaauacaaaauucacaccaguaggaguuauacaagauggcuccacaacucauagaaaugaaccacaacaauggguucuaccaagcuauucaggaagaaauacacauaacguacacuuagccccugcaguagcaccaacauucccaggagaacaauuauuauucuuucguuccacaaugccuggaugcucaggauauccuaacauggacuuagacuguuuauuaccacaagaauggguacaauauuuuuaucaagaagcagcaccagcacaaucugacguagccuuauuaagguucguuaacccugauaccggaagaguccuauuugaaugcaaacuacacaaaucaggauauguaacuguagcacauaccggucaacacgaucuuguuauaccuccaaauggauauuucagauuugauaguuggguaaaccaauucuacacauuagcaccaaugggaaacggaacaggcagacgcagauaa

SEQ ID NO: 34016 - RNA, 1617 nt, Artificial Sequence
  derived and/or modified sequence opt6 from VP1__Norovirus_and/or_Norovirus-like__KX353991
augaaaauggcaucaaaugacgcuaauccaucagaugguucuacagcuaaccuaguuccagaaguaaacaaugaaguaauggcacuugaaccaguugucggcgcugcgauagcagcccccgucgcaggucaacaaaacguaauugauccuuggauuagaaauaauuuuguacaagcaccuggcggagaauuuaccguaucaccaagaaacgcuccaggagaaauacuauggucugcaccucuagguccagaccuaaaccccuauuuaucacauuuagcccguauguacaacggauaugcaggaggauucgaaguacaaguaauuuuagcuggaaaugcguuuacagcaggaaaaauaauauuugcugcaguaccaccaaacuuccccacagaaggauuaucaccaucucaaguaacaauguucccacacauaauaguagauguacgacaacuagaaccaguccuaauuccacuaccagauguacgcaacaauuuuuaucacuauaaucaaucuaaugauccaacaauaaaacuuauagcuaugcuauacacaccuuuacgagcaaacaacgcaggcgacgauguguucacaguuagcuguagaguacuaacaagacccagcccagacuucgacuucauauuccuaguaccaccuacaguagaaucuagaacuaaaccuuucaguguaccuguacuaaccguagaagaaaugacaaacucaagaaucccaauaccauuagaaaaacuauuuacaggucccucuucagccuuuguaguacaaccacaaaauggaagaugcacaacagacggaguuuuauuaggaaccacucaauuaucuccuguaaauauaugcacuuuuagaggagacguaacccauauagcaggaucucgaaauuacacaaugaauuuagcaucccaaaacuggaacucuuacgacccuacagaagaaaucccagcucccuuaggaaccccagacuuuguaggaaaaauccaagguguauuaacacaaacuacuagaacagauggaucuacaagaggacauaaagcuaccguuuauacuggaucagcagacuuuaguccaaaauuaggacgaguacaauucgcaacagauacagacaaugauuuugaaacuaaucaaaauacaaaauucacaccagugggaguaauacaagauggaggaacaacacacagaaaugaaccacaacaauggguacuaccaucuuacucaggaagaaacacacauaauguucaccuagccccagcaguagcaccuacuuuuccaggagaacaauuacucuucuuuagaaguacaaugccagguuguucaggauauccaaacauggaccuugauugcuuauuaccucaagaauggguacaauacuucuaucaagaagcagccccugcacaaucugacguugcacuccuaagauuuguuaacccugacacaggccgaguacuuuucgaauguaaacuacauaaaucuggauauguaaccguagcucacacaggacaacacgaccuaguaauucccccuaauggauauuucagauucgauagcuggguaaaucaguuuuacacccuagcuccaauggguaauggcacuggaagaagaagauaa

SEQ ID NO: 34017 - RNA, 1617 nt, Artificial Sequence
  derived and/or modified sequence opt6 from VP1__Norovirus_and/or_Norovirus-like__KU985162
augaaaauggccuccucagacgcaaacccaucagacggcucagcagcaaaccuaguaccagaagucaauaacgaaguaauggcuuuagaaccgguuguaggagcagccauugcugcaccaguagcaggacaacaaaauguaauagaccccuggauacgaaauaacuuuguacaagcaccagguggagaauuuacaguaucuccucgaaaugcaccaggugaaauacuauggucagcaccacuagguccugauuuaaacccauauuuaucacacuuagcaagaauguauaacggauacgccggaggcuucgaaguacaaguaauccuagcaggaaaugcauuuacagcaggaaaaguaauuuuugcagcuguaccaccaaacuuuccuacagaaggacuaucaccaucacaaguaacaauguuuccacacauugucguagauguaagacaauuagaaccaguauuaauaccccuaccagacguaagaaauaauuucuaucauuauaaccaaucuaacgauccaacaauaaaauuaauagcaauguuguauacuccauuaagagccaacaacgcaggagacgacguauuuacaguauccugucgaguuuuaacaagaccaucaccugauuuugacuuuauauuuuuaguacccccuacaguagaauccagaacaaaacccuuuucagucccuguuuuaacaguugaagaaaugacaaauuccagauuuccaauaccccucgaaaaauuauuuaccggaccauccucagcauucguaguacaaccacaaaauggccgauguacuacagacggaguauuacuaggaacaacucaauuaucaccaguaaauauaugcaccuuuagaggugauguuacccauauaacaggcucacauaauuauacaaugaacuuagcuucccaaaacuggaacaauuacgacccaacugaagaaauucccgcaccgcuuggaaccccagauuuuguaggaaaaauccaaggaguacuaacacaaacaacaagaaccgacggaucaacaagaggucauaaagcaacaguauauacaggaucagcagacuuugcaccuaaacuuggaagaguacaauucgaaacggauaccaaucaugacuucgaagcaaaccaaaauacuaaauuuacuccaguaggaguaauacaagacggaucaacaacacaucgaaaugaaccacaacaauggguacuucccucauacuccggaagaaauacccccaacguacaccuagcacccgccgucgcaccaacauuuccaggagaacaacucuuauucuuucgaucuacuaugccaggcugcuccgguuacccuaauauggacuuagauugccuccuaccacaagaauggguucaauauuucuaccaagaagcagcaccagcacaaucagacguagcacuacuaagauucguaaacccagacacuggacgcguccuuuucgaaugcaaacuucauaaauccgguuauguaacaguagcacacaccggccaacaugauuuaguaauacccccaaaugguuauuuuagauucgacucauggguaaaucaauuuuacacacucgcaccaaugggaaauggcacuggaagaagacgauaa

SEQ ID NO: 34018 - RNA, 1617 nt, Artificial Sequence
  derived and/or modified sequence opt6 from VP1__Norovirus_and/or_Norovirus-like__AB972476
augaaaauggcaucuaaugacgcaaaccccucagauggaucagccgcaaaccuaguaccagaaguaaacaaugaagucauggcauuagaaccaguuguaggagcagcaaucgcugcaccaguagcuggacaacaaaauguaauagacccuuggauaagaaauaauuucguacaagcaccaggaggcgaauuuacuguauccccaagaaacgcaccaggcgaaauucuauggucagcgccacuugguccagaccucaaucccuaucuaucacaccuagccagaauguauaacgguuaugcaggaggcuucgaaguacaaguaauccuagcaggaaaugcauuuaccgcuggaaaaauuauuuuugcagcaguaccacccaacuuccccacagagggacuaagcccaucucaagucacaauguuuccucauauaauagucgaugucagacaauuagaaccaguuuuaauaccacuucccgacguaagaaacaacuuuuaccauuauaaccaauccaaugauucaaccauaaaauuaauagccauguuauacacaccuuuaagagcaaacaaugcaggcgaagauguauucacaguuucuuguagagucuuaaccagaccaucaccagacuucgacuuuauuuuucuaguaccaccaaccguagagucccgaacaaaaccauucacaguuccaauauuaacaguagaagaaaugacaaacucaagauucccaauaccacuagaaaaacuuuuuacuggaccaucaucagcauuuguaguacaaccacaaaaugguagauguacaacugauggaguacuuuugggaaccacacaacuaucaccaguaaauauauguacauuuagaggugacguaacucauauagcaggaucuagaaacuacacaaugaaucuagccaguuuaaauuggaauaauuacgaccccacagaagaaauaccagcuccacuaggaacaccugacuuuguuggaaaaauacaaggaaugcuaacacaaacaaccaaaggugauggauccacaagaggacacaaagcaacugucuauacagguuccgcaccauuuacaccuaaguuaggaucaguacaauucgaaacugacacagaaaaugauuuugaaacacaccaaaauacaaaauucacaccaguagguguaauccaagacggagguacaacacaccgaaacgaaccacaacaauggguauuaccaucauauucagguagaaauguaccaaauguacaucuagccccugcaguagcaccaacauuuccuggagaacaauuacuuuucuuccgaucaacaaugccaggaugcucaggcuauccaaauauggaccucgauuguuuacuaccacaagaauggguacaacacuuuuaucaagaagccgcuccugcacaaucagauguagcacuuuuaagauuuguaaacccugacacaggaagaguacuauucgaauguaaauuacauaaaucaggauauguaacuguagcacauacaggacaacacgacuuaguaauaccaccaaauggauacuuccgauuugauagcugggugaaccaauuuuacacucuagcaccuaugggaaauggaaccggacgacguagauag

SEQ ID NO: 34019 - RNA, 1617 nt, Artificial Sequence
  derived and/or modified sequence opt6 from VP1__Norovirus_and/or_Norovirus-like__KU311162
augaaaauggcaucuaaugacgcaaauccaucagauggaucagcugcaaaucuagucccagaaguaaauaaugaaguuauggcccuugaaccaguuguaggugcugcaauagcagcaccagucgccggacaacaaaaugucauagauccauggauuagauccaauuucguacaagcacccggaggagaauuuacuguaucaccucgaaaugcaccuggugaaauauuauggucagcaccauugggaccagaccuaaaucccuauuuaagccaucuugcuagaauguauaacggauaugcaggaggauuugaaguacaagucauauuagccggcaaugcauuuacagcaggaaaaauaauauucgcagcaguacccccuaauuucccaacagagggauuaucaccaucucaaguaacaauguuuccucacauaauagucgauguaagacaacuagaaccaguauuaaucccuuuaccagauguaagaaacaauuuuuaucacuacaaucaaucaaaagauucuacuauaaaauuaauagcuaugcucuauacaccacuaagagcaaauaaugcaggagaugauguuuuuacaguuucgugcagaguucuaacuagaccuucuccagauuucgacuuuauauuucuaguaccaccuacaguagaauccagaacaaaaccuuucacagucccuauacuaacaguagaagagaugacuaacuccagauuuccuauaccauuagaaaaacuauucacaggcccaucaaacgcauuugucguacaaccucaaaacggaagauguacuacagauggcguauuauuaggcaccacacaauuaucuccaguaaauauuuguacauuucgcggagacguuacacaaauugcaaguacccaaacuuauacaaugaauuuagcaucacuaaauuggaauaauuaugauccuacugaagaaauaccagcaccgcugggagcaccagacuucaugggaaaaauucaaggaguacucacacaaacaacccgacaaggcggaucaacaagaggacauaaagcaacaguaucaaccgguaguguucacuuuacaccaaaacucggauccguacgcuucgauacagacacaaauaaugauuuacaaccucaucaaucuacaagauucaccccaguagguguaauccaagacggugauacccaucaaaaugaaccacaacaaugggcacucccauguuauucaggaagagacguaaacaacguacaccuagcaccagcaguugcaccaucauuuccaggagaacaacuacuauuuuuccgaaguacaaugcccggcuguucuggauaccccaauauggacuuagacuguuuacuaccacaagaauggguacaacauuuuuaucaagaagccgccccagcacaauccgauguagcucuauuaagauucguaaauccagauacagguagaguuuuauuugaaugcaaacuacacaaauccggauauguaacaguugcucauacaggccaacauaauuuaguaaucccuccuaacggauacuucagauuugauuccuggguaaaccaauuuuacacacucgccccaaugggaaauggaacagguagacgaagaguuuaa

SEQ ID NO: 34020 - RNA, 1617 nt, Artificial Sequence
  derived and/or modified sequence opt6 from VP1__Norovirus_and/or_Norovirus-like__KR904212
augaaaauggcaucaucagacgcuaauccuucagauggaucaaccgcaaaccuuguaccagaaguuaacaaugaaguaauggcccuagaaccaguaguaggagcagcuauagcugcaccaguagcaggacaacaaaauguaauagacccauggauaagaaacaacuucguacaagcuccugguggugaauuuacaguaaguccaagaaacgcaccgggagaaauauuauggucugccccacuaggacccgauuuaaauccauauuuaucacacuuagccagaauguacaacggauaugcaggcggauucgaaguacaaguaauauuagcaggaaaugcauuuacugcagguaaaaucacauucgcagcaguaccaccuaacuuccccacugaaggucuaucuccaucucaaguaacuauguucccacacauuauaguagacguaagacaauuagaacccguuuuaauaccuuuaccugauguaagaaauaauuucuaucacuauaaucaaucaaaugauccaacaauuaaacuaauugcaauguuauauacaccacuaagagcaaacaaugccggagacgauguauuuacagucucguguagaguacucacaagaccaucacccgacuuugacuuuauauuuuuagucccaccaacaguagaaucucgaacaaaaccuuuuucaguaccaauacuaaccguagaagaaaugacaaacucuagauuuccaauuccauuagaaaaacuauucacaggaccaucuuccacauucgucguacaaccacaaaacggacgauguacaacagacggaguccuacuaggaacaacacaacucuccccaguaaacauuuguacuuucagaggagacguaacccacauaacaggaagccacaacuauacaaugaaucuagccucacaaaauugguccuccuaugauccaaccgaagaaauacccgcaccccuaggaacaccugauuuuguaggaaaaauacaaggaguauuaacccaaacaaccagaacagacggauccacacgaggucauaaagccacuguuuuuacaggaucagcugacuuuucaccaaaauuaggcagaguacaauuugccacagauacagacaacgauuuuguagccaaucaaaauacaaaauucacaccuguaggaguaauacaagacgguggaacggcccauagaaacgaaccgcaacaauggguacuuccuuccuauucaggaagaaacauacacaauguucaccuagcaccagcaguagcaccaaccuuuccaggcgaacaacuauuauuuuucagaucaaccaugccaggaugcucaggcuacccaaauauggaucuugauugccuacuaccucaagaauggguacaauauuuuuaucaagaagccgcacccgcccaaucagauguugccuuauuacgauucguaaauccagauaccggaagaguccuauucgaguguaaacuacacaaaagcggguauguuaccguagcacauacaggccaacacgauuuagucaucccacccaauggauauuucagauuugacucaugggucaaucaauuuuauacuuuagcaccaaugggaaacggaacagguagaagaagauaa

SEQ ID NO: 34021 - RNA, 1617 nt, Artificial Sequence
  derived and/or modified sequence opt6 from VP1__Norovirus_and/or_Norovirus-like__AB933678
augaaaauggccucaaaugacgccaauccauuugauggaucagcugcaaaucuuguuccagaaguaaacaacgaagucauggcccuagaaccaguuguaggagcagcuauagcagcaccaguugcaggacaacaaaacguaauagacccauggauucgaaacaauuuuguccaagccccaggaggugaauuuaccguaucuccuagaaaugcaccaggugaaauauuauggucagccccgcuaggaccagauuuaaauccguacuuaucacacuuagcaagaauguauaacgguuaugcaggagguuucgaaguacaaguaauacuagcugguaaugcuuuuacagcagguaaaauaauuuucgcagcuguaccaccuaacuuuccagcagaaggccucagccccucacaaguaacaauguucccacacauaauaguagacgucagacaacuggaaccaguacuaauaccauuaccagaugucagaaauaauuucuaucacuauaaccaaucaaaugacaguaccaucaaacuaaucgcaaugcuauacacaccacuacgcgcaaacaaugccggcgaagaugucuuuacaguauccuguagaguacuaacccgaccuucuccagauuuugauuuuauauuucuaguaccucccacaguagaaucaagaacaaaaccauuuacaguaccaauauuaaccguagaagaaaugacaaauucaagauuuccaauaccauuagaaaaauuauuuacuggaccaucuucagcauuugucguucaaccacagaacggacgauguacuacagacggaguacuucuuggaacaacucaacuaucuccaguuaauauauguacuuucagaggcgacguaacucauaucgcaggaucacgaaacuacacaaugaaucuagcaucauuaaauuggaauaauuacgauccaacagaagaaauaccagcaccucucggaacaccagacuuuguaggcaaaauccaaggcguauuaacucaaacaacaaaaggcgauggaucaacacgaggccauaaagcaacaguauauacuggaucagcaccauucacuccuaaacucggcucaguucaauucucaacagauacagaaaacgacuuugaaacccaucaaaacacuaaauuuacaccaguuggaguaauucaagauggaggaacaacacauagaaaugaaccacaacaauggguauuaccuucauacucaggaagaaauguaccaaauguacacuuagcaccagccguagccccaacauucccaggugaacaacuacuuuucuuuagaagcaccaugccagguuguucaggauacccaaacauggaucuagauugccucuuaccucaagaauggguacaacacuucuaucaagaagccgcuccagcacaaucggauguagcuuuacuaagauuuguaaacccagacacaggucguguuuuauucgaauguaaacuacauaaaaguggcuauguuacuguagcccacacuggacaacacgaucucguaauaccuccaaacggauauuuuagauuugauuccuggguaaaucaauuuuauacauuagcaccaauggguaauggcacaggacgaagaagauaa

SEQ ID NO: 34022 - RNA, 1617 nt, Artificial Sequence
  derived and/or modified sequence opt6 from VP1__Norovirus_and/or_Norovirus-like__AB933648
augaaaauggccaguaacgacgcuaauccuucagauggaucagcugcaaacuuaguacccgaaguauccaaugaagucauggcacuagaacccguuguaggagcugcaauagcugccccaguagcaggacaacaaaauguaauagacccuuggauaagaaacaauuucguacaagcaccaggaggcgaauuuacuguuucaccaagaaacgccccuggcgaaauacuauggucagcgccacuaggaccagauuuaaacccauacuuaucacacuuagcaagaauguauaacgguuacgcaggaggauuugaaguucaaguaauuuuagcaggaaaugcauuuacagcaggcaaaaucauuuucgcagcaguacccccaaacuucccaacagaagguuuaucaccaucacaagucacaauguuuccucauauaauagucgacguaagacaacuugaaccaguacuaauaccucuaccagacguaagaaacaacuucuaccauuauaaccaaucaaaugauucaacaauaaaauuaauugcaaugcuauauacuccacuaagagcaaauaaugcaggagaagauguauucacagucagcuguagaguguuaacuagaccaucaccagauuuugacuuuauauuuuuagucccaccuacagucgaaucaagaacaaaacccuuuacaguaccaaucuuaacaguugaagaaaugacaaacucaagauucccuauuccacucgaaaaacuauucacaggacccucaggagcauucguaguccaaccacaaaacggaagauguacaacagauggcguauuauuaggcacaacacaauuaucuccaguaaauauauguacauuuagaggagacguaacacauauagcaggaucucgcaauuacacaaugaaucucgccucauuaaacuggaauaacuacgauccaacugaagaaauaccugcaccacuuggaacacccgauuuuguuggaaaaauucaaggaguauuaacccaaacaaccaaaggagacggaucaacacguggucacaaggcaacuguauauacagggucagcuccauucacaccaaaauuaggaucaguacaauucucaaccgauacagaaaacgauuucgaaacccaucaaaacacaaaauuuaccccagucggcguaauacaagacgguuccacaacccacagaaaugaaccccaacaauggguacuaccaucuuauucaggaagagauguacacaacguacaccuagcaccagccguagcaccaacauucccuggagaacaauuauuauucuuuagaucaacaaugccuggcugcucaggauauccuaacauggaucuagauugcuuauuaccacaagaauggguacaacauuuuuaucaagaagcagcuccagcucaaucugauguugcauuacuaagauucguaaacccagacacaggcagagucuuauucgaauguaaauuacauaaauccgguuaugucacuguagcacauacuggccaacacgaucuaguaauaccuccaaauggauauuuuagauucgacucauggguaaaucaauuuuauacacuagccccaaugggaaacggaacuggaagaagaagauaa

SEQ ID NO: 34023 - RNA, 1617 nt, Artificial Sequence
  derived and/or modified sequence opt6 from VP1__Norovirus_and/or_Norovirus-like__LN854571
augaaaauggcaucaaaugacgcagcuccaucagauggaucuacugcaaaucucguaccugaagucaacaaugaaguaauggcacuagaaccaguuguaggcgcagcaauagcagcaccaguugccggacaacaaaacguaauagacccauggauacguaacaacuuuguacaagcccccggaggagaauuuacagucucuccuagaaaugcaccaggcgaaauacuuuggucugcaccuuuagguccagaucuaaauccauauuuaucccaccuagcaagaauguauaacggauaugcaggaggauucgaaguacaagucauauuagcaggaaaugcauucacagccggaaaaauaauauuugccgcaguucccccuaacuuuccaacagaaggacuaucccccucucaaguaacaauguuuccucacauuauaguagacguuagacaauuagaacccguacuaauaccauuacccgaugucagaaauaauuuuuaucacuauaaccaaucaaaugauccuacuauaaaacuaaucgcaaugcuuuacacgccacuaagagcaaacaaugcaggagacgauguauuuaccguaucauguagaguacuuacuagaccuucaccagacuuugacuuuauauucuuaguaccaccaacaguugaaucacgaaccaaaccuuuuucuguaccuguacuaacaguagaagaaaugacaaauucaagauuucccauaccacuagaaaaauuauucacaggcccauccucagcauucgucguacaaccacaaaacggaagauguacaacagauggagucuuauuagguacaacccaauuaucaccuguaaacauauguacauuuaggggagauguaauacauauaccaggcucaagaaauuacacaaugaaucuagcaucacaaaacuggaacucauaugacccuaccgaagaaaucccagcaccauuaggcaccccagauuucgucgguaaaauacaaggaguucuaacacaaacuacacgaaccaacggcucaacaagaggacauaaagcaacuguauauaccggaucagcagacuuuuccccaaaauuaggaagaguccaauuugccaccgacacagauaacgauuucgaaacaaaucaaaauacaaaauucacuccaguaggcguaauucaagauggaucaacaacaccucgaaaugaaccacaacaauggguuuuaccauccuacucaggcagaaauauacauaacguucaccuagcacccgcaguagccccaacuuuuccaggagaacaacuauuauucuuuagaucuacaaugccaggaugcuccggauauccgaauauggauuuagauuguuuauuaccacaagaauggguacaauauuuuuaccaagaagccgcaccagcucaaucagacguagcacuucuaagauucguaaacccagacaccggaagaguacuauucgaauguaaauuacacaaauccggcuacguaacagucgcucacacuggacaacacgaccuagucauaccaccaaauggauauuuuagauuugauuccuggguaaaucaauuuuacacucucgcaccaaugggaaauggaacaggacgacgaagauag

SEQ ID NO: 34024 - RNA, 1617 nt, Artificial Sequence
  derived and/or modified sequence opt6 from VP1__Norovirus_and/or_Norovirus-like__EU921384
augaaaauggcuagcaaugaugcaaacccuucugauggaucagcugcuaauuuaguaccagaaguaucuaacgaaguaauggcccuagaaccuguaguuggagcugcaauagcugcaccuguagcaggacaacaaaauguaauagacccauggauaagaaacaacuuuguacaagcaccagguggcgaauuuacaguaucaccaagaaaugcaccaggagaaauacuauggucagcaccacucggacccgaucuaaauccuuacuuaucucaccuagcacgaauguauaacggauacgccgguggauucgaaguacaaguaauacuagcaggaaaugcauuuacugcagguaaaauaauauucgcagcaguuccacccaauuucccuacagaagguuuauccccaagucaaguaacaauguuuccacacauaaucguagauguccgacaacuagaaccuguucucauaccccuaccagauguucguaacaacuuuuaccacuacaaccaauccaacgacucuaccauaaaacuaauugcaauguuauauacucccuuacgagcaaacaaugcuggugaagauguauucaccguuucaugcagaguucuaacucgaccuucaccugacuucgacuuuauauuccuuguaccaccuacagucgaaucuagaacuaaaccuuucacugucccuaucuuaacugucgaagaaaugacaaacaguagauucccaaucccuuuagaaaaacuauucacaggaccauccggagcauucgucguacaaccgcagaacggaagaugcacaacagacggaguuuuacuagguacaacucaacuuucaccuguaaauauauguacauuuagaggcgauguaacacauauagccggauccagaaauuauacaaugaauuuagcaucauuaaacuggaauaauuaugauccaaccgaagaaauaccagcaccucuaggaaccccagacuuuguaggaaaaauacaaggaguauuaacccaaacaacaaaaggcgauggcucaacacguggacacaaagcaacaguuuauacaggaucagcaccauuuaccccaaaacuagguucaguacaauuuucuacagacacagagaaugauuucgaaacacaucaaaauacaaaauuuacccccgucggaguaauucaagacggauccacaacacacagaaaugaaccucaacaauggguauuaccaucauauaguggaaggaauguccauaauguacauuuagcaccagcaguagcaccaacauuucccggugaacaauuauuauucuuucguucaacaaugccaggaugcucaggauauccaaauauggauuuagacuguuuacuaccacaagaauggguacagcauuucuaucaagaagcugcaccagcucaaucugacguugcauuauuacgauucguaaacccagacacaggaagaguauuauucgaaugcaaauuacauaaaucuggcuauguaacaguagcacauacaggacaacaugauuuaguuauaccaccaaacggauacuuccgauuugauagcuggguaaaucaauuuuauacauuagcaccaaugggaaauggaacaggccgaagaagauaa

SEQ ID NO: 34025 - RNA, 1617 nt, Artificial Sequence
  derived and/or modified sequence opt6 from VP1__Norovirus_and/or_Norovirus-like__LC005716
augaaaauggcaucaagugaugcaaacccuuccgauggaucugccgcaaacuuagucccugaaguaaauaacgaaguaauggcauuagaacccguagucggagcagcaaucgcagcaccaguagcaggccaacaaaacguaauagauccauggauacgcaauaacuuuguacaagcaccaggaggagaauuuaccguuucaccaagaaaugcaccuggagaaauacuauggucagccccauuaggaccagacuuaaauccuuauuuaucacacuuagcaagaauguauaauggauaugcaggaggauucgaaguacaaguaauacuugcaggaaacgcauuuacagcaggcaaaaucaucuuugcugccguuccaccaaauuuuccaacagaaggacuaucaccaucacaaguaacaauguucccccauauaauaguagauguucgacaacuagaaccaguacuaauaccauuaccagaugucagaaacaacuucuaucacuauaaucaauccaaugacucaacaauaaaauuaauugccauguuauacacaccacuacgugcuaacaaugcaggagaagacguauucaccguuucauguagaguacuaacaagaccaaguccagacuuugauuuuauauuuuuaguuccaccuacuguugaaucaagaaccaaaccuuucacaguuccaauuuuaacaguagaagaaaugacaaacaguagauuucccauaccacuagaaaaacuauuuacagguccauccagcgcauucguaguacaaccacaaaacggaagaugcacaacagauggaguauuauuagguacaacucaacuaaguccaguaaacauuugcaccuuuagaggugacgucacccauauagccggcucaggcaauuauacaaugaauuuagcuucaguaaauuggaacaauuaugacccaacugaagaaauaccagcaccacuuggaacacccgauuuuguagggaaaauacaagguauguuaacacaaaccacaaaaggugacggcucaacacgaggacauaaagcaacaguauauacaggaucugcgccuuuuacaccaaaauuaggaucaguacaauuuucaacugauaccgaaaacgauuucgaaacacaucaaaacacaaaauucacaccaguuggaguaauccaagacggaaacacaacacaucgaaaugaaccacaacaauggguucuuccuucauauucaggacguaacguaccaaacguacaucucgcaccagcaguagcaccaaccuuccccggagaacaacuuuuauucuuuagaucaacaaugccagggugcucugguuacccaaauauggaucucgacugccuauuaccacaagaauggguacaacauuuuuaucaagaagccgcuccagcacaaucagacguagcacuauuacgauucguaaauccagacacaggacgaguccuuuuugaaugcaaacuacacaaaucaggcuauguaacaguagcacacacaggacaacaugaucucguaauaccaccaaaugguuauuucagauucgauucuuggguaaaucaauucuacacauuagcacccaugggaaaugguacaggccgaagaagauaa

SEQ ID NO: 34026 - RNA, 1617 nt, Artificial Sequence
  derived and/or modified sequence opt6 from VP1__Norovirus_and/or_Norovirus-like__KP241914
augaaaauggcaucaucagaugcaaacccaucagauggaagugcagcuucguuaguacccgaaguaaauaaugaaguaauggcacuagaaccaguaguaggagcagcuauagcagcaccuguagccggccaacaaaauguaauugacccauggauacgaaauaauuuugugcaagccccaggaggagaauuuacagucagcccacguaacgcuccaggcgaaauacucuggucugcaccacucggaccugaucuuaauccauaucuaagucaccucgccagaauguacaacggauaugcuggugguuuugaaguccaaguaauauuagcaggaaacgcauucacagcaggaaaaguaauauucgcagcaguucccccaaacuuuccuaccgaagguuuauccccaagucaaguaacaauguucccucauauaguaguagacguaagacaacucgaacccguacuaauaccauuacccgauguaagaaauaauuucuaucauuauaaccaaucaaaugauccuacaauuaaacuaauagcaaugcuauacacuccacuacgagcuaauaaugcaggagacgaugucuucacuguauccuguagaguucuaacaagaccaucaccagauuuugauuucauauuuuuaguuccaccaaccguagaaucaagaacaaaaccauuuucuguaccaguauuaacaguagaagaaaugacuaacagccgauuuccaauuccacuagaaaaacuauucacaggacccucuagcgcuuuuguaguacaaccacaaaauggaagaugcacaacagauggcguauuauuaggaacuacccaacuuucuccugucaauauuugcacauuucgaggugauguaacacacauuacaggauccagaaauuacacaaugaauuuagcaucacaaaacuggaauaauuacgauccaacagaagaaaucccagcaccacuagguaccccagacuuuguaggaaaaauacaagguguauuaacccaaacaacaagaacagacggaucuacaagaggacacaaagcaacuguauauacagguucagccgacuuuucaccaaaauuaggaagaguacaauucgaaacagauacagacagagauuuugaagcaaaccaaaacacaaaauuuaccccaguaggagucauacaagauggcggaacaacucauagaaaugaaccccaacaauggguauuaccuucuuauucaggaagaaaugcuccaaauguacaucuugcaccagcaguugcaccuaccuuuccuggugaacaauuacuuuucuucagaucuacaaugccuggaugcucagguuauccaaacauggaucuagauugcuuacuaccacaagaauggguucaauacuucuaucaagaagcugcuccugcacaaucugacguagcacuacuacgauucgucaacccagauacuggacgaguauuauucgaauguaaauuacacaaaucaggauauguaacaguagcacacacaggacaacacgauuuaguaauaccaccaaacggauacuuccgcuucgauucauggguaaaccaauucuacacacuagcacccauggguaauggaacaggacgaagaagauaa

SEQ ID NO: 34027 - RNA, 1617 nt, Artificial Sequence
  derived and/or modified sequence opt6 from VP1__Norovirus_and/or_Norovirus-like__KJ433968
augaaaauggcaucaucagacgcaaaucccucagaugguagugcagccaaucuaguccccgaagucaacaacgaaguaauggcacucgaaccagucguaggagcagcaaucgcagcaccaguagcaggucaacaaaaugucauagauccauggauuagaaauaacuuuguucaagcaccaggaggagaauuuacugucagcccacgaaacgcacccggagaaauauuauggucagccccacuaggacccgaucuaaaucccuauuuaucacaucuugcccgaauguauaauggauacgcuggaggauuugaaguacaaguaauucuagcaggaaaugcauuuacugcuggaaaaguaauauucgcagcaguaccuccaaauuuucccaccgaaggacuuaguccaucacaagucacaauguuuccucauauaguagucgacgucagacaacuagagccaguucuaauuccacuaccagauguacgaaacaauuucuaucacuacaaccaaucaaaugacccaacaauaaaauuaauagcaauguuauauacaccacucagagcaaacaacgcuggcgacgacguauucacaguaagcuguagaguacuaacuagaccaucccccgauuuugauuuuauauucuuaguuccaccaaccguugaaucacguacaaaaccauucucugucccaguucuaacuguagaggaaaugacaaauucuagauucccaauaccacuagaaaaacuauuuaccggaccaaguucagcauucguaguucaaccccaaaacggaagaugcacaaccgacggaguacuaccaggaacuacucaauuaucuccaguaaauaucuguacauuuagaggagacgucacacauauaacaggaucacgaaauuauacuaugaaucuagcaucccaaaacuggaacaacuacgaucccaccgaagaaauccccgcuccuuuaggaacaccagauuucguaggaaaaauacaagguguauuaacacaaacaacccgaucagauggaucaaccagaggccacaaagcaacuguauauacagguuccgcagacuuugcaccaaaauuaggaagaguacaauuugaaacagauaccgaucgugauuucgaagcaaaucaaaauacaaaauucacaccugucggaguuauccaagauggaggaacaacacaccgaaaugaaccacaacaauggguucuaccaagcuauuccggcagaaauacaccuaacguucaccuagcaccagcaguugcaccuacauuuccaggugaacaacuauuauuuuucagaucaacaaugccaggaugcucuggauauccaaacauggauuuagauugccuauuaccacaagaauggguucaauauuucuaccaagaagcagcuccagcacaaucagauguagcacuacuaagauucguaaauccugauacaggcagaguacuauucgaaugcaaacuacauaaaucaggauauguaacaguugcacacacaggacaacacgaucuaguaauaccuccuaauggcuacuuuagauucgacucauggguaaaccaauuuuauacauuagccccaaugggaaauggaacaggaagaagacgauaa

SEQ ID NO: 34028 - RNA, 1617 nt, Artificial Sequence
  derived and/or modified sequence opt6 from VP1__Norovirus_and/or_Norovirus-like__KP176409
augaaaauggcauccucagaugcaucaccaagcgauggaucugcagcaaauuuaguaccagaaguaaacaaugaaguuauggcucuugaaccagucguaggcgcagcaauagcugcaccaguagcaggccaacaaaacguaauagacccauggauaagaaauaacuuuguacaagccccagguggugaauuuacaguuucuccccgaaacgccccuggagaaauacuaugguccgcaccacuaggaccagaccuaaacccauaucugucacaccuagcaagaauguauaacgguuacgcuggcggauucgaaguacaagucauauuagcuggaaacgccuuuacugcaggcaaaguuaucuucgcagcuguaccaccaaauuuuccuacagaggguuuaucaccaucacaaguaaccauguucccucauauuguagucgauguucgacaacuagaaccaguacuuauaccauuaccagauguaagaaacaacuucuaucacuacaaucaaaguaaugacccaacaauaaaacuaauagcaauguuauauacaccacucagagcaaauaaugcaggagaugauguauucacaguaucaugcaggguauuaaccagaccaucacccgacuuugauuuuauauuucuaguaccaccuaccguagaaucuagaacaaaacccuuuucugucccuguauuaacaguagaagaaaugaccaacucaagauuuccaauaccuuuagaaaaacucuucaccggaccaucaucagcuuucguaguacaaccucaaaaugguagauguacaacagacggaguacuacuugguacaacucaauuaagcccagucaauaucuguaccuuuagaggcgauguuacacauauaacugguucuagaaauuacacaaugaauuuagcuucacaaaacuggaguaauuaugacccaacugaagaaauaccagcaccacuagguaccccagauuucguaggaaaaauacaaggaguacuaacacaaaccaccagaaccgacgguucaaccagaggacacaaagcaacaguauauacaggaucagcggacuucgccccaaaauugggaagaguacaauucgaaacagauaccgauagagauuucgaagcaaaucaaaauacaaaauucaccccaguaggaguaauacaggacggaggaacaacucacagaaaugaaccacaacaauggguauuacccucauauuccggaagaaauacaccuaauguccaccuagcuccugcaguagcaccaacauuucccggcgaacaacucuuauucuuuagaucuacaaugccaggaugcucaggauauccuaauauggaucuugacugcuuacuaccacaagaauggguacaauauuucuaccaagaagccgcuccagcucaaucagacguagcuuuacuaagauuuguaaacccggauaccgguagaguauuauucgaaugcaaauuacauaaaucaggauauguaacuguagcucacacaggucaacacgauuuagucauaccaccaaauggauauuucagauucgacucaugggucaaucaauuuuauacuuuagcaccaaugggcaaugguaccggcagaagaagauaa

SEQ ID NO: 34029 - RNA, 1617 nt, Artificial Sequence
  derived and/or modified sequence opt6 from VP1__Norovirus_and/or_Norovirus-like__KM514064
augaaaauggcaucauccgacgcaaauccaucugacgguagcgcagcaaaucuaguuccugaaguuaacaaugaaguaauggcacuagaaccaguaguuggugcagcaauagccgcaccaguagcaggacaacaaaauguuauagacccuuggauaagaaauaauuucguacaagcaccagguggagaauuuacuguaaguccacguaaugcaccaggugaaauauuaugguccgcaccauuagguccugauuuaaacccauaucuaucucacuuagcaagaauguauaaugguuaugcugguggauucgaaguucaaguaauacuugcaggaaaugcauucacagcaggaaaaguaauauucgcagcuguuccaccaaauuucccaacagaaggauuaucaccaucucaaguaacuauguuuccacacauaguaguagaugucagacaacuagaacccguacuaauaccauuacccgauguaagaaauaacuuuuaucacuacaaccaaucuuccgacccaaccauaaaacuaauagcaaugcuauacacaccauuaagagcaaacaaugcuggugaugacguauuuacuguuucuugcagaguauuaacacguccauccccagauuuugacuucauauuccuaguacccccaacuguugaaagccgaacaaaaccauuuucugucccaguguuaacuguagaagaaaugacaaauucacgauuuccaaucccacuugaaaaauuauuuacaggaccaucuucagcauuuguuguccaaccacaaaauggaagaugcacgacugacgguguacucuuaggcacaacacaauuaucacccguaaauauauguacauuuagaggagacgucacacauauaacaggaagucauaacuauacaaugaaucuugcuagccaaaauuggucaaauuacgacccaacggaagaaauaccagcuccucuaggcacaccagacuucguaggaaaaauacaaggaguucuaacacaaacaacaagaacagauggaucaacaagaggacacaaagccacaguauauacaggaucugcagauuuugcacccaaauuaggaagaguacaauucgaaacagacaccaaccaugauuuugaagcaaaucaaaauacaaaauucaccccuguaggcguaauccaagauggaucaacaacacaucguaacgaaccacaacaauggguucuacccucauacuccggacguaacaccccaaauguccaucuagcaccagcaguugcacccacauucccuggugaacaacuuuuauucuucagaagcacaaugccaggcugcucaggauauccaaacauggaucuagauugucuucuaccacaagaauggguucaauauuuuuaccaagaagccgcaccagcucaaucugaugucgcauuacuacguuucguaaacccagauacaggaagaguguuauucgaauguaaacuacacaaaucuggauauguaacuguagcacacacaggucaacacgauuuaguaauaccuccaaacggauacuuuagauucgacuccuggguaaaccaauuuuauacucuagcaccaaugggaaauggcacgggaagacgaagauaa

SEQ ID NO: 34030 - RNA, 1617 nt, Artificial Sequence
  derived and/or modified sequence opt6 from VP1__Norovirus_and/or_Norovirus-like__KJ649703
augaaaauggcaucaucagacgcaaacccaucagauggaucagcagcaaaccuuguaccugaaguaaacaacgaaguaauggcacuugaaccaguuguaggagcagcuauagccgccccuguagcaggacaacaaaacguaaucgauccuuggauacgaaacaacuuuguacaagcaccaggaggcgaauuuacgguaucucccagaaaugcuccaggugaaauacuauggagugcaccauuaggaccugaccuaaauccauauuuaucacaccuugccagaauguauaacgguuacgcaggcggauucgaaguacaagucauucuagcaggaaacgcauucacagccggaaaaguaauauucgcugcuguuccaccaaacuuuccaacugaaggacuaucaccaucacaagucaccauguucccacauauaguaguugaugucagacaauuagaaccaguccuaauuccauuaccugauguacgcaauaauuucuaucacuauaaccaaucaaaugacccaacaauaaaacuaauagcuaugcuuuauacuccauuaagagcaaauaaugcaggcgaugacguauuuacagucucaugucgaguauuaacacgucccucaccagauuuugauuucauauuucucguuccaccaacaguagaaucuagaacuaaacccuucuccguaccaguauuaacaguagaagaaaugacaaacucuagauuucccauaccacuugaaaaauuauuuaccggaccuuccagugcauuuguaguccaaccacaaaacggaagauguacaacagacggagucuuacuagguacaacacaacuuucaccaguaaauauaugcacauucagaggagacguaacucacaucaccggcucucacaauuauacuaugaaucuugcaucacaaaacuggaacaacuaugaucccacagaagaaauaccagcuccacuaggaaccccugauuucguuggaaaaauacaagguguauuaacucaaacaacaagaaccgacggcuccaccagaggucacaaagcaacaguauacacuggcuccgcagauuuuagcccuaaacuaggccguauacaauucgaaacagacacaaaucacgacuucgaggcaaaucaaaauacaaaauuuacaccaguugguguaauccaagauggaggaacuacacauagaaaugaaccacaacaauggguucuacccucauauucaggaagaaacacuccaaacguucaccucgcuccugcaguugcaccuacauuuccaggugaacaauuauuauucuuuagaucaacaaugccagguuguucaggauauccaaauauggauuuagacugcuuacuaccacaagaauggguacaauauuuuuaccaagaagcagcaccagcacaaucagauguagcacuauuaagauucguaaaucccgacacagguagaguauuauucgaauguaaacuucauaaaucaggauauguaacaguagcacacacuggucaacacgaccuaguuaucccaccaaaugguuacuucagauucgacucauggguaaaucaauuuuacaccuuagcaccaaugggaaacggcaccggaagaagacgcuaa

SEQ ID NO: 34031 - RNA, 1617 nt, Artificial Sequence
  derived and/or modified sequence opt6 from VP1__Norovirus_and/or_Norovirus-like__KF177447
augaaaauggccucuucagaugccaauccauccgauggauccgcagcaaauuuaguuccugaaguuaauaaugaaguaauggcacuagaaccagucguaggcgcagcuauagcagcaccaguagcaggacaacaaaauguaauagaccccuggauaagaaauaauuuuguacaagcuccuggaggugaauuuacaguuaguccaagaaaugcuccaggugaaauacuuuggucagcaccucuuggaccagaucuaaaucccuauuuaucucaucuugcaagaauguauaacggauacgcuggcggauucgaaguacaaguaaucuuagcuggaaaugcauuuaccgccgguaaaguaauuuucgcagcuguacccccaaacuuuccuacagaaggucuaucaccaucacaaguaacaauguuuccacauauaguuguugaugucagacaacuggaaccaguuuuaauuccauuaccagauguaagaaacaauuucuaucacuauaaccaaucaaaugauccaacaauaaaauuaauagcgauguuauacacaccauuaagagcuaacaaugccggagacgauguauuuacuguaucuuguagaguacuaacaagaccaagcccagacuucgauuucaucuuccuaguacccccuacuguugaaaguagaaccaaaccauucaguguaccuguacuaacaguugaagaaaugacgaacagcagauucccaauuccacuugaaaaauuauuuaccggaccaucaucagcauucguaguucaaccacaaaauggcagauguacaacagacggagucuuacuaggaacuacccaacucuccccaguuaauaucuguacauuuagaggugauguaacccacauaacagguucucgaaauuacauaaugaaucuagcaucccaaaacuggucaaauuaugacccaacugaagaaauaccagccccacuaggaacacccgauuuugucgguaaaauacaaggaguccuaacucaaacaacaagaacugaugguucuacacgaggucacaaagcaacaguauauacaggauccgcugauuucgcaccaaaacuaggaagaguacaauuugaaacagauacagaccaugauuuugaagcuaaucaaaauacuaaauucacuccuguaggaguuauacaagauggaucaacaacacauagaaaugaaccacaacaauggguauuacccaguuauucagguagaaauaccccaaacguacaccuugcuccagccguagcaccaaccuuucccggagaacaacuauuauuuuuccgauccacaaugccaggcugcucuggauacccaaauauggaucuggacugucuacuuccacaagaauggguacaauacuucuaucaagaagcagcaccagcacaaucagacguugcacuacuaagauuuguaaauccagauacaggaagaguauuauuugaauguaaauuacacaaaucaggauacguaacaguagcucauacaggccaacaugaccuaguuauaccuccaaauggauauuuccgauucgauucauggguaaaccaauuuuauacacuggcuccaaugggaaaugguacaggcagaagaagguaa

SEQ ID NO: 34032 - RNA, 1617 nt, Artificial Sequence
  derived and/or modified sequence opt6 from VP1__Norovirus_and/or_Norovirus-like__JX439820
augaaaauggcaucaaaugacgccaacccaucagacggaucaacagcuaauuuaguuccugaaguaaauaacgaaguaauggcauuagaaccaguagucggagcagcaaucgccgcaccaguagcaggccaacaaaacguuauugacccauggauaagaaauaauuuuguacaagcaccaggaggagaauuuacagucucaccacguaacgcaccuggagaaauauuauggucugcaccacuaggacccgaucuaaauccauauuuaagccaucuugccagaauguauaacgguuaugcaggagguuuugaaguacaaguuauacuagcaggaaaugcauuuacagcaggaaaaaucauauuugcugcaguaccaccaaacuucccaacggaaggauuaucaccuucacaaguaacaauguuuccacacauaauaguagacguuagacaacuagaaccaguauuaauaccauuaccggaugucagaaacaacuucuaucacuauaaccaaucaaaugauccaacuauaaaauuaauagcaauguuguauacaccacuuagagcaaacaaugcaggagacgauguauucaccguaucaugucguguucuaacaagaccaucacccgauuuugacuucauauuucucguuccucccacaguugaaucacgaacaaaaccauuuucaguaccaguacuaacagucgaagaaaugaccaacucacgauuuccuauaccacuagaaaaacuauuuacagguccuucaucagcauucguaguacaaccucaaaauggaagauguacaacagauggaguacuacuaggaaccacacaauuaaguccaguaaauauauguacauuucgcggugacguaacacauaucucuaguucuagaaauuauaccaugaacuuagccucacaaaacuggaguuccuacgaucccacagaagaaaucccagcaccacuaggcacaccagauuuuguaggaaaaauucaaggaguauuaacucaaaccacacgaaccgacggaucaacuagaggacacaaagccacaguuuauacagguucagcagauuuuucaccaaaauuaggaagaguacaauuugauacugauacagauaacgauuucgaaacaaaucaaaauacaaaauucacuccagucggaguaauacaagauggaucaacaaccuauagaaaugaaccacaacaauggguuuuaccaucauauuccgguagaaauacccauaacguacauuuagcaccagcuguagcaccuacuuuuccaggcgaacaauuauuauuuuucagaucuacaaugccagguuguucaggcuauccaaacauggacuuagauugccuccuuccacaagaauggguacaauacuuuuaccaagaagccgcaccagcacaaagugauguagcauuacuaagauuuguuaauccugacacuggaagaguauuauucgaauguaaacuucauaaauccggauauguaacaguagcccauacaggacaacacgaucuuguaauaccaccaaacggauauuucagauuugauuccugggucaaucaauucuacacacuagccccaaugggcaacggaacaggucguagacgcuaa

SEQ ID NO: 34033 - RNA, 1617 nt, Artificial Sequence
  derived and/or modified sequence opt6 from VP1__Norovirus_and/or_Norovirus-like__HF952120
augaaaauggcaaguucagacgcuaacccaucugaugguucuacagcaaauuuaguaccagaaguaaacaaugaaguaauggcacucgaaccaguaguaggagcugcaauagcagcuccagucgcaggacaacaaaauauuauagauccuuggaucagaaauaacuuuguucaagccccaggcggagaauuuaccguauccccuagaaaugccccuggagaaauuuuauggucugcuccauuaggaccagacuuaaauccuuaccucucacaccuagccagaauguacaacgguuaugcaggaggauucgaaguacaaguaauacuagcuggaaaugcuuuuacagcaggaaaaauaauauucgcagcuguaccuccaaacuuuccaacugaaggacuauccccaagccaagucaccauguucccacacauaauaguagacguaagacaacuagaaccaguuuuagucccauuaccagauguaagaaacaauuuuuaucacuauaaccagagcaaugaccccacaauuaaacuaaucgcaauguuauacacaccccuaagagcaaacaaugcuggugacgaugucuuuacaguaucaugcagaguacucaccagaccaucuccagauuuugauuuuaucuuucuaguuccaccuacagucgaauccagaacgaaaccauuuucugucccaauauuaaccguagaagaaaugacaaacucaagauucccaauacccuuagaaaaacuauucaccggucccucaagugcauucgucguacaaccucaaaaugguagauguacuaccgacggugugcucuuaggaacaacucaauuauccccaguaaauaucuguacauuuagaggagauguuacacauauagcaggaucaagaaacuacacaaugaaccuagcuucacaaaacuggaacucuuaugacccuacagaagaaauaccugcaccauuaggaacaccagacuuuguaggaaaaauacaaggcguauuaacccaaacaacaagaacagacggaucaacaagaggucacaaagccacuguauauacaggaucagcagacuucucaccaaaacuaggaagaguucaauuugcaaccgauacagacaaugacuuugaagcuaaucaaaacacaaaauucacuccaguuggaguaauccaagacggaucuacagcucauaggaacgaaccucaacaauggguacuaccaucauauucagguagaaacauacauaauguccaccuagcaccagcaguugcuccaacauuucccggagaacaauuauuauucuuucgaaguacaaugccaggaugcucuggcuauccaaacauggauuuagauugccuuuuaccacaagaauggguccaauacuuuuaucaagaagcagcacccgcacaaucugacgucgcccuacucagauucguaaacccugacacaggaagaguuuuauuugaaugcaaauuacauaaaccuggauacgucacaguagcacacacaggccagcacgaucuagucauaccuccaaacggcuacuucagauucgauucauggguaaaucaauuuuacacacuagccccaaugggaaacggaacaggacguagacguuaa

SEQ ID NO: 34034 - RNA, 1617 nt, Artificial Sequence
  derived and/or modified sequence opt6 from VP1__Norovirus_and/or_Norovirus-like__KC517369
augaaaauggcuucaaaugacgccaauccaucagacggaagcgcugcaaauuuaguuccagaagucaacaaugaaguaauggcuuuagaaccuguaguaggugcagcaauagcagccccugucgcaggacaacaaaauguaauagauccuuggauaagaaauaacuuuguucaagcaccaggaggagaauuuacaguaucaccuagaaacgcaccuggagaaauacuuuggucagcaccuuuaggaccagaucuaaacccauaccuuagucaucuagcucgaauguauaauggauaugccggaggauuugaaguacaaguaauacuagcaggaaaugccuuuacagccggaaaaauaauauuugcaacaguaccaccaaauuucccuacugaaggacucucacccucacaaguuacaauguucccacacauaauaguagacguuagacaacucgaaccuguacuaauacccuuaccagacguacgaaacaauuucuaucacuacaaccaauccaaugacucaacaauaaaacuuauagccaugcuauacacaccuuuaagagccaauaacgcaggcgaagacguauucacaguuucaugccgaguacuaacacgaccaucaccugauuuugauuuuaucuuuuuaguaccaccuaccguagaaucacgcacaaaacccuuuacugucccaauuuuaacuguagaagaaaugacaaauucaagauucccaauaccacuagaaaaacuauuuaccggaccuaguucggcauuuguaguacaaccacaaaacggaagauguacaacagauggaguauuauuaggaacaacacaacuuagcccaguaaauauauguacauuuagaggagauguaacacacauagcaggaucacgcaauuauacaaugaaucucgcaucauuaaauuggaauaauuaugacccaacagaagaaaucccagcuccauuaggaacaccagacuuuguagguaaaauacaagguguauuaacccaaacaacaaaaggagacgguaguacuagaggacacaaagccacaguauauacuggaucagcaccauucacacccaaacuuggaucuguacaauucgaaacagauacugaaaacgauuuugaaacacaucaaaauacaaaauuuaccccaguaggagucauacaagacgguggaacaacccacagaaaugaaccacaacaauggguacuaccuucuuauuccggccguaauguaccuaacguucacuuagcaccagcagucgcaccuaccuuucccggagaacaacuauuauucuuuagaucaacaaugccaggaugcucagguuauccaaauauggauuuagauuguuuacuuccucaagaauggguacaacacuuuuaucaagaagcagcaccagcacaaagcgacguagccuuacuacgauuugugaacccagauacggguagagucuuauuugaauguaaacuacauaaaucaggauauguaacuguugcacacacaggacaacacgaucucguaauaccaccaaacggcuacuuuagauuugauucauggguaaaucaauuuuacacauuagcaccaaugggaaacggaacugguagaagacgauaa

SEQ ID NO: 34035 - RNA, 1617 nt, Artificial Sequence
  derived and/or modified sequence opt6 from VP1__Norovirus_and/or_Norovirus-like__KC409293
augaaaauggccucaaacgaugcaaauccaagugauggaucagcugccaaccuaguuccagaaguaagcaaugaaguuauggcauuagaacccguagucggagccgcaauagcagcaccaguugcaggucaacaaaaugucauagacccauggauuagaaacaacuuuguacaagccccaggaggagaauuuacaguuucuccacgaaaugcaccuggugaaaucuuauggucagcaccacuaggaccagaucuaaacccauauuuaucacauuuagcaagaauguauaacgguuaugcaggaggauuugaaguccaaguuauauuagccgggaaugcuuucacagcaggaaaaauuauuuuugcagcaguaccuccaaacuucccaacugaaggauuaucaccaagucaaguaaccauguucccacacauaauaguugacguacgccaguuagaaccaguuuuaauaccacuacccgacguaagaaacaauuucuaucacuauaaucaaacaaaugauuccacaauaaaacuuauagcaauguuauacacaccauuaagagcuaauaaugccggugaagauguauuuacaguuagcugcaggguacuaacaagaccuucuccugacuucgacuuuauauuucuugucccaccaacaguagaaaguagaacaaaaccauuuacaguaccaauucuaaccguugaagaaaugacaaacucacgauucccaauaccucuagaaaaauuauuuacuggaccaucaggcgcauucguuguacaaccacaaaacggacgcuguacaacagacgguguacuucuaggaacuacacaauuaucaccagucaauauuugcacauuuagaggcgauguaacucacauagcaggaagucgaaauuauacaaugaauuuagcaucccuuaacuggaacaauuacgaccccacagaagaaauuccagcaccucuaggaaccccagacuuuguagguaaaauacaaggaguacuaacacaaacaacaaaaggagacggaucaacuagaggccacaaagcuacaguauauacuggaucagcacccuucacaccaaaacucggaucaguacaauucaguaccgauacagaaaacgauuuugaaacacaucaaaauacaaaauuuaccccaguaggagucauucaagacgguggaacaacacauagaaacgaaccacaacaauggguuuuacccuccuauucaggaagagauguacaaaacguacaccucgcccccgcaguagcaccaacauuucccggugagcaauuacuuuucuuccgaucaaccaugccuggauguucagguuacccaaacauggacuuagauugucucuuaccccaagaauggguacaacauuuuuaucaagaagcagccccagcucaauccgacguugcauuauuaagauucguaaauccagauacuggaagaguuuuauucgaaugcaaacuacauaaaucaggauauguaacaguagcucauacaggccaacaugauuuagugauaccaccaaacggcuacuuccgauucgauucauggguaaaccaauuuuacacucuagcuccaaugggaaauggaaccggaagacgacgauaa

SEQ ID NO: 34036 - RNA, 1617 nt, Artificial Sequence
  derived and/or modified sequence opt6 from VP1__Norovirus_and/or_Norovirus-like__JX984951
augaaaauggcuucaaacgaugcuaauccaucugauggaucagcagcaaauuuaguaccugaaguaaacaaugaagucauggcuuuagaaccaguuguuggagcagcaauugcagcaccuguugcaggacaacaaaaugucauugauccauggauacgcaacaauuuuguacaagcaccaggaggagaauuuacuguuucaccacgcaaugcaccuggagaaauauuaugguccgccccguuaggaccagauuuaaacccauaucuaucucauuuagcccgaauguauaacggauacgcaggcggauucgaaguacaaguaauacuagcaggaaacgcauucacagcagguaaaauaauauucgcagcaguaccaccaaauuucccgacagaaggacucucaccuucucaaguaacaauguucccacauauuaucguugacguaagacaacuagaaccuguucuaauucccuuaccagacguaagaaauaauuuuuaucauuacaaccaaucaaaugacucaacaauaaaguuaaucgcaauguuauauacaccccuacgagccaauaacgccggagaagaugucuucacaguaucuugucgagucuuaacacguccaucaccagacuucgauuuuauauuucucguaccaccuaccguagaaagccgaacaaaacccuuuacaguuccaauauuaaccguagaagaaaugacaaauucaagauuuccaauaccacucgaaaaauuauucaccggaccaucaucagcauucguaguccaaccacaaaacggcagauguacaacagauggaguauuacuaggaacuacacaacuaucaccaguaaauauauguacauucagaggagauguuacacauauagcagguucaagaaauuauacaaugaauuuggcaucauuaaacuggaauaacuacgaucccacagaagaaauacccgcuccauuaggaacaccugacuuuguaggcaaaauacaaggaguauuaacacagacaacaaaaggugauggaucgacuagaggacauaaagcuaccguauauacagguucagcucccuuuaccccaaaauuaggauccguacgauuuucuacagauacagaaaaugauuucgaaacacaucaaaacacaaaauucaccccuguaggaguuauacaagauggaggcacaacacaucgaaaugaaccacaacaauggguccuuccaaauuacucuggaagugauguaccuaauguucacuuagccccagccguugcuccaaauuucccaggagaacaacuauuauucuuuagaucaacaaugccuggauguucugguuauccuaauauggacuuagacuguuuacuaccacaagaauggguacaacauuuuuaccaagaagcagcaccagcacaaucagauguagcuuuauuaagauuuguuaauccagauacagguagaguucuauucgaaugcaaacuacauaaaucaggcuauguaacaguagcucacaccggacaacacgacuuaguaauaccuccaaauggauacuuuagauucgacucaugggucaaccaauuuuauacccucgcaccuaugggaaauggaacuggcagaaggagauaa

SEQ ID NO: 34037 - RNA, 1617 nt, Artificial Sequence
  derived and/or modified sequence opt6 from VP1__Norovirus_and/or_Norovirus-like__JX459612
augaaaauggcuucaucagacgcacacccaucugaugguucaacagcaaaccuuguaccagaaguuaacaaugaagucauggcacuugaaccagucgucggagcugccauagcugcaccaguugccggacaacaaaacguaaucgauccauggauuagaaacaacuuuguccaagcaccaggaggugaauuuacaguaucaccaagaaaugcuccaggcgaaauauuauggucugccccauuaggcccagauuuaaacccauaucuaucucacuuagcaagaauguauaauucuuacgcaggagguuuugaaguacaaguaauauuagcaggaaacgcauuuacagcaggcaaaauaauauuugcagcagugccacccaacuucccaacagaaggucuaucacccucucaaguuacuauguucccucacauuauaguagacgucagacaacuagaacccguacuuauaccauuacccgauguacguaacaauuucuaucauuauaaccaaucaaaugaccccacaaucaaauuaaucgcuauguuauacacaccacuacgagcuaacaacgcaggagaugauguauuuacaguuagcuguagaguuuuaaccagaccuucaccagacuuugauuuuauauuccuaguaccuccaacaguagaaucacgcacaaaaccauucuccguaccaauacucacuguagaagaaaugacuaacuccagauucccaauuccccuagaaaaauuauuuacaggaccaucauccgcauucguaguacaaccccaaaauggucgcugcacaacagaugguguacuacuagguacuacacaacuaagcccagucaacauauguacauuucgaggagauguaacacauauugcuggaacucaagaauacacaaugaaccuagcaucacaaaacuggaauaauuaugauccuacagaagaaaucccagcaccauuaggcacaccagacuuuguagguaaaauccaaggaguccuaacucaaaccacaucacgagaugguucaacuagaggucauaaagcaacagucucuacagguucuguacauuucacuccaaaacuaggaagaguccaauucucuacagauacuucaaaugauuucgaaaccggacaaaacaccagauuuaccccaguaggaguuguacaagacgguucaacaacacaccaaaaugaaccacaacaauggguauuaccaaauuauucaggaagagacucacauaacguacaucuagcuccugcaguagcaccauccuucccaggagaacaacuuuuauucuuucgaucaacaaugccagguugcucaggauauccaaacaugaaucuagauugccuauuaccucaagaauggguacaacacuucuaccaagaagcagcaccagcccaaucugacguagcacuacuuagauucguuaacccagacacugguagaguacuauucgaaugcaaauuacauaaaucuggauacguaacuguagcacacacaggacaacaugacuuaguaauacccccaaauggcuauuuccgauuugacucauggguuaaucaauuuuacacuuuagcacccaugggaaauggaacaggcagaagaagauaa

SEQ ID NO: 34038 - RNA, 1617 nt, Artificial Sequence
  derived and/or modified sequence opt6 from VP1__Norovirus_and/or_Norovirus-like__JX459604
augaaaauggcauccaaugacgucacacccucagauggaucugccgcaaacuuaguucccgaagucaauaaugaaguaauggcucuagaaccaguaguaggagcagcuauagcagccccaguggcaggacaacaaaauguaauugacccauggauucgcaauaauuuuguccaagcaccaggaggugaauuuaccguauccccuagaaaugcaccaggugaaauuuuauggucagcuccacuagguccagauuuaaacccauauuuaucacacuuagcaagaauguauaacggauaugcuggaggauuugaaguccaagucauuuuagccgguaaugcuuuuacagcaggcaaaauaauauucgcagcuguucccccaaauuuuccaacagaaggacuaucuccaucucaaguuacaauguucccacacauaaucguugacguacgccaacuagaacccguccuaauuccauuacccgacguuagaaauaauuuuuaucauuauaaccaauccaaugacucaaccauuaaacuaauagcaauguuauacacacccuuaagagcaaauaacgcuggagaagauguauuuacaguaucauguagaguuuuaacucgacccucaccagauuuugacuuuauauuucucguaccaccaacagucgaaucacgaacaaaacccuucacaguaccaauacucaccguugaagaaaugacaaauucucgcuucccaaucccauuagaaaaauuauuuacaggcccaucaggugcauuuguaguacaaccccaaaauggucgauguacaacagacggaguccuacuuggcacaacacaauuaagcccaguaaauaucuguacauuuagaggagauguaacccauauugcaggcucaagaaauuauacuaugaaccucgcaucccuaaacuggaauaauuaugaucccacagaagaaauccccgcaccauuagguacaccagacuucguaggaaaaauacaagguguauuaacccaaaccacuaaaggugauggaucaacaagaggacauaaagcuacaguuuauacaggcucagcaccauucacaccuaaauuaggcucaguacaauucucaacagauaccgaaaacgauuucgaaacacaccaaaauacuaaauucacgccaguaggcguaauccaagaugguggcacaacacaccguaacgaaccucaacaauggguacuaccaucauauucagguagaaauguacauaacguacaccuagccccugcaguagcaccaacauuuccaggagaacaauuauuauuuuucagauccacaaugccaggauguucaggauauccuaacauggauuuagauuguuuacucccucaagaauggguucaacauuuuuaucaagaagcagcuccagcacaaucugacgucgcauuauuaagauuuguaaacccugacaccggaagagucuuauuugaaugcaaacuccauaaaucaggauauguaacaguagcacauacuggacaacacgaccuaguuauuccacccaacggauauuucagauuugauuccugggucaaccaauuuuauacacuugcuccuaugggcaaugguacuggaagaagaagauaa

SEQ ID NO: 34039 - RNA, 1617 nt, Artificial Sequence
  derived and/or modified sequence opt6 from VP1__Norovirus_and/or_Norovirus-like__JX155745
augaaaauggcaucaaacgacgcaaauccuucagacggaucugcagcaaaccuugucccagaaguaaacaaugaaguuauggcauuagaaccaguaguaggagccgcaauagcagcaccagucgcuggacaacaaaaugugauagaucccuggauaagaaacaacuucguacaagcaccaggaggcgaauuuacaguaucaccuagaaaugcaccuggcgaaauauuauggucagcaccucuaggcccagauuuaaaccccuaucuaucccaucuugcgcgaauguauaauggcuaugccggugguuucgaaguacaagucauccuagcaggaaaugcuuucaccgccggaaaaaucauauucgcagcaguaccaccuaacuuucccacagaaggucuauccccuucucaaguaacaauguucccacacauuauagucgacguacgccaacuagaaccuguacuaauuccuuuaccagauguaagaaacaacuucuaucacuauaaucaaucaaaugauucgaccauaaaacuaaucgccauguuauacacaccacuaagagcaaacaacgcaggagaagacguauuuacuguauccuguagaguacuaacaagaccuucaccagacuuugacuucauauuccucguuccaccaacagucgaaucaagaacuaaaccauucacugucccuauacucacaguagaagaaaugacaaauucucgauucccaauaccccuagaaaaacuauuuaccggucccucaucagcauucguaguacaaccacaaaacggucgauguaccacugacggagucuuauuaggaacaacacaacucuccccagucaacauuugcacauuuagaggagacgucacccauauagcuggaucuagaaauuauaccaugaacuuagccucacuaaacuggaacaauuaugauccaacagaagaaaucccagcaccacucggaacacccgacuuuguuggaaaaauacaaggaguacuuacccaaacaacucgaggagacggaucaacacgaggacacaaagcaacaguauauacaggaucugcaccauucacuccaaaaaugggcuccguacaauucagcacagauacagaaaacgacuuugaaacacaccaaaauacaaaauucacaccagucggcguaauacaagacggaggaacaacacacagaaaugaaccacaacaauggguacuuccaucauacucaggaagaaacguccccaacguacauuuagccccugcaguagcaccuacuuuuccaggagaacaauuauuauucuucagaucuacuaugccaggaugcucgggauauccaaauauggacuuagacugucuacuaccacaagaauggguacaacauuuuuaccaagaagcagcaccagcacaaucagauguugcccuacuacgauuuguaaacccagacacaggaagaguuuuauucgaaugcaaacuacauaaaucaggcuauguaaccguugcacauacaggccaacacgaccuaguaauuccgccaaacggauauuucagauuugauuccuggguaaaucaguuuuacacccuagcaccuauggguaacggaacaggaagacgaagauaa

SEQ ID NO: 34040 - RNA, 1617 nt, Artificial Sequence
  derived and/or modified sequence opt6 from VP1__Norovirus_and/or_Norovirus-like__HM635155
augaaaauggcaucuucagauacaaaaacaucagacggaucaaccgcaaaucucguuccagaaguuaacaaugaagucauggcucuagaaccugucguaggagcggcuauagcagcaccaguagcaggacaacaaaacguuauagacccauggauacgaaauaauuuuguacaagcaccaggaggugaauuuaccguaagcccuagaaacgcuccuggagaaauauuauggagugcaccccuaggcccugaucuaaauccauaucuaucccacuuagcacguauguauaauggauacgcaggaggauucgaaguacaagucauuuuagccggaaaugcuuuuacagccggaaaaauaauauuugcggcugucccacccaauuucccaacugaaggauuaaguccaucccaaguuacuauguucccacacauuauaguagauguaagacaacuagaaccaguauuaauacccuuaccagaugucagaaacaauuuuuaucauuauaaccaaaguaacgauccaacuaucaaauuaauugccauguuauacacaccucuacgagcaaauaaugcaggagacgauguuuuuacagucucaugcagaguucuaacaagaccaucaccugacuuugacuuuauauuucuagucccaccaaccguugaaucuagaacaaaaccauucucuguacccauauuaaccguagaagaaaugacaaacucaagauuuccuauuccauuagagaaacuauuuacagguccaagcuccgcauuugucguacaaccacaaaauggaagaugcacaauugauggaguacuccucggaacuacacaacuaucaccaguaaauauauguacauuucguggagacguaacucauauaacaggaucaagaaacuacaccaugaauuuagcaacucaaaacuggaacuccuacgauccaacagaagaaauaccagccccuuuaggcacaccagauuuuguaggaaaaauacaaggaguauuaacacaaaccacaagagcagacggaucaacacgcggacacaaagcaaccgucuauacagguucagcagacuuugcacccaaauuaggcagaguacaauuugcuacagacacagacaacgacuuugacgcaaaccaaaauacaaaauucacuccuguaggaguaauucaagacggaaacacagcacaccgcaacgaaccacaacaauggguuuuaccaucauacucuggaagaaauucccauaacguccacuuagccccagcaguugcuccaaccuucccaggagaacaacuacuauucuuuagaucaacaaugccaggaugcucuggauauccuaauauggacuuagacugcuuacucccacaagaauggguacaauauuuuuaucaggaagcagcucccgcacaaucugacguagcacucuuaagauuugucaauccagacacaggaagaguacucuucgaauguaaacuucauaaaucuggauauguaacaguagcacacacuggucaacaugacuuaguaaucccaccaaaugguuacuuuagauucgacuccugggucaaccaauucuauacacuugccccaaugggaaacggaacuggaagaagacguuaa

SEQ ID NO: 34041 - RNA, 1617 nt, Artificial Sequence
  derived and/or modified sequence opt6 from VP1__Norovirus_and/or_Norovirus-like__JN400620
augaaaauggcuucaaacgauguaaacccaucugacggaagugcagcuaaccuaguaccagaaguuaacaacgaaguaauggcacucgaaccaguugugggugcagcaauagcagcacccguagcaggacaacaaaauguaauagacccauggauacgaaauaacuuuguacaagcaccaggaggugaauuuaccguuucaccacgcaaugcaccaggcgaaauauuauggucagcaccacuaggaccagacuuaaacccuuaucucucacauuuagcacgcauguauaacggcuaugcaggaggauuugaaguccaaguaauccuagcaggcaacgcauuuacagcaggcaaaauaauauucgcugcaguacccccuaacuuucccacagaaggacuuucaccaucacaagucaccauguuuccacauauaauaguagaugucagacaacuagaaccuguacuaauacccuuaccagauguaagaaauaacuucuaucauuauaaucaaucaaaugacuccacaauaaaauuaauagcuaugcuauauacaccuuuaagagcaaauaacgccggagaagauguauuuacagucucauguagaguauuaacacgcccaagucccgauuucgacuucauauuucuuguacccccuacaguugaaucuagaacaaaaccauucacaguaccaauacuaacaguagaagaaaugacuaauucaagauuucccauaccacuagaaaaacuauuuacaggaccaucaucugcauucguaguacaaccacaaaacggaagauguacuaccgacggaguacuccuagguaccacacaauuaucaccuguaaauauauguacauucaggggagacguaacacacauagcagguucaagaaauuacacaaugaaucucgcuucauuaaauuggaacaauuacgacccuacagaagaaauaccugcaccacuaggcacaccagauuuuguaggaaaaauacaaggaguacuaacucaaacaacaaaaggagacggaucaacuagaggacacaaagccacaguauauacagguucagcaccauuuaccccaaaauuaggaucaguacaauuuucaacagauacagaaaacgacuuugaaacacaucaaaacacaaaauucacacccguaggaguaauacaagacgggggaacuacacacagaaaugaaccacaacaauggguacuaccaucauauucuggccgagauguaccaaauguccacuuagcaccagccguagcaccaacauuuccuggagaacaauuacuauucuuucgaaguacaaugccaggcugcaguggauauccaaauauggaucuagauuguuuacuaccacaagaaugggugcaacacuuuuaucaagaagcagcuccagcacaauccgauguagcacuacuucguuuuguuaacccagacacaggacgaguacuauucgaauguaaacuacacaaaucuggauaugucaccguagcacauacuggacaacacgaccucguaauaccuccaaacggauauuuccgauucgauucauggguaaaucaauuuuacacauuagcuccuaugggaaauggaaccggaagaagacgauaa

SEQ ID NO: 34042 - RNA, 1617 nt, Artificial Sequence
  derived and/or modified sequence opt6 from VP1__Norovirus_and/or_Norovirus-like__JQ613573
augaaaauggcaucaucugacgcaaacccaucagauggaucuacagcaaaccuuguacccgaaguaaacaaugaagucauggcacuagaaccaguuguuggugccgccauagcagcaccaguugcaggccaacaaaacguaauagaccccuggauaagaaacaacuucguacaagcaccuggaggugaauuuaccguuucuccuagaaaugcaccuggagaaauccuauggucagcuccgcuaggaccagaucucaaucccuaucuaucacaccucgcaagaauguauaaugguuaugcuggaggauuugaaguacaaguaauacuagcaggaaaugcauuuaccgccgguaaaauaauauuugcugcaguaccaccaaacuucccaacagaaggauuaucaccaucucaaguaacaauguuuccccacaucauaguagacguuagacaacuugaaccaguacuaauaccauuaccagauguacguaauaacuuuuaucacuauaaccaaucaaaugaccccacaauaaaacucauagcaaugcuauacacaccccuuagagcuaauaaugcaggcgaugauguauuuaccguaucaugcagaguauuaacuagaccaucacccgacuuugacuucauuuuccugguaccaccuacuguagaaucacgaacaaaaccuuuuucaguacccguccuaacaguagaagaaaugacaaacuccagauucccaauaccuuuagaaaaacuuuuuaccggaccaucaagugccuucguaguucaaccacaaaauggaagauguaccacagacggaguacucuuaggaacaacacaacucucaccaguaaauauauguaccuuucgaggagauguaacacauauaccaucaucuagaaauuauacuaugaaccuagcaagccaaaacuggaacucauaugauccaacagaagaaauuccugcuccacuuggaacccccgacuuuguagguaaaauucaaggaguauuaacccaaacaacccgcacagacggaucaacaagaggacauaaagcaacaguauauacaggaucagcagauuuuucaccaaaauuaggacgcguccaauuugcaacagacacagauaaugauuucgaaacuaaucaaaauaccaaauuuacaccaguaggaguaauccaagacgguucaacaacacauagaaaugaaccacaacaauggguacucccaucauauagcggaagaaauauccacaauguccacuuggccccagcuguagcaccaaccuuuccaggagaacaauuauuauucuuucgaucuacaaugcccggaugcuccggauauccaaacauggacuuagauugccuauuaccacaagaauggguacaauauuuuuaucaagaagcagcuccagcacaaucagacguagcuuuacucagauuuguuaacccagauaccggaagaguacuauuugaaugcaaacuccacaaaucaggauauguaacaguagcacacaccggacaacacgaccuaguaauaccacccaacggauacuuccgauucgacucuuggguaaaucaauuuuacacuuuagcaccaaugggaaauggcacaggaagacguagauaa

SEQ ID NO: 34043 - RNA, 1617 nt, Artificial Sequence
  derived and/or modified sequence opt6 from VP1__Norovirus_and/or_Norovirus-like__JQ478408
augaaaauggccucaaaugacgcuaacccaucagauggaaguaccgcuaauuuaguaccugaaguaaacaaugaagucauggcucuagaaccuguaguaggugcagcuauagcagcaccagucgcaggucaacaaaauguaauagaccccuggauuagaaauaauuuuguacaagcacccggaggagaguucacuguaucaccucgaaaugcaccaggcgaaauauuauggucagcaccacuaggucccgauuuaaauccauauuuaucacacuuggcacgaauguacaacggcuaugcaggaggauucgaaguucaaguaauauuagcaggaaacgcauuuacagcaggaaaaauuauauucgcagcaguuccucccaacuuuccaacagaaggauuaucaccaucucaaguuacuauguuuccucacaucauaguagacgucagacaauuagaaccaguucuaauaccauuaccagaugucagaaacaauuuuuaucacuacaaucaaucaaaugauccuacuauaaaacuaaucgcaauguuauauacaccccuucgagcuaacaacgccggugaagauguauuuaccguauccugccgcguacucacccgaccaucaccagauuuugauuucaucuucuuaguaccacccacaguugaaucacguacaaaacccuuuacaguaccuauacuuaccgucgaagaaaugacaaacucaagauucccaauaccauuagaaaaacuauuuacaggaccaucaggagcauucguaguacaaccacaaaacggaagauguaccacagacggugucuuacuaggaacaacacaacuuagccccguaaauauauguacuuuccgaggagacguaacacauauagcaggaacucacaauuacacaaugaaccuagccucacaaaauuggaacaacuaugauccaaccgaagaaauaccagccccuuuaggaacaccagauuuuguuggaagaauacaaggaauguuaacacaaacuacacgaggagauggaucuacgcgaggacacaaagcaacaguaucaacaggcgacguccacuuuacaccaaaauuaggaucaauacaauucaauacagauacaaauaaugauuucgaaaccggacaaaauacaaaauuuacaccagucggaguaguacaagaugguaacggugcacaucaaaacgaaccacaacaauggguauuaccaucauacucaggaagaacaggacauaauguacacuuagcgccagcuguagcaccaacauucccaggagaacaacuacuauucuuucgcucaacuaugccaggaugcucaggauacccaaacaugaaucuugauugccuccuaccacaagaguggguucaacacuucuaucaagaagcagcaccagcacaaucagaugucgcauuacugagauuuguaaacccagacacaggacgaguauuauuugaaugcaaacuacauaaaucaggauauguaacaguagcccacacaggucaacacgaucucguaauaccaccaaauggauauuuccgauucgauaguuggguaaaucaauuuuauacacuagcacccaugggcaauggaacuggaagacgaagauaa

SEQ ID NO: 34044 - RNA, 1617 nt, Artificial Sequence
  derived and/or modified sequence opt6 from VP1__Norovirus_and/or_Norovirus-like__EF684915
augaaaauggcaagcaaugaugcaaacccaucagacggcucagccgcaaauuuagucccagaaguaaacaaugaaguaauggcacuagaacccgucguaggagcagccauagcagcaccugucgcaggacaacaaaauguaauagacccauggauaagaaauaacuuuguccaagcaccuggaggagaauuuacaguaucacccagaaaugcuccuggagagauauuauggucugcaccccuaggaccagaucuaaacccauauuuaucacacuuagcacgaauguauaacggauacgcaggaggauucgaaguacaaguaauauuagccggcaacgcuuuuacugcuggaaaaaucauauucgcugcaguaccaccuaacuuuccuacagaaggauuaucuccaucacaaguuacaauguucccacauauaauagucgauguucgacaauuagaaccaguauuaauaccccuucccgauguaagaaacaauuucuaucacuacaaucaaucaaaugauuccacaaucaaauuaauugcaauguuauacaccccauuacgagcaaauaaugcaggagaagauguauuuacagucuccuguagaguucuaacaagaccauccccagauuuugacuuuauuuuucuaguaccaccaacaguagaaucacgaacaaaaccauucacaguaccuauacuaacaguagaagaaaugacuaacucaagauuuccaauaccauuagaaaaauuauuuacaggaccuucaggcgcauucguagugcaaccccaaaauggucgauguacuacugacggaguauugcuaggcaccacacaacuaaguccaguaaacauauguacuuuuagaggcgacgucacacauaucgcuggaucaagaaacuauaccaugaaucuagcaagucuaaaauggaauaaauaugauccaacagaagaaauaccagcaccacucggcaccccugauuuugugggaaaaauacaaggaguauuaacccaaacaacaaaaggcgacgguucaacucgaggacacaaagcaacuauauauacagguucagcaccauuuacuccuaaauuaggaucaguacaauuuucaacagauacugaaaacgauuucgaaacccaucaaaauacaaaguucacaccaguuggaguaacacaagacggcagcacuacacacaggaaugaaccacaacaauggguacuuccaucauacucaggucgaaauguacauaacguucaccuagcaccagcaguagcaccaacauuuccaggugaacaacuacuauucuuccgaucaacaaugccagguuguucaggcuaucccaauauggaccuugauuguuuauuaccacaagaauggguucaacacuuuuaccaagaagcagccccugcacaaucagauguagcacuauuaagauucguaaacccugacacagguagaguauuauucgaauguaaacuacauaaaucaggauacguaacagucgcacauacaggacaacaugauuuaguuaucccaccaaauggauauuuucgauucgauucauggguaaaucaauucuauacauuagcaccaaugggaaacggaacuggaagaagacguuaa

SEQ ID NO: 34045 - RNA, 1617 nt, Artificial Sequence
  derived and/or modified sequence opt6 from VP1__Norovirus_and/or_Norovirus-like__HQ456331
augaaaauggcuucaaaugaugcaaauccaucagauggcagcgcagcuaaucucguacccgaaguaaacaaugaagucauggcacuagaaccaguaguaggugccgcaauagcagcaccagucgcaggucaacaaaacguaauagauccauggauaagaaauaacuuuguacaagcaccaggaggagaauuuacaguauccccuagaaaugcaccaggagaaauauuaugguccgcaccuuuaggaccagaccuaaauccuuauuuaucacauuuagccagaauguacaacggauacgcuggaggauucgagguacaaguaauauuggcaggaaaugccuucacagcagguaaaauaauauucgcagcagucccaccaaacuuuccaacugagggauuauccccaucacaaguuacaauguucccacauauuauaguagauguaagacaacuagaaccaguucuaauaccauuaccagacguuagaaauaacuucuaucauuacaaccaaaguaaugacucuaccauuaaauuaauagcaaugcuauauacaccauuaagagcuaacaaugcaggcgaagauguauuuacaguuucauguaggguuuuaacaagacccuccccagacuuugauuuuauauuuuuaguaccaccaacaguagaaaguagaacuaaaccuuucacaguaccaaucuuaacaguagaagaaaugacaaacucaagauuccccauaccauuagaaaaauuauucacuggacccucaggagcauucgucguacaaccacaaaauggaagaugcacaaccgauggaguacuccuaggaacaacucagcuaucaccagucaauauauguacuuuuagaggugacguaacacauaucgcaggaucaagaaauuauacaaugaaccuagcaucccucaacuggaacaacuaugauccuacagaagaaacgccagcuccccuaggcacaccagacuuuguaggaaaaauccaaggcguucuaacccaaacaacaaaaggcgauggcucaacaagaggacauaaagccacaguuuauaccggauccgcaccauuuaccccaaaauuaggauccguccaauuuucaacugauacagaaaaugauuuugaaacacaucaaaacacuaaauuuacaccaguaggcguaauucaagauggaucaacuacacauagaaaugaaccacaacaauggguauuaccaucuuauucaggacgaaacguccauaacguucaccuagcuccagcuguagccccuacuuuuccaggcgaacaauuacuauucuuuagauccaccaugccugguuguucaggauauccuaacauggaucuagauuguuuacucccacaagaauggguacaacauuuuuaucaagaagccgcaccagcucaaucagacguagcauuacucagauuuguaaaucccgauacgggacguguauuauucgaaugcaaacuacauaaaucagguuauguaacaguagcucauacaggacaacacgauuuaguaaucccaccaaacggauacuucagauuugauucauggguuaaccaauuuuauacacuugcaccaaugggcaauggaacuggcagacguagauaa

SEQ ID NO: 34046 - RNA, 1617 nt, Artificial Sequence
  derived and/or modified sequence opt6 from VP1__Norovirus_and/or_Norovirus-like__HQ456322
augaaaaucgcaucauccgacgcaaacccuucagaugguucuaccgcuaaccuaguccccgaaguaaacaaugaaguaauggcccuugagccaguaguaggagcagcaauagccgccccugucgcaggccaacaaaauguaauagacccauggauccgaaacaacuucguacaagcaccagguggagaauuuaccguaucaccgagaaaugcaccaggagaaauauuauggucagcaccacuuggaccagaucuuaaccccuaucucucacaccuagcaagaauguacaauucuuacgcaggcggauucgaaguacaaguaauacuagcagguaaugcuuucacagcaggaaaaauaauauuugcugccguaccaccaaauuuuccaacagaaggccuaucaccaucacaaguaacuauguucccccacauaauaguagacguccgucaacucgaaccuguauuaauaccauuaccagauguaagaaauaauuuuuaccacuauaaccaauccaaugacccaacuauaaaacuaauagcaaugcucuauaccccuuuaagagcuaauaacgcaggagacgauguauuuacaguuucaugcagaguucuuacaagacccaguccagauuucgacuuuauauuucuaguaccaccuaccguagaaucacgcacaaaaccauucucagucccuauacuaaccguagaagaaaugacaaacagccguuucccaaucccauuagaaaaauuauuuacaggaccaucaagugccuuuguuguacaaccucaaaacggucgauguaccacagauggagucuuacuagguaccacucaauuaucuccaguuaauauaugcacauucagaggcgacguuacacacauagcaaguacucaagaauacacaaugaauuuagcaucacaaaacuggaauaauuacgauccaacagaagaaauaccagcaccacuugguacaccagauuuuguaggaaaaauucaaggaguccuaacacaaaccacacgaagagaugguagcaccagaggacacaaagcaacaguaucaaccggaagcguacauuuuacaccaaaauuaggaagaauacaauucucuaccgauaccucaaacgauuuugaaacaggacaaaacacaagauucacaccaguaggaguaguacaagauggauccacuacacaucaaaaugaaccacaacaauggguacuaccaaacuauuccggaagagacucucauaauguacaccuagccccugcaguagcaccuucauuucccggcgaacaacuauuauucuuuagauccacaaugcccggaugcuccgguuaucccaauaugaacuuagauugcuuauuaccacaagaauggguacaacauuucuaccaagaagcagcaccagcacaaucugacgucgcacuacucagauuugucaaucccgacaccggacgaguacuuuucgaaugcaaacuacacaaaucaggauaugucacaguagcacauacaggccaacaugaccucguaauaccuccaaauggauauuuuagauucgauuccuggguaaaccaauuuuauacacucgcaccaaugggaaacggaacuggacgacguagauaa

SEQ ID NO: 34047 - RNA, 1617 nt, Artificial Sequence
  derived and/or modified sequence opt6 from VP1__Norovirus_and/or_Norovirus-like__HM802551
augaaaauggcaucaaaugacgccucuccauccgauggauccaccgcaaauuuagucccagaaguuaacaaugaaguaauggcacuagaaccaguaguaggagccgcaauagcagccccaguagcuggacaacaaaauguaaucgacccuuggauacgcaauaauuuuguacaagcccccggaggcgaauuuacaguaucacccagaaaugcaccaggagaaauacuuugguccgcaccucucggaccagacuuaaauccauaccuaucacacuuagccagaauguacaauggauacgcaggcggauucgaaguacaaguaauauuagcaggcaaugcauucacagcaggaaaaauaauauuugcagcaguaccucccaacuuccccacagaaggacuaaguccaucacaaguuacaauguucccacauauaauaguagauguacgccaauuagaaccaguacucauaccacuaccugauguaagaaauaacuucuaucacuauaaccaaucaaaugacucaacuauaaaacuuauagcuauguuguauacuccauuaagagcuaacaaugccggagaugacguauucacaguauccugucgaguauuaacuagaccuucaccagacuuugauuuuauauuucuaguaccaccuacaguugaaucacgaaccaaaccauucacuguaccaauacuaacaguugaagaaaugacaaacucuagauuuccaauaccccuagaaaaacuauucacagguccauccucugccuuugucguacaaccucaaaauggaagaugcaccacagacgguguuuuacuaggaaccacacaacuuuccccaguaaauaucugcacauucagaggagacguaacacauauaucagguucuagaacauacagaaugaaccucgcuucacaaaacuggaacaauuacgaccccacagaagaaauaccagccccucuaggaacaccugacuuuguuggaaaaauacaaggcauguuaacacaaacuaccaaaggagauggaucaacaagaggccacaaagcaacugucucaacugguaguguagacuucacaccuaaacuuggaucaguucaauuugcaacagauacagauaaugauuuugaaacaggccaaaauacuagauucacacccguaggagucauacaagacgguuccuccacacaccgaaaugaaccacaacaauggguauuaccagauuauagcggaagaacaguucauaauguacaccuagcaccagcaguagcccccacauucccaggcgaacaacuauuauucuuucgaucaacaaugccaggauguucuggauauccuaauauggaccuagacugcuuacucccacaagaauggguacaacauuucuaucaagaagcagcaccuucacaaagugacguagcacuccuaagauuuguaaauccagauacaggcagaguacuauuugaauguaaacuacauaaagcagguuauguaacaguugcacacaccggacaacaugauuuaguuauuccacccaauggauauuucagauuugauuccuggguaaaucaauuuuauacucuagcaccaaugggaaauggcgcuggcagacgaagauaa

SEQ ID NO: 34048 - RNA, 1617 nt, Artificial Sequence
  derived and/or modified sequence opt6 from VP1__Norovirus_and/or_Norovirus-like__HM802546
augaaaauggcaucgaaugaugcaagcccaucagauggaucaacugcaaacuuaguaccugaagucaauaacgaagugauggcacuagaaccaguaguaggagcagcaauagcagccccugucgcaggccaacaaaauguaauagauccauggauaagaaauaauuuuguacaagcaccaggaggagaauuuacaguuucaccaagaaacgcaccuggagaaauacuauggagugcaccucuaggcccagauuuaaacccauacuuaucccacuuagcuagaauguauaacggguacgcuggaggcuucgaaguucaaguaauacuagcaggaaacgcuuuuacagcaggaaaaaucauauucgcagcaguuccaccaaacuucccuacagaaggccuaucccccucacaagucacaauguuuccacacauuauaguugacguucgacaacuagaaccaguauuaauaccucuuccagaugucagaaauaauuuuuaucacuacaaccaaucaaacgauuccacaauuaaauuaauagcaaugcuuuacacaccauuacgagcaaauaacgcuggugacgacguauuuaccguaucauguagaguacuaacacgcccuucaccagauuuugacuuuauauuuuuaguaccaccaacaguagaaucuagaacaaaaccauucacuguaccaauuuuaacaguagaagaaaugacaaacucccgauuuccaauaccacuagaaaaauuauuuacaggaccaucaucugcauucguaguacaaccccaaaacggaagaugcaccacagacggaguauuauuagguacaacacaauuaucaccgguaaauauauguacauuuagaggugacgucacccauauaucuggaacacgcacauaucguaugaaucuagcaucccaaaacuggaacaacuacgaccccacagaagaaauaccagcaccauuaggaacaccagacuuuguagguaaaauccaaggaauguuaacacaaacaacuaaaggcgacggauccacccgaggacacaaagccacagucucuaccggaucaguagacuucacaccaaaauuaggcucaguacaauucgcuacagauaccgauaacgauuuugaaacaggucaaaauacacgauucacaccaguaggaguaauacaagacggaucgucagcacacagaaacgaaccacaacaauggguacuaccagauuauucagguagaacaguccauaacguacaccuagccccagcuguagcaccaacauuuccaggagaacaacuauuauuuuuccgaucaacaaugccaggauguucaggauauccaaauauggaucuagauugccuucuuccacaagaauggguacaacacuuuuaccaagaagcagcaccaucacaaagugauguagcacuauuacgcuuuguaaauccugacaccggacguguacuuuucgaauguaaauuacauaaagcaggcuauguuaccguagcacauacuggacaacacgaccuaguaauaccaccaaacggguacuuccguuucgauucuuggguaaaccaauucuauacuuuagcacccaugggaaauggagcuggaagaagacgauaa

SEQ ID NO: 34049 - RNA, 1617 nt, Artificial Sequence
  derived and/or modified sequence opt6 from VP1__Norovirus_and/or_Norovirus-like__GQ856453
augaaaauggcaucaaaugaugcaaacccaucagaugguucugcagcaaaucuuguacccgaaguaaacaaugaaguuauggcacuagaaccaguuguaggagcagcaauugcagccccaguagcaggacaacaaaauguaauugacccauggauaagaaacaauuuuguccaagcaccaggcggcgaauuuacugucucaccaagaaaugcaccuggagaaauuuuauggucagccccguuaggcccagacuuaaauccauaucuaucacaccuagcacgaauguauaaugguuacgccggaggauucgaaguccaagcaauacuagcuggaaaugcuuuuacagcaggaaaaauaauauuugcagcaguaccaccaaacuucccaacagaagguuuaucuccaucacaaguaacaauguucccacauauuaucguagauguaagacaacuagaaccaguacuaaucccauuaccugauguaagaaacaacuucuaucacuauaaccaauccaacgauuccacuauuaaacuaauagcaaugcuauauacuccauuacgagcaaauaaugcuggugaagauguauuuacagucucauguagaguacuaacaagaccaucaccagauuuugacuucauauuucuaguuccaccuacaguugaaucacgaacuaaaccuuuuacaguaccaauacuaaccguagaagaaaugacaaacucuagauucccaauaccauuagaaaaauuauuuaccggaccaagcuccgcauucguaguacaaccacaaaacgguagauguacaacagacgguguuuuacuagguacaacacaacuuaguccaguaaacauuugcaccuuuagaggagacgucacccauauagcaggcucucgaaauuacacuaugaaucucgcaucccuuaacuggaacaauuaugauccaacagaagaaauaccagcaccccuaggaacaccagacuucguaggaaaaauacaaggaguacuuacacaaacaaccaaaggagacggaucaacacgaggacauaaagcuacaguauauacaggaagcgcaccauuuacaccaaaauuaggauccuuacaauucucaaccgauaccgaaaacgauuucgaaacucaucaaaauacaaaauucacaccaguugguguuauacaagaugguggaacaacccauagaaacgaaccucaacaauggguacuaccuaguuacucaggacgaaauguaccaaauguccacuuagcaccagcugucgccccuaccuuucccggugaacaacuacuauuuuuccgaucaaccaugcccgguuguaguggauacccaaauauggacuuagauugccuucucccacaagaauggguucaacauuuuuaccaagaagcagcuccagcacaaucagacguagcacucuuacguuucguaaauccagacacaggccgaguauuauucgaauguaaacuacauaaauccgguuauguaacaguagcacacaccggacaacaugacuuaguaauaccaccaaacggauauuucagauuugauucuuggguaaaucaauuuuacacucuagccccaaugggaaauggaaccggacgaagaagauaa

SEQ ID NO: 34050 - RNA, 1617 nt, Artificial Sequence
  derived and/or modified sequence opt6 from VP1__Norovirus_and/or_Norovirus-like__GQ856445
augaaaauggcuaguaaugaugcuaacccauccgacggaucagcagcaaaucuuguaccagaaguaaauaaugaaguaauggcucuagaaccgguagucggagcagcaauugcagcaccaguagcaggacaacaaaauguuauagacccauggauacguaacaauuucguacaagcaccaggaggagaauuuacuguaucacccagaaaugccccaggcgaaauucucuggagugcuccacuuggaccugaccuaaauccauauuuaucccauuuagcucgcauguauaacggauaugcaggcggauuugaaguacaaguaauacuagcaggcaaugcauucacagcagguaaaauaauauucgcagcaguaccaccuaauuuuccaaccgaaggccucucaccaucucaaguaacaauguuuccucauauuauaguagauguuagacaacuagaaccuguauuaauaccuuuaccugauguaagaaacaauuucuaucacuauaaccaaagcaaugacucaacaauaaaacuaauagcaauguuauacacacccuuacgugcaaauaaugcaggagaagacguuuuuacaguaucaugccgcguccuuacuagaccuucuccagauuucgauuuuauuuuucuagucccgccaacuguagaaucaagaaccaaaccauuuaccguuccaauauuaacaguagaagaaaugacuaauucaagauuuccaauuccauuagaaaaauuauuuacaggaccuucuucagcuuucguuguacaaccacaaucaggcagauguacaacagacggaguacuauuaggaacaacacaacuuucuccagucaacauauguacauuuagaggagacguuacacacaucgcaggcaguagaaacuauacaaugaauuuagcaucauuaaauuggaauaauuaugauccaacugaagaaauaccugcaccauuaggaacaccagacuuugucggaaaaauccaaggcguacuaacacaaacaacaaaaggagacggauccacuagaggacacaaagccacaguauacaccggaucugcacccuucaccccaaaauuaggaucaguccaauuuucaacugacacagaaaacgacuuugaaacccaucaaaauaccaaauucacaccaguaggugucauacaagauggaggcacaacacauagaaaugaaccccaacaauggguacuaccaucauauucaggaagaaacgucccaaauguucaccuagcacccgcagucgcaccaacguuucccggugaacaauuacuuuucuuuagaucaaccaugccagguugcucaggauauccuaauguagauuuagauugccucuuaccacaagaauggguccaacacuuuuaucaagaagcagcuccugcacaaucagauguagcacuacuaagauucguaaacccugacacaggaagaguccucuucgaaugcaaacuccauaaauccggauauguaacaguugcccauacagggcaacaugaucuaguaaucccaccaaaugguuacuuucgauucgauucauggguaaaucaauuuuauacuuuagcaccaauggguaaugguacaggaagacguagauaa

SEQ ID NO: 34051 - RNA, 1617 nt, Artificial Sequence
  derived and/or modified sequence opt6 from VP1__Norovirus_and/or_Norovirus-like__AB541358
augaaaauggcauccaaugaugcaaacccaagcgauggaucggcagcuaaccuuguaccagaaguaaacaaugaagucauggcacuagaaccagucguaggugcagcaauagcugcacccguagcaggacaacaaaauguuauugauccauggaucagaaacaauuucguucaagcaccaggcggagaauuuacaguaucuccaagaaacgcaccaggagaaauuuuauggucugcaccuuuaggaccagaucuaaaucccuacuuaagucaucucgcuagaauguacaacgguuaugccggaggauucgaaguacaaguaauacuagcaggaaaugcauucacugcuggaaaaauaauauucgcagcagucccaccaaacuuucccaccgaaggauuaucaccaucucaaguaacaauguuuccacacauuauaguagauguacgacaauuagaaccaguuuuaauaccacuacccgauguaagaaacaauuuuuaccacuacaaccaaucaaaugauucaacgaucaaauuaaucgcuauguuauauacucccuuaagagcuaacaaugcaggagaagauguauuuaccguaaguugccguguacuaacaagaccuucaccugauuucgacuucauauuucuuguacccccaacaguagaaucuagaacuaaaccauucacaguucuaauauugacaguagaagaaaugacuaauucaagauuucccauaccacucgaaaaacuauuuacaggaccauccucagcuuuuguaguacaaccacaaaacggaagauguaccacagauggaguacuacuaggaacuacacaacucagcccaguaaauauauguacauuccgaggugacgucacacauauagcaggcucacguaacuauacuaugaaucuagcuucacucaacuggaauaauuaugauccaacugaagaaauaccagcaccacuaggaacaccagacuuuguaggaaaaauccaaggaguacuaacccaaacaacaaaaggagauggaucuacaagaggucacaaagcaacaguauauaccggaucagcaccauucacaccuaaacuagguucaguacaauucuccaccgauacagaaaacgauuuugaaauucaucaaaauacaaaauucaccccaguaggaguuauacaagacggaucaaccacacauagaaaugaaccacaacaauggguucuaccauccuauucaggacgaaauguacauaacguacacuuagcacccgcaguagcaccaacuuuuccaggagaacaauuacuauucuuccgaucaaccaugccaggaugcuccggauauccaaauauggauuuagauugucuauuaccacaagaauggguacaacauuuuuaucaagaagcagccccagcacaaucagauguugcccuucucagauucguaaacccugauacaggccgagucuuauucgaauguaaauuacacaaaucaggauauguaacuguagcauacacaggccaacacgaucuuguaauaccuccaaaugguuacuucagauucgacucauggguuaaucaauuuuacacauuagcuccaaugggaaaugguacaggacgaagaagauaa

SEQ ID NO: 34052 - RNA, 1617 nt, Artificial Sequence
  derived and/or modified sequence opt6 from VP1__Norovirus_and/or_Norovirus-like__AB541349
augaaaauggcuucaaaugacgcaaaccccuccgauggaucugcagcaaaccuaguucccgaaguuaauaacgaaguaauggcauuagaaccaguaguaggagcagccauagccgcaccaguagcaggacagcaaaaugucauagauccauggauucguaauaacuuuguccaagcacccggaggagaauuuacaguauccccaagaaaugcaccaggcgaaauacuauggucagccccauuaggaccagaucuaaauccauauuuaucacaccucgcaagaauguacaacggauaugcaggcggcuucgaaguacaaguaauacuugcagguaaugcauuuacagcugguaaaauuauauuugcagcaguuccuccaaacuucccaacugaaggauuaucaccaucacaaguaacaauguucccacauauaauaguagauguacgacaauuagaaccaguucuaauaccauuaccugauguaagaaauaacuuuuaucacuauaaccaaucaaacgacucaacaauuaaauuaauagcaaugcucuauacaccucucagggccaacaaugcaggcgaagaugucuuuacaguaucaugcagaguacucacaagaccauccccagauuuugauuucauauuucuaguacccccaacaguagaaucaagaaccaaaccauuuacuguaccaauauuaacaguagaagaaaugacaaacucaagauuuccaauaccacuagaaaaacuauuuaccgguccaucuggagcauucguaguccaaccccaaaacggacguugcaccacagacggaguacuacuaggaacaacucaacuaucaccaguaaacauaugcacauucagaggcgacgugacacauauagcagguucaagaaauuacacaaugaaucuugccucacuaaacuggaacaacuaugauccaacagaagaaauccccgcuccucucggcacaccagacuuuguaggaaaaauacagggaguacucacucaaacaacaaaaggagauggaucaacuagaggucacaaagcaacaguauacacaggcucaacuccauuuacaccuaaacuuggauccguucaauucucaaccgauacagaaaacgacuucgaaacacaccaaaacacaaaauucacaccagucggaguaauacaagacggaucuaccauacaucgaaaugaaccacaacaauggguacucccaucauacucugguagaaauguucaaaauguacacuuagcaccagcaguagcuccaacauucccaggagaacaacuauuauuuuuccguuccacaaugccaggaugcucaggauaccccaauauggauuuagauugcuuacuaccacaagaauggguacaacauuucuaucaagaagcagcuccggcacaaucagacguagcacuccuuagauucguaaacccagacacaggacgaguucuauucgaauguaaauuacauaaauccggcuauguaacaguagcacauacaggacaacacgauuuaguaauaccuccaaauggauauuuuagauucgacucauggguaaaucaauucuauaccuuagcaccaaugggaaauggcaccgguagaagaagauaa

SEQ ID NO: 34053 - RNA, 1617 nt, Artificial Sequence
  derived and/or modified sequence opt6 from VP1__Norovirus_and/or_Norovirus-like__AB541342
augaaaauggccucaaaugaugcuaauccaucggaugguucugcagcaaauuuaguaccugaaguaaauaaugaaguaauggcuuuagaaccaguaguuggagcagcuauagcagcuccuguagcuggacaaacaaaugucauagacccauggauaagaaacaauuuuguacaagcuccuggaggagaauuuacuguaucacccagaaaugcaccuggcgaaauccuuuggucagcaccaagcgguccugacuuaaaccccuaucuaucucaccuugccagaauguucaaugauuacgcaggaggauucgaaguucaaguaauacucgcaggaaaugcauuuacagcaggaaaaauaauauucgcagcagucccuccaaacuuuccaacagaaggcuuauccccaagccaagucacuauguucccacacauaauaguagacguaagacaacuugaaccaguucuuauuccucuucccgauguaagaaacaauuucuaucacuacaaucaaucaaacgacucaacaauaaaacucauagcaauguuauacacaccacuaagagcuaacaaugcuggugaagacgucuuuacuguauccugucgaguccuaacaagaccaucaccugacuuugauuuuauuuuucuuguuccaccaacaguugaaucccgaacuaaaccauuuaccguaccaauacuuacaguugaagaaaugacaaacucuagauucccaauaccauuagaaaaacuauuuaccggaccaagcggagcauucguaguacaaccacaaaacggcagaugcacaacagacggaguauuacuaggaacaacacaauuaucuccaguuaauauuuguacuuuuagaggcgacguaacacauauagcuggaucuagaaacuauacuaugaauuuagcaucccuaaacuggaacaauuacgauccaacugaagaaauaccugcaccauuagguacaccugauuuuguaggaaaaauacaaggcguguuaacacaaacaacaaaaggagacggaucaacaagaggucacaaggccacuguauacacaggaucagcacccuuuacaccaaaacuaggcagcguacaauuuuccacagauaccgaaaacgacuucgaagcccaucaaaacacaaaauuuacaccugucggaguuauucaagauggcucaacaacacacagaaaugaaccacaacaauggguacuaccauccuauucugguagaaauguucaaaauguucaucucgccccugccgucgcaccuacauuucccggcgaacaauuacuauucuuucgaucuacaaugccaggauguucuggauauccaaauauggaucuagacugucuucuaccacaagaauggguacaacacuucuaccaagaagcugcaccagcacaaucagacguagcacuacuaagauuugucaacccagauacuggacgaguacuauuugaauguaaacuacacaaaucuggauauguuacaguugcacauaccggacaacaugaccuaguuauacccccaaaugguuacuucagauucgacucauggguaaaucaauuuuacacauuagcacccaugggaaauggcacaggcagacgccgauaa

SEQ ID NO: 34054 - RNA, 1617 nt, Artificial Sequence
  derived and/or modified sequence opt6 from VP1__Norovirus_and/or_Norovirus-like__AB541248
augaaaauggcuagcaaugaugcaaacccaucagacggaucagcagcuaacuuaguuccugaaguuaauaaugaagucauggcacuagaaccaguaguaggagccgcaauagcugccccagucgcuggacaacaaaacguaauagacccauggauaagaaauaauuuuguccaagcaccaggaggcgaauuuacaguaucaccacguaaugccccaggcgaaauuuuauggucugcaccuuuaggcccagaucuaaauccauaucuaucacacuuagcaagaauguauaauagcuacgcaggaggauuugaaguacaaguaauacuagcaggaaacgccuuuacagcaggcaaaauaauauucgcagcaguuccaccuaauuucccaacagagggauuaucaccaagucaagucaccauguuuccucauauaauaguagacguaagacaauuagaaccagucuuaauuccauuaccugacguuagaaacaauuuuuaucauuauaaccaauccaacgauucaacaauuaaacuaaucgcuauguuauauacaccauuaagagcaaacaaugcaggcgaagauguuuucacaguuucauguagaguacuaacccguccuucaccugauuuugacuucauauuuuuaguaccaccaacaguagaaucaagaacaaaaccuuucacaguaccaauacuaacgguagaagaaaugacaaauagcagauuuccaauacccuuagaaaaauuauucacuggcccaucuagcgcauuugucguacaaccccaaaacggaagauguacaacagauggaguauuauuaggcacaacacaacuuuccccuguaaacauuuguaccuuuagaggagacguaacccauauagcaggaagcagaaauuacacaaugaauuuagcaucacuaaacuggaacaacuaugacccaacagaagaaaucccagcuccacuuggcacuccugacuuuguaggaaaaauucaaggaguacuaacacaaacuacaaaaggagacggauccacuagaggacacaaagcuacagucuauacaggaucagcaccauuuacaccuaaauuaggcucaguacaauuuucaacugauacagaaaaugacuuugaaacacaucaaaacacuaaguuuacaccaguuggcguaauucaagacgguggaacaacacaccgaaaugaaccacaacaauggguuuuaccaucuuacuccggacgagacguacauaauguacauuuagcacccgccguagccccaacauuuccaggcgaacaauuauuauucuuuagaucuaccaugccaggaugcucagguuacccuaacauggaccuagacuguuuacuaccucaagaauggguacaacauuuuuaccaagaagcagcaccagcacaaucagacguagcacuccuaagauuuguaaaccccgauaccggcagaguacuauucgaauguaaacuacauaaauccggcuacguaacaguagcacauacaggacaacaugaucuuguuauaccuccaaauggauauuuucgcuucgauucauggguaaaucaauucuauaccuuagcaccaaugggaaauggaacaggaagacgaagauaa

SEQ ID NO: 34055 - RNA, 1617 nt, Artificial Sequence
  derived and/or modified sequence opt6 from VP1__Norovirus_and/or_Norovirus-like__GQ246798
augaaaauggcaucaucagaugcaaauccauuugauggauccacugcaaaucuugucccagaaguaaauaaugaaguaauggcacuugaacccguaguaggagccgcaauagcagcaccaguugcaggccagcagaacgucauugacccuuggauaagaaauaauuuuguacaagcaccagguggagaauuuacaguuucaccaagaaacgccccaggugaaauacuauggucugcaccacuaggcccagaucuaaauccauacuuaucccacuuagcacgaauguauaacggauacgccggaggauuugaaguacaaguaauauuagcaggaaaugcuuucacagcuggaaagauaaucuucgcagcagucccacccaacuucccuacagaaggauuaucuccuucacaaguaacaauguucccacauauaauaguagacguucgacaauuagaaccaguacuaauaccacuaccggauguaagaaauaacuuuuaucauuauaaccaaucaaaugaucccacaaucaaacucauagcuauguuauacacacccuuaagagcaaauaacgcaggagaugacguauuuacaguaucuuguagaguccuaacaagaccaaguccagauuuugacuucauauuucuuguucccccaacaguagaaucacgaacaaaacccuucucagucccuauucuaacaguagaagaaaugaccaacucaagauuuccaauaccacuugaaaaacuauucacagguccaucuucagcuuuuguaguacaaccucaaaacggacgauguacaacagauggcguacuauuaggcacaacacaauuaucuccaguaaacauuugcacauuuagaggagaugucacacauauaacaggaucuagaaauuauaccaugaauuuagcaacacaaaacuggaauaguuaugaucccacugaagaaauaccagcaccacuagguacacccgacuuuguaggaaaaauacaagguguuuuaacacaaacaacuagagcagauggauccacaagaggccacaaagcaacaguauacacaggauccgcagauuuugcaccaaaacuugguagaguacaauuugcuacagauacagauaaugacuucgacgcaaaccaaaauacaaaauucacaccaguaggcguuauacaagacggaaauacugcucacagaaaugaaccacaacaauggguucuaccaucauauuccgguagaaauagccauaacguacacuuagccccugcaguugccccaaccuuuccaggagaacaauuauuauuuuucagauccaccaugccuggauguucaggauauccaaauauggaucuagauugucuacuuccucaagaauggguacaauacuucuaucaagaagcagccccagcccaaucagauguagcauuauuaagauuuguaaacccagauacaggcagaguucuauuugaaugcaaacuucauaaauccggauauguuaccguagcacacacaggacaacacgacuuaguaauaccaccaaauggauauuuuagauucgauuccuggguaaaucaauucuauacauuagcaccuaugggaaaugguacaggcagacgacgauaa

SEQ ID NO: 34056 - RNA, 1617 nt, Artificial Sequence
  derived and/or modified sequence opt6 from VP1__Norovirus_and/or_Norovirus-like__GQ246791
augaaaauggcuucaaacgacgcuaacccaucagacgguucaacagcuaacuuaguuccugaaguuaauaaugaaguaauggcccuagaacccguaguuggugccgcaauagcagcaccaguagcaggacaacaaaacgucaucgacccauggauacgaaauaauuuuguacaagcaccagguggggaauuuaccguuucuccaagaaaugccccuggagaaauacuauggucagcaccauuagguccagaucuaaauccuuaucuaucacacuuagcaagaauguauaauggcuacgcuggaggauuugaaguacaaguaauuuuagcaggaaaugcuuucacagcaggaaaaauaauauuugcugcaguuccaccgaacuuuccaacagaaggcuuaucaccuucacaaguaacaauguucccaagaauaauaguagauguaagacaacuagaaccaguacuaauacccuuaccagacguaagaaacaauuuuuaccacuacaaccaaucaaacgacccaacaauuaaauuaauagcaauguuauacacaccacuaagagccaauaaugcaggcgacgauguauuuaccguaucauguagaguauuaacuagaccaucaccagacuuugacuuuauauucuuaguaccaccaacaguugaaucacgaacaaaaccauucacaguaccaauauuaaccguagaagaaaugacaaacucgcgauucccaauaccauuagaaagauuauauacaggaccauccucagcauucgugguccaaccacaaaauggacgauguacaacagacggcguuuuacuugguacaacacaauuaucagcuguaaauauuugcacauuucgaggcgacguuacacacauagcuggaucaagaaacuauacuaugaauuuagcuucucaaaacuggaauaauuacgauccuacugaagaaauucccgcaccauuaggaaccccagacuucguagguaaaauacaaggaaugcucacucaaaccacaagaagugacggaucuacacgcggacacaaagcaacugucuuaacaggaucugcagacuuugcaccuaaacuagguagaguccaauucgcaacagauacagauaaugauuucgaaucaggucaaaauacuaaguucacacccguagguguuauucaagauggaucaacaacucaucgaaacgaaccacaacaaugggucuuaccuaacuauucaggaagaaccggacacaauguccauuuagcaccagcaguagcaccaaccuauccaggagaacaauuacucuucuuccgaucaacuaugccaggcugcucaggauauccaaauauggaucuagauugcuuaauaccacaagacuggguacaacacuucuaucaagaagcagcuccugcacaaucugauguugcauuacuuagauuuguaaacccagacacaggaagaguuuuauucgaaugcaaauuacauaaaucaggauauguuacaguagcccacacaggccaacacgauuuaguaauuccaccaaauggcuacuuucgauucgacucauggguaaaucaauuuuauacuuuagcaccaaugggaaacggaacaggaagacguagauaa

SEQ ID NO: 34057 - RNA, 1617 nt, Artificial Sequence
  derived and/or modified sequence opt6 from VP1__Norovirus_and/or_Norovirus-like__GU350225
augaaaauggcaucuaaugacgcaucaccaucggacggaucaacagcaaauuuagucccagaaguuaacaaugaaguaauggcauuagaaccaguugucggugcggcuauagcugcaccaguagcaggacaacaaaauguaauagacccuuggauaagaaauaauuucguacaagcaccaggaggugaauuuaccguaucaccacgaaaugcaccaggagaaauacuaugguccgcuccauuaggaccagauuuaaauccauacuuaucacacuuagcaagaauguauaacgguuaugccggaggauucgaaguacaaguaauacuagccggaaaugccuucacagcaggaaaaauaauauucgcugcaguaccacccaauuuccccacugaaggauuauccccaucucaaguaacaauguuuccucacauaauuguagaugucagacaacuugaaccaguauuaauacccuuaccagauguaagaaauaauuucuaucacuauaaucaaucaaaugacucuacaauaaaacuaauugcuauguuauacacaccauuaagagcuaauaacgccggugaugauguauucacuguaucauguagaguacuaacaagaccuucuccagacuucgacuuuauauuuuuaguacccccaaccguugaaucacgcacaaaaccauuuacaguaccaauauuaaccguagaagaaaugacaaauuccagauuuccaauacccuuagaaaaauuauuuacuggucccucaucugcauucgucguacaaccccaaaauggaagauguacuacagacggaguacuacuaggaacaacacaauuaucaccaguaaauauuuguacauuucguggagacguaacucacaucccaggaacaaggacauaucguaugaauuuagcaucacaaaauuggaacaauuacgauccaacggaagaaauuccugcaccacuaggaacacccgacuuuguagguaaaauacaaggaauguuaacacaaacaacuaaaggugacggaucaacacguggacauaaagcaacuguuaguacagguucaguagauuuuacaccuaaauuaggaucuguccaauucgcaacagacacagauaacgacuuugaaacaggucaaaauacacgauuuacaccagucggaguuauacaagacggcaguucaacacacagaaacgaaccacaacaauggguauuaccagacuauagcggucguacagcacauaauguacaucuagcaccagcagucgcaccaacauucccuggagaacaauuauuauucuuuagaucaacaaugcccggcugcaguggauacccaaacauggacuuagauuguuuacuaccccaagaauggguacaacacuucuaucaagaagcagcuccaucccaauccgacguagcacuccuacgauuuguaaauccagacacaggaagaguuuuauuugaaugcaaauuacauaaagcuggcuauguaacaguugcgcacacaggacaacacgaucucguaauaccaccaaauggauauuuuagauuugauucuuggguaaaccaauuuuauacuuuggcaccaaugggaaauggagcaggcagaagaagauaa

SEQ ID NO: 34058 - RNA, 1617 nt, Artificial Sequence
  derived and/or modified sequence opt6 from VP1__Norovirus_and/or_Norovirus-like__AB504319
augaaaauggcauccaaugacgcaaacccaucagauggaucagcagcaaaucuaguuccagaaguaaauaaugaaguaauggccuuagaaccagucguuggagccgccauagcagccccaguagcuggacaacaaaauguuauugacccauggauuagaaauaacuuuguacaagcuccaggaggcgaauuuacaguuucaccaagaaacgccccaggugagauacuauggucagccccauuaggacccgaccuaaacccuuauuuaucacauuuagcacgaauguauaacgguuacgcaggagguuucgaaguucaagucauauuagcuggaaacgcauuuaccgcaggaaaaauaauuuucgcagcggucccaccuaacuuuccaacugaaggucuauccccaagucaaguaacaauguuuccacacauaauaguagacguaagacaacuagaaccaguacucauuccacuacccgauguaagaaauaauuucuaucacuauaaucaaagcaacgacucaacuauuaaacuaauagcuauguuauauacuccacuaagagcaaauaacgcaggagaagacguuuuuacaguaucauguagaguauuaacacgucccucaccugacuuugacuucauauuuuuaguaccuccaacuguagaaucacgaacaaaaccauuuacaguaccaauauuaacaguagaagaaguaacaaacuccagauucccuauuccauuagaaaaacuuuucacaggaccaagcggagcauuugucguacaaccacaaaacggaagguguacaacagacggaguucuauuagguacaacccaauuaucaccaguaaauauaugcacauuuagaggagauguaacccauauagcaggcacucguaauuacacaaugaaucuagcaucauuaaauuggaauaacuacgauccaacagaagaaauaccagcaccacucggcacaccagacuuuguagguaaaauacaagguguauuaacacaaacaacuaaaggagacgguuccacucgaggccauaaagccacaguauacacaggauccgcuccauucacaccaaaacuaggaucaguacaguucagcacagauacagaaaaugauuucgaaacccaucaaaacacaaaauuuacaccaguaggaguaauacaagauggaggaacaacacacagaaaugaaccccaacaauggguauuacccucauauucuggaagaaauguccauaacguacauuuagcacccgcaguagcaccaaccuuuccaggagaacaacuauuauucuuuagaaguacaaugcccggauguagcggauaucccaauauggacuuagauugccuacuaccacaagaauggguacaacacuucuaccaagaagccgcacccgcacaaucugacgucgcuuuaaugagauuuguuaacccugacacaggaagaguccuauuugaaugcaaauuacauaaaucugguuauguaacugucgcacacacaggacaacaugacuuaguaauuccaccaaauggauauuucagauucgauagcuggguaaaccaauuuuacacauuagcaccaaugggcaacggaacaggaagacgaagauaa

SEQ ID NO: 34059 - RNA, 1617 nt, Artificial Sequence
  derived and/or modified sequence opt6 from VP1__Norovirus_and/or_Norovirus-like__AB447458
augaaaauggcaaguucagaugcaaauccaucagauggaucuacugcuaaccuaguaccagaaguaaauaaugaaguaauggccuuagaacccguaguaggagcagccauagcugcaccaguagcaggccaacaaaauguaauagacccauggauacgaaacaacuucguacaagccccaggcggagaauuuacaguuucaccacgaaaugcgccuggugaaauuuuauggucugcaccauuaggaccagauuuaaauccauaucucucacaucuagccagaauguauaacucuuacgcuggagguuucgaaguucaaguuauucuugcaggaaaugccuuuacagcaggcaaaauaauauuugcagcaguaccacccaacuuuccuacagaaggauuaucaccuucucaaguaacaauguuuccacacauaauaguugacgucagacaacuagaaccaguacuuauaccacuaccagauguaagaaacaauuucuaucauuauaaccaaucaaaugacccaaccauuaaauuaauugcaaugcuuuacacaccucuaagagcuaacaaugcaggagacgacguauuuacaguaucauguagaguucuuacaagaccaucaccagauuucgacuucauauucuuaguaccaccaacaguagaaucaagaacaaaaccuuuuucaguucccguauuaacaguagaagaaaugacaaacucucgauuuccaauaccacuugaaaaacuauuuacuggaccaucuucagcuuucguuguccaaccacaaaauggacgaugcacaacagauggaguauuacuuggaacaacacaacucucaccaguuaauauuuguacauuucguggagauguuacccacaucgcaggaacucaagaauacacaaugaaccuugcaucccaaaacuggaacaacuacgauccaacagaagaaauaccagcaccucuuggaacaccagacuuuguuggaaaaauacaaggaguauuaacccaaaccacacgccgagauggaucuacaagaggacacaaggccaccguuucuacaggaucuguccacuuuacaccaaaacuagguagaauacaauucucuaccgacacaucuaacgauuuugaaacaggacaaaacacaagauucacaccuguaggcguuguccaagauggaggaacaacacaucaaaacgaaccccaacaauggguucuaccuaauuacaguggacgcgacagucacaauguacacuuagcaccagcaguagcaccuagcuucccaggugaacaacuacuauuuuucagaucaacaaugccuggaugcucagguuacccaaauaugaaucuagauugcuuauuaccacaagaauggguccaacauuucuaucaagaagcagcaccagcacaaagugauguagcauuauuacgauuuguuaacccagauacuggaagaguacuauucgaauguaaacuccauaaaucuggauauguaacaguugcacacaccggccaacacgauuuagucauaccaccaaauggcuauuucagauucgauucauggguaaaccaauuuuauacacuagcaccuaugggaaauggcacaggacgaagacgauaa

SEQ ID NO: 34060 - RNA, 1617 nt, Artificial Sequence
  derived and/or modified sequence opt6 from VP1__Norovirus_and/or_Norovirus-like__AB385640
augaaaauggcaucaagugaugcuaauccaucagacggaucaacugcaaaucucguaccagaaguaaauaaugaaguuauggcacuagaacccguaguaggagcagcaauagcagcaccaguagcuggacaacaaaauguaauagacccuuggauuagaaacaauuucguacaagcaccuggaggugaauuuacagucagcccucgaaacgcccccggugaaaucuuauggucagcaccacuaggaccagauuuaaacccauaucuuucacaucuaucccguauguauaacucauacgccggaggauucgaaguacaaguaauauuagcaggaaacgcauucaccgcaggcaaaauaaucuucgcagcaguaccaccaaacuuuccaaucgaaggacuuucuccaagccaaguaacaauguucccacacauaauaguagacgugcgucaauuagaacccguacuaauaccauuacccgauguucgaaacaacuucuaucacuauaaucaaagcaaugacccuacaauaaaacugauagcaauguuauacacuccacuaagagcaaacaacgcaggagaugaugucuuuacaguaucauguagaguauuaacuagaccaucaccugauuuugacuuuaucuuucuaguacccccaaccguagaauccagaacaaaacccuuuucagugccaaucuuaaccguagaagaaaugacaaacucacgauuuccaacaccaguugaaaaacucuucacagguccauccagcgccuuuauaguacaaccacaaaauggaagauguacaauagauggaguacuacucggaacaacacaauuaagcccagucaacauuugcacauucagaggagauguaacacacauugccggaacucaagaauacacaaugaauuuagcaucucaaaauuggaacaauuacgaucccacugaagaaaucccagcaccacuaggaacaccagacuuuguaggaaaaauucaaggaguacuaacccaaacaacaagaagagacggaucaacacgaggacacaaagcaacaguauccacaggaucaguucacuuuacaccaaaauuaggacgaauacaauuuuccacugauacauccaacgauuucgaaacgagacaaaauacaagauucacaccaguuggagugauccaagacggcagcaccacacaccaaaaugaaccacaacaauggguuuuaccaaacuauucuggaagagauucacauaacguacaucuugccccagcaguagcaccaucauuuccaggcgaacaacuauuauucuucagaucaacaaugccaggauguucaggauacccaaauaugaauuuagacugccuacucccucaagaauggguucaacauuuuuaucaagaagcugcaccagcucaaucagacguagccuuacuaagauucgugaacccagacacaggaagaguaauguuugaauguaaguuacauaaaucuggauauauaacaguagcacacacuggccaacaugaccucguaauaccaccaaauggauacuuuagauucgaugccuggguaaaucaauucuacacucuagcuccaaugggaaacggaacuggaagaagaagauaa

SEQ ID NO: 34061 - RNA, 1617 nt, Artificial Sequence
  derived and/or modified sequence opt6 from VP1__Norovirus_and/or_Norovirus-like__AB385633
augaaaauggccucaucagacgcaaauccaucagacggauccacagcaaaucuuguaccagaagucaacaaugaagucauggcccuagaaccaguaguaggagcugcuauagccgcaccaguugccggacaacaaaaugucaucgauccuuggaucagaaauaacuucguacaagcaccaggaggagaauuuaccguauccccaagaaacgcaccaggcgaaauacuaugguccgcaccacuaggaccagaucuaaacccauaccuaucacacuuagcaagaauguacaacggauaugcaggaggauucgaaguacaaguaauucucgcaggaaaugcauuuacagcuggaaaaauaguauucgcagcaguaccaccaaacuuuccaacagaaggacuuucaccaucacaaguuacaauguucccacacauaauaguagacguacgucaacucgaaccaguucuaauaccacuaccagacguaagaaacaauuucuaccacuauaaccaaucaaaugauucaacaauaaaacuaauagcaauguuauacacacccuuacgagcaaacaaugccggagacgacgucuuuacaguauccugccgaguacuaacaagaccauccccagauuuugacuuuauauuuuuaguuccaccuacaguagaaucaagaacaaaaccauuuuccguuccgauacuuacaguugaagaaaugacaaacucuagauuuccaauuccacucgaaaaauuauuuacaggacccucaucagcuuuuauaguccaaccucaaaacggaagauguacaaccgacggaguccuccuaggaaccacacaacuaucaccaguaaauauuugcacauuccgcggcgacguaacacauauagcaggaacacaagaauauacaaugaaucuagcaucacaaaauuggaauaauuacgacccaaccgaagaaaucccagcaccauuagguacaccagauuucguaggaaaaauacaaggaguacuuacacaaacaacacguagagauggaucaacuagaggucacaaagccacaguuucaacaggaaguguacacuucacaccaaaacuaggccgaauacaauucucuacagauacaagcaaugacuucgaaacaggccaaaauacaagauuuacaccuguaggaguaguacaagauggaucaacaacacaccaaaaugaaccacaacaauggguccuaccaaauuaccuaggaagagacucacauaacguacauuuagcaccagccguagcaccauccuucccaggugaacaacuacuuuucuuuagaucaacaaugcccggaugcagcggauacccaaauaugaauuuagacugcuuauuaccucaagaauggguucaacacuuuuaucaagaagccgcaccagcccaaucagauguagcacuauuaagauuuguaaauccagacacaggaagaguccuauucgaauguaaacuacacaaaucuggauauguaacuguagcccacacaggacaacacgaucuaguaauaccaccaaauggauauuucagauuugauucauggguaaaccaauucuauacacuagcacccaugggaaauggaaccggacgaagacgcuaa

SEQ ID NO: 34062 - RNA, 1617 nt, Artificial Sequence
  derived and/or modified sequence opt6 from VP1__Norovirus_and/or_Norovirus-like__DQ658413
augaaaauggcuucuaaugacgccaacccuucagacggaucuacagccaacuuaguaccugaaguuaauaaugaaguuauggcacuagaaccaguugucggagcugcaauagcugcacccguagcuggacaacaaaauguaauugacccauggauaagaaauaauuuuguacaagcaccaggcggagaauuuacaguuucaccaagaaacgcuccaggagaaauucuuuggucagcaccccuagguccagauuuaaaccccuacuuaucccacuuagcaagaauguauaauggauacgcaggaggcuuugaaguccaaguaauacuggcaggaaacgcauucacugcaggaaaaauaauauucgcugcuguacccccaaacuuuccuacugaaggacuuucaccaucucaaguaacaauguucccacacauuauuguugacguaagacaacuagaaccaguacuaaucccauuaccagaugucagaaacaauuuuuaucacuauaaucaaucaaaugauccaacaaucaaauuaaucgccaugcuauacacuccacuuagagcaaacaaugcaggagaagaugucuuuaccguauccugcagaguauuaacucgacccucaccugacuuugacuuuauauuucuagucccuccaacuguagaaucaagaacuaaaccuuucacuguaccaauacuaacaguagaagaaaugacaaacuccagauuuccaauaccauuagaaaaauuauucacaggaccuucuggagcguucguaguacaaccacaaaaugguagauguacaaccgacggaguacuacuaggaacaacucaauuaucaccuguaaauauauguacauuccgcggugauguuacccauauagcugauacacacaauuauacuaugaacuuagccagccaaaacuggaacaacuacgacccaaccgaagaaauaccugccccacuaggaaccccagauuuuguaggaaaaauacaagguauguuaacucaaacaacacgaggagacgguucaacaagaggucauaaagcaacaguaucaacaggagacguacauuuuacaccaaaauuggguucaauacaauucaauacagacacaaauaacgauuuugaaacaggacaaaauacaaaauucacacccgucggcgucguccaagacggaaauggcacacaccaaaacgaaccacaacaauggguccucccaucauacucaggacgaacuggacacaauguucauuuagcaccagcaguagcuccuaccuuucccggugaacaauuacuuuucuuuagaucuacaaugccaggaugcucaggauauccaaauaugaaccuagauugcuuauuaccacaagaauggguccaacauuucuaucaagaagcagccccugcacaaagugacguagcuuuauuaagauuuguaaacccagauaccggccguguacuauucgaaugcaaauuacacaaaucaggauauguuacaguagcacauacaggucaacaugaucuaguaaucccaccaaacggauauuuuagauuugauuccuggguaaaucaauucuauacauuagcaccaauggguaacggaacuggaagaagacgauaa
